United States Patent 10,988,754 (NUCLEIC ACID MOLECULES) - sequence listing, part 3

SEQ ID NO: 43082 - RNA, 87 nt, Artificial Sequence
  Alpha-synuclein (103-131)
aacgaggagggcgccccccaggaggggauccuggaggacaugccgguggaccccgacaacgaggccuacgagaugcccagcgaggag

SEQ ID NO: 43083 - RNA, 15 nt, Artificial Sequence
  Carbonic anhydrase 2 (85-89)
gacggcaccuaccgc

SEQ ID NO: 43084 - RNA, 15 nt, Artificial Sequence
  Carbonic anhydrase 2 (155-159)
ggccugcagaaggug

SEQ ID NO: 43085 - RNA, 15 nt, Artificial Sequence
  Carbonic anhydrase 2 (22-26)
aucgccaagggcgag

SEQ ID NO: 43086 - RNA, 15 nt, Artificial Sequence
  Carbonic anhydrase 2 (253-257)
cgccagaucaaggcc

SEQ ID NO: 43087 - RNA, 15 nt, Artificial Sequence
  Carbonic anhydrase 2 (218-222)
agcuccgagcaggug

SEQ ID NO: 43088 - RNA, 45 nt, Artificial Sequence
  Complement factor H (1110-1124)
ggccccccgccccccaucgacaacggggacaucaccagcuucccc

SEQ ID NO: 43089 - RNA, 33 nt, Artificial Sequence
  Complement factor H (1112-1122)
cccccgcccaucgacaacggcgacaucaccagc

SEQ ID NO: 43090 - RNA, 30 nt, Artificial Sequence
  Glutathione peroxidase 1 (7-16)
gccgccgcggccgccgcccagagcguguac

SEQ ID NO: 43091 - RNA, 36 nt, Artificial Sequence
  RalBP1-associated Eps domain-containing protein 2 (13-24)
gccgccgcggccgccggcgggggcugcgggagcggc

SEQ ID NO: 43092 - RNA, 75 nt, Artificial Sequence
  Pre-mRNA-processing factor 40 homolog A (251-275)
gccgccgcggccguggucgccgccgccgcggccgccgccgcggccgccgccgccgcgaacgccaacgccagcacc

SEQ ID NO: 43093 - RNA, 33 nt, Artificial Sequence
  Cytochrome b-c1 complex subunit 9 (2-12)
gccgccgcgacccugaccagcaagcucuacucc

SEQ ID NO: 43094 - RNA, 186 nt, Artificial Sequence
  Cytochrome b-c1 complex subunit 9 (2-63)
gccgccgcgacccugaccagcaagcucuacucccugcuguuccgccggacgagcaccuucgcccucaccaucaucgugggcgucauguucuucgagcgcgccuucgaccagggggccgacgccaucuacgaccacaucaacgagggcaagcuguggaagcacaucaagcacaaguacgagaacaag

SEQ ID NO: 43095 - RNA, 27 nt, Artificial Sequence
  Semaphorin-3A (191-199)
gccgccgacuucaugggccgcgacuuc

SEQ ID NO: 43096 - RNA, 27 nt, Artificial Sequence
  60S ribosomal protein L28 (54-62)
gccgccgacggcaaggggguggucgug

SEQ ID NO: 43097 - RNA, 27 nt, Artificial Sequence
  Glia-derived nexin (209-217)
gccgccgacggcaagagcuaccaggug

SEQ ID NO: 43098 - RNA, 27 nt, Artificial Sequence
  AF4/FMR2 family member 4 (993-1001)
gccgccgacaagcgccugaccgugcuc

SEQ ID NO: 43099 - RNA, 27 nt, Artificial Sequence
  Enhancer of mRNA-decapping protein 4 (854-862)
gccgccgaccugaaccucgugcuguac

SEQ ID NO: 43100 - RNA, 42 nt, Artificial Sequence
  Core histone macro-H2A.2 (57-70)
gccgccgagauccuggagcucgcgggcaacgccgcccgcgac

SEQ ID NO: 43101 - RNA, 45 nt, Artificial Sequence
  Melanotransferrin (591-605)
gccgccgagcugcgcagcgaggacuacgagcuccugugccccaac

SEQ ID NO: 43102 - RNA, 30 nt, Artificial Sequence
  Cholinesterase (211-220)
gccgccuucggcgggaaccccaagagcgug

SEQ ID NO: 43103 - RNA, 27 nt, Artificial Sequence
  Phospholipid transfer protein (155-163)
gccgccuucggcgggaccuucaagaag

SEQ ID NO: 43104 - RNA, 27 nt, Artificial Sequence
  Bax inhibitor 1 (88-96)
gccgccggcgcguacgugcacaugguc

SEQ ID NO: 43105 - RNA, 39 nt, Artificial Sequence
  Ran-binding protein 9 (182-194)
gccgccggccccgggccggcgggcggggcccccaccccc

SEQ ID NO: 43106 - RNA, 45 nt, Artificial Sequence
  SKI family transcriptional corepressor 2 (519-533)
gccgccggcagcgcggaggccgcccccccgcccgggcagcccccc

SEQ ID NO: 43107 - RNA, 42 nt, Artificial Sequence
  Fatty acid synthase (859-872)
gccgccaucuacaacaucgacaccagcuccgagagccccgac

SEQ ID NO: 43108 - RNA, 45 nt, Artificial Sequence
  Fatty acid synthase (859-873)
gccgccaucuacaacaucgacaccagcuccgagagccccgaccac

SEQ ID NO: 43109 - RNA, 48 nt, Artificial Sequence
  Fatty acid synthase (859-874)
gccgccaucuacaacaucgacaccagcuccgagagccccgaccacuac

SEQ ID NO: 43110 - RNA, 24 nt, Artificial Sequence
  Spectrin beta chain, non-erythrocytic 4 (2141-2148)
gccgccaaggcggccccccugcuc

SEQ ID NO: 43111 - RNA, 45 nt, Artificial Sequence
  Talin-1 (859-873)
gccgccaagauccuggcggacgccaccgccaagaugguggaggcc

SEQ ID NO: 43112 - RNA, 36 nt, Artificial Sequence
  Prohibitin (2-13)
gccgccaagguguucgagagcaucggcaaguucggg

SEQ ID NO: 43113 - RNA, 42 nt, Artificial Sequence
  Prohibitin (2-15)
gccgccaagguguucgagagcaucggcaaguucgggcuggcg

SEQ ID NO: 43114 - RNA, 45 nt, Artificial Sequence
  Beta-secretase 2 (74-88)
gccgccaacuuccuggcgaugguggacaaccuccagggcgacagc

SEQ ID NO: 43115 - RNA, 27 nt, Artificial Sequence
  Rho guanine nucleotide exchange factor 2 (516-524)
gccgcccccccggagauguacgaggug

SEQ ID NO: 43116 - RNA, 27 nt, Artificial Sequence
  Collagen alpha-1(VI) chain (3-11)
gccgcccgcgcgcugcucccccugcug

SEQ ID NO: 43117 - RNA, 27 nt, Artificial Sequence
  U2 small nuclear ribonucleoprotein B'' (202-210)
gccgcccgcgacgcgcugcagggcuuc

SEQ ID NO: 43118 - RNA, 39 nt, Artificial Sequence
  Transport and Golgi organization protein 6 homolog (2-14)
gccgcccgccaggcggugggcagcggggcccaggagacc

SEQ ID NO: 43119 - RNA, 24 nt, Artificial Sequence
  Protein AATF (31-38)
gccgcccgcgugaucgaccgguuc

SEQ ID NO: 43120 - RNA, 48 nt, Artificial Sequence
  Dachshund homolog 1 (110-125)
gccgccagcaacggcuccgggggcgggggcgggggcaucagcgcgggc

SEQ ID NO: 43121 - RNA, 57 nt, Artificial Sequence
  HLA class I histocompatibility antigen, A-23 alpha chain (347-365)
gccgccagcuccgacagcgcgcagggcuccgacgugagccugaccgccugcaagguc

SEQ ID NO: 43122 - RNA, 27 nt, Artificial Sequence
  Talin-1 (2432-2440)
gccgccagcaccgcgcagcugcucgug

SEQ ID NO: 43123 - RNA, 27 nt, Artificial Sequence
  Amyloid-like protein 2 (10-18)
gccgccaccggccgccugcuccugcug

SEQ ID NO: 43124 - RNA, 27 nt, Artificial Sequence
  Protein BTG1 (17-25)
gccgccgugagcuucaucuccaaguuc

SEQ ID NO: 43125 - RNA, 27 nt, Artificial Sequence
  Basement membrane-specific heparan sulfate proteoglycan core protein (1409-1417)
gccgccuacggcgggaagcugcgcuac

SEQ ID NO: 43126 - RNA, 27 nt, Artificial Sequence
  Glycogen phosphorylase, muscle form (154-162)
gccgccuacggcuacgggauccgcuac

SEQ ID NO: 43127 - RNA, 30 nt, Artificial Sequence
  Tyrosine-tRNA ligase, cytoplasmic (339-348)
gccgccuaccccgacccgagcaagcagaag

SEQ ID NO: 43128 - RNA, 30 nt, Artificial Sequence
  SPRY domain-containing SOCS box protein 1 (218-227)
gccgacgccccccugcacagcgugggcuac

SEQ ID NO: 43129 - RNA, 27 nt, Artificial Sequence
  Ataxin-10 (381-389)
gccgacgccagccugcucaagaaggug

SEQ ID NO: 43130 - RNA, 39 nt, Artificial Sequence
  Histidine triad nucleotide-binding protein 1 (2-14)
gccgacgagaucgccaaggcgcagguggcccgccccggc

SEQ ID NO: 43131 - RNA, 27 nt, Artificial Sequence
  Eukaryotic initiation factor 4A-II (185-193)
gccgacgagaugcugagccgcggcuuc

SEQ ID NO: 43132 - RNA, 27 nt, Artificial Sequence
  Cyclin-dependent kinase 4 (83-91)
gccgacuucggccuggcccgcaucuac

SEQ ID NO: 43133 - RNA, 27 nt, Artificial Sequence
  Cyclin-dependent kinase 13 (240-248)
gccgacuucggccuggcccgccucuac

SEQ ID NO: 43134 - RNA, 21 nt, Artificial Sequence
  Coatomer subunit gamma-1 (761-767)
gccgaccacauccagaaggug

SEQ ID NO: 43135 - RNA, 21 nt, Artificial Sequence
  Eukaryotic translation initiation factor 3 subunit H (222-228)
gccgacaagcacgagcugcuc

SEQ ID NO: 43136 - RNA, 21 nt, Artificial Sequence
  Dual specificity protein phosphatase 14 (94-100)
gccgacaagauccacagcgug

SEQ ID NO: 43137 - RNA, 21 nt, Artificial Sequence
  Transformation/transcription domain-associated protein (380-386)
gccgaccuggugcaccacguc

SEQ ID NO: 43138 - RNA, 27 nt, Artificial Sequence
  Threonine-tRNA ligase, cytoplasmic (147-155)
gccgacaacaccgugaucgccaagguc

SEQ ID NO: 43139 - RNA, 51 nt, Artificial Sequence
  H(+)/Cl(-) exchange transporter 7 (526-542)
gccgaccccggcaaguacgcccugaugggggcggccgcccagcucggcggg

SEQ ID NO: 43140 - RNA, 27 nt, Artificial Sequence
  Cyclin-dependent kinase 18 (414-422)
gccgaggccgcgcugagccacuccuac

SEQ ID NO: 43141 - RNA, 27 nt, Artificial Sequence
  Actin-binding protein anillin (758-766)
gccgaggccgagcgccugcuccugauc

SEQ ID NO: 43142 - RNA, 36 nt, Artificial Sequence
  T-box transcription factor TBX2 (61-72)
gccgaggccggccugcacgugagcgcgcucgggccc

SEQ ID NO: 43143 - RNA, 30 nt, Artificial Sequence
  Synemin (1056-1065)
gccgaggcccccgcggccggcauccgcuuc

SEQ ID NO: 43144 - RNA, 30 nt, Artificial Sequence
  IgGFc-binding protein (407-416)
gccgaggccaccaccaaccugggccuccug

SEQ ID NO: 43145 - RNA, 36 nt, Artificial Sequence
  Probable methyltransferase TARBP1 (184-195)
gccgaggacgccgcggcccugguggccggccgccuc

SEQ ID NO: 43146 - RNA, 27 nt, Artificial Sequence
  Filamin-B (9-17)
gccgaggacgcccccuggaagaagauc

SEQ ID NO: 43147 - RNA, 30 nt, Artificial Sequence
  Cytochrome c oxidase subunit 6B1 (2-11)
gccgaggacauggagaccaagaucaagaac

SEQ ID NO: 43148 - RNA, 30 nt, Artificial Sequence
  Voltage-dependent L-type calcium channel subunit alpha-1C (919-928)
gccgaggaccccgugcagcacaccagcuuc

SEQ ID NO: 43149 - RNA, 30 nt, Artificial Sequence
  F-box/WD repeat-containing protein 8 (326-335)
gccgaggacagcgcccgcacccugcucuac

SEQ ID NO: 43150 - RNA, 33 nt, Artificial Sequence
  ATP-binding cassette sub-family B member 8, mitochondrial (351-361)
gccgaggagcugggccgcgggaucgcccucuuc

SEQ ID NO: 43151 - RNA, 27 nt, Artificial Sequence
  Vimentin (287-295)
gccgaggagugguacaagagcaaguuc

SEQ ID NO: 43152 - RNA, 63 nt, Artificial Sequence
  Proliferation-associated protein 2G4 (162-182)
gccgaguucgaggugcacgaggucuacgccguggacgugcuggucagcuccggcgaggggaag

SEQ ID NO: 43153 - RNA, 36 nt, Artificial Sequence
  Gamma-secretase C-terminal fragment 59 (563-574)
gccgaguuccgccacgacagcggcuacgaggugcac

SEQ ID NO: 43154 - RNA, 39 nt, Artificial Sequence
  Gamma-secretase C-terminal fragment 59 (563-575)
gccgaguuccgccacgacagcggcuacgaggugcaccac

SEQ ID NO: 43155 - RNA, 42 nt, Artificial Sequence
  Gamma-secretase C-terminal fragment 59 (563-576)
gccgaguuccgccacgacagcggcuacgaggugcaccaccag

SEQ ID NO: 43156 - RNA, 45 nt, Artificial Sequence
  Gamma-secretase C-terminal fragment 59 (563-577)
gccgaguuccgccacgacagcggcuacgaggugcaccaccagaag

SEQ ID NO: 43157 - RNA, 36 nt, Artificial Sequence
  Ataxin-10 (295-306)
gccgagggcgacaucagcaacguggccaacggguuc

SEQ ID NO: 43158 - RNA, 21 nt, Artificial Sequence
  Baculoviral IAP repeat-containing protein 6 (1093-1099)
gccgagggcauccacaacuuc

SEQ ID NO: 43159 - RNA, 30 nt, Artificial Sequence
  Zinc finger protein 516 (373-382)
gccgagggccccagcgacaccaagcaguuc

SEQ ID NO: 43160 - RNA, 33 nt, Artificial Sequence
  Synemin (327-337)
gccgagcacguggagaacaugcccagcgaguuc

SEQ ID NO: 43161 - RNA, 27 nt, Artificial Sequence
  Intraflagellar transport protein 81 homolog (43-51)
gccgagaucgaccccaagcagcuggug

SEQ ID NO: 43162 - RNA, 33 nt, Artificial Sequence
  Nucleolar pre-ribosomal-associated protein 1 (403-413)
gccgagaucaucggcggggagcgcagcguguuc

SEQ ID NO: 43163 - RNA, 21 nt, Artificial Sequence
  Poly (ADP-ribose) polymerase 1 (811-817)
gccgagaucauccgcaaguac

SEQ ID NO: 43164 - RNA, 36 nt, Artificial Sequence
  Sorting nexin-18 (397-408)
gccgagaaggacgagauggugggcgccaacuucuuc

SEQ ID NO: 43165 - RNA, 36 nt, Artificial Sequence
  Actin-binding protein anillin (451-462)
gccgagaagggcgggaacagcaaguccaagcagcug

SEQ ID NO: 43166 - RNA, 27 nt, Artificial Sequence
  A-kinase anchor protein 9 (834-842)
gccgagaagaacuucgaggugaacuac

SEQ ID NO: 43167 - RNA, 27 nt, Artificial Sequence
  Ribosomal protein S6 kinase alpha-5 (41-49)
gccgagaaggugggcaucgagaacuuc

SEQ ID NO: 43168 - RNA, 24 nt, Artificial Sequence
  Guanine nucleotide-binding protein G(olf) subunit alpha (78-85)
gccgagaaggugcuggccggcaag

SEQ ID NO: 43169 - RNA, 36 nt, Artificial Sequence
  Myosin-10 (1603-1614)
gccgagcuggaggacgagcgcaagcagcgggcccuc

SEQ ID NO: 43170 - RNA, 30 nt, Artificial Sequence
  Synemin (111-120)
gccgagcugggcgcccagcagcgcgagcuc

SEQ ID NO: 43171 - RNA, 27 nt, Artificial Sequence
  YTH domain-containing family protein 3 (480-488)
gccgagaugaagagcguggucgacuac

SEQ ID NO: 43172 - RNA, 36 nt, Artificial Sequence
  YTH domain-containing family protein 3 (480-491)
gccgagaugaagagcguggucgacuacaacgccuac

SEQ ID NO: 43173 - RNA, 33 nt, Artificial Sequence
  Melanoma-associated antigen 4 (134-144)
gccgagaugcuggagcgcgugaucaagaacuac

SEQ ID NO: 43174 - RNA, 33 nt, Artificial Sequence
  Melanoma-associated antigen 9 (132-142)
gccgagaugcuggagagcgugaucaagaacuac

SEQ ID NO: 43175 - RNA, 21 nt, Artificial Sequence
  Probable ATP-dependent RNA helicase DHX37 (108-114)
gccgagaugcgccuguucuac

SEQ ID NO: 43176 - RNA, 33 nt, Artificial Sequence
  Synemin (1391-1401)
gccgagaugaccagcggcgugucccgcagcuuc

SEQ ID NO: 43177 - RNA, 27 nt, Artificial Sequence
  Obscurin (5874-5882)
gccgagaacaagcugcacgugagccuc

SEQ ID NO: 43178 - RNA, 27 nt, Artificial Sequence
  Plexin-B2 (399-407)
gccgagaacaaccacaccguggccuuc

SEQ ID NO: 43179 - RNA, 30 nt, Artificial Sequence
  Heterogeneous nuclear ribonucleoprotein U (399-408)
gccgagaaccccggcaaguacaacauccug

SEQ ID NO: 43180 - RNA, 27 nt, Artificial Sequence
  Protocadherin gamma-B2 (110-118)
gccgagaacccccugaacaucuucuac

SEQ ID NO: 43181 - RNA, 27 nt, Artificial Sequence
  Dolichyl-diphosphooligosaccharide-proteinosyltransferase subunit 2 (312-320)
gccgagcccgacaacaagaacguguac

SEQ ID NO: 43182 - RNA, 30 nt, Artificial Sequence
  RING finger protein 112 (134-143)
gccgagccccugcuccuggugcgcaucaac

SEQ ID NO: 43183 - RNA, 33 nt, Artificial Sequence
  Plectin (1676-1686)
gccgagcaggagcuggagaagcagcgccagcuc

SEQ ID NO: 43184 - RNA, 30 nt, Artificial Sequence
  Intraflagellar transport protein 81 homolog (40-49)
gccgagcaggagaaccugggcaagaagcuc

SEQ ID NO: 43185 - RNA, 39 nt, Artificial Sequence
  Transcription factor SOX-10 (195-207)
gccgagcagggcgggaccgccgcgauccaggcccacuac

SEQ ID NO: 43186 - RNA, 30 nt, Artificial Sequence
  Vacuolar protein sorting-associated protein 13D (998-1007)
gccgagcagggcgggacccccauccgcuac

SEQ ID NO: 43187 - RNA, 27 nt, Artificial Sequence
  Tetratricopeptide repeat protein 19, mitochondrial (155-163)
gccgagcagcuguucaaggccaccaug

SEQ ID NO: 43188 - RNA, 30 nt, Artificial Sequence
  Vacuolar protein sorting-associated protein 18 homolog (210-219)
gccgagcgcggccccgacgggcggagcuuc

SEQ ID NO: 43189 - RNA, 27 nt, Artificial Sequence
  COP9 signalosome complex subunit 7a (56-64)
gccgagagcgacuucgccuccaccuuc

SEQ ID NO: 43190 - RNA, 27 nt, Artificial Sequence
  Tumor suppressor candidate 3 (279-287)
gccgagagccacaucauccuggugcuc

SEQ ID NO: 43191 - RNA, 27 nt, Artificial Sequence
  Melanoma-associated antigen 4 (102-110)
gccgagagccuguuccgcgaggcccuc

SEQ ID NO: 43192 - RNA, 30 nt, Artificial Sequence
  Peroxisome assembly protein 12 (45-54)
gccgagagcaaccccacccacuacggcuuc

SEQ ID NO: 43193 - RNA, 30 nt, Artificial Sequence
  Collagen alpha-1(XI) chain (281-290)
gccgagagcgugaccgagggccccaccguc

SEQ ID NO: 43194 - RNA, 27 nt, Artificial Sequence
  Procollagen-lysine,2-oxoglutarate 5-dioxygenase 3 (47-55)
gccgagaccgagggcuaccugcgcuuc

SEQ ID NO: 43195 - RNA, 30 nt, Artificial Sequence
  Procollagen-lysine,2-oxoglutarate 5-dioxygenase 3 (47-56)
gccgagaccgagggcuaccugcgcuuccuc

SEQ ID NO: 43196 - RNA, 27 nt, Artificial Sequence
  Melanoma-associated antigen 4 (280-288)
gccgagaccagcuacgugaagguccug

SEQ ID NO: 43197 - RNA, 33 nt, Artificial Sequence
  Melanoma-associated antigen 1 (272-282)
gccgagaccagcuacgugaagguccuggaguac

SEQ ID NO: 43198 - RNA, 36 nt, Artificial Sequence
  THO complex subunit 5 homolog (41-52)
gccgagguggaccugcgcgaccccggccgggacuac

SEQ ID NO: 43199 - RNA, 33 nt, Artificial Sequence
  Peptidase M20 domain-containing protein 2 (78-88)
gccgaggugggcgccgcggccgcccuggggguc

SEQ ID NO: 43200 - RNA, 21 nt, Artificial Sequence
  Probable cation-transporting ATPase 13A2 (443-449)
gccuuccugccccucgugccg

SEQ ID NO: 43201 - RNA, 93 nt, Artificial Sequence
  Heat shock protein HSP 90-beta (38-68)
gccuucauggaggcccugcaggcgggcgccgacaucagcaugaucgggcaguucggcgugggguucuacuccgccuaccucgucgccgagaag

SEQ ID NO: 43202 - RNA, 33 nt, Artificial Sequence
  Integrin alpha-7 (107-117)
gccuucagccccgacucccacuaccugcucuuc

SEQ ID NO: 43203 - RNA, 21 nt, Artificial Sequence
  Clustered mitochondria protein homolog (332-338)
gccuucguggagcaccgcuac

SEQ ID NO: 43204 - RNA, 27 nt, Artificial Sequence
  DnaJ homolog subfamily C member 3 (224-232)
gccuucuacaagaucagcacccuguac

SEQ ID NO: 43205 - RNA, 33 nt, Artificial Sequence
  SKI family transcriptional corepressor 2 (437-447)
gccggcgccgggggcgcgggggccgcccccaag

SEQ ID NO: 43206 - RNA, 27 nt, Artificial Sequence
  Actin, gamma-enteric smooth muscle (23-31)
gccggcgacgacgccccccgcgcggug

SEQ ID NO: 43207 - RNA, 48 nt, Artificial Sequence
  Tripartite motif-containing protein 67 (85-100)
gccggcgggcugggcgggggcgccgggggcggcggggaccacgcggac

SEQ ID NO: 43208 - RNA, 24 nt, Artificial Sequence
  Cytochrome c oxidase subunit 6C (68-75)
gccggcaucuuccagagcgugaag

SEQ ID NO: 43209 - RNA, 69 nt, Artificial Sequence
  Histone-lysine N-methyltransferase EHMT1 (702-724)
gccggccuggggcgccccaccccgggccucagccaggggcccggcaaggagacccuggaguccgcccug

SEQ ID NO: 43210 - RNA, 78 nt, Artificial Sequence
  Trifunctional enzyme subunit beta, mitochondrial (344-369)
gccggccugaccaugaacgacaucgacgccuucgaguuccacgaggcguucagcgggcagauccucgccaacuucaag

SEQ ID NO: 43211 - RNA, 36 nt, Artificial Sequence
  Collagen alpha-2(IV) chain (15-26)
gccggccccccggggaucaccggcuuccccggguuc

SEQ ID NO: 43212 - RNA, 30 nt, Artificial Sequence
  HLA class I histocompatibility antigen, B-8 alpha chain (89-98)
gccggcagccacacccugcaguccauguac

SEQ ID NO: 43213 - RNA, 24 nt, Artificial Sequence
  Actin-related protein 2/3 complex subunit 5 (75-82)
gccggcagcaucgugcugaagguc

SEQ ID NO: 43214 - RNA, 27 nt, Artificial Sequence
  Glucosylceramidase (22-30)
gccggcagccugaccgggcuccugcug

SEQ ID NO: 43215 - RNA, 39 nt, Artificial Sequence
  CD44 antigen (31-43)
gccggcguguuccacgucgagaagaacgggcgcuacagc

SEQ ID NO: 43216 - RNA, 36 nt, Artificial Sequence
  Cytochrome c oxidase subunit 5B, mitochondrial (118-129)
gcccacuacaagcuggugccccagcagcucgcccac

SEQ ID NO: 43217 - RNA, 27 nt, Artificial Sequence
  H(+)/Cl(-) exchange transporter 5 (533-541)
gccaucgccggccgccugcucggggug

SEQ ID NO: 43218 - RNA, 27 nt, Artificial Sequence
  HEAT repeat-containing protein 2 (474-482)
gccaucgccaccgagcuggcgcaggcc

SEQ ID NO: 43219 - RNA, 27 nt, Artificial Sequence
  Tetratricopeptide repeat protein 28 (1994-2002)
gccaucgacgagaaggugcaggccguc

SEQ ID NO: 43220 - RNA, 27 nt, Artificial Sequence
  Prolow-density lipoprotein receptor-related protein 1 (1748-1756)
gccaucgacuuccccgagagcaagcug

SEQ ID NO: 43221 - RNA, 24 nt, Artificial Sequence
  L-dopachrome tautomerase (63-70)
gccaucgaccugcccgugagcguc

SEQ ID NO: 43222 - RNA, 24 nt, Artificial Sequence
  CCR4-NOT transcription complex subunit 1 (94-101)
gccaucgacaacccccugcacuac

SEQ ID NO: 43223 - RNA, 27 nt, Artificial Sequence
  Leucine-rich repeat-containing protein 1 (516-524)
gccaucgaccgcgugaccaccagcguc

SEQ ID NO: 43224 - RNA, 42 nt, Artificial Sequence
  Clathrin heavy chain 1 (1124-1137)
gccaucgacagcuacaucaaggccgacgaccccuccagcuac

SEQ ID NO: 43225 - RNA, 45 nt, Artificial Sequence
  Clathrin heavy chain 1 (1124-1138)
gccaucgacagcuacaucaaggccgacgaccccuccagcuacaug

SEQ ID NO: 43226 - RNA, 24 nt, Artificial Sequence
  Eukaryotic translation initiation factor 4 gamma 1 (748-755)
gccaucgacaccgaggagcgccug

SEQ ID NO: 43227 - RNA, 27 nt, Artificial Sequence
  Probable phospholipid-transporting ATPase VB (1005-1013)
gccaucuuccagggcaagcuggagaag

SEQ ID NO: 43228 - RNA, 30 nt, Artificial Sequence
  Tubulin beta-2A chain (315-324)
gccaucuuccgcggccggaugagcaugaag

SEQ ID NO: 43229 - RNA, 66 nt, Artificial Sequence
  Aldose reductase (156-177)
gccaucggcaucagcaacuucaaccaccugcagguggagaugauccucaacaagcccgggcugaag

SEQ ID NO: 43230 - RNA, 27 nt, Artificial Sequence
  General transcription factor 3C polypeptide 1 (642-650)
gccaucaucgccaccggcugcuucggg

SEQ ID NO: 43231 - RNA, 27 nt, Artificial Sequence
  Receptor-type tyrosine-protein phosphatase zeta (195-203)
gccaucaucgacggcguggagagcguc

SEQ ID NO: 43232 - RNA, 27 nt, Artificial Sequence
  Protein TANC1 (414-422)
gccaucaucagcaagcugguggcccuc

SEQ ID NO: 43233 - RNA, 27 nt, Artificial Sequence
  Putative endoplasmin-like protein (265-273)
gccaucaaggacaagaucgagaaggcc

SEQ ID NO: 43234 - RNA, 27 nt, Artificial Sequence
  Kinesin-like protein KIF2A (638-646)
gccauccuggagcagaagaucgacauc

SEQ ID NO: 43235 - RNA, 27 nt, Artificial Sequence
  CLIP-associating protein 2 (795-803)
gccauccugaaguacaucgagacccuc

SEQ ID NO: 43236 - RNA, 27 nt, Artificial Sequence
  Heat shock 70 kDa protein 4 (381-389)
gccauccugagccccgccuucaaggug

SEQ ID NO: 43237 - RNA, 27 nt, Artificial Sequence
  Arginyl-tRNA-protein transferase 1 (382-390)
gccaucaugcccuacggcguguacaag

SEQ ID NO: 43238 - RNA, 27 nt, Artificial Sequence
  Probable ATP-dependent RNA helicase DDX17 (464-472)
gccaucaaccccaagcugaugcagcuc

SEQ ID NO: 43239 - RNA, 30 nt, Artificial Sequence
  Polypyrimidine tract-binding protein 1 (346-355)
gccauccccggccuggccggggcgggcaac

SEQ ID NO: 43240 - RNA, 33 nt, Artificial Sequence
  Moesin (19-29)
gccauccagcccaacaccaccggcaagcagcug

SEQ ID NO: 43241 - RNA, 39 nt, Artificial Sequence
  Moesin (19-31)
gccauccagcccaacaccaccggcaagcagcuguucgac

SEQ ID NO: 43242 - RNA, 27 nt, Artificial Sequence
  EH domain-containing protein 2 (17-25)
gccauccgcaccgugaccagcgcccug

SEQ ID NO: 43243 - RNA, 30 nt, Artificial Sequence
  DNA-dependent protein kinase catalytic subunit (460-469)
gccaucgugaaggucuuccuggcccucgcg

SEQ ID NO: 43244 - RNA, 36 nt, Artificial Sequence
  Solute carrier family 23 member 2 (58-69)
gccaucuacaccaccgagaacggcaucgccgagaag

SEQ ID NO: 43245 - RNA, 24 nt, Artificial Sequence
  Nuclear factor of activated T-cells 5 (154-161)
gccaaggccccccacuacgugcug

SEQ ID NO: 43246 - RNA, 96 nt, Artificial Sequence
  ATP synthase subunit epsilon, mitochondrial (20-51)
gccaaggccgugcgcgacgcgcugaagaccgaguucaaggccaacgccgagaagaccagcggcuccaacgucaagaucgugaaggugaagaaggag

SEQ ID NO: 43247 - RNA, 42 nt, Artificial Sequence
  Alpha-protein kinase 2 (1992-2005)
gccaagaucuacgccgcggaggcccagccccuggagggcuuc

SEQ ID NO: 43248 - RNA, 27 nt, Artificial Sequence
  Choline-phosphate cytidylyltransferase A (99-107)
gccaagaaccuguuccccaacaccuac

SEQ ID NO: 43249 - RNA, 27 nt, Artificial Sequence
  Putative hexokinase HKDC1 (389-397)
gcccuggccgcgauccucacccgccug

SEQ ID NO: 43250 - RNA, 39 nt, Artificial Sequence
  AT-rich interactive domain-containing protein 1B (2130-2142)
gcccuggccgcgcgcgccaucgccgugcagaagggcagc

SEQ ID NO: 43251 - RNA, 27 nt, Artificial Sequence
  Lamin-B receptor (330-338)
gcccuggccgcgaccguguucugcguc

SEQ ID NO: 43252 - RNA, 42 nt, Artificial Sequence
  Chondroitin sulfate proteoglycan 4 (1294-1307)
gcccuggccgacgagcccccgagccucgaccccgugcagucc

SEQ ID NO: 43253 - RNA, 33 nt, Artificial Sequence
  Metastasis-associated protein MTA1 (57-67)
gcccuggccgacaagcacgcgacccucagcgug

SEQ ID NO: 43254 - RNA, 33 nt, Artificial Sequence
  Probable ATP-dependent RNA helicase DDX27 (69-79)
gcccuggccgacgugaugagccagcucaagaag

SEQ ID NO: 43255 - RNA, 27 nt, Artificial Sequence
  Seizure 6-like protein 2 (50-58)
gcccuggccgagcuccugcacggcgcg

SEQ ID NO: 43256 - RNA, 27 nt, Artificial Sequence
  Helicase SKI2W (784-792)
gcccuggccgagcucaccaagcgccug

SEQ ID NO: 43257 - RNA, 30 nt, Artificial Sequence
  Chloride channel protein 2 (506-515)
gcccuggccggcgcggugacccacaccguc

SEQ ID NO: 43258 - RNA, 27 nt, Artificial Sequence
  RNA 3'-terminal phosphate cyclase (317-325)
gcccuggccaacggcgugagccgcauc

SEQ ID NO: 43259 - RNA, 27 nt, Artificial Sequence
  La-related protein 1 (672-680)
gcccuggccaacaagcucuucggcgcg

SEQ ID NO: 43260 - RNA, 27 nt, Artificial Sequence
  Beclin-1 (316-324)
gcccuggccaacaagaugggccucaag

SEQ ID NO: 43261 - RNA, 30 nt, Artificial Sequence
  Nicastrin (550-559)
gcccuggccaaccucaccggcaccgugguc

SEQ ID NO: 43262 - RNA, 27 nt, Artificial Sequence
  Poly(rC)-binding protein 4 (256-264)
gcccuggcccaguaccucaucaccgcg

SEQ ID NO: 43263 - RNA, 27 nt, Artificial Sequence
  Oxidation resistance protein 1 (776-784)
gcccuggccagcgagccccucaaggug

SEQ ID NO: 43264 - RNA, 27 nt, Artificial Sequence
  Kinesin light chain 4 (108-116)
gcccuggccagccaccucuccaccgug

SEQ ID NO: 43265 - RNA, 27 nt, Artificial Sequence
  E3 ubiquitin-protein ligase TRIM33 (830-838)
gcccuggccagccucgagaaccacgug

SEQ ID NO: 43266 - RNA, 30 nt, Artificial Sequence
  Ataxin-10 (300-309)
gcccuggccaccauccgccuccuggacgug

SEQ ID NO: 43267 - RNA, 27 nt, Artificial Sequence
  Catenin alpha-1 (336-344)
gcccugugcccccaggugaucaacgcc

SEQ ID NO: 43268 - RNA, 27 nt, Artificial Sequence
  Pre-mRNA-processing factor 40 homolog B (616-624)
gcccuggacgccggcaacaucaagcuc

SEQ ID NO: 43269 - RNA, 27 nt, Artificial Sequence
  Coiled-coil domain-containing protein 14 (192-200)
gcccuggacgccaacaucgcgcgccuc

SEQ ID NO: 43270 - RNA, 27 nt, Artificial Sequence
  Hyccin (259-267)
gcccuggacgacaucaucuaccgcgcc

SEQ ID NO: 43271 - RNA, 27 nt, Artificial Sequence
  Protein transport protein Sec16A (815-823)
gcccuggacuucacccucagccgcacc

SEQ ID NO: 43272 - RNA, 27 nt, Artificial Sequence
  Rho GTPase-activating protein 5 (624-632)
gcccuggacggcaagaucuacgagcuc

SEQ ID NO: 43273 - RNA, 24 nt, Artificial Sequence
  Endoplasmin (90-97)
gcccuggacaagauccgccucauc

SEQ ID NO: 43274 - RNA, 21 nt, Artificial Sequence
  Heat shock protein HSP 90-beta (1-7)
gcccuggacaagauccgcuac

SEQ ID NO: 43275 - RNA, 30 nt, Artificial Sequence
  Puromycin-sensitive aminopeptidase-like protein (412-421)
gcccuggacaacagccaccccaucgaggug

SEQ ID NO: 43276 - RNA, 33 nt, Artificial Sequence
  Ubiquitin-like modifier-activating enzyme 1 (574-584)
gcccuggacaacguggacgcccgcauguacaug

SEQ ID NO: 43277 - RNA, 27 nt, Artificial Sequence
  Receptor-type tyrosine-protein phosphatase gamma (213-221)
gcccuggaccccaucauccacggccuc

SEQ ID NO: 43278 - RNA, 27 nt, Artificial Sequence
  Chromobox protein homolog 8 (299-307)
gcccuggaccccaacggcacccgcgug

SEQ ID NO: 43279 - RNA, 27 nt, Artificial Sequence
  Microtubule-associated protein 1A (1498-1506)
gcccuggaccagaaggugcgcagcguc

SEQ ID NO: 43280 - RNA, 27 nt, Artificial Sequence
  Cathepsin F (223-231)
gcccuggaccgcggcaccgcccaguac

SEQ ID NO: 43281 - RNA, 27 nt, Artificial Sequence
  Probable helicase with zinc finger domain (1495-1503)
gcccuggaccgcauccacggcagcgug

SEQ ID NO: 43282 - RNA, 27 nt, Artificial Sequence
  Integrin beta-8 (291-299)
gcccuggacagcaagcucgccggcauc

SEQ ID NO: 43283 - RNA, 27 nt, Artificial Sequence
  C-type lectin domain family 11 member A (131-139)
gcccuggacacccgcguggucgagcuc

SEQ ID NO: 43284 - RNA, 27 nt, Artificial Sequence
  Keratin, type I cytoskeletal 27 (352-360)
gcccuggaggagcagcuccaccaggug

SEQ ID NO: 43285 - RNA, 27 nt, Artificial Sequence
  Serine-protein kinase ATM (1512-1520)
gcccuggagaaccaccuccacgugauc

SEQ ID NO: 43286 - RNA, 27 nt, Artificial Sequence
  Tetratricopeptide repeat protein 28 (936-944)
gcccuggagcagcacaucgccagcgug

SEQ ID NO: 43287 - RNA, 27 nt, Artificial Sequence
  DNA-dependent protein kinase catalytic subunit (315-323)
gcccuggagagcuuccucaagcaggug

SEQ ID NO: 43288 - RNA, 27 nt, Artificial Sequence
  Uridine phosphorylase 1 (48-56)
gcccuguucggcgacgugaaguucguc

SEQ ID NO: 43289 - RNA, 27 nt, Artificial Sequence
  Ankyrin repeat and SAM domain-containing protein 1A (255-263)
gcccuguucggcaagaccgacgugguc

SEQ ID NO: 43290 - RNA, 33 nt, Artificial Sequence
  Eukaryotic translation initiation factor 2-alpha kinase 4 (1102-1112)
gcccuguucauggaccacagcggcaugcucgug

SEQ ID NO: 43291 - RNA, 27 nt, Artificial Sequence
  Protein transport protein Sec61 subunit alpha isoform 2 (88-96)
gcccuguucaacggcgcccagaagcuc

SEQ ID NO: 43292 - RNA, 30 nt, Artificial Sequence
  Transforming growth factor-beta-induced protein ig-h3 (2-11)
gcccuguucgugcgccuccuggcccuggcg

SEQ ID NO: 43293 - RNA, 24 nt, Artificial Sequence
  Jerky protein homolog (486-493)
gcccugggcgccguggucaaggug

SEQ ID NO: 43294 - RNA, 30 nt, Artificial Sequence
  GTP-binding protein 2 (438-447)
gcccugggcgacuucgaccgcgcccuccug

SEQ ID NO: 43295 - RNA, 24 nt, Artificial Sequence
  Ankyrin repeat domain-containing protein 40 (19-26)
gcccugggcgacauccgcgaggug

SEQ ID NO: 43296 - RNA, 27 nt, Artificial Sequence
  Integrin alpha-11 (344-352)
gcccugggcgaccgcaucuucagccuc

SEQ ID NO: 43297 - RNA, 78 nt, Artificial Sequence
  Collagen alpha-3(VI) chain (105-130)
gcccugggcuucgccgggggcgagcucgcgaacaucgggcuggcccuggacuucguggucgagaaccacuucacccgc

SEQ ID NO: 43298 - RNA, 24 nt, Artificial Sequence
  Fucose-1-phosphate guanylyltransferase (126-133)
gcccugggcaagaucuucaccgcc

SEQ ID NO: 43299 - RNA, 36 nt, Artificial Sequence
  NAD(P) transhydrogenase, mitochondrial (649-660)
gcccugggcaugaucgggguggccggcgggcucgcg

SEQ ID NO: 43300 - RNA, 30 nt, Artificial Sequence
  ATP-binding cassette sub-family A member 13 (1237-1246)
gcccugggcaacgcccucgugagcgucaag

SEQ ID NO: 43301 - RNA, 24 nt, Artificial Sequence
  ATP-binding cassette sub-family B member 8, mitochondrial (320-327)
gcccugggcaacgugcgcaccguc

SEQ ID NO: 43302 - RNA, 27 nt, Artificial Sequence
  T-box transcription factor TBX2 (69-77)
gcccugggcccccacccgcccgccgcg

SEQ ID NO: 43303 - RNA, 27 nt, Artificial Sequence
  Dolichol-phosphate mannosyltransferase subunit 3 (74-82)
gcccugggcaccgugggguaccgcguc

SEQ ID NO: 43304 - RNA, 27 nt, Artificial Sequence
  Methionine-tRNA ligase, cytoplasmic (168-176)
gcccugcacagcugguuccagacccuc

SEQ ID NO: 43305 - RNA, 27 nt, Artificial Sequence
  X-ray repair cross-complementing protein 5 (456-464)
gcccugaucgacagcaugucccucgcc

SEQ ID NO: 43306 - RNA, 30 nt, Artificial Sequence
  Gamma-tubulin complex component 2 (186-195)
gcccugaucggcgacuuccucaucggggcc

SEQ ID NO: 43307 - RNA, 30 nt, Artificial Sequence
  Sodium-dependent phosphate transporter 2 (216-225)
gcccugaucagcuucggcguggcccuccug

SEQ ID NO: 43308 - RNA, 27 nt, Artificial Sequence
  Outer dense fiber protein 2-like (357-365)
gcccugaaggacgagguggucagcgug

SEQ ID NO: 43309 - RNA, 27 nt, Artificial Sequence
  Lysine-specific demethylase 5B (1044-1052)
gcccugaaggacagcgugcagcgcgcc

SEQ ID NO: 43310 - RNA, 21 nt, Artificial Sequence
  Max-like protein X (153-159)
gcccugaagaucaugaaggug

SEQ ID NO: 43311 - RNA, 27 nt, Artificial Sequence
  Poly (ADP-ribose) polymerase 1 (194-202)
gcccugaagaagcagcuccccggcgug

SEQ ID NO: 43312 - RNA, 27 nt, Artificial Sequence
  Chondroitin sulfate proteoglycan 4 (2314-2322)
gcccugaagaacggccaguacugggug

SEQ ID NO: 43313 - RNA, 78 nt, Artificial Sequence
  ATP synthase subunit epsilon, mitochondrial (26-51)
gcccugaagaccgaguucaaggccaacgcggagaagaccagcggcuccaacgugaagaucgucaaggugaagaaggag

SEQ ID NO: 43314 - RNA, 27 nt, Artificial Sequence
  Ubiquitin thioesterase OTUB1 (103-111)
gcccugcucgacgacagcaaggagcug

SEQ ID NO: 43315 - RNA, 33 nt, Artificial Sequence
  Eukaryotic translation initiation factor 3 subunit C-like protein (633-643)
gcccugcucgacauccagagcuccggccgcgcc

SEQ ID NO: 43316 - RNA, 27 nt, Artificial Sequence
  Dystonin (5774-5782)
gcccugcucgacagccugaacgaggug

SEQ ID NO: 43317 - RNA, 30 nt, Artificial Sequence
  G1/S-specific cyclin-D1 (253-262)
gcccugcucgagagcucccugcgccaggcc

SEQ ID NO: 43318 - RNA, 33 nt, Artificial Sequence
  Phosphatidylinositol 3-kinase catalytic subunit type 3 (575-585)
gcccugcucggcgacaacgagaagaugaaccug

SEQ ID NO: 43319 - RNA, 27 nt, Artificial Sequence
  WD repeat and FYVE domain-containing protein 3 (1152-1160)
gcccugcucggccacaccgacaccgug

SEQ ID NO: 43320 - RNA, 36 nt, Artificial Sequence
  ATP-binding cassette sub-family A member 13 (940-951)
gcccugcucggcaccaacggggccggcaagaccacg

SEQ ID NO: 43321 - RNA, 27 nt, Artificial Sequence
  Immunity-related GTPase family Q protein (318-326)
gcccugcuccugcccgacgccccgcug

SEQ ID NO: 43322 - RNA, 27 nt, Artificial Sequence
  Ubiquitin-like modifier-activating enzyme 6 (782-790)
gcccugcucaacauccugagcgaggug

SEQ ID NO: 43323 - RNA, 27 nt, Artificial Sequence
  Transmembrane O-methyltransferase (232-240)
gcccugcuccccgccggcgcgaccgug

SEQ ID NO: 43324 - RNA, 33 nt, Artificial Sequence
  Insulin receptor substrate 2 (417-427)
gcccugcuccccgccggcggggcgcugcagcac

SEQ ID NO: 43325 - RNA, 27 nt, Artificial Sequence
  General vesicular transport factor p115 (852-860)
gcccugcuccaggagaccaaggagcug

SEQ ID NO: 43326 - RNA, 30 nt, Artificial Sequence
  Sulfate transporter (251-260)
gcccugcucagcggcuucgugaccggggcc

SEQ ID NO: 43327 - RNA, 27 nt, Artificial Sequence
  Protein eva-1 homolog A (15-23)
gcccugcucagcaacauccuggccgcg

SEQ ID NO: 43328 - RNA, 27 nt, Artificial Sequence
  Putative tyrosine-protein phosphatase auxilin (822-830)
gcccugcucagcaccaugcacaccgug

SEQ ID NO: 43329 - RNA, 30 nt, Artificial Sequence
  Ankyrin repeat and SOCS box protein 11 (33-42)
gcccugcucacccacuucuacaucgugaag

SEQ ID NO: 43330 - RNA, 27 nt, Artificial Sequence
  Multiple epidermal growth factor-like domains protein 8 (1267-1275)
gcccugcucaccaacgugagcuccguc

SEQ ID NO: 43331 - RNA, 33 nt, Artificial Sequence
  Protein TANC2 (1001-1011)
gcccugauggacaaggagggccucaccgcccug

SEQ ID NO: 43332 - RNA, 33 nt, Artificial Sequence
  Calpain-3 (37-47)
gcccugauggacaccgacggcagcgggaagcuc

SEQ ID NO: 43333 - RNA, 39 nt, Artificial Sequence
  Calpain-3 (37-49)
gcccugauggacaccgacggcagcgggaagcucaaccug

SEQ ID NO: 43334 - RNA, 27 nt, Artificial Sequence
  Protein cordon-bleu (1169-1177)
gcccugauggaggccauccacagcgcg

SEQ ID NO: 43335 - RNA, 33 nt, Artificial Sequence
  Bestrophin-1 (462-472)
gcccugauggagcaccccgaggugagccagguc

SEQ ID NO: 43336 - RNA, 27 nt, Artificial Sequence
  Integrin beta-8 (662-670)
gcccugauggagcagcagcacuacgug

SEQ ID NO: 43337 - RNA, 63 nt, Artificial Sequence
  60 kDa heat shock protein, mitochondrial (38-58)
gcccugaugcuccagggcguggaccugcuggccgacgcggucgccgugaccauggggcccaag

SEQ ID NO: 43338 - RNA, 27 nt, Artificial Sequence
  HLA class II histocompatibility antigen, DQ beta 1 chain (103-111)
gcccugaaccaccacaaccuccuggug

SEQ ID NO: 43339 - RNA, 27 nt, Artificial Sequence
  Putative ribosome-binding factor A, mitochondrial (243-251)
gcccugaacaagcagaucauggaguac

SEQ ID NO: 43340 - RNA, 30 nt, Artificial Sequence
  Protocadherin gamma-A2 (171-180)
gcccugaaccccaacgaccacuucagccuc

SEQ ID NO: 43341 - RNA, 33 nt, Artificial Sequence
  RELT-like protein 1 (5-15)
gcccugcccggcagcgccgugcucgcggccgcc

SEQ ID NO: 43342 - RNA, 27 nt, Artificial Sequence
  Formin-1 (867-875)
gcccugcccccgccccccgccagcauc

SEQ ID NO: 43343 - RNA, 27 nt, Artificial Sequence
  E3 ubiquitin/ISG15 ligase TRIM25 (398-406)
gcccugcccagcaagcucccgaccuuc

SEQ ID NO: 43344 - RNA, 33 nt, Artificial Sequence
  Epsin-2 (283-293)
gcccugcccagcuccggcccggccgcgcagaag

SEQ ID NO: 43345 - RNA, 30 nt, Artificial Sequence
  Transcription factor SOX-10 (341-350)
gcccugcccaccgugagcccgcccggcguc

SEQ ID NO: 43346 - RNA, 27 nt, Artificial Sequence
  Nuclear receptor subfamily 1 group D member 2 (527-535)
gcccugcaggagacccucauccgcgcc

SEQ ID NO: 43347 - RNA, 27 nt, Artificial Sequence
  Interleukin-17 receptor D (642-650)
gcccugcagccccuccugcacaccgug

SEQ ID NO: 43348 - RNA, 27 nt, Artificial Sequence
  Golgin subfamily A member 3 (542-550)
gcccugcagagccagcuccagcaggug

SEQ ID NO: 43349 - RNA, 27 nt, Artificial Sequence
  V-type proton ATPase subunit C 1 (264-272)
gcccugcgcguguucgucgagagcgug

SEQ ID NO: 43350 - RNA, 27 nt, Artificial Sequence
  Rootletin (252-260)
gcccugagcgaggacauccgcaaggug

SEQ ID NO: 43351 - RNA, 33 nt, Artificial Sequence
  Catenin alpha-1 (773-783)
gcccugagcgaguucaaggccauggacuccauc

SEQ ID NO: 43352 - RNA, 27 nt, Artificial Sequence
  Staphylococcal nuclease domain-containing protein 1 (626-634)
gcccugagcaaggugcacuucaccgcc

SEQ ID NO: 43353 - RNA, 33 nt, Artificial Sequence
  Ubiquitin carboxyl-terminal hydrolase isozyme L5 (129-139)
gcccugagcaacuccgacgugauccgccagguc

SEQ ID NO: 43354 - RNA, 27 nt, Artificial Sequence
  Serine incorporator 5 (278-286)
gcccugagcuccaagcccgccgaggug

SEQ ID NO: 43355 - RNA, 27 nt, Artificial Sequence
  NudC domain-containing protein 3 (153-161)
gcccugagcuccagcuccauccgcgug

SEQ ID NO: 43356 - RNA, 27 nt, Artificial Sequence
  Piezo-type mechanosensitive ion channel component 1 (218-226)
gcccugagcuccguguaccuccugcug

SEQ ID NO: 43357 - RNA, 30 nt, Artificial Sequence
  Glutamate receptor ionotropic, kainate 3 (632-641)
gcccugagcacccgcaucaucggcgggauc

SEQ ID NO: 43358 - RNA, 27 nt, Artificial Sequence
  A-kinase anchor protein 9 (1723-1731)
gcccugaccgacuacaucacccgccuc

SEQ ID NO: 43359 - RNA, 27 nt, Artificial Sequence
  Transmembraneoprotein NMB (477-485)
gcccugaccagcacccucaucuccgug

SEQ ID NO: 43360 - RNA, 27 nt, Artificial Sequence
  Glutamine-tRNA ligase (715-723)
gcccugguggacugcagcgucgcccuc

SEQ ID NO: 43361 - RNA, 27 nt, Artificial Sequence
  (4658-4666)
gcccugguggacuggcucuacaagguc

SEQ ID NO: 43362 - RNA, 33 nt, Artificial Sequence
  Ribosome biogenesis protein BRX1 homolog (228-238)
gcccugguggagaucggcccccgcuucguccuc

SEQ ID NO: 43363 - RNA, 39 nt, Artificial Sequence
  Kinesin-like protein KIF1A (397-409)
gcccuggugggcaugagccccuccagcucccucagcgcc

SEQ ID NO: 43364 - RNA, 30 nt, Artificial Sequence
  Plexin-A2 (475-484)
gcccuggugggcaccaccagcgggcccguc

SEQ ID NO: 43365 - RNA, 30 nt, Artificial Sequence
  E3 ubiquitin-protein ligase TRIP12 (1669-1678)
gcccuggugagccaggagcuccagcgcgcc

SEQ ID NO: 43366 - RNA, 27 nt, Artificial Sequence
  Diphthamide biosynthesis protein 1 (172-180)
gcccuggugagcaccauccaguucguc

SEQ ID NO: 43367 - RNA, 30 nt, Artificial Sequence
  ER membrane protein complex subunit 7 (4-13)
gcccuguggggcuucuuccccgugcuccug

SEQ ID NO: 43368 - RNA, 30 nt, Artificial Sequence
  Transmembrane protein 234 (16-25)
gcccuguggggcgggacccagccccuccug

SEQ ID NO: 43369 - RNA, 30 nt, Artificial Sequence
  tRNA (uracil-5-)-methyltransferase homolog A (132-141)
gcccuguggaagggccgcccccucagcgug

SEQ ID NO: 43370 - RNA, 30 nt, Artificial Sequence
  WD repeat-containing protein 60 (1057-1066)
gcccuguggcccgagggcaagcuccacaag

SEQ ID NO: 43371 - RNA, 27 nt, Artificial Sequence
  Beta-hexosaminidase subunit beta (43-51)
gcccuguggccccucccgcugagcgug

SEQ ID NO: 43372 - RNA, 45 nt, Artificial Sequence
  Phosphatidate phosphatase LPIN1 (411-425)
gcccuguacuuccccaagaacggcgacccgagcgggcucgccaag

SEQ ID NO: 43373 - RNA, 27 nt, Artificial Sequence
  Caskin-2 (229-237)
gcccuguacggcaagaccgaggugguc

SEQ ID NO: 43374 - RNA, 27 nt, Artificial Sequence
  Ankyrin repeat and SAM domain-containing protein 1A (190-198)
gcccuguacggccgccucgaggugguc

SEQ ID NO: 43375 - RNA, 30 nt, Artificial Sequence
  Hemicentin-1 (1594-1603)
gcccuguacaucgacaagggccaguaccuc

SEQ ID NO: 43376 - RNA, 36 nt, Artificial Sequence
  Cytoplasmic dynein 1 heavy chain 1 (3101-3112)
gcccuguaccaggugggcaaggaguucaccagcaag

SEQ ID NO: 43377 - RNA, 36 nt, Artificial Sequence
  Type II inositol 3,4-bisphosphate 4-phosphatase (472-483)
gcccuguacaccgcccgccccggcgggauccucaag

SEQ ID NO: 43378 - RNA, 39 nt, Artificial Sequence
  Type II inositol 3,4-bisphosphate 4-phosphatase (472-484)
gcccuguacaccgcccgccccggcgggauccucaagaag

SEQ ID NO: 43379 - RNA, 27 nt, Artificial Sequence
  Dedicator of cytokinesis protein 7 (712-720)
gccauggccagcaucaucaaccgccug

SEQ ID NO: 43380 - RNA, 27 nt, Artificial Sequence
  Protein transport protein Sec31A (697-705)
gccauggacaccagcaccgugggcguc

SEQ ID NO: 43381 - RNA, 24 nt, Artificial Sequence
  Synemin (36-43)
gccauguucgacaagaaggugcag

SEQ ID NO: 43382 - RNA, 33 nt, Artificial Sequence
  Exportin-4 (248-258)
gccauguucgagagcucccagaacgugcugcuc

SEQ ID NO: 43383 - RNA, 33 nt, Artificial Sequence
  NAD(P)H dehydrogenase (quinone) 1 (21-31)
gccaugaaggaggccgcggccgccgcccugaag

SEQ ID NO: 43384 - RNA, 30 nt, Artificial Sequence
  Tryptophan-tRNA ligase, cytoplasmic (424-433)
gccaugcugaccggcgagcucaagaaggcc

SEQ ID NO: 43385 - RNA, 27 nt, Artificial Sequence
  Nucleoporin p58/p45 (376-384)
gccaugcagaagaucuaccagaccuuc

SEQ ID NO: 43386 - RNA, 27 nt, Artificial Sequence
  Tenascin (3-11)
gccaugacccagcugcucgccggcgug

SEQ ID NO: 43387 - RNA, 27 nt, Artificial Sequence
  S-adenosylmethionine synthase isoform type-1 (75-83)
gccaugguggacuaccagcgcgucgug

SEQ ID NO: 43388 - RNA, 30 nt, Artificial Sequence
  Zinc finger protein 697 (233-242)
gccauggugggcaugaugggggucggcgug

SEQ ID NO: 43389 - RNA, 33 nt, Artificial Sequence
  Leucine zipper putative tumor suppressor 1 (529-539)
gccauguaccagcgcaaccagcggcuggagaag

SEQ ID NO: 43390 - RNA, 24 nt, Artificial Sequence
  Eukaryotic translation initiation factor 2 subunit 3 (84-91)
gccaacgccaagaucuacaagcug

SEQ ID NO: 43391 - RNA, 42 nt, Artificial Sequence
  Beta-secretase 2 (75-88)
gccaacuuccuggccaugguggacaaccuccagggcgacagc

SEQ ID NO: 43392 - RNA, 21 nt, Artificial Sequence
  EH domain-containing protein 1 (504-510)
gccaaccaccugaucaaggug

SEQ ID NO: 43393 - RNA, 24 nt, Artificial Sequence
  Galectin-3 (142-149)
gccaaccgcaucgcccuggacuuc

SEQ ID NO: 43394 - RNA, 27 nt, Artificial Sequence
  Spectrin alpha chain, non-erythrocytic 1 (94-102)
gccaacagcggcgccaucgugaagcug

SEQ ID NO: 43395 - RNA, 27 nt, Artificial Sequence
  AT-rich interactive domain-containing protein 2 (940-948)
gcccccgccauccaccagaucgugcug

SEQ ID NO: 43396 - RNA, 33 nt, Artificial Sequence
  E3 ubiquitin-protein ligase MIB2 (408-418)
gcccccgcccugggccgcguggggaaggucgug

SEQ ID NO: 43397 - RNA, 30 nt, Artificial Sequence
  Biogenesis of lysosome-related organelles complex 1 subunit 3 (99-108)
gcccccgccccggcgcccgcccgcagccug

SEQ ID NO: 43398 - RNA, 27 nt, Artificial Sequence
  Protein capicua homolog (1681-1689)
gcccccgccccgcccgcggugcaguuc

SEQ ID NO: 43399 - RNA, 30 nt, Artificial Sequence
  Cathepsin F (20-29)
gcccccgcccagccgcgcgcggccagcuuc

SEQ ID NO: 43400 - RNA, 27 nt, Artificial Sequence
  Serum paraoxonase/arylesterase 2 (78-86)
gcccccgacaagccgggcgggauccug

SEQ ID NO: 43401 - RNA, 54 nt, Artificial Sequence
  Fructose-bisphosphate aldolase A (79-96)
gcccccggcaaggggauccuggccgcggacgagagcaccggcuccaucgccaag

SEQ ID NO: 43402 - RNA, 30 nt, Artificial Sequence
  Lysosome-associated membraneoprotein 1 (3-12)
gcccccggcagcgcccgccggccgcugcuc

SEQ ID NO: 43403 - RNA, 36 nt, Artificial Sequence
  Dynein heavy chain domain-containing protein 1 (4690-4701)
gcccccggcaccagcgaccugccggcccccgcggac

SEQ ID NO: 43404 - RNA, 27 nt, Artificial Sequence
  Protein SEC13 homolog (98-106)
gccccccacgacuacggccugauccuc

SEQ ID NO: 43405 - RNA, 27 nt, Artificial Sequence
  Chondroitin sulfate proteoglycan 4 (1875-1883)
gccccccacaacggcuuccugagccuc

SEQ ID NO: 43406 - RNA, 30 nt, Artificial Sequence
  Hypoxia-inducible factor 1-alpha (828-837)
gcccccauccagggcagccgcaaccugcuc

SEQ ID NO: 43407 - RNA, 24 nt, Artificial Sequence
  TRAF2 and NCK-interacting protein kinase (326-333)
gcccccaagccguaccacaaguuc

SEQ ID NO: 43408 - RNA, 30 nt, Artificial Sequence
  Ankyrin repeat and SOCS box protein 11 (248-257)
gcccccaagagcuccguggagcaggcccug

SEQ ID NO: 43409 - RNA, 27 nt, Artificial Sequence
  Cancer/testis antigen 2 (114-122)
gccccccugccgcgccccggcgccgug

SEQ ID NO: 43410 - RNA, 48 nt, Artificial Sequence
  GTP-binding nuclear protein Ran (203-218)
gcccccccggagguggucauggaccccgcccuggcggcccaguacgag

SEQ ID NO: 43411 - RNA, 51 nt, Artificial Sequence
  GTP-binding nuclear protein Ran (203-219)
gcccccccggagguggucauggaccccgcccuggcggcccaguacgagcac

SEQ ID NO: 43412 - RNA, 30 nt, Artificial Sequence
  DNA-binding protein inhibitor ID-4 (131-140)
gcccccccgcgcaccccccugaccgcccuc

SEQ ID NO: 43413 - RNA, 39 nt, Artificial Sequence
  Heat shock cognate 71 kDa protein (630-642)
gcccccccgagcggcggggccuccagcggccccaccauc

SEQ ID NO: 43414 - RNA, 33 nt, Artificial Sequence
  Uncharacterized protein C17orf51 (66-76)
gcccccccgacccgccgggcccaggcggcccug

SEQ ID NO: 43415 - RNA, 36 nt, Artificial Sequence
  UPF0669 protein C6orf120 (3-14)
gccccccgcggccgggccgcgccguggaccaccgcc

SEQ ID NO: 43416 - RNA, 24 nt, Artificial Sequence
  Procollagen-lysine,2-oxoglutarate 5-dioxygenase 1 (691-698)
gccccccgcaagggcuggacccug

SEQ ID NO: 43417 - RNA, 27 nt, Artificial Sequence
  La-related protein 7 (193-201)
gccccccgcaagccgggcaucuucccc

SEQ ID NO: 43418 - RNA, 123 nt, Artificial Sequence
  DNA-binding protein RFX5 (352-392)
gccccccgccugagcuccggcgcccucaagguggcgacccugccgcugagcucccgggccggggccccccccgccgccguccccaucaucaacaugauccucccgaccgugcccgcgcugccc

SEQ ID NO: 43419 - RNA, 30 nt, Artificial Sequence
  RNA-binding protein 33 (702-711)
gccccccgcaacagcaaccugcgggagcuc

SEQ ID NO: 43420 - RNA, 27 nt, Artificial Sequence
  Alpha-2-macroglobulin receptor-associated protein (2-10)
gccccccgccgggugcgcagcuuccug

SEQ ID NO: 43421 - RNA, 27 nt, Artificial Sequence
  Alpha-1-syntrophin (7-15)
gccccccgcaccggccugcucgagcug

SEQ ID NO: 43422 - RNA, 36 nt, Artificial Sequence
  Nance-Horan syndrome protein (1306-1317)
gcccccagcgccggccuggaggagguggcgcagccg

SEQ ID NO: 43423 - RNA, 27 nt, Artificial Sequence
  Eukaryotic translation initiation factor 3 subunit C-like protein (203-211)
gcccccagcggcgagucccgcaaguuc

SEQ ID NO: 43424 - RNA, 27 nt, Artificial Sequence
  Rho GTPase-activating protein 7 (241-249)
gcccccagcaagcugggccucaucauc

SEQ ID NO: 43425 - RNA, 27 nt, Artificial Sequence
  Dickkopf-related protein 3 (30-38)
gcccccgugaagccgggccccgcccug

SEQ ID NO: 43426 - RNA, 27 nt, Artificial Sequence
  Hemicentin-1 (1702-1710)
gcccaggagaucgaccgcggccaguac

SEQ ID NO: 43427 - RNA, 33 nt, Artificial Sequence
  Coatomer subunit alpha (141-151)
gcccaguuccaccccaccgaggaccuggugguc

SEQ ID NO: 43428 - RNA, 30 nt, Artificial Sequence
  Voltage-dependent T-type calcium channel subunit alpha-1H (1841-1850)
gcccaguucgugcuggucaacguggugguc

SEQ ID NO: 43429 - RNA, 24 nt, Artificial Sequence
  Ran GTPase-activating protein 1 (175-182)
gcccagggcaagccccuggcccuc

SEQ ID NO: 43430 - RNA, 36 nt, Artificial Sequence
  Heat shock 70 kDa protein 1B (623-634)
gcccagggccccaaggggggcagcggguccggcccg

SEQ ID NO: 43431 - RNA, 39 nt, Artificial Sequence
  HLA class I histocompatibility antigen, A-69 alpha chain (234-246)
gcccagggcagcgacgugucccugaccgccugcaagguc

SEQ ID NO: 43432 - RNA, 51 nt, Artificial Sequence
  T-complex protein 1 subunit zeta (291-307)
gcccagcugggcgugcaggccuucgcggacgcccuccugaucauccccaag

SEQ ID NO: 43433 - RNA, 27 nt, Artificial Sequence
  Retrotransposon-derived protein PEG10 (460-468)
gcccagaacggcaucccccugcgcauc

SEQ ID NO: 43434 - RNA, 33 nt, Artificial Sequence
  F-box/LRR-repeat protein 18 (437-447)
gcccagcccgccaugcacgcggugccgcgcggc

SEQ ID NO: 43435 - RNA, 30 nt, Artificial Sequence
  Actin, aortic smooth muscle (60-69)
gcccagagcaagcgcggcauccugacccuc

SEQ ID NO: 43436 - RNA, 30 nt, Artificial Sequence
  Histone-lysine N-methyltransferase NSD3 (366-375)
gcccagugggacaucggcaucgcccacgcg

SEQ ID NO: 43437 - RNA, 27 nt, Artificial Sequence
  Arrestin domain-containing protein 1 (236-244)
gcccaguggcacgagcagauccuggug

SEQ ID NO: 43438 - RNA, 27 nt, Artificial Sequence
  Glycogen phosphorylase, liver form (247-255)
gcccgcgcccccaacgacuucaaccug

SEQ ID NO: 43439 - RNA, 27 nt, Artificial Sequence
  Myosin-10 (1639-1647)
gcccgcgacgaggugaucaagcagcug

SEQ ID NO: 43440 - RNA, 27 nt, Artificial Sequence
  Apoptosis-inducing factor 1, mitochondrial (148-156)
gcccgcgaccccggcgcccgggugcug

SEQ ID NO: 43441 - RNA, 30 nt, Artificial Sequence
  HLA class II histocompatibility antigen, DQ beta 1 chain (33-42)
gcccgcuucgacagcgacgugggcgucuac

SEQ ID NO: 43442 - RNA, 33 nt, Artificial Sequence
  HLA class II histocompatibility antigen, DQ beta 1 chain (33-43)
gcccgcuucgacagcgacgugggcgucuaccgg

SEQ ID NO: 43443 - RNA, 30 nt, Artificial Sequence
  H/ACA ribonucleoprotein complex subunit 3 (33-42)
gcccgcuucagccccgacgacaaguacucc

SEQ ID NO: 43444 - RNA, 24 nt, Artificial Sequence
  ATP-dependent RNA helicase DDX24 (411-418)
gcccgcuucaccggcaucaagacc

SEQ ID NO: 43445 - RNA, 27 nt, Artificial Sequence
  60S ribosomal protein L7 (75-83)
gcccgcaaggccggcaacuucuacgug

SEQ ID NO: 43446 - RNA, 27 nt, Artificial Sequence
  Phospholipid transfer protein (319-327)
gcccgccugagcgccaagauggcgcuc

SEQ ID NO: 43447 - RNA, 27 nt, Artificial Sequence
  V-type proton ATPase subunit S1 (217-225)
gcccgccugagccucaccuacgagcgg

SEQ ID NO: 43448 - RNA, 27 nt, Artificial Sequence
  Peroxisomal acyl-coenzyme A oxidase 1 (492-500)
gcccgccugguggagaucgccgcgaag

SEQ ID NO: 43449 - RNA, 33 nt, Artificial Sequence
  Membrane-associated guanylate kinase, WW and PDZ domain-containing protein 2 (849-859)
gcccgcaacggccaggugaaccugaccguccgg

SEQ ID NO: 43450 - RNA, 33 nt, Artificial Sequence
  Melanotransferrin (274-284)
gcccgcgugcccgcccacgcggucguggugcgg

SEQ ID NO: 43451 - RNA, 36 nt, Artificial Sequence
  Syntenin-1 (35-46)
gccagcgcccccaucccgcacgacggcaaccuguac

SEQ ID NO: 43452 - RNA, 39 nt, Artificial Sequence
  Receptor-type tyrosine-protein phosphatase mu (849-861)
gccagcgacaccuccagccuggugcagucccacaccuac

SEQ ID NO: 43453 - RNA, 27 nt, Artificial Sequence
  Heterogeneous nuclear ribonucleoprotein M (578-586)
gccagcuucgaccgcgccaucgagaug

SEQ ID NO: 43454 - RNA, 24 nt, Artificial Sequence
  Cytochrome c oxidase subunit 7A2, mitochondrial (76-83)
gccagcuuccccaagaagcaggag

SEQ ID NO: 43455 - RNA, 87 nt, Artificial Sequence
  Cytochrome c oxidase subunit 5B, mitochondrial (32-60)
gccagcggcgggggcgugcccaccgacgaggagcaggccaccgggcuggagcgcgagaucaugcucgcggccaagaagggccuggac

SEQ ID NO: 43456 - RNA, 24 nt, Artificial Sequence
  Chromodomain-helicase-DNA-binding protein 4 (1045-1052)
gccagcggcaagcugcuccugcug

SEQ ID NO: 43457 - RNA, 24 nt, Artificial Sequence
  Thioredoxin domain-containing protein 12 (52-59)
gccagcggccugccccucauggug

SEQ ID NO: 43458 - RNA, 24 nt, Artificial Sequence
  Histone deacetylase 6 (38-45)
gccagcggcuccgugcugcgccuc

SEQ ID NO: 43459 - RNA, 27 nt, Artificial Sequence
  DNA damage-binding protein 1 (882-890)
gccagcaucaacuccaccgugcgccug

SEQ ID NO: 43460 - RNA, 24 nt, Artificial Sequence
  Alpha-actinin-3 (115-122)
gccagcaagggcgugaagcugguc

SEQ ID NO: 43461 - RNA, 27 nt, Artificial Sequence
  Adhesion G protein-coupled receptor A3 (756-764)
gccagccugcuccaccccguggucuac

SEQ ID NO: 43462 - RNA, 27 nt, Artificial Sequence
  Dynein light chain roadblock-type 1 (43-51)
gccagccugaugcacuccuucauccuc

SEQ ID NO: 43463 - RNA, 27 nt, Artificial Sequence
  Proline synthase co-transcribed bacterial homolog protein (77-85)
gccagcaaccccaagauccugucccuc

SEQ ID NO: 43464 - RNA, 30 nt, Artificial Sequence
  Solute carrier family 52, riboflavin transporter, member 2 (127-136)
gccagcaacgugaccuuccugcccuuccuc

SEQ ID NO: 43465 - RNA, 27 nt, Artificial Sequence
  Alanine-tRNA ligase, cytoplasmic (341-349)
gccagccgcggcuucuucgccacccug

SEQ ID NO: 43466 - RNA, 21 nt, Artificial Sequence
  Histone H2B type 2-F (78-84)
gccagccgccuggcccacuac

SEQ ID NO: 43467 - RNA, 54 nt, Artificial Sequence
  HLA class I histocompatibility antigen, A-23 alpha chain (348-365)
gccagcuccgacagcgcccagggcuccgacgugagccugaccgcgugcaagguc

SEQ ID NO: 43468 - RNA, 27 nt, Artificial Sequence
  OTU domain-containing protein 5 (237-245)
gccagcucccccgagcacccggagcug

SEQ ID NO: 43469 - RNA, 27 nt, Artificial Sequence
  40S ribosomal protein S19 (58-66)
gccagcaccgcccgccaccuguaccuc

SEQ ID NO: 43470 - RNA, 30 nt, Artificial Sequence
  Cullin-1 (195-204)
gccagcaccuuccagauggccauccugcuc

SEQ ID NO: 43471 - RNA, 27 nt, Artificial Sequence
  Dolichyl-diphosphooligosaccharide-proteinosyltransferase subunit DAD1 (100-108)
gccagcaccauccugcaccucgugguc

SEQ ID NO: 43472 - RNA, 30 nt, Artificial Sequence
  Thyroid adenoma-associated protein (153-162)
gccagcgugaacaaccugcucaagaacguc

SEQ ID NO: 43473 - RNA, 24 nt, Artificial Sequence
  Cystic fibrosis transmembrane conductance regulator (9-16)
gccagcguggucuccaagcuguuc

SEQ ID NO: 43474 - RNA, 27 nt, Artificial Sequence
  ATP-citrate synthase (223-231)
gccaccgccgacuacaucugcaaggug

SEQ ID NO: 43475 - RNA, 27 nt, Artificial Sequence
  Leucine-rich repeat-containing protein 47 (393-401)
gccaccgcccccccgcacgugaccguc

SEQ ID NO: 43476 - RNA, 30 nt, Artificial Sequence
  Hermansky-Pudlak syndrome 1 protein (7-16)
gccaccgagggcgccgaggugcuguucuac

SEQ ID NO: 43477 - RNA, 27 nt, Artificial Sequence
  Kinesin-like protein KIF3C (506-514)
gccaccgagcugcucgccgcgaaguac

SEQ ID NO: 43478 - RNA, 27 nt, Artificial Sequence
  EF-hand calcium-binding domain-containing protein 4B isoform a (677-685)
gccaccgagaacaaccugaucuucuac

SEQ ID NO: 43479 - RNA, 27 nt, Artificial Sequence
  Bestrophin-1 (573-581)
gccaccuucaccggcauccuggggaag

SEQ ID NO: 43480 - RNA, 27 nt, Artificial Sequence
  Apoptosis inhibitor 5 (19-27)
gccaccggcgagaaccugccccgcgug

SEQ ID NO: 43481 - RNA, 24 nt, Artificial Sequence
  (11-18)
gccaccggccgccugcuccugcug

SEQ ID NO: 43482 - RNA, 33 nt, Artificial Sequence
  40S ribosomal protein S15 (135-145)
gccacccacagcucccgcuucaucccccugaag

SEQ ID NO: 43483 - RNA, 27 nt, Artificial Sequence
  Poly(rC)-binding protein 4 (135-143)
gccaccauccccuaccacccgagccug

SEQ ID NO: 43484 - RNA, 30 nt, Artificial Sequence
  Phosphatidylinositol 4-kinase alpha (169-178)
gccaccauccgcaacgugcugcgggagaag

SEQ ID NO: 43485 - RNA, 27 nt, Artificial Sequence
  Cathepsin D (182-190)
gccaccaagcagcccggcaucaccuuc

SEQ ID NO: 43486 - RNA, 36 nt, Artificial Sequence
  Protein FAM171B (413-424)
gccacccugccccgcaagggccagcucguguacggg

SEQ ID NO: 43487 - RNA, 27 nt, Artificial Sequence
  Nuclear fragile X mental retardation-interacting protein 2 (116-124)
gccaccaaccccaucagccgcgugcug

SEQ ID NO: 43488 - RNA, 39 nt, Artificial Sequence
  UPF0606 protein KIAA1549L (947-959)
gccaccacccugggcagcuacacggugcagauggucaag

SEQ ID NO: 43489 - RNA, 27 nt, Artificial Sequence
  PH domain leucine-rich repeat-containing protein phosphatase 1 (7-15)
gccaccgugcagcgccugcccgagcuc

SEQ ID NO: 43490 - RNA, 27 nt, Artificial Sequence
  Myelin proteolipid protein (206-214)
gccaccuacaacuucgccgugcugaag

SEQ ID NO: 43491 - RNA, 30 nt, Artificial Sequence
  Eyes absent homolog 1 (124-133)
gccaccuacccccagccgggccagcccuac

SEQ ID NO: 43492 - RNA, 27 nt, Artificial Sequence
  Sigma non-opioid intracellular receptor 1 (17-25)
gccguggccgcgguccugacccaggug

SEQ ID NO: 43493 - RNA, 27 nt, Artificial Sequence
  Unconventional myosin-Ic (83-91)
gccguggccgacaccgucuaccgcgcg

SEQ ID NO: 43494 - RNA, 27 nt, Artificial Sequence
  Membrane-associated guanylate kinase, WW and PDZ domain-containing protein 2 (1428-1436)
gccguggcccccggcccguggaagguc

SEQ ID NO: 43495 - RNA, 27 nt, Artificial Sequence
  Endothelin B receptor (291-299)
gccguggccagcuggucccgcaucaag

SEQ ID NO: 43496 - RNA, 27 nt, Artificial Sequence
  Sideroflexin-3 (161-169)
gccguggccaccgcgcugggccucaag

SEQ ID NO: 43497 - RNA, 27 nt, Artificial Sequence
  Ubiquitin-like modifier-activating enzyme 1 (786-794)
gccguggccaccuuccugcagagcguc

SEQ ID NO: 43498 - RNA, 51 nt, Artificial Sequence
  Tubulin alpha-3E chain (374-390)
gccgugugcaugcugagcaacaccaccgccaucgcggaggccugggcccgc

SEQ ID NO: 43499 - RNA, 30 nt, Artificial Sequence
  SH3 domain-containing RING finger protein 3 (442-451)
gccguggacgcccugcuccagggcgcgguc

SEQ ID NO: 43500 - RNA, 27 nt, Artificial Sequence
  Ribosome biogenesis protein WDR12 (196-204)
gccguggacggcagcgggaccaaguuc

SEQ ID NO: 43501 - RNA, 27 nt, Artificial Sequence
  Protein fem-1 homolog A (542-550)
gccguggacaaggacaccaccaacguc

SEQ ID NO: 43502 - RNA, 45 nt, Artificial Sequence
  Transmembraneoprotein NMB (550-564)
gccguguucuuccccggcaaccaggagaaggacccgcugcucaag

SEQ ID NO: 43503 - RNA, 30 nt, Artificial Sequence
  GTP-binding protein Di-Ras2 (11-20)
gccguguucggcgccgggggcgucgggaag

SEQ ID NO: 43504 - RNA, 30 nt, Artificial Sequence
  Ankyrin-2 (1172-1181)
gccguguuccccgagggcgcccugaccaag

SEQ ID NO: 43505 - RNA, 24 nt, Artificial Sequence
  Mitochondrial coenzyme A transporter SLC25A42 (298-305)
gccgugggcaucagcuucaccacc

SEQ ID NO: 43506 - RNA, 27 nt, Artificial Sequence
  Low-density lipoprotein receptor-related protein 2 (1967-1975)
gccgugcacgacagcuuccuguacuac

SEQ ID NO: 43507 - RNA, 27 nt, Artificial Sequence
  Exosome complex exonuclease RRP44 (286-294)
gccgugcacgaggacaucgucgccgug

SEQ ID NO: 43508 - RNA, 36 nt, Artificial Sequence
  Structural maintenance of chromosomes flexible hinge domain-containing protein 1 (181-192)
gccgugaucgacaacggccgcgggaugaccagcaag

SEQ ID NO: 43509 - RNA, 33 nt, Artificial Sequence
  Pirin (150-160)
gccgugaucagcggcgaggcccuggggaucaag

SEQ ID NO: 43510 - RNA, 33 nt, Artificial Sequence
  Protein disulfide-isomerase (199-209)
gccgugaagguccacagcuuccccacccugaag

SEQ ID NO: 43511 - RNA, 27 nt, Artificial Sequence
  Influenza virus NS1A-binding protein (306-314)
gccgugcuggacggcaucuucugcguc

SEQ ID NO: 43512 - RNA, 27 nt, Artificial Sequence
  HLA class I histocompatibility antigen, Cw-5 alpha chain (322-330)
gccgugcugggcgccgucauggcggug

SEQ ID NO: 43513 - RNA, 27 nt, Artificial Sequence
  HLA class I histocompatibility antigen, Cw-3 alpha chain (322-330)
gccgugcugggcgccgucguggcggug

SEQ ID NO: 43514 - RNA, 27 nt, Artificial Sequence
  Kelch-like protein 21 (508-516)
gccgugcugggcgggaagcucuacguc

SEQ ID NO: 43515 - RNA, 27 nt, Artificial Sequence
  Transmembrane protein 147 (17-25)
gccgugcugggccacuuccucagccac

SEQ ID NO: 43516 - RNA, 24 nt, Artificial Sequence
  ER membrane protein complex subunit 1 (144-151)
gccgugcugaagaagaccacccuc

SEQ ID NO: 43517 - RNA, 27 nt, Artificial Sequence
  Coronin-1B (42-50)
gccgugaaccccaaguuccuggccguc

SEQ ID NO: 43518 - RNA, 36 nt, Artificial Sequence
  Trinucleotide repeat-containing gene 6C protein (287-298)
gccgugcagaaggagggcagcgggggcaacgccugg

SEQ ID NO: 43519 - RNA, 27 nt, Artificial Sequence
  Constitutive coactivator of peroxisome proliferator-activated receptor gamma (278-286)
gccgugagcgaccacaucuccaagguc

SEQ ID NO: 43520 - RNA, 51 nt, Artificial Sequence
  Histone H2B type 2-F (111-127)
gccgugagcgagggcaccaaggccgucaccaaguacacguccagcaagcug

SEQ ID NO: 43521 - RNA, 30 nt, Artificial Sequence
  Unconventional myosin-Ib (273-282)
gccguggucgccgcggugcugaagcucggc

SEQ ID NO: 43522 - RNA, 39 nt, Artificial Sequence
  HLA class I histocompatibility antigen, Cw-7 alpha chain (270-282)
gccguggucgugcccagcggccaggagcagcgcuacacc

SEQ ID NO: 43523 - RNA, 54 nt, Artificial Sequence
  Transketolase (84-101)
gccgugugggccgaggcgggcuuccuggccgaggccgagcuccugaaccugcgc

SEQ ID NO: 43524 - RNA, 27 nt, Artificial Sequence
  Fanconi anemia group B protein (310-318)
gccguguggaaggagagcuuccagguc

SEQ ID NO: 43525 - RNA, 27 nt, Artificial Sequence
  Glia-derived nexin (198-206)
gccguguacuucaagggccuguggaag

SEQ ID NO: 43526 - RNA, 30 nt, Artificial Sequence
  Ras GTPase-activating protein-binding protein 1 (54-63)
gccguguacggccagaaggagauccaccgc

SEQ ID NO: 43527 - RNA, 27 nt, Artificial Sequence
  Probable helicase with zinc finger domain (533-541)
gccguguaccugcuccccgucccgaag

SEQ ID NO: 43528 - RNA, 27 nt, Artificial Sequence
  Coagulation factor VIII (1262-1270)
gccuacgcccccgugcugcaggacuuc

SEQ ID NO: 43529 - RNA, 30 nt, Artificial Sequence
  E3 ubiquitin-protein ligase TTC3 (578-587)
gccuacugcggcaucgggaagguguaccug

SEQ ID NO: 43530 - RNA, 27 nt, Artificial Sequence
  Serine/threonine-protein kinase SIK3 (371-379)
gccuacgaccacuacagcgccaucuac

SEQ ID NO: 43531 - RNA, 27 nt, Artificial Sequence
  E3 ubiquitin-protein ligase TRIM13 (217-225)
gccuacgaccccgagaucaacaagcug

SEQ ID NO: 43532 - RNA, 27 nt, Artificial Sequence
  Lysophosphatidic acid receptor 1 (291-299)
gccuacgagaaguucuuccugcuccug

SEQ ID NO: 43533 - RNA, 24 nt, Artificial Sequence
  Annexin A5 (93-100)
gccuacgagcugaagcacgcccuc

SEQ ID NO: 43534 - RNA, 24 nt, Artificial Sequence
  Collagen alpha-1(VI) chain (997-1004)
gccuacggcgagagccaccuguuc

SEQ ID NO: 43535 - RNA, 24 nt, Artificial Sequence
  Ribosomal protein S6 kinase alpha-4 (27-34)
gccuacggcaagguguuccugguc

SEQ ID NO: 43536 - RNA, 24 nt, Artificial Sequence
  Lipase maturation factor 2 (303-310)
gccuacggcaccgugcacuacuuc

SEQ ID NO: 43537 - RNA, 27 nt, Artificial Sequence
  Transportin-1 (520-528)
gccuacauccuggacacccucguguuc

SEQ ID NO: 43538 - RNA, 27 nt, Artificial Sequence
  Poly(A)-specific ribonuclease PARN (337-345)
gccuacaucaccggccugugcuucauc

SEQ ID NO: 43539 - RNA, 27 nt, Artificial Sequence
  Collagen alpha-1(XXII) chain (141-149)
gccuacaagcagguggccauccugcuc

SEQ ID NO: 43540 - RNA, 27 nt, Artificial Sequence
  Nuclear receptor subfamily 2 group C member 2 (493-501)
gccuaccugaaggccaucgugcucuuc

SEQ ID NO: 43541 - RNA, 27 nt, Artificial Sequence
  Low affinity sodium-glucose cotransporter (318-326)
gccuaccugaagcuccugcccauguuc

SEQ ID NO: 43542 - RNA, 27 nt, Artificial Sequence
  Phosphatidylinositide phosphatase SAC2 (390-398)
gccuaccugaagcaggugcuccuguuc

SEQ ID NO: 43543 - RNA, 30 nt, Artificial Sequence
  TRPM8 channel-associated factor 1 (477-486)
gccuaccugcccgaguggaaggagaacauc

SEQ ID NO: 43544 - RNA, 27 nt, Artificial Sequence
  Catenin alpha-2 (811-819)
gccuaccugcagcgcaucgcccucuac

SEQ ID NO: 43545 - RNA, 27 nt, Artificial Sequence
  Signal recognition particle subunit SRP68 (191-199)
gccuaccugagcggcaugcuccgcuuc

SEQ ID NO: 43546 - RNA, 27 nt, Artificial Sequence
  Transmembraneoprotein NMB (36-44)
gccuacaugcgcgagcacaaccagcug

SEQ ID NO: 43547 - RNA, 30 nt, Artificial Sequence
  Serine/threonine-protein kinase mTOR (1308-1317)
gccuacaaccccauggcccgcgaccuguuc

SEQ ID NO: 43548 - RNA, 27 nt, Artificial Sequence
  Eukaryotic translation initiation factor 2-alpha kinase 4 (919-927)
gccuacaaccagaagguggaccuguuc

SEQ ID NO: 43549 - RNA, 27 nt, Artificial Sequence
  Regulation of nuclear pre-mRNA domain-containing protein 2 (70-78)
gccuacccccaccgccugaaccucuuc

SEQ ID NO: 43550 - RNA, 27 nt, Artificial Sequence
  Alpha-mannosidase 2C1 (924-932)
gccuacagccugaacuucccccuccug

SEQ ID NO: 43551 - RNA, 27 nt, Artificial Sequence
  Glutamine-fructose-6-phosphate aminotransferase (isomerizing) 1 (477-485)
gccuacaccagccaguucgugucccug

SEQ ID NO: 43552 - RNA, 24 nt, Artificial Sequence
  Bax inhibitor 1 (91-98)
gccuacgugcacauggucacccac

SEQ ID NO: 43553 - RNA, 147 nt, Artificial Sequence
  ATP synthase subunit epsilon, mitochondrial (3-51)
gccuacuggcgccaggccggccugagcuacauccgguacucccagaucugcgcgaaggccgugcgcgacgcccucaagaccgaguucaaggccaacgccgagaagaccagcggguccaacgucaagaucgugaaggugaagaaggag

SEQ ID NO: 43554 - RNA, 27 nt, Artificial Sequence
  Serum albumin (500-508)
ugcugcaccgagagccuggugaaccgc

SEQ ID NO: 43555 - RNA, 27 nt, Artificial Sequence
  Phosphoglycerate kinase 1 (50-58)
ugccuggacaacggcgccaagagcgug

SEQ ID NO: 43556 - RNA, 27 nt, Artificial Sequence
  Sodium/potassium-transporting ATPase subunit alpha-3 (359-367)
ugccuggugaagaaccucgaggccguc

SEQ ID NO: 43557 - RNA, 24 nt, Artificial Sequence
  Unconventional myosin-Id (243-250)
gacgccgccgaguuccgcgugguc

SEQ ID NO: 43558 - RNA, 27 nt, Artificial Sequence
  Dual serine/threonine and tyrosine protein kinase (357-365)
gacgccgccaaggcgcugaaccucgug

SEQ ID NO: 43559 - RNA, 27 nt, Artificial Sequence
  Dynactin subunit 1 (411-419)
gacgccgcccugggcgcggaggagaug

SEQ ID NO: 43560 - RNA, 27 nt, Artificial Sequence
  Cytoplasmic dynein 2 heavy chain 1 (311-319)
gacgccgcccugcagaugaucaccgug

SEQ ID NO: 43561 - RNA, 24 nt, Artificial Sequence
  Unconventional myosin-Ib (247-254)
gacgccgccaacuuccgcaccgug

SEQ ID NO: 43562 - RNA, 24 nt, Artificial Sequence
  HLA class I histocompatibility antigen, alpha chain E (60-67)
gacgccgccagcccccgcauggug

SEQ ID NO: 43563 - RNA, 30 nt, Artificial Sequence
  Density-regulated protein (69-78)
gacgccgacuacccccugcgcgugcucuac

SEQ ID NO: 43564 - RNA, 42 nt, Artificial Sequence
  Gamma-secretase C-terminal fragment 59 (562-575)
gacgccgaguuccgccacgacagcggcuacgaggugcaccac

SEQ ID NO: 43565 - RNA, 27 nt, Artificial Sequence
  Uncharacterized protein C15orf52 (63-71)
gacgccgagcuggaccgccggaucgug

SEQ ID NO: 43566 - RNA, 24 nt, Artificial Sequence
  Zinc finger SWIM domain-containing protein 6 (875-882)
gacgccuucaagaucgccacccug

SEQ ID NO: 43567 - RNA, 27 nt, Artificial Sequence
  Fructosamine-3-kinase (34-42)
gacgccggccccguguucgucaaggug

SEQ ID NO: 43568 - RNA, 27 nt, Artificial Sequence
  WD repeat-containing protein 81 (428-436)
gacgcccacuuccacuuccaccagauc

SEQ ID NO: 43569 - RNA, 27 nt, Artificial Sequence
  Farnesyl pyrophosphate synthase (33-41)
gacgccaucgcccgccugaaggaggug

SEQ ID NO: 43570 - RNA, 27 nt, Artificial Sequence
  Dolichyl-diphosphooligosaccharide-proteinosyltransferase subunit 2 (67-75)
gacgccaagaaggccugcaccuacauc

SEQ ID NO: 43571 - RNA, 27 nt, Artificial Sequence
  Heat shock 70 kDa protein 1B (323-331)
gacgccaagcuggacaaggcccagauc

SEQ ID NO: 43572 - RNA, 27 nt, Artificial Sequence
  FERM, RhoGEF and pleckstrin domain-containing protein 2 (711-719)
gacgcccugaaggccaucaccgaggug

SEQ ID NO: 43573 - RNA, 27 nt, Artificial Sequence
  Protocadherin gamma-A12 (636-644)
gacgcccugaagcagagccucgugguc

SEQ ID NO: 43574 - RNA, 27 nt, Artificial Sequence
  Short-chain dehydrogenase/reductase 3 (138-146)
gacgcccugcucaagagccagcacauc

SEQ ID NO: 43575 - RNA, 27 nt, Artificial Sequence
  Importin subunit alpha-3 (326-334)
gacgcccugagccacuuccccgcccuc

SEQ ID NO: 43576 - RNA, 27 nt, Artificial Sequence
  Rab GDP dissociation inhibitor beta (233-241)
gacgccaacagcugccagaucaucauc

SEQ ID NO: 43577 - RNA, 24 nt, Artificial Sequence
  Cubilin (2289-2296)
gacgcccccauccugagcaaguuc

SEQ ID NO: 43578 - RNA, 24 nt, Artificial Sequence
  Fibronectin isoform 11 (1163-1170)
gacgcccccaucgugaacaagguc

SEQ ID NO: 43579 - RNA, 27 nt, Artificial Sequence
  Fibronectin isoform 11 (1163-1171)
gacgcccccaucgugaacaaggucgug

SEQ ID NO: 43580 - RNA, 24 nt, Artificial Sequence
  Transcription activator BRG1 (696-703)
gacgcccccaaggccggccagcug

SEQ ID NO: 43581 - RNA, 27 nt, Artificial Sequence
  Protein scribble homolog (439-447)
gacgcccccccgagccgcguguccguc

SEQ ID NO: 43582 - RNA, 27 nt, Artificial Sequence
  Protocadherin gamma-C3 (256-264)
gacgcccccagcggcacccgcgugguc

SEQ ID NO: 43583 - RNA, 27 nt, Artificial Sequence
  Fc receptor-like A (54-62)
gacgcccgcgaggccggcuuccaggug

SEQ ID NO: 43584 - RNA, 24 nt, Artificial Sequence
  Polymerase delta-interacting protein 3 (116-123)
gacgcccgcgagaagaucagccug

SEQ ID NO: 43585 - RNA, 24 nt, Artificial Sequence
  Forkhead-associated domain-containing protein 1 (180-187)
gacgcccgcaagcccccggugauc

SEQ ID NO: 43586 - RNA, 24 nt, Artificial Sequence
  Polymerase delta-interacting protein 3 (55-62)
gacgcccgccagaagaucggccug

SEQ ID NO: 43587 - RNA, 39 nt, Artificial Sequence
  Filamin-A (1614-1626)
gacgccagcaagugcaccgugaccggcgccgggaucggc

SEQ ID NO: 43588 - RNA, 24 nt, Artificial Sequence
  Ataxin-10 (382-389)
gacgccagccugcucaagaaggug

SEQ ID NO: 43589 - RNA, 30 nt, Artificial Sequence
  Rootletin (478-487)
gacgccagcaacggcucccugcgcgggcuc

SEQ ID NO: 43590 - RNA, 27 nt, Artificial Sequence
  Basement membrane-specific heparan sulfate proteoglycan core protein (2026-2034)
gacgccagccccccgcccgugaagauc

SEQ ID NO: 43591 - RNA, 27 nt, Artificial Sequence
  Poly(A)-specific ribonuclease PARN (220-228)
gacgccgugggcuucagccgcgucauc

SEQ ID NO: 43592 - RNA, 24 nt, Artificial Sequence
  Uncharacterized protein KIAA1522 (204-211)
gacgccgugcgcauccccaccguc

SEQ ID NO: 43593 - RNA, 24 nt, Artificial Sequence
  Peptidylprolyl isomerase domain and WD repeat-containing protein 1 (214-221)
gacgccgugcgccugaucaacauc

SEQ ID NO: 43594 - RNA, 24 nt, Artificial Sequence
  GCN1 general control of amino-acid synthesis 1-like 1 (1074-1081)
gacgccgugcgccagagcgucgug

SEQ ID NO: 43595 - RNA, 27 nt, Artificial Sequence
  Putative segment polarity protein dishevelled homolog DVL1P1 (316-324)
gacgccgugcgcguccugcgggagauc

SEQ ID NO: 43596 - RNA, 24 nt, Artificial Sequence
  WD repeat-containing protein 60 (576-583)
gacgccguggucaugcccaagauc

SEQ ID NO: 43597 - RNA, 27 nt, Artificial Sequence
  Acyl-coenzyme A thioesterase 1 isoform X1 (280-288)
gacgccuggaagcagcugcagaccuuc

SEQ ID NO: 43598 - RNA, 24 nt, Artificial Sequence
  Nuclear factor erythroid 2-related factor 3 (109-116)
gacgccuggcuggugcacagcguc

SEQ ID NO: 43599 - RNA, 27 nt, Artificial Sequence
  Zinc finger protein 148 (493-501)
gacgccuaccugaacagccccucccuc

SEQ ID NO: 43600 - RNA, 24 nt, Artificial Sequence
  Phosphatidylinositide phosphatase SAC2 (555-562)
gacgccuaccgccaggccgugauc

SEQ ID NO: 43601 - RNA, 27 nt, Artificial Sequence
  Type II inositol 3,4-bisphosphate 4-phosphatase (589-597)
gacugcaugggcgagguggucaaccgc

SEQ ID NO: 43602 - RNA, 54 nt, Artificial Sequence
  Prolow-density lipoprotein receptor-related protein 1 (2270-2287)
gacgacggcagccgccggaucaccaucguggagaacgucggguccguggagggc

SEQ ID NO: 43603 - RNA, 48 nt, Artificial Sequence
  HLA class I histocompatibility antigen, alpha chain E (50-65)
gacgacacccaguucgugcgcuucgacaacgacgccgccagcccccgg

SEQ ID NO: 43604 - RNA, 39 nt, Artificial Sequence
  HLA class I histocompatibility antigen, B-15 alpha chain (53-65)
gacgacacccaguucgugcgcuucgacagcgacgccgcc

SEQ ID NO: 43605 - RNA, 24 nt, Artificial Sequence
  Serum paraoxonase/arylesterase 2 (123-130)
gacgacaccguguaccuguucguc

SEQ ID NO: 43606 - RNA, 30 nt, Artificial Sequence
  Prohibitin (166-175)
gacgacgugagccugacccaccucaccuuc

SEQ ID NO: 43607 - RNA, 33 nt, Artificial Sequence
  Eukaryotic initiation factor 4A-II (183-193)
gacgaggccgacgagaugcugagccgcggcuuc

SEQ ID NO: 43608 - RNA, 30 nt, Artificial Sequence
  Protein Red (199-208)
gacgaggaccccgagaacaagaucgaguuc

SEQ ID NO: 43609 - RNA, 30 nt, Artificial Sequence
  Nuclear pore complex protein Nup98-Nup96 (633-642)
gacgaggacagccuggugucccacuucuac

SEQ ID NO: 43610 - RNA, 24 nt, Artificial Sequence
  Caseinolytic peptidase B protein homolog (340-347)
gacgaggagcacccccugguguuc

SEQ ID NO: 43611 - RNA, 30 nt, Artificial Sequence
  Splicing factor, proline- and glutamine-rich (311-320)
gacgaguucaagcgccuguucgccaaguac

SEQ ID NO: 43612 - RNA, 27 nt, Artificial Sequence
  ER membrane protein complex subunit 1 (527-535)
gacgaguucaaccugcagaagaugaug

SEQ ID NO: 43613 - RNA, 27 nt, Artificial Sequence
  Aggrecan core protein (225-233)
gacgaguuccccggcgugcgcaccuac

SEQ ID NO: 43614 - RNA, 27 nt, Artificial Sequence
  Alpha-actinin-3 (248-256)
gacgagaaggccaucaugaccuacgug

SEQ ID NO: 43615 - RNA, 21 nt, Artificial Sequence
  Probable ATP-dependent RNA helicase DDX27 (87-93)
gacgagaagaucgagaaggug

SEQ ID NO: 43616 - RNA, 27 nt, Artificial Sequence
  Heterogeneous nuclear ribonucleoprotein U (281-289)
gacgagaacgacgugaucaccugcuuc

SEQ ID NO: 43617 - RNA, 30 nt, Artificial Sequence
  SURP and G-patch domain-containing protein 2 (569-578)
gacgagaacagccuggaguacaaguacuac

SEQ ID NO: 43618 - RNA, 27 nt, Artificial Sequence
  Serine/threonine-protein phosphatase 2A 65 kDa regulatory subunit A beta isoform (227-235)
gacgagcaggacagcgugcgccugcuc

SEQ ID NO: 43619 - RNA, 39 nt, Artificial Sequence
  Cytochrome c oxidase subunit 6B1 (5-17)
gacgagcagcgcgccgagggcaccuuccccgggaagauc

SEQ ID NO: 43620 - RNA, 27 nt, Artificial Sequence
  Glycine-tRNA ligase (545-553)
gacgagcagcgcaccuucuucagcuuc

SEQ ID NO: 43621 - RNA, 48 nt, Artificial Sequence
  Prohibitin-2 (246-261)
gacgagagcuucacccgcggcuccgacagccugaucaaggggaagaag

SEQ ID NO: 43622 - RNA, 45 nt, Artificial Sequence
  Annexin A2 (52-66)
gacgaggugaccaucgucaacauccugaccaaccgcagcaacgcc

SEQ ID NO: 43623 - RNA, 72 nt, Artificial Sequence
  Beta-2-microglobulin (75-98)
gacgaguacgccugccgcgugaaccacgucacccugagccagcccaagaucgugaagugggaccgggacaug

SEQ ID NO: 43624 - RNA, 27 nt, Artificial Sequence
  Rho GTPase-activating protein 33 (76-84)
gacuucggccacauccagcugcuccug

SEQ ID NO: 43625 - RNA, 21 nt, Artificial Sequence
  Exocyst complex component 1 (516-522)
gacuucaucagcaaguucuuc

SEQ ID NO: 43626 - RNA, 30 nt, Artificial Sequence
  Chromodomain-helicase-DNA-binding protein 4 (1081-1090)
gacuuccuggagcacgagggcuacaaguac

SEQ ID NO: 43627 - RNA, 21 nt, Artificial Sequence
  Prelamin-A/C (56-62)
gacuuccagaagaacaucuac

SEQ ID NO: 43628 - RNA, 30 nt, Artificial Sequence
  Vacuolar protein sorting-associated protein 51 homolog (75-84)
gacuucagcgcccgcaucuccgccacccug

SEQ ID NO: 43629 - RNA, 54 nt, Artificial Sequence
  Prohibitin-2 (174-191)
gacuucagccugauccucgacgacguggccaucaccgagcuguccuucagccgc

SEQ ID NO: 43630 - RNA, 75 nt, Artificial Sequence
  Cytochrome c oxidase subunit 6C (51-75)
gacuucuaccgcaacuacgacgugaugaaggacuucgaggagaugcggaaggccggcaucuuccagagcgucaag

SEQ ID NO: 43631 - RNA, 24 nt, Artificial Sequence
  Histone-lysine N-methyltransferase 2C (1502-1509)
gacggcgccauccuggggaagcuc

SEQ ID NO: 43632 - RNA, 24 nt, Artificial Sequence
  Melanocyte protein PMEL (233-240)
gacggcgggaacaagcacuuccug

SEQ ID NO: 43633 - RNA, 66 nt, Artificial Sequence
  Cytochrome c oxidase subunit 6A1, mitochondrial (65-86)
gacggcaaccacacccuguuccacaacccccacgugaacccgcuccccaccggguacgaggacgag

SEQ ID NO: 43634 - RNA, 27 nt, Artificial Sequence
  E3 ubiquitin-protein ligase UBR4 (503-511)
gacggccccccggccgcccugagcauc

SEQ ID NO: 43635 - RNA, 24 nt, Artificial Sequence
  Signal transducer and activator of transcription 2 (570-577)
gacggccgcaucaugggguucgug

SEQ ID NO: 43636 - RNA, 27 nt, Artificial Sequence
  Protein transport protein Sec31A (325-333)
gacggccgcaucagcguguacuccauc

SEQ ID NO: 43637 - RNA, 48 nt, Artificial Sequence
  Roundabout homolog 1 (1436-1451)
gacggccgccagguggucgacaugcggaccaaccccggggacccgcgc

SEQ ID NO: 43638 - RNA, 24 nt, Artificial Sequence
  Ubiquitin-60S ribosomal protein L40 (57-64)
gacggccgcacccugagcgacuac

SEQ ID NO: 43639 - RNA, 27 nt, Artificial Sequence
  Low-density lipoprotein receptor-related protein 2 (857-865)
gacggcagccaccugcuccccgugauc

SEQ ID NO: 43640 - RNA, 45 nt, Artificial Sequence
  Annexin A2 (182-196)
gacggcagcgugaucgacuacgagcugaucgaccaggacgcccgc

SEQ ID NO: 43641 - RNA, 24 nt, Artificial Sequence
  Neuroblast differentiation-associated protein AHNAK (730-737)
gacggcgugaagguccccgggauc

SEQ ID NO: 43642 - RNA, 60 nt, Artificial Sequence
  Glia-derived nexin (187-206)
gacggcgugcugacccgccucguccuggugaacgccguguacuucaaggggcuguggaag

SEQ ID NO: 43643 - RNA, 27 nt, Artificial Sequence
  Myotubularin-related protein 3 (99-107)
gacggcugggaccgcaccccccagauc

SEQ ID NO: 43644 - RNA, 27 nt, Artificial Sequence
  Phosphorylase b kinase regulatory subunit alpha, skeletal muscle isoform (591-599)
gacggcuacuucgggggcgcccgcgug

SEQ ID NO: 43645 - RNA, 24 nt, Artificial Sequence
  Molybdenum cofactor sulfurase (53-60)
gaccacgccggcgccacccuguuc

SEQ ID NO: 43646 - RNA, 36 nt, Artificial Sequence
  Trifunctional enzyme subunit alpha, mitochondrial (752-763)
gaccacgccaacagccccaacaagaaguucuaccag

SEQ ID NO: 43647 - RNA, 21 nt, Artificial Sequence
  tRNA-splicing ligase RtcB homolog (149-155)
gaccacauccccgugggcguc

SEQ ID NO: 43648 - RNA, 24 nt, Artificial Sequence
  T-complex protein 1 subunit beta (336-343)
gaccaccccgagcuggugaagcuc

SEQ ID NO: 43649 - RNA, 21 nt, Artificial Sequence
  Syntenin-1 (292-298)
gaccacaccauccccgaggug

SEQ ID NO: 43650 - RNA, 21 nt, Artificial Sequence
  GPI transamidase component PIG-T (163-169)
gaccacuacuuccugcgcuac

SEQ ID NO: 43651 - RNA, 21 nt, Artificial Sequence
  Probable helicase with zinc finger domain (343-349)
gaccacuacguguacaagguc

SEQ ID NO: 43652 - RNA, 27 nt, Artificial Sequence
  Probable helicase with zinc finger domain (343-351)
gaccacuacguguacaaggucggcauc

SEQ ID NO: 43653 - RNA, 27 nt, Artificial Sequence
  Putative Polycomb group protein ASXL1 (616-624)
gacaucaaggcccgcgcccugcaggug

SEQ ID NO: 43654 - RNA, 27 nt, Artificial Sequence
  Protein zyg-11 homolog B (263-271)
gacauccugcccaaccucgugagccug

SEQ ID NO: 43655 - RNA, 42 nt, Artificial Sequence
  Collagen alpha-1(XI) chain (219-232)
gacauccagcaguuccugaucaccggcgaccccaaggccgcc

SEQ ID NO: 43656 - RNA, 48 nt, Artificial Sequence
  Collagen alpha-1(XI) chain (219-234)
gacauccagcaguuccugaucaccggcgaccccaaggccgccuacgac

SEQ ID NO: 43657 - RNA, 27 nt, Artificial Sequence
  Eukaryotic translation initiation factor 3 subunit C-like protein (636-644)
gacauccagagcuccggccgcgccaag

SEQ ID NO: 43658 - RNA, 42 nt, Artificial Sequence
  Protocadherin Fat 1 (2630-2643)
gacaucaccuacgccaucgaggccgacagcgaguccgugaag

SEQ ID NO: 43659 - RNA, 45 nt, Artificial Sequence
  Glia-derived nexin (118-132)
gacaucgugaccgucgccaacgccguguucgugaagaacgcgagc

SEQ ID NO: 43660 - RNA, 24 nt, Artificial Sequence
  SWI/SNF complex subunit SMARCC1 (603-610)
gacaucuacagcaagaagacccug

SEQ ID NO: 43661 - RNA, 36 nt, Artificial Sequence
  Spectrin alpha chain, non-erythrocytic 1 (662-673)
gacaagggcgacagccuggacuccguggaggcccuc

SEQ ID NO: 43662 - RNA, 21 nt, Artificial Sequence
  V-type proton ATPase catalytic subunit A (466-472)
gacaagcacuucaccgaguuc

SEQ ID NO: 43663 - RNA, 21 nt, Artificial Sequence
  Heat shock protein HSP 90-beta (498-504)
gacaagaagguggagaagguc

SEQ ID NO: 43664 - RNA, 21 nt, Artificial Sequence
  Protein O-GlcNAcase (831-837)
gacaagcgcauccuggaguuc

SEQ ID NO: 43665 - RNA, 42 nt, Artificial Sequence
  Beta-enolase (195-208)
gacaagguggucaucggcauggacguggccgccagcgaguuc

SEQ ID NO: 43666 - RNA, 45 nt, Artificial Sequence
  L-lactate dehydrogenase A chain (43-57)
gaccuggccgacgagcucgcccugguggacgucaucgaggacaag

SEQ ID NO: 43667 - RNA, 69 nt, Artificial Sequence
  Neutral alpha-glucosidase AB (213-235)
gaccugggcaucuucuggcucaacgccgccgagaccuggguggacaucagcuccaacaccgcggggaag

SEQ ID NO: 43668 - RNA, 57 nt, Artificial Sequence
  Biotin-protein ligase (615-633)
gaccugaucaccgaguacaacaagcagcacaaggccgagcucaagccccugcgcgcc

SEQ ID NO: 43669 - RNA, 24 nt, Artificial Sequence
  1-phosphatidylinositol 4,5-bisphosphate phosphodiesterase beta-4 (280-287)
gaccugaagaagaagggccucauc

SEQ ID NO: 43670 - RNA, 27 nt, Artificial Sequence
  Protein AHNAK2 (2044-2052)
gaccugaaggugcagaccggccagguc

SEQ ID NO: 43671 - RNA, 48 nt, Artificial Sequence
  Inosine triphosphate pyrophosphatase (41-56)
gaccugcccgaguaccagggcgagccggacgagaucagcauccagaag

SEQ ID NO: 43672 - RNA, 81 nt, Artificial Sequence
  Heat shock protein HSP 90-alpha (477-503)
gaccuggugauccuccuguacgagaccgcccugcucagcuccggcuucagccuggaggacccccagacccacgccaaccgc

SEQ ID NO: 43673 - RNA, 24 nt, Artificial Sequence
  Melanocyte protein PMEL (9-16)
gaccuggugcucaagcgcugccug

SEQ ID NO: 43674 - RNA, 81 nt, Artificial Sequence
  Heat shock protein HSP 90-beta (579-605)
gaccuggugguccuccuguucgagaccgcccugcucagcuccggcuucagccuggaggacccccagacccacuccaaccgc

SEQ ID NO: 43675 - RNA, 33 nt, Artificial Sequence
  Fibronectin isoform 6 (1235-1245)
gacaaccugagccccggccucgaguacaacgug

SEQ ID NO: 43676 - RNA, 57 nt, Artificial Sequence
  Serine/threonine-protein phosphatase 2A 65 kDa regulatory subunit A alpha isoform (199-217)
gacaacgugaagagcgagaucauccccauguucuccaaccuggccagcgacgagcag

SEQ ID NO: 43677 - RNA, 24 nt, Artificial Sequence
  GPN-loop GTPase 2 (151-158)
gaccccgccaaguucaucagcgug

SEQ ID NO: 43678 - RNA, 48 nt, Artificial Sequence
  Cadherin-2 (380-395)
gaccccgccaacuggcugaagaucgacccggugaacggccagaucacc

SEQ ID NO: 43679 - RNA, 27 nt, Artificial Sequence
  DNA helicase MCM9 (298-306)
gaccccuucgccggccgcaacgugauc

SEQ ID NO: 43680 - RNA, 24 nt, Artificial Sequence
  Putative signal peptidase complex catalytic subunit SEC11B (62-69)
gaccccauccgcgugggcgagauc

SEQ ID NO: 43681 - RNA, 30 nt, Artificial Sequence
  Maestro heat-like repeat-containing protein family member 6 (652-661)
gaccccaagccggccguggccgcggccgcc

SEQ ID NO: 43682 - RNA, 27 nt, Artificial Sequence
  Prolyl 4-hydroxylase subunit alpha-2 (368-376)
gaccccaagaccggcgugcugaccguc

SEQ ID NO: 43683 - RNA, 24 nt, Artificial Sequence
  Sulfate transporter (642-649)
gacccccuggagcuccacaccauc

SEQ ID NO: 43684 - RNA, 24 nt, Artificial Sequence
  Signal recognition particle 9 kDa protein (21-28)
gaccccaugaaggcccgcgugguc

SEQ ID NO: 43685 - RNA, 27 nt, Artificial Sequence
  Titin (17217-17225)
gaccccccgggcacccccgagcccauc

SEQ ID NO: 43686 - RNA, 27 nt, Artificial Sequence
  Titin (16908-16916)
gacccccgcagccuggccgugccgauc

SEQ ID NO: 43687 - RNA, 27 nt, Artificial Sequence
  Dedicator of cytokinesis protein 7 (1087-1095)
gacccccgcuacagcgacccgcagauc

SEQ ID NO: 43688 - RNA, 30 nt, Artificial Sequence
  Integral membrane protein DGCR2/IDD (52-61)
gaccccagccacuuccacgccgugaacguc

SEQ ID NO: 43689 - RNA, 45 nt, Artificial Sequence
  Cadherin-2 (267-281)
gaccccaccggccgcuucgccauccagaccgacccgaacagcaac

SEQ ID NO: 43690 - RNA, 48 nt, Artificial Sequence
  Cadherin-2 (267-282)
gaccccaccggccgcuucgccauccagaccgacccgaacagcaacgac

SEQ ID NO: 43691 - RNA, 51 nt, Artificial Sequence
  Cadherin-2 (267-283)
gaccccaccggccgcuucgccauccagaccgacccgaacagcaacgacggg

SEQ ID NO: 43692 - RNA, 27 nt, Artificial Sequence
  Zinc finger protein 469 (3286-3294)
gaccccugggccggcggggagccgcug

SEQ ID NO: 43693 - RNA, 24 nt, Artificial Sequence
  Poly (ADP-ribose) polymerase 12 (148-155)
gaccccuggcugcucccggagauc

SEQ ID NO: 43694 - RNA, 78 nt, Artificial Sequence
  Protein S100-A6 (65-90)
gaccaggaggugaacuuccaggaguacgucaccuuccugggcgcccucgcccugaucuacaacgaggcgcugaagggg

SEQ ID NO: 43695 - RNA, 72 nt, Artificial Sequence
  CREB-binding protein (539-562)
gaccagcagcccccgaaccugaucagcgaguccgcccuccccaccagccugggcgccaccaacccccugaug

SEQ ID NO: 43696 - RNA, 21 nt, Artificial Sequence
  Paired amphipathic helix protein Sin3a (131-137)
gaccaggugaagcugcaguuc

SEQ ID NO: 43697 - RNA, 21 nt, Artificial Sequence
  Cyclin-I (74-80)
gaccgcuuccuggccaccgug

SEQ ID NO: 43698 - RNA, 24 nt, Artificial Sequence
  SUN domain-containing protein 2 (41-48)
gaccgcaucggccuggccgacuac

SEQ ID NO: 43699 - RNA, 63 nt, Artificial Sequence
  Heterogeneous nuclear ribonucleoprotein U (184-204)
gaccgccugagcgccuccagccucaccauggaguccuucgccuuccugugggcgggcgggcgg

SEQ ID NO: 43700 - RNA, 45 nt, Artificial Sequence
  HLA class I histocompatibility antigen, A-23 alpha chain (351-365)
gacagcgcccagggcuccgacgugagccugaccgccugcaagguc

SEQ ID NO: 43701 - RNA, 33 nt, Artificial Sequence
  HLA class I histocompatibility antigen, alpha chain E (338-348)
gacagcgcccagggcuccgagagccacucccug

SEQ ID NO: 43702 - RNA, 33 nt, Artificial Sequence
  DNA-directed RNA polymerase I subunit RPA1 (1009-1019)
gacagcgacggcuccgugguccaguuccuguac

SEQ ID NO: 43703 - RNA, 33 nt, Artificial Sequence
  ATP-dependent RNA helicase DHX29 (1132-1142)
gacagcgaccaccugaccaucuacaacgccuac

SEQ ID NO: 43704 - RNA, 27 nt, Artificial Sequence
  Sorbin and SH3 domain-containing protein 1 (255-263)
gacagcgaccuguacuccccccgcuac

SEQ ID NO: 43705 - RNA, 30 nt, Artificial Sequence
  Tyrosinase (454-463)
gacagcgaccccgacuccuuccaggacuac

SEQ ID NO: 43706 - RNA, 21 nt, Artificial Sequence
  Cullin-4B (365-371)
gacagcuucgagcagcgcuuc

SEQ ID NO: 43707 - RNA, 48 nt, Artificial Sequence
  Alpha-endosulfine (66-81)
gacagcggcgacuacaacauggccaaggccaagaugaagaacaagcag

SEQ ID NO: 43708 - RNA, 30 nt, Artificial Sequence
  Ral GTPase-activating protein subunit alpha-1 (921-930)
gacagccacuccgacagcuucuccgccuuc

SEQ ID NO: 43709 - RNA, 42 nt, Artificial Sequence
  Acylamino-acid-releasing enzyme (442-455)
gacagcauccugucccuccccggcaacguggggcaccaggac

SEQ ID NO: 43710 - RNA, 39 nt, Artificial Sequence
  Endoplasmin (205-217)
gacagcaacgaguucuccgugaucgccgacccccgcggc

SEQ ID NO: 43711 - RNA, 42 nt, Artificial Sequence
  Endoplasmin (205-218)
gacagcaacgaguucuccgugaucgccgacccccgcggcaac

SEQ ID NO: 43712 - RNA, 45 nt, Artificial Sequence
  Endoplasmin (205-219)
gacagcaacgaguucuccgugaucgccgacccccgcggcaacacc

SEQ ID NO: 43713 - RNA, 48 nt, Artificial Sequence
  Endoplasmin (205-220)
gacagcaacgaguucuccgugaucgccgacccccgcggcaacacccug

SEQ ID NO: 43714 - RNA, 51 nt, Artificial Sequence
  Endoplasmin (205-221)
gacagcaacgaguucuccgugaucgccgacccccgcggcaacacccugggg

SEQ ID NO: 43715 - RNA, 24 nt, Artificial Sequence
  Serine/threonine-protein phosphatase 2A 65 kDa regulatory subunit A beta isoform isoform e (103-110)
gacagcgugcgccugcucgccguc

SEQ ID NO: 43716 - RNA, 30 nt, Artificial Sequence
  Calpain-3 (40-49)
gacaccgacggcagcgggaagcugaaccuc

SEQ ID NO: 43717 - RNA, 57 nt, Artificial Sequence
  Beta-secretase 2 (110-128)
gacaccggcagcuccaacuucgccguggccgggaccccccacagcuacaucgacacg

SEQ ID NO: 43718 - RNA, 33 nt, Artificial Sequence
  Fibronectin isoform 6 (1261-1271)
gacaccaucauccccgccgugccgccccccacc

SEQ ID NO: 43719 - RNA, 36 nt, Artificial Sequence
  IST1 homolog (333-344)
gacacccugcccaccgccagcgccggcgcguccacg

SEQ ID NO: 43720 - RNA, 27 nt, Artificial Sequence
  Pre-mRNA-processing-splicing factor 8 (1782-1790)
gacaccaacguguaccgcgucaccauc

SEQ ID NO: 43721 - RNA, 48 nt, Artificial Sequence
  Glutamate receptor ionotropic, kainate 2 (79-94)
gacacccagaagaucaaccuguacgacagcuucgaggccuccaagaag

SEQ ID NO: 43722 - RNA, 21 nt, Artificial Sequence
  Zinc finger MYM-type protein 2 (612-618)
gacaccuggcgcaccgaguac

SEQ ID NO: 43723 - RNA, 27 nt, Artificial Sequence
  V-type proton ATPase subunit S1 (142-150)
gacguggccgucguggccggcgggcug

SEQ ID NO: 43724 - RNA, 27 nt, Artificial Sequence
  Coatomer subunit epsilon (49-57)
gacguggagcgcgacgucuuccuguac

SEQ ID NO: 43725 - RNA, 24 nt, Artificial Sequence
  Endothelial differentiation-related factor 1 (37-44)
gacguggagaccagcaagaagugg

SEQ ID NO: 43726 - RNA, 30 nt, Artificial Sequence
  Inhibitor of nuclear factor kappa-B kinase subunit alpha (123-132)
gacgugggcgggaagaucauccacaagauc

SEQ ID NO: 43727 - RNA, 36 nt, Artificial Sequence
  Gamma-secretase C-terminal fragment 59 (584-595)
gacgugggcagcaacaagggggccaucaucggccug

SEQ ID NO: 43728 - RNA, 54 nt, Artificial Sequence
  Gamma-secretase C-terminal fragment 59 (584-601)
gacgugggcagcaacaagggggccaucaucggccugauggucgggggcguggug

SEQ ID NO: 43729 - RNA, 21 nt, Artificial Sequence
  40S ribosomal protein S13 (21-27)
gacgugaaggagcagaucuac

SEQ ID NO: 43730 - RNA, 48 nt, Artificial Sequence
  Laminin subunit alpha-4 (1287-1302)
gacgugaagggcaucaagguccagagcguggacaagcaguacaacgac

SEQ ID NO: 43731 - RNA, 51 nt, Artificial Sequence
  Laminin subunit alpha-4 (1287-1303)
gacgugaagggcaucaagguccagagcguggacaagcaguacaacgacggg

SEQ ID NO: 43732 - RNA, 24 nt, Artificial Sequence
  N6-adenosine-methyltransferase 70 kDa subunit (382-389)
gacgugagcauccugggcaaguuc

SEQ ID NO: 43733 - RNA, 27 nt, Artificial Sequence
  HLA class I histocompatibility antigen, A-23 alpha chain (357-365)
gacgugagccugaccgccugcaagguc

SEQ ID NO: 43734 - RNA, 36 nt, Artificial Sequence
  Ubiquitin carboxyl-terminal hydrolase 36 (576-587)
gacgugguccugagcaccucccccaagcuccuggcc

SEQ ID NO: 43735 - RNA, 18 nt, Artificial Sequence
  U5 small nuclear ribonucleoprotein 200 kDa helicase (1392-1397)
gacugguacgagaaguuc

SEQ ID NO: 43736 - RNA, 27 nt, Artificial Sequence
  Growth arrest-specific protein 7 (285-293)
gacuacgccaagaaccuggccaagcuc

SEQ ID NO: 43737 - RNA, 27 nt, Artificial Sequence
  ER membrane protein complex subunit 1 (634-642)
gacuacgccaaggugcugcuccugauc

SEQ ID NO: 43738 - RNA, 27 nt, Artificial Sequence
  Multidrug resistance-associated protein 5 (776-784)
gacuacgccaccaucuucaacaaccug

SEQ ID NO: 43739 - RNA, 27 nt, Artificial Sequence
  Protein Niban (485-493)
gacuacgacagcuccaccauccgcaag

SEQ ID NO: 43740 - RNA, 21 nt, Artificial Sequence
  Plastin-3 (34-40)
gacuacgagcugcacgagcuc

SEQ ID NO: 43741 - RNA, 27 nt, Artificial Sequence
  14-3-3 protein epsilon (127-135)
gacuaccaccgcuaccuggccgaguuc

SEQ ID NO: 43742 - RNA, 27 nt, Artificial Sequence
  Cyclic AMP-dependent transcription factor ATF-4 (36-44)
gacuaccuggagguggccaagcacuuc

SEQ ID NO: 43743 - RNA, 27 nt, Artificial Sequence
  Lysosomal-trafficking regulator (2228-2236)
gacuaccugaagggccucgccagcuuc

SEQ ID NO: 43744 - RNA, 27 nt, Artificial Sequence
  Importin-7 (93-101)
gacuaccccagccgcuggaccgccauc

SEQ ID NO: 43745 - RNA, 27 nt, Artificial Sequence
  L-dopachrome tautomerase (155-163)
gacuacgugaucaccacccagcacugg

SEQ ID NO: 43746 - RNA, 27 nt, Artificial Sequence
  Down syndrome critical region protein 3 (203-211)
gaggccgccauccgcagcguggagcug

SEQ ID NO: 43747 - RNA, 30 nt, Artificial Sequence
  V-set and immunoglobulin domain-containing protein 10-like (447-456)
gaggccgccgugcccgcgggcagccgccug

SEQ ID NO: 43748 - RNA, 24 nt, Artificial Sequence
  Laminin subunit gamma-1 (1193-1200)
gaggccgacgacaucgugcgcguc

SEQ ID NO: 43749 - RNA, 24 nt, Artificial Sequence
  Poly (ADP-ribose) polymerase 1 (810-817)
gaggccgagaucauccgcaaguac

SEQ ID NO: 43750 - RNA, 30 nt, Artificial Sequence
  Poly (ADP-ribose) polymerase 14 (805-814)
gaggccuucgccgaggcggugaagaccguc

SEQ ID NO: 43751 - RNA, 24 nt, Artificial Sequence
  Alpha-mannosidase 2x (749-756)
gaggccuucccccugcgcgugauc

SEQ ID NO: 43752 - RNA, 36 nt, Artificial Sequence
  Coronin-6 (123-134)
gaggccggcgggggcggggccuucaucgugcugccc

SEQ ID NO: 43753 - RNA, 24 nt, Artificial Sequence
  Leucine-tRNA ligase, cytoplasmic (462-469)
gaggccaaggagaagaucuaccug

SEQ ID NO: 43754 - RNA, 27 nt, Artificial Sequence
  Guanine nucleotide-binding protein G(s) subunit alpha isoforms short (258-266)
gaggcccugaaccucuucaagagcauc

SEQ ID NO: 43755 - RNA, 27 nt, Artificial Sequence
  60 kDa heat shock protein, mitochondrial (165-173)
gaggcccugagcacccucgugcugaac

SEQ ID NO: 43756 - RNA, 24 nt, Artificial Sequence
  Sulfhydryl oxidase 1 (224-231)
gaggccaacgugguccgcaaguuc

SEQ ID NO: 43757 - RNA, 30 nt, Artificial Sequence
  General transcription factor IIF subunit 1 (356-365)
gaggccagcuccgcccuguucauggcgaag

SEQ ID NO: 43758 - RNA, 27 nt, Artificial Sequence
  Spectrin beta chain, non-erythrocytic 2 (1585-1593)
gaggacgcccugcgcgcccagcaguuc

SEQ ID NO: 43759 - RNA, 24 nt, Artificial Sequence
  Tyrosine-protein kinase BAZ1B (275-282)
gaggacgagcuggugaagaaguac

SEQ ID NO: 43760 - RNA, 27 nt, Artificial Sequence
  ATP-dependent RNA helicase DDX50 (3-11)
gaggacaacccccagacccugcucuuc

SEQ ID NO: 43761 - RNA, 27 nt, Artificial Sequence
  Kinesin-like protein KIF13B (775-783)
gaggacaaccccgugauccgcagcuac

SEQ ID NO: 43762 - RNA, 24 nt, Artificial Sequence
  F-box only protein 32 (101-108)
gaggaccagcagaacauccgccug

SEQ ID NO: 43763 - RNA, 27 nt, Artificial Sequence
  Peptidyl-prolyl cis-trans isomerase FKBP9 (198-206)
gaggaccaggugcagauccacaccuac

SEQ ID NO: 43764 - RNA, 24 nt, Artificial Sequence
  Eukaryotic translation initiation factor 3 subunit A (755-762)
gaggaccgcgaccuguucgugaug

SEQ ID NO: 43765 - RNA, 27 nt, Artificial Sequence
  Cullin-4B (405-413)
gaggaggccgaccgccugaucaccuac

SEQ ID NO: 43766 - RNA, 30 nt, Artificial Sequence
  Proteasome activator complex subunit 3 (93-102)
gaggaggccuuccagggcaccaagguguuc

SEQ ID NO: 43767 - RNA, 30 nt, Artificial Sequence
  Heterogeneous nuclear ribonucleoprotein U (540-549)
gaggaggcccagaagcugcucgagcaguac

SEQ ID NO: 43768 - RNA, 30 nt, Artificial Sequence
  Staphylococcal nuclease domain-containing protein 1 (554-563)
gaggaggccacccuguucaccaaggagcuc

SEQ ID NO: 43769 - RNA, 27 nt, Artificial Sequence
  Tribbles homolog 2 (149-157)
gaggaggaggccgcccgccuguucuac

SEQ ID NO: 43770 - RNA, 30 nt, Artificial Sequence
  Cullin-4B (404-413)
gaggaggaggccgaccgccugaucaccuac

SEQ ID NO: 43771 - RNA, 27 nt, Artificial Sequence
  Negative elongation factor E (11-19)
gaggaggaggcccugcagaagaaguuc

SEQ ID NO: 43772 - RNA, 30 nt, Artificial Sequence
  Synemin (68-77)
gaggaggaggagaacgacggccacugguuc

SEQ ID NO: 43773 - RNA, 33 nt, Artificial Sequence
  Nestin (503-513)
gaggaggagggcagcgcccugaagaccuccugg

SEQ ID NO: 43774 - RNA, 30 nt, Artificial Sequence
  Angiomotin-like protein 1 (596-605)
gaggaggagcugcgcgagaagcaggccuac

SEQ ID NO: 43775 - RNA, 30 nt, Artificial Sequence
  Nestin (316-325)
gaggaggagaaccugggcaagggggaguac

SEQ ID NO: 43776 - RNA, 27 nt, Artificial Sequence
  SHC-transforming protein 1 (341-349)
gaggaggagcccccggaccaccaguac

SEQ ID NO: 43777 - RNA, 30 nt, Artificial Sequence
  Synemin (856-865)
gaggaggagagcaccauccgcuacuccugg

SEQ ID NO: 43778 - RNA, 27 nt, Artificial Sequence
  (1052-1060)
gaggaguucgagacccugaaggaguuc

SEQ ID NO: 43779 - RNA, 39 nt, Artificial Sequence
  HLA class II histocompatibility antigen, DR alpha chain (41-53)
gaggaguucggccgcuucgccagcuucgaggcccagggg

SEQ ID NO: 43780 - RNA, 21 nt, Artificial Sequence
  cAMP-dependent protein kinase type I-beta regulatory subunit (247-253)
gaggaguuccugagcaaggug

SEQ ID NO: 43781 - RNA, 27 nt, Artificial Sequence
  Erlin-2 (50-58)
gaggagggccacaucgggguguacuac

SEQ ID NO: 43782 - RNA, 27 nt, Artificial Sequence
  STAM-binding protein (50-58)
gaggagggcaacaucgagcacgccuuc

SEQ ID NO: 43783 - RNA, 27 nt, Artificial Sequence
  Rho guanine nucleotide exchange factor 11 (801-809)
gaggagggccccaucaucaaggagauc

SEQ ID NO: 43784 - RNA, 30 nt, Artificial Sequence
  Nestin (504-513)
gaggagggcagcgcccugaagaccuccugg

SEQ ID NO: 43785 - RNA, 24 nt, Artificial Sequence
  Cytochrome c oxidase subunit 6A1, mitochondrial (8-15)
gaggagggcagcgcccgcaugugg

SEQ ID NO: 43786 - RNA, 27 nt, Artificial Sequence
  Phosphopantothenate-cysteine ligase (283-291)
gaggagaucgagaagggcguggagauc

SEQ ID NO: 43787 - RNA, 30 nt, Artificial Sequence
  A-kinase anchor protein 9 (822-831)
gaggagaucgagaagcagcgcaacaccuuc

SEQ ID NO: 43788 - RNA, 30 nt, Artificial Sequence
  Vimentin (240-249)
gaggagauccaggagcugcaggcccagauc

SEQ ID NO: 43789 - RNA, 27 nt, Artificial Sequence
  Zinc finger E-box-binding homeobox 2 (457-465)
gaggagaucagcaagcugaagggcuac

SEQ ID NO: 43790 - RNA, 27 nt, Artificial Sequence
  Nuclear pore complex protein Nup205 (77-85)
gaggagaucagcaccgugcugcaguac

SEQ ID NO: 43791 - RNA, 27 nt, Artificial Sequence
  Cadherin-2 (138-146)
gaggagaucguguucccccgccaguuc

SEQ ID NO: 43792 - RNA, 27 nt, Artificial Sequence
  Leucine zipper putative tumor suppressor 1 (511-519)
gaggagaaggagaaggugauccaguac

SEQ ID NO: 43793 - RNA, 33 nt, Artificial Sequence
  Intraflagellar transport protein 81 homolog (450-460)
gaggagaagaagggcaucagcggguacuccuac

SEQ ID NO: 43794 - RNA, 27 nt, Artificial Sequence
  FERM domain-containing protein 5 (259-267)
gaggagaagaagaucauccugaccuac

SEQ ID NO: 43795 - RNA, 27 nt, Artificial Sequence
  Receptor-type tyrosine-protein phosphatase zeta (1495-1503)
gaggagaagcugaucauccaggacuuc

SEQ ID NO: 43796 - RNA, 33 nt, Artificial Sequence
  Cyclic AMP-responsive element-binding protein 3-like protein 2 (268-278)
gaggagaagcgcacccugaucgccgagggcuac

SEQ ID NO: 43797 - RNA, 33 nt, Artificial Sequence
  Nestin (176-186)
gaggagcuggcccgccggcucggcgaggccugg

SEQ ID NO: 43798 - RNA, 42 nt, Artificial Sequence
  L-dopachrome tautomerase (49-62)
gaggagcuguuccucaccagcgaccagcugggcuacuccuac

SEQ ID NO: 43799 - RNA, 36 nt, Artificial Sequence
  Glia-derived nexin (40-51)
gaggagcugggcagcaacaccgggauccagguguuc

SEQ ID NO: 43800 - RNA, 30 nt, Artificial Sequence
  Myotubularin-related protein 6 (290-299)
gaggagcugaagcucaaggagaagaccuac

SEQ ID NO: 43801 - RNA, 27 nt, Artificial Sequence
  HEAT repeat-containing protein 1 (773-781)
gaggagcugaacagcacccagcgcgug

SEQ ID NO: 43802 - RNA, 24 nt, Artificial Sequence
  E3 ubiquitin-protein ligase RNF213 (1762-1769)
gaggagcugccccucaugcugcug

SEQ ID NO: 43803 - RNA, 30 nt, Artificial Sequence
  Protein KRI1 homolog (27-36)
gaggagcugcagcgccucaaggaccgguac

SEQ ID NO: 43804 - RNA, 27 nt, Artificial Sequence
  Angiomotin-like protein 1 (597-605)
gaggagcugcgcgagaagcaggccuac

SEQ ID NO: 43805 - RNA, 30 nt, Artificial Sequence
  Serpin H1 (373-382)
gaggagcugcgcagccccaagcucuucuac

SEQ ID NO: 43806 - RNA, 30 nt, Artificial Sequence
  Vimentin (374-383)
gaggagauggcccgccaccugcgggaguac

SEQ ID NO: 43807 - RNA, 30 nt, Artificial Sequence
  RANBP2-like and GRIP domain-containing protein 1 (1180-1189)
gaggagaugaagagcggccugaaggacuuc

SEQ ID NO: 43808 - RNA, 30 nt, Artificial Sequence
  Non-POU domain-containing octamer-binding protein (88-97)
gaggagaugcgcaagcuguucgagaaguac

SEQ ID NO: 43809 - RNA, 27 nt, Artificial Sequence
  NudC domain-containing protein 3 (165-173)
gaggagaacggcgagcgcgugcugaug

SEQ ID NO: 43810 - RNA, 30 nt, Artificial Sequence
  cGMP-inhibited 3',5'-cyclic phosphodiesterase B (605-614)
gaggagaacaucuucagcaaggaguccuuc

SEQ ID NO: 43811 - RNA, 33 nt, Artificial Sequence
  Pituitary tumor-transforming gene 1 protein-interacting protein (169-179)
gaggagaaccccuacgcccgcuucgagaacaac

SEQ ID NO: 43812 - RNA, 30 nt, Artificial Sequence
  Nestin (283-292)
gaggagaaccaggagagccugcgcucccuc

SEQ ID NO: 43813 - RNA, 27 nt, Artificial Sequence
  Tropomodulin-2 (273-281)
gaggagaacagccgcauccugaaguuc

SEQ ID NO: 43814 - RNA, 30 nt, Artificial Sequence
  Syndecan-3 (422-431)
gaggagcccaagcaggccagcgugaccuac

SEQ ID NO: 43815 - RNA, 27 nt, Artificial Sequence
  Lymphoid enhancer-binding factor 1 (247-255)
gaggagcaggccaaguacuacgagcug

SEQ ID NO: 43816 - RNA, 27 nt, Artificial Sequence
  Receptor-type tyrosine-protein phosphatase gamma (1261-1269)
gaggagcagaucaucauccacgacuuc

SEQ ID NO: 43817 - RNA, 27 nt, Artificial Sequence
  Eukaryotic translation initiation factor 4 gamma 2 (197-205)
gaggagcagcgcgccaucgccaagauc

SEQ ID NO: 43818 - RNA, 30 nt, Artificial Sequence
  General receptor for phosphoinositides 1-associated scaffold protein (125-134)
gaggagcagcgcguggagauggucaccuuc

SEQ ID NO: 43819 - RNA, 30 nt, Artificial Sequence
  14-3-3 protein beta/alpha (41-50)
gaggagcgcaaccugcucagcguggccuac

SEQ ID NO: 43820 - RNA, 27 nt, Artificial Sequence
  Unconventional myosin-Va (255-263)
gaggagcgcaacuaccacaucuucuac

SEQ ID NO: 43821 - RNA, 27 nt, Artificial Sequence
  Protein RTF2 homolog (273-281)
gaggagagcgaggccuacaagucccug

SEQ ID NO: 43822 - RNA, 30 nt, Artificial Sequence
  Protein RTF2 homolog (273-282)
gaggagagcgaggccuacaagucccuguuc

SEQ ID NO: 43823 - RNA, 30 nt, Artificial Sequence
  Rho-associated protein kinase 2 (440-449)
gaggagagccaggagauccagaagaagcug

SEQ ID NO: 43824 - RNA, 33 nt, Artificial Sequence
  Rho-associated protein kinase 2 (440-450)
gaggagagccaggagauccagaagaagcuguac

SEQ ID NO: 43825 - RNA, 27 nt, Artificial Sequence
  Spectrin beta chain, non-erythrocytic 1 (635-643)
gaggagagccgccggcuguggaaguuc

SEQ ID NO: 43826 - RNA, 27 nt, Artificial Sequence
  Synemin (857-865)
gaggagagcaccauccgcuacuccugg

SEQ ID NO: 43827 - RNA, 30 nt, Artificial Sequence
  Caldesmon (163-172)
gaggagaccgagaccgugacgaagagcuac

SEQ ID NO: 43828 - RNA, 27 nt, Artificial Sequence
  Putative segment polarity protein dishevelled homolog DVL1P1 (13-21)
gaggagacccccuaccuggugaagcuc

SEQ ID NO: 43829 - RNA, 27 nt, Artificial Sequence
  Trinucleotide repeat-containing gene 18 protein (2863-2871)
gaggagaccagccccggcaagcaguuc

SEQ ID NO: 43830 - RNA, 24 nt, Artificial Sequence
  Dedicator of cytokinesis protein 10 (2044-2051)
gaggagguggacaugauccgccug

SEQ ID NO: 43831 - RNA, 30 nt, Artificial Sequence
  ATR-interacting protein (133-142)
gaggaggugcugaucaagaacggcgagauc

SEQ ID NO: 43832 - RNA, 27 nt, Artificial Sequence
  V-type proton ATPase subunit B, kidney isoform (273-281)
gaggaggugcccggccgccggggguuc

SEQ ID NO: 43833 - RNA, 24 nt, Artificial Sequence
  Protein ITFG3 (235-242)
gaggaggugagcggccaccuguac

SEQ ID NO: 43834 - RNA, 27 nt, Artificial Sequence
  Tyrosinase (280-288)
gaggaguacaacagccaccagucccug

SEQ ID NO: 43835 - RNA, 30 nt, Artificial Sequence
  Hom s 1 (51-60)
gaggaguaccgcggcuucacccaggacuuc

SEQ ID NO: 43836 - RNA, 36 nt, Artificial Sequence
  Moesin (17-28)
gaguucgccauccagcccaacaccaccggcaagcag

SEQ ID NO: 43837 - RNA, 39 nt, Artificial Sequence
  Moesin (17-29)
gaguucgccauccagcccaacaccaccggcaagcagcug

SEQ ID NO: 43838 - RNA, 30 nt, Artificial Sequence
  Lamin-B receptor (208-217)
gaguucggcggggugcccggcgucuuccug

SEQ ID NO: 43839 - RNA, 27 nt, Artificial Sequence
  Nuclear factor erythroid 2-related factor 1 (312-320)
gaguucaacgagcugcucagcaaguac

SEQ ID NO: 43840 - RNA, 30 nt, Artificial Sequence
  Maltase-glucoamylase  (594-603)
gaguucaaccuguucggcauccccauggug

SEQ ID NO: 43841 - RNA, 27 nt, Artificial Sequence
  Signal peptidase complex subunit 2 (188-196)
gaguucaccaagagcaucgccaaguuc

SEQ ID NO: 43842 - RNA, 24 nt, Artificial Sequence
  Inositol 1,4,5-trisphosphate receptor type 3 (835-842)
gaguucguggaggacuaccugaac

SEQ ID NO: 43843 - RNA, 21 nt, Artificial Sequence
  Melanoma-associated antigen D1 (610-616)
gaguucgugaagcagaaguac

SEQ ID NO: 43844 - RNA, 27 nt, Artificial Sequence
  Vimentin (405-413)
gagggcgaggagagccgcaucucccug

SEQ ID NO: 43845 - RNA, 36 nt, Artificial Sequence
  Disintegrin and metalloproteinase domain-containing protein 10 (17-28)
gagggcuucauccagacccgcgggggcaccuucuac

SEQ ID NO: 43846 - RNA, 24 nt, Artificial Sequence
  Coiled-coil-helix-coiled-coil-helix domain-containing protein 2 (135-142)
gagggcuucaacgaggugcugaag

SEQ ID NO: 43847 - RNA, 21 nt, Artificial Sequence
  Dual specificity protein phosphatase 6 (133-139)
gagggcggguucagcaaguuc

SEQ ID NO: 43848 - RNA, 27 nt, Artificial Sequence
  Heat shock protein beta-8 (131-139)
gagggcgggaucgugagcaagaacuuc

SEQ ID NO: 43849 - RNA, 27 nt, Artificial Sequence
  Chondroitin sulfate proteoglycan 4 (257-265)
gagggccaccugcgcgccguggucgag

SEQ ID NO: 43850 - RNA, 24 nt, Artificial Sequence
  Zinc finger protein 106 (925-932)
gagggccacagcaagaccauccug

SEQ ID NO: 43851 - RNA, 21 nt, Artificial Sequence
  Activator of 90 kDa heat shock protein ATPase homolog 1 (249-255)
gagggcaucaagcagaccuuc

SEQ ID NO: 43852 - RNA, 21 nt, Artificial Sequence
  Kremen protein 2 (107-113)
gagggcaucuacuggcgcuac

SEQ ID NO: 43853 - RNA, 27 nt, Artificial Sequence
  Secretory phospholipase A2 receptor (1283-1291)
gagggcagcaaccugcucaccaucaag

SEQ ID NO: 43854 - RNA, 18 nt, Artificial Sequence
  Leucine-tRNA ligase, cytoplasmic (177-182)
gagcacaucuggacccug

SEQ ID NO: 43855 - RNA, 30 nt, Artificial Sequence
  Protein DBF4 homolog A (541-550)
gagcaccugaccgugcaggccaaggccccc

SEQ ID NO: 43856 - RNA, 24 nt, Artificial Sequence
  Bestrophin-1 (465-472)
gagcaccccgaggugagccagguc

SEQ ID NO: 43857 - RNA, 18 nt, Artificial Sequence
  Glycine-tRNA ligase (536-541)
gagcacaccuuccacgug

SEQ ID NO: 43858 - RNA, 24 nt, Artificial Sequence
  Fibronectin 1 (1541-1548)
gagaucgacaagcccagccagaug

SEQ ID NO: 43859 - RNA, 39 nt, Artificial Sequence
  39S ribosomal protein L37, mitochondrial (51-63)
gagauccccggccuggagccgaucaccuucgccgggaag

SEQ ID NO: 43860 - RNA, 21 nt, Artificial Sequence
  ATP-dependent RNA helicase DDX24 (574-580)
gagaaggacuucuaccuguac

SEQ ID NO: 43861 - RNA, 24 nt, Artificial Sequence
  Tyrosinase (517-524)
gagaaggaggacuaccacagccug

SEQ ID NO: 43862 - RNA, 33 nt, Artificial Sequence
  Nuclear autoantigenic sperm protein (365-375)
gagaagcccggccaggaggccccggugcugccc

SEQ ID NO: 43863 - RNA, 27 nt, Artificial Sequence
  Exocyst complex component 3 (32-40)
gagcuggccaagcagcucuggauggug

SEQ ID NO: 43864 - RNA, 27 nt, Artificial Sequence
  Eukaryotic initiation factor 4A-II (112-120)
gagcuggcccagcagauccagaaggug

SEQ ID NO: 43865 - RNA, 27 nt, Artificial Sequence
  Probable ATP-dependent RNA helicase DDX5 (178-186)
gagcuggcccagcaggugcagcagguc

SEQ ID NO: 43866 - RNA, 27 nt, Artificial Sequence
  Splicing factor 3B subunit 3 (1196-1204)
gagcuggaccgcacccccccggaggug

SEQ ID NO: 43867 - RNA, 27 nt, Artificial Sequence
  Microtubule cross-linking factor 1 (532-540)
gagcuggagcaggagcuccagaaguac

SEQ ID NO: 43868 - RNA, 21 nt, Artificial Sequence
  Clathrin heavy chain 1 (362-368)
gagcuguucgcccgcaaguuc

SEQ ID NO: 43869 - RNA, 66 nt, Artificial Sequence
  HEAT repeat-containing protein 5B (423-444)
gagcugggcagccucgugcagucccugaacgccaccgccagcccccugauccaggaggcguccauc

SEQ ID NO: 43870 - RNA, 24 nt, Artificial Sequence
  Leucine-rich repeat flightless-interacting protein 2 (198-205)
gagcugaucgagaagcacggccuc

SEQ ID NO: 43871 - RNA, 27 nt, Artificial Sequence
  Golgin subfamily B member 1 (2901-2909)
gagcugaagaaccuccagcagcaguac

SEQ ID NO: 43872 - RNA, 21 nt, Artificial Sequence
  Eukaryotic translation initiation factor 3 subunit C-like protein (84-90)
gagcugcucggcaaggccuac

SEQ ID NO: 43873 - RNA, 27 nt, Artificial Sequence
  RHO/RAC effector protein (236-244)
gagcugaacaaccagaacuucuaccuc

SEQ ID NO: 43874 - RNA, 24 nt, Artificial Sequence
  Presenilin-1 (3-10)
gagcugcccgccccgcucagcuac

SEQ ID NO: 43875 - RNA, 18 nt, Artificial Sequence
  FERM domain-containing protein 4A (927-932)
gagcugcgccagugguac

SEQ ID NO: 43876 - RNA, 27 nt, Artificial Sequence
  Proteasome maturation protein (49-57)
gagcugagcgagaagaacuuccagcuc

SEQ ID NO: 43877 - RNA, 24 nt, Artificial Sequence
  FACT complex subunit SSRP1 (312-319)
gagauggugagccgcgucaugaag

SEQ ID NO: 43878 - RNA, 30 nt, Artificial Sequence
  Ras GTPase-activating-like protein IQGAP2 (450-459)
gagaacgaccgcguggucgccgugggcuac

SEQ ID NO: 43879 - RNA, 21 nt, Artificial Sequence
  Eukaryotic translation initiation factor 3 subunit L (295-301)
gagaacaucgagcugaacaag

SEQ ID NO: 43880 - RNA, 102 nt, Artificial Sequence
  Glia-derived nexin (343-376)
gagaaccugcacgugagccacauccuccagaaggccaagaucgaggucuccgaggacggcaccaaggccagcgcggccaccacggccauccugaucgcccgc

SEQ ID NO: 43881 - RNA, 105 nt, Artificial Sequence
  Proteasome activator complex subunit 4 (1077-1111)
gagaaccugaaccacgacgccaucgugguccgcaagauggccaucagcgcgguggccggcauccucaagcagcugaagcggacccacaagaagcugaccaucaac

SEQ ID NO: 43882 - RNA, 33 nt, Artificial Sequence
  FYVE, RhoGEF and PH domain-containing protein 6 (143-153)
gagaacagcaagaucgacgagacccugaccauc

SEQ ID NO: 43883 - RNA, 27 nt, Artificial Sequence
  Ankyrin repeat domain-containing protein SOWAHB (248-256)
gagcccgccccggugcccgccgucgcg

SEQ ID NO: 43884 - RNA, 33 nt, Artificial Sequence
  39S ribosomal protein L3, mitochondrial (91-101)
gagcccggcagcuuccgcguggggcugaucgcc

SEQ ID NO: 43885 - RNA, 27 nt, Artificial Sequence
  Nurim (116-124)
gagcccaucccgaagggccccgugcug

SEQ ID NO: 43886 - RNA, 30 nt, Artificial Sequence
  Ryanodine receptor 1 (370-379)
gagcccccgacccccgagggcagccccauc

SEQ ID NO: 43887 - RNA, 27 nt, Artificial Sequence
  WD repeat-containing protein 18 (350-358)
gagccccgccacggcgggcugacccuc

SEQ ID NO: 43888 - RNA, 33 nt, Artificial Sequence
  Gamma-secretase C-terminal fragment 59 (473-483)
gagccccgcaucagcuacggcaacgacgcccug

SEQ ID NO: 43889 - RNA, 54 nt, Artificial Sequence
  Integral membrane protein GPR137C (19-36)
gagcccagcaccccgggcgggggcuccgggggcgggggcgccguggccgcggcc

SEQ ID NO: 43890 - RNA, 123 nt, Artificial Sequence
  Ubiquitin-associated protein 2-like (364-404)
gagcaguucaagaccgcccaggcccuggcgcagcucgccgcccagcacagccaguccggcagcaccacgaccuccagcugggacaugggguccaccacccagagccccucccuggugcaguac

SEQ ID NO: 43891 - RNA, 30 nt, Artificial Sequence
  Keratin, type II cytoskeletal 1b (186-195)
gagcagcagaaccaggugcugcagaccaag

SEQ ID NO: 43892 - RNA, 30 nt, Artificial Sequence
  Histone-lysine N-methyltransferase 2D (2989-2998)
gagcagcagagcaagauccagaagcagcug

SEQ ID NO: 43893 - RNA, 24 nt, Artificial Sequence
  Hsp90 co-chaperone Cdc37 (207-214)
gagcagguggcccaccagaccauc

SEQ ID NO: 43894 - RNA, 24 nt, Artificial Sequence
  Mucin-16 (582-589)
gagcagguguuccuggacaagacc

SEQ ID NO: 43895 - RNA, 21 nt, Artificial Sequence
  Serine/arginine-rich splicing factor 3 (27-33)
gagcgcgccuucggcuacuac

SEQ ID NO: 43896 - RNA, 27 nt, Artificial Sequence
  Kinectin (367-375)
gagcgcagcaacguggucaucacccgg

SEQ ID NO: 43897 - RNA, 21 nt, Artificial Sequence
  RAB6A-GEF complex partner protein 2 (263-269)
gagcgcgugcagcccgaguac

SEQ ID NO: 43898 - RNA, 18 nt, Artificial Sequence
  Vacuolar protein sorting-associated protein 18 homolog (309-314)
gagcgcgugugggaguac

SEQ ID NO: 43899 - RNA, 33 nt, Artificial Sequence
  Pre-mRNA-splicing factor ATP-dependent RNA helicase PRP16 (1005-1015)
gagagcgaccaccugaccuaccucaacguguac

SEQ ID NO: 43900 - RNA, 57 nt, Artificial Sequence
  Endoplasmin (203-221)
gagagcgacuccaacgaguucagcgugaucgccgacccccgcggcaacacccugggg

SEQ ID NO: 43901 - RNA, 30 nt, Artificial Sequence
  Netrin receptor UNC5A (438-447)
gagagcgaggccggcgugcccgcccugguc

SEQ ID NO: 43902 - RNA, 27 nt, Artificial Sequence
  DNA-directed RNA polymerase I subunit RPA1 (186-194)
gagagcaaguccaagcugaucgcccuc

SEQ ID NO: 43903 - RNA, 24 nt, Artificial Sequence
  Four and a half LIM domains protein 2 (122-129)
gagagccuguucggcaagaaguac

SEQ ID NO: 43904 - RNA, 24 nt, Artificial Sequence
  T-complex protein 1 subunit beta (114-121)
gagagccugaucgccaagaagauc

SEQ ID NO: 43905 - RNA, 21 nt, Artificial Sequence
  Heterogeneous nuclear ribonucleoproteins A2/B1 (23-29)
gagagccugcgcaacuacuac

SEQ ID NO: 43906 - RNA, 51 nt, Artificial Sequence
  AT-rich interactive domain-containing protein 1A (78-94)
gagagcaacggcgggggcgggggcgggggcgccggcuccgggggcgggccc

SEQ ID NO: 43907 - RNA, 21 nt, Artificial Sequence
  DENN domain-containing protein 4B (1394-1400)
gagagcgugcugcgccacguc

SEQ ID NO: 43908 - RNA, 27 nt, Artificial Sequence
  Protein kinase C-binding protein 1 (695-703)
gagaccgacagccccaccgugcaccug

SEQ ID NO: 43909 - RNA, 27 nt, Artificial Sequence
  HEAT repeat-containing protein 1 (1479-1487)
gagaccauccccaaggccgugagcuuc

SEQ ID NO: 43910 - RNA, 27 nt, Artificial Sequence
  Receptor-type tyrosine-protein phosphatase C (52-60)
gagaccaagcuguucaccgccaagcuc

SEQ ID NO: 43911 - RNA, 30 nt, Artificial Sequence
  Uridine-cytidine kinase-like 1 (329-338)
gagaccagccgcgacgaguucaucuucuac

SEQ ID NO: 43912 - RNA, 54 nt, Artificial Sequence
  UPF0606 protein KIAA1549 (278-295)
gagaccacccuguuccucagcucccgcagccugaugccccagccgcugggcgac

SEQ ID NO: 43913 - RNA, 66 nt, Artificial Sequence
  ATP synthase subunit alpha, mitochondrial (339-360)
gagguggccgccuucgcgcaguucggcagcgaccuggacgccgccacccagcagcuccugucccgc

SEQ ID NO: 43914 - RNA, 27 nt, Artificial Sequence
  40S ribosomal protein S21 (38-46)
gagguggacaaggucaccggccgcuuc

SEQ ID NO: 43915 - RNA, 27 nt, Artificial Sequence
  Melanoma-associated antigen 4 (169-177)
gagguggaccccgccagcaacaccuac

SEQ ID NO: 43916 - RNA, 30 nt, Artificial Sequence
  Dystrophin (1633-1642)
gaggugggcgaggcccugaagaccguccuc

SEQ ID NO: 43917 - RNA, 48 nt, Artificial Sequence
  Filamin-A (1150-1165)
gaggugggccaguuccaggucgacugcagcuccgccgggagcgccgag

SEQ ID NO: 43918 - RNA, 57 nt, Artificial Sequence
  Titin (5338-5356)
gaggugggcagcuccagcugcgagaccaccuucacgguccuggaccgcgacaucgcc

SEQ ID NO: 43919 - RNA, 27 nt, Artificial Sequence
  Nucleosome assembly protein 1-like 4 (87-95)
gaggugcacgaccuggagcgcaaguac

SEQ ID NO: 43920 - RNA, 24 nt, Artificial Sequence
  Pseudouridylate synthase 7 homolog-like protein (87-94)
gaggugcacacccugaucaaguac

SEQ ID NO: 43921 - RNA, 30 nt, Artificial Sequence
  Midasin (595-604)
gaggugaucggcagcaagcugaacaucucc

SEQ ID NO: 43922 - RNA, 30 nt, Artificial Sequence
  Protein ZGRF1 (72-81)
gaggugaaggucgccggcgccaucgggauc

SEQ ID NO: 43923 - RNA, 30 nt, Artificial Sequence
  RNA-binding protein Nova-1 (277-286)
gaggugcugcccaccgccgccgcggccgcc

SEQ ID NO: 43924 - RNA, 30 nt, Artificial Sequence
  Hemicentin-1 (2987-2996)
gaggugagcggcuuccccccgcccgaccug

SEQ ID NO: 43925 - RNA, 21 nt, Artificial Sequence
  Basigin (49-55)
gaggugaccggccaccgcugg

SEQ ID NO: 43926 - RNA, 39 nt, Artificial Sequence
  Annexin A2 (53-65)
gaggugaccaucgucaacauccugaccaaccgcagcaac

SEQ ID NO: 43927 - RNA, 45 nt, Artificial Sequence
  Annexin A2 (53-67)
gaggugaccaucgucaacauccugaccaaccgcagcaacgcccag

SEQ ID NO: 43928 - RNA, 27 nt, Artificial Sequence
  Myotubularin (410-418)
gaguggaucagcuucggccacaaguuc

SEQ ID NO: 43929 - RNA, 27 nt, Artificial Sequence
  Zinc finger protein 317 (82-90)
gaguacgcccaccuguucgagguguuc

SEQ ID NO: 43930 - RNA, 27 nt, Artificial Sequence
  Lysophosphatidylcholine acyltransferase 2 (495-503)
gaguacgccaagaucuucaccaccuac

SEQ ID NO: 43931 - RNA, 30 nt, Artificial Sequence
  Meiosis arrest female protein 1 (1363-1372)
gaguacgccaagaccuucggcuacaccuuc

SEQ ID NO: 43932 - RNA, 27 nt, Artificial Sequence
  Tyrosine-protein kinase Fer (41-49)
gaguacgccagcacccugcagaaccuc

SEQ ID NO: 43933 - RNA, 27 nt, Artificial Sequence
  Origin recognition complex subunit 3 (309-317)
gaguacgccagcgugcugcagcuccug

SEQ ID NO: 43934 - RNA, 27 nt, Artificial Sequence
  Gamma-tubulin complex component 2 (312-320)
gaguacggccaggugaaccacgcccug

SEQ ID NO: 43935 - RNA, 27 nt, Artificial Sequence
  Nuclear pore complex protein Nup214 (115-123)
gaguacggcagcaucaucgccuucuuc

SEQ ID NO: 43936 - RNA, 27 nt, Artificial Sequence
  GDH/6PGL endoplasmic bifunctional protein (267-275)
gaguacggcgugauccgcgacguccug

SEQ ID NO: 43937 - RNA, 27 nt, Artificial Sequence
  Probable ATP-dependent RNA helicase DDX52 (539-547)
gaguacaucaagggcuuccagaagcug

SEQ ID NO: 43938 - RNA, 27 nt, Artificial Sequence
  Myotubularin (566-574)
gaguacaucaagcgccuggaggagcuc

SEQ ID NO: 43939 - RNA, 27 nt, Artificial Sequence
  Probable ATP-dependent RNA helicase DDX60-like (1185-1193)
gaguacaucaacuuccuggagaaccuc

SEQ ID NO: 43940 - RNA, 33 nt, Artificial Sequence
  Aspartate aminotransferase, mitochondrial (95-105)
gaguaccugcccaucggcgggcucgccgaguuc

SEQ ID NO: 43941 - RNA, 27 nt, Artificial Sequence
  Phosphatidylinositol-glycan biosynthesis class W protein (124-132)
gaguacaaccccgccaucagcugcuuc

SEQ ID NO: 43942 - RNA, 27 nt, Artificial Sequence
  Lysosomal protective protein (111-119)
gaguacaaccccuacagcuggaaccug

SEQ ID NO: 43943 - RNA, 27 nt, Artificial Sequence
  Dolichyl-diphosphooligosaccharide-proteinosyltransferase 48 kDa subunit (332-340)
gaguacagcaucgugauccagcagcug

SEQ ID NO: 43944 - RNA, 27 nt, Artificial Sequence
  MAU2 chromatid cohesion factor homolog (89-97)
gaguacacccgcgcccuguuccuccug

SEQ ID NO: 43945 - RNA, 27 nt, Artificial Sequence
  FERM, RhoGEF and pleckstrin domain-containing protein 2 (134-142)
gaguacacccgcuaccuguucgcccuc

SEQ ID NO: 43946 - RNA, 27 nt, Artificial Sequence
  Dual specificity protein kinase CLK3 (343-351)
gaguacuaccgcggcuucacccuguuc

SEQ ID NO: 43947 - RNA, 24 nt, Artificial Sequence
  Nuclear receptor corepressor 2 (1025-1032)
uucgccgccgaggcgcagaagcug

SEQ ID NO: 43948 - RNA, 24 nt, Artificial Sequence
  UDP-N-acetylglucosamine-peptide N-acetylglucosaminyltransferase 110 kDa subunit (428-435)
uucgccgacgcccacagcaaccug

SEQ ID NO: 43949 - RNA, 27 nt, Artificial Sequence
  Catenin alpha-2 (110-118)
uucgccgacgaccccugcagcuccgug

SEQ ID NO: 43950 - RNA, 27 nt, Artificial Sequence
  Zinc finger MYM-type protein 1 (482-490)
uucgccgacgagcugagccaccuccug

SEQ ID NO: 43951 - RNA, 30 nt, Artificial Sequence
  E3 ubiquitin-protein ligase UBR4 (495-504)
uucgccgacaaggagacccugauccaguuc

SEQ ID NO: 43952 - RNA, 30 nt, Artificial Sequence
  Histone-lysine N-methyltransferase SETDB1 (995-1004)
uucgccgacagcgacucccacagcuccuuc

SEQ ID NO: 43953 - RNA, 30 nt, Artificial Sequence
  Staphylococcal nuclease domain-containing protein 1 (819-828)
uucgccgacagcaagggcgacguggggcug

SEQ ID NO: 43954 - RNA, 27 nt, Artificial Sequence
  Frizzled-1 (386-394)
uucgccgaggacggcgcccgcaccgug

SEQ ID NO: 43955 - RNA, 39 nt, Artificial Sequence
  Amyloid beta A4 protein (18-30)
uucgccgaggacgugggcagcaacaagggggccaucauc

SEQ ID NO: 43956 - RNA, 42 nt, Artificial Sequence
  Amyloid beta A4 protein (20-33)
uucgccgaggacgugggcagcaacaagggggccaucaucggc

SEQ ID NO: 43957 - RNA, 27 nt, Artificial Sequence
  Centromere protein F (1090-1098)
uucgccgaggagcgcaaccagaaccug

SEQ ID NO: 43958 - RNA, 24 nt, Artificial Sequence
  Superkiller viralicidic activity 2-like 2 (1024-1031)
uucgccgagggcaucaccaagauc

SEQ ID NO: 43959 - RNA, 27 nt, Artificial Sequence
  ATP-binding cassette sub-family C member 11 (241-249)
uucgccuucgagaagcugauccaguuc

SEQ ID NO: 43960 - RNA, 27 nt, Artificial Sequence
  Arf-GAP with SH3 domain, ANK repeat and PH domain-containing protein 3 (673-681)
uucgccuucccccugcacguggacuac

SEQ ID NO: 43961 - RNA, 24 nt, Artificial Sequence
  Filamin-A (333-340)
uucgccggccagcacaucgccaag

SEQ ID NO: 43962 - RNA, 27 nt, Artificial Sequence
  Elongation factor 1-gamma (198-206)
uucgcccaccugcccaagagcaccuuc

SEQ ID NO: 43963 - RNA, 27 nt, Artificial Sequence
  Nuclear pore complex protein Nup85 (365-373)
uucgcccaccccagccuguggcagcuc

SEQ ID NO: 43964 - RNA, 36 nt, Artificial Sequence
  Moesin (18-29)
uucgccauccagcccaacaccaccggcaagcagcug

SEQ ID NO: 43965 - RNA, 27 nt, Artificial Sequence
  Sodium-dependent phosphate transport protein 2C (387-395)
uucgcccugcagagcuccagcguguuc

SEQ ID NO: 43966 - RNA, 45 nt, Artificial Sequence
  Cytochrome c oxidase subunit 7C, mitochondrial (49-63)
uucgccacccccuuccuggugguccgccaccagcuccugaagacc

SEQ ID NO: 43967 - RNA, 36 nt, Artificial Sequence
  Beta-secretase 2 (116-127)
uucgccguggccggcaccccccacagcuacaucgac

SEQ ID NO: 43968 - RNA, 27 nt, Artificial Sequence
  Protein FAM179B (1301-1309)
uucgccgugguccaggaggugaagaac

SEQ ID NO: 43969 - RNA, 24 nt, Artificial Sequence
  WD repeat-containing protein 35 (933-940)
uucgacgccgccaagcugauguuc

SEQ ID NO: 43970 - RNA, 21 nt, Artificial Sequence
  Synemin (38-44)
uucgacaagaaggugcagcug

SEQ ID NO: 43971 - RNA, 24 nt, Artificial Sequence
  Protein SET (138-145)
uucgaggacaucaagagcggcuac

SEQ ID NO: 43972 - RNA, 42 nt, Artificial Sequence
  ATP synthase-coupling factor 6, mitochondrial (95-108)
uucgaggaccccaaguucgaggugaucgagaagccgcaggcc

SEQ ID NO: 43973 - RNA, 42 nt, Artificial Sequence
  Cytochrome c oxidase subunit 6C (62-75)
uucgaggagaugcgcaaggccggcaucuuccagagcgugaag

SEQ ID NO: 43974 - RNA, 21 nt, Artificial Sequence
  Myotubularin-related protein 13 (1490-1496)
uucgaguucaaccuguacuac

SEQ ID NO: 43975 - RNA, 33 nt, Artificial Sequence
  FACT complex subunit SSRP1 (391-401)
uucgagaucgagaccaagcagggcacccaguac

SEQ ID NO: 43976 - RNA, 27 nt, Artificial Sequence
  Myosin-9 (456-464)
uucgagaucuucgaccugaacagcuuc

SEQ ID NO: 43977 - RNA, 24 nt, Artificial Sequence
  F-box/LRR-repeat protein 5 (75-82)
uucgagaagggccugaagaacgug

SEQ ID NO: 43978 - RNA, 27 nt, Artificial Sequence
  Integrin beta-5 (536-544)
uucgagagcgaguucggcaagaucuac

SEQ ID NO: 43979 - RNA, 21 nt, Artificial Sequence
  Small subunit processome component 20 homolog (1420-1426)
uucgagagcggccugaaguac

SEQ ID NO: 43980 - RNA, 27 nt, Artificial Sequence
  ATP synthase-coupling factor 6, mitochondrial (100-108)
uucgaggugaucgagaagccccaggcc

SEQ ID NO: 43981 - RNA, 30 nt, Artificial Sequence
  Nuclear pore membraneoprotein 210 (396-405)
uucuucgaggugcugagcuccagccagaac

SEQ ID NO: 43982 - RNA, 27 nt, Artificial Sequence
  Dynein heavy chain 10, axonemal (148-156)
uucuucuucaucagcgacgacgagcug

SEQ ID NO: 43983 - RNA, 18 nt, Artificial Sequence
  FACT complex subunit SSRP1 (88-93)
uucuucaagacccacuac

SEQ ID NO: 43984 - RNA, 27 nt, Artificial Sequence
  Sterol regulatory element-binding protein 2 (769-777)
uucuucauggagcgcagcugguccgug

SEQ ID NO: 43985 - RNA, 27 nt, Artificial Sequence
  L-dopachrome tautomerase (339-347)
uucuuccagaacagcaccuucuccuuc

SEQ ID NO: 43986 - RNA, 21 nt, Artificial Sequence
  Protein MCM10 homolog (335-341)
uucggcgaggugcacaaggcc

SEQ ID NO: 43987 - RNA, 27 nt, Artificial Sequence
  Dynein light chain 4, axonemal (77-85)
uucggcuucgagaucacccacgaggug

SEQ ID NO: 43988 - RNA, 27 nt, Artificial Sequence
  Myelin basic protein (46-54)
uucggcggggaccgcggcgcccccaag

SEQ ID NO: 43989 - RNA, 87 nt, Artificial Sequence
  Keratin, type I cytoskeletal 9 (90-118)
uucggcgggggcagccgcggguucggcggggccuccggcggcggguacagcuccagcggcggguucggcgggggcuucggcgggggc

SEQ ID NO: 43990 - RNA, 24 nt, Artificial Sequence
  Oxysterol-binding protein-related protein 1 (367-374)
uucggcaaggagcugcacaaggug

SEQ ID NO: 43991 - RNA, 27 nt, Artificial Sequence
  Cyclin-dependent kinase 3 (146-154)
uucggccuggcccgcgccuucggggug

SEQ ID NO: 43992 - RNA, 48 nt, Artificial Sequence
  Pyruvate kinase PKM (157-172)
uucggcguggagcaggacgucgacaugguguucgccagcuucauccgc

SEQ ID NO: 43993 - RNA, 33 nt, Artificial Sequence
  AP-2 complex subunit beta (776-786)
uucggcgugauccccagcaccccgcuggccauc

SEQ ID NO: 43994 - RNA, 30 nt, Artificial Sequence
  Myelin basic protein (152-161)
uucggcuacgggggccgcgccagcgacuac

SEQ ID NO: 43995 - RNA, 48 nt, Artificial Sequence
  Cytochrome c oxidase subunit 6A1, mitochondrial (71-86)
uuccacaacccccacgugaacccgcugcccaccggcuacgaggacgag

SEQ ID NO: 43996 - RNA, 18 nt, Artificial Sequence
  Large proline-rich protein BAG6 (789-794)
uuccaccagcacuaccug

SEQ ID NO: 43997 - RNA, 27 nt, Artificial Sequence
  Transformation/transcription domain-associated protein (280-288)
uucaucgccgcccagaucaagacccug

SEQ ID NO: 43998 - RNA, 30 nt, Artificial Sequence
  Vitamin K-dependent gamma-carboxylase (474-483)
uucaucgccgacuuccccggccugcaccuc

SEQ ID NO: 43999 - RNA, 27 nt, Artificial Sequence
  Ubiquitin carboxyl-terminal hydrolase 7 (183-191)
uucaucgacgacgacaaggugaccuuc

SEQ ID NO: 44000 - RNA, 27 nt, Artificial Sequence
  Histone-lysine N-methyltransferase SETDB1 (43-51)
uucaucgacgaggagcuggagaagaug

SEQ ID NO: 44001 - RNA, 27 nt, Artificial Sequence
  Dolichyl-diphosphooligosaccharide-proteinosyltransferase 48 kDa subunit (119-127)
uucaucgacggcgggggcagcgugcug

SEQ ID NO: 44002 - RNA, 30 nt, Artificial Sequence
  Dolichyl-diphosphooligosaccharide-proteinosyltransferase 48 kDa subunit (119-128)
uucaucgacggcgggggcagcgugcugguc

SEQ ID NO: 44003 - RNA, 27 nt, Artificial Sequence
  Nck-associated protein 1 (400-408)
uucaucgacaagcacaucgccgagcug

SEQ ID NO: 44004 - RNA, 27 nt, Artificial Sequence
  ATP-dependent RNA helicase DDX19B (230-238)
uucaucgaccccaagaagaucaaggug

SEQ ID NO: 44005 - RNA, 27 nt, Artificial Sequence
  BTB/POZ domain-containing protein KCTD15 (102-110)
uucaucgaccgcgacggcgagaucuuc

SEQ ID NO: 44006 - RNA, 78 nt, Artificial Sequence
  Tubulin beta chain (387-412)
uucaucggcaacagcaccgccauccaggagcuguucaagcgcaucuccgagcaguucaccgccauguuccggcgcaag

SEQ ID NO: 44007 - RNA, 27 nt, Artificial Sequence
  Receptor-type protein tyrosine phosphatase beta (1317-1325)
uucauccacgacacccugguggaggcc

SEQ ID NO: 44008 - RNA, 27 nt, Artificial Sequence
  Kelch-like protein 7 (120-128)
uucauccaccagcacuucaccgaggug

SEQ ID NO: 44009 - RNA, 27 nt, Artificial Sequence
  Kelch-like protein 18 (97-105)
uucauccaccagcacuucguggagguc

SEQ ID NO: 44010 - RNA, 27 nt, Artificial Sequence
  Myotubularin-related protein 13 (272-280)
uucaucaucggcgugcacagcgucuuc

SEQ ID NO: 44011 - RNA, 27 nt, Artificial Sequence
  LisH domain-containing protein ARMC9 (551-559)
uucaucaaggagggcaacgccgagaug

SEQ ID NO: 44012 - RNA, 27 nt, Artificial Sequence
  Importin-5 (200-208)
uucauccuggccaacgagcacaacgug

SEQ ID NO: 44013 - RNA, 27 nt, Artificial Sequence
  WD repeat and FYVE domain-containing protein 3 (419-427)
uucauccuggagagccagcacacccuc

SEQ ID NO: 44014 - RNA, 27 nt, Artificial Sequence
  Cyclin-related protein FAM58A (33-41)
uucaucauggaggccggcgugaagcug

SEQ ID NO: 44015 - RNA, 27 nt, Artificial Sequence
  Protein EFR3 homolog A (468-476)
uucaucaugggcaaggugcccgucuuc

SEQ ID NO: 44016 - RNA, 27 nt, Artificial Sequence
  Translocated to HRX in t(11,19) leukemia (81-89)
uucaucaugcccaucgaggugcacuuc

SEQ ID NO: 44017 - RNA, 18 nt, Artificial Sequence
  Endoplasmic reticulum metallopeptidase 1 (110-115)
uucaucaacuucaucuac

SEQ ID NO: 44018 - RNA, 30 nt, Artificial Sequence
  Sacsin (114-123)
uucaucaacggcaacuuccccgggaccuuc

SEQ ID NO: 44019 - RNA, 27 nt, Artificial Sequence
  Tripartite motif-containing protein 2 (185-193)
uucaucagcgagaucauccaccagcug

SEQ ID NO: 44020 - RNA, 27 nt, Artificial Sequence
  Protein TANC1 (603-611)
uucaucaccaagaucaucagcaaguuc

SEQ ID NO: 44021 - RNA, 21 nt, Artificial Sequence
  Gelsolin (365-371)
uucaucaccaagauggacuac

SEQ ID NO: 44022 - RNA, 27 nt, Artificial Sequence
  Calcium/calmodulin-dependent 3',5'-cyclic nucleotide phosphodiesterase 1C (433-441)
uucaucguggagcccaccuucaccguc

SEQ ID NO: 44023 - RNA, 30 nt, Artificial Sequence
  Dopamine D4 receptor (72-81)
uucaucgugagccuggccgccgcggaccuc

SEQ ID NO: 44024 - RNA, 27 nt, Artificial Sequence
  Regulatory-associated protein of mTOR (277-285)
uucaucugggccaagauccuggccgug

SEQ ID NO: 44025 - RNA, 27 nt, Artificial Sequence
  Unconventional myosin-X (583-591)
uucaucuacgaccuguucgagcacgug

SEQ ID NO: 44026 - RNA, 30 nt, Artificial Sequence
  Cullin-4B (578-587)
uucaucuacggcaaggacguguucgaggcc

SEQ ID NO: 44027 - RNA, 39 nt, Artificial Sequence
  Cytochrome c oxidase subunit 7A2, mitochondrial (24-36)
uucaagaacaaggugcccgagaagcagaagcuguuccag

SEQ ID NO: 44028 - RNA, 84 nt, Artificial Sequence
  Cytochrome c oxidase subunit 7A2, mitochondrial (24-51)
uucaagaacaaggugcccgagaagcagaagcuguuccaggaggacgacgagaucccgcucuaccugaagggcggggucgccgac

SEQ ID NO: 44029 - RNA, 180 nt, Artificial Sequence
  Cytochrome c oxidase subunit 7A2, mitochondrial (24-83)
uucaagaacaaggugcccgagaagcagaagcuguuccaggaggacgacgagaucccgcucuaccugaagggcggggucgccgacgcccugcucuaccgcgcgaccaugauccugaccgugggcgggacggccuacgccaucuacgagcuggccguggccagcuuccccaagaagcaggag

SEQ ID NO: 44030 - RNA, 21 nt, Artificial Sequence
  Histone deacetylase 1 (241-247)
uucaagcccgugaugagcaag

SEQ ID NO: 44031 - RNA, 21 nt, Artificial Sequence
  Protein kinase C-binding protein 1 (213-219)
uuccuggccgacgccaagugg

SEQ ID NO: 44032 - RNA, 30 nt, Artificial Sequence
  Methionine-tRNA ligase, cytoplasmic (395-404)
uuccuggccgaccgcuucguggagggcguc

SEQ ID NO: 44033 - RNA, 30 nt, Artificial Sequence
  Ras GTPase-activating-like protein IQGAP3 (868-877)
uuccuggccgaggccgagcuccugaagcug

SEQ ID NO: 44034 - RNA, 30 nt, Artificial Sequence
  Protein sel-1 homolog 1 (366-375)
uuccuggccgagaagggcgacgugcaggcc

SEQ ID NO: 44035 - RNA, 27 nt, Artificial Sequence
  H(+)/Cl(-) exchange transporter 3 (206-214)
uuccuggccgugagccucgucaaggug

SEQ ID NO: 44036 - RNA, 27 nt, Artificial Sequence
  Sodium/potassium-transporting ATPase subunit alpha-1 (28-36)
uuccuggccuacagcauccaggccgcg

SEQ ID NO: 44037 - RNA, 24 nt, Artificial Sequence
  B-cell receptor-associated protein 29 (63-70)
uuccuggacgccgugcgcgagguc

SEQ ID NO: 44038 - RNA, 27 nt, Artificial Sequence
  Cytoplasmic dynein 2 heavy chain 1 (42-50)
uuccuggacgacggcaaccagaugcuc

SEQ ID NO: 44039 - RNA, 27 nt, Artificial Sequence
  Guanine nucleotide-binding protein G(I)/G(S)/G(T) subunit beta-2 (151-159)
uuccuggacgacaaccagaucaucacc

SEQ ID NO: 44040 - RNA, 27 nt, Artificial Sequence
  Polycystin-1 (3400-3408)
uuccuggacgacagcaagucccucgug

SEQ ID NO: 44041 - RNA, 27 nt, Artificial Sequence
  Guanine nucleotide-binding protein subunit beta-4 (151-159)
uuccuggacgacagccagaucgugacc

SEQ ID NO: 44042 - RNA, 27 nt, Artificial Sequence
  F-box only protein 32 (25-33)
uuccuggacgagaagagcggcuccuuc

SEQ ID NO: 44043 - RNA, 30 nt, Artificial Sequence
  F-box only protein 32 (25-34)
uuccuggacgagaagagcggcuccuucgug

SEQ ID NO: 44044 - RNA, 24 nt, Artificial Sequence
  Dipeptidyl peptidase 8 (72-79)
uuccuggacgagaacgugcacuuc

SEQ ID NO: 44045 - RNA, 27 nt, Artificial Sequence
  Ubiquitin-like-conjugating enzyme ATG10 (117-125)
uuccuggacggccgcccccucacccug

SEQ ID NO: 44046 - RNA, 27 nt, Artificial Sequence
  Mediator of RNA polymerase II transcription subunit 18 (51-59)
uuccuggaccacgagaugguguuccuc

SEQ ID NO: 44047 - RNA, 24 nt, Artificial Sequence
  Protein SMG8 (484-491)
uuccuggacaucgacaccaaguuc

SEQ ID NO: 44048 - RNA, 27 nt, Artificial Sequence
  Unconventional myosin-Ic (523-531)
uuccuggacaagaacaacgaccuccug

SEQ ID NO: 44049 - RNA, 27 nt, Artificial Sequence
  Sterol regulatory element-binding protein cleavage-activating protein (641-649)
uuccuggacaagcgcaucguggccgcc

SEQ ID NO: 44050 - RNA, 27 nt, Artificial Sequence
  Major facilitator superfamily domain-containing protein 12 (410-418)
uuccuggacaagguggccaacggccuc

SEQ ID NO: 44051 - RNA, 24 nt, Artificial Sequence
  Putative bifunctional UDP-N-acetylglucosamine transferase and deubiquitinase ALG13 (156-163)
uuccuggacaagguggucggccuc

SEQ ID NO: 44052 - RNA, 24 nt, Artificial Sequence
  Formin-1 (471-478)
uuccuggaccucccccacaaggug

SEQ ID NO: 44053 - RNA, 27 nt, Artificial Sequence
  Group XV phospholipase A2 (126-134)
uuccuggaccccagcaaguccagcgug

SEQ ID NO: 44054 - RNA, 24 nt, Artificial Sequence
  Glycogen phosphorylase, muscle form (144-151)
uuccuggacagcauggccacccuc

SEQ ID NO: 44055 - RNA, 27 nt, Artificial Sequence
  Basic leucine zipper and W2 domain-containing protein 2 (51-59)
uuccuggacagcaccggcucccgccuc

SEQ ID NO: 44056 - RNA, 27 nt, Artificial Sequence
  Tuftelin-interacting protein 11 (507-515)
uuccuggacagcugggugcacaucauc

SEQ ID NO: 44057 - RNA, 30 nt, Artificial Sequence
  Sulfate transporter (658-667)
uuccuggacaccgccggcauccacacccuc

SEQ ID NO: 44058 - RNA, 27 nt, Artificial Sequence
  Protein naked cuticle homolog 1 (320-328)
uuccuggacacccccaucgccaaggug

SEQ ID NO: 44059 - RNA, 27 nt, Artificial Sequence
  Protein S100-A1 (45-53)
uuccuggacgugaaggagcucaugcug

SEQ ID NO: 44060 - RNA, 27 nt, Artificial Sequence
  Electron transfer flavoprotein subunit beta (232-240)
uuccuggacuggccccagggcaccuuc

SEQ ID NO: 44061 - RNA, 27 nt, Artificial Sequence
  A-kinase anchor protein 9 (882-890)
uuccuggaggagcgcagcgugcuccug

SEQ ID NO: 44062 - RNA, 27 nt, Artificial Sequence
  Paraneoplastic antigen Ma2 (107-115)
uuccuggagaaggagggccagaccgug

SEQ ID NO: 44063 - RNA, 27 nt, Artificial Sequence
  Nitric oxide synthase-interacting protein (114-122)
uuccuggagaaggagagcgccaucgug

SEQ ID NO: 44064 - RNA, 30 nt, Artificial Sequence
  Cytochrome c oxidase subunit 2 (127-136)
uuccuggagcccggcgaccuccgccugcug

SEQ ID NO: 44065 - RNA, 21 nt, Artificial Sequence
  Calnexin (139-145)
uuccuguucgacaccaagccc

SEQ ID NO: 44066 - RNA, 27 nt, Artificial Sequence
  Transmembrane protein 97 (118-126)
uuccuguucgaggacuucagcaaggcc

SEQ ID NO: 44067 - RNA, 27 nt, Artificial Sequence
  Melanoma-associated antigen 11 (321-329)
uuccuguucggcgagcccaagcgccuc

SEQ ID NO: 44068 - RNA, 27 nt, Artificial Sequence
  Transmembrane protein 106B (155-163)
uuccuguucccccgcagcaucgacgug

SEQ ID NO: 44069 - RNA, 27 nt, Artificial Sequence
  Hephaestin (680-688)
uuccuguucagcaaccucccccgccug

SEQ ID NO: 44070 - RNA, 27 nt, Artificial Sequence
  Unconventional myosin-Ib (362-370)
uuccuguucagcuccgaccaccucauc

SEQ ID NO: 44071 - RNA, 24 nt, Artificial Sequence
  POU domain, class 2, transcription factor 1 (70-77)
uuccugggccaccuccaccaggug

SEQ ID NO: 44072 - RNA, 27 nt, Artificial Sequence
  Glutathione S-transferase Mu 4 (141-149)
uuccugggcaagcgccccugguucgug

SEQ ID NO: 44073 - RNA, 27 nt, Artificial Sequence
  Maltase-glucoamylase, intestinal (1217-1225)
uuccugggccccaccccggagcucgug

SEQ ID NO: 44074 - RNA, 27 nt, Artificial Sequence
  Asparagine synthetase (glutamine-hydrolyzing) (51-59)
uuccugggccgcgacaccuacggggug

SEQ ID NO: 44075 - RNA, 27 nt, Artificial Sequence
  Ras GTPase-activating protein 1 (583-591)
uuccugcacgagaagcucgagagccug

SEQ ID NO: 44076 - RNA, 27 nt, Artificial Sequence
  Kelch domain-containing protein 8B (171-179)
uuccugcacggcaacaagaucuacgug

SEQ ID NO: 44077 - RNA, 30 nt, Artificial Sequence
  VWFA and cache domain-containing protein 1 (212-221)
uuccugaucgacgacaagggcuacacccuc

SEQ ID NO: 44078 - RNA, 30 nt, Artificial Sequence
  Adenylate kinase isoenzyme 5 (224-233)
uuccugaucgacggcuacccccgcgaggug

SEQ ID NO: 44079 - RNA, 27 nt, Artificial Sequence
  BTB/POZ domain-containing protein KCTD9 (136-144)
uuccugaucgaccgcagccccgaguac

SEQ ID NO: 44080 - RNA, 30 nt, Artificial Sequence
  Tensin-2 (1202-1211)
uuccugaucgagaccggccccaagggggug

SEQ ID NO: 44081 - RNA, 27 nt, Artificial Sequence
  Protein phosphatase 1 regulatory subunit 12A (37-45)
uuccugaucggccagggggcccacgug

SEQ ID NO: 44082 - RNA, 27 nt, Artificial Sequence
  Proline-rich protein 12 (641-649)
uuccugauccagcaccuccugcaggcc

SEQ ID NO: 44083 - RNA, 33 nt, Artificial Sequence
  Protein FAM73A (567-577)
uuccugaaggacaucuucgacuucgagaaggug

SEQ ID NO: 44084 - RNA, 27 nt, Artificial Sequence
  Catenin alpha-1 (85-93)
uuccugaaggaggagcucguggccgcc

SEQ ID NO: 44085 - RNA, 27 nt, Artificial Sequence
  Threonylcarbamoyladenosine tRNA methylthiotransferase (278-286)
uuccugaaggagaaggugcccggcauc

SEQ ID NO: 44086 - RNA, 27 nt, Artificial Sequence
  Ankyrin-3 (171-179)
uuccugcucgaccacggcgccagccug

SEQ ID NO: 44087 - RNA, 30 nt, Artificial Sequence
  DNA-binding protein RFX7 (684-693)
uuccugcucgacagcgacuccaagagcgug

SEQ ID NO: 44088 - RNA, 30 nt, Artificial Sequence
  Protein TANC2 (96-105)
uuccugcucggcgagaaggugaccgagguc

SEQ ID NO: 44089 - RNA, 27 nt, Artificial Sequence
  Transmembrane emp24 domain-containing protein 10 (22-30)
uuccugcucggcccccgccuggugcug

SEQ ID NO: 44090 - RNA, 27 nt, Artificial Sequence
  TBC1 domain family member 8B (190-198)
uuccugcucggcagcgagaucaagcug

SEQ ID NO: 44091 - RNA, 27 nt, Artificial Sequence
  Intraflagellar transport protein 56 (385-393)
uuccugcucauccagagcgagaagaug

SEQ ID NO: 44092 - RNA, 30 nt, Artificial Sequence
  Peptidyl-prolyl cis-trans isomerase B (15-24)
uuccugcuccugcccggcccgagcgccgcc

SEQ ID NO: 44093 - RNA, 27 nt, Artificial Sequence
  G-protein coupled receptor 56 (460-468)
uuccugcucagcgagcccguggcccug

SEQ ID NO: 44094 - RNA, 27 nt, Artificial Sequence
  Huntingtin (694-702)
uuccugcucaccggcgggaagaacgug

SEQ ID NO: 44095 - RNA, 36 nt, Artificial Sequence
  Protocadherin Fat 3 (2442-2453)
uuccugauggacagcaaguccggcgugaucacccuc

SEQ ID NO: 44096 - RNA, 27 nt, Artificial Sequence
  Cortactin-binding protein 2 (1244-1252)
uuccugaugggcaccaucgccaaggcc

SEQ ID NO: 44097 - RNA, 33 nt, Artificial Sequence
  5,6-dihydroxyindole-2-carboxylic acid oxidase (383-393)
uuccugaacggcaccgggggccagacccaccuc

SEQ ID NO: 44098 - RNA, 27 nt, Artificial Sequence
  Multidrug and toxin extrusion protein 1 (134-142)
uuccugaacacccagcacauccuccug

SEQ ID NO: 44099 - RNA, 27 nt, Artificial Sequence
  Peroxisome biogenesis factor 1 (613-621)
uuccugcccgccagccuccgcuccgug

SEQ ID NO: 44100 - RNA, 27 nt, Artificial Sequence
  Paired amphipathic helix protein Sin3a (379-387)
uuccugcccgacgccaacagcuccgug

SEQ ID NO: 44101 - RNA, 36 nt, Artificial Sequence
  Eukaryotic translation initiation factor 4 gamma 1 (1367-1378)
uuccugcccgagggccaggacaucggggccuucgug

SEQ ID NO: 44102 - RNA, 27 nt, Artificial Sequence
  NADH dehydrogenase (ubiquinone) 1 alpha subcomplex subunit 9, mitochondrial (286-294)
uuccugcccuucccgcucccccuguuc

SEQ ID NO: 44103 - RNA, 27 nt, Artificial Sequence
  Mitochondrial dynamics protein MID51 (470-478)
uuccugccccgccaggcccuccuguuc

SEQ ID NO: 44104 - RNA, 30 nt, Artificial Sequence
  Ubiquitin carboxyl-terminal hydrolase 19 (742-751)
uuccugcccagccacucccucgacaccgug

SEQ ID NO: 44105 - RNA, 27 nt, Artificial Sequence
  Peroxisomal acyl-coenzyme A oxidase 1 (107-115)
uuccugcccacccuccugcaccaggcc

SEQ ID NO: 44106 - RNA, 30 nt, Artificial Sequence
  ATP-binding cassette sub-family C member 11 (455-464)
uuccugcaggagagccccguguucuacguc

SEQ ID NO: 44107 - RNA, 27 nt, Artificial Sequence
  Hemicentin-1 (2534-2542)
uuccugcagaucaccaacgugcagguc

SEQ ID NO: 44108 - RNA, 27 nt, Artificial Sequence
  Protocadherin gamma-A12 (749-757)
uuccugcagaccuacagccacgaggug

SEQ ID NO: 44109 - RNA, 27 nt, Artificial Sequence
  Melanocyte protein PMEL (239-247)
uuccugcgcaaccagccccucaccuuc

SEQ ID NO: 44110 - RNA, 33 nt, Artificial Sequence
  Hemoglobin subunit alpha (5-15)
uuccugagcuuccccaccaccaagacguacuuc

SEQ ID NO: 44111 - RNA, 27 nt, Artificial Sequence
  Insulin receptor substrate 2 (1325-1333)
uuccugagccaccaccucaaggaggcc

SEQ ID NO: 44112 - RNA, 27 nt, Artificial Sequence
  Tensin-3 (1065-1073)
uuccugagccacaacuuccucaccgug

SEQ ID NO: 44113 - RNA, 27 nt, Artificial Sequence
  Protein capicua homolog (1061-1069)
uuccugagcaucaugucccccgagauc

SEQ ID NO: 44114 - RNA, 33 nt, Artificial Sequence
  Vitamin K-dependent protein S (26-36)
uuccugagcaagcagcaggccucccaggugcuc

SEQ ID NO: 44115 - RNA, 36 nt, Artificial Sequence
  Vitamin K-dependent protein S (26-37)
uuccugagcaagcagcaggccucccaggugcucguc

SEQ ID NO: 44116 - RNA, 24 nt, Artificial Sequence
  mRNA-decapping enzyme 1A (523-530)
uuccugagcacccuccacgaggug

SEQ ID NO: 44117 - RNA, 27 nt, Artificial Sequence
  Lysosomal-trafficking regulator (12-20)
uuccugaccgacgugaaccgccucugc

SEQ ID NO: 44118 - RNA, 30 nt, Artificial Sequence
  L-dopachrome tautomerase (52-61)
uuccugaccagcgaccagcucggcuacucc

SEQ ID NO: 44119 - RNA, 33 nt, Artificial Sequence
  L-dopachrome tautomerase (52-62)
uuccugaccagcgaccagcucggcuacuccuac

SEQ ID NO: 44120 - RNA, 27 nt, Artificial Sequence
  Bifunctional glutamate/proline-tRNA ligase (1167-1175)
uuccuguggcaggagggccacagcgcc

SEQ ID NO: 44121 - RNA, 27 nt, Artificial Sequence
  Fatty acyl-CoA reductase 1 (362-370)
uuccuguacgacaucuaccuccgcaug

SEQ ID NO: 44122 - RNA, 27 nt, Artificial Sequence
  Tetratricopeptide repeat protein 17 (740-748)
uuccuguacaacaucaccagcuccgug

SEQ ID NO: 44123 - RNA, 27 nt, Artificial Sequence
  Chromodomain-helicase-DNA-binding protein 1-like (358-366)
uuccuguacagcggcgggcaccgcgug

SEQ ID NO: 44124 - RNA, 27 nt, Artificial Sequence
  Ropporin-1A (163-171)
uuccuguacaccuacaucgccaaggug

SEQ ID NO: 44125 - RNA, 27 nt, Artificial Sequence
  Histone deacetylase 11 (141-149)
uucauggacgacaagcgcguguacauc

SEQ ID NO: 44126 - RNA, 27 nt, Artificial Sequence
  Pre-mRNA-processing-splicing factor 8 (1561-1569)
uucaugcacggcaagauccccacccug

SEQ ID NO: 44127 - RNA, 27 nt, Artificial Sequence
  Maltase-glucoamylase (551-559)
uucaugaacaaccgcagcuucauccug

SEQ ID NO: 44128 - RNA, 27 nt, Artificial Sequence
  Adenosine 3'-phospho 5'-phosphosulfate transporter 1 (49-57)
uucauggugcccggcuaccugcucguc

SEQ ID NO: 44129 - RNA, 27 nt, Artificial Sequence
  DNA-directed RNA polymerase II subunit RPB1 (1247-1255)
uucaacgacgacaacgccgagaagcug

SEQ ID NO: 44130 - RNA, 27 nt, Artificial Sequence
  Tumor susceptibility gene 101 protein (44-52)
uucaacgacggcagcucccgcgagcug

SEQ ID NO: 44131 - RNA, 27 nt, Artificial Sequence
  Amyloid-like protein 2 (10-18)
uucaacggcaacgggaagaucaacgug

SEQ ID NO: 44132 - RNA, 21 nt, Artificial Sequence
  Cytoplasmic FMR1-interacting protein 1 (472-478)
uucaaccacgccauccgccac

SEQ ID NO: 44133 - RNA, 30 nt, Artificial Sequence
  WD repeat-containing protein 19 (187-196)
uuccccgacccgaacggcacccgccuggug

SEQ ID NO: 44134 - RNA, 24 nt, Artificial Sequence
  WD repeat-containing protein 6 (464-471)
uuccccggcaaggugcacagccug

SEQ ID NO: 44135 - RNA, 30 nt, Artificial Sequence
  Collagen alpha-1(VIII) chain (279-288)
uuccccggcccgcaggggccccugggcaag

SEQ ID NO: 44136 - RNA, 24 nt, Artificial Sequence
  Proline and serine-rich protein 1 (159-166)
uuccccggcaccccgcugaagaag

SEQ ID NO: 44137 - RNA, 24 nt, Artificial Sequence
  Patatin-like phospholipase domain-containing protein 2 (454-461)
uuccccccggaggcccugcgcaug

SEQ ID NO: 44138 - RNA, 27 nt, Artificial Sequence
  Non-POU domain-containing octamer-binding protein (129-137)
uucccccgcccggugaccgucgagccc

SEQ ID NO: 44139 - RNA, 27 nt, Artificial Sequence
  Alpha-mannosidase 2x (42-50)
uucccccgcagccagaucuccgugcug

SEQ ID NO: 44140 - RNA, 30 nt, Artificial Sequence
  Transformation/transcription domain-associated protein (2223-2232)
uuccccaccgagccgagcaccuccagcgug

SEQ ID NO: 44141 - RNA, 27 nt, Artificial Sequence
  Protein 4.1 (223-231)
uuccccuggccgaaggugcugaagauc

SEQ ID NO: 44142 - RNA, 24 nt, Artificial Sequence
  DNA polymerase alpha catalytic subunit (594-601)
uuccccuacgccuucaaggaggug

SEQ ID NO: 44143 - RNA, 27 nt, Artificial Sequence
  DnaJ homolog subfamily C member 11 (314-322)
uuccaggacgacgaccagacccgcgug

SEQ ID NO: 44144 - RNA, 24 nt, Artificial Sequence
  Structural maintenance of chromosomes flexible hinge domain-containing protein 1 (1128-1135)
uuccaggacgaccacgugagccug

SEQ ID NO: 44145 - RNA, 27 nt, Artificial Sequence
  Serine/threonine-protein kinase MRCK alpha (144-152)
uuccaggacgacaacaaccuguaccuc

SEQ ID NO: 44146 - RNA, 27 nt, Artificial Sequence
  Zinc finger HIT domain-containing protein 1 (40-48)
uuccaggacgacccccacgccggccug

SEQ ID NO: 44147 - RNA, 27 nt, Artificial Sequence
  General transcription factor 3C polypeptide 1 (734-742)
uuccaggacaaggaccagguguucauc

SEQ ID NO: 44148 - RNA, 27 nt, Artificial Sequence
  Citron Rho-interacting kinase (164-172)
uuccaggacaagaaccaccuguaccuc

SEQ ID NO: 44149 - RNA, 27 nt, Artificial Sequence
  Protein PRR14L (1088-1096)
uuccaggaggacagccgcuccacccug

SEQ ID NO: 44150 - RNA, 24 nt, Artificial Sequence
  Plectin (2903-2910)
uuccagggcaagaccgugaccauc

SEQ ID NO: 44151 - RNA, 21 nt, Artificial Sequence
  Proteasome activator complex subunit 4 (789-795)
uuccagggcagccacaagcac

SEQ ID NO: 44152 - RNA, 27 nt, Artificial Sequence
  Heat shock 70 kDa protein 1B (21-29)
uuccagcacggcaagguggagaucauc

SEQ ID NO: 44153 - RNA, 27 nt, Artificial Sequence
  Spatacsin (332-340)
uuccagaucgaccgcagcuggaaggcc

SEQ ID NO: 44154 - RNA, 24 nt, Artificial Sequence
  Sodium/potassium-transporting ATPase subunit alpha-3 (948-955)
uuccagcagggcaugaagaacaag

SEQ ID NO: 44155 - RNA, 33 nt, Artificial Sequence
  Gamma-secretase C-terminal fragment 59 (565-575)
uuccgccacgacagcggcuacgaggugcaccac

SEQ ID NO: 44156 - RNA, 36 nt, Artificial Sequence
  Gamma-secretase C-terminal fragment 59 (565-576)
uuccgccacgacagcggcuacgaggugcaccaccag

SEQ ID NO: 44157 - RNA, 24 nt, Artificial Sequence
  60S ribosomal protein L4 (257-264)
uuccgcaagcuggacgagcucuac

SEQ ID NO: 44158 - RNA, 27 nt, Artificial Sequence
  Annexin A5 (288-296)
uuccgcaagaacuucgccaccagccug

SEQ ID NO: 44159 - RNA, 27 nt, Artificial Sequence
  Glycogen phosphorylase, brain form (546-554)
uucagcgccuuccuggagaaggaguac

SEQ ID NO: 44160 - RNA, 21 nt, Artificial Sequence
  Erlin-2 (43-49)
uucagcgccgugcacaagauc

SEQ ID NO: 44161 - RNA, 27 nt, Artificial Sequence
  Myb-binding protein 1A (239-247)
uucagcgacgagaacgugccccgccug

SEQ ID NO: 44162 - RNA, 24 nt, Artificial Sequence
  Leucine zipper putative tumor suppressor 1 (232-239)
uucagcgacggcggguccaagcug

SEQ ID NO: 44163 - RNA, 27 nt, Artificial Sequence
  Basic leucine zipper and W2 domain-containing protein 2 (143-151)
uucagcgagaccgagcagaccaagcug

SEQ ID NO: 44164 - RNA, 30 nt, Artificial Sequence
  Cytoplasmic dynein 2 heavy chain 1 (202-211)
uucagcgagaccggcgggggcgagaaguac

SEQ ID NO: 44165 - RNA, 27 nt, Artificial Sequence
  Dual specificity protein phosphatase 4 (366-374)
uucagcuuccccguguccgucggcgug

SEQ ID NO: 44166 - RNA, 30 nt, Artificial Sequence
  Protein FAM135A (667-676)
uucagcggcgagaacaucaccgugaagcug

SEQ ID NO: 44167 - RNA, 27 nt, Artificial Sequence
  Uncharacterized protein C20orf194 (1005-1013)
uucagcggcaacaucuaccacauccug

SEQ ID NO: 44168 - RNA, 24 nt, Artificial Sequence
  RNA-binding protein FUS (355-362)
uucagcggcaaccccaucaaggug

SEQ ID NO: 44169 - RNA, 24 nt, Artificial Sequence
  5,6-dihydroxyindole-2-carboxylic acid oxidase (213-220)
uucagccacgagggccccgccuuc

SEQ ID NO: 44170 - RNA, 24 nt, Artificial Sequence
  L-dopachrome tautomerase (209-216)
uucagccaccagggccccgccuuc

SEQ ID NO: 44171 - RNA, 33 nt, Artificial Sequence
  Homeobox protein Hox-B7 (11-21)
uucagcaaguaccccgccuccagcuccguguuc

SEQ ID NO: 44172 - RNA, 33 nt, Artificial Sequence
  Sodium/potassium/calcium exchanger 1 (352-362)
uucagccugaucaacggccuccagcccgugccg

SEQ ID NO: 44173 - RNA, 27 nt, Artificial Sequence
  Small subunit processome component 20 homolog (925-933)
uucagcaacccccgcgcccuguaccuc

SEQ ID NO: 44174 - RNA, 42 nt, Artificial Sequence
  Paired box protein Pax-1 (59-72)
uucagccccuccggcagccugcucuccggggccagcgccgag

SEQ ID NO: 44175 - RNA, 21 nt, Artificial Sequence
  ADP-ribosylation factor 4 (9-15)
uucagccgccuguucggcaag

SEQ ID NO: 44176 - RNA, 30 nt, Artificial Sequence
  Synemin (764-773)
uucagcgugcccuucaaggucgaggaggug

SEQ ID NO: 44177 - RNA, 30 nt, Artificial Sequence
  Elongation factor 1-gamma (335-344)
uucagcugggagggcgccuuccagcacgug

SEQ ID NO: 44178 - RNA, 27 nt, Artificial Sequence
  Eukaryotic translation initiation factor 3 subunit H (135-143)
uucagcuaccagcacgccaucgaggag

SEQ ID NO: 44179 - RNA, 24 nt, Artificial Sequence
  Bcl-2-associated transcription factor 1 (338-345)
uucaccgacgaggagagccgcgug

SEQ ID NO: 44180 - RNA, 27 nt, Artificial Sequence
  Nuclear pore complex protein Nup160 (151-159)
uucaccgacaucggcaagguggacuuc

SEQ ID NO: 44181 - RNA, 24 nt, Artificial Sequence
  Homeobox protein TGIF1 (222-229)
uucaccgacaccagccugauguac

SEQ ID NO: 44182 - RNA, 27 nt, Artificial Sequence
  Transmembrane 9 superfamily member 4 (168-176)
uucaccgacgugaacaagaucuaccug

SEQ ID NO: 44183 - RNA, 27 nt, Artificial Sequence
  Fibronectin isoform 7 (286-294)
uucaccgacgugcgcgccgccgucuac

SEQ ID NO: 44184 - RNA, 27 nt, Artificial Sequence
  Integrator complex subunit 1 (745-753)
uucaccgagcagcccgagaccuacuac

SEQ ID NO: 44185 - RNA, 27 nt, Artificial Sequence
  CUB and sushi domain-containing protein 1 (3053-3061)
uucaccuucaacaagaccgugagcuac

SEQ ID NO: 44186 - RNA, 21 nt, Artificial Sequence
  Up-regulated during skeletal muscle growth protein 5 (12-18)
uucaccggcaucaagaaguac

SEQ ID NO: 44187 - RNA, 21 nt, Artificial Sequence
  Bestrophin-1 (575-581)
uucaccggcauccuggggaag

SEQ ID NO: 44188 - RNA, 27 nt, Artificial Sequence
  Ribosomal protein S6 kinase alpha-3 (519-527)
uucaccaucaccaagacgguggaguac

SEQ ID NO: 44189 - RNA, 27 nt, Artificial Sequence
  Nuclear factor erythroid 2-related factor 1 (300-308)
uucaccaacgacaagaucaucaaccug

SEQ ID NO: 44190 - RNA, 27 nt, Artificial Sequence
  Serine-threonine kinase receptor-associated protein (108-116)
uucacccaggacagcaacuaccugcuc

SEQ ID NO: 44191 - RNA, 39 nt, Artificial Sequence
  FXYD domain-containing ion transport regulator 3 isoform 3 (28-40)
uucacccagagcccccugcacggcgccgccgcggccuac

SEQ ID NO: 44192 - RNA, 30 nt, Artificial Sequence
  FRAS1-related extracellular matrix protein 1 (471-480)
uucaccguggccgaccugcaggccggcguc

SEQ ID NO: 44193 - RNA, 27 nt, Artificial Sequence
  CUB and sushi domain-containing protein 1 (2875-2883)
uucaccuacggcgccgugguccacuac

SEQ ID NO: 44194 - RNA, 27 nt, Artificial Sequence
  Fibronectin (364-372)
uucaccuacaacggccgcaccuucuac

SEQ ID NO: 44195 - RNA, 27 nt, Artificial Sequence
  Leucine-rich repeat protein 1 (73-81)
uucguggacgagggcaaggccaccguc

SEQ ID NO: 44196 - RNA, 21 nt, Artificial Sequence
  Protein FAM127B (50-56)
uucguggacgagaacaccuuc

SEQ ID NO: 44197 - RNA, 27 nt, Artificial Sequence
  Calsyntenin-1 (820-828)
uucguggaccugagcggccacaaccuc

SEQ ID NO: 44198 - RNA, 27 nt, Artificial Sequence
  Ras-specific guanine nucleotide-releasing factor RalGPS2 (272-280)
uucguggaggacgacaacuacaagcug

SEQ ID NO: 44199 - RNA, 27 nt, Artificial Sequence
  Smith-Magenis syndrome chromosomal region candidate gene 8 protein (117-125)
uucguggaggacagcaaggucgugcug

SEQ ID NO: 44200 - RNA, 27 nt, Artificial Sequence
  (38-46)
uucguggaggagaccgucuaccugcuc

SEQ ID NO: 44201 - RNA, 39 nt, Artificial Sequence
  Tubulin beta chain (110-122)
uucguguucggccagagcggggccggcaacaacugggcc

SEQ ID NO: 44202 - RNA, 27 nt, Artificial Sequence
  2-hydroxyacylsphingosine 1-beta-galactosyltransferase (145-153)
uucgugaucgcccaccugcucggcguc

SEQ ID NO: 44203 - RNA, 27 nt, Artificial Sequence
  Glioma tumor suppressor candidate region gene 1 protein (784-792)
uucgugauccagaaccagcugggcguc

SEQ ID NO: 44204 - RNA, 27 nt, Artificial Sequence
  40S ribosomal protein S26 (39-47)
uucgugauccgcaacaucgucgaggcc

SEQ ID NO: 44205 - RNA, 27 nt, Artificial Sequence
  Kelch-like protein 7 (430-438)
uucgugaaggacaagaucuucgccguc

SEQ ID NO: 44206 - RNA, 27 nt, Artificial Sequence
  Tectonic-1 (346-354)
uucgugcugggcaccgucagcuccgug

SEQ ID NO: 44207 - RNA, 27 nt, Artificial Sequence
  Zinc finger protein 618 (573-581)
uucgugaugagcgagauccgcaccguc

SEQ ID NO: 44208 - RNA, 30 nt, Artificial Sequence
  Integrin alpha-11 (525-534)
uucguguacaacggcacccugaaggacagc

SEQ ID NO: 44209 - RNA, 33 nt, Artificial Sequence
  Protein disulfide-isomerase TMX3 (154-164)
uucguguacgucggcggggagagcccccugaag

SEQ ID NO: 44210 - RNA, 27 nt, Artificial Sequence
  Palmitoyl-protein thioesterase 1 (194-202)
uucuacgcccacaucauccccuuccug

SEQ ID NO: 44211 - RNA, 27 nt, Artificial Sequence
  Serine/threonine-protein kinase 36 (200-208)
uucuacgccaccagcaucuuccagcug

SEQ ID NO: 44212 - RNA, 27 nt, Artificial Sequence
  Tetratricopeptide repeat protein 31 (320-328)
uucuaccacgaggccgugguccuguuc

SEQ ID NO: 44213 - RNA, 30 nt, Artificial Sequence
  Ubinuclein-1 (160-169)
uucuacaucaacagcggcacccugcaguuc

SEQ ID NO: 44214 - RNA, 21 nt, Artificial Sequence
  HLA class I histocompatibility antigen, B-15 alpha chain (232-238)
uucuaccccgccgagaucacc

SEQ ID NO: 44215 - RNA, 27 nt, Artificial Sequence
  PX domain-containing protein kinase-like protein (233-241)
uucuaccgcagcuacuucucccaguuc

SEQ ID NO: 44216 - RNA, 27 nt, Artificial Sequence
  HLA class II histocompatibility antigen, DO alpha chain (163-171)
uucuacagccagcccgaccaccuguuc

SEQ ID NO: 44217 - RNA, 33 nt, Artificial Sequence
  Hypoxia-inducible factor 1-alpha (545-555)
uucuacguggacagcgacauggucaacgaguuc

SEQ ID NO: 44218 - RNA, 66 nt, Artificial Sequence
  Neurobeachin (23-44)
ggcgccgccgggggcgggggcgggggcagcggcgggggcgggaccggcggguccggcaugggcgag

SEQ ID NO: 44219 - RNA, 27 nt, Artificial Sequence
  Myb-binding protein 1A (310-318)
ggcgccgcccugccccuccugaccaag

SEQ ID NO: 44220 - RNA, 27 nt, Artificial Sequence
  Neutral amino acid transporter A (59-67)
ggcgccgcccugcgcgggcucagccug

SEQ ID NO: 44221 - RNA, 48 nt, Artificial Sequence
  Beta-secretase 2 (73-88)
ggcgccgccaacuuccuggcgaugguggacaaccuccagggggacagc

SEQ ID NO: 44222 - RNA, 39 nt, Artificial Sequence
  Transcription factor E2F3 (21-33)
ggcgccgccguggucgcggccgccgccgccgcgagcaug

SEQ ID NO: 44223 - RNA, 27 nt, Artificial Sequence
  U3 small nucleolar RNA-associated protein 15 homolog (121-129)
ggcgccgacgacuacaccgugaagcug

SEQ ID NO: 44224 - RNA, 27 nt, Artificial Sequence
  Pre-mRNA-processing factor 19 (241-249)
ggcgccgacaagaacguggucguguuc

SEQ ID NO: 44225 - RNA, 57 nt, Artificial Sequence
  Myc-associated zinc finger protein (303-321)
ggcgccgggggcgggggcggggaggccggcgcgggcgggggcgccgccgccguggcc

SEQ ID NO: 44226 - RNA, 36 nt, Artificial Sequence
  High affinity cationic amino acid transporter 1 (35-46)
ggcgccgggguguacguccuggccggcgcgguggcc

SEQ ID NO: 44227 - RNA, 39 nt, Artificial Sequence
  Cytochrome c oxidase subunit 5B, mitochondrial (117-129)
ggcgcccacuacaagcuggugccccagcagcucgcccac

SEQ ID NO: 44228 - RNA, 45 nt, Artificial Sequence
  Adenosylhomocysteinase 3 (39-53)
ggcgccauggcccccccggcggggggcggggaccccgaggccccc

SEQ ID NO: 44229 - RNA, 39 nt, Artificial Sequence
  Sickle tail protein homolog (296-308)
ggcgccccccgcccggggagcaccgcccaccccccccac

SEQ ID NO: 44230 - RNA, 33 nt, Artificial Sequence
  Fibrocystin (1261-1271)
ggcgcccccaccgugccggccgcggucgaggug

SEQ ID NO: 44231 - RNA, 57 nt, Artificial Sequence
  Collagen alpha-1(XVIII) chain (992-1010)
ggcgcccgcggggagagcggccuggccggggcgcccggcccggccgggccccccggc

SEQ ID NO: 44232 - RNA, 24 nt, Artificial Sequence
  Mastermind-like protein 2 (85-92)
ggcgcccgcaaggccgggaagcac

SEQ ID NO: 44233 - RNA, 99 nt, Artificial Sequence
  Frizzled-8 (634-666)
ggcgccaccgccgcggggggcgggggcgggcccggcggcgggggcgggggcgggccgggcggcgggggcgggcccggcggcgggggcgggagccuguac

SEQ ID NO: 44234 - RNA, 60 nt, Artificial Sequence
  26S protease regulatory subunit 6A (376-395)
ggcgccaccgagcugacccacgaggacuacauggaggggauccucgaggugcaggccaag

SEQ ID NO: 44235 - RNA, 36 nt, Artificial Sequence
  Vesicle transport protein SFT2C (154-165)
ggcgccacccuguucgccgcgcucgggcugcgcagc

SEQ ID NO: 44236 - RNA, 45 nt, Artificial Sequence
  Chondroitin sulfate proteoglycan 4 (2058-2072)
ggcgccacccugcgccucgaccccaccgugcuggacgccggggag

SEQ ID NO: 44237 - RNA, 27 nt, Artificial Sequence
  Pecanex-like protein 3 (1088-1096)
ggcgccgugggguucuucacccacuac

SEQ ID NO: 44238 - RNA, 27 nt, Artificial Sequence
  Pecanex-like protein 2 (267-275)
ggcgccgugggguucgucacccacuac

SEQ ID NO: 44239 - RNA, 27 nt, Artificial Sequence
  Tensin-3 (1204-1212)
ggcgccuacgggcuggccaugaaggug

SEQ ID NO: 44240 - RNA, 69 nt, Artificial Sequence
  Cytochrome c oxidase subunit 6A1, mitochondrial (64-86)
ggcgacgggaaccacacccuguuccacaacccccacgugaacccgcuccccaccggcuacgaggacgag

SEQ ID NO: 44241 - RNA, 54 nt, Artificial Sequence
  Cadherin-2 (266-283)
ggcgaccccaccgggcgcuucgccauccagaccgacccgaacagcaacgacggc

SEQ ID NO: 44242 - RNA, 30 nt, Artificial Sequence
  E3 ubiquitin-protein ligase makorin-1 (147-156)
ggcgaggccgagagccgcaacuccaacuuc

SEQ ID NO: 44243 - RNA, 30 nt, Artificial Sequence
  Suppression of tumorigenicity 5 protein (770-779)
ggcgaggacgggagccgccgguucggcuac

SEQ ID NO: 44244 - RNA, 33 nt, Artificial Sequence
  Melanotransferrin (422-432)
ggcgaggacaucuacaccgccgggaagaccuac

SEQ ID NO: 44245 - RNA, 30 nt, Artificial Sequence
  Protein capicua homolog (1390-1399)
ggcgaggaccccgaggggaacaagggcuuc

SEQ ID NO: 44246 - RNA, 63 nt, Artificial Sequence
  Eukaryotic translation initiation factor 5A-1 (130-150)
ggcgaggagauccugaucaccgugcucagcgccaugaccgaggaggccgcggucgccaucaag

SEQ ID NO: 44247 - RNA, 27 nt, Artificial Sequence
  Nucleosome-remodeling factor subunit BPTF (1023-1031)
ggcgaggaguaccgcgugaccggguac

SEQ ID NO: 44248 - RNA, 48 nt, Artificial Sequence
  Gamma-interferon-inducible protein 16 (644-659)
ggcgaguucaccuacuacgagauccaggacaacaccgggaagauggag

SEQ ID NO: 44249 - RNA, 27 nt, Artificial Sequence
  Cyclin-dependent kinase 6 (20-28)
ggcgagggggccuacggcaagguguuc

SEQ ID NO: 44250 - RNA, 24 nt, Artificial Sequence
  Nestin (495-502)
ggcgagggggagggccagaucugg

SEQ ID NO: 44251 - RNA, 27 nt, Artificial Sequence
  Zinc finger and BTB domain-containing protein 10 (226-234)
ggcgagggggagaccgugcagcacuuc

SEQ ID NO: 44252 - RNA, 30 nt, Artificial Sequence
  Matrix metalloproteinase-24 (185-194)
ggcgaggggggcuuccuggcccacgccuac

SEQ ID NO: 44253 - RNA, 27 nt, Artificial Sequence
  Filamin-B (1548-1556)
ggcgaggggcugcucgccgugcagauc

SEQ ID NO: 44254 - RNA, 30 nt, Artificial Sequence
  Chondroitin sulfate proteoglycan 4 (1563-1572)
ggcgagcacaccagccccgggcacuucuuc

SEQ ID NO: 44255 - RNA, 27 nt, Artificial Sequence
  EKC/KEOPS complex subunit TPRKB (113-121)
ggcgagaagcagaucaaccaggaguac

SEQ ID NO: 44256 - RNA, 27 nt, Artificial Sequence
  Peroxisomal biogenesis factor 19 (180-188)
ggcgagaugcccccggggcugaacuuc

SEQ ID NO: 44257 - RNA, 27 nt, Artificial Sequence
  TRAF2 and NCK-interacting protein kinase (434-442)
ggcgagaugcccaccagcguggccuac

SEQ ID NO: 44258 - RNA, 30 nt, Artificial Sequence
  Girdin (1244-1253)
ggcgagaacgaccgccugaaccacaccuac

SEQ ID NO: 44259 - RNA, 30 nt, Artificial Sequence
  Plectin (1154-1163)
ggcgagcgcgacguggaggucgagcggugg

SEQ ID NO: 44260 - RNA, 27 nt, Artificial Sequence
  Fragile X mental retardation syndrome-related protein 1 (266-274)
ggcgagagcgccgacgccgugaagaag

SEQ ID NO: 44261 - RNA, 27 nt, Artificial Sequence
  Nestin (482-490)
ggcgagagcgggggcucccgcguguuc

SEQ ID NO: 44262 - RNA, 27 nt, Artificial Sequence
  Protein MON2 homolog (918-926)
ggcgagagccugauccgcaccgccuuc

SEQ ID NO: 44263 - RNA, 30 nt, Artificial Sequence
  Synemin (317-326)
ggcgagagcaaccccgagaucgugaucugg

SEQ ID NO: 44264 - RNA, 27 nt, Artificial Sequence
  Protein piccolo (255-263)
ggcgagagcgugaagcccucccugccg

SEQ ID NO: 44265 - RNA, 30 nt, Artificial Sequence
  Vacuolar protein sorting-associated protein 18 homolog (657-666)
ggcgagaccgagcaggccauccacaacuac

SEQ ID NO: 44266 - RNA, 30 nt, Artificial Sequence
  Spectrin beta chain, non-erythrocytic 2 (1112-1121)
ggcgagguggagcgcgcccagagcgaguac

SEQ ID NO: 44267 - RNA, 27 nt, Artificial Sequence
  ATP-citrate synthase (392-400)
ggcgagguggggaagaccaccggcauc

SEQ ID NO: 44268 - RNA, 27 nt, Artificial Sequence
  Hermansky-Pudlak syndrome 5 protein (252-260)
ggcgaggugaucagcacccaccaguuc

SEQ ID NO: 44269 - RNA, 36 nt, Artificial Sequence
  Serum albumin (423-434)
ggcgaguacaaguuccagaacgcccugcucgugcgc

SEQ ID NO: 44270 - RNA, 33 nt, Artificial Sequence
  HLA class I histocompatibility antigen, B-15 alpha chain (231-241)
ggcuucuaccccgccgagaucacccugaccugg

SEQ ID NO: 44271 - RNA, 60 nt, Artificial Sequence
  Transcription factor Maf (211-230)
ggcggggccggcggggccggcgggggcggccccgcgagcgccgggggcgggggcgggggc

SEQ ID NO: 44272 - RNA, 21 nt, Artificial Sequence
  Inhibitor of nuclear factor kappa-B kinase subunit beta (42-48)
ggcggggaccugcgcaaguac

SEQ ID NO: 44273 - RNA, 57 nt, Artificial Sequence
  Cadherin-2 (265-283)
ggcggggaccccaccggccgcuucgccauccagaccgacccgaacagcaacgacggg

SEQ ID NO: 44274 - RNA, 93 nt, Artificial Sequence
  Keratin, type I cytoskeletal 9 (593-623)
ggcggggagagcggcggguccuacggcgggggcgaggaggccagcggcuccgggggcggguacggcgggggcagcggcaaguccagccacucc

SEQ ID NO: 44275 - RNA, 69 nt, Artificial Sequence
  Prostaglandin reductase 1 (141-163)
ggcggggagaccgugauggucaacgccgccgcgggcgccguggggagcguggucggccagaucgccaag

SEQ ID NO: 44276 - RNA, 51 nt, Artificial Sequence
  Hemicentin-1 (3579-3595)
ggcgggggcgaggugcugcgcaucagcaccgcccaggucgaggacaccggg

SEQ ID NO: 44277 - RNA, 57 nt, Artificial Sequence
  Regulator of nonsense transcripts 1 (55-73)
ggcgggggcggggccggcgggcccggcggcgccggggcgggcgccgccgccgggcag

SEQ ID NO: 44278 - RNA, 69 nt, Artificial Sequence
  Electrogenic sodium bicarbonate cotransporter 4 (440-462)
ggcgggggcgggggcgcccccgggggcggcaacgggggcgggggcgggggcggcagcgggggcggggcc

SEQ ID NO: 44279 - RNA, 51 nt, Artificial Sequence
  AT-rich interactive domain-containing protein 1B (322-338)
ggcgggggcgggggcgggggcgccggcgccgggggcgcgggggccggcgcc

SEQ ID NO: 44280 - RNA, 45 nt, Artificial Sequence
  Neuronal PAS domain-containing protein 3 (734-748)
ggcgggggcgggggcgggggcgccggcgggggcgggcccagcgcc

SEQ ID NO: 44281 - RNA, 57 nt, Artificial Sequence
  Homeobox even-skipped homolog protein 2 (416-434)
ggcgggggcgggggcgggggcggcgggggcgggggcggggccggcgccggcgggggc

SEQ ID NO: 44282 - RNA, 66 nt, Artificial Sequence
  WD repeat-containing protein 26 (8-29)
ggcgggggcgggggcgggggcggcgggggcgggggcgggggcggcgggggcgggcagggccagacc

SEQ ID NO: 44283 - RNA, 54 nt, Artificial Sequence
  Keratin, type I cytoskeletal 9 (15-32)
ggcgggggcgggggcgggggccugggcagcgggggcuccauccgcagcuccuac

SEQ ID NO: 44284 - RNA, 45 nt, Artificial Sequence
  Zinc finger SWIM domain-containing protein 6 (150-164)
ggcgggggcgggggcagcuccagcucccccgccgccaccagcgcg

SEQ ID NO: 44285 - RNA, 39 nt, Artificial Sequence
  40S ribosomal protein S16 (74-86)
ggcgggggccacguggcccagaucuacggggagagccag

SEQ ID NO: 44286 - RNA, 30 nt, Artificial Sequence
  Serine/threonine-protein kinase TAO2 (869-878)
ggcgggggccugcaggccgcccuccuggcg

SEQ ID NO: 44287 - RNA, 54 nt, Artificial Sequence
  Keratin, type II cytoskeletal 1 (595-612)
ggcgggggcagcuccgggggccgcgggagcggcggcggguccagcggcgggucc

SEQ ID NO: 44288 - RNA, 39 nt, Artificial Sequence
  Keratin, type II cytoskeletal 3 (144-156)
ggcgggggcuacgggggcgggaugggcggcgggcugggc

SEQ ID NO: 44289 - RNA, 60 nt, Artificial Sequence
  Protein scribble homolog (1289-1308)
ggcgggaagauggccgagagccccugcuccccgagcggccagcagccccccucccccccg

SEQ ID NO: 44290 - RNA, 39 nt, Artificial Sequence
  Protein TASOR (44-56)
ggcgggcugaacaucgccgagcccagcggcggggccggc

SEQ ID NO: 44291 - RNA, 78 nt, Artificial Sequence
  Keratin, type I cytoskeletal 18 (56-81)
ggcgggaugggcagcgggggccuggccaccgggaucgccggcggccucgcggggaugggcgggauccagaacgagaag

SEQ ID NO: 44292 - RNA, 54 nt, Artificial Sequence
  Inositol 1,4,5-trisphosphate receptor type 1 (1761-1778)
ggcgggcccggcaagccggggggcgggggcggcgggagcggcuccagcuccaug

SEQ ID NO: 44293 - RNA, 30 nt, Artificial Sequence
  KN motif and ankyrin repeat domain-containing protein 2 (473-482)
ggcgggcccccggccggcgugcgcagcauc

SEQ ID NO: 44294 - RNA, 39 nt, Artificial Sequence
  AT-rich interactive domain-containing protein 1A (277-289)
ggcgggcccagcgccgccggcgggggcaccccgcagccc

SEQ ID NO: 44295 - RNA, 48 nt, Artificial Sequence
  Protein transport protein Sec24C (725-740)
ggcgggagcguguacaaguacgccuccuuccaggucgagaacgaccag

SEQ ID NO: 44296 - RNA, 75 nt, Artificial Sequence
  HLA class I histocompatibility antigen, A-1 alpha chain (316-340)
ggcgggagcuacacccaggccgccuccagcgacuccgcgcagggcagcgacgugucccugaccgccugcaagguc

SEQ ID NO: 44297 - RNA, 27 nt, Artificial Sequence
  Abl interactor 2 (222-230)
ggccaccccgugcaguucuacagcaug

SEQ ID NO: 44298 - RNA, 84 nt, Artificial Sequence
  Guanine nucleotide-binding protein subunit beta-2-like 1 (61-88)
ggccacagccacuucguguccgacgucgugaucagcuccgacgggcaguucgcccugagcggcuccugggacgggacccuccgc

SEQ ID NO: 44299 - RNA, 27 nt, Artificial Sequence
  Spatacsin (1079-1087)
ggccacacccugcucgcccuggccacc

SEQ ID NO: 44300 - RNA, 27 nt, Artificial Sequence
  Protein Jumonji (51-59)
ggcaucgccgggagccugaagaccgug

SEQ ID NO: 44301 - RNA, 27 nt, Artificial Sequence
  Lipoprotein lipase (23-31)
ggcaucgccgggagccugaccaacaag

SEQ ID NO: 44302 - RNA, 39 nt, Artificial Sequence
  Protein transport protein Sec16A (84-96)
ggcaucgccaacccccugcucgccgugccggcgcccagc

SEQ ID NO: 44303 - RNA, 30 nt, Artificial Sequence
  Interferon alpha-inducible protein 27, mitochondrial (57-66)
ggcaucgccagcuccagcaucgccgcgaag

SEQ ID NO: 44304 - RNA, 27 nt, Artificial Sequence
  HLA class II histocompatibility antigen, DQ beta 1 chain (233-241)
ggcaucgggggcuucgugcuggggcuc

SEQ ID NO: 44305 - RNA, 27 nt, Artificial Sequence
  Probable methyltransferase TARBP1 (1190-1198)
ggcaucaucgaccgcaucuuccaggcc

SEQ ID NO: 44306 - RNA, 114 nt, Artificial Sequence
  Glyceraldehyde-3-phosphate dehydrogenase (272-309)
ggcauccugggguacaccgagcaccagguggucagcuccgacuucaacagcgacacccacuccagcacguucgacgccggcgccgggaucgcgcucaacgaccacuucgugaag

SEQ ID NO: 44307 - RNA, 27 nt, Artificial Sequence
  Zinc finger ZZ-type and EF-hand domain-containing protein 1 (2890-2898)
ggcauccugcucccccugcaccgcgcc

SEQ ID NO: 44308 - RNA, 24 nt, Artificial Sequence
  HEAT repeat-containing protein 5A (975-982)
ggcauccgcaacgggagcugcucc

SEQ ID NO: 44309 - RNA, 27 nt, Artificial Sequence
  NHP2-like protein 1 (49-57)
ggcaucagcgaguucaucgugauggcc

SEQ ID NO: 44310 - RNA, 27 nt, Artificial Sequence
  Putative segment polarity protein dishevelled homolog DVL1P1 (277-285)
ggcaucuacaucgggagcaucaugaag

SEQ ID NO: 44311 - RNA, 27 nt, Artificial Sequence
  Afadin (1018-1026)
ggcaucuacgugaagagcgucgugaag

SEQ ID NO: 44312 - RNA, 21 nt, Artificial Sequence
  Mesoderm induction early response protein 3 (303-309)
ggcaaggacuuccaccugauc

SEQ ID NO: 44313 - RNA, 36 nt, Artificial Sequence
  Leucine-rich repeat serine/threonine-protein kinase 2 (780-791)
ggcaagggggacagccagaucaucucccugcuccug

SEQ ID NO: 44314 - RNA, 33 nt, Artificial Sequence
  E1A-binding protein p400 (281-291)
ggcaagaccaucacccccgcccacuuccagcug

SEQ ID NO: 44315 - RNA, 30 nt, Artificial Sequence
  Probable E3 ubiquitin-protein ligase HERC1 (2585-2594)
ggccuggccgaccucgagcgcgcccaggcg

SEQ ID NO: 44316 - RNA, 27 nt, Artificial Sequence
  Minor histocompatibility antigen H13 (189-197)
ggccuggccuucagccucaacggggug

SEQ ID NO: 44317 - RNA, 27 nt, Artificial Sequence
  Serpin H1 (48-56)
ggccuggccuucagccucuaccaggcc

SEQ ID NO: 44318 - RNA, 27 nt, Artificial Sequence
  Ral GTPase-activating protein subunit beta (790-798)
ggccuggccaaggugaaggucauggug

SEQ ID NO: 44319 - RNA, 33 nt, Artificial Sequence
  Equilibrative nucleoside transporter 1 (483-493)
ggccuggcccucggggccguguucagcuuccug

SEQ ID NO: 44320 - RNA, 33 nt, Artificial Sequence
  Prominin-2 (17-27)
ggccuggcccucagccagcuggccgcgggggcc

SEQ ID NO: 44321 - RNA, 27 nt, Artificial Sequence
  Vacuolar protein sorting-associated protein 41 homolog (323-331)
ggccuggccuacaucaaccaccucgug

SEQ ID NO: 44322 - RNA, 27 nt, Artificial Sequence
  Zinc finger and BTB domain-containing protein 39 (63-71)
ggccuggacgccgcccgcaccuacgug

SEQ ID NO: 44323 - RNA, 27 nt, Artificial Sequence
  C-type lectin domain family 11 member A (117-125)
ggccuggacgccgggcuccaccagcug

SEQ ID NO: 44324 - RNA, 30 nt, Artificial Sequence
  Protein PRR14L (130-139)
ggccuggacgagcucgacggggugaaggcc

SEQ ID NO: 44325 - RNA, 27 nt, Artificial Sequence
  Protein furry homolog-like (621-629)
ggccuggacaacgagacccacuuccuc

SEQ ID NO: 44326 - RNA, 27 nt, Artificial Sequence
  Heat shock 70 kDa protein 12A (522-530)
ggccuggaccccgccgugaucaagguc

SEQ ID NO: 44327 - RNA, 27 nt, Artificial Sequence
  DNA polymerase alpha catalytic subunit (1240-1248)
ggccuggaccccacccaguuccgcgug

SEQ ID NO: 44328 - RNA, 27 nt, Artificial Sequence
  Sodium- and chloride-dependent creatine transporter 1 (299-307)
ggccuggacagccaguucguggggguc

SEQ ID NO: 44329 - RNA, 27 nt, Artificial Sequence
  ADP-ribosylation factor 5 (169-177)
ggccuggacuggcucagccacgagcug

SEQ ID NO: 44330 - RNA, 30 nt, Artificial Sequence
  Trinucleotide repeat-containing gene 18 protein (737-746)
ggccuggaggagagcgggcucggccugcug

SEQ ID NO: 44331 - RNA, 30 nt, Artificial Sequence
  Rho GTPase-activating protein 23 (525-534)
ggccuggagagcaccgggaucuaccgcgug

SEQ ID NO: 44332 - RNA, 30 nt, Artificial Sequence
  Ciliary neurotrophic factor (150-159)
ggccuguucgagaagaagcucugggggcug

SEQ ID NO: 44333 - RNA, 30 nt, Artificial Sequence
  Oxysterol-binding protein-related protein 1 (365-374)
ggccuguucgggaaggagcuccacaaggug

SEQ ID NO: 44334 - RNA, 27 nt, Artificial Sequence
  Receptor-interacting serine/threonine-protein kinase 4 (180-188)
ggccuguucgggaccaucgccuaccuc

SEQ ID NO: 44335 - RNA, 30 nt, Artificial Sequence
  Presenilin-2 (364-373)
ggccugggggacuucaucuucuacagcgug

SEQ ID NO: 44336 - RNA, 27 nt, Artificial Sequence
  Nurim (175-183)
ggccugggggagccccucgcccugaag

SEQ ID NO: 44337 - RNA, 24 nt, Artificial Sequence
  Unconventional myosin-Va (1848-1855)
ggccugggguucaucagccgcgug

SEQ ID NO: 44338 - RNA, 24 nt, Artificial Sequence
  Probable ATP-dependent RNA helicase YTHDC2 (1364-1371)
ggccuggggggcguguucaagguc

SEQ ID NO: 44339 - RNA, 24 nt, Artificial Sequence
  Sodium-dependent multivitamin transporter (227-234)
ggccuggggcgcgugugggccguc

SEQ ID NO: 44340 - RNA, 33 nt, Artificial Sequence
  Vacuole membrane protein 1 (126-136)
ggccuggggaccggccuccacaccuuccugcug

SEQ ID NO: 44341 - RNA, 36 nt, Artificial Sequence
  Elastin (104-115)
ggccugggggugggcgccgggguccccggcuucggg

SEQ ID NO: 44342 - RNA, 27 nt, Artificial Sequence
  Bifunctional heparan sulfate N-deacetylase/N-sulfotransferase 3 (265-273)
ggccugcacgacgggauccagcgcgug

SEQ ID NO: 44343 - RNA, 27 nt, Artificial Sequence
  Vacuolar protein sorting-associated protein 13D (747-755)
ggccugcacgggcucgugguccaggcc

SEQ ID NO: 44344 - RNA, 27 nt, Artificial Sequence
  Ribosome-binding protein 1 (183-191)
ggccugcacgggcagcuccaggaggcc

SEQ ID NO: 44345 - RNA, 33 nt, Artificial Sequence
  Dystonin (1614-1624)
ggccugaucgacgagcagauccucugccagcug

SEQ ID NO: 44346 - RNA, 33 nt, Artificial Sequence
  28 kDa heat- and acid-stable phosphoprotein (79-89)
ggccugaucgacaucgagaaccccaaccgcgug

SEQ ID NO: 44347 - RNA, 33 nt, Artificial Sequence
  Dystonin (1576-1586)
ggccugaucgacuacgacaccgggauccgccuc

SEQ ID NO: 44348 - RNA, 42 nt, Artificial Sequence
  ATP-citrate synthase (832-845)
ggccugauccgcaagcccgccagcuucaugaccuccaucugc

SEQ ID NO: 44349 - RNA, 21 nt, Artificial Sequence
  Rho-related BTB domain-containing protein 3 (23-29)
ggccugauccgcaccuaccuc

SEQ ID NO: 44350 - RNA, 27 nt, Artificial Sequence
  Nucleolar protein 6 (323-331)
ggccugaaggacgggguggcccuccug

SEQ ID NO: 44351 - RNA, 30 nt, Artificial Sequence
  Matrin-3 (27-36)
ggccugcucgccgccgcgacccagagccug

SEQ ID NO: 44352 - RNA, 27 nt, Artificial Sequence
  Transmembrane protein 223 (112-120)
ggccugcucuucagccugcgcuccgug

SEQ ID NO: 44353 - RNA, 27 nt, Artificial Sequence
  Receptor-type tyrosine-protein phosphatase T (1083-1091)
ggccugcucggguucgugcgccagguc

SEQ ID NO: 44354 - RNA, 27 nt, Artificial Sequence
  LanC-like protein 1 (313-321)
ggccugcucaagaagggguacggccug

SEQ ID NO: 44355 - RNA, 30 nt, Artificial Sequence
  Protein ELYS (20-29)
ggccugcuccccuucccggaggugacccug

SEQ ID NO: 44356 - RNA, 27 nt, Artificial Sequence
  Protein farnesyltransferase subunit beta (256-264)
ggccugcucccccugcugcaccgcgcc

SEQ ID NO: 44357 - RNA, 27 nt, Artificial Sequence
  Angiomotin (797-805)
ggccugcucagccacuccagcacccug

SEQ ID NO: 44358 - RNA, 27 nt, Artificial Sequence
  Helicase SKI2W (380-388)
ggccugcucaccggggacgugcagcug

SEQ ID NO: 44359 - RNA, 27 nt, Artificial Sequence
  Glycerol-3-phosphate acyltransferase 3 (87-95)
ggccugauggggaucauccagcgcgcc

SEQ ID NO: 44360 - RNA, 27 nt, Artificial Sequence
  Glycerol-3-phosphate acyltransferase 4 (150-158)
ggccugaugggggugauccagcgcgcc

SEQ ID NO: 44361 - RNA, 30 nt, Artificial Sequence
  Contactin-associated protein-like 3B (447-456)
ggccugaacgacgggcaguggcacagcgug

SEQ ID NO: 44362 - RNA, 27 nt, Artificial Sequence
  Basement membrane-specific heparan sulfate proteoglycan core protein (280-288)
ggccugaaccuccacacccugcuguac

SEQ ID NO: 44363 - RNA, 30 nt, Artificial Sequence
  Sorting nexin-18 (488-497)
ggccugaaccaggccaucgccuucaccggg

SEQ ID NO: 44364 - RNA, 30 nt, Artificial Sequence
  Cell surfaceoprotein MUC18 (416-425)
ggccugaaccgcacccagcucgugaacguc

SEQ ID NO: 44365 - RNA, 33 nt, Artificial Sequence
  DnaJ homolog subfamily B member 11 (305-315)
ggccugcccaacuucgacaacaacaacaucaag

SEQ ID NO: 44366 - RNA, 39 nt, Artificial Sequence
  Epidermal growth factor receptor substrate 15 (256-268)
ggccugcccagcacccuccuggcccacaucuggucccug

SEQ ID NO: 44367 - RNA, 27 nt, Artificial Sequence
  Uridine phosphorylase 1 (55-63)
ggccugcaggccgccguggucugcgug

SEQ ID NO: 44368 - RNA, 36 nt, Artificial Sequence
  Nestin (434-445)
ggccugcaggaccccgaggggcagagccagcaggug

SEQ ID NO: 44369 - RNA, 45 nt, Artificial Sequence
  Ryanodine receptor 1 (135-149)
ggccugcaggaggacgccaccggggaggccugcugguggaccaug

SEQ ID NO: 44370 - RNA, 27 nt, Artificial Sequence
  Catenin beta-1 (278-286)
ggccugcagaagaugguggcccuccug

SEQ ID NO: 44371 - RNA, 27 nt, Artificial Sequence
  Serine hydroxymethyltransferase, mitochondrial (399-407)
ggccugcgccucggggcccccgcccug

SEQ ID NO: 44372 - RNA, 51 nt, Artificial Sequence
  AP-5 complex subunit beta-1 (121-137)
ggccugcgccagcgggccgcccucgacgggggcccccgcgcgcuggccacc

SEQ ID NO: 44373 - RNA, 30 nt, Artificial Sequence
  Actin-like protein 6B (313-322)
ggccugagcgggaacaccaugcucggcgug

SEQ ID NO: 44374 - RNA, 27 nt, Artificial Sequence
  Melanoma antigen preferentially expressed in tumors (432-440)
ggccugagcaaccucacccacgugcug

SEQ ID NO: 44375 - RNA, 27 nt, Artificial Sequence
  G-protein coupled receptor 143 (150-158)
ggccugagcaccauccuccuguaccac

SEQ ID NO: 44376 - RNA, 27 nt, Artificial Sequence
  Purine nucleoside phosphorylase (37-45)
ggccugaccgacaagcucacccaggcc

SEQ ID NO: 44377 - RNA, 30 nt, Artificial Sequence
  Beta-glucuronidase (23-32)
ggccuggugaacuaccagaucagcgucaag

SEQ ID NO: 44378 - RNA, 114 nt, Artificial Sequence
  Testis anion transporter 1 (103-140)
ggccuggugcaggucccccaggggcucacccugagccugcucgcccgccagcugaucccgccccugaacaucgccuacgcggccuucugcuccagcgugaucuacgugaucuuc

SEQ ID NO: 44379 - RNA, 27 nt, Artificial Sequence
  Laminin subunit alpha-4 (1544-1552)
ggccuguggcacgacgugaucuucauc

SEQ ID NO: 44380 - RNA, 30 nt, Artificial Sequence
  Disco-interacting protein 2 homolog C (547-556)
ggccuguggcacgggauccucaccagcgug

SEQ ID NO: 44381 - RNA, 30 nt, Artificial Sequence
  Disco-interacting protein 2 homolog B (156-165)
ggccuguggcacgggauguucgccaacgug

SEQ ID NO: 44382 - RNA, 27 nt, Artificial Sequence
  Adhesion G protein-coupled receptor A3 (1170-1178)
ggccuguggaagcacgagaccaccgug

SEQ ID NO: 44383 - RNA, 27 nt, Artificial Sequence
  Zinc transporter ZIP14 (20-28)
ggccuguggcgcaccacccccgaggcc

SEQ ID NO: 44384 - RNA, 30 nt, Artificial Sequence
  RNA pseudouridylate synthase domain-containing protein 1 (32-41)
ggccuguacgccggggaccccgugagcaag

SEQ ID NO: 44385 - RNA, 27 nt, Artificial Sequence
  Lysosomal-trafficking regulator (2306-2314)
ggccuguacgagcuccugagcggggug

SEQ ID NO: 44386 - RNA, 27 nt, Artificial Sequence
  Zinc finger BED domain-containing protein 1 (137-145)
ggccuguaccccgccagcaucguggac

SEQ ID NO: 44387 - RNA, 27 nt, Artificial Sequence
  ATP-dependent RNA helicase DHX36 (824-832)
ggccuguaccccaagguggccaagauc

SEQ ID NO: 44388 - RNA, 27 nt, Artificial Sequence
  E3 ubiquitin-protein ligase HERC2 (1628-1636)
ggccuguacccccagagcccgcuccug

SEQ ID NO: 44389 - RNA, 27 nt, Artificial Sequence
  Unconventional myosin-XVIIIa (758-766)
ggccuguacagcgagcucuucacccug

SEQ ID NO: 44390 - RNA, 27 nt, Artificial Sequence
  Gamma-tubulin complex component 2 (879-887)
ggcauggccagcgugaucucccgccug

SEQ ID NO: 44391 - RNA, 27 nt, Artificial Sequence
  Intraflagellar transport protein 27 homolog (41-49)
ggcauggaccugguggucaagaccgug

SEQ ID NO: 44392 - RNA, 30 nt, Artificial Sequence
  Lysophosphatidic acid phosphatase type 6 (118-127)
ggcauguucgccgggcagcugaccaaggug

SEQ ID NO: 44393 - RNA, 36 nt, Artificial Sequence
  AP-3 complex subunit beta-1 (317-328)
ggcauguucgagcccuaccugaagagcuucuacgug

SEQ ID NO: 44394 - RNA, 30 nt, Artificial Sequence
  ATP-dependent RNA helicase DHX29 (113-122)
ggcaugaucagcgggcgccugaccgccaag

SEQ ID NO: 44395 - RNA, 27 nt, Artificial Sequence
  Glucocorticoid modulatory element-binding protein 2 (289-297)
ggcaugcuggaccucgugaagaagguc

SEQ ID NO: 44396 - RNA, 27 nt, Artificial Sequence
  E3 ubiquitin-protein ligase HUWE1 (407-415)
ggcaugauggaggcccugcucaaggug

SEQ ID NO: 44397 - RNA, 27 nt, Artificial Sequence
  Complement receptor type 1 (563-571)
ggcauggugcacgucaucaccgacauc

SEQ ID NO: 44398 - RNA, 33 nt, Artificial Sequence
  Chromodomain-helicase-DNA-binding protein 4 (1035-1045)
ggcauguacgacgggagcgcccugauccgcgcc

SEQ ID NO: 44399 - RNA, 30 nt, Artificial Sequence
  Peroxisomal acyl-coenzyme A oxidase 3 (111-120)
ggcauguacgacagcucccuggccgccaag

SEQ ID NO: 44400 - RNA, 78 nt, Artificial Sequence
  ATP synthase-coupling factor 6, mitochondrial (83-108)
ggcaacgccgacaugaacaccuuccccaccuucaaguucgaggacccgaaguucgaggugaucgagaagccccaggcc

SEQ ID NO: 44401 - RNA, 21 nt, Artificial Sequence
  Sorbitol dehydrogenase (58-64)
ggcaacuucaucgugaagaag

SEQ ID NO: 44402 - RNA, 63 nt, Artificial Sequence
  Fibrillin-2 (463-483)
ggcaacggguucagccccggcguggggggcgccggggucggcgccggcgggcagggcccgauc

SEQ ID NO: 44403 - RNA, 63 nt, Artificial Sequence
  Cytochrome c oxidase subunit 6A1, mitochondrial (66-86)
ggcaaccacacccuguuccacaacccccacgugaacccgcuccccaccggguacgaggacgag

SEQ ID NO: 44404 - RNA, 27 nt, Artificial Sequence
  Tyrosine-protein phosphatase non-receptor type substrate 1 (5-13)
ggccccgccccggggcgccugggcccc

SEQ ID NO: 44405 - RNA, 66 nt, Artificial Sequence
  Heat shock cognate 71 kDa protein (4-25)
ggccccgccguggggaucgaccugggcaccaccuacagcugcgucgggguguuccagcacggcaag

SEQ ID NO: 44406 - RNA, 33 nt, Artificial Sequence
  Kinesin-like protein KIF13A (1193-1203)
ggcccccacgccagcggggugaacuccauccug

SEQ ID NO: 44407 - RNA, 51 nt, Artificial Sequence
  Myosin-IIIb (1132-1148)
ggcccccacagcccgguggccgccgggacccgcggcuccgcggagguccag

SEQ ID NO: 44408 - RNA, 30 nt, Artificial Sequence
  Obscurin (6240-6249)
ggccccaaggccccggggcccagcaccggc

SEQ ID NO: 44409 - RNA, 36 nt, Artificial Sequence
  Collagen alpha-2(XI) chain (739-750)
ggccccaagggggccaagggcgccaccgggccgggc

SEQ ID NO: 44410 - RNA, 39 nt, Artificial Sequence
  Collagen alpha-1(III) chain (660-672)
ggccccaagggggacgccggcgccccgggggcgcccggc

SEQ ID NO: 44411 - RNA, 27 nt, Artificial Sequence
  Synaptic vesicle membrane protein VAT-1 homolog (289-297)
ggccccaagcgcaaccugauggcccuc

SEQ ID NO: 44412 - RNA, 48 nt, Artificial Sequence
  Fibronectin isoform 6 (1673-1688)
ggccccaugaaggagaucaaccuggccccggacagcuccagcgugguc

SEQ ID NO: 44413 - RNA, 51 nt, Artificial Sequence
  Fibronectin isoform 6 (1673-1689)
ggccccaugaaggagaucaaccuggccccggacagcuccagcguggucgug

SEQ ID NO: 44414 - RNA, 36 nt, Artificial Sequence
  Histone acetyltransferase p300 (672-683)
ggccccaacauggggcagccgcagcccggcaugacc

SEQ ID NO: 44415 - RNA, 51 nt, Artificial Sequence
  Collagen alpha-3(IV) chain (637-653)
ggccccccgggggaggccggcccccgcggggagcugagcguguccaccccc

SEQ ID NO: 44416 - RNA, 36 nt, Artificial Sequence
  Collagen alpha-1(III) chain (43-54)
ggccccccggggcccgccggcaacaccggggccccc

SEQ ID NO: 44417 - RNA, 30 nt, Artificial Sequence
  ETS translocation variant 5 (359-368)
ggccccccguaccagcgccgggggagccug

SEQ ID NO: 44418 - RNA, 45 nt, Artificial Sequence
  REST corepressor 2 (504-518)
ggcccccagccgccccccacccugaucgggaccccccucgagccg

SEQ ID NO: 44419 - RNA, 27 nt, Artificial Sequence
  Cathepsin D (303-311)
ggccccguggacgagguccgcgagcug

SEQ ID NO: 44420 - RNA, 48 nt, Artificial Sequence
  Collagen alpha-1(V) chain (1225-1240)
ggccccguggggcugcagggccucccggggccccccggcgagaagggg

SEQ ID NO: 44421 - RNA, 21 nt, Artificial Sequence
  Barrier-to-autointegration factor (47-53)
ggccaguuccuggugcucaag

SEQ ID NO: 44422 - RNA, 51 nt, Artificial Sequence
  Filamin-A (1240-1256)
ggccaggggguguuccgcgaggccaccaccgaguucagcgucgacgcccgg

SEQ ID NO: 44423 - RNA, 30 nt, Artificial Sequence
  UHRF1-binding protein 1-like (784-793)
ggccagaagcccagcuccagcgacaccuuc

SEQ ID NO: 44424 - RNA, 30 nt, Artificial Sequence
  Pleckstrin homology-like domain family B member 1 (354-363)
ggccagcugcccguggucgccaucagccuc

SEQ ID NO: 44425 - RNA, 27 nt, Artificial Sequence
  Transcription elongation factor SPT5 (995-1003)
ggccagaccggggugauccgcagcguc

SEQ ID NO: 44426 - RNA, 27 nt, Artificial Sequence
  Protein prune homolog 2 (1236-1244)
ggccagguggagaucgucaccaaggug

SEQ ID NO: 44427 - RNA, 27 nt, Artificial Sequence
  E3 SUMO-protein ligase RanBP2 (112-120)
ggccgcgccaaguacuggcuggagcgg

SEQ ID NO: 44428 - RNA, 27 nt, Artificial Sequence
  Hemicentin-1 (3137-3145)
ggccgcgacgacaagaacuuccaccug

SEQ ID NO: 44429 - RNA, 114 nt, Artificial Sequence
  DnaJ homolog subfamily B member 11 (23-60)
ggccgcgacuucuacaagauccugggggugccccggagcgccuccaucaaggacaucaagaaggccuaccgcaagcucgcgcugcagcugcacccggaccggaaccccgacgac

SEQ ID NO: 44430 - RNA, 27 nt, Artificial Sequence
  Integrin alpha-X (519-527)
ggccgcuucggggccgcccugaccgug

SEQ ID NO: 44431 - RNA, 27 nt, Artificial Sequence
  Phosphorylase b kinase regulatory subunit alpha, skeletal muscle isoform (1123-1131)
ggccgcuucgggaccaugaccuaccug

SEQ ID NO: 44432 - RNA, 27 nt, Artificial Sequence
  Glycerol-3-phosphate acyltransferase 4 (81-89)
ggccgcuucaaggaguucaugagcaag

SEQ ID NO: 44433 - RNA, 27 nt, Artificial Sequence
  Tyrosine-protein phosphatase non-receptor type 21 (1024-1032)
ggccgcuucaagaucaccacccgguuc

SEQ ID NO: 44434 - RNA, 27 nt, Artificial Sequence
  Hemicentin-1 (2532-2540)
ggccgcuuccugcagaucaccaacgug

SEQ ID NO: 44435 - RNA, 27 nt, Artificial Sequence
  40S ribosomal protein S21 (44-52)
ggccgcuucaacgggcaguucaagacc

SEQ ID NO: 44436 - RNA, 27 nt, Artificial Sequence
  Serine/threonine-protein kinase WNK1 (228-236)
ggccgcgggagcuucaagaccguguac

SEQ ID NO: 44437 - RNA, 30 nt, Artificial Sequence
  Homeodomain-interacting protein kinase 1 (197-206)
ggccgcgggaccuucggccagguggccaag

SEQ ID NO: 44438 - RNA, 27 nt, Artificial Sequence
  Exosome component 10 (399-407)
ggccgccacagccuggaccaccuccug

SEQ ID NO: 44439 - RNA, 27 nt, Artificial Sequence
  Eukaryotic translation initiation factor 3 subunit L (261-269)
ggccgccacagccuguacaagaugcuc

SEQ ID NO: 44440 - RNA, 30 nt, Artificial Sequence
  Hemicentin-1 (305-314)
ggccgccacagcgugcggaucaccgggcug

SEQ ID NO: 44441 - RNA, 27 nt, Artificial Sequence
  Sulfiredoxin-1 (29-37)
ggccgcaucgccgccgugcacaacguc

SEQ ID NO: 44442 - RNA, 27 nt, Artificial Sequence
  FH2 domain-containing protein 1 (1122-1130)
ggccgcauccugaacccccuccggaag

SEQ ID NO: 44443 - RNA, 78 nt, Artificial Sequence
  40S ribosomal protein S19 (120-145)
ggccgcaagcugaccccccaggggcagcgggaccucgaccgcaucgccggccagguggccgcggccaacaagaagcac

SEQ ID NO: 44444 - RNA, 27 nt, Artificial Sequence
  Plectin (581-589)
ggccgccuggaccuccaguacgccaag

SEQ ID NO: 44445 - RNA, 27 nt, Artificial Sequence
  Chondroitin sulfate proteoglycan 4 (2121-2129)
ggccgccuggggcucgaggugggccgg

SEQ ID NO: 44446 - RNA, 27 nt, Artificial Sequence
  CDK-activating kinase assembly factor MAT1 (225-233)
ggccgccugggguaccucaaccacgug

SEQ ID NO: 44447 - RNA, 27 nt, Artificial Sequence
  Coiled-coil domain-containing protein 85B (43-51)
ggccgccugaugcaggaggugaaccgg

SEQ ID NO: 44448 - RNA, 30 nt, Artificial Sequence
  Up-regulator of cell proliferation (625-634)
ggccgccugcccgccgggcagcggcgcuuc

SEQ ID NO: 44449 - RNA, 27 nt, Artificial Sequence
  Pleckstrin homology-like domain family B member 1 (536-544)
ggccgccugagccccgccuacucccuc

SEQ ID NO: 44450 - RNA, 27 nt, Artificial Sequence
  Muscleblind-like protein 3 (34-42)
ggccgcaacaaccugauccagcagaag

SEQ ID NO: 44451 - RNA, 30 nt, Artificial Sequence
  L-dopachrome tautomerase (313-322)
ggccgcaacagcaugaagcugcccacccuc

SEQ ID NO: 44452 - RNA, 33 nt, Artificial Sequence
  Probable ATP-dependent RNA helicase DDX17 (123-133)
ggccgcagcucccagagcuccagccagcaguuc

SEQ ID NO: 44453 - RNA, 27 nt, Artificial Sequence
  DNA-dependent protein kinase catalytic subunit (2721-2729)
ggccgcaccgaccugcuccggcugcgc

SEQ ID NO: 44454 - RNA, 27 nt, Artificial Sequence
  Alpha-1,3-mannosyl-glycoprotein 4-beta-N-acetylglucosaminyltransferase B (36-44)
ggccgcaccggggugagcgucgugaug

SEQ ID NO: 44455 - RNA, 27 nt, Artificial Sequence
  Ubiquitin-associated protein 2-like (711-719)
ggccgcaccagcaccuccacgcugcuc

SEQ ID NO: 44456 - RNA, 27 nt, Artificial Sequence
  Multidrug resistance protein 1 (515-523)
ggccgcaccaccaucgugaucgcccac

SEQ ID NO: 44457 - RNA, 30 nt, Artificial Sequence
  Transmembraneoprotein NMB (76-85)
ggccgcgugcaggccguccugaccagcgac

SEQ ID NO: 44458 - RNA, 27 nt, Artificial Sequence
  DNA-directed RNA polymerase III subunit RPC4 (335-343)
ggccgcgugcagcugcuccuggggaag

SEQ ID NO: 44459 - RNA, 27 nt, Artificial Sequence
  Retinoic acid-induced protein 1 (110-118)
ggccgcuacgccggggaggagagccug

SEQ ID NO: 44460 - RNA, 39 nt, Artificial Sequence
  CD44 antigen (40-52)
ggccgcuacagcaucucccggaccgaggccgccgaccug

SEQ ID NO: 44461 - RNA, 54 nt, Artificial Sequence
  Cytochrome c oxidase subunit 7C, mitochondrial (46-63)
ggcagcgccuucgccacccccuuccuggugguccgccaccagcuccugaagacc

SEQ ID NO: 44462 - RNA, 39 nt, Artificial Sequence
  Vimentin (41-53)
ggcagcgcccugcgccccuccaccagccggucccucuac

SEQ ID NO: 44463 - RNA, 27 nt, Artificial Sequence
  WD repeat-containing protein 81 (728-736)
ggcagcgacaacggggugauccgccug

SEQ ID NO: 44464 - RNA, 30 nt, Artificial Sequence
  Protein-methionine sulfoxide oxidase MICAL1 (594-603)
ggcagcgacccccuggggcucaucgccuac

SEQ ID NO: 44465 - RNA, 36 nt, Artificial Sequence
  A-kinase anchor protein 8 (159-170)
ggcagcgaccgcaacggguccuucggcgggcaguac

SEQ ID NO: 44466 - RNA, 30 nt, Artificial Sequence
  Plasminogen activator inhibitor 1 RNA-binding protein (114-123)
ggcagcgaccgcuccagcuucucccacuac

SEQ ID NO: 44467 - RNA, 36 nt, Artificial Sequence
  Retinoic acid-induced protein 1 (520-531)
ggcagcgaggacccccuggagcgcuccuuccucuac

SEQ ID NO: 44468 - RNA, 27 nt, Artificial Sequence
  Ribosomal protein S6 kinase alpha-6 (82-90)
ggcagcuucgggaagguguuccugguc

SEQ ID NO: 44469 - RNA, 33 nt, Artificial Sequence
  V-type proton ATPase subunit H (179-189)
ggcagcgggguggccgucgagaccggcaccgug

SEQ ID NO: 44470 - RNA, 42 nt, Artificial Sequence
  HLA class I histocompatibility antigen, A-1 alpha chain (25-38)
ggcagccacuccaugcgcuacuucuucaccagcgugucccgg

SEQ ID NO: 44471 - RNA, 45 nt, Artificial Sequence
  HLA class I histocompatibility antigen, A-1 alpha chain (25-39)
ggcagccacuccaugcgcuacuucuucaccagcgugucccggccc

SEQ ID NO: 44472 - RNA, 51 nt, Artificial Sequence
  HLA class I histocompatibility antigen, A-1 alpha chain (25-41)
ggcagccacuccaugcgcuacuucuucaccagcgugucccggcccgggcgc

SEQ ID NO: 44473 - RNA, 54 nt, Artificial Sequence
  HLA class I histocompatibility antigen, A-1 alpha chain (25-42)
ggcagccacuccaugcgcuacuucuucaccagcgugucccggcccgggcgcggc

SEQ ID NO: 44474 - RNA, 78 nt, Artificial Sequence
  HLA class I histocompatibility antigen, A-1 alpha chain (25-50)
ggcagccacuccaugcgcuacuucuucaccagcgugucccggcccgggcgcggcgagccgcgguucaucgccgucggg

SEQ ID NO: 44475 - RNA, 87 nt, Artificial Sequence
  HLA class I histocompatibility antigen, A-1 alpha chain (25-53)
ggcagccacuccaugcgcuacuucuucaccagcgugucccggcccgggcgcggcgagccgcgguucaucgccgucggguacguggac

SEQ ID NO: 44476 - RNA, 111 nt, Artificial Sequence
  HLA class I histocompatibility antigen, A-1 alpha chain (25-61)
ggcagccacuccaugcgcuacuucuucaccagcgugucccggcccgggcgcggcgagccgcgguucaucgccgucggguacguggacgacacccaguucgugcgcuucgac

SEQ ID NO: 44477 - RNA, 117 nt, Artificial Sequence
  HLA class I histocompatibility antigen, A-1 alpha chain (25-63)
ggcagccacuccaugcgcuacuucuucaccagcgugucccggcccgggcgcggcgagccgcgguucaucgccgucggguacguggacgacacccaguucgugcgcuucgacagcgac

SEQ ID NO: 44478 - RNA, 48 nt, Artificial Sequence
  HLA class I histocompatibility antigen, A-23 alpha chain (25-40)
ggcagccacuccaugcgcuacuucagcaccuccgugagccggcccggg

SEQ ID NO: 44479 - RNA, 54 nt, Artificial Sequence
  HLA class I histocompatibility antigen, A-23 alpha chain (25-42)
ggcagccacuccaugcgcuacuucagcaccuccgugagccggcccgggcgcggc

SEQ ID NO: 44480 - RNA, 57 nt, Artificial Sequence
  HLA class I histocompatibility antigen, A-23 alpha chain (25-43)
ggcagccacuccaugcgcuacuucagcaccuccgugagccggcccgggcgcggcgag

SEQ ID NO: 44481 - RNA, 63 nt, Artificial Sequence
  HLA class I histocompatibility antigen, A-23 alpha chain (25-45)
ggcagccacuccaugcgcuacuucagcaccuccgugagccggcccgggcgcggcgagccgcgg

SEQ ID NO: 44482 - RNA, 78 nt, Artificial Sequence
  HLA class I histocompatibility antigen, A-23 alpha chain (25-50)
ggcagccacuccaugcgcuacuucagcaccuccgugagccggcccgggcgcggcgagccgcgguucaucgccgucggg

SEQ ID NO: 44483 - RNA, 87 nt, Artificial Sequence
  HLA class I histocompatibility antigen, A-23 alpha chain (25-53)
ggcagccacuccaugcgcuacuucagcaccuccgugagccggcccgggcgcggcgagccgcgguucaucgccgucggguacguggac

SEQ ID NO: 44484 - RNA, 90 nt, Artificial Sequence
  HLA class I histocompatibility antigen, A-23 alpha chain (25-54)
ggcagccacuccaugcgcuacuucagcaccuccgugagccggcccgggcgcggcgagccgcgguucaucgccgucggguacguggacgac

SEQ ID NO: 44485 - RNA, 108 nt, Artificial Sequence
  HLA class I histocompatibility antigen, A-23 alpha chain (25-60)
ggcagccacuccaugcgcuacuucagcaccuccgugagccggcccgggcgcggcgagccgcgguucaucgccgucggguacguggacgacacccaguucgugcgcuuc

SEQ ID NO: 44486 - RNA, 111 nt, Artificial Sequence
  HLA class I histocompatibility antigen, A-23 alpha chain (25-61)
ggcagccacuccaugcgcuacuucagcaccuccgugagccggcccgggcgcggcgagccgcgguucaucgccgucggguacguggacgacacccaguucgugcgcuucgac

SEQ ID NO: 44487 - RNA, 117 nt, Artificial Sequence
  HLA class I histocompatibility antigen, A-23 alpha chain (25-63)
ggcagccacuccaugcgcuacuucagcaccuccgugagccggcccgggcgcggcgagccgcgguucaucgccgucggguacguggacgacacccaguucgugcgcuucgacuccgac

SEQ ID NO: 44488 - RNA, 111 nt, Artificial Sequence
  HLA class I histocompatibility antigen, B-39 alpha chain (25-61)
ggcagccacuccaugcgcuacuucuacaccagcgugucccggcccgggcgcggcgagccgcgguucaucagcgucggguacguggacgacacccaguucgugcgcuucgac

SEQ ID NO: 44489 - RNA, 117 nt, Artificial Sequence
  HLA class I histocompatibility antigen, B-39 alpha chain (25-63)
ggcagccacuccaugcgcuacuucuacaccagcgugucccggcccgggcgcggcgagccgcgguucaucagcgucggguacguggacgacacccaguucgugcgcuucgacuccgac

SEQ ID NO: 44490 - RNA, 24 nt, Artificial Sequence
  Inosine-5'-monophosphate dehydrogenase 1 (142-149)
ggcagcaagcugguggggaucguc

SEQ ID NO: 44491 - RNA, 42 nt, Artificial Sequence
  Leucine-tRNA ligase, cytoplasmic (286-299)
ggcagcaugcccgagcugaagaaguacaugaagaaggugaug

SEQ ID NO: 44492 - RNA, 48 nt, Artificial Sequence
  Beta-secretase 2 (112-127)
ggcagcuccaacuucgccguggccgggaccccccacagcuacaucgac

SEQ ID NO: 44493 - RNA, 51 nt, Artificial Sequence
  Beta-secretase 2 (112-128)
ggcagcuccaacuucgccguggccgggaccccccacagcuacaucgacacc

SEQ ID NO: 44494 - RNA, 54 nt, Artificial Sequence
  Keratin, type II cytoskeletal 71 (27-44)
ggcagcuccagcuccuuccgcgccgggagcaagggccuguccgggggcuucggg

SEQ ID NO: 44495 - RNA, 27 nt, Artificial Sequence
  PH-interacting protein (339-347)
ggcagcaccgaccacaucauccgcgug

SEQ ID NO: 44496 - RNA, 27 nt, Artificial Sequence
  WD repeat-containing protein 48 (104-112)
ggcagcaccgagaaggugcugcgcguc

SEQ ID NO: 44497 - RNA, 27 nt, Artificial Sequence
  Interferon-induced protein with tetratricopeptide repeats 1 (265-273)
ggcagcguggacaaggcccuggagcuc

SEQ ID NO: 44498 - RNA, 27 nt, Artificial Sequence
  Polyadenylate-binding protein 2 (223-231)
ggcagcgugaaccgcgucaccauccug

SEQ ID NO: 44499 - RNA, 33 nt, Artificial Sequence
  Immunoglobulin superfamily member 8 (138-148)
ggcagcuacuccgggaagguggagcugcgcguc

SEQ ID NO: 44500 - RNA, 72 nt, Artificial Sequence
  HLA class I histocompatibility antigen, A-23 alpha chain (342-365)
ggcagcuacucccaggccgccagcuccgacagcgcgcagggguccgacgugagccugaccgccugcaagguc

SEQ ID NO: 44501 - RNA, 72 nt, Artificial Sequence
  HLA class I histocompatibility antigen, A-1 alpha chain (317-340)
ggcagcuacacccaggccgccuccagcgacuccgcgcaggggagcgacgugucccugaccgccugcaagguc

SEQ ID NO: 44502 - RNA, 27 nt, Artificial Sequence
  Myelin proteolipid protein (19-27)
ggcaccgccagcuucuucuuccuguac

SEQ ID NO: 44503 - RNA, 33 nt, Artificial Sequence
  Hemicentin-1 (688-698)
ggcaccgacaagcagaacagcacccugcgcuac

SEQ ID NO: 44504 - RNA, 27 nt, Artificial Sequence
  Chondroitin sulfate proteoglycan 4 (1612-1620)
ggcaccgacccccagcugcuccuguac

SEQ ID NO: 44505 - RNA, 24 nt, Artificial Sequence
  Cathepsin F (454-461)
ggcaccgacuggggggagaagggc

SEQ ID NO: 44506 - RNA, 30 nt, Artificial Sequence
  Cathepsin F (454-463)
ggcaccgacuggggggagaagggcuacuac

SEQ ID NO: 44507 - RNA, 33 nt, Artificial Sequence
  Cathepsin F (454-464)
ggcaccgacuggggggagaagggcuacuacuac

SEQ ID NO: 44508 - RNA, 27 nt, Artificial Sequence
  Cytoplasmic dynein 1 heavy chain 1 (2749-2757)
ggcaccuucaaccgcgccaugcugcgg

SEQ ID NO: 44509 - RNA, 93 nt, Artificial Sequence
  Nucleoporin p58/p45 (64-94)
ggcaccgggcuguucggcagcaagcccgccaccggguucacgcucggcgggaccaacaccggcaccccggccacgaccuccgcggccaccacc

SEQ ID NO: 44510 - RNA, 27 nt, Artificial Sequence
  DNA damage-binding protein 1 (702-710)
ggcaccaucgacgagauccagaagcug

SEQ ID NO: 44511 - RNA, 30 nt, Artificial Sequence
  60S ribosomal protein L6 (147-156)
ggcaccauccugaucauccucaccgggcgc

SEQ ID NO: 44512 - RNA, 39 nt, Artificial Sequence
  D-3-phosphoglycerate dehydrogenase (49-61)
ggcaccauccaggugaucacccaggggacgagccugaag

SEQ ID NO: 44513 - RNA, 27 nt, Artificial Sequence
  Hexokinase-1 (535-543)
ggcaccaacuuccgcgugcugcucguc

SEQ ID NO: 44514 - RNA, 27 nt, Artificial Sequence
  Calponin-3 (207-215)
ggcaccaacaagguggccagccagaag

SEQ ID NO: 44515 - RNA, 30 nt, Artificial Sequence
  Tripeptidyl-peptidase 1 (306-315)
ggcacccccaacuucccggcccugcucaag

SEQ ID NO: 44516 - RNA, 27 nt, Artificial Sequence
  Histone-lysine N-methyltransferase ASH1L (311-319)
ggcaccaccgccguguucaucaacaag

SEQ ID NO: 44517 - RNA, 27 nt, Artificial Sequence
  L-dopachrome tautomerase (301-309)
ggcaccuacgaggggcugcuccgccgg

SEQ ID NO: 44518 - RNA, 132 nt, Artificial Sequence
  Cytochrome c oxidase subunit 6C (32-75)
ggcguggccgcccuguacaaguuccgcgucgcggaccagcggaagaaggccuacgccgacuucuaccgcaacuacgacgugaugaaggacuucgaggagaugcggaaggccgggaucuuccagagcgugaag

SEQ ID NO: 44519 - RNA, 45 nt, Artificial Sequence
  Hemicentin-2 (666-680)
ggcguggcccccgaggacgccgggaacuacagcugccaggcgacc

SEQ ID NO: 44520 - RNA, 33 nt, Artificial Sequence
  Unconventional myosin-Ib (244-254)
ggcguggacgacgccgccaacuuccgcaccguc

SEQ ID NO: 44521 - RNA, 48 nt, Artificial Sequence
  Annexin A2 (50-65)
ggcguggacgaggucaccaucgugaacauccugaccaaccgcagcaac

SEQ ID NO: 44522 - RNA, 54 nt, Artificial Sequence
  Annexin A2 (50-67)
ggcguggacgaggucaccaucgugaacauccugaccaaccgcagcaacgcccag

SEQ ID NO: 44523 - RNA, 27 nt, Artificial Sequence
  Complement C3 (1424-1432)
ggcguggaccgcuacaucagcaaguac

SEQ ID NO: 44524 - RNA, 27 nt, Artificial Sequence
  Biotinidase (443-451)
ggcguguucgacgggcugcacaccguc

SEQ ID NO: 44525 - RNA, 27 nt, Artificial Sequence
  T-cell immunomodulatory protein (25-33)
ggcguggggcccgucccggcccgcgcc

SEQ ID NO: 44526 - RNA, 27 nt, Artificial Sequence
  CD109 antigen (187-195)
ggcgugaucagcaagaccuuccagcug

SEQ ID NO: 44527 - RNA, 27 nt, Artificial Sequence
  Zinc finger CCCH domain-containing protein 14 (68-76)
ggcgugcuggacaagcuccgcagcguc

SEQ ID NO: 44528 - RNA, 33 nt, Artificial Sequence
  Probable E3 ubiquitin-protein ligase HERC1 (3840-3850)
ggcgugcuggggcucaacauggcccccugcaug

SEQ ID NO: 44529 - RNA, 57 nt, Artificial Sequence
  Glia-derived nexin (188-206)
ggcgugcugacccgccucguccuggugaacgccguguacuucaaggggcuguggaag

SEQ ID NO: 44530 - RNA, 24 nt, Artificial Sequence
  Nucleolar RNA helicase 2 (421-428)
ggcgugcuggucgccaccaacgug

SEQ ID NO: 44531 - RNA, 39 nt, Artificial Sequence
  Neuronal cell adhesion molecule (398-410)
ggcgugcccaucgagaucgccccggacgaccccagccgc

SEQ ID NO: 44532 - RNA, 42 nt, Artificial Sequence
  Neuronal cell adhesion molecule (398-411)
ggcgugcccaucgagaucgccccggacgaccccagccgcaag

SEQ ID NO: 44533 - RNA, 72 nt, Artificial Sequence
  Heat shock cognate 71 kDa protein (470-493)
ggcgugccccagaucgaggucaccuucgacaucgacgccaacgggauccugaacgugagcgccguggacaag

SEQ ID NO: 44534 - RNA, 102 nt, Artificial Sequence
  Apolipoprotein L1 (146-179)
ggcgugcagaagguccacaaggggaccaccaucgccaacguggugagcggcucccugagcaucuccagcgggauccucacgcuggucggcauggggcuggcc

SEQ ID NO: 44535 - RNA, 27 nt, Artificial Sequence
  Ropporin-1B (131-139)
ggcgugaccaucaccaagacgcugaag

SEQ ID NO: 44536 - RNA, 27 nt, Artificial Sequence
  Alpha-synuclein (47-55)
ggcgugguccacgggguggccaccgug

SEQ ID NO: 44537 - RNA, 30 nt, Artificial Sequence
  Melanoma-associated antigen C2 (257-266)
ggcguguacgccgggcgcgagcacuucguc

SEQ ID NO: 44538 - RNA, 141 nt, Artificial Sequence
  Protein CDV3 homolog (167-213)
ggcguguaccgccccccgggggcccggcugaccaccacgcgcaagaccccccagggcccccccgagaucuacagcgacacccaguucccgucccuccagagcaccgccaagcacgucgagucccggaaccgcuaccugaag

SEQ ID NO: 44539 - RNA, 27 nt, Artificial Sequence
  Procollagen-lysine,2-oxoglutarate 5-dioxygenase 1 (159-167)
ggcuacgcccccaaccugagcaagcuc

SEQ ID NO: 44540 - RNA, 45 nt, Artificial Sequence
  Interferon alpha-inducible protein 6 (116-130)
ggcuacgccacccacaaguaccuggacagcgaggaggacgaggag

SEQ ID NO: 44541 - RNA, 48 nt, Artificial Sequence
  HLA class I histocompatibility antigen, B-44 alpha chain (136-151)
ggcuacgaccaggacgccuacgacgggaaggacuacaucgcccugaac

SEQ ID NO: 44542 - RNA, 27 nt, Artificial Sequence
  Alpha-parvin (305-313)
ggcuacuucgugccccugcacagcuuc

SEQ ID NO: 44543 - RNA, 30 nt, Artificial Sequence
  Keratin, type II cytoskeletal 3 (100-109)
ggcuacgggggcggguucggcgggggcuuc

SEQ ID NO: 44544 - RNA, 48 nt, Artificial Sequence
  HLA class I histocompatibility antigen, A-2 alpha chain (111-126)
ggcuaccaccaguacgccuacgacgggaaggacuacaucgcccugaag

SEQ ID NO: 44545 - RNA, 48 nt, Artificial Sequence
  Laminin subunit gamma-1 (666-681)
ggcuaccuggacgacgugacccucgccagcgcccgccccgggccgggc

SEQ ID NO: 44546 - RNA, 33 nt, Artificial Sequence
  Unconventional myosin-XVIIIa (1111-1121)
ggcuaccccgaccacaugguguucagcgaguuc

SEQ ID NO: 44547 - RNA, 27 nt, Artificial Sequence
  Heterogeneous nuclear ribonucleoprotein U-like protein 1 (231-239)
ggcuacccccugaccaucgagggguuc

SEQ ID NO: 44548 - RNA, 30 nt, Artificial Sequence
  Spectrin beta chain, non-erythrocytic 1 (189-198)
ggcuaccccaacgugaacauccacaacuuc

SEQ ID NO: 44549 - RNA, 27 nt, Artificial Sequence
  FERM domain-containing protein 5 (67-75)
ggcuacagcuccaaguuccaguucuuc

SEQ ID NO: 44550 - RNA, 60 nt, Artificial Sequence
  L-lactate dehydrogenase B chain (247-266)
ggcuacaccaacugggccaucgggcugagcguggccgaccucaucgaguccaugcugaag

SEQ ID NO: 44551 - RNA, 60 nt, Artificial Sequence
  L-lactate dehydrogenase A chain (275-294)
ggcuacaccagcugggccaucgggcuguccguggccgaccucgcggagagcaucaugaag

SEQ ID NO: 44552 - RNA, 27 nt, Artificial Sequence
  Beta-hexosaminidase subunit alpha (369-377)
ggcuacguggucuggcaggagguguuc

SEQ ID NO: 44553 - RNA, 27 nt, Artificial Sequence
  Nestin (55-63)
cacgccgacgacgagcuggccgcgcuc

SEQ ID NO: 44554 - RNA, 27 nt, Artificial Sequence
  Centrosomal protein C10orf90 (226-234)
cacgccgacgacaaggagaccagcuuc

SEQ ID NO: 44555 - RNA, 27 nt, Artificial Sequence
  Sentrin-specific protease 6 (139-147)
cacgcccacgcccagauccccgugguc

SEQ ID NO: 44556 - RNA, 27 nt, Artificial Sequence
  Sodium/potassium/calcium exchanger 1 (212-220)
cacgccaucaccccccgcaccacggug

SEQ ID NO: 44557 - RNA, 24 nt, Artificial Sequence
  Growth/differentiation factor 15 (241-248)
cacgcccagaucaagaccagccug

SEQ ID NO: 44558 - RNA, 27 nt, Artificial Sequence
  Beta-parvin (157-165)
cacgaccugcuccgcccccggggcugg

SEQ ID NO: 44559 - RNA, 36 nt, Artificial Sequence
  Kinase D-interacting substrate of 220 kDa (21-32)
cacgagggccccccgcgcgcccccagcggguacucc

SEQ ID NO: 44560 - RNA, 27 nt, Artificial Sequence
  Sex comb on midleg-like protein 2 (691-699)
cacgagaucgacggcaaggcccuguuc

SEQ ID NO: 44561 - RNA, 27 nt, Artificial Sequence
  Aldehyde dehydrogenase family 1 member A3 (41-49)
cacgagagcaaguccggcaagaaguuc

SEQ ID NO: 44562 - RNA, 27 nt, Artificial Sequence
  Echinoderm microtubule-associated protein-like 6 (1842-1850)
cacgaggugccccugggcaagcagguc

SEQ ID NO: 44563 - RNA, 18 nt, Artificial Sequence
  Leucine-rich repeat-containing protein 42 (71-76)
cacuucaucuucaccuac

SEQ ID NO: 44564 - RNA, 45 nt, Artificial Sequence
  Laminin subunit gamma-1 (101-115)
cacggcgccgccuuccugaccgacuacaacaaccaggcggacacc

SEQ ID NO: 44565 - RNA, 48 nt, Artificial Sequence
  Laminin subunit gamma-1 (101-116)
cacggcgccgccuuccugaccgacuacaacaaccaggcggacaccacg

SEQ ID NO: 44566 - RNA, 27 nt, Artificial Sequence
  Fibrocystin-L (1809-1817)
caccacagcguguccgucguggugggc

SEQ ID NO: 44567 - RNA, 27 nt, Artificial Sequence
  DIS3-like exonuclease 1 (421-429)
cacaucgccgacgugacccacuucguc

SEQ ID NO: 44568 - RNA, 27 nt, Artificial Sequence
  Protein arginine N-methyltransferase 3 (190-198)
cacaucuucaaggacaaggugguccug

SEQ ID NO: 44569 - RNA, 27 nt, Artificial Sequence
  Carbonic anhydrase 14 (176-184)
cacauccugagccaccuccacgaggug

SEQ ID NO: 44570 - RNA, 27 nt, Artificial Sequence
  Coatomer subunit gamma-2 (46-54)
cacauccugaccaagauccucuaccug

SEQ ID NO: 44571 - RNA, 27 nt, Artificial Sequence
  Chondroitin sulfate proteoglycan 4 (290-298)
cacaucaacgcccaccgccuggagauc

SEQ ID NO: 44572 - RNA, 21 nt, Artificial Sequence
  Mediator of RNA polymerase II transcription subunit 23 (178-184)
cacaucaaccagaucggcuac

SEQ ID NO: 44573 - RNA, 72 nt, Artificial Sequence
  Histidine triad nucleotide-binding protein 1 (59-82)
cacaucagccagaucuccguggccgaggacgacgacgagagccugcucggccaccugaugaucgucgggaag

SEQ ID NO: 44574 - RNA, 21 nt, Artificial Sequence
  Thymidylate synthase (256-262)
cacaucuaccugaaccacauc

SEQ ID NO: 44575 - RNA, 27 nt, Artificial Sequence
  Vesicle-trafficking protein SEC22c (208-216)
caccuggccgagcacagccuccaggug

SEQ ID NO: 44576 - RNA, 27 nt, Artificial Sequence
  Leucine-rich repeat-containing protein C10orf11 (68-76)
caccuggccgaggugacccccgcccuc

SEQ ID NO: 44577 - RNA, 33 nt, Artificial Sequence
  Cytochrome c oxidase subunit 1 (151-161)
caccuggccggcgugagcuccauccucggggcc

SEQ ID NO: 44578 - RNA, 27 nt, Artificial Sequence
  Beta-hexosaminidase subunit beta (59-67)
caccuggcccccgagaacuucuacauc

SEQ ID NO: 44579 - RNA, 27 nt, Artificial Sequence
  Zinc finger protein 638 (1613-1621)
caccuggcccaggcccucgugaccguc

SEQ ID NO: 44580 - RNA, 27 nt, Artificial Sequence
  Receptor-interacting serine/threonine-protein kinase 4 (730-738)
caccuggccaccgugaagcuccugguc

SEQ ID NO: 44581 - RNA, 27 nt, Artificial Sequence
  Unconventional myosin-Ic (1017-1025)
caccuggccguggucgccccccgccuc

SEQ ID NO: 44582 - RNA, 30 nt, Artificial Sequence
  Zinc finger protein 879 (30-39)
caccuggacagcgcccagcgcgcccucuac

SEQ ID NO: 44583 - RNA, 27 nt, Artificial Sequence
  Vacuolar protein sorting-associated protein 13C (1304-1312)
caccuggacagcaugaacgugucccuc

SEQ ID NO: 44584 - RNA, 27 nt, Artificial Sequence
  Membrane-associated transporter protein (324-332)
caccugaucggcuggaccgccuuccuc

SEQ ID NO: 44585 - RNA, 24 nt, Artificial Sequence
  Neutral alpha-glucosidase AB (77-84)
caccugauccacgaggugaccaag

SEQ ID NO: 44586 - RNA, 27 nt, Artificial Sequence
  Polypeptide N-acetylgalactosaminyltransferase 2 (166-174)
caccugaucaaggagaucauccucgug

SEQ ID NO: 44587 - RNA, 33 nt, Artificial Sequence
  Myomegalin (201-211)
caccugcucgaggagcccaccagcauggaggug

SEQ ID NO: 44588 - RNA, 27 nt, Artificial Sequence
  Transmembrane and TPR repeat-containing protein 3 (93-101)
caccugcucaacaugaucuuccacgcc

SEQ ID NO: 44589 - RNA, 27 nt, Artificial Sequence
  Gamma-tubulin complex component 5 (435-443)
caccugcucaacacccuguacaaggcc

SEQ ID NO: 44590 - RNA, 27 nt, Artificial Sequence
  RNA-binding protein EWS (499-507)
caccugaacggccacaucaagcaggug

SEQ ID NO: 44591 - RNA, 27 nt, Artificial Sequence
  Triple functional domain protein (852-860)
caccugcaggccgaggugaagcagguc

SEQ ID NO: 44592 - RNA, 27 nt, Artificial Sequence
  Eukaryotic translation initiation factor 3 subunit C-like protein (594-602)
caccugcaggacaacauccagcacgcc

SEQ ID NO: 44593 - RNA, 51 nt, Artificial Sequence
  Histone H2A.V (60-76)
caccugcagcucgccauccgcggcgacgaggagcuggacagccugaucaag

SEQ ID NO: 44594 - RNA, 27 nt, Artificial Sequence
  Inhibitor of nuclear factor kappa-B kinase subunit alpha (688-696)
caccugagcaccaucauccacgaggcc

SEQ ID NO: 44595 - RNA, 27 nt, Artificial Sequence
  Protein TANC1 (1149-1157)
caccugagcaccguggaguuccuccug

SEQ ID NO: 44596 - RNA, 27 nt, Artificial Sequence
  Pre-mRNA-splicing factor ATP-dependent RNA helicase PRP16 (1008-1016)
caccugaccuaccucaacguguaccug

SEQ ID NO: 44597 - RNA, 30 nt, Artificial Sequence
  ATPase family AAA domain-containing protein 1 (79-88)
caccugguggacccccucaacaugcacguc

SEQ ID NO: 44598 - RNA, 27 nt, Artificial Sequence
  Dedicator of cytokinesis protein 1 (422-430)
caccugguggaccgcaccaccgccguc

SEQ ID NO: 44599 - RNA, 27 nt, Artificial Sequence
  Putative inactive carbonic anhydrase 5B-like protein (29-37)
caccuggugcacuggaacgccgucaag

SEQ ID NO: 44600 - RNA, 27 nt, Artificial Sequence
  UDP-galactose translocator (109-117)
caccuggugcucuuccugcacgaggcc

SEQ ID NO: 44601 - RNA, 27 nt, Artificial Sequence
  Tonsoku-like protein (37-45)
caccuguacgaggaccucuuccgcgcc

SEQ ID NO: 44602 - RNA, 27 nt, Artificial Sequence
  Alpha/beta hydrolase domain-containing protein 13 (38-46)
caccuguacggcgggaucauccuccug

SEQ ID NO: 44603 - RNA, 27 nt, Artificial Sequence
  Interferon-related developmental regulator 1 (373-381)
caccuguacaacagcgccgccuucaag

SEQ ID NO: 44604 - RNA, 18 nt, Artificial Sequence
  Bax inhibitor 1 (94-99)
cacauggugacccacuuc

SEQ ID NO: 44605 - RNA, 27 nt, Artificial Sequence
  Eukaryotic translation initiation factor 3 subunit C-like protein (433-441)
cacaacgccgaccagccccugcgcgug

SEQ ID NO: 44606 - RNA, 45 nt, Artificial Sequence
  Tartrate-resistant acid phosphatase type 5 (240-254)
cacaaccugcaguaccuccaggacgagaacggcgugggguacguc

SEQ ID NO: 44607 - RNA, 27 nt, Artificial Sequence
  GMP synthase (glutamine-hydrolyzing) (555-563)
cacaacgugaaccgcgucguguacauc

SEQ ID NO: 44608 - RNA, 24 nt, Artificial Sequence
  60S ribosomal protein L10 (92-99)
caccccuuccacgugauccgcauc

SEQ ID NO: 44609 - RNA, 27 nt, Artificial Sequence
  Protein EURL homolog (214-222)
cacccccacuacagccgcgaggagcug

SEQ ID NO: 44610 - RNA, 27 nt, Artificial Sequence
  Porphobilinogen deaminase (109-117)
caccccaaguucgugggcaagacccug

SEQ ID NO: 44611 - RNA, 30 nt, Artificial Sequence
  Transmembrane protein 209 (465-474)
caccccaaguacccggacggcaagaccuuc

SEQ ID NO: 44612 - RNA, 27 nt, Artificial Sequence
  WD repeat-containing protein 43 (361-369)
caccccaacagcgccgugcugaugguc

SEQ ID NO: 44613 - RNA, 24 nt, Artificial Sequence
  Angio-associated migratory cell protein (51-58)
cacccccgcgccccggugcugcuc

SEQ ID NO: 44614 - RNA, 24 nt, Artificial Sequence
  Microtubule-associated proteins 1A/1B light chain 3B (27-34)
caccccaccaagaucccggugauc

SEQ ID NO: 44615 - RNA, 27 nt, Artificial Sequence
  Uncharacterized protein C18orf8 (244-252)
caccccgugcugccggcccgcagcauc

SEQ ID NO: 44616 - RNA, 27 nt, Artificial Sequence
  Melanoma-derived growth regulatory protein (65-73)
caccgcggccagguggucuacguguuc

SEQ ID NO: 44617 - RNA, 27 nt, Artificial Sequence
  Platelet-derived growth factor D (2-10)
caccgccugaucuucguguacacccuc

SEQ ID NO: 44618 - RNA, 24 nt, Artificial Sequence
  Serine protease HTRA1 (143-150)
caccgccccccggugaucguccug

SEQ ID NO: 44619 - RNA, 27 nt, Artificial Sequence
  Asparagine synthetase (glutamine-hydrolyzing) (86-94)
cacagcgccacccccuuccugaaggug

SEQ ID NO: 44620 - RNA, 24 nt, Artificial Sequence
  Histone deacetylase 1 (68-75)
cacagcgacgacuacaucaaguuc

SEQ ID NO: 44621 - RNA, 33 nt, Artificial Sequence
  Histone-lysine N-methyltransferase NSD3 (877-887)
cacagcgaccccauguucuccagcuacgccuac

SEQ ID NO: 44622 - RNA, 27 nt, Artificial Sequence
  Histone deacetylase 9 (697-705)
cacagcgagcaccacucccugcucuac

SEQ ID NO: 44623 - RNA, 42 nt, Artificial Sequence
  Tubulin alpha-1C chain (209-222)
cacagcuucggcgggggcaccggguccggcuucaccagccug

SEQ ID NO: 44624 - RNA, 24 nt, Artificial Sequence
  Neuropilin-2 (415-422)
cacagcggcaucgcccugcgccuc

SEQ ID NO: 44625 - RNA, 24 nt, Artificial Sequence
  Pre-mRNA-processing factor 19 (391-398)
cacagcggccccaucaccuccauc

SEQ ID NO: 44626 - RNA, 27 nt, Artificial Sequence
  Centrosome-associated protein 350 (1116-1124)
cacagcaucuccauccccaccaagcug

SEQ ID NO: 44627 - RNA, 27 nt, Artificial Sequence
  Serine/threonine-protein kinase MRCK alpha (1363-1371)
cacagcaacgaccacacccuguccuuc

SEQ ID NO: 44628 - RNA, 27 nt, Artificial Sequence
  Heterogeneous nuclear ribonucleoprotein K (187-195)
cacagcaccgaccgcgugguccugauc

SEQ ID NO: 44629 - RNA, 24 nt, Artificial Sequence
  COP9 signalosome complex subunit 6 (130-137)
cacaccgaccugcccgugagcguc

SEQ ID NO: 44630 - RNA, 42 nt, Artificial Sequence
  Sodium/potassium-transporting ATPase subunit alpha-3 (688-701)
cacaccgagaucguguucgcccgcaccagcccccagcagaag

SEQ ID NO: 44631 - RNA, 45 nt, Artificial Sequence
  Sodium/potassium-transporting ATPase subunit alpha-3 (688-702)
cacaccgagaucguguucgcccgcaccagcccccagcagaagcug

SEQ ID NO: 44632 - RNA, 42 nt, Artificial Sequence
  Tyrosine-protein phosphatase non-receptor type substrate 1 (453-466)
cacaccgaguacgccagcauccagaccuccccccagccggcc

SEQ ID NO: 44633 - RNA, 27 nt, Artificial Sequence
  H(+)/Cl(-) exchange transporter 3 (72-80)
cacaccaucgacugggugcgcgagaag

SEQ ID NO: 44634 - RNA, 33 nt, Artificial Sequence
  Tensin-3 (344-354)
cacacccagggccccguggacgggagccuguac

SEQ ID NO: 44635 - RNA, 27 nt, Artificial Sequence
  Bifunctional glutamate/proline-tRNA ligase (1093-1101)
cacguggccgacuucgcccccgagguc

SEQ ID NO: 44636 - RNA, 36 nt, Artificial Sequence
  Cytochrome c oxidase subunit 6A1, mitochondrial (75-86)
cacgugaacccccugccgaccggcuacgaggacgag

SEQ ID NO: 44637 - RNA, 48 nt, Artificial Sequence
  Beta-2-microglobulin (83-98)
cacgugacccugagccagcccaagaucgucaagugggaccgcgacaug

SEQ ID NO: 44638 - RNA, 18 nt, Artificial Sequence
  GPI transamidase component PIG-T (164-169)
cacuacuuccugcgcuac

SEQ ID NO: 44639 - RNA, 24 nt, Artificial Sequence
  Vacuolar protein sorting-associated protein 41 homolog (13-20)
cacuacggcaagguguaccugcuc

SEQ ID NO: 44640 - RNA, 24 nt, Artificial Sequence
  Interferon-induced protein with tetratricopeptide repeats 1 (383-390)
cacuacggccgcuuccaggaguuc

SEQ ID NO: 44641 - RNA, 27 nt, Artificial Sequence
  Transcription factor SOX-10 (387-395)
cacuacggcagcgccuuccccuccauc

SEQ ID NO: 44642 - RNA, 27 nt, Artificial Sequence
  AF4/FMR2 family member 4 (917-925)
cacuaccugcaggaggccaagaagcuc

SEQ ID NO: 44643 - RNA, 27 nt, Artificial Sequence
  KN motif and ankyrin repeat domain-containing protein 1 (1167-1175)
cacuacagcgugucccacagcaacuuc

SEQ ID NO: 44644 - RNA, 27 nt, Artificial Sequence
  L-dopachrome tautomerase (189-197)
cacuacuacagcgugcgcgacacccug

SEQ ID NO: 44645 - RNA, 24 nt, Artificial Sequence
  Brefeldin A-inhibited guanine nucleotide-exchange protein 2 (340-347)
aucgccgacgaccgccagagccug

SEQ ID NO: 44646 - RNA, 27 nt, Artificial Sequence
  Tripartite motif-containing protein 44 (270-278)
aucgccgacgaggagcagaaggcccug

SEQ ID NO: 44647 - RNA, 30 nt, Artificial Sequence
  Serine hydroxymethyltransferase, cytosolic (79-88)
aucgccgacgagaacggcgccuaccugaug

SEQ ID NO: 44648 - RNA, 27 nt, Artificial Sequence
  Vitamin K-dependent gamma-carboxylase (475-483)
aucgccgacuuccccggccugcaccuc

SEQ ID NO: 44649 - RNA, 27 nt, Artificial Sequence
  Chromodomain-helicase-DNA-binding protein 3 (372-380)
aucgccgacggcggguucaccgagcug

SEQ ID NO: 44650 - RNA, 24 nt, Artificial Sequence
  Probable dimethyladenosine transferase (116-123)
aucgccgacaagauccagcagauc

SEQ ID NO: 44651 - RNA, 24 nt, Artificial Sequence
  Mitotic checkpoint serine/threonine-protein kinase BUB1 beta (956-963)
aucgccgaccuggcccaccuccug

SEQ ID NO: 44652 - RNA, 27 nt, Artificial Sequence
  Gamma-interferon-inducible protein 16 (48-56)
aucgccgaccugauggaggagaaguuc

SEQ ID NO: 44653 - RNA, 24 nt, Artificial Sequence
  Ras association domain-containing protein 5 (335-342)
aucgccgaccgcccccuguaccuc

SEQ ID NO: 44654 - RNA, 24 nt, Artificial Sequence
  Dolichyl-diphosphooligosaccharide-proteinosyltransferase subunit 2 (268-275)
aucgccgacagccaccagaacuuc

SEQ ID NO: 44655 - RNA, 27 nt, Artificial Sequence
  Consortin (202-210)
aucgccgaggaccccaagguguuccug

SEQ ID NO: 44656 - RNA, 27 nt, Artificial Sequence
  Eukaryotic translation initiation factor 4 gamma 2 (5-13)
aucgccgagggcggggccagccgcuuc

SEQ ID NO: 44657 - RNA, 27 nt, Artificial Sequence
  Tensin-3 (154-162)
aucgccuucagccgccccgugaaguac

SEQ ID NO: 44658 - RNA, 90 nt, Artificial Sequence
  Flavin reductaseADPH) (6-35)
aucgccaucuucggcgccaccgggcagaccggccugacgacccucgcgcaggccgugcaggccggguacgaggucaccgugcuggugcgc

SEQ ID NO: 44659 - RNA, 27 nt, Artificial Sequence
  Ras GTPase-activating-like protein IQGAP2 (219-227)
aucgccaucaacgaggccguggagaag

SEQ ID NO: 44660 - RNA, 27 nt, Artificial Sequence
  Ubiquitin carboxyl-terminal hydrolase 15 (259-267)
aucgccaagagcuacgccgagcugauc

SEQ ID NO: 44661 - RNA, 27 nt, Artificial Sequence
  Prolow-density lipoprotein receptor-related protein 1 (1392-1400)
aucgcccuggacccccgcgacggcauc

SEQ ID NO: 44662 - RNA, 36 nt, Artificial Sequence
  Transcription factor Sp1 (551-562)
aucgccaacgcccccggcgaccacggggcgcagcug

SEQ ID NO: 44663 - RNA, 27 nt, Artificial Sequence
  Dolichyl-diphosphooligosaccharide-proteinosyltransferase subunit 2 (220-228)
aucgccaacaccguggagcugcgcguc

SEQ ID NO: 44664 - RNA, 42 nt, Artificial Sequence
  Solute carrier family 2, facilitated glucose transporter member 1 (21-34)
aucgcccagguguucggccuggacagcaucauggggaacaag

SEQ ID NO: 44665 - RNA, 48 nt, Artificial Sequence
  Solute carrier family 2, facilitated glucose transporter member 1 (21-36)
aucgcccagguguucggccuggacagcaucauggggaacaaggaccuc

SEQ ID NO: 44666 - RNA, 24 nt, Artificial Sequence
  60S ribosomal protein L35 (54-61)
aucgcccgcgugcugaccgucauc

SEQ ID NO: 44667 - RNA, 27 nt, Artificial Sequence
  Alpha-actinin-3 (114-122)
aucgccagcaagggcgugaagcugguc

SEQ ID NO: 44668 - RNA, 27 nt, Artificial Sequence
  Derlin-2 (50-58)
aucgccgugggccacaucuacuucuuc

SEQ ID NO: 44669 - RNA, 21 nt, Artificial Sequence
  Solute carrier family 25 member 35 (138-144)
aucgccgugggccaccaguac

SEQ ID NO: 44670 - RNA, 27 nt, Artificial Sequence
  Ectonucleoside triphosphate diphosphohydrolase 4 (279-287)
aucgccuacgaggugcccaagaccguc

SEQ ID NO: 44671 - RNA, 27 nt, Artificial Sequence
  DNA topoisomerase 3-beta-1 (521-529)
aucugccagcgcaacuacgugaccguc

SEQ ID NO: 44672 - RNA, 30 nt, Artificial Sequence
  Zinc transporter ZIP14 (350-359)
aucgacggccuggccaucggggccagcuuc

SEQ ID NO: 44673 - RNA, 27 nt, Artificial Sequence
  Nucleolin (454-462)
aucgacggccgcagcaucucccuguac

SEQ ID NO: 44674 - RNA, 30 nt, Artificial Sequence
  Nucleolin (454-463)
aucgacggccgcagcaucucccuguacuac

SEQ ID NO: 44675 - RNA, 21 nt, Artificial Sequence
  Keratin, type II cytoskeletal 1b (179-185)
aucgacaaggugcgcuuccug

SEQ ID NO: 44676 - RNA, 69 nt, Artificial Sequence
  Puromycin-sensitive aminopeptidase (305-327)
aucgaccugaucgccaucgccgacuucgcggccggcgccauggagaacugggggcucgugaccuaccgc

SEQ ID NO: 44677 - RNA, 27 nt, Artificial Sequence
  Prelamin-A/C (80-88)
aucgacaacggcaagcagcgcgaguuc

SEQ ID NO: 44678 - RNA, 30 nt, Artificial Sequence
  Structural maintenance of chromosomes flexible hinge domain-containing protein 1 (183-192)
aucgacaacggccgcgggaugaccagcaag

SEQ ID NO: 44679 - RNA, 27 nt, Artificial Sequence
  DNA damage-binding protein 1 (794-802)
aucgaccagcacaccuucgaggugcug

SEQ ID NO: 44680 - RNA, 21 nt, Artificial Sequence
  Pre-mRNA-processing-splicing factor 8 (1380-1386)
aucgacagccagcgcgugugg

SEQ ID NO: 44681 - RNA, 42 nt, Artificial Sequence
  Clathrin heavy chain 1 (1125-1138)
aucgacagcuacaucaaggccgacgaccccuccagcuacaug

SEQ ID NO: 44682 - RNA, 45 nt, Artificial Sequence
  Clathrin heavy chain 1 (1125-1139)
aucgacagcuacaucaaggccgacgaccccuccagcuacauggag

SEQ ID NO: 44683 - RNA, 21 nt, Artificial Sequence
  Talin-1 (292-298)
aucgaggccaaggugcgcuac

SEQ ID NO: 44684 - RNA, 27 nt, Artificial Sequence
  Microtubule-associated protein 4 (17-25)
aucgagggcgagaucaagcgcgacuuc

SEQ ID NO: 44685 - RNA, 27 nt, Artificial Sequence
  Actin, cytoplasmic 2 (71-79)
aucgagcacggcaucgugaccaacugg

SEQ ID NO: 44686 - RNA, 18 nt, Artificial Sequence
  Fatty acid desaturase 2 (352-357)
aucgagcaccaccuguuc

SEQ ID NO: 44687 - RNA, 21 nt, Artificial Sequence
  Programmed cell death protein 5 (93-99)
aucgagauccugaagaaggug

SEQ ID NO: 44688 - RNA, 27 nt, Artificial Sequence
  DnaJ homolog subfamily C member 7 (216-224)
aucgagaaggccgugcaguucuucguc

SEQ ID NO: 44689 - RNA, 21 nt, Artificial Sequence
  Cysteine-rich protein 2-binding protein (156-162)
aucgagaagcacuggaccuuc

SEQ ID NO: 44690 - RNA, 24 nt, Artificial Sequence
  rRNA-processing protein FCF1 homolog (110-117)
aucgagaagcugggccagaaguac

SEQ ID NO: 44691 - RNA, 30 nt, Artificial Sequence
  Lysosomal-trafficking regulator (3604-3613)
aucgagauggagacccagauccaccuguac

SEQ ID NO: 44692 - RNA, 27 nt, Artificial Sequence
  Cholinesterase (384-392)
aucuucuuccccggcgugagcgaguuc

SEQ ID NO: 44693 - RNA, 27 nt, Artificial Sequence
  Inositol 1,4,5-trisphosphate receptor type 2 (1770-1778)
aucuucagcgagggcaucuuccugggg

SEQ ID NO: 44694 - RNA, 30 nt, Artificial Sequence
  E3 ubiquitin-protein ligase UBR4 (2405-2414)
aucggcgccagcguggaccccgccgggguc

SEQ ID NO: 44695 - RNA, 27 nt, Artificial Sequence
  Mannose-6-phosphate isomerase (121-129)
aucggcgacgaggccgccacccaccug

SEQ ID NO: 44696 - RNA, 27 nt, Artificial Sequence
  Beta-catenin-like protein 1 (430-438)
aucggcgacgggcgcagccccgaguuc

SEQ ID NO: 44697 - RNA, 27 nt, Artificial Sequence
  Fructose-bisphosphate aldolase A (208-216)
aucggcgagcacacccccagcgcccug

SEQ ID NO: 44698 - RNA, 21 nt, Artificial Sequence
  40S ribosomal protein S29 (50-56)
aucggcuucaucaagcuggac

SEQ ID NO: 44699 - RNA, 24 nt, Artificial Sequence
  Transmembrane protein 263 (60-67)
aucggcgggaagagccuggaggug

SEQ ID NO: 44700 - RNA, 30 nt, Artificial Sequence
  RNA-binding Raly-like protein (25-34)
aucggcaaccugaacaccgccaucgugaag

SEQ ID NO: 44701 - RNA, 30 nt, Artificial Sequence
  RNA-binding protein Raly (25-34)
aucggcaaccugaacaccgcccucgugaag

SEQ ID NO: 44702 - RNA, 45 nt, Artificial Sequence
  Protocadherin Fat 1 (1606-1620)
aucggcaacagcuucaugaucgaccccgugcugggguccaucaag

SEQ ID NO: 44703 - RNA, 45 nt, Artificial Sequence
  Protocadherin Fat 1 (1682-1696)
aucggcagcuucguggggauggucaccgcccacucccagagcucc

SEQ ID NO: 44704 - RNA, 24 nt, Artificial Sequence
  Cilia- and flagella-associated protein 20 (17-24)
aucggcagcaagccccugcagauc

SEQ ID NO: 44705 - RNA, 21 nt, Artificial Sequence
  Retinoblastoma-like protein 1 (197-203)
aucggcaccccccgcaaguuc

SEQ ID NO: 44706 - RNA, 72 nt, Artificial Sequence
  Heterogeneous nuclear ribonucleoprotein U (241-264)
aucggcuggagccugaccaccuccgggaugcuccugggcgaggaggaguucagcuacggguacucccugaag

SEQ ID NO: 44707 - RNA, 24 nt, Artificial Sequence
  Zinc finger protein 148 (258-265)
auccaccccccgaagcuggugcuc

SEQ ID NO: 44708 - RNA, 27 nt, Artificial Sequence
  Trifunctional purine biosynthetic protein adenosine-3 (206-214)
auccaccccagccugcucccguccuuc

SEQ ID NO: 44709 - RNA, 21 nt, Artificial Sequence
  Dedicator of cytokinesis protein 7 (741-747)
auccacuacguguuccgccug

SEQ ID NO: 44710 - RNA, 24 nt, Artificial Sequence
  MICOS complex subunit MIC27 (159-166)
aucaucgccaaggugaccgccaag

SEQ ID NO: 44711 - RNA, 24 nt, Artificial Sequence
  Protein PRRC2C (1659-1666)
aucaucgacgaccaccccgaggug

SEQ ID NO: 44712 - RNA, 27 nt, Artificial Sequence
  26S protease regulatory subunit 4 (115-123)
aucaucgacgacaaccacgccaucgug

SEQ ID NO: 44713 - RNA, 24 nt, Artificial Sequence
  Lambda-crystallin homolog (90-97)
aucaucgacgaccgcgugauccug

SEQ ID NO: 44714 - RNA, 27 nt, Artificial Sequence
  RANBP2-like and GRIP domain-containing protein 1 (712-720)
aucaucgacgacagcgacuccaaccug

SEQ ID NO: 44715 - RNA, 27 nt, Artificial Sequence
  Niemann-Pick C1 protein (1094-1102)
aucaucgacgacaccaucuucaaccug

SEQ ID NO: 44716 - RNA, 27 nt, Artificial Sequence
  Eukaryotic translation initiation factor 3 subunit L (186-194)
aucaucgacgaguucaucuaccaguuc

SEQ ID NO: 44717 - RNA, 30 nt, Artificial Sequence
  UDP-N-acetylhexosamine pyrophosphorylase (491-500)
aucaucgacgagaacggcgugcacgagcug

SEQ ID NO: 44718 - RNA, 27 nt, Artificial Sequence
  Serine/threonine-protein kinase Kist (152-160)
aucaucgaccacaucuucgccagcaag

SEQ ID NO: 44719 - RNA, 27 nt, Artificial Sequence
  AP-3 complex subunit mu-2 (190-198)
aucaucgacaagagcggcuccaccauc

SEQ ID NO: 44720 - RNA, 27 nt, Artificial Sequence
  Caspase recruitment domain-containing protein 19 (143-151)
aucaucgaccgccacgugagccgguac

SEQ ID NO: 44721 - RNA, 24 nt, Artificial Sequence
  Double-strand-break repair protein rad21 homolog (444-451)
aucaucgaggagcccagccgccug

SEQ ID NO: 44722 - RNA, 63 nt, Artificial Sequence
  T-complex protein 1 subunit alpha (160-180)
aucaucggcaucaacggggacuucuucgccaacaugguggucgacgccgugcuggcgaucaag

SEQ ID NO: 44723 - RNA, 27 nt, Artificial Sequence
  Ubiquitin-like modifier-activating enzyme 1 (91-99)
aucauccugggcggggugaaggccguc

SEQ ID NO: 44724 - RNA, 27 nt, Artificial Sequence
  Transportin-1 (757-765)
aucaucaaccgccccaacaccccgaag

SEQ ID NO: 44725 - RNA, 27 nt, Artificial Sequence
  Far upstream element-binding protein 1 (359-367)
aucaucaccgaccugcuccgcagcgug

SEQ ID NO: 44726 - RNA, 27 nt, Artificial Sequence
  Glycerol-3-phosphate acyltransferase 4 (30-38)
aucaucgugcccgccaucuucggcguc

SEQ ID NO: 44727 - RNA, 45 nt, Artificial Sequence
  Syntaxin-7 (70-84)
aucaaggaguucggcagccugcccaccaccccguccgagcagcgc

SEQ ID NO: 44728 - RNA, 48 nt, Artificial Sequence
  Alpha-enolase (26-41)
aucaaggagaaguacggcaaggacgccaccaacgugggggacgagggc

SEQ ID NO: 44729 - RNA, 21 nt, Artificial Sequence
  26S proteasome non-ATPase regulatory subunit 8 (133-139)
aucaagcaccccgugagccug

SEQ ID NO: 44730 - RNA, 33 nt, Artificial Sequence
  Keratin, type II cytoskeletal 1 (184-194)
aucaagagccugaacaaccaguucgccuccuuc

SEQ ID NO: 44731 - RNA, 30 nt, Artificial Sequence
  Synaptojanin-1 (895-904)
aucaagagcucccugcccgagaacaacuuc

SEQ ID NO: 44732 - RNA, 69 nt, Artificial Sequence
  Vimentin (444-466)
aucaagaccguggagacccgcgacggccaggucaucaacgagacgagccagcaccacgacgaccuggag

SEQ ID NO: 44733 - RNA, 27 nt, Artificial Sequence
  Talin-1 (862-870)
auccuggccgacgccaccgcgaagaug

SEQ ID NO: 44734 - RNA, 30 nt, Artificial Sequence
  DNA-dependent protein kinase catalytic subunit (544-553)
auccuggccgacgaggccuucuucagcgug

SEQ ID NO: 44735 - RNA, 30 nt, Artificial Sequence
  Exonuclease 3'-5' domain-containing protein 2 (30-39)
auccuggccgacggcaccauccucaaggug

SEQ ID NO: 44736 - RNA, 36 nt, Artificial Sequence
  Globoside alpha-1,3-N-acetylgalactosaminyltransferase 1 (266-277)
auccuggccgacaaggccaacggcaucauggcggcc

SEQ ID NO: 44737 - RNA, 33 nt, Artificial Sequence
  Catenin alpha-1 (140-150)
auccuggccgacauggccgacguguacaagcuc

SEQ ID NO: 44738 - RNA, 27 nt, Artificial Sequence
  Dynactin subunit 3 (87-95)
auccuggccgaggagcaguucauccuc

SEQ ID NO: 44739 - RNA, 27 nt, Artificial Sequence
  Transmembrane protein 87A (234-242)
auccuggccgagcuccugagcgccgug

SEQ ID NO: 44740 - RNA, 27 nt, Artificial Sequence
  Serum paraoxonase/arylesterase 2 (239-247)
auccuggcccacgagauccacgugcuc

SEQ ID NO: 44741 - RNA, 27 nt, Artificial Sequence
  Centrosomal protein of 170 kDa protein B (1269-1277)
auccuggcccaggagauccacgacgug

SEQ ID NO: 44742 - RNA, 27 nt, Artificial Sequence
  Unconventional myosin-XV (2127-2135)
auccuggcccagcucgccaaccaggug

SEQ ID NO: 44743 - RNA, 27 nt, Artificial Sequence
  Multidrug resistance-associated protein 1 (560-568)
auccuggacgcccagaccgccuucgug

SEQ ID NO: 44744 - RNA, 27 nt, Artificial Sequence
  Unconventional myosin-Id (455-463)
auccuggacgacgccugcaugaacgug

SEQ ID NO: 44745 - RNA, 27 nt, Artificial Sequence
  Acyl-CoA synthetase short-chain family member 3, mitochondrial (486-494)
auccuggacgacaacaugcagaagcuc

SEQ ID NO: 44746 - RNA, 27 nt, Artificial Sequence
  FRAS1-related extracellular matrix protein 1 (98-106)
auccuggacgaggacaccgugaagcuc

SEQ ID NO: 44747 - RNA, 27 nt, Artificial Sequence
  HEAT repeat-containing protein 1 (1277-1285)
auccuggacgaggagaaguucaacgug

SEQ ID NO: 44748 - RNA, 24 nt, Artificial Sequence
  Hemicentin-1 (2341-2348)
auccuggacgagggccacauccuc

SEQ ID NO: 44749 - RNA, 30 nt, Artificial Sequence
  Hemicentin-1 (2341-2350)
auccuggacgagggccacauccuccagcug

SEQ ID NO: 44750 - RNA, 27 nt, Artificial Sequence
  Pleckstrin homology domain-containing family H member 1 (1314-1322)
auccuggaccacaacaccaugcaggug

SEQ ID NO: 44751 - RNA, 27 nt, Artificial Sequence
  Mitochondrial tRNA-specific 2-thiouridylase 1 (63-71)
auccuggacauccccuuccaccaggug

SEQ ID NO: 44752 - RNA, 27 nt, Artificial Sequence
  Protein GPR107 (122-130)
auccuggacaucagccgcuccgaggug

SEQ ID NO: 44753 - RNA, 24 nt, Artificial Sequence
  Heat shock protein HSP 90-beta (496-503)
auccuggacaagaagguggagaag

SEQ ID NO: 44754 - RNA, 27 nt, Artificial Sequence
  Anthrax toxin receptor 1 (48-56)
auccuggacaagagcggcuccgugcuc

SEQ ID NO: 44755 - RNA, 30 nt, Artificial Sequence
  UDP-glucose 4-epimerase (67-76)
auccuggaccagggcgcccuccagcgccug

SEQ ID NO: 44756 - RNA, 33 nt, Artificial Sequence
  Pleckstrin homology-like domain family B member 1 (850-860)
auccuggacagccaggccggccagauccgcgcc

SEQ ID NO: 44757 - RNA, 27 nt, Artificial Sequence
  Chromobox protein homolog 6 (48-56)
auccuggacagccgccucaucgccgcc

SEQ ID NO: 44758 - RNA, 30 nt, Artificial Sequence
  Voltage-dependent calcium channel subunit alpha-2/delta-2 (731-740)
auccuggacaccggcaucacccagcagcuc

SEQ ID NO: 44759 - RNA, 27 nt, Artificial Sequence
  Kinesin-like protein KIF1B (1497-1505)
auccuggacaccagcguggccuacguc

SEQ ID NO: 44760 - RNA, 27 nt, Artificial Sequence
  CAP-Gly domain-containing linker protein 4 (12-20)
auccuguucgaccccaagaccagcgug

SEQ ID NO: 44761 - RNA, 27 nt, Artificial Sequence
  ATP-binding cassette sub-family A member 13 (826-834)
auccuguucgagaucaaccccaagcuc

SEQ ID NO: 44762 - RNA, 27 nt, Artificial Sequence
  Carbonic anhydrase-related protein (233-241)
auccuguuccgcuacccccucaccauc

SEQ ID NO: 44763 - RNA, 27 nt, Artificial Sequence
  Tribbles homolog 1 (150-158)
auccugggcgagaccaaggccuacgug

SEQ ID NO: 44764 - RNA, 27 nt, Artificial Sequence
  KH domain-containing, RNA-binding, signal transduction-associated protein 1 (176-184)
auccugggcccccaggggaacaccauc

SEQ ID NO: 44765 - RNA, 24 nt, Artificial Sequence
  Epidermal growth factor receptor substrate 15 (164-171)
auccugggccgcgugugggagcuc

SEQ ID NO: 44766 - RNA, 24 nt, Artificial Sequence
  Lecithin retinol acyltransferase (98-105)
auccugggcgugaucgucaaggug

SEQ ID NO: 44767 - RNA, 111 nt, Artificial Sequence
  Glyceraldehyde-3-phosphate dehydrogenase (273-309)
auccugggcuacaccgagcaccagguggucagcuccgacuucaacagcgacacccacuccagcacguucgacgccggggccggcaucgcgcucaacgaccacuucgugaag

SEQ ID NO: 44768 - RNA, 24 nt, Artificial Sequence
  Sperm-associated antigen 7 (80-87)
auccugcacgacguggucgaggug

SEQ ID NO: 44769 - RNA, 36 nt, Artificial Sequence
  Lysosomal-trafficking regulator (1804-1815)
auccugcacgagaucggcgggaccggcaucuucgug

SEQ ID NO: 44770 - RNA, 27 nt, Artificial Sequence
  Coiled-coil domain-containing protein 93 (480-488)
auccugcaccgcaagaucgacgaggug

SEQ ID NO: 44771 - RNA, 27 nt, Artificial Sequence
  S1 RNA-binding domain-containing protein 1 (186-194)
auccugcacaccgacguggucuaccuc

SEQ ID NO: 44772 - RNA, 27 nt, Artificial Sequence
  Prolow-density lipoprotein receptor-related protein 1 (408-416)
auccugaucgagcaccucuacggccug

SEQ ID NO: 44773 - RNA, 27 nt, Artificial Sequence
  Tissue-type plasminogen activator (243-251)
auccugaucggcaagguguacaccgcc

SEQ ID NO: 44774 - RNA, 57 nt, Artificial Sequence
  ATP-citrate synthase (337-355)
auccugaucaucggcgggagcaucgccaacuucaccaacguggccgcgaccuucaag

SEQ ID NO: 44775 - RNA, 27 nt, Artificial Sequence
  Laminin subunit beta-1 (612-620)
auccugauccgcuacgagccccagcuc

SEQ ID NO: 44776 - RNA, 27 nt, Artificial Sequence
  Receptor-interacting serine/threonine-protein kinase 4 (149-157)
auccugcucgacgcccacuaccacgug

SEQ ID NO: 44777 - RNA, 30 nt, Artificial Sequence
  CD109 antigen (864-873)
auccugcucgaccugaccgacaaccgccug

SEQ ID NO: 44778 - RNA, 27 nt, Artificial Sequence
  Lon protease homolog 2, peroxisomal (293-301)
auccugcucgacaacgaccacuacgcc

SEQ ID NO: 44779 - RNA, 27 nt, Artificial Sequence
  Zinc finger protein basonuclin-1 (109-117)
auccugcucgaccgccuguucagcgug

SEQ ID NO: 44780 - RNA, 27 nt, Artificial Sequence
  COP9 signalosome complex subunit 3 (213-221)
auccugcucggcaaggugcagcagcug

SEQ ID NO: 44781 - RNA, 30 nt, Artificial Sequence
  T-lymphoma invasion and metastasis-inducing protein 1 (425-434)
auccugcucaccgccgcccagggcaccgug

SEQ ID NO: 44782 - RNA, 27 nt, Artificial Sequence
  Transcription factor IIIB 90 kDa subunit (434-442)
auccugaacgagagcgaggcccgcgug

SEQ ID NO: 44783 - RNA, 30 nt, Artificial Sequence
  G-protein coupled receptor 143 (297-306)
auccugaaccccgcccagggcuuccuccug

SEQ ID NO: 44784 - RNA, 27 nt, Artificial Sequence
  Adipocyte enhancer-binding protein 1 (945-953)
auccugaaccccggcgaguaccgcgug

SEQ ID NO: 44785 - RNA, 27 nt, Artificial Sequence
  Kinesin-like protein KIF13B (36-44)
auccugaaccccgugaacaccaaccuc

SEQ ID NO: 44786 - RNA, 27 nt, Artificial Sequence
  Lysine-specific demethylase 5B (178-186)
auccugaaccccuacaaccucuuccug

SEQ ID NO: 44787 - RNA, 27 nt, Artificial Sequence
  Importin-7 (833-841)
auccugcccgccuucauccuccuguuc

SEQ ID NO: 44788 - RNA, 33 nt, Artificial Sequence
  Lysosome-associated membraneoprotein 1 (248-258)
auccugcccgacgcccgcgacccggccuucaag

SEQ ID NO: 44789 - RNA, 33 nt, Artificial Sequence
  Peroxisome biogenesis factor 1 (908-918)
auccugcccgacgagagcaaguucaacauguac

SEQ ID NO: 44790 - RNA, 27 nt, Artificial Sequence
  E3 ubiquitin-protein ligase CBL-B (77-85)
auccugcccgacaccuaccagcaccuc

SEQ ID NO: 44791 - RNA, 27 nt, Artificial Sequence
  Estradiol 17-beta-dehydrogenase 11 (272-280)
auccugcccgagcgcuuccucgccgug

SEQ ID NO: 44792 - RNA, 27 nt, Artificial Sequence
  E1A-binding protein p400 (1032-1040)
auccugcccaagggcagcgcccgcgug

SEQ ID NO: 44793 - RNA, 27 nt, Artificial Sequence
  LINE-1 retrotransposable element ORF2 protein (817-825)
auccugcccaaggugaucuaccgcuuc

SEQ ID NO: 44794 - RNA, 27 nt, Artificial Sequence
  Aryl hydrocarbon receptor (23-31)
auccugcccccgcagcucgcccuguuc

SEQ ID NO: 44795 - RNA, 27 nt, Artificial Sequence
  Zinc finger and SCAN domain-containing protein 25 (93-101)
auccugccccgcgaguucuacgccugg

SEQ ID NO: 44796 - RNA, 27 nt, Artificial Sequence
  DDB1- and CUL4-associated factor 4 (318-326)
auccugcaggacgagcaguaccucaug

SEQ ID NO: 44797 - RNA, 27 nt, Artificial Sequence
  Zinc finger protein RFP (330-338)
auccugagcgacaaccuccgccaggug

SEQ ID NO: 44798 - RNA, 27 nt, Artificial Sequence
  AP2-associated protein kinase 1 (635-643)
auccugagcgacgugacccacuccgcc

SEQ ID NO: 44799 - RNA, 27 nt, Artificial Sequence
  Ras GTPase-activating protein 1 (674-682)
auccugagcgagcucguggagaagauc

SEQ ID NO: 44800 - RNA, 27 nt, Artificial Sequence
  Mediator of RNA polymerase II transcription subunit 13 (1076-1084)
auccugagcgaguccgugaugaaccuc

SEQ ID NO: 44801 - RNA, 27 nt, Artificial Sequence
  Endoplasmic reticulum metallopeptidase 1 (340-348)
auccugaccgacagcauccagcgcgcc

SEQ ID NO: 44802 - RNA, 27 nt, Artificial Sequence
  Ankyrin repeat domain-containing protein 17 (886-894)
auccugaccgagacccagcagggccuc

SEQ ID NO: 44803 - RNA, 27 nt, Artificial Sequence
  Notchless protein homolog 1 (240-248)
auccugaccggccacacccagagcgug

SEQ ID NO: 44804 - RNA, 24 nt, Artificial Sequence
  InaD-like protein (50-57)
auccugacccuccagcagagcauc

SEQ ID NO: 44805 - RNA, 27 nt, Artificial Sequence
  Fibrous sheath-interacting protein 2 (3738-3746)
auccugaccaacaaccuccagcugagc

SEQ ID NO: 44806 - RNA, 27 nt, Artificial Sequence
  Midasin (1057-1065)
auccugaccagcuccgugaagcucaac

SEQ ID NO: 44807 - RNA, 27 nt, Artificial Sequence
  Spatacsin (642-650)
auccugaccagcuacaucaacgagcuc

SEQ ID NO: 44808 - RNA, 27 nt, Artificial Sequence
  Eukaryotic translation initiation factor 2-alpha kinase 4 (377-385)
auccugguggagcacaucagcggcguc

SEQ ID NO: 44809 - RNA, 27 nt, Artificial Sequence
  Plexin-B2 (432-440)
auccugguggagaucaacaagcgcguc

SEQ ID NO: 44810 - RNA, 27 nt, Artificial Sequence
  Heat shock factor protein 4 (167-175)
auccuguggcgcgagguggucacccuc

SEQ ID NO: 44811 - RNA, 27 nt, Artificial Sequence
  1-phosphatidylinositol 4,5-bisphosphate phosphodiesterase gamma-1 (109-117)
auccuguacggcauggaguuccgccuc

SEQ ID NO: 44812 - RNA, 30 nt, Artificial Sequence
  116 kDa U5 small nuclear ribonucleoprotein component (202-211)
aucauggacacccccggccacgugaacuuc

SEQ ID NO: 44813 - RNA, 27 nt, Artificial Sequence
  Eukaryotic translation initiation factor 4 gamma 3 (915-923)
aucaugcacgacugcguggucaagcug

SEQ ID NO: 44814 - RNA, 30 nt, Artificial Sequence
  Syntenin-1 (269-278)
aucaugcccgccuucaucuucgagcacauc

SEQ ID NO: 44815 - RNA, 27 nt, Artificial Sequence
  CLIP-associating protein 1 (410-418)
aucaugcccaccaucuucaaccugauc

SEQ ID NO: 44816 - RNA, 30 nt, Artificial Sequence
  Hexokinase-2 (118-127)
aucaugcgcggcagcgggacccagcuguuc

SEQ ID NO: 44817 - RNA, 36 nt, Artificial Sequence
  Protein ERGIC-53 (496-507)
aucauguaccgcagccagcaggaggccgccgcgaag

SEQ ID NO: 44818 - RNA, 66 nt, Artificial Sequence
  T-complex protein 1 subunit eta (413-434)
aucaacgcccugaccgccgcgagcgaggccgccugccucaucguguccgucgacgagaccaucaag

SEQ ID NO: 44819 - RNA, 36 nt, Artificial Sequence
  Vimentin (455-466)
aucaacgagaccagccagcaccacgacgaccuggag

SEQ ID NO: 44820 - RNA, 24 nt, Artificial Sequence
  DNA-dependent protein kinase catalytic subunit (866-873)
aucaacaagaaccugcucaccgug

SEQ ID NO: 44821 - RNA, 21 nt, Artificial Sequence
  Deoxynucleotidyltransferase terminal-interacting protein 2 (255-261)
aucaacaagcccaacuucuac

SEQ ID NO: 44822 - RNA, 33 nt, Artificial Sequence
  Pleckstrin homology domain-containing family H member 1 (922-932)
aucaacgugcccgucgaggccgccagcguggac

SEQ ID NO: 44823 - RNA, 24 nt, Artificial Sequence
  Sodium/potassium-transporting ATPase subunit alpha-1 (2-9)
auccccgccgaccugcgcaucauc

SEQ ID NO: 44824 - RNA, 30 nt, Artificial Sequence
  Far upstream element-binding protein 1 (213-222)
auccccgccagcaaggccggccuggugauc

SEQ ID NO: 44825 - RNA, 30 nt, Artificial Sequence
  Collagen alpha-1(XV) chain (185-194)
auccccuuccagcgcagcucccaggcccug

SEQ ID NO: 44826 - RNA, 45 nt, Artificial Sequence
  Leucine-rich repeat-containing G-protein coupled receptor 6 (62-76)
auccccggccaggccuucagcgggcuguacucccucaagauccug

SEQ ID NO: 44827 - RNA, 27 nt, Artificial Sequence
  Low-density lipoprotein receptor-related protein 2 (601-609)
aucccccacccguucggcgugagccug

SEQ ID NO: 44828 - RNA, 24 nt, Artificial Sequence
  BCL-6 corepressor (730-737)
aucccccacaccccgaucgagauc

SEQ ID NO: 44829 - RNA, 27 nt, Artificial Sequence
  Chondroitin sulfate proteoglycan 4 (108-116)
aucccccacaccgugguccugaccgug

SEQ ID NO: 44830 - RNA, 27 nt, Artificial Sequence
  C-syn protooncogene  (266-274)
aucccccgcgagagccugcagcucauc

SEQ ID NO: 44831 - RNA, 27 nt, Artificial Sequence
  Interferon-induced transmembrane protein 10 (62-70)
aucccccgcccgcccgccggcagcccc

SEQ ID NO: 44832 - RNA, 27 nt, Artificial Sequence
  Basement membrane-specific heparan sulfate proteoglycan core protein (447-455)
auccccagccacccgcgcgugaccguc

SEQ ID NO: 44833 - RNA, 45 nt, Artificial Sequence
  E3 ubiquitin-protein ligase RNF13 (145-159)
auccccagcguguucaucggcgaguccagcgccaacucccugaag

SEQ ID NO: 44834 - RNA, 27 nt, Artificial Sequence
  Sorbin and SH3 domain-containing protein 2 (262-270)
auccccaccgccauccgcaccacggug

SEQ ID NO: 44835 - RNA, 27 nt, Artificial Sequence
  Procollagen-lysine,2-oxoglutarate 5-dioxygenase 2 (34-42)
auccccaccgacaagcugcucgugauc

SEQ ID NO: 44836 - RNA, 27 nt, Artificial Sequence
  Rap1 GTPase-activating protein 1 (28-36)
auccccuacccgagcgugcacgagguc

SEQ ID NO: 44837 - RNA, 27 nt, Artificial Sequence
  Spectrin beta chain, non-erythrocytic 1 (579-587)
auccaggccgagcgcgugcggggcguc

SEQ ID NO: 44838 - RNA, 24 nt, Artificial Sequence
  N6-adenosine-methyltransferase 70 kDa subunit (8-15)
auccaggcccacaagaagcagcug

SEQ ID NO: 44839 - RNA, 30 nt, Artificial Sequence
  Potassium/sodium hyperpolarization-activated cyclic nucleotide-gated channel 4 (778-787)
auccaggccccccugcaggccgcggccgcc

SEQ ID NO: 44840 - RNA, 27 nt, Artificial Sequence
  CCAAT/enhancer-binding protein zeta (255-263)
auccaggacgacgccgugcacacccug

SEQ ID NO: 44841 - RNA, 42 nt, Artificial Sequence
  Beta-2-microglobulin (21-34)
auccagcgcacccccaagauccagguguacagccggcacccg

SEQ ID NO: 44842 - RNA, 45 nt, Artificial Sequence
  Beta-2-microglobulin (21-35)
auccagcgcacccccaagauccagguguacagccggcacccggcc

SEQ ID NO: 44843 - RNA, 51 nt, Artificial Sequence
  Beta-2-microglobulin (21-37)
auccagcgcacccccaagauccagguguacagccggcacccggccgagaac

SEQ ID NO: 44844 - RNA, 54 nt, Artificial Sequence
  Beta-2-microglobulin (21-38)
auccagcgcacccccaagauccagguguacagccggcacccggccgagaacggc

SEQ ID NO: 44845 - RNA, 57 nt, Artificial Sequence
  Beta-2-microglobulin (21-39)
auccagcgcacccccaagauccagguguacagccggcacccggccgagaacggcaag

SEQ ID NO: 44846 - RNA, 60 nt, Artificial Sequence
  Beta-2-microglobulin (1-20)
auccagcgcacccccaagauccagguguacagccggcacccggccgagaacggcaagucc

SEQ ID NO: 44847 - RNA, 63 nt, Artificial Sequence
  Beta-2-microglobulin (1-21)
auccagcgcacccccaagauccagguguacagccggcacccggccgagaacggcaaguccaac

SEQ ID NO: 44848 - RNA, 69 nt, Artificial Sequence
  Beta-2-microglobulin (21-43)
auccagcgcacccccaagauccagguguacagccggcacccggccgagaacggcaaguccaacuuccug

SEQ ID NO: 44849 - RNA, 72 nt, Artificial Sequence
  Beta-2-microglobulin (21-44)
auccagcgcacccccaagauccagguguacagccggcacccggccgagaacggcaaguccaacuuccugaac

SEQ ID NO: 44850 - RNA, 27 nt, Artificial Sequence
  Hemicentin-1 (876-884)
auccagagcgagaccaccgugacgguc

SEQ ID NO: 44851 - RNA, 33 nt, Artificial Sequence
  Glia-derived nexin (392-402)
auccgccacaaccccaccggcgccgugcuguuc

SEQ ID NO: 44852 - RNA, 27 nt, Artificial Sequence
  Protein wntless homolog (302-310)
auccgccagggcaucuucuacgccaug

SEQ ID NO: 44853 - RNA, 21 nt, Artificial Sequence
  Synembryn-B (156-162)
auccgcagccagcugcgguac

SEQ ID NO: 44854 - RNA, 27 nt, Artificial Sequence
  Clathrin heavy chain 1 (170-178)
aucagcgcccagcagaaccgcgugguc

SEQ ID NO: 44855 - RNA, 24 nt, Artificial Sequence
  HLA class I histocompatibility antigen, B-44 alpha chain (218-225)
aucagcgaccacgaggugacccug

SEQ ID NO: 44856 - RNA, 27 nt, Artificial Sequence
  Integrin-alpha FG-GAP repeat-containing protein 2 (132-140)
aucagcgacaucggcgggcacgccuac

SEQ ID NO: 44857 - RNA, 24 nt, Artificial Sequence
  Protein arginine N-methyltransferase 1 (112-119)
aucagcgacuacgccgugaagauc

SEQ ID NO: 44858 - RNA, 27 nt, Artificial Sequence
  Membrane-associated transporter protein (237-245)
aucagcgaggccccccugaccgaggug

SEQ ID NO: 44859 - RNA, 24 nt, Artificial Sequence
  26S proteasome non-ATPase regulatory subunit 13 (64-71)
aucagcgaguucgagcaccgcgug

SEQ ID NO: 44860 - RNA, 21 nt, Artificial Sequence
  Cleft lip and palate transmembrane protein 1 (109-115)
aucagcgagcacgagcacuuc

SEQ ID NO: 44861 - RNA, 27 nt, Artificial Sequence
  Zinc finger protein ZFPM2 (861-869)
aucagcuucaacaagguggagaacuac

SEQ ID NO: 44862 - RNA, 30 nt, Artificial Sequence
  Neprilysin (536-545)
aucagcggcgccgccguggucaacgcguuc

SEQ ID NO: 44863 - RNA, 33 nt, Artificial Sequence
  Annexin A2 (214-224)
aucagcaucaugaccgagcgcuccgugccccac

SEQ ID NO: 44864 - RNA, 27 nt, Artificial Sequence
  Integrin alpha-6 (516-524)
aucagcaucgugggcacccuggaggcc

SEQ ID NO: 44865 - RNA, 27 nt, Artificial Sequence
  Transcription factor SOX-10 (334-342)
aucagcaagcccccgggcguggcccug

SEQ ID NO: 44866 - RNA, 24 nt, Artificial Sequence
  Serine-protein kinase ATM (1999-2006)
aucagccugcaggaccuccugcug

SEQ ID NO: 44867 - RNA, 45 nt, Artificial Sequence
  Glia-derived nexin (263-277)
aucagcaugcugaucgcccuccccaccgaguccagcaccccgcug

SEQ ID NO: 44868 - RNA, 27 nt, Artificial Sequence
  Unconventional myosin-XVIIIa (62-70)
aucagcaaccccaucccgaucaaggug

SEQ ID NO: 44869 - RNA, 27 nt, Artificial Sequence
  Interferon regulatory factor 3 (68-76)
aucagcaacucccacccccugagccuc

SEQ ID NO: 44870 - RNA, 27 nt, Artificial Sequence
  Poly (ADP-ribose) polymerase 14 (310-318)
aucagccccggccgcuacuuccugcuc

SEQ ID NO: 44871 - RNA, 48 nt, Artificial Sequence
  Disintegrin and metalloproteinase domain-containing protein 10 (189-204)
aucagcucccacgugaaggccaucgacaccaucuaccagaccacggac

SEQ ID NO: 44872 - RNA, 30 nt, Artificial Sequence
  Dolichyl-diphosphooligosaccharide-proteinosyltransferase subunit 2 (230-239)
aucagcaccgaggugggcaucaccaacguc

SEQ ID NO: 44873 - RNA, 27 nt, Artificial Sequence
  Peroxisome biogenesis factor 1 (593-601)
aucagcacccgcgagaagcuggugcuc

SEQ ID NO: 44874 - RNA, 27 nt, Artificial Sequence
  Hemicentin-1 (2-10)
aucagcugggaggugguccacaccgug

SEQ ID NO: 44875 - RNA, 27 nt, Artificial Sequence
  UDP-N-acetylhexosamine pyrophosphorylase (463-471)
aucaccgccgacgugaaccacaaccug

SEQ ID NO: 44876 - RNA, 33 nt, Artificial Sequence
  Endoplasmin (418-428)
aucaccgacgacuuccacgacaugaugcccaag

SEQ ID NO: 44877 - RNA, 27 nt, Artificial Sequence
  Maltase-glucoamylase (141-149)
aucaccgacuucaacaacauccgcuac

SEQ ID NO: 44878 - RNA, 21 nt, Artificial Sequence
  Hemicentin-1 (2935-2941)
aucaccgacaucggccgcuac

SEQ ID NO: 44879 - RNA, 24 nt, Artificial Sequence
  Ral GTPase-activating protein subunit beta (1463-1470)
aucaccgacaucgugaacaaguac

SEQ ID NO: 44880 - RNA, 24 nt, Artificial Sequence
  Myosin-9 (315-322)
aucaccgaccuggaggagcgccuc

SEQ ID NO: 44881 - RNA, 27 nt, Artificial Sequence
  Protein piccolo (883-891)
aucaccgaccugcagaaggaguucuac

SEQ ID NO: 44882 - RNA, 30 nt, Artificial Sequence
  Titin (15513-15522)
aucaccggccugaccgagaaccaggaguac

SEQ ID NO: 44883 - RNA, 27 nt, Artificial Sequence
  Leucine-rich repeat-containing protein 34 (306-314)
aucacccacgacggcaugguguaccug

SEQ ID NO: 44884 - RNA, 24 nt, Artificial Sequence
  Titin (14574-14581)
aucaccaaggacagcgugacccug

SEQ ID NO: 44885 - RNA, 21 nt, Artificial Sequence
  Elongation factor 2 (165-171)
aucaccaagggcgugcaguac

SEQ ID NO: 44886 - RNA, 27 nt, Artificial Sequence
  CLIP-associating protein 1 (390-398)
aucacccugggccaccucagcuccgug

SEQ ID NO: 44887 - RNA, 27 nt, Artificial Sequence
  Armadillo repeat-containing X-linked protein 2 (498-506)
aucaccaacgacuaccagcaccugcuc

SEQ ID NO: 44888 - RNA, 30 nt, Artificial Sequence
  Titin (16885-16894)
aucaccaaccugacccagggcgaggaguac

SEQ ID NO: 44889 - RNA, 27 nt, Artificial Sequence
  Heat shock 70 kDa protein 1-like (299-307)
aucacccgcgcccgguucgaggagcug

SEQ ID NO: 44890 - RNA, 60 nt, Artificial Sequence
  L-lactate dehydrogenase A chain (23-42)
aucaccguggucggcgugggggccgugggcauggccugcgcgaucagcauccugaugaag

SEQ ID NO: 44891 - RNA, 60 nt, Artificial Sequence
  L-lactate dehydrogenase B chain (24-43)
aucaccguggucggcguggggcaggugggcauggccugcgccaucagcauccuggggaag

SEQ ID NO: 44892 - RNA, 27 nt, Artificial Sequence
  G protein-coupled receptor kinase 4 (6-14)
aucguggccaacagccugcuccugaag

SEQ ID NO: 44893 - RNA, 27 nt, Artificial Sequence
  G protein-coupled receptor kinase 6 (6-14)
aucguggccaacaccguccugcucaag

SEQ ID NO: 44894 - RNA, 27 nt, Artificial Sequence
  T-cell surfaceoprotein CD8 beta chain (211-219)
aucgugugccugaagaucagcggcuuc

SEQ ID NO: 44895 - RNA, 27 nt, Artificial Sequence
  Sorting nexin-13 (161-169)
aucguggacgacuucggcacccaccug

SEQ ID NO: 44896 - RNA, 27 nt, Artificial Sequence
  Tripartite motif-containing protein 2 (200-208)
aucguggacgacauccacagcaccuuc

SEQ ID NO: 44897 - RNA, 27 nt, Artificial Sequence
  Fibronectin isoform 7 (519-527)
aucguggacgacaucaccuacaacguc

SEQ ID NO: 44898 - RNA, 27 nt, Artificial Sequence
  U3 small nucleolar ribonucleoprotein protein MPP10 (190-198)
aucguggacgacaaguucuucaagcug

SEQ ID NO: 44899 - RNA, 24 nt, Artificial Sequence
  Alpha-actinin-1 (115-122)
aucguggacggcaacgucaagaug

SEQ ID NO: 44900 - RNA, 30 nt, Artificial Sequence
  Methylcrotonoyl-CoA carboxylase beta chain, mitochondrial (300-309)
aucguggacggcagccgcuucaccgaguuc

SEQ ID NO: 44901 - RNA, 27 nt, Artificial Sequence
  Proteasome inhibitor PI31 subunit (209-217)
aucguggacccccugcgcagcggcuuc

SEQ ID NO: 44902 - RNA, 27 nt, Artificial Sequence
  Neutral amino acid transporter A (156-164)
aucguggaccgcaccaccacggucgug

SEQ ID NO: 44903 - RNA, 27 nt, Artificial Sequence
  HMG domain-containing protein 3 (1356-1364)
aucguggacagcaagcccaacggcguc

SEQ ID NO: 44904 - RNA, 27 nt, Artificial Sequence
  Synemin (748-756)
aucguggaggagcccgucagcuacgug

SEQ ID NO: 44905 - RNA, 33 nt, Artificial Sequence
  Glia-derived nexin (63-73)
aucgugaucagcccccacggcaucgccuccguc

SEQ ID NO: 44906 - RNA, 36 nt, Artificial Sequence
  Sterol regulatory element-binding protein 2 (1129-1140)
aucgugaagcugggcgggggcaccgccaucgccgcg

SEQ ID NO: 44907 - RNA, 51 nt, Artificial Sequence
  Melanoma-associated antigen 4 (205-221)
aucgugcugggcaccaucgccauggagggggacagcgccuccgaggaggag

SEQ ID NO: 44908 - RNA, 27 nt, Artificial Sequence
  Elongator complex protein 4 (107-115)
aucgugaacggccacacccugcucguc

SEQ ID NO: 44909 - RNA, 30 nt, Artificial Sequence
  Rho guanine nucleotide exchange factor 2 (500-509)
aucgugcgcgacaucgccaaccaggagaag

SEQ ID NO: 44910 - RNA, 27 nt, Artificial Sequence
  Cytoplasmic dynein 1 heavy chain 1 (1043-1051)
aucgugagcgaggucgagcaguacgug

SEQ ID NO: 44911 - RNA, 42 nt, Artificial Sequence
  Glia-derived nexin (119-132)
aucgugaccgucgccaacgccguguucgugaagaacgcgagc

SEQ ID NO: 44912 - RNA, 30 nt, Artificial Sequence
  Neuropilin-2 (58-67)
aucguguacgcccccgagccgaaccagaag

SEQ ID NO: 44913 - RNA, 27 nt, Artificial Sequence
  Mitochondrial calcium uniporter regulator 1 (3-11)
aucguguacaaggacauggucaccaag

SEQ ID NO: 44914 - RNA, 27 nt, Artificial Sequence
  Transmembrane emp24 domain-containing protein 5 (5-13)
aucuggcugcccuucccggugcuccug

SEQ ID NO: 44915 - RNA, 27 nt, Artificial Sequence
  Unconventional myosin-Va (407-415)
aucuacgccaagcuguucaacuggauc

SEQ ID NO: 44916 - RNA, 27 nt, Artificial Sequence
  Alpha-soluble NSF attachment protein (44-52)
aucuacgcccgcgccgcgaacauguuc

SEQ ID NO: 44917 - RNA, 27 nt, Artificial Sequence
  DNA polymerase delta subunit 2 (88-96)
aucuacgccacccgccugauccagaug

SEQ ID NO: 44918 - RNA, 24 nt, Artificial Sequence
  39S ribosomal protein L20, mitochondrial (107-114)
aucuacgagcccaagaccuucaag

SEQ ID NO: 44919 - RNA, 27 nt, Artificial Sequence
  V-type proton ATPase 116 kDa subunit a isoform 1 (560-568)
aucuacuucaagaagccccugaacauc

SEQ ID NO: 44920 - RNA, 33 nt, Artificial Sequence
  Antizyme inhibitor 1 (258-268)
aucuacuuccccgagggcagcggggugaagauc

SEQ ID NO: 44921 - RNA, 30 nt, Artificial Sequence
  Protein disulfide-isomerase A3 (453-462)
aucuacuucagccccgccaacaagaagcug

SEQ ID NO: 44922 - RNA, 24 nt, Artificial Sequence
  Zinc finger protein 382 (116-123)
aucuacggcaagaccuucacccug

SEQ ID NO: 44923 - RNA, 27 nt, Artificial Sequence
  Protein kinase C and casein kinase substrate in neurons protein 2 (266-274)
aucuaccacgaccuggagcagagcauc

SEQ ID NO: 44924 - RNA, 27 nt, Artificial Sequence
  Ubiquitin-conjugating enzyme E2 N (75-83)
aucuaccaccccaacguggacaagcug

SEQ ID NO: 44925 - RNA, 27 nt, Artificial Sequence
  Diacylglycerol kinase zeta (748-756)
aucuacauccuggaccccgagcuccug

SEQ ID NO: 44926 - RNA, 27 nt, Artificial Sequence
  Lysosomal protective protein (183-191)
aucuacauccccacccuggccgugcuc

SEQ ID NO: 44927 - RNA, 27 nt, Artificial Sequence
  Protein unc-119 homolog A (83-91)
aucuacaagaucgacuucgugcgcuuc

SEQ ID NO: 44928 - RNA, 30 nt, Artificial Sequence
  Alpha-2-macroglobulin (162-171)
aucuacaagcccggccagaccgugaaguuc

SEQ ID NO: 44929 - RNA, 27 nt, Artificial Sequence
  Tubby-related protein 4 (640-648)
aucuaccugcccgaggugcgcaagauc

SEQ ID NO: 44930 - RNA, 27 nt, Artificial Sequence
  Alpha-adducin (165-173)
aucuacaaccacaucaccacccgcgug

SEQ ID NO: 44931 - RNA, 27 nt, Artificial Sequence
  Sprouty-related, EVH1 domain-containing protein 1 (81-89)
aucuacaacaaggugacccccaccuuc

SEQ ID NO: 44932 - RNA, 27 nt, Artificial Sequence
  Serine-protein kinase ATM (1147-1155)
aucuacaaccgcaagagcgugcugcuc

SEQ ID NO: 44933 - RNA, 27 nt, Artificial Sequence
  Spermine synthase (46-54)
aucuacccccacggccuggugcuccug

SEQ ID NO: 44934 - RNA, 27 nt, Artificial Sequence
  E3 ubiquitin-protein ligase RNF213 (3834-3842)
aucuacccccaggugcugcacagccuc

SEQ ID NO: 44935 - RNA, 30 nt, Artificial Sequence
  Nuclear fragile X mental retardation-interacting protein 2 (473-482)
aucuaccccagcaacaugcagaccaugcug

SEQ ID NO: 44936 - RNA, 27 nt, Artificial Sequence
  Zinc finger protein castor homolog 1 (463-471)
aucuaccagaaguacaucgcccgcuuc

SEQ ID NO: 44937 - RNA, 27 nt, Artificial Sequence
  Renin receptor (327-335)
aucuaccgcaugaccaaccagaagauc

SEQ ID NO: 44938 - RNA, 27 nt, Artificial Sequence
  Pericentriolar material 1 protein (1385-1393)
aucuacagcgagguggccacccugauc

SEQ ID NO: 44939 - RNA, 33 nt, Artificial Sequence
  Perilipin-2 (353-363)
aucuacagcguguuccgcaacgccgccuccuuc

SEQ ID NO: 44940 - RNA, 27 nt, Artificial Sequence
  Poly (ADP-ribose) polymerase 14 (1584-1592)
aucuacacccacggcaaccacagccug

SEQ ID NO: 44941 - RNA, 27 nt, Artificial Sequence
  Transmembraneoprotein NMB (174-182)
aucuacguguuccacacccugggcugg

SEQ ID NO: 44942 - RNA, 27 nt, Artificial Sequence
  Protein-methionine sulfoxide oxidase MICAL3 (1990-1998)
aucuacgugccccacgcccuggccuuc

SEQ ID NO: 44943 - RNA, 27 nt, Artificial Sequence
  Clathrin heavy chain 1 (1130-1138)
aaggccgacgaccccagcuccuacaug

SEQ ID NO: 44944 - RNA, 33 nt, Artificial Sequence
  L-dopachrome tautomerase (356-366)
aaggccgacggcacccuggacagccaggugaug

SEQ ID NO: 44945 - RNA, 27 nt, Artificial Sequence
  Activating signal cointegrator 1 complex subunit 2 (32-40)
aaggccgaccgcuacuucgugcuguac

SEQ ID NO: 44946 - RNA, 27 nt, Artificial Sequence
  Lupus La protein (148-156)
aaggccuucaagggcagcaucuucgug

SEQ ID NO: 44947 - RNA, 27 nt, Artificial Sequence
  Neuronal PAS domain-containing protein 3 (509-517)
aaggccggcgaggacggguucggcgcc

SEQ ID NO: 44948 - RNA, 27 nt, Artificial Sequence
  Filamin-A (2252-2260)
aaggccggcaacaacaugcugcucgug

SEQ ID NO: 44949 - RNA, 27 nt, Artificial Sequence
  Alpha-soluble NSF attachment protein (180-188)
aaggccaucgacaucuacgagcaggug

SEQ ID NO: 44950 - RNA, 27 nt, Artificial Sequence
  Phosphorylase b kinase regulatory subunit beta (81-89)
aaggccaagauccaggacagccuguac

SEQ ID NO: 44951 - RNA, 33 nt, Artificial Sequence
  Vacuolar protein sorting-associated protein 13A (1058-1068)
aaggcccuggugggcggggccgucggcgggcuc

SEQ ID NO: 44952 - RNA, 33 nt, Artificial Sequence
  Zinc finger homeobox protein 3 (2172-2182)
aaggccaacgaggugcugggccucgccgcgcag

SEQ ID NO: 44953 - RNA, 54 nt, Artificial Sequence
  Bifunctional glutamate/proline-tRNA ligase (778-795)
aaggcccccaaggaggacguggacgccgcggucaagcagcugcucagccugaag

SEQ ID NO: 44954 - RNA, 27 nt, Artificial Sequence
  Treacle protein (215-223)
aaggccagcgagaagauccugcaggug

SEQ ID NO: 44955 - RNA, 30 nt, Artificial Sequence
  Cytoplasmic dynein 1 heavy chain 1 (1729-1738)
aaggccaccagcaucgaccccaacaccuac

SEQ ID NO: 44956 - RNA, 27 nt, Artificial Sequence
  Tubulin alpha-1A chain (171-179)
aaggccuaccacgagcagcugagcgug

SEQ ID NO: 44957 - RNA, 30 nt, Artificial Sequence
  UDP-N-acetylhexosamine pyrophosphorylase-like protein 1 (151-160)
aaggccuaccccgaggagccggugggcguc

SEQ ID NO: 44958 - RNA, 75 nt, Artificial Sequence
  Beta-2-microglobulin (74-98)
aaggacgaguacgccugccgcgugaaccacgucacccugagccagcccaagaucgugaagugggaccgggacaug

SEQ ID NO: 44959 - RNA, 45 nt, Artificial Sequence
  Glia-derived nexin (117-131)
aaggacaucgugaccgucgccaacgccguguucgugaagaacgcg

SEQ ID NO: 44960 - RNA, 48 nt, Artificial Sequence
  Glia-derived nexin (117-132)
aaggacaucgugaccgucgccaacgccguguucgugaagaacgcgagc

SEQ ID NO: 44961 - RNA, 27 nt, Artificial Sequence
  Serine-protein kinase ATM (129-137)
aaggacagcuccaacggcgccaucuac

SEQ ID NO: 44962 - RNA, 27 nt, Artificial Sequence
  E3 ubiquitin-protein ligase RNF213 (4774-4782)
aaggaggccgagcugcgccucgugaag

SEQ ID NO: 44963 - RNA, 27 nt, Artificial Sequence
  Neuron navigator 2 (1035-1043)
aaggaggacagccgcccccaccuguuc

SEQ ID NO: 44964 - RNA, 30 nt, Artificial Sequence
  Multidrug resistance-associated protein 7 (836-845)
aaggagggcgccguggcccugcacgucuac

SEQ ID NO: 44965 - RNA, 30 nt, Artificial Sequence
  Hemicentin-1 (4939-4948)
aaggagaucggcgaggccgugaacggguuc

SEQ ID NO: 44966 - RNA, 27 nt, Artificial Sequence
  Synemin (925-933)
aaggagaucaagaucccccacgaguuc

SEQ ID NO: 44967 - RNA, 30 nt, Artificial Sequence
  Annexin A1 (147-156)
aaggagauccgcgacaucaaccggguguac

SEQ ID NO: 44968 - RNA, 27 nt, Artificial Sequence
  Probable global transcription activator SNF2L1 (774-782)
aaggagaagcugcucacccagggcuuc

SEQ ID NO: 44969 - RNA, 57 nt, Artificial Sequence
  Protein FAM208B (1764-1782)
aaggagaaccugagcaaggagccccucgccuccuucgugagcgaguccuucgacacc

SEQ ID NO: 44970 - RNA, 27 nt, Artificial Sequence
  Cullin-4B (885-893)
aaggagaaccccaaccaguacaacuac

SEQ ID NO: 44971 - RNA, 69 nt, Artificial Sequence
  60S ribosomal protein L18 (16-38)
aaggagcccaagagccaggacaucuaccugcgccuccuggugaagcuguaccgguuccucgcccgccgg

SEQ ID NO: 44972 - RNA, 30 nt, Artificial Sequence
  Melanoma-associated antigen 10 (192-201)
aaggagguggaccccaccggccacagcuuc

SEQ ID NO: 44973 - RNA, 30 nt, Artificial Sequence
  Melanoma-associated antigen 11 (251-260)
aaggagguggaccccaccagccacuccuac

SEQ ID NO: 44974 - RNA, 30 nt, Artificial Sequence
  Melanoma-associated antigen 4 (168-177)
aaggagguggaccccaccagcaacaccuac

SEQ ID NO: 44975 - RNA, 57 nt, Artificial Sequence
  ATP-dependent RNA helicase A (392-410)
aaguucgagagcgagauccuggaggccaucucccagaacagcguggucaucauccgc

SEQ ID NO: 44976 - RNA, 30 nt, Artificial Sequence
  ATP synthase-coupling factor 6, mitochondrial (99-108)
aaguucgaggugaucgagaagccccaggcc

SEQ ID NO: 44977 - RNA, 42 nt, Artificial Sequence
  B-cell CLL/lymphoma 9 protein (45-58)
aaguucagcaaccagggcaagcaggggggcuccgccagccag

SEQ ID NO: 44978 - RNA, 27 nt, Artificial Sequence
  Collagen alpha-1(IV) chain (238-246)
aaguucagcaccaugcccuuccuguuc

SEQ ID NO: 44979 - RNA, 27 nt, Artificial Sequence
  Protein diaphanous homolog 2 (949-957)
aaguucguggagaagaugaccagcuuc

SEQ ID NO: 44980 - RNA, 30 nt, Artificial Sequence
  V-type proton ATPase 116 kDa subunit a isoform 1 (813-822)
aaguucuacagcggcaccggguucaaguuc

SEQ ID NO: 44981 - RNA, 60 nt, Artificial Sequence
  Collagen alpha-2(I) chain (441-460)
aagggcgagcccgggguggucggcgccguggggaccgccggcccgagcgggcccuccggc

SEQ ID NO: 44982 - RNA, 48 nt, Artificial Sequence
  Calpain small subunit 1 (9-24)
aagggcgggggcgggggcgggggcggcgggggcgggcugggcgggggc

SEQ ID NO: 44983 - RNA, 78 nt, Artificial Sequence
  HLA class I histocompatibility antigen, A-23 alpha chain (340-365)
aagggcgggagcuacucccaggccgccagcuccgacagcgcgcagggcuccgacgugagccugaccgccugcaagguc

SEQ ID NO: 44984 - RNA, 78 nt, Artificial Sequence
  HLA class I histocompatibility antigen, A-1 alpha chain (315-340)
aagggcgggagcuacacccaggccgccuccagcgacuccgcgcagggcagcgacgugucccugaccgccugcaagguc

SEQ ID NO: 44985 - RNA, 114 nt, Artificial Sequence
  Cytochrome c oxidase subunit 7A2, mitochondrial (46-83)
aagggcgggguggccgacgcccugcucuaccgcgcgaccaugauccugaccgucggcgggacggccuacgccaucuacgagcuggccguggccagcuuccccaagaagcaggag

SEQ ID NO: 44986 - RNA, 30 nt, Artificial Sequence
  Nebulin (852-861)
aagggcaagaugaucggggcccugagcauc

SEQ ID NO: 44987 - RNA, 30 nt, Artificial Sequence
  Fatty acid synthase (2391-2400)
aagggccuggaggagcgcguggccgccgcg

SEQ ID NO: 44988 - RNA, 27 nt, Artificial Sequence
  E3 ubiquitin-protein ligase HUWE1 (1718-1726)
aagggcaacgacaccccccuggcccuc

SEQ ID NO: 44989 - RNA, 27 nt, Artificial Sequence
  Vigilin (314-322)
aagggcaacagccugcaggagauccuc

SEQ ID NO: 44990 - RNA, 24 nt, Artificial Sequence
  UDP-glucose:glycoprotein glucosyltransferase 1 (1055-1062)
aagggccccaucgccaaguuccug

SEQ ID NO: 44991 - RNA, 27 nt, Artificial Sequence
  Serine/arginine-rich splicing factor 4 (23-31)
aagggcuacgggaagauccuggaggug

SEQ ID NO: 44992 - RNA, 75 nt, Artificial Sequence
  Histidine triad nucleotide-binding protein 1 (58-82)
aagcacaucagccagaucuccguggccgaggacgacgacgagagccugcucggccaccugaugaucgucgggaag

SEQ ID NO: 44993 - RNA, 24 nt, Artificial Sequence
  Trabeculin-alpha (4579-4586)
aagcacaaggaguuccagaagacc

SEQ ID NO: 44994 - RNA, 27 nt, Artificial Sequence
  Unconventional myosin-VIIa (1948-1956)
aagaucgccgacaaggugcugagcguc

SEQ ID NO: 44995 - RNA, 21 nt, Artificial Sequence
  LIM domain transcription factor LMO4 (29-35)
aagaucgccgaccgcuuccug

SEQ ID NO: 44996 - RNA, 30 nt, Artificial Sequence
  MICOS complex subunit MIC60 (45-54)
aagaucgccggcgccgggcugcucuucgug

SEQ ID NO: 44997 - RNA, 36 nt, Artificial Sequence
  Calcium-binding mitochondrial carrier protein SCaMC-2 (252-263)
aagaucgcccccgagagcgccaucaaguucauggcg

SEQ ID NO: 44998 - RNA, 27 nt, Artificial Sequence
  Protein TASOR (673-681)
aagaucgccagcaacccccuggagcgc

SEQ ID NO: 44999 - RNA, 27 nt, Artificial Sequence
  UV excision repair protein RAD23 homolog B (42-50)
aagaucgacgagaagaacuucgugguc

SEQ ID NO: 45000 - RNA, 27 nt, Artificial Sequence
  RNA-binding protein 5 (302-310)
aagaucgacggcaagaccaucggggug

SEQ ID NO: 45001 - RNA, 27 nt, Artificial Sequence
  26S protease regulatory subunit 7 (156-164)
aagaucgaccccaccgugaccaugaug

SEQ ID NO: 45002 - RNA, 33 nt, Artificial Sequence
  26S protease regulatory subunit 7 (156-166)
aagaucgaccccaccgugaccaugaugcagguc

SEQ ID NO: 45003 - RNA, 27 nt, Artificial Sequence
  Thioredoxin reductase 1, cytoplasmic (299-307)
aagaucggccuggagaccguggggguc

SEQ ID NO: 45004 - RNA, 30 nt, Artificial Sequence
  1-phosphatidylinositol 4,5-bisphosphate phosphodiesterase gamma-1 (969-978)
aagaucggcaccgagcgcgccugcuaccgg

SEQ ID NO: 45005 - RNA, 24 nt, Artificial Sequence
  Heat shock protein 105 kDa (711-718)
aagaucggcacccccgugaagguc

SEQ ID NO: 45006 - RNA, 30 nt, Artificial Sequence
  Pleckstrin homology domain-containing family G member 3 (122-131)
aagaucaucgacacccccggccugcucaag

SEQ ID NO: 45007 - RNA, 27 nt, Artificial Sequence
  Unconventional myosin-Id (269-277)
aagauccuggccgccauccuccaccug

SEQ ID NO: 45008 - RNA, 30 nt, Artificial Sequence
  Kinesin-like protein KIF1B (1496-1505)
aagauccuggacaccagcguggccuacguc

SEQ ID NO: 45009 - RNA, 27 nt, Artificial Sequence
  28S ribosomal protein S2, mitochondrial (61-69)
aagauccugaacgagccccucaagcac

SEQ ID NO: 45010 - RNA, 33 nt, Artificial Sequence
  D-3-phosphoglycerate dehydrogenase (21-31)
aagauccugcaggacggcgggcuccaggugguc

SEQ ID NO: 45011 - RNA, 27 nt, Artificial Sequence
  Endothelial differentiation-related factor 1 (98-106)
aagaucaacgagaagccccaggugauc

SEQ ID NO: 45012 - RNA, 27 nt, Artificial Sequence
  Upstream stimulatory factor 2 (138-146)
aagaucaacaacuggaucgugcagcug

SEQ ID NO: 45013 - RNA, 27 nt, Artificial Sequence
  Sodium/potassium/calcium exchanger 5 (219-227)
aagaucaaccaguacaucaucaagaag

SEQ ID NO: 45014 - RNA, 27 nt, Artificial Sequence
  Protein sidekick-1 (309-317)
aagauccagggccugagcucccucacc

SEQ ID NO: 45015 - RNA, 27 nt, Artificial Sequence
  Keratinocyte-associated protein 2 (136-144)
aagaucagcuccacccuguaccaggcc

SEQ ID NO: 45016 - RNA, 33 nt, Artificial Sequence
  Dolichyl-diphosphooligosaccharide-proteinosyltransferase subunit 2 (368-378)
aagaucagcaccgaggugggcaucaccaacguc

SEQ ID NO: 45017 - RNA, 33 nt, Artificial Sequence
  Melanoma-associated antigen 6 (220-230)
aagaucugggaggagcugagcgugcucgagguc

SEQ ID NO: 45018 - RNA, 33 nt, Artificial Sequence
  Ras GTPase-activating-like protein IQGAP1 (94-104)
aagaucuacgaccgcgagcagacccgguacaag

SEQ ID NO: 45019 - RNA, 27 nt, Artificial Sequence
  NADH dehydrogenase (ubiquinone) 1 beta subcomplex subunit 5, mitochondrial (79-87)
aagaucuacgagcgcaccauggccgug

SEQ ID NO: 45020 - RNA, 24 nt, Artificial Sequence
  Lariat debranching enzyme (72-79)
aagaaggcccccgugcugacccuc

SEQ ID NO: 45021 - RNA, 24 nt, Artificial Sequence
  Myc proto-oncogene protein (412-419)
aagaaggccaccgccuacauccug

SEQ ID NO: 45022 - RNA, 27 nt, Artificial Sequence
  Zinc phosphodiesterase ELAC protein 2 (366-374)
aagaaggagggccccacccugagcgug

SEQ ID NO: 45023 - RNA, 48 nt, Artificial Sequence
  Serum albumin (437-452)
aagaaggugccccaggucagcaccccgacccugguggaggugucccgc

SEQ ID NO: 45024 - RNA, 27 nt, Artificial Sequence
  Nuclear mitotic apparatus protein 1 (1-9)
aagcuggccgacgaccucagcacccug

SEQ ID NO: 45025 - RNA, 27 nt, Artificial Sequence
  SNW domain-containing protein 1 (28-36)
aagcuggccgaggcccucuacaucgcg

SEQ ID NO: 45026 - RNA, 27 nt, Artificial Sequence
  Vesicle transport protein USE1 (171-179)
aagcuggccgaggagaugcucggccug

SEQ ID NO: 45027 - RNA, 27 nt, Artificial Sequence
  SLIT-ROBO Rho GTPase-activating protein 2C (69-77)
aagcuggccgagcacuuccucgccaag

SEQ ID NO: 45028 - RNA, 27 nt, Artificial Sequence
  Plexin-A3 (55-63)
aagcuggcccccaaccucaccgagcug

SEQ ID NO: 45029 - RNA, 27 nt, Artificial Sequence
  Peroxisome biogenesis factor 1 (411-419)
aagcuggacgcccacguggagcgcguc

SEQ ID NO: 45030 - RNA, 27 nt, Artificial Sequence
  Probable helicase with zinc finger domain (944-952)
aagcuggacgacggcagcaucggggug

SEQ ID NO: 45031 - RNA, 27 nt, Artificial Sequence
  Afadin (391-399)
aagcuggacgacaacagcauccagcuc

SEQ ID NO: 45032 - RNA, 27 nt, Artificial Sequence
  E3 ubiquitin-protein ligase RNF139 (456-464)
aagcuggacgacuacguguacuacguc

SEQ ID NO: 45033 - RNA, 27 nt, Artificial Sequence
  Transcriptional regulator ATRX (1499-1507)
aagcuggacuucagcaccgcccucgug

SEQ ID NO: 45034 - RNA, 27 nt, Artificial Sequence
  Probable ATP-dependent RNA helicase DHX58 (177-185)
aagcuggacggcgccaucaaccacgug

SEQ ID NO: 45035 - RNA, 27 nt, Artificial Sequence
  Serine/threonine-protein kinase Sgk3 (115-123)
aagcuggacggcaaguucuacgccgug

SEQ ID NO: 45036 - RNA, 27 nt, Artificial Sequence
  Inter-alpha-trypsin inhibitor heavy chain H5 (522-530)
aagcuggaccaccuccacguggagguc

SEQ ID NO: 45037 - RNA, 27 nt, Artificial Sequence
  Kin of IRRE-like protein 1 (435-443)
aagcuggacaucaagguggagaccguc

SEQ ID NO: 45038 - RNA, 27 nt, Artificial Sequence
  Tectonic-1 (198-206)
aagcuggacauccccaccgccgccaag

SEQ ID NO: 45039 - RNA, 30 nt, Artificial Sequence
  Lactoperoxidase (313-322)
aagcuggaccucagccccugggccuccgug

SEQ ID NO: 45040 - RNA, 27 nt, Artificial Sequence
  WD repeat-containing protein 26 (306-314)
aagcuggacaacaaccucgacagcgug

SEQ ID NO: 45041 - RNA, 27 nt, Artificial Sequence
  Cytoplasmic dynein 1 heavy chain 1 (828-836)
aagcuggaccccuacgugcagcgccuc

SEQ ID NO: 45042 - RNA, 27 nt, Artificial Sequence
  cAMP-dependent protein kinase type I-beta regulatory subunit (349-357)
aagcuggaccgcccccgguucgagcgc

SEQ ID NO: 45043 - RNA, 33 nt, Artificial Sequence
  SH3 domain-binding protein 4 (249-259)
aagcuggacagcuccggcggggccgugcagcuc

SEQ ID NO: 45044 - RNA, 27 nt, Artificial Sequence
  Eukaryotic initiation factor 4A-II (260-268)
aagcuggacacccucugcgaccuguac

SEQ ID NO: 45045 - RNA, 30 nt, Artificial Sequence
  Eukaryotic translation initiation factor 3 subunit I (213-222)
aagcuguucgacagcaccacccucgagcac

SEQ ID NO: 45046 - RNA, 27 nt, Artificial Sequence
  Centromere protein R (110-118)
aagcuguucgagaagagcaccggccuc

SEQ ID NO: 45047 - RNA, 27 nt, Artificial Sequence
  Protein kinase C delta type (581-589)
aagcuguucgagcgcgagcccaccaag

SEQ ID NO: 45048 - RNA, 27 nt, Artificial Sequence
  Nucleolar complex protein 2 homolog (168-176)
aagcuguuccacgaggugguccaggcc

SEQ ID NO: 45049 - RNA, 30 nt, Artificial Sequence
  Unconventional myosin-Va (410-419)
aagcuguucaacuggaucguggacaacguc

SEQ ID NO: 45050 - RNA, 27 nt, Artificial Sequence
  Constitutive coactivator of PPAR-gamma-like protein 1 (805-813)
aagcuguuccagagcaagcuccugaag

SEQ ID NO: 45051 - RNA, 30 nt, Artificial Sequence
  GTPase-activating protein and VPS9 domain-containing protein 1 (42-51)
aagcuguucagcgagggccucuucuccgcc

SEQ ID NO: 45052 - RNA, 24 nt, Artificial Sequence
  Pleckstrin homology domain-containing family M member 2 (338-345)
aagcugggcgacaucagcgccgug

SEQ ID NO: 45053 - RNA, 27 nt, Artificial Sequence
  Atrial natriuretic peptide receptor 2 (148-156)
aagcugggcgaguucguggucacccuc

SEQ ID NO: 45054 - RNA, 24 nt, Artificial Sequence
  Destrin (151-158)
aagcugggcgggagccucaucgug

SEQ ID NO: 45055 - RNA, 24 nt, Artificial Sequence
  Transformation/transcription domain-associated protein (1157-1164)
aagcugggcgggguggucagcauc

SEQ ID NO: 45056 - RNA, 24 nt, Artificial Sequence
  Laminin subunit beta-2 (55-62)
aagcugggcaucgugcaggggauc

SEQ ID NO: 45057 - RNA, 27 nt, Artificial Sequence
  TRPM8 channel-associated factor 1 (281-289)
aagcugggccccuuccuccugaacgcc

SEQ ID NO: 45058 - RNA, 36 nt, Artificial Sequence
  Transcription and mRNA export factor ENY2 (19-30)
aagcugaucgagaccggcgagcgcgagcggcucaag

SEQ ID NO: 45059 - RNA, 27 nt, Artificial Sequence
  Ral GTPase-activating protein subunit beta (194-202)
aagcugaucggcgugcucuucgagguc

SEQ ID NO: 45060 - RNA, 27 nt, Artificial Sequence
  Protein FAM179B (1545-1553)
aagcugaucaccggccuccugaacgcc

SEQ ID NO: 45061 - RNA, 36 nt, Artificial Sequence
  L-lactate dehydrogenase B chain (308-319)
aagcugaaggacgacgagguggcccagcucaagaag

SEQ ID NO: 45062 - RNA, 30 nt, Artificial Sequence
  Formin-1 (1119-1128)
aagcugcucgacaagcccgagcaguuccug

SEQ ID NO: 45063 - RNA, 33 nt, Artificial Sequence
  Formin-1 (1119-1129)
aagcugcucgacaagcccgagcaguuccugcac

SEQ ID NO: 45064 - RNA, 30 nt, Artificial Sequence
  Inositol 1,4,5-trisphosphate receptor type 2 (474-483)
aagcugcucgaggaccugaucuucuucgug

SEQ ID NO: 45065 - RNA, 30 nt, Artificial Sequence
  AP-3 complex delta subunit (1019-1028)
aagcugcucgagagcggcgaccuguccaug

SEQ ID NO: 45066 - RNA, 33 nt, Artificial Sequence
  Catenin beta-1 (158-168)
aagcugcucaacgacgaggaccagguggucgug

SEQ ID NO: 45067 - RNA, 27 nt, Artificial Sequence
  Laminin subunit gamma-1 (646-654)
aagcugcucaacaaccugaccagcauc

SEQ ID NO: 45068 - RNA, 30 nt, Artificial Sequence
  Laminin subunit gamma-1 (646-655)
aagcugcucaacaaccugaccagcaucaag

SEQ ID NO: 45069 - RNA, 30 nt, Artificial Sequence
  Dedicator of cytokinesis protein 5 (404-413)
aagcugcuccccggcgaccugacccaggug

SEQ ID NO: 45070 - RNA, 30 nt, Artificial Sequence
  Myosin-10 (1002-1011)
aagcugauggaggaccgcaucgccgagugc

SEQ ID NO: 45071 - RNA, 27 nt, Artificial Sequence
  Heat shock protein HSP 90-beta (491-499)
aagcugaugaaggagauccucgacaag

SEQ ID NO: 45072 - RNA, 27 nt, Artificial Sequence
  Nuclear envelope integral membrane protein 1 (123-131)
aagcugaacgacaccuacgugaacguc

SEQ ID NO: 45073 - RNA, 27 nt, Artificial Sequence
  Zinc finger protein ZIC 1 (48-56)
aagcugaaccccagcucccacgagcuc

SEQ ID NO: 45074 - RNA, 27 nt, Artificial Sequence
  Lysine-specific histone demethylase 1A (609-617)
aagcugaacaccgccgugcgccagguc

SEQ ID NO: 45075 - RNA, 24 nt, Artificial Sequence
  Probable ATP-dependent RNA helicase DDX60-like (1106-1113)
aagcugcccgccaucuucuuccuc

SEQ ID NO: 45076 - RNA, 27 nt, Artificial Sequence
  Probable ATP-dependent RNA helicase DDX60-like (1106-1114)
aagcugcccgccaucuucuuccucuuc

SEQ ID NO: 45077 - RNA, 24 nt, Artificial Sequence
  Probable ATP-dependent RNA helicase DDX60 (1126-1133)
aagcugcccgcccucuucuuccug

SEQ ID NO: 45078 - RNA, 27 nt, Artificial Sequence
  Probable ATP-dependent RNA helicase DDX60 (1126-1134)
aagcugcccgcccucuucuuccuguuc

SEQ ID NO: 45079 - RNA, 30 nt, Artificial Sequence
  Nuclear receptor coactivator 7 (189-198)
aagcugcccgacgccgaccucgcccgcaag

SEQ ID NO: 45080 - RNA, 27 nt, Artificial Sequence
  Dolichyl-diphosphooligosaccharide-proteinosyltransferase 48 kDa subunit (380-388)
aagcugcccgacguguacggcgucuuc

SEQ ID NO: 45081 - RNA, 27 nt, Artificial Sequence
  Neuropathy target esterase (713-721)
aagcugcccgagggcacccucgggcac

SEQ ID NO: 45082 - RNA, 27 nt, Artificial Sequence
  von Willebrand factor A domain-containing protein 9 (368-376)
aagcugcccgagaagacccagaccuuc

SEQ ID NO: 45083 - RNA, 27 nt, Artificial Sequence
  Puratrophin-1 (608-616)
aagcugcccccggugggcagcaccgcc

SEQ ID NO: 45084 - RNA, 27 nt, Artificial Sequence
  MAU2 chromatid cohesion factor homolog (108-116)
aagcugcaggaggugcacccccuccug

SEQ ID NO: 45085 - RNA, 27 nt, Artificial Sequence
  Myosin-10 (1284-1292)
aagcugcagaacgagcucgacaacgug

SEQ ID NO: 45086 - RNA, 27 nt, Artificial Sequence
  Unconventional myosin-If (409-417)
aagcugcagcagaucuucaucgagcuc

SEQ ID NO: 45087 - RNA, 33 nt, Artificial Sequence
  High affinity cAMP-specific and IBMX-insensitive 3',5'-cyclic phosphodiesterase 8B (264-274)
aagcugcgcgccugcaacagcguguucaccgcc

SEQ ID NO: 45088 - RNA, 27 nt, Artificial Sequence
  Laminin subunit beta-2 (210-218)
aagcugagcgcccacacccacacccuc

SEQ ID NO: 45089 - RNA, 30 nt, Artificial Sequence
  Nischarin (1228-1237)
aagcugagcgaccuccaguccgugaacguc

SEQ ID NO: 45090 - RNA, 27 nt, Artificial Sequence
  Threonine synthase-like 2 (359-367)
aagcugagcgaggccgugaccuccguc

SEQ ID NO: 45091 - RNA, 27 nt, Artificial Sequence
  Rho GTPase-activating protein 7 (720-728)
aagcugagcgagaccuuccuccagauc

SEQ ID NO: 45092 - RNA, 24 nt, Artificial Sequence
  Myristoylated alanine-rich C-kinase substrate (165-172)
aagcugagcggcuucuccuucaag

SEQ ID NO: 45093 - RNA, 27 nt, Artificial Sequence
  Kinesin-1 heavy chain (222-230)
aagcugagcggcaagcucuaccuggug

SEQ ID NO: 45094 - RNA, 30 nt, Artificial Sequence
  Cathepsin D (348-357)
aagcugagccccgaggacuacacccucaag

SEQ ID NO: 45095 - RNA, 27 nt, Artificial Sequence
  26S proteasome non-ATPase regulatory subunit 4 (83-91)
aagcugaccgccuucgugaacacccuc

SEQ ID NO: 45096 - RNA, 27 nt, Artificial Sequence
  Kinesin-like protein KIF13A (701-709)
aagcugaccgacuaccaggugacccuc

SEQ ID NO: 45097 - RNA, 27 nt, Artificial Sequence
  Cyclin-dependent kinase 2 (24-32)
aagcugaccggcgagguggucgcccuc

SEQ ID NO: 45098 - RNA, 27 nt, Artificial Sequence
  E3 ubiquitin-protein ligase UBR2 (543-551)
aagcugacccacgugaucagcaugaug

SEQ ID NO: 45099 - RNA, 27 nt, Artificial Sequence
  AP-1 complex subunit beta-1 (901-909)
aagcugaccaacggcaucugggugcuc

SEQ ID NO: 45100 - RNA, 27 nt, Artificial Sequence
  Copine-3 (110-118)
aagcugacccgcccccucgugaugaag

SEQ ID NO: 45101 - RNA, 27 nt, Artificial Sequence
  Rab3 GTPase-activating protein non-catalytic subunit (337-345)
aagcugaccagcgcccucuucaacgcc

SEQ ID NO: 45102 - RNA, 27 nt, Artificial Sequence
  Endothelin B receptor (175-183)
aagcuggugcccuucauccagaaggcc

SEQ ID NO: 45103 - RNA, 27 nt, Artificial Sequence
  Platelet-activating factor acetylhydrolase IB subunit alpha (53-61)
aagcugugggacuuccagggcuucgag

SEQ ID NO: 45104 - RNA, 27 nt, Artificial Sequence
  Interleukin-24 (68-76)
aagcugugggaggccuucugggccgug

SEQ ID NO: 45105 - RNA, 27 nt, Artificial Sequence
  Coatomer subunit beta' (771-779)
aagcuguggcgcgagaaccucagcaag

SEQ ID NO: 45106 - RNA, 27 nt, Artificial Sequence
  Cullin-9 (1503-1511)
aagcuguacgagcaccuccagcgcgcc

SEQ ID NO: 45107 - RNA, 27 nt, Artificial Sequence
  Phosphatidylinositol 4,5-bisphosphate 3-kinase catalytic subunit beta isoform (191-199)
aagcuguacggcgggaagcucaucgug

SEQ ID NO: 45108 - RNA, 33 nt, Artificial Sequence
  Protein FAM3C (30-40)
aagauggacgccagccugggcaaccucuucgcc

SEQ ID NO: 45109 - RNA, 30 nt, Artificial Sequence
  Dihydropyrimidinase-related protein 2 (338-347)
aagauggacgagaaccaguucguggccguc

SEQ ID NO: 45110 - RNA, 36 nt, Artificial Sequence
  Splicing factor, arginine/serine-rich 19 (1112-1123)
aagauggaggaggccaaccuggccagccgcgcgaag

SEQ ID NO: 45111 - RNA, 36 nt, Artificial Sequence
  Leucine-tRNA ligase, cytoplasmic (497-508)
aagaugaucgacgccggcgacgcccugaucuacaug

SEQ ID NO: 45112 - RNA, 33 nt, Artificial Sequence
  LisH domain-containing protein ARMC9 (259-269)
aagaugaucacccccgaguaccugcagagcgug

SEQ ID NO: 45113 - RNA, 30 nt, Artificial Sequence
  Neuron navigator 1 (1349-1358)
aagaugcuggacgaggccguguuccagguc

SEQ ID NO: 45114 - RNA, 27 nt, Artificial Sequence
  Eukaryotic translation initiation factor 3 subunit L (267-275)
aagaugcugggcuacuucagccucgug

SEQ ID NO: 45115 - RNA, 27 nt, Artificial Sequence
  KDEL motif-containing protein 1 (7-15)
aagaugcccgacguggagcuguucguc

SEQ ID NO: 45116 - RNA, 27 nt, Artificial Sequence
  Ceramide synthase 1 (98-106)
aagaugcccgagagcgccuggaaguuc

SEQ ID NO: 45117 - RNA, 39 nt, Artificial Sequence
  Amyloid-like protein 2 (688-700)
aagaugcagaaccacggcuacgagaaccccaccuacaag

SEQ ID NO: 45118 - RNA, 39 nt, Artificial Sequence
  Gamma-secretase C-terminal fragment 59 (641-653)
aagaugcagcagaacggcuacgagaaccccaccuacaag

SEQ ID NO: 45119 - RNA, 33 nt, Artificial Sequence
  E3 ubiquitin-protein ligase UBR4 (905-915)
aagaugguggacggcgucggggugugcaccgug

SEQ ID NO: 45120 - RNA, 27 nt, Artificial Sequence
  Polypyrimidine tract-binding protein 2 (415-423)
aagauguacggcaagaucauccgcgug

SEQ ID NO: 45121 - RNA, 30 nt, Artificial Sequence
  Protein diaphanous homolog 2 (637-646)
aagauguacaagcccgaggugagcaugaag

SEQ ID NO: 45122 - RNA, 27 nt, Artificial Sequence
  Nuclear pore complex protein Nup93 (510-518)
aagaacgccgacaaggugcuggagcuc

SEQ ID NO: 45123 - RNA, 27 nt, Artificial Sequence
  5'-nucleotidase domain-containing protein 1 (159-167)
aagaacgccggcaagauccugcuccug

SEQ ID NO: 45124 - RNA, 27 nt, Artificial Sequence
  60S ribosomal protein L13 (174-182)
aagaacuucaaggccuucgccagccug

SEQ ID NO: 45125 - RNA, 27 nt, Artificial Sequence
  Centrosome-associated protein 350 (625-633)
aagaacaagcgccugcaggagcucuac

SEQ ID NO: 45126 - RNA, 27 nt, Artificial Sequence
  Aldehyde dehydrogenase family 1 member A3 (446-454)
aagaaccuggacaaggcccucaagcug

SEQ ID NO: 45127 - RNA, 27 nt, Artificial Sequence
  Junction plakoglobin (278-286)
aagaacaaccccaaguuccuggccauc

SEQ ID NO: 45128 - RNA, 27 nt, Artificial Sequence
  COX assembly mitochondrial protein homolog (43-51)
aagaacagcggcgugcugauggucgug

SEQ ID NO: 45129 - RNA, 27 nt, Artificial Sequence
  Cytosolic acyl coenzyme A thioester hydrolase (126-134)
aagaacguggacaagguccuggaggug

SEQ ID NO: 45130 - RNA, 27 nt, Artificial Sequence
  Synaptic vesicle membrane protein VAT-1 homolog (374-382)
aagaacgugggcaagguccugcucgug

SEQ ID NO: 45131 - RNA, 27 nt, Artificial Sequence
  DnaJ homolog subfamily A member 4 (79-87)
aagaacgugguccaccagcugagcgug

SEQ ID NO: 45132 - RNA, 36 nt, Artificial Sequence
  Triosephosphate isomerase (156-167)
aagcccgaguucguggacaucaucaacgccaagcag

SEQ ID NO: 45133 - RNA, 27 nt, Artificial Sequence
  Rho GTPase-activating protein 7 (369-377)
aagcccggcaccuucccgaaggcccug

SEQ ID NO: 45134 - RNA, 27 nt, Artificial Sequence
  Anion exchange protein 3 (360-368)
aagccccacguggccagccuguccuuc

SEQ ID NO: 45135 - RNA, 21 nt, Artificial Sequence
  Kelch repeat and BTB domain-containing protein 6 (284-290)
aagcccaucgugaagaaguac

SEQ ID NO: 45136 - RNA, 27 nt, Artificial Sequence
  Protein quaking (6-14)
aagcccaagccgacccccgacuaccug

SEQ ID NO: 45137 - RNA, 27 nt, Artificial Sequence
  Sulfate transporter (548-556)
aagcccaagagcucccugcucggccug

SEQ ID NO: 45138 - RNA, 27 nt, Artificial Sequence
  Adenylate cyclase type 1 (422-430)
aagcccaacagcucccuggugguccuc

SEQ ID NO: 45139 - RNA, 21 nt, Artificial Sequence
  Serine/threonine-protein kinase tousled-like 1 (483-489)
aagcccccgaucauccacuac

SEQ ID NO: 45140 - RNA, 54 nt, Artificial Sequence
  NEDD4 family-interacting protein 1 (63-80)
aagcccccgagcuacaacguggccaccacccugcccuccuacgacgaggccgag

SEQ ID NO: 45141 - RNA, 27 nt, Artificial Sequence
  Plexin-D1 (92-100)
aagccccgcaaccugaacgugagcuuc

SEQ ID NO: 45142 - RNA, 33 nt, Artificial Sequence
  Collagen alpha-1(XV) chain (98-108)
aagcccagcuccacccgcggcggggugcuguuc

SEQ ID NO: 45143 - RNA, 63 nt, Artificial Sequence
  Nuclear pore complex protein Nup214 (1252-1272)
aagcccagcuacgaggccaucccggaguccagcccccccuccggcaucaccagcgccuccaac

SEQ ID NO: 45144 - RNA, 27 nt, Artificial Sequence
  Phosphatidylinositol-binding clathrin assembly protein (465-473)
aagcccaccguggccagccagaaccag

SEQ ID NO: 45145 - RNA, 27 nt, Artificial Sequence
  Lysyl oxidase homolog 3 (52-60)
aagcccuacgagggccgcguggagauc

SEQ ID NO: 45146 - RNA, 27 nt, Artificial Sequence
  Nuclear factor of activated T-cells, cytoplasmic 2 (50-58)
aagcccuacagcccgcuggccucccuc

SEQ ID NO: 45147 - RNA, 27 nt, Artificial Sequence
  Procollagen galactosyltransferase 1 (274-282)
aagcaggccgaggugcagauguacguc

SEQ ID NO: 45148 - RNA, 30 nt, Artificial Sequence
  Syntaxin-binding protein 6 (78-87)
aagcaguucgagggcagcaccuccuucgug

SEQ ID NO: 45149 - RNA, 30 nt, Artificial Sequence
  Dystonin (5209-5218)
aagcagaaggagaccaucaaggccuuccug

SEQ ID NO: 45150 - RNA, 27 nt, Artificial Sequence
  EAW49110.1 (48-56)
aagcagcuggaggacggccgcagccuc

SEQ ID NO: 45151 - RNA, 27 nt, Artificial Sequence
  E3 ubiquitin-protein ligase RNF130 (159-167)
aagcagaacgacgugguccgcauccug

SEQ ID NO: 45152 - RNA, 27 nt, Artificial Sequence
  Putative signal peptidase complex catalytic subunit SEC11B (91-99)
aagcagaacggccacaucaaguuccug

SEQ ID NO: 45153 - RNA, 27 nt, Artificial Sequence
  Unconventional myosin-IXa (65-73)
aagcagcccgaggaguaccacuaccug

SEQ ID NO: 45154 - RNA, 27 nt, Artificial Sequence
  Rho guanine nucleotide exchange factor 2 (208-216)
aagcagcaggacgugaucuacgagcug

SEQ ID NO: 45155 - RNA, 48 nt, Artificial Sequence
  Heat shock 70 kDa protein 4 (754-769)
aagcagagccugaccauggaccccguggucaaguccaaggagaucgag

SEQ ID NO: 45156 - RNA, 30 nt, Artificial Sequence
  Serum albumin (549-558)
aagcagaccgcccugguggagcucgucaag

SEQ ID NO: 45157 - RNA, 30 nt, Artificial Sequence
  Tyrosine-protein kinase Fer (613-622)
aagcaguacgaccaccccaacaucgugaag

SEQ ID NO: 45158 - RNA, 27 nt, Artificial Sequence
  Transmembrane emp24 domain-containing protein 3 (83-91)
aagcaguacgacagcuucaccuaccgc

SEQ ID NO: 45159 - RNA, 36 nt, Artificial Sequence
  Protein Niban (482-493)
aagcaguacgacuacgacagcuccaccauccgcaag

SEQ ID NO: 45160 - RNA, 39 nt, Artificial Sequence
  Protein Niban (482-494)
aagcaguacgacuacgacagcuccaccauccgcaagaag

SEQ ID NO: 45161 - RNA, 27 nt, Artificial Sequence
  Phosphatidylinositol 3,4,5-trisphosphate-dependent Rac exchanger 1 protein (1094-1102)
aagcaguacgugacccagaucaaccgc

SEQ ID NO: 45162 - RNA, 27 nt, Artificial Sequence
  Unconventional myosin-Ib (37-45)
aagcgcuucgaccacagcgagaucuac

SEQ ID NO: 45163 - RNA, 27 nt, Artificial Sequence
  Serine/threonine-protein kinase 10 (596-604)
aagcgcuucgagcaggagaucaacgcc

SEQ ID NO: 45164 - RNA, 24 nt, Artificial Sequence
  60S ribosomal protein L10a (47-54)
aagcgcuucagcggcaccgugcgg

SEQ ID NO: 45165 - RNA, 27 nt, Artificial Sequence
  Copine-1 (190-198)
aagcgcuucagcgugcccguccagcac

SEQ ID NO: 45166 - RNA, 30 nt, Artificial Sequence
  MAP/microtubule affinity-regulating kinase 3 (731-740)
aagcgcaucagcggcaccuccaucgccuuc

SEQ ID NO: 45167 - RNA, 27 nt, Artificial Sequence
  Intraflagellar transport protein 81 homolog (264-272)
aagcgccuggaggaggagaucaaguuc

SEQ ID NO: 45168 - RNA, 30 nt, Artificial Sequence
  ATP-dependent RNA helicase A (30-39)
aagcgccugggcuacauccaccggaacuuc

SEQ ID NO: 45169 - RNA, 27 nt, Artificial Sequence
  Maltase-glucoamylase (110-118)
aagcgccugcccagcccgucccucuuc

SEQ ID NO: 45170 - RNA, 27 nt, Artificial Sequence
  Serum albumin (468-476)
aagcgcaugcccugcgccgaggacuac

SEQ ID NO: 45171 - RNA, 27 nt, Artificial Sequence
  Gamma-interferon-inducible protein 16 (202-210)
aagcgccccgugaucgucaaggugcug

SEQ ID NO: 45172 - RNA, 27 nt, Artificial Sequence
  Band 4.1-like protein 2 (451-459)
aagcgcagcaacuucuacaucaaggug

SEQ ID NO: 45173 - RNA, 42 nt, Artificial Sequence
  Glyceraldehyde-3-phosphate dehydrogenase (117-130)
aagcgcgugaucaucagcgcccccuccgccgacgcgccgaug

SEQ ID NO: 45174 - RNA, 27 nt, Artificial Sequence
  Glia-derived nexin (299-307)
aagcgcgugcaggucauccugcccaag

SEQ ID NO: 45175 - RNA, 27 nt, Artificial Sequence
  Growth/differentiation factor 15 (45-53)
aagcgcuacgaggaccugcucacccgg

SEQ ID NO: 45176 - RNA, 27 nt, Artificial Sequence
  Insulin-like growth factor 1 receptor (927-935)
aagcgcuacgagaacuucauccaccug

SEQ ID NO: 45177 - RNA, 27 nt, Artificial Sequence
  Protein zyg-11 homolog B (68-76)
aagcgcuacagcgagcgggccuucuuc

SEQ ID NO: 45178 - RNA, 30 nt, Artificial Sequence
  Glycerol-3-phosphate acyltransferase 4 (407-416)
aagagcgccaucgcccgccagggcgggcug

SEQ ID NO: 45179 - RNA, 27 nt, Artificial Sequence
  Centrosomal protein C10orf90 (33-41)
aagagcgacuucaccaaggagacccug

SEQ ID NO: 45180 - RNA, 30 nt, Artificial Sequence
  Transcriptional protein SWT1 (56-65)
aagagcgaccacaccgacgugcuguacuac

SEQ ID NO: 45181 - RNA, 27 nt, Artificial Sequence
  78 kDa glucose-regulated protein (335-343)
aagagcgacaucgacgagaucgugcug

SEQ ID NO: 45182 - RNA, 27 nt, Artificial Sequence
  Copine-9 (167-175)
aagagcgaccccuuccugguguucuac

SEQ ID NO: 45183 - RNA, 27 nt, Artificial Sequence
  Pre-mRNA-processing factor 40 homolog A (164-172)
aagagcgacuccggcaagcccuacuac

SEQ ID NO: 45184 - RNA, 48 nt, Artificial Sequence
  Serine/threonine-protein phosphatase 2A 65 kDa regulatory subunit A alpha isoform (202-217)
aagagcgagaucauccccauguucuccaaccuggccagcgacgagcag

SEQ ID NO: 45185 - RNA, 27 nt, Artificial Sequence
  Minor histocompatibility antigen H13 (234-242)
aagagcuucgaggcccccaucaagcug

SEQ ID NO: 45186 - RNA, 54 nt, Artificial Sequence
  Protein HEG homolog 1 (147-164)
aagagcggcgacuuccagaugucccccuacgccgaguacccgaagaacccccgc

SEQ ID NO: 45187 - RNA, 27 nt, Artificial Sequence
  Protein LAP2 (860-868)
aagagcggccccgugggguccgucgug

SEQ ID NO: 45188 - RNA, 24 nt, Artificial Sequence
  Vacuolar protein sorting-associated protein 16 homolog (82-89)
aagagcggccccguggucucccug

SEQ ID NO: 45189 - RNA, 27 nt, Artificial Sequence
  Alpha-catulin (373-381)
aagagcaucgccgaggagcuggagcuc

SEQ ID NO: 45190 - RNA, 27 nt, Artificial Sequence
  60S ribosomal protein L35 (52-60)
aagagcaucgcccgcgugcugaccguc

SEQ ID NO: 45191 - RNA, 27 nt, Artificial Sequence
  Syntenin-1 (130-138)
aagagcaucgacaacggcaucuucgug

SEQ ID NO: 45192 - RNA, 27 nt, Artificial Sequence
  Protein disulfide-isomerase TMX3 (71-79)
aagagcaucggcucccccgugaagguc

SEQ ID NO: 45193 - RNA, 27 nt, Artificial Sequence
  Protein RTF2 homolog (83-91)
aagagcaucaagaacgugaccgagcug

SEQ ID NO: 45194 - RNA, 27 nt, Artificial Sequence
  Adenylosuccinate synthetase isozyme 2 (203-211)
aagagcaucuaccccacccuggagauc

SEQ ID NO: 45195 - RNA, 27 nt, Artificial Sequence
  Selenoprotein N (53-61)
aagagcaaggacggcuuccugggggug

SEQ ID NO: 45196 - RNA, 30 nt, Artificial Sequence
  Nucleolar pre-ribosomal-associated protein 1 (429-438)
aagagccugaccaagcuccugaucaugaag

SEQ ID NO: 45197 - RNA, 27 nt, Artificial Sequence
  Astrotactin-2 (499-507)
aagagcaugcccuucaucaccuaccug

SEQ ID NO: 45198 - RNA, 33 nt, Artificial Sequence
  Transmembrane protein 98 (144-154)
aagagcauguaccccccgcuggaccccaagcuc

SEQ ID NO: 45199 - RNA, 27 nt, Artificial Sequence
  CD44 antigen (303-311)
aagagccaggagauggugcaccugguc

SEQ ID NO: 45200 - RNA, 27 nt, Artificial Sequence
  Targeting protein for Xklp2 (686-694)
aagagcuccgaccagccccugaccgug

SEQ ID NO: 45201 - RNA, 27 nt, Artificial Sequence
  Chromodomain-helicase-DNA-binding protein 1 (88-96)
aagagcucccccagcauccuggccgug

SEQ ID NO: 45202 - RNA, 27 nt, Artificial Sequence
  Leucine-tRNA ligase, cytoplasmic (28-36)
aagagcaccggcaacuuccugacccuc

SEQ ID NO: 45203 - RNA, 27 nt, Artificial Sequence
  116 kDa U5 small nuclear ribonucleoprotein component (182-190)
aagagcacccccgugaccgucgugcug

SEQ ID NO: 45204 - RNA, 27 nt, Artificial Sequence
  Lysosome-associated membraneoprotein 2 (402-410)
aagagcuacgccggcuaccagacccug

SEQ ID NO: 45205 - RNA, 27 nt, Artificial Sequence
  2',3'-cyclic-nucleotide 3'-phosphodiesterase (256-264)
aagagcuacuccaaggccuucacccug

SEQ ID NO: 45206 - RNA, 27 nt, Artificial Sequence
  Zinc finger protein ZIC 2 (401-409)
aagagcuacacccaccccuccagccug

SEQ ID NO: 45207 - RNA, 24 nt, Artificial Sequence
  Ubiquitin carboxyl-terminal hydrolase 8 (34-41)
aagagcuacgugcacuccgcccug

SEQ ID NO: 45208 - RNA, 27 nt, Artificial Sequence
  Peptidyl-prolyl cis-trans isomerase A (31-39)
aagaccgccgagaacuuccgcgcccug

SEQ ID NO: 45209 - RNA, 27 nt, Artificial Sequence
  Endothelin B receptor (359-367)
aagaccgccaaggacugguggcuguuc

SEQ ID NO: 45210 - RNA, 27 nt, Artificial Sequence
  V-type proton ATPase 116 kDa subunit a isoform 4 (360-368)
aagaccgcccccccgaccuucaaccgc

SEQ ID NO: 45211 - RNA, 27 nt, Artificial Sequence
  RAC-gamma serine/threonine-protein kinase (32-40)
aagaccgacggcagcuucaucggguac

SEQ ID NO: 45212 - RNA, 33 nt, Artificial Sequence
  Growth/differentiation factor 15 (274-284)
aagaccgacaccggcgugagccugcagacguac

SEQ ID NO: 45213 - RNA, 51 nt, Artificial Sequence
  Myeloid-derived growth factor (132-148)
aagaccgaggaguucgaggugaccaagacggccgucgcccaccgccccggc

SEQ ID NO: 45214 - RNA, 27 nt, Artificial Sequence
  Myosin-IIIb (442-450)
aagaccgagagcgcccaccugaucgug

SEQ ID NO: 45215 - RNA, 27 nt, Artificial Sequence
  Cullin-4B (327-335)
aagaccaucgacggcauccugcuccug

SEQ ID NO: 45216 - RNA, 27 nt, Artificial Sequence
  UPF0769 protein C21orf59 (114-122)
aagaccaucgaggaggccaaggccauc

SEQ ID NO: 45217 - RNA, 30 nt, Artificial Sequence
  Protein FAM184A (180-189)
aagaccaucggcaagcugaagaccgagcuc

SEQ ID NO: 45218 - RNA, 27 nt, Artificial Sequence
  Probable C-mannosyltransferase DPY19L4 (129-137)
aagaccaucaacgccgugcagcagaug

SEQ ID NO: 45219 - RNA, 27 nt, Artificial Sequence
  Transcription factor SOX-8 (16-24)
aagacccugggcaagcucuggcgccug

SEQ ID NO: 45220 - RNA, 24 nt, Artificial Sequence
  Transcription factor Dp-2 (49-56)
aagacccugggccccaucaacgug

SEQ ID NO: 45221 - RNA, 60 nt, Artificial Sequence
  Uncharacterized protein KIAA1109 (4603-4622)
aagaccaugaccagcaaccuggagaaguccagccaggagcagcuccuggacgccgcccac

SEQ ID NO: 45222 - RNA, 27 nt, Artificial Sequence
  Catenin beta-1 (288-296)
aagaccaacgugaaguuccuggccauc

SEQ ID NO: 45223 - RNA, 24 nt, Artificial Sequence
  RNA-binding protein Raly (143-150)
aagaccaacgugcccgucaagcug

SEQ ID NO: 45224 - RNA, 27 nt, Artificial Sequence
  THO complex subunit 2 (892-900)
aagacccccaacuucagcacccugcuc

SEQ ID NO: 45225 - RNA, 27 nt, Artificial Sequence
  HEAT repeat-containing protein 2 (446-454)
aagacccccagcgccuccggccugcuc

SEQ ID NO: 45226 - RNA, 27 nt, Artificial Sequence
  Eukaryotic translation initiation factor 4 gamma 1 (717-725)
aagacccaggaccuguuccgccgggug

SEQ ID NO: 45227 - RNA, 27 nt, Artificial Sequence
  Angiomotin-like protein 1 (332-340)
aagacccaggagcacggccuguucuac

SEQ ID NO: 45228 - RNA, 27 nt, Artificial Sequence
  Cohesin subunit SA-2 (965-973)
aagacccgcgaggccaucgccaugcug

SEQ ID NO: 45229 - RNA, 24 nt, Artificial Sequence
  Golgin subfamily B member 1 (382-389)
aagaccagccacauccugucccuc

SEQ ID NO: 45230 - RNA, 24 nt, Artificial Sequence
  ATP-binding cassette sub-family F member 3 (144-151)
aagaccagcaacccccuggugcuc

SEQ ID NO: 45231 - RNA, 27 nt, Artificial Sequence
  Hemicentin-1 (971-979)
aagaccaccagcguggucgugcacgug

SEQ ID NO: 45232 - RNA, 27 nt, Artificial Sequence
  Vigilin (294-302)
aagaccaccacgaucgccguggagguc

SEQ ID NO: 45233 - RNA, 24 nt, Artificial Sequence
  Rab3 GTPase-activating protein non-catalytic subunit (1174-1181)
aagaccgugaagccccugagccuc

SEQ ID NO: 45234 - RNA, 27 nt, Artificial Sequence
  40S ribosomal protein S11 (136-144)
aagaccgugcgcuucaacguccugaag

SEQ ID NO: 45235 - RNA, 30 nt, Artificial Sequence
  Melanocyte protein PMEL (154-163)
aagaccugggaccaggugcccuucagcguc

SEQ ID NO: 45236 - RNA, 27 nt, Artificial Sequence
  Spermidine synthase (57-65)
aagaccuacggcaacgugcugguccuc

SEQ ID NO: 45237 - RNA, 39 nt, Artificial Sequence
  26S protease regulatory subunit 7 (34-46)
aagaccuacggccagagcaccuacucccgccagaucaag

SEQ ID NO: 45238 - RNA, 27 nt, Artificial Sequence
  Cyclin-dependent kinase 16 (470-478)
aagaccuacaacuaccccaaguaccgc

SEQ ID NO: 45239 - RNA, 27 nt, Artificial Sequence
  Non-receptor tyrosine-protein kinase TNK1 (260-268)
aagguggccgacuucggccugguccgc

SEQ ID NO: 45240 - RNA, 27 nt, Artificial Sequence
  GMP synthase (glutamine-hydrolyzing) (292-300)
aagguggccgacggcuucaaggucgug

SEQ ID NO: 45241 - RNA, 27 nt, Artificial Sequence
  Dynactin subunit 3 (32-40)
aagguggccgacggccuggucaaggug

SEQ ID NO: 45242 - RNA, 27 nt, Artificial Sequence
  Phosphoglycerate kinase 1 (216-224)
aagguggccgacaagauccagcugauc

SEQ ID NO: 45243 - RNA, 27 nt, Artificial Sequence
  Disks large homolog 1 (368-376)
aagguggccaagcccaccagcauguac

SEQ ID NO: 45244 - RNA, 30 nt, Artificial Sequence
  GPI mannosyltransferase 1 (15-24)
aagguggcccccgccggcgucuucggggug

SEQ ID NO: 45245 - RNA, 36 nt, Artificial Sequence
  Coatomer subunit delta (123-134)
aagguggcccccgccccggcgcgccccagcggcccc

SEQ ID NO: 45246 - RNA, 27 nt, Artificial Sequence
  Asparagine synthetase (glutamine-hydrolyzing) (112-120)
aagguggccagcgucgagauggugaag

SEQ ID NO: 45247 - RNA, 69 nt, Artificial Sequence
  Pyridoxal kinase (152-174)
aagguggacgccgucuucgugggcaccggggaccuguucgccgcgaugcuccuggccuggacccacaag

SEQ ID NO: 45248 - RNA, 27 nt, Artificial Sequence
  Melanoma-associated antigen 4 (113-121)
aagguggacgagcuggcccacuuccuc

SEQ ID NO: 45249 - RNA, 27 nt, Artificial Sequence
  Centromere protein F (738-746)
aagguggacgagcugaccaccgagauc

SEQ ID NO: 45250 - RNA, 27 nt, Artificial Sequence
  Beta-secretase 2 (314-322)
aagguguucgacgccgucguggaggcc

SEQ ID NO: 45251 - RNA, 27 nt, Artificial Sequence
  Transcription factor HES-1 (214-222)
aagguguucggcggguuccaggucgug

SEQ ID NO: 45252 - RNA, 24 nt, Artificial Sequence
  Myelin expression factor 2 (123-130)
aaggugggcgaggucaccuacgug

SEQ ID NO: 45253 - RNA, 24 nt, Artificial Sequence
  Uridine phosphorylase 1 (99-106)
aaggugggccccguccugagcgug

SEQ ID NO: 45254 - RNA, 33 nt, Artificial Sequence
  Nucleosome-remodeling factor subunit BPTF (2095-2105)
aaggugggcagccccgccaccgucaccuuccag

SEQ ID NO: 45255 - RNA, 18 nt, Artificial Sequence
  E3 ubiquitin/ISG15 ligase TRIM25 (596-601)
aaggugcaccugauguac

SEQ ID NO: 45256 - RNA, 30 nt, Artificial Sequence
  Unconventional myosin-Id (255-264)
aaggugaucggcuucaagcccgaggagauc

SEQ ID NO: 45257 - RNA, 39 nt, Artificial Sequence
  Titin (15654-15666)
aaggugaaggaggucaccaagaccagcgugacgcugacc

SEQ ID NO: 45258 - RNA, 27 nt, Artificial Sequence
  Fructose-bisphosphate aldolase A (262-270)
aaggugcuggccgccgucuacaaggcg

SEQ ID NO: 45259 - RNA, 153 nt, Artificial Sequence
  Titin (21056-21106)
aaggugcuggacacccccgccgccugccagaagcuccaggucaagcacgugagccgcggcaccgugacgcugcugugggacccgccccucaucgacgggggcucccccaucaucaacuacgucaucgagaagcgggacgcgaccaagcgcacc

SEQ ID NO: 45260 - RNA, 33 nt, Artificial Sequence
  F-box only protein 32 (98-108)
aaggugcuggaggaccagcagaacauccgccuc

SEQ ID NO: 45261 - RNA, 27 nt, Artificial Sequence
  Melanoma-associated antigen 4 (286-294)
aaggugcuggagcacgucgugcgcgug

SEQ ID NO: 45262 - RNA, 27 nt, Artificial Sequence
  Chloride transport protein 6 (183-191)
aaggugcugggcguccucuucagcgug

SEQ ID NO: 45263 - RNA, 27 nt, Artificial Sequence
  SLIT-ROBO Rho GTPase-activating protein 2 (155-163)
aaggugcugaacgagcucuacagcguc

SEQ ID NO: 45264 - RNA, 27 nt, Artificial Sequence
  Signal recognition particle receptor subunit alpha (345-353)
aaggugaugggcaccuucagcaccguc

SEQ ID NO: 45265 - RNA, 27 nt, Artificial Sequence
  40S ribosomal protein S16 (32-40)
aaggugaacggccgcccccuggagaug

SEQ ID NO: 45266 - RNA, 24 nt, Artificial Sequence
  E3 ubiquitin-protein ligase RING1 (361-368)
aaggugagccgcccccuggagcuc

SEQ ID NO: 45267 - RNA, 27 nt, Artificial Sequence
  Solute carrier family 41 member 2 (192-200)
aaggugaccgaggucuucauccuggug

SEQ ID NO: 45268 - RNA, 27 nt, Artificial Sequence
  Hom s 1 (524-532)
aagguggucgagaucgugaagaagcug

SEQ ID NO: 45269 - RNA, 18 nt, Artificial Sequence
  Poly (ADP-ribose) polymerase 12 (512-517)
aagguguggaaccuguuc

SEQ ID NO: 45270 - RNA, 30 nt, Artificial Sequence
  Unconventional myosin-Id (707-716)
aagguguggcgcggcacccuggcccggaug

SEQ ID NO: 45271 - RNA, 30 nt, Artificial Sequence
  Hemicentin-1 (2662-2671)
aagguguacauccccccgaucaucaacaag

SEQ ID NO: 45272 - RNA, 27 nt, Artificial Sequence
  Probable helicase with zinc finger domain (500-508)
aaguacgcccagaacggccagcuguuc

SEQ ID NO: 45273 - RNA, 27 nt, Artificial Sequence
  DNA cross-link repair 1A protein (370-378)
aaguacgacgagggccuguaccgcuuc

SEQ ID NO: 45274 - RNA, 27 nt, Artificial Sequence
  EH domain-containing protein 2 (452-460)
aaguacgacgagaucuucuacaaccug

SEQ ID NO: 45275 - RNA, 27 nt, Artificial Sequence
  E3 ubiquitin-protein ligase SIAH1 (198-206)
aaguacgacggccaccagcaguucuuc

SEQ ID NO: 45276 - RNA, 27 nt, Artificial Sequence
  Dedicator of cytokinesis protein 4 (92-100)
aaguacggcgacaugcgcgugaccaug

SEQ ID NO: 45277 - RNA, 24 nt, Artificial Sequence
  Serine/threonine-protein kinase PLK2 (513-520)
aaguacggcuucggguaccagcug

SEQ ID NO: 45278 - RNA, 27 nt, Artificial Sequence
  Protein SOGA1 (415-423)
aaguacggcaucgugcaggaguucuuc

SEQ ID NO: 45279 - RNA, 24 nt, Artificial Sequence
  Glycerol-3-phosphate acyltransferase 4 (365-372)
aaguacggcauggugaccuaccug

SEQ ID NO: 45280 - RNA, 27 nt, Artificial Sequence
  RNA-binding motif protein, X chromosome (30-38)
aaguacggccgcaucguggagguccug

SEQ ID NO: 45281 - RNA, 27 nt, Artificial Sequence
  Non-specific lipid-transfer protein (92-100)
aaguacggcaccaagaucgagcacuuc

SEQ ID NO: 45282 - RNA, 30 nt, Artificial Sequence
  Paired amphipathic helix protein Sin3b (300-309)
aaguacggcacccugcaggaguucagcuuc

SEQ ID NO: 45283 - RNA, 27 nt, Artificial Sequence
  Kinase D-interacting substrate of 220 kDa (126-134)
aaguacggcaccaccccccuggugugg

SEQ ID NO: 45284 - RNA, 27 nt, Artificial Sequence
  Peroxisome proliferator-activated receptor delta isoform 4 (185-193)
aaguacggcgugcacgaggccaucuuc

SEQ ID NO: 45285 - RNA, 27 nt, Artificial Sequence
  Tubulin-tyrosine ligase-like protein 12 (451-459)
aaguacaucgagagccccgugcuguuc

SEQ ID NO: 45286 - RNA, 27 nt, Artificial Sequence
  Protein yippee-like 3 (104-112)
aaguacaucaucgagcugaaccacaug

SEQ ID NO: 45287 - RNA, 27 nt, Artificial Sequence
  3-hydroxy-3-methylglutaryl-coenzyme A reductase (89-97)
aaguacauccugggcaucgccgggcuc

SEQ ID NO: 45288 - RNA, 27 nt, Artificial Sequence
  Alpha-fetoprotein (403-411)
aaguacauccaggagagccaggcccug

SEQ ID NO: 45289 - RNA, 27 nt, Artificial Sequence
  Membrane progestin receptor alpha (193-201)
aaguacauccagaagcccggccugcuc

SEQ ID NO: 45290 - RNA, 27 nt, Artificial Sequence
  Centrosomal protein of 135 kDa (857-865)
aaguacaucaccgaggugagccgcugg

SEQ ID NO: 45291 - RNA, 27 nt, Artificial Sequence
  Transmembrane emp24 domain-containing protein 5 (84-92)
aaguacaucaccggcaccgacauccug

SEQ ID NO: 45292 - RNA, 27 nt, Artificial Sequence
  Kinesin light chain 1 (266-274)
aaguacaaggacgccgccaaccugcuc

SEQ ID NO: 45293 - RNA, 27 nt, Artificial Sequence
  Melanoma-associated antigen B1 (141-149)
aaguacaaggaccacuucaccgagauc

SEQ ID NO: 45294 - RNA, 27 nt, Artificial Sequence
  Melanoma-associated antigen C2 (173-181)
aaguacaaggacuacuuccccgugauc

SEQ ID NO: 45295 - RNA, 27 nt, Artificial Sequence
  Kinesin light chain 4 (191-199)
aaguacaaggaggccgcccaccugcuc

SEQ ID NO: 45296 - RNA, 27 nt, Artificial Sequence
  Antizyme inhibitor 1 (341-349)
aaguacaaggaggacgagccccuguuc

SEQ ID NO: 45297 - RNA, 27 nt, Artificial Sequence
  Protein disulfide-isomerase (91-99)
aaguacaagcccgagagcgaggagcug

SEQ ID NO: 45298 - RNA, 27 nt, Artificial Sequence
  Peroxisomal acyl-coenzyme A oxidase 3 (120-128)
aaguaccugcuccacagccugguguuc

SEQ ID NO: 45299 - RNA, 27 nt, Artificial Sequence
  Gem-associated protein 4 (188-196)
aaguaccugcccgcccucgacgaguuc

SEQ ID NO: 45300 - RNA, 33 nt, Artificial Sequence
  Phosphatidylinositol-glycan biosynthesis class W protein (189-199)
aaguacauggagggcagcaagcugcacuacuuc

SEQ ID NO: 45301 - RNA, 30 nt, Artificial Sequence
  Histone acetyltransferase type B catalytic subunit (207-216)
aaguacaacaaggacggcgccacccuguuc

SEQ ID NO: 45302 - RNA, 27 nt, Artificial Sequence
  Formin-like protein 3 (158-166)
aaguaccccgaccuggccaacuucugg

SEQ ID NO: 45303 - RNA, 27 nt, Artificial Sequence
  Rho guanine nucleotide exchange factor 12 (939-947)
aaguacccccugcuccuggacaacauc

SEQ ID NO: 45304 - RNA, 27 nt, Artificial Sequence
  Rho guanine nucleotide exchange factor 11 (884-892)
aaguacccccugcuccuggagagcauc

SEQ ID NO: 45305 - RNA, 27 nt, Artificial Sequence
  Protein lifeguard 4 (139-147)
aaguacccccugaaccucuaccugcug

SEQ ID NO: 45306 - RNA, 27 nt, Artificial Sequence
  Ceramide glucosyltransferase (104-112)
aaguaccccaacguggacgcccgccug

SEQ ID NO: 45307 - RNA, 21 nt, Artificial Sequence
  ATP-dependent RNA helicase A (169-175)
aaguaccccagcccguucuuc

SEQ ID NO: 45308 - RNA, 27 nt, Artificial Sequence
  Early endosome antigen 1 (387-395)
aaguaccagcaccugaaggccgaguuc

SEQ ID NO: 45309 - RNA, 27 nt, Artificial Sequence
  Tetratricopeptide repeat protein 9C (156-164)
aaguaccgcgacgccgugagccgguac

SEQ ID NO: 45310 - RNA, 27 nt, Artificial Sequence
  Zinc finger protein ZFAT (350-358)
aaguacagcgacgugaagaaccugauc

SEQ ID NO: 45311 - RNA, 27 nt, Artificial Sequence
  Host cell factor 1 (105-113)
aaguacagcaacgaccuguacgagcuc

SEQ ID NO: 45312 - RNA, 27 nt, Artificial Sequence
  Serine-protein kinase ATM (331-339)
aaguacagcuccggcuuccgcaacauc

SEQ ID NO: 45313 - RNA, 27 nt, Artificial Sequence
  Zinc finger MYM-type protein 4 (1301-1309)
aaguacagcaccaagaugaccuaccug

SEQ ID NO: 45314 - RNA, 72 nt, Artificial Sequence
  Actin, gamma-enteric smooth muscle (294-317)
aaguacagcguguggaucggcggguccauccuggccagccucuccaccuuccagcagauguggaucagcaag

SEQ ID NO: 45315 - RNA, 27 nt, Artificial Sequence
  DNA/RNA-binding protein KIN17 (311-319)
aaguacaccgccguggucaagaugauc

SEQ ID NO: 45316 - RNA, 27 nt, Artificial Sequence
  Signal peptidase complex subunit 2 (73-81)
aaguacguggagaacuucggccugauc

SEQ ID NO: 45317 - RNA, 27 nt, Artificial Sequence
  Sorting nexin-29 (103-111)
aaguacgugggcgccguccagaugcug

SEQ ID NO: 45318 - RNA, 24 nt, Artificial Sequence
  Zinc finger protein 195 (148-155)
aaguacgugaagaucuucgacaac

SEQ ID NO: 45319 - RNA, 27 nt, Artificial Sequence
  Zinc finger protein 92 (117-125)
aaguacgugaaggucuuccacaaguuc

SEQ ID NO: 45320 - RNA, 27 nt, Artificial Sequence
  Zinc finger protein 708 (80-88)
aaguacgugaaggucuuccacaaguac

SEQ ID NO: 45321 - RNA, 27 nt, Artificial Sequence
  Tubulin beta chain (78-86)
aaguacgugccccgcgccauccugguc

SEQ ID NO: 45322 - RNA, 27 nt, Artificial Sequence
  Centromere/kinetochore protein zw10 homolog (130-138)
aaguacgugaccggcgcccagcgccug

SEQ ID NO: 45323 - RNA, 27 nt, Artificial Sequence
  Ubiquitin carboxyl-terminal hydrolase 8 (65-73)
aaguacgugaccgucuacaaccugauc

SEQ ID NO: 45324 - RNA, 27 nt, Artificial Sequence
  Digestive organ expansion factor homolog (526-534)
aaguacuaccgccagacccugcucuuc

SEQ ID NO: 45325 - RNA, 30 nt, Artificial Sequence
  Probable E3 ubiquitin-protein ligase HERC1 (3206-3215)
cuggccgccggccucgagagccuggggcug

SEQ ID NO: 45326 - RNA, 33 nt, Artificial Sequence
  Glutamate receptor ionotropic, kainate 2 (827-837)
cuggccgccggccucgugcugagcgucuucgug

SEQ ID NO: 45327 - RNA, 27 nt, Artificial Sequence
  Ankyrin repeat domain-containing protein 17 (848-856)
cuggccgccggcccccucccgcccggg

SEQ ID NO: 45328 - RNA, 24 nt, Artificial Sequence
  Spectrin beta chain, non-erythrocytic 4 (1779-1786)
cuggccgccgugaaccagaugguc

SEQ ID NO: 45329 - RNA, 27 nt, Artificial Sequence
  Vimentin (88-96)
cuggccgacgccaucaacaccgaguuc

SEQ ID NO: 45330 - RNA, 27 nt, Artificial Sequence
  Exonuclease 3'-5' domain-containing protein 2 (31-39)
cuggccgacggcaccauccucaaggug

SEQ ID NO: 45331 - RNA, 27 nt, Artificial Sequence
  Kinesin-associated protein 3 (289-297)
cuggccgaggacacccgcaccgagcuc

SEQ ID NO: 45332 - RNA, 24 nt, Artificial Sequence
  Kinectin (601-608)
cuggccgaggagcuccacaaggug

SEQ ID NO: 45333 - RNA, 24 nt, Artificial Sequence
  CREB-binding protein (654-661)
cuggccgagaagaucuacaagauc

SEQ ID NO: 45334 - RNA, 24 nt, Artificial Sequence
  Protein shisa-4 (79-86)
cuggccuucagccccaagaccauc

SEQ ID NO: 45335 - RNA, 24 nt, Artificial Sequence
  DNA-dependent protein kinase catalytic subunit (29-36)
cuggccggccaccagcucauccgc

SEQ ID NO: 45336 - RNA, 30 nt, Artificial Sequence
  Signal transducer and activator of transcription 3 (221-230)
cuggccggccuccugagcgccauggaguac

SEQ ID NO: 45337 - RNA, 27 nt, Artificial Sequence
  Phosphoacetylglucosamine mutase (519-527)
cuggcccacgaggugagccucgccguc

SEQ ID NO: 45338 - RNA, 33 nt, Artificial Sequence
  Ancient ubiquitous protein 1 (320-330)
cuggccaagaccggcugcguggaccucaccauc

SEQ ID NO: 45339 - RNA, 27 nt, Artificial Sequence
  Splicing factor 3B subunit 3 (765-773)
cuggcccucgagaagcugggcgccgug

SEQ ID NO: 45340 - RNA, 24 nt, Artificial Sequence
  EH domain-containing protein 1 (503-510)
cuggccaaccaccucaucaaggug

SEQ ID NO: 45341 - RNA, 24 nt, Artificial Sequence
  Alpha-2-macroglobulin-like protein 1 (37-44)
cuggcccccgacccgagccucgug

SEQ ID NO: 45342 - RNA, 24 nt, Artificial Sequence
  COP9 signalosome complex subunit 1 (358-365)
cuggccccccacgugcgcacccuc

SEQ ID NO: 45343 - RNA, 27 nt, Artificial Sequence
  WAS/WASL-interacting protein family member 2 (294-302)
cuggcccccccgccccccaccagcgcc

SEQ ID NO: 45344 - RNA, 24 nt, Artificial Sequence
  Ancient ubiquitous protein 1 (300-307)
cuggcccagcgcgugaaggagguc

SEQ ID NO: 45345 - RNA, 27 nt, Artificial Sequence
  Fatty acid synthase (899-907)
cuggcccgcgcccucggccugggggug

SEQ ID NO: 45346 - RNA, 30 nt, Artificial Sequence
  Molybdate-anion transporter (181-190)
cuggccguggucgccggcguggcggccgag

SEQ ID NO: 45347 - RNA, 54 nt, Artificial Sequence
  Epidermal growth factor receptor (5-22)
cuggccguggucagccucaacaucaccucccugggccugcgcagccucaaggag

SEQ ID NO: 45348 - RNA, 21 nt, Artificial Sequence
  Serum albumin (484-490)
cugugcgugcuccacgagaag

SEQ ID NO: 45349 - RNA, 69 nt, Artificial Sequence
  Actin, cytoplasmic 2 (73-95)
cugugcuacguggcccucgacuucgagcaggagauggccaccgcggccagcuccagcucccuggagaag

SEQ ID NO: 45350 - RNA, 24 nt, Artificial Sequence
  Coiled-coil domain-containing protein 93 (525-532)
cuggacgacaagaagguguaccuc

SEQ ID NO: 45351 - RNA, 30 nt, Artificial Sequence
  Melanoma inhibitory activity protein 3 (157-166)
cuggacgacaccgccaagaaccuccgcgug

SEQ ID NO: 45352 - RNA, 24 nt, Artificial Sequence
  Axin-1 (509-516)
cuggacgagcacgugcagcgcguc

SEQ ID NO: 45353 - RNA, 24 nt, Artificial Sequence
  Probable ATP-dependent RNA helicase DDX27 (86-93)
cuggacgagaagaucgagaaggug

SEQ ID NO: 45354 - RNA, 24 nt, Artificial Sequence
  U6 snRNA-associated Sm-like protein LSm8 (17-24)
cuggacgagagccacgagcgcgug

SEQ ID NO: 45355 - RNA, 111 nt, Artificial Sequence
  Collagen alpha-1(XX) chain (189-225)
cuggacuuccuccagcugggcgcccuggccgggcuccugagccgccugaucugccagcggcuccagggcggguccccccgccagggcccggcggccgcccccgcccuggac

SEQ ID NO: 45356 - RNA, 24 nt, Artificial Sequence
  Prelamin-A/C (55-62)
cuggacuuccagaagaacaucuac

SEQ ID NO: 45357 - RNA, 30 nt, Artificial Sequence
  ATP-binding cassette sub-family A member 13 (447-456)
cuggacggcgcccuccgcaacgccaucgcg

SEQ ID NO: 45358 - RNA, 21 nt, Artificial Sequence
  Mitochondrial dicarboxylate carrier (145-151)
cuggacggccucuaccgcgug

SEQ ID NO: 45359 - RNA, 21 nt, Artificial Sequence
  Heat shock protein HSP 90-beta (497-503)
cuggacaagaagguggagaag

SEQ ID NO: 45360 - RNA, 24 nt, Artificial Sequence
  RHO/RAC effector protein (1024-1031)
cuggacaagaacgaccacagccuc

SEQ ID NO: 45361 - RNA, 21 nt, Artificial Sequence
  Small subunit processome component 20 homolog (301-307)
cuggaccuccacaccaaggug

SEQ ID NO: 45362 - RNA, 24 nt, Artificial Sequence
  Exportin-1 (715-722)
cuggacaugcucaacguguacaag

SEQ ID NO: 45363 - RNA, 27 nt, Artificial Sequence
  Mediator of RNA polymerase II transcription subunit 12 (1430-1438)
cuggacaugcucagcgugcugaucaac

SEQ ID NO: 45364 - RNA, 24 nt, Artificial Sequence
  Serine/threonine-protein kinase N1 (459-466)
cuggacaacgagcgccacgaggug

SEQ ID NO: 45365 - RNA, 27 nt, Artificial Sequence
  SWI/SNF-related matrix-associated actin-dependent regulator of chromatin subfamily A member 5 (921-929)
cuggacaccaagaucggccgcuacaag

SEQ ID NO: 45366 - RNA, 27 nt, Artificial Sequence
  Serine-protein kinase ATM (1050-1058)
cuggaggccgaccccuacagcaagugg

SEQ ID NO: 45367 - RNA, 39 nt, Artificial Sequence
  Erlin-2 (327-339)
cuggaggacgagccccucgagaccgccaccaaggagaac

SEQ ID NO: 45368 - RNA, 30 nt, Artificial Sequence
  Spectrin beta chain, non-erythrocytic 1 (740-749)
cuggaggaggccagccuccugcaccaguuc

SEQ ID NO: 45369 - RNA, 27 nt, Artificial Sequence
  Structural maintenance of chromosomes protein 1A (367-375)
cuggaggagaaccaggugaagaaguac

SEQ ID NO: 45370 - RNA, 39 nt, Artificial Sequence
  Moesin (16-28)
cuggaguucgccauccagcccaacaccaccggcaagcag

SEQ ID NO: 45371 - RNA, 42 nt, Artificial Sequence
  Moesin (16-29)
cuggaguucgccauccagcccaacaccaccggcaagcagcuc

SEQ ID NO: 45372 - RNA, 30 nt, Artificial Sequence
  Synemin (898-907)
cuggagggcgaccucgggagcacccacugg

SEQ ID NO: 45373 - RNA, 21 nt, Artificial Sequence
  Melanoma-associated antigen 4 (288-294)
cuggagcacgugguccgcgug

SEQ ID NO: 45374 - RNA, 27 nt, Artificial Sequence
  Keratin, type II cytoskeletal 1 (477-485)
cuggagaucgccaccuaccgcacccuc

SEQ ID NO: 45375 - RNA, 27 nt, Artificial Sequence
  Integrator complex subunit 11 (341-349)
cuggagauggagggccgccaggugcuc

SEQ ID NO: 45376 - RNA, 27 nt, Artificial Sequence
  Voltage-dependent calcium channel subunit alpha-2/delta-1 (566-574)
cuggagaacgacaucaagguggagauc

SEQ ID NO: 45377 - RNA, 27 nt, Artificial Sequence
  Histone acetyltransferase type B catalytic subunit (44-52)
cuggagaacgacauccgcaccuucuuc

SEQ ID NO: 45378 - RNA, 51 nt, Artificial Sequence
  Thioredoxin domain-containing protein 15 (185-201)
cuggagaacuucacccucaagauccugaacaugagccaggaccugauggac

SEQ ID NO: 45379 - RNA, 36 nt, Artificial Sequence
  HLA class I histocompatibility antigen, A-2 alpha chain (171-182)
cuggagaacggcaaggagacccuccagcgcaccgac

SEQ ID NO: 45380 - RNA, 27 nt, Artificial Sequence
  V-type proton ATPase subunit H (318-326)
cuggagaaccucgagcagcagaaguac

SEQ ID NO: 45381 - RNA, 45 nt, Artificial Sequence
  Tubulin beta-6 chain (68-82)
cuggagcccggcaccauggacagcgugcgcuccgggccguucggc

SEQ ID NO: 45382 - RNA, 27 nt, Artificial Sequence
  DNA repair protein RAD51 homolog 3 (91-99)
cuggagcaggagcacacccagggcuuc

SEQ ID NO: 45383 - RNA, 27 nt, Artificial Sequence
  Laminin subunit gamma-1 (1296-1304)
cuggagcagcucaucgaccagaagcug

SEQ ID NO: 45384 - RNA, 24 nt, Artificial Sequence
  Serine/arginine-rich splicing factor 3 (26-33)
cuggagcgcgccuucggcuacuac

SEQ ID NO: 45385 - RNA, 24 nt, Artificial Sequence
  Melanoma-associated antigen 4 (137-144)
cuggagcgcgugaucaagaacuac

SEQ ID NO: 45386 - RNA, 42 nt, Artificial Sequence
  Kin of IRRE-like protein 1 (338-351)
cuggagcgcuacaccguggagcggaccaacagcggcuccggg

SEQ ID NO: 45387 - RNA, 21 nt, Artificial Sequence
  Cyclic AMP-dependent transcription factor ATF-4 (38-44)
cuggagguggccaagcacuuc

SEQ ID NO: 45388 - RNA, 66 nt, Artificial Sequence
  Calpain-2 catalytic subunit (459-480)
cuguucgcccagcucgccggcgaggacgcggagaucagcgccuucgagcugcagaccauccugcgc

SEQ ID NO: 45389 - RNA, 27 nt, Artificial Sequence
  Vacuolar protein sorting-associated protein 8 homolog (853-861)
cuguucgaccaggugcucgaguuccug

SEQ ID NO: 45390 - RNA, 30 nt, Artificial Sequence
  Titin (9698-9707)
cuguucuucgugagcgagccccaguccauc

SEQ ID NO: 45391 - RNA, 24 nt, Artificial Sequence
  Protein MCM10 homolog (334-341)
cuguucggcgaggugcacaaggcc

SEQ ID NO: 45392 - RNA, 24 nt, Artificial Sequence
  Guanine nucleotide-binding protein subunit beta-5 (321-328)
cuguucggccacgagaaccgcgug

SEQ ID NO: 45393 - RNA, 30 nt, Artificial Sequence
  Cullin-7 (1270-1279)
cuguucggcccccgcgccgccuuccuccug

SEQ ID NO: 45394 - RNA, 30 nt, Artificial Sequence
  HLA class II histocompatibility antigen, DP alpha 1 chain (167-176)
cuguuccucccccgcaccgacuacagcuuc

SEQ ID NO: 45395 - RNA, 33 nt, Artificial Sequence
  ER membrane protein complex subunit 1 (430-440)
cuguuccuccagcagcuggccggcaaggugguc

SEQ ID NO: 45396 - RNA, 24 nt, Artificial Sequence
  Asparagine synthetase (glutamine-hydrolyzing) (155-162)
cuguucaacaacgccgugaagaag

SEQ ID NO: 45397 - RNA, 27 nt, Artificial Sequence
  Chloride transport protein 6 (104-112)
cuguucacccagcucaaguucggcgug

SEQ ID NO: 45398 - RNA, 30 nt, Artificial Sequence
  Cytochrome c oxidase subunit 1 (347-356)
cuguucaccgugggcgggcucaccggcauc

SEQ ID NO: 45399 - RNA, 30 nt, Artificial Sequence
  Protein-glutamine gamma-glutamyltransferase 5 (627-636)
cugggcgccgccguggucaaccagccccuc

SEQ ID NO: 45400 - RNA, 33 nt, Artificial Sequence
  Elastin (48-58)
cugggcgcccucgggggcggggcccugggcccc

SEQ ID NO: 45401 - RNA, 21 nt, Artificial Sequence
  Proteasome subunit beta type-4 (122-128)
cugggcgacgggcacagcuac

SEQ ID NO: 45402 - RNA, 27 nt, Artificial Sequence
  Mitogen-activated protein kinase 4 (26-34)
cugggcuucggggugaacggccucguc

SEQ ID NO: 45403 - RNA, 21 nt, Artificial Sequence
  Lipopolysaccharide-responsive and beige-like anchor protein (138-144)
cugggcaagaucgagaaggug

SEQ ID NO: 45404 - RNA, 21 nt, Artificial Sequence
  EH domain-containing protein 4 (484-490)
cugggcaagaucuggaagcuc

SEQ ID NO: 45405 - RNA, 27 nt, Artificial Sequence
  Probable E3 ubiquitin-protein ligase HECTD4 (712-720)
cugggcaaguacgccgagagcauccuc

SEQ ID NO: 45406 - RNA, 60 nt, Artificial Sequence
  14-3-3 protein beta/alpha (170-189)
cugggccucgcccugaacuucagcguguucuacuacgagauccugaacucccccgagaag

SEQ ID NO: 45407 - RNA, 102 nt, Artificial Sequence
  Heat shock protein HSP 90-alpha (510-543)
cugggccucgggaucgacgaggacgaccccaccgccgacgacaccagcgccgcggugacggaggagaugccgccccuggagggcgacgacgacaccucccgc

SEQ ID NO: 45408 - RNA, 30 nt, Artificial Sequence
  HLA class II histocompatibility antigen, DQ alpha 1 chain (223-232)
cugggccucagcguggggcuggucggcauc

SEQ ID NO: 45409 - RNA, 27 nt, Artificial Sequence
  Splicing factor 3B subunit 2 (104-112)
cugggccccccgcccccccuccgcgug

SEQ ID NO: 45410 - RNA, 30 nt, Artificial Sequence
  Ankyrin repeat domain-containing protein 17 (882-891)
cugggccaggggauccucaccgagacccag

SEQ ID NO: 45411 - RNA, 33 nt, Artificial Sequence
  Transketolase (38-48)
cugggccaggggcucggcgccgccugcgggaug

SEQ ID NO: 45412 - RNA, 24 nt, Artificial Sequence
  60S ribosomal protein L13a (138-145)
cugggccgccucgcccacgaggug

SEQ ID NO: 45413 - RNA, 72 nt, Artificial Sequence
  Filamin-B (1896-1919)
cugggcagcgccgccgacuuccuccuggacaucuccgagaccgaccugagcucccucaccgcgagcaucaag

SEQ ID NO: 45414 - RNA, 21 nt, Artificial Sequence
  YY1-associated protein 1 (323-329)
cugggcagcgagacccgcuac

SEQ ID NO: 45415 - RNA, 30 nt, Artificial Sequence
  Cadherin-2 (351-360)
cugcacgccggcaccaugcucaccacguuc

SEQ ID NO: 45416 - RNA, 24 nt, Artificial Sequence
  Mortality factor 4-like protein 1 (291-298)
cugcacgacuuccucaaguaccug

SEQ ID NO: 45417 - RNA, 30 nt, Artificial Sequence
  Cyclin-G-associated kinase (18-27)
cugcacagcgaggugggcgccgggcccgcc

SEQ ID NO: 45418 - RNA, 96 nt, Artificial Sequence
  Glia-derived nexin (345-376)
cugcacgugagccacauccuccagaaggccaagaucgaggucuccgaggacggcaccaaggccagcgcggccaccacggccauccugaucgcccgc

SEQ ID NO: 45419 - RNA, 102 nt, Artificial Sequence
  Glia-derived nexin (345-378)
cugcacgugagccacauccuccagaaggccaagaucgaggucuccgaggacggcaccaaggccagcgcggccaccacggccauccugaucgcccgcuccagc

SEQ ID NO: 45420 - RNA, 30 nt, Artificial Sequence
  Cyclin-dependent kinase 1 (135-144)
cugaucgacgacaagggcaccaucaagcuc

SEQ ID NO: 45421 - RNA, 27 nt, Artificial Sequence
  CCR4-NOT transcription complex subunit 3 (77-85)
cugaucgacaaccgcaagcucaucgag

SEQ ID NO: 45422 - RNA, 27 nt, Artificial Sequence
  Eukaryotic translation initiation factor 3 subunit L (66-74)
cugaucgaccagaagguguacgagcuc

SEQ ID NO: 45423 - RNA, 24 nt, Artificial Sequence
  Dystonin (1766-1773)
cugaucgaccgcgagaccauguuc

SEQ ID NO: 45424 - RNA, 30 nt, Artificial Sequence
  Elongation factor 2 (102-111)
cugaucgacagccccggccacguggacuuc

SEQ ID NO: 45425 - RNA, 27 nt, Artificial Sequence
  Ubiquitin-like domain-containing CTD phosphatase 1 (226-234)
cugaucgacgugaagccccucggcguc

SEQ ID NO: 45426 - RNA, 24 nt, Artificial Sequence
  Programmed cell death protein 5 (92-99)
cugaucgagauccucaagaaggug

SEQ ID NO: 45427 - RNA, 24 nt, Artificial Sequence
  Nuclear pore complex protein Nup205 (249-256)
cugaucggccaccucgagcgcgug

SEQ ID NO: 45428 - RNA, 72 nt, Artificial Sequence
  Vimentin (443-466)
cugaucaagaccguggagacccgcgacggccaggucaucaacgagacgagccagcaccacgacgaccucgag

SEQ ID NO: 45429 - RNA, 30 nt, Artificial Sequence
  Syndetin (107-116)
cugauccucgagaagcagcccgccuacgug

SEQ ID NO: 45430 - RNA, 27 nt, Artificial Sequence
  Small subunit processome component 20 homolog (1298-1306)
cugauccucccccacgugccggccauc

SEQ ID NO: 45431 - RNA, 27 nt, Artificial Sequence
  Patatin-like phospholipase domain-containing protein 2 (154-162)
cugauccccccgagccuccagggcgug

SEQ ID NO: 45432 - RNA, 27 nt, Artificial Sequence
  Histone deacetylase 6 (119-127)
cugauccaggagggccuccuggaccgc

SEQ ID NO: 45433 - RNA, 27 nt, Artificial Sequence
  Membrane-bound transcription factor site-2 protease (165-173)
cugaucagcggcgugguccacgagauc

SEQ ID NO: 45434 - RNA, 24 nt, Artificial Sequence
  Asparagine synthetase (glutamine-hydrolyzing) (264-271)
cugaucagcaaguacauccgcaag

SEQ ID NO: 45435 - RNA, 33 nt, Artificial Sequence
  Histone H4 (19-29)
cugaucuacgaggagacccgcggcgugcucaag

SEQ ID NO: 45436 - RNA, 33 nt, Artificial Sequence
  Endoplasmic reticulum-Golgi intermediate compartment protein 3 (328-338)
cugaucuaccacagcgcccgcgccauccagaag

SEQ ID NO: 45437 - RNA, 30 nt, Artificial Sequence
  Zinc finger protein 638 (6-15)
cugaaggcccucaacagcaacuccaucuac

SEQ ID NO: 45438 - RNA, 24 nt, Artificial Sequence
  Protein FAM171B (21-28)
cugaaggcccgccucgugcccgcc

SEQ ID NO: 45439 - RNA, 33 nt, Artificial Sequence
  E3 ubiquitin-protein ligase UHRF1 (701-711)
cugaaggaccgccccgccagcggcuccccguuc

SEQ ID NO: 45440 - RNA, 21 nt, Artificial Sequence
  Putative RNA exonuclease NEF-sp (343-349)
cugaaguuccucgccaaggug

SEQ ID NO: 45441 - RNA, 39 nt, Artificial Sequence
  Triosephosphate isomerase (155-167)
cugaagcccgaguucguggacaucaucaacgccaagcag

SEQ ID NO: 45442 - RNA, 42 nt, Artificial Sequence
  Transmembrane protein 181 (194-207)
cugaagcccauccagauccucagcaacccgcuguccaccuac

SEQ ID NO: 45443 - RNA, 24 nt, Artificial Sequence
  Clathrin light chain A (223-230)
cugaagcaggccccccucgugcac

SEQ ID NO: 45444 - RNA, 24 nt, Artificial Sequence
  Eukaryotic translation initiation factor 4 gamma 1 (786-793)
cugaaggugcccaccaccgagaag

SEQ ID NO: 45445 - RNA, 30 nt, Artificial Sequence
  T-complex protein 1 subunit eta (12-21)
cugcucgccgccgaguuccugaagcaggug

SEQ ID NO: 45446 - RNA, 33 nt, Artificial Sequence
  E3 ubiquitin-protein ligase UBR4 (195-205)
cugcucgccgccggcagccagcuggacaccgug

SEQ ID NO: 45447 - RNA, 27 nt, Artificial Sequence
  Torsin-1B (16-24)
cugcucgccgcccgcguggucgcggcc

SEQ ID NO: 45448 - RNA, 27 nt, Artificial Sequence
  Vacuolar protein sorting-associated protein 18 homolog (338-346)
cugcucgccgaccgcguggaggccguc

SEQ ID NO: 45449 - RNA, 27 nt, Artificial Sequence
  Protein zyg-11 homolog B (139-147)
cugcucgccgacgugacccaccugcug

SEQ ID NO: 45450 - RNA, 27 nt, Artificial Sequence
  Tumor suppressor candidate 3 (48-56)
cugcucgccgagaagguggagcagcug

SEQ ID NO: 45451 - RNA, 36 nt, Artificial Sequence
  Sulfhydryl oxidase 1 (651-662)
cugcucgccgagagccgcgccgagaagaaccggcug

SEQ ID NO: 45452 - RNA, 33 nt, Artificial Sequence
  Poly (ADP-ribose) polymerase 10 (465-475)
cugcucgccggccugggggacguggcccugcuc

SEQ ID NO: 45453 - RNA, 27 nt, Artificial Sequence
  General transcription factor IIH subunit 3 (91-99)
cugcucgccggcagccuggccaaggcg

SEQ ID NO: 45454 - RNA, 27 nt, Artificial Sequence
  E3 ubiquitin-protein ligase MARCH6 (678-686)
cugcucgccggcguggucccccugcug

SEQ ID NO: 45455 - RNA, 30 nt, Artificial Sequence
  DNA-directed RNA polymerases I, II, and III subunit RPABC5 (49-58)
cugcucgcccacguggaccugaucgagaag

SEQ ID NO: 45456 - RNA, 75 nt, Artificial Sequence
  RWD domain-containing protein 1 (86-110)
cugcucgcccugcaggccgaggagaaccugggcauggugaugaucuucacccucgucaccgcggugcaggagaag

SEQ ID NO: 45457 - RNA, 27 nt, Artificial Sequence
  N-terminal kinase-like protein (58-66)
cugcucgcccccaagcugaacgaggcc

SEQ ID NO: 45458 - RNA, 27 nt, Artificial Sequence
  Actin-binding protein anillin (610-618)
cugcucgccccccuggcccagaccgug

SEQ ID NO: 45459 - RNA, 27 nt, Artificial Sequence
  Transmembrane and coiled-coil domain-containing protein 3 (411-419)
cugcucgcccccgugcuguggcgcgcc

SEQ ID NO: 45460 - RNA, 24 nt, Artificial Sequence
  Receptor-interacting serine/threonine-protein kinase 4 (150-157)
cugcucgacgcccacuaccacgug

SEQ ID NO: 45461 - RNA, 27 nt, Artificial Sequence
  Brefeldin A-inhibited guanine nucleotide-exchange protein 1 (1477-1485)
cugcucgacgacaucuucgcccagcug

SEQ ID NO: 45462 - RNA, 33 nt, Artificial Sequence
  ETS translocation variant 1 (241-251)
cugcucgacgaccccagcaacucccacuucauc

SEQ ID NO: 45463 - RNA, 30 nt, Artificial Sequence
  Contactin-associated protein-like 4 (266-275)
cugcucgacgaccagcacuggcacagcgug

SEQ ID NO: 45464 - RNA, 27 nt, Artificial Sequence
  Protein FAM179B (402-410)
cugcucgacgacagcaacuucaaggug

SEQ ID NO: 45465 - RNA, 24 nt, Artificial Sequence
  von Willebrand factor A domain-containing protein 8 (512-519)
cugcucgacggcauccaccgcgug

SEQ ID NO: 45466 - RNA, 27 nt, Artificial Sequence
  Leucine-rich repeat-containing protein 40 (571-579)
cugcucgacggcaaccccuuccgcgug

SEQ ID NO: 45467 - RNA, 24 nt, Artificial Sequence
  Uridine-cytidine kinase-like 1 (454-461)
cugcucgaccacgacgugcccgag

SEQ ID NO: 45468 - RNA, 27 nt, Artificial Sequence
  Armadillo repeat protein deleted in velo-cardio-facial syndrome (408-416)
cugcucgaccacccccgcgccgaggug

SEQ ID NO: 45469 - RNA, 27 nt, Artificial Sequence
  Integrator complex subunit 8 (617-625)
cugcucgacauccacacccacgaggcc

SEQ ID NO: 45470 - RNA, 27 nt, Artificial Sequence
  RNA-binding protein 20 (68-76)
cugcucgacaagaaccccuucagcgug

SEQ ID NO: 45471 - RNA, 24 nt, Artificial Sequence
  Small subunit processome component 20 homolog (300-307)
cugcucgaccugcacaccaaggug

SEQ ID NO: 45472 - RNA, 27 nt, Artificial Sequence
  AP-1 complex subunit beta-1 (395-403)
cugcucgaccugauccagaccaaggug

SEQ ID NO: 45473 - RNA, 27 nt, Artificial Sequence
  ERI1 exoribonuclease 3 (155-163)
cugcucgaccccaacgugaagagcauc

SEQ ID NO: 45474 - RNA, 30 nt, Artificial Sequence
  DDB1- and CUL4-associated factor 16 (80-89)
cugcucgaccccagcaccccggugcacauc

SEQ ID NO: 45475 - RNA, 24 nt, Artificial Sequence
  Coiled-coil domain-containing protein 180 (707-714)
cugcucgaccagcugcgccagcag

SEQ ID NO: 45476 - RNA, 21 nt, Artificial Sequence
  Protein Bop (113-119)
cugcucgaccgcuuccuggcc

SEQ ID NO: 45477 - RNA, 24 nt, Artificial Sequence
  Nuclear pore complex protein Nup205 (319-326)
cugcucgaccgcaucgugagcguc

SEQ ID NO: 45478 - RNA, 30 nt, Artificial Sequence
  Plexin-B3 (450-459)
cugcucgacagcuccggcagccaccuguac

SEQ ID NO: 45479 - RNA, 27 nt, Artificial Sequence
  Protein PML (195-203)
cugcucgacagcucccacagcgagcug

SEQ ID NO: 45480 - RNA, 33 nt, Artificial Sequence
  Asparagine synthetase (glutamine-hydrolyzing) (42-52)
cugcucgacaccgccaacaagaagguguuccug

SEQ ID NO: 45481 - RNA, 24 nt, Artificial Sequence
  Myosin-10 (265-272)
cugcucgagaagagccgcgccgug

SEQ ID NO: 45482 - RNA, 30 nt, Artificial Sequence
  Serine/threonine-protein kinase Kist (127-136)
cugcucgagauguucagcggcaugaagcug

SEQ ID NO: 45483 - RNA, 30 nt, Artificial Sequence
  Serine/threonine-protein kinase MRCK gamma (979-988)
cugcucuucgacgcccccgaccugcgccug

SEQ ID NO: 45484 - RNA, 27 nt, Artificial Sequence
  Cartilage-associated protein (322-330)
cugcucuucgaccagaacgacaaggug

SEQ ID NO: 45485 - RNA, 39 nt, Artificial Sequence
  Protein wntless homolog (297-309)
cugcucuucggcgacauccgccaggggaucuucuacgcc

SEQ ID NO: 45486 - RNA, 27 nt, Artificial Sequence
  Cytoplasmic dynein 2 heavy chain 1 (138-146)
cugcucuucggcgaccugcugcgcgug

SEQ ID NO: 45487 - RNA, 30 nt, Artificial Sequence
  Protein YIF1B (224-233)
cugcucuucggcaagaucggguacuaccug

SEQ ID NO: 45488 - RNA, 27 nt, Artificial Sequence
  Probable palmitoyltransferase ZDHHC24 (214-222)
cugcucuuccacggcaugcugcugcuc

SEQ ID NO: 45489 - RNA, 27 nt, Artificial Sequence
  Kelch-like protein 5 (518-526)
cugcucggcgacaagcuguacgccgug

SEQ ID NO: 45490 - RNA, 27 nt, Artificial Sequence
  E3 ubiquitin-protein ligase RNF213 (957-965)
cugcucggcgacauggaguggcgccug

SEQ ID NO: 45491 - RNA, 24 nt, Artificial Sequence
  Receptor-type tyrosine-protein phosphatase T (1084-1091)
cugcucggcuucgugcgccagguc

SEQ ID NO: 45492 - RNA, 33 nt, Artificial Sequence
  Neurosecretory protein VGF (286-296)
cugcucggcgggagcgaggccggcgagcgccug

SEQ ID NO: 45493 - RNA, 24 nt, Artificial Sequence
  MAU2 chromatid cohesion factor homolog (357-364)
cugcucggccacaucuucuacgug

SEQ ID NO: 45494 - RNA, 24 nt, Artificial Sequence
  Polypeptide N-acetylgalactosaminyltransferase 2 (186-193)
cugcucggcaagaucgagaaggug

SEQ ID NO: 45495 - RNA, 24 nt, Artificial Sequence
  Spectrin alpha chain, non-erythrocytic 1 (418-425)
cugcucggcagcgcccacgaggug

SEQ ID NO: 45496 - RNA, 30 nt, Artificial Sequence
  Zinc finger X-linked protein ZXDA (257-266)
cugcucggcagcgggcccggcgugguccug

SEQ ID NO: 45497 - RNA, 30 nt, Artificial Sequence
  CUB and sushi domain-containing protein 1 (2833-2842)
cugcucggcagcuccgcccugaccugcaug

SEQ ID NO: 45498 - RNA, 27 nt, Artificial Sequence
  Protein virilizer homolog (786-794)
cugcucggcacccugcacaaccuguac

SEQ ID NO: 45499 - RNA, 27 nt, Artificial Sequence
  Zinc transporter ZIP1 (215-223)
cugcuccacaagggcauccuggccgug

SEQ ID NO: 45500 - RNA, 33 nt, Artificial Sequence
  Catenin beta-1 (263-273)
cugcuccaccaggagggcgccaagauggccgug

SEQ ID NO: 45501 - RNA, 27 nt, Artificial Sequence
  Actin-binding protein anillin (773-781)
cugcucaucgacgagcugaacaagcug

SEQ ID NO: 45502 - RNA, 48 nt, Artificial Sequence
  Tastin (465-480)
cugcucaucggccuggccguggggggcgggggcggggaggacagcacc

SEQ ID NO: 45503 - RNA, 27 nt, Artificial Sequence
  Mitochondrial dynamics protein MID49 (418-426)
cugcucaucggcagccuggagcaggcc

SEQ ID NO: 45504 - RNA, 75 nt, Artificial Sequence
  Vimentin (276-300)
cugcucaucaagaccguggagacccgcgacggccaggucaucaacgagacgagccagcaccacgacgaccuggag

SEQ ID NO: 45505 - RNA, 27 nt, Artificial Sequence
  Histone deacetylase 9 (93-101)
cugcucauccagcagcagcagcagauc

SEQ ID NO: 45506 - RNA, 30 nt, Artificial Sequence
  Dolichyl-diphosphooligosaccharide-proteinosyltransferase 48 kDa subunit (180-189)
cugcucaaggcccccaccaucgugggcaag

SEQ ID NO: 45507 - RNA, 27 nt, Artificial Sequence
  Protein FAM171B (20-28)
cugcucaaggcccgccuggugcccgcc

SEQ ID NO: 45508 - RNA, 24 nt, Artificial Sequence
  Melanoma-associated antigen 10 (311-318)
cugcucaaguuccuggccaaggug

SEQ ID NO: 45509 - RNA, 27 nt, Artificial Sequence
  Protein TANC1 (360-368)
cugcucaagccccugcuguucgaggug

SEQ ID NO: 45510 - RNA, 24 nt, Artificial Sequence
  Asparagine synthetase (glutamine-hydrolyzing) (187-194)
cugcucaagcagcugaaggaggcc

SEQ ID NO: 45511 - RNA, 33 nt, Artificial Sequence
  Transmembrane protein 132B (372-382)
cugcucaagagcggcgggcccgacgccuucacc

SEQ ID NO: 45512 - RNA, 39 nt, Artificial Sequence
  BAH and coiled-coil domain-containing protein 1 (636-648)
cugcucaaguacagcucccaggcccugguggucggccag

SEQ ID NO: 45513 - RNA, 30 nt, Artificial Sequence
  Procollagen-lysine,2-oxoglutarate 5-dioxygenase 3 (319-328)
cugcuccuggacuaccccccggaccgcgug

SEQ ID NO: 45514 - RNA, 36 nt, Artificial Sequence
  Procollagen-lysine,2-oxoglutarate 5-dioxygenase 3 (319-330)
cugcuccuggacuaccccccggaccgcgugacccug

SEQ ID NO: 45515 - RNA, 24 nt, Artificial Sequence
  Mediator of RNA polymerase II transcription subunit 12 (988-995)
cugcuccuggaggaccugauccgc

SEQ ID NO: 45516 - RNA, 27 nt, Artificial Sequence
  Mediator of RNA polymerase II transcription subunit 12 (988-996)
cugcuccuggaggaccugauccgcugc

SEQ ID NO: 45517 - RNA, 27 nt, Artificial Sequence
  Myosin phosphatase Rho-interacting protein (997-1005)
cugcuccuggagaagacccaggagcug

SEQ ID NO: 45518 - RNA, 63 nt, Artificial Sequence
  Fatty acid synthase (81-101)
cugcuccuggaggugaccuacgaggccaucgucgacggcgggaucaaccccgacagccugcgc

SEQ ID NO: 45519 - RNA, 45 nt, Artificial Sequence
  Ephrin type-B receptor 3 (28-42)
cugcuccugcugcccgccggcugccgcgcccucgaggagacccug

SEQ ID NO: 45520 - RNA, 27 nt, Artificial Sequence
  TBC1 domain family member 9 (215-223)
cugcuccugcccgacgugaucaagguc

SEQ ID NO: 45521 - RNA, 27 nt, Artificial Sequence
  Lysosomal thioesterase PPT2 (16-24)
cugcuccugcccuuccugccgcuccug

SEQ ID NO: 45522 - RNA, 27 nt, Artificial Sequence
  Tartrate-resistant acid phosphatase type 5 (13-21)
cugcuccugcccagccuggccgacggc

SEQ ID NO: 45523 - RNA, 27 nt, Artificial Sequence
  Cathepsin K (7-15)
cugcuccugcccguggucagcuucgcc

SEQ ID NO: 45524 - RNA, 27 nt, Artificial Sequence
  4F2 cell-surface antigen heavy chain (521-529)
cugcuccugcgcuuccccuacgccgcc

SEQ ID NO: 45525 - RNA, 33 nt, Artificial Sequence
  Glypican-6 (15-25)
cugcuccugagccugcccgccggcgccgacgug

SEQ ID NO: 45526 - RNA, 33 nt, Artificial Sequence
  Tyrosinase (514-524)
cugcucauggagaaggaggacuaccacagccug

SEQ ID NO: 45527 - RNA, 27 nt, Artificial Sequence
  Glutamine-tRNA ligase (137-145)
cugcucaugggcgaggcccgcgccgug

SEQ ID NO: 45528 - RNA, 27 nt, Artificial Sequence
  Nucleolar protein 11 (405-413)
cugcucaacgccauccugcacagcgcc

SEQ ID NO: 45529 - RNA, 33 nt, Artificial Sequence
  Eukaryotic translation initiation factor 4 gamma 1 (363-373)
cugcucaacggcgcccccagcccgcccgccgug

SEQ ID NO: 45530 - RNA, 27 nt, Artificial Sequence
  Plexin-B3 (1376-1384)
cugcucaacagcaagcuguuccugcuc

SEQ ID NO: 45531 - RNA, 27 nt, Artificial Sequence
  E3 ubiquitin-protein ligase CBL (87-95)
cugcuccccgacaccuaccagcaccug

SEQ ID NO: 45532 - RNA, 27 nt, Artificial Sequence
  F-box only protein 46 (301-309)
cugcuccccgagcacgugcuggucaag

SEQ ID NO: 45533 - RNA, 33 nt, Artificial Sequence
  Fibronectin isoform 6 (1328-1338)
cugcuccccggcaccgaguacguggucagcgug

SEQ ID NO: 45534 - RNA, 27 nt, Artificial Sequence
  Fibronectin type III domain-containing protein 3B (282-290)
cugcuccccggcaccguguaccgcuuc

SEQ ID NO: 45535 - RNA, 27 nt, Artificial Sequence
  Transportin-2 (391-399)
cugcucccccaccugcugccgcuccug

SEQ ID NO: 45536 - RNA, 27 nt, Artificial Sequence
  Atlastin-3 (264-272)
cugcucccccacccgggccugcaggug

SEQ ID NO: 45537 - RNA, 27 nt, Artificial Sequence
  Probable E3 SUMO-protein ligase RNF212 (145-153)
cugcuccccccgcacagcuccgccccc

SEQ ID NO: 45538 - RNA, 27 nt, Artificial Sequence
  Matrix metalloproteinase-17 (588-596)
cugcuccccccgcugagccccggcgcc

SEQ ID NO: 45539 - RNA, 27 nt, Artificial Sequence
  Astrotactin-2 (41-49)
cugcuccccccgcccccccugcuggcc

SEQ ID NO: 45540 - RNA, 27 nt, Artificial Sequence
  Serine/threonine-protein kinase 32A (347-355)
cugcuccaggagcaccuggacagcgug

SEQ ID NO: 45541 - RNA, 42 nt, Artificial Sequence
  Adhesion G-protein coupled receptor F3 (210-223)
cugcuccagcccggcacccaggugagcgucaccuccagccac

SEQ ID NO: 45542 - RNA, 30 nt, Artificial Sequence
  Interleukin-24 (91-100)
cugcuccagcaggaggugcugcagaacguc

SEQ ID NO: 45543 - RNA, 27 nt, Artificial Sequence
  Oxysterol-binding protein-related protein 10 (231-239)
cugcuccagcagagcgugcaccaggcc

SEQ ID NO: 45544 - RNA, 27 nt, Artificial Sequence
  Nodal modulator 3 (688-696)
cugcuccgcgacggcgagaacuacgug

SEQ ID NO: 45545 - RNA, 21 nt, Artificial Sequence
  Serine/threonine-protein phosphatase PP1-beta catalytic subunit (71-77)
cugcuccgccuguucgaguac

SEQ ID NO: 45546 - RNA, 27 nt, Artificial Sequence
  Sorting nexin-10 (27-35)
cugcucagcgacuccagccugcaccug

SEQ ID NO: 45547 - RNA, 27 nt, Artificial Sequence
  Brefeldin A-inhibited guanine nucleotide-exchange protein 2 (1424-1432)
cugcucagcgacguguucgcccagcug

SEQ ID NO: 45548 - RNA, 27 nt, Artificial Sequence
  BTB/POZ domain-containing protein 1 (67-75)
cugcucagcgacgugcgcuucguccug

SEQ ID NO: 45549 - RNA, 27 nt, Artificial Sequence
  Spermatogenesis-associated protein 20 (129-137)
cugcucagcgaggacuucguguccguc

SEQ ID NO: 45550 - RNA, 27 nt, Artificial Sequence
  Mediator of RNA polymerase II transcription subunit 13 (188-196)
cugcucagcgaggagcacaucacccug

SEQ ID NO: 45551 - RNA, 27 nt, Artificial Sequence
  Synemin (707-715)
cugcucagcaaggacaucaaggaggug

SEQ ID NO: 45552 - RNA, 36 nt, Artificial Sequence
  Plexin-B3 (33-44)
cugcucagccccccgccccugccccugaccggcgcc

SEQ ID NO: 45553 - RNA, 27 nt, Artificial Sequence
  Nuclear pore complex protein Nup88 (115-123)
cugcucagccccacccagcaccacgug

SEQ ID NO: 45554 - RNA, 27 nt, Artificial Sequence
  Fanconi anemia group D2 protein (1110-1118)
cugcucagccaguccgugcacuaccug

SEQ ID NO: 45555 - RNA, 24 nt, Artificial Sequence
  Regulatory-associated protein of mTOR (224-231)
cugcucagccaggugcaccgccug

SEQ ID NO: 45556 - RNA, 30 nt, Artificial Sequence
  Muskelin (78-87)
cugcucagcuccggccugaagaacgacuac

SEQ ID NO: 45557 - RNA, 24 nt, Artificial Sequence
  Ras GTPase-activating-like protein IQGAP2 (416-423)
cugcucagcgugaagcuggagguc

SEQ ID NO: 45558 - RNA, 27 nt, Artificial Sequence
  Mediator of RNA polymerase II transcription subunit 13 (1410-1418)
cugcucaccgacggcaucaugcgcgug

SEQ ID NO: 45559 - RNA, 27 nt, Artificial Sequence
  T-complex protein 1 subunit zeta-2 (471-479)
cugcucguggacgagaucaugcgcgcc

SEQ ID NO: 45560 - RNA, 33 nt, Artificial Sequence
  Nuclear factor of activated T-cells, cytoplasmic 2 (115-125)
cugcucguggagcagcccccgcuggccggcguc

SEQ ID NO: 45561 - RNA, 33 nt, Artificial Sequence
  Ankyrin repeat and KH domain-containing protein 1 (1008-1018)
cugcucgugcaggagcccgacggccugaugguc

SEQ ID NO: 45562 - RNA, 27 nt, Artificial Sequence
  Structure-specific endonuclease subunit SLX1 (242-250)
cugcucuggggcgaccugaucuggcug

SEQ ID NO: 45563 - RNA, 27 nt, Artificial Sequence
  Interleukin-24 (41-49)
cugcucuggagccagguguccggcgcc

SEQ ID NO: 45564 - RNA, 33 nt, Artificial Sequence
  Interleukin-24 (41-51)
cugcucuggagccagguguccggcgcccagggg

SEQ ID NO: 45565 - RNA, 27 nt, Artificial Sequence
  Glutamate receptor ionotropic, kainate 3 (325-333)
cugcucuacgacgccgugcacaucguc

SEQ ID NO: 45566 - RNA, 33 nt, Artificial Sequence
  AT-rich interactive domain-containing protein 1A (1336-1346)
cugcucuacgacgacaacagcaucaugaccuuc

SEQ ID NO: 45567 - RNA, 30 nt, Artificial Sequence
  Intron-binding protein aquarius (152-161)
cugcucuacgacuuccagcugaucaacgug

SEQ ID NO: 45568 - RNA, 27 nt, Artificial Sequence
  Nicastrin (501-509)
cugcucuacggcuuccugaucaaggcc

SEQ ID NO: 45569 - RNA, 30 nt, Artificial Sequence
  Adenosine 3'-phospho 5'-phosphosulfate transporter 1 (251-260)
cugcucuacggccacaccgugaccgucgug

SEQ ID NO: 45570 - RNA, 30 nt, Artificial Sequence
  DNA-dependent protein kinase catalytic subunit (421-430)
cugcucuaccuggacaccgugcccgagguc

SEQ ID NO: 45571 - RNA, 27 nt, Artificial Sequence
  Unconventional myosin-Ib (533-541)
cugcucuaccgcgaccugagccaggcc

SEQ ID NO: 45572 - RNA, 27 nt, Artificial Sequence
  Nuclear pore complex protein Nup85 (266-274)
cugcucuacagcaaccccaccgugaag

SEQ ID NO: 45573 - RNA, 30 nt, Artificial Sequence
  Microtubule-actin cross-linking factor 1, isoforms 1/2/3/5 (794-803)
cugauggacgagaagcuccugcacaacgug

SEQ ID NO: 45574 - RNA, 30 nt, Artificial Sequence
  Tyrosinase (515-524)
cugauggagaaggaggacuaccacagccuc

SEQ ID NO: 45575 - RNA, 33 nt, Artificial Sequence
  Tyrosinase (515-525)
cugauggagaaggaggacuaccacagccucuac

SEQ ID NO: 45576 - RNA, 24 nt, Artificial Sequence
  Leucine-tRNA ligase, cytoplasmic (211-218)
cugauggaggugacccacgaccuc

SEQ ID NO: 45577 - RNA, 24 nt, Artificial Sequence
  Dynein light chain roadblock-type 1 (52-59)
cugaugcacagcuucauccucaag

SEQ ID NO: 45578 - RNA, 30 nt, Artificial Sequence
  T-complex protein 1 subunit beta (159-168)
cugaugaacaucgccggcaccacccucagc

SEQ ID NO: 45579 - RNA, 24 nt, Artificial Sequence
  Phosphatidylinositol 5-phosphate 4-kinase type-2 beta (66-73)
cugaugcccgacgacuucaaggcc

SEQ ID NO: 45580 - RNA, 27 nt, Artificial Sequence
  Folliculin-interacting protein 1 (804-812)
cugaugagcgaccucucccacgccgug

SEQ ID NO: 45581 - RNA, 27 nt, Artificial Sequence
  Constitutive coactivator of PPAR-gamma-like protein 2 (619-627)
cugauguaccccuacaucuaccacgug

SEQ ID NO: 45582 - RNA, 27 nt, Artificial Sequence
  Sodium channel protein type 5 subunit alpha (1513-1521)
cugaacaaguaccagggcuucaucuuc

SEQ ID NO: 45583 - RNA, 18 nt, Artificial Sequence
  Heterogeneous nuclear ribonucleoprotein K (133-138)
cugaacuaccagcacuac

SEQ ID NO: 45584 - RNA, 24 nt, Artificial Sequence
  Tropomodulin-2 (46-53)
cugcccgccggcuuccgccagaag

SEQ ID NO: 45585 - RNA, 21 nt, Artificial Sequence
  Probable ATP-dependent RNA helicase DDX5 (150-156)
cugcccgccaucgugcacauc

SEQ ID NO: 45586 - RNA, 33 nt, Artificial Sequence
  Basement membrane-specific heparan sulfate proteoglycan core protein (1907-1917)
cugcccgccaaggcccagauccacggcgggauc

SEQ ID NO: 45587 - RNA, 24 nt, Artificial Sequence
  UV excision repair protein RAD23 homolog B (278-285)
cugcccgcccuccugcagcagauc

SEQ ID NO: 45588 - RNA, 27 nt, Artificial Sequence
  Potassium/sodium hyperpolarization-activated cyclic nucleotide-gated channel 3 (671-679)
cugcccgccccgcccgcccgcacccuc

SEQ ID NO: 45589 - RNA, 30 nt, Artificial Sequence
  AT-hook-containing transcription factor (393-402)
cugcccgccccgagcggccaggcccccaug

SEQ ID NO: 45590 - RNA, 30 nt, Artificial Sequence
  Lysosome-associated membraneoprotein 1 (249-258)
cugcccgacgcccgcgacccggccuucaag

SEQ ID NO: 45591 - RNA, 48 nt, Artificial Sequence
  Legumain (198-213)
cugcccgacaacaucaacguguacgccaccaccgccgcgaacccgcgc

SEQ ID NO: 45592 - RNA, 24 nt, Artificial Sequence
  Serine/threonine-protein kinase ULK3 (109-116)
cugcccgagaagguggcccgcguc

SEQ ID NO: 45593 - RNA, 24 nt, Artificial Sequence
  Solute carrier family 23 member 2 (603-610)
cugcccuucggcaugaacaucauc

SEQ ID NO: 45594 - RNA, 36 nt, Artificial Sequence
  Retinoic acid receptor RXR-beta (168-179)
cugcccggcgggggcagcgggccgcccgaggacgug

SEQ ID NO: 45595 - RNA, 45 nt, Artificial Sequence
  Mucin-19 (5182-5196)
cugcccggcgugagcgccgggcucaccggcaccaucggguccccg

SEQ ID NO: 45596 - RNA, 27 nt, Artificial Sequence
  (Pyruvate dehydrogenase (acetyl-transferring))-phosphatase 1, mitochondrial (168-176)
cugccccacgagacccuccuggagauc

SEQ ID NO: 45597 - RNA, 24 nt, Artificial Sequence
  Transportin-1 (395-402)
cugccccacauccucccgcugcug

SEQ ID NO: 45598 - RNA, 27 nt, Artificial Sequence
  Phosphatidylcholine translocator ABCB4 (1167-1175)
cugccccacaaguacgagacccgcgug

SEQ ID NO: 45599 - RNA, 27 nt, Artificial Sequence
  HMG domain-containing protein 3 (213-221)
cugccccaccucccgcagagcgagauc

SEQ ID NO: 45600 - RNA, 27 nt, Artificial Sequence
  Low-density lipoprotein receptor-related protein 2 (704-712)
cugccccacccguucgccaucaccauc

SEQ ID NO: 45601 - RNA, 24 nt, Artificial Sequence
  Melanophilin (392-399)
cugcccaucuuccucccgcgcgug

SEQ ID NO: 45602 - RNA, 45 nt, Artificial Sequence
  Collagen alpha-1(I) chain (1013-1027)
cugcccaucaucgacguggccccgcucgacgucggcgcccccgac

SEQ ID NO: 45603 - RNA, 27 nt, Artificial Sequence
  Coatomer subunit gamma-1 (712-720)
cugcccaaggaggacccgaccgccgug

SEQ ID NO: 45604 - RNA, 27 nt, Artificial Sequence
  Tight junction protein ZO-1 (478-486)
cugcccaagggcgaggaggugaccauc

SEQ ID NO: 45605 - RNA, 24 nt, Artificial Sequence
  40S ribosomal protein S26 (64-71)
cugcccaagcucuacgugaagcug

SEQ ID NO: 45606 - RNA, 27 nt, Artificial Sequence
  Interferon alpha-inducible protein 27, mitochondrial (28-36)
cugccccucgcccgcaucgccaccgug

SEQ ID NO: 45607 - RNA, 27 nt, Artificial Sequence
  Receptor tyrosine-protein kinase erbB-3 (97-105)
cugccccucccgaaccugcgcgugguc

SEQ ID NO: 45608 - RNA, 27 nt, Artificial Sequence
  Ubiquitin domain-containing protein UBFD1 (251-259)
cugcccaugggcagcaucaagaacgug

SEQ ID NO: 45609 - RNA, 27 nt, Artificial Sequence
  Ras-related protein Rab-38 (114-122)
cugcccaacggcaagccggugagcguc

SEQ ID NO: 45610 - RNA, 27 nt, Artificial Sequence
  Transcriptional regulator Kaiso (298-306)
cugcccaaccacaugccgagcuccauc

SEQ ID NO: 45611 - RNA, 27 nt, Artificial Sequence
  Bromodomain-containing protein 4 (958-966)
cugcccccgcccccccaccccagcgug

SEQ ID NO: 45612 - RNA, 27 nt, Artificial Sequence
  Shootin-1 (302-310)
cugcccccgcccccccccaacccgauc

SEQ ID NO: 45613 - RNA, 24 nt, Artificial Sequence
  Nicotinamide phosphoribosyltransferase (344-351)
cugcccccguaccuccgcgugauc

SEQ ID NO: 45614 - RNA, 27 nt, Artificial Sequence
  Kinase D-interacting substrate of 220 kDa (104-112)
cugccccgcgaccagaacaacggccuc

SEQ ID NO: 45615 - RNA, 27 nt, Artificial Sequence
  Cap-specific mRNAucleoside-2'-O-)-methyltransferase 1 (631-639)
cugccccgcgacacccuccugagcgug

SEQ ID NO: 45616 - RNA, 30 nt, Artificial Sequence
  Serine/threonine-protein kinase 32A (171-180)
cugccccgcgagacccagaucaccacgaug

SEQ ID NO: 45617 - RNA, 30 nt, Artificial Sequence
  Ubiquitin-associated protein 1 (236-245)
cugccccgcggcgggagcggcuccgugcuc

SEQ ID NO: 45618 - RNA, 27 nt, Artificial Sequence
  Intercellular adhesion molecule 1 (16-24)
cugccccgcggcgggagcgugcucguc

SEQ ID NO: 45619 - RNA, 27 nt, Artificial Sequence
  Ropporin-1B (153-161)
cugccccgcaucccguucagcaccuuc

SEQ ID NO: 45620 - RNA, 27 nt, Artificial Sequence
  LIM domain and actin-binding protein 1 (161-169)
cugccccgccucagcgagaccuccauc

SEQ ID NO: 45621 - RNA, 27 nt, Artificial Sequence
  Apolipoprotein L1 (85-93)
cugccccgcaacgaggccgacgagcuc

SEQ ID NO: 45622 - RNA, 27 nt, Artificial Sequence
  E3 ubiquitin-protein ligase TRIP12 (518-526)
cugccccgcagcuccgccguggucgug

SEQ ID NO: 45623 - RNA, 27 nt, Artificial Sequence
  Periaxin (1315-1323)
cugccccgcgugggccucgccgccccg

SEQ ID NO: 45624 - RNA, 24 nt, Artificial Sequence
  SET domain-containing protein 5 (1382-1389)
cugcccagcgaccuccgcaccauc

SEQ ID NO: 45625 - RNA, 48 nt, Artificial Sequence
  Cathepsin F (337-352)
cugcccagcaacgccuacuccgccaucaagaaccucggcgggcuggag

SEQ ID NO: 45626 - RNA, 27 nt, Artificial Sequence
  Ropporin-1B (99-107)
cugcccaccgaccucuucaacagcgug

SEQ ID NO: 45627 - RNA, 24 nt, Artificial Sequence
  AP-5 complex subunit zeta-1 (154-161)
cugcccgugauggccaaggucgug

SEQ ID NO: 45628 - RNA, 24 nt, Artificial Sequence
  Rho guanine nucleotide exchange factor 2 (884-891)
cugcccgugaccacccgcagcguc

SEQ ID NO: 45629 - RNA, 24 nt, Artificial Sequence
  Protein O-mannosyl-transferase 1 (538-545)
cugcccgugguccuccagcacauc

SEQ ID NO: 45630 - RNA, 27 nt, Artificial Sequence
  Histone-lysine N-methyltransferase 2A (1096-1104)
cugcccugggaggagcgcgagaagauc

SEQ ID NO: 45631 - RNA, 27 nt, Artificial Sequence
  Lathosterol oxidase (84-92)
cugcccuggaucagcauccucaccgug

SEQ ID NO: 45632 - RNA, 27 nt, Artificial Sequence
  Metallophosphoesterase MPPED2 (106-114)
cugcccuacgaguacaagaucgugauc

SEQ ID NO: 45633 - RNA, 24 nt, Artificial Sequence
  Glia-derived nexin (256-263)
cugcccuaccacggcgagagcauc

SEQ ID NO: 45634 - RNA, 30 nt, Artificial Sequence
  Glia-derived nexin (256-265)
cugcccuaccacggcgagagcaucuccaug

SEQ ID NO: 45635 - RNA, 24 nt, Artificial Sequence
  Neurofibromin (488-495)
cugcccuaccucuuccacgugguc

SEQ ID NO: 45636 - RNA, 30 nt, Artificial Sequence
  NAD-dependent protein deacetylase sirtuin-2 (95-104)
cugcccuacccggaggccaucuucgagauc

SEQ ID NO: 45637 - RNA, 30 nt, Artificial Sequence
  NAD-dependent protein deacetylase sirtuin-3, mitochondrial (173-182)
cugcccuacccggaggccaucuucgagcuc

SEQ ID NO: 45638 - RNA, 27 nt, Artificial Sequence
  CDK5 and ABL1 enzyme substrate 1 (27-35)
cugcccuaccgcgacagcacccaggug

SEQ ID NO: 45639 - RNA, 24 nt, Artificial Sequence
  Serpin B6 (104-111)
cugcccuacgugggcaaggagcuc

SEQ ID NO: 45640 - RNA, 33 nt, Artificial Sequence
  Guanine nucleotide exchange factor VAV3 (680-690)
cugcaggccgagaccgagcucaucaaccgcgug

SEQ ID NO: 45641 - RNA, 27 nt, Artificial Sequence
  Peroxisome proliferator-activated receptor gamma coactivator-related protein 1 (1097-1105)
cugcaggcccccgagcucgccaacgug

SEQ ID NO: 45642 - RNA, 36 nt, Artificial Sequence
  Zinc finger homeobox protein 2 (544-555)
cugcagggcuuccaggccgggcccggcgggcagggc

SEQ ID NO: 45643 - RNA, 48 nt, Artificial Sequence
  Proline-rich transmembrane protein 3 (172-187)
cugcagcacgagggccaggaggggcaguggcccccgcgcgacgagggc

SEQ ID NO: 45644 - RNA, 72 nt, Artificial Sequence
  Plectin (387-410)
cugcagauggaggccggccucugcgaggagcagcugaaccaggccgacgcgcugcuccagagcgacgugcgc

SEQ ID NO: 45645 - RNA, 33 nt, Artificial Sequence
  T-complex protein 1 subunit gamma (268-278)
cugcagauggaggaggaguacauccagcagcuc

SEQ ID NO: 45646 - RNA, 42 nt, Artificial Sequence
  Glyceraldehyde-3-phosphate dehydrogenase (203-216)
cugcagaacaucauccccgccagcaccggcgccgcgaaggcc

SEQ ID NO: 45647 - RNA, 27 nt, Artificial Sequence
  Ubiquitin carboxyl-terminal hydrolase 22 (305-313)
cugcagagcgacgugaccugccagguc

SEQ ID NO: 45648 - RNA, 24 nt, Artificial Sequence
  Titin (123-130)
cugcaggugcgcgucaccggcauc

SEQ ID NO: 45649 - RNA, 54 nt, Artificial Sequence
  Collagen alpha-1(VI) chain (694-711)
cugcaguggauggccggcgggaccuucaccggcgaggcccuccaguacacgcgc

SEQ ID NO: 45650 - RNA, 24 nt, Artificial Sequence
  Interferon regulatory factor 2-binding protein 1 (301-308)
cugcgcgagcccggcaaggcccuc

SEQ ID NO: 45651 - RNA, 33 nt, Artificial Sequence
  Disintegrin and metalloproteinase domain-containing protein 10 (60-70)
cugcgccucgacuuccacgcccacggccggcac

SEQ ID NO: 45652 - RNA, 30 nt, Artificial Sequence
  Keratin, type I cytoskeletal 10 (294-303)
cugcgcaacgugagcaccggcgacgucaac

SEQ ID NO: 45653 - RNA, 33 nt, Artificial Sequence
  Casein kinase II subunit alpha (305-315)
cugcgcuacgaccaccagagccggcucaccgcc

SEQ ID NO: 45654 - RNA, 39 nt, Artificial Sequence
  SKI family transcriptional corepressor 2 (329-341)
cugagcgccgccgcggccucccucagcguggccgccgcc

SEQ ID NO: 45655 - RNA, 27 nt, Artificial Sequence
  DNA-binding protein RFX7 (64-72)
cugagcgccgccgacuucggcaagauc

SEQ ID NO: 45656 - RNA, 57 nt, Artificial Sequence
  Heterogeneous nuclear ribonucleoprotein U (186-204)
cugagcgccuccagccucaccauggaguccuucgccuuccugugggcgggcgggcgc

SEQ ID NO: 45657 - RNA, 27 nt, Artificial Sequence
  Unconventional myosin-Ib (87-95)
cugagcgacgaggccuaccgcucccuc

SEQ ID NO: 45658 - RNA, 27 nt, Artificial Sequence
  Leucine-tRNA ligase, cytoplasmic (166-174)
cugagcgacgaggagaucgugaaguuc

SEQ ID NO: 45659 - RNA, 27 nt, Artificial Sequence
  1-phosphatidylinositol 4,5-bisphosphate phosphodiesterase beta-4 (725-733)
cugagcgacaagaagaucggcaccuac

SEQ ID NO: 45660 - RNA, 27 nt, Artificial Sequence
  CCAAT/enhancer-binding protein beta (118-126)
cugagcgaccucuucuccgacgacuac

SEQ ID NO: 45661 - RNA, 27 nt, Artificial Sequence
  Ras association domain-containing protein 3 (88-96)
cugagcgaccgcgagcacccccucuac

SEQ ID NO: 45662 - RNA, 27 nt, Artificial Sequence
  Plexin-D1 (920-928)
cugagcgacguggcccacggcgucugg

SEQ ID NO: 45663 - RNA, 27 nt, Artificial Sequence
  Melanoma antigen preferentially expressed in tumors (334-342)
cugagcgagggcgacgugaugcaccuc

SEQ ID NO: 45664 - RNA, 27 nt, Artificial Sequence
  Putative pre-mRNA-splicing factor ATP-dependent RNA helicase DHX16 (506-514)
cugagcgagcccgaccucgccuccuac

SEQ ID NO: 45665 - RNA, 21 nt, Artificial Sequence
  Hemoglobin subunit alpha (6-12)
cugagcuuccccaccaccaag

SEQ ID NO: 45666 - RNA, 27 nt, Artificial Sequence
  Hemoglobin subunit alpha (6-14)
cugagcuuccccaccaccaagacguac

SEQ ID NO: 45667 - RNA, 27 nt, Artificial Sequence
  Sister chromatid cohesion protein PDS5 homolog B (656-664)
cugagcuucacccaccccaucuccuuc

SEQ ID NO: 45668 - RNA, 30 nt, Artificial Sequence
  Zinc transporter ZIP12 (31-40)
cugagcggcgacgcccuccugcaccugauc

SEQ ID NO: 45669 - RNA, 30 nt, Artificial Sequence
  Asparagine synthetase (glutamine-hydrolyzing) (174-183)
cugagcggcgggcucgacuccagccuggug

SEQ ID NO: 45670 - RNA, 27 nt, Artificial Sequence
  Phosphorylase b kinase regulatory subunit alpha, liver isoform (46-54)
cugagcggccagcacggggugaccguc

SEQ ID NO: 45671 - RNA, 33 nt, Artificial Sequence
  PCNA-interacting partner (149-159)
cugagcauccccaccuccccgaccagcaaguac

SEQ ID NO: 45672 - RNA, 24 nt, Artificial Sequence
  Synemin (708-715)
cugagcaaggacaucaaggaggug

SEQ ID NO: 45673 - RNA, 24 nt, Artificial Sequence
  Ryanodine receptor 1 (442-449)
cugagccuccaggaccugaucauc

SEQ ID NO: 45674 - RNA, 33 nt, Artificial Sequence
  Codanin-1 (382-392)
cugagcaaccucgacaagggcacccugaagcug

SEQ ID NO: 45675 - RNA, 30 nt, Artificial Sequence
  Caprin-2 (108-117)
cugagcuccgccgccagccccucccaggcg

SEQ ID NO: 45676 - RNA, 57 nt, Artificial Sequence
  Protein unc-13 homolog D (375-393)
cugagcuccggccagaaggaccaggggcaggccgccaacaugcucugcguggucgug

SEQ ID NO: 45677 - RNA, 30 nt, Artificial Sequence
  Melanocyte-stimulating hormone receptor (129-138)
cugagcucccucugcuuccugggcgccauc

SEQ ID NO: 45678 - RNA, 27 nt, Artificial Sequence
  Protein prune homolog 2 (1282-1290)
cugagcucccccgagaccggcaaguac

SEQ ID NO: 45679 - RNA, 27 nt, Artificial Sequence
  Kelch-like protein 12 (386-394)
cugagcuccguggaggccuacaacauc

SEQ ID NO: 45680 - RNA, 36 nt, Artificial Sequence
  AP-2 complex subunit beta (710-721)
cugagcaccggcaucgggauggcccccggcggguac

SEQ ID NO: 45681 - RNA, 30 nt, Artificial Sequence
  Peroxisome assembly protein 12 (247-256)
cugagcaccggccucuccgugggggucuuc

SEQ ID NO: 45682 - RNA, 27 nt, Artificial Sequence
  Amyloid protein-binding protein 2 (472-480)
cugagcgugggccaccucgccucccug

SEQ ID NO: 45683 - RNA, 21 nt, Artificial Sequence
  Serine/threonine-protein kinase mTOR (1960-1966)
cugaccgacaucggccgcuac

SEQ ID NO: 45684 - RNA, 24 nt, Artificial Sequence
  Tyrosine-protein kinase BAZ1B (894-901)
cugaccgacaugaagcagguguuc

SEQ ID NO: 45685 - RNA, 30 nt, Artificial Sequence
  CDC2L5 protein kinase  (1231-1240)
cugaccgacccccacgccggcgugaaggcc

SEQ ID NO: 45686 - RNA, 27 nt, Artificial Sequence
  Zinc finger with UFM1-specific peptidase domain protein (139-147)
cugaccgagaucaagggcagcguguac

SEQ ID NO: 45687 - RNA, 24 nt, Artificial Sequence
  Protocadherin-15 (1267-1274)
cugaccgagauccucgaccgcuac

SEQ ID NO: 45688 - RNA, 27 nt, Artificial Sequence
  Beta-1-syntrophin (254-262)
cugaccgagaaggaccuccugaucuac

SEQ ID NO: 45689 - RNA, 27 nt, Artificial Sequence
  Alpha-1-syntrophin (122-130)
cugaccgagaaggagcuccugcuguac

SEQ ID NO: 45690 - RNA, 27 nt, Artificial Sequence
  Nucleoprotein TPR (587-595)
cugaccgagcucgagcagcugcgcaag

SEQ ID NO: 45691 - RNA, 27 nt, Artificial Sequence
  Zinc finger MIZ domain-containing protein 1 (470-478)
cugaccuuccccgugcgcgacggcguc

SEQ ID NO: 45692 - RNA, 48 nt, Artificial Sequence
  Basement membrane-specific heparan sulfate proteoglycan core protein (350-365)
cugaccggcgaguucaccguggagcccgucccggagggggcccagcuc

SEQ ID NO: 45693 - RNA, 24 nt, Artificial Sequence
  Erythrocyte band 7 integral membrane protein (109-116)
cugaccaaggacagcgugaccauc

SEQ ID NO: 45694 - RNA, 27 nt, Artificial Sequence
  CCR4-NOT transcription complex subunit 1 (247-255)
cugaccaagcccaugcagauccucuac

SEQ ID NO: 45695 - RNA, 27 nt, Artificial Sequence
  Phenylalanine-tRNA ligase alpha subunit (381-389)
cugacccucggccaccugaugggggug

SEQ ID NO: 45696 - RNA, 27 nt, Artificial Sequence
  Plectin (1055-1063)
cugacccucggcaagcuggagcaggug

SEQ ID NO: 45697 - RNA, 81 nt, Artificial Sequence
  POU domain, class 6, transcription factor 2 (131-157)
cugacccuccccaccgccaaccugacgaacauccagggccugguggccgcggccgccgccgggggcaucaugacccucccg

SEQ ID NO: 45698 - RNA, 27 nt, Artificial Sequence
  Cytoplasmic dynein 1 heavy chain 1 (469-477)
cugaccauggagaucaaccccaaggug

SEQ ID NO: 45699 - RNA, 30 nt, Artificial Sequence
  Plasma membrane calcium-transporting ATPase 1 (480-489)
cugaccaugaaccgcaugaccgugguccag

SEQ ID NO: 45700 - RNA, 36 nt, Artificial Sequence
  Insulin-like growth factor-binding protein complex acid labile subunit (399-410)
cugaccaacguggccgucaugaaccucagcggcaac

SEQ ID NO: 45701 - RNA, 27 nt, Artificial Sequence
  Peroxisomal acyl-coenzyme A oxidase 1 (273-281)
cugaccuacggcaccaugguguucguc

SEQ ID NO: 45702 - RNA, 36 nt, Artificial Sequence
  Potassium/sodium hyperpolarization-activated cyclic nucleotide-gated channel 4 (1006-1017)
cugguggccggcgccagcgggggcgcgucccccguc

SEQ ID NO: 45703 - RNA, 30 nt, Artificial Sequence
  ER membrane protein complex subunit 7 (68-77)
cugguggacggcgaggagcacgucggguuc

SEQ ID NO: 45704 - RNA, 24 nt, Artificial Sequence
  Manganese-transporting ATPase 13A1 (282-289)
cugguggacauccccgucgaguuc

SEQ ID NO: 45705 - RNA, 27 nt, Artificial Sequence
  Supervillin (1622-1630)
cugguggacaaccaccacgaggucuac

SEQ ID NO: 45706 - RNA, 27 nt, Artificial Sequence
  Aldehyde dehydrogenase family 1 member A3 (106-114)
cugguggagcgcgaccgggccacccuc

SEQ ID NO: 45707 - RNA, 27 nt, Artificial Sequence
  A-kinase anchor protein 11 (654-662)
cugguguucgagggcaucauggagguc

SEQ ID NO: 45708 - RNA, 30 nt, Artificial Sequence
  Serum albumin (66-75)
cuggugaacgaggucaccgaguucgccaag

SEQ ID NO: 45709 - RNA, 24 nt, Artificial Sequence
  Cytochrome c oxidase subunit 5B, mitochondrial (122-129)
cuggugccccagcagcucgcccac

SEQ ID NO: 45710 - RNA, 30 nt, Artificial Sequence
  Stabilin-2 (1032-1041)
cuggugcccagccagcaggccaccgaggac

SEQ ID NO: 45711 - RNA, 24 nt, Artificial Sequence
  Adenomatous polyposis coli protein 2 (11-18)
cuggugcgccaggucgaggcccuc

SEQ ID NO: 45712 - RNA, 48 nt, Artificial Sequence
  60S ribosomal protein L9 (153-168)
cuggugagcaacuccgccgcccucauccagcaggcgaccaccgucaag

SEQ ID NO: 45713 - RNA, 33 nt, Artificial Sequence
  Thioredoxin reductase 2, mitochondrial (4-14)
cugguggucggcgggggcagcgggggccucgcc

SEQ ID NO: 45714 - RNA, 27 nt, Artificial Sequence
  Midasin (3107-3115)
cugguggucagcgacggccgcgggcuc

SEQ ID NO: 45715 - RNA, 30 nt, Artificial Sequence
  Kelch-like protein 29 (511-520)
cugguguacgacggcaagaucuacacccuc

SEQ ID NO: 45716 - RNA, 27 nt, Artificial Sequence
  Pre-mRNA-processing-splicing factor 8 (405-413)
cugugggccccccgcccguucaaccuc

SEQ ID NO: 45717 - RNA, 27 nt, Artificial Sequence
  Plexin-B3 (1462-1470)
cuguacgccuuccuccgcgagguggcc

SEQ ID NO: 45718 - RNA, 30 nt, Artificial Sequence
  Aldehyde dehydrogenase family 1 member A3 (471-480)
cuguacgcccaggcccccuucggcggguuc

SEQ ID NO: 45719 - RNA, 27 nt, Artificial Sequence
  DNA-binding protein RFXANK (131-139)
cuguacgccgugcgcggcaaccacguc

SEQ ID NO: 45720 - RNA, 27 nt, Artificial Sequence
  Asparagine synthetase (glutamine-hydrolyzing) (132-140)
cuguacgacaacguggagaagcucuuc

SEQ ID NO: 45721 - RNA, 24 nt, Artificial Sequence
  Mediator of RNA polymerase II transcription subunit 12 (572-579)
cuguacgaccagccccgccacgug

SEQ ID NO: 45722 - RNA, 24 nt, Artificial Sequence
  Signal recognition particle subunit SRP68 (454-461)
cuguacgaccgcgugcucaaguac

SEQ ID NO: 45723 - RNA, 27 nt, Artificial Sequence
  GPI mannosyltransferase 2 (80-88)
cuguacgagcacaacuucgccuucuuc

SEQ ID NO: 45724 - RNA, 27 nt, Artificial Sequence
  Hemicentin-1 (1595-1603)
cuguacaucgacaagggccaguaccuc

SEQ ID NO: 45725 - RNA, 27 nt, Artificial Sequence
  Cleavage and polyadenylation specificity factor subunit 6 (83-91)
cuguacaucggcaaccucaccuggugg

SEQ ID NO: 45726 - RNA, 27 nt, Artificial Sequence
  Myotubularin-related protein 12 (484-492)
cuguacauccccaucuucagcaccuuc

SEQ ID NO: 45727 - RNA, 27 nt, Artificial Sequence
  Disintegrin and metalloproteinase domain-containing protein 10 (167-175)
cuguacauccagaccgaccaccucuuc

SEQ ID NO: 45728 - RNA, 27 nt, Artificial Sequence
  SUN domain-containing ossification factor (723-731)
cuguacaucguggagccccucaaguuc

SEQ ID NO: 45729 - RNA, 30 nt, Artificial Sequence
  Solute carrier family 25 member 34 (267-276)
cuguacaagggccucgggcccgccuaccug

SEQ ID NO: 45730 - RNA, 27 nt, Artificial Sequence
  ER membrane protein complex subunit 1 (731-739)
cuguacaagagccucaaccccaaccug

SEQ ID NO: 45731 - RNA, 27 nt, Artificial Sequence
  NTF2-related export protein 2 (39-47)
cuguaccucgacaaggccacccugauc

SEQ ID NO: 45732 - RNA, 30 nt, Artificial Sequence
  NTF2-related export protein 2 (39-48)
cuguaccucgacaaggccacccugaucugg

SEQ ID NO: 45733 - RNA, 27 nt, Artificial Sequence
  SWI/SNF-related matrix-associated actin-dependent regulator of chromatin subfamily A containing DEAD/H box 1 (320-328)
cuguaccucggccuguucaaccgccug

SEQ ID NO: 45734 - RNA, 27 nt, Artificial Sequence
  Protein CLN8 (226-234)
cuguaccucccccaccugacccuguuc

SEQ ID NO: 45735 - RNA, 21 nt, Artificial Sequence
  Mitochondrial carrier homolog 1 (63-69)
cuguaccuccccagcuucuuc

SEQ ID NO: 45736 - RNA, 27 nt, Artificial Sequence
  DnaJ homolog subfamily A member 2 (129-137)
cuguacaacggcaagaccaccaagcuc

SEQ ID NO: 45737 - RNA, 33 nt, Artificial Sequence
  Melanocyte protein PMEL (55-65)
cuguaccccgaguggaccgaggcccagcgccuc

SEQ ID NO: 45738 - RNA, 27 nt, Artificial Sequence
  Protein transport protein Sec23B (560-568)
cuguacccccaguucauguuccaccuc

SEQ ID NO: 45739 - RNA, 27 nt, Artificial Sequence
  Vacuolar protein sorting-associated protein 4A (31-39)
cuguaccagcacgccguggaguacuuc

SEQ ID NO: 45740 - RNA, 27 nt, Artificial Sequence
  CCAAT/enhancer-binding protein zeta (212-220)
cuguaccagcacgagaucaaccucuuc

SEQ ID NO: 45741 - RNA, 27 nt, Artificial Sequence
  Engulfment and cell motility protein 2 (207-215)
cuguaccagaagaucgccgaggagauc

SEQ ID NO: 45742 - RNA, 24 nt, Artificial Sequence
  E3 ubiquitin-protein ligase UBR5 (1255-1262)
cuguaccgccuccugaccgccacc

SEQ ID NO: 45743 - RNA, 27 nt, Artificial Sequence
  Unconventional myosin-Ib (356-364)
cuguacagccgccucuucuccuggcug

SEQ ID NO: 45744 - RNA, 27 nt, Artificial Sequence
  Ubiquitin-like modifier-activating enzyme 7 (14-22)
cuguacagccgccagcucuacgugcug

SEQ ID NO: 45745 - RNA, 24 nt, Artificial Sequence
  Mitochondrial ubiquitin ligase activator of NFKB 1 (25-32)
cuguacagcguguaccgccagaag

SEQ ID NO: 45746 - RNA, 27 nt, Artificial Sequence
  Melanoma antigen preferentially expressed in tumors (301-309)
cuguacguggacagccucuucuuccug

SEQ ID NO: 45747 - RNA, 27 nt, Artificial Sequence
  Beta-galactosidase-1-like protein (586-594)
cuguacgugccccgcuuccuccuguuc

SEQ ID NO: 45748 - RNA, 24 nt, Artificial Sequence
  40S ribosomal protein S29 (6-13)
cuguacuggagccacccccgcaag

SEQ ID NO: 45749 - RNA, 39 nt, Artificial Sequence
  Mitogen-activated protein kinase 1 (1-13)
auggccgccgcggccgccgccggcgccgggcccgagaug

SEQ ID NO: 45750 - RNA, 27 nt, Artificial Sequence
  B-cell CLL/lymphoma 9-like protein (186-194)
auggccgccccccagcugggcccgggg

SEQ ID NO: 45751 - RNA, 30 nt, Artificial Sequence
  Glucosylceramidase (21-30)
auggccggcagccugaccgggcuccugcug

SEQ ID NO: 45752 - RNA, 24 nt, Artificial Sequence
  Dystonin (1657-1664)
auggccaucaaggugcuggagauc

SEQ ID NO: 45753 - RNA, 24 nt, Artificial Sequence
  BRAF (48-55)
auggcccccgaggugauccgcaug

SEQ ID NO: 45754 - RNA, 24 nt, Artificial Sequence
  HLA class I histocompatibility antigen, alpha chain F (1-8)
auggccccccgcagccugcuccug

SEQ ID NO: 45755 - RNA, 24 nt, Artificial Sequence
  HLA class I histocompatibility antigen, B-39 alpha chain (4-11)
auggccccccgcaccgugcugcuc

SEQ ID NO: 45756 - RNA, 48 nt, Artificial Sequence
  Gamma-secretase C-terminal fragment 59 (561-576)
auggacgccgaguuccgccacgacagcggcuacgaggugcaccaccag

SEQ ID NO: 45757 - RNA, 48 nt, Artificial Sequence
  Dihydropyrimidinase-related protein 2 (339-354)
auggacgagaaccaguucguggccgucaccagcaccaacgccgcgaag

SEQ ID NO: 45758 - RNA, 21 nt, Artificial Sequence
  Insulin receptor substrate 2 (545-551)
auggaccgcccccugagccac

SEQ ID NO: 45759 - RNA, 27 nt, Artificial Sequence
  Receptor-type tyrosine-protein phosphatase gamma (796-804)
auggaggccauccccgugaagcaguuc

SEQ ID NO: 45760 - RNA, 30 nt, Artificial Sequence
  Protein wntless homolog (185-194)
auggagaucggcagcguggcccacaaguuc

SEQ ID NO: 45761 - RNA, 27 nt, Artificial Sequence
  Tyrosinase (516-524)
auggagaaggaggacuaccacagccug

SEQ ID NO: 45762 - RNA, 30 nt, Artificial Sequence
  PRELI domain containing protein 3B (91-100)
auggagcugaagagcaccaacaucuccuuc

SEQ ID NO: 45763 - RNA, 30 nt, Artificial Sequence
  Fructose-bisphosphate aldolase A (219-228)
auggagaacgccaacgugcuggcccgcuac

SEQ ID NO: 45764 - RNA, 30 nt, Artificial Sequence
  Poly(U)-binding-splicing factor PUF60 (74-83)
auggagcagagcaucaaguccgugcugguc

SEQ ID NO: 45765 - RNA, 30 nt, Artificial Sequence
  Melanoma-associated antigen 3 (167-176)
auggagguggaccccaucggccaccuguac

SEQ ID NO: 45766 - RNA, 24 nt, Artificial Sequence
  Synemin (37-44)
auguucgacaagaaggugcagcug

SEQ ID NO: 45767 - RNA, 18 nt, Artificial Sequence
  Proliferating cell nuclear antigen (244-249)
augggccaccugaaguac

SEQ ID NO: 45768 - RNA, 60 nt, Artificial Sequence
  Actin, aortic smooth muscle (49-68)
augggccagaaggacagcuacgugggggacgaggcccaguccaagcgcggcauccugacc

SEQ ID NO: 45769 - RNA, 24 nt, Artificial Sequence
  Ankyrin-1 (733-740)
augggcuacaccccccugcacgug

SEQ ID NO: 45770 - RNA, 21 nt, Artificial Sequence
  Dynein light chain roadblock-type 1 (53-59)
augcacagcuucauccugaag

SEQ ID NO: 45771 - RNA, 27 nt, Artificial Sequence
  Glycogen phosphorylase, liver form (619-627)
augaucaucaagcugaucaccagcgug

SEQ ID NO: 45772 - RNA, 27 nt, Artificial Sequence
  Phenylalanine-tRNA ligase alpha subunit (465-473)
augaucaaguacggcaucaacaacauc

SEQ ID NO: 45773 - RNA, 30 nt, Artificial Sequence
  Malate dehydrogenase, mitochondrial (273-282)
augaucagcgacgccauccccgagcugaag

SEQ ID NO: 45774 - RNA, 27 nt, Artificial Sequence
  ER membrane protein complex subunit 1 (976-984)
augaucaccaagcgccuggcccaggug

SEQ ID NO: 45775 - RNA, 27 nt, Artificial Sequence
  Huntingtin (537-545)
augaucaccacccaccccgcccuggug

SEQ ID NO: 45776 - RNA, 27 nt, Artificial Sequence
  EH domain-containing protein 3 (385-393)
augcuggcccacgacaucgcccagcuc

SEQ ID NO: 45777 - RNA, 24 nt, Artificial Sequence
  Chondroitin sulfate proteoglycan 4 (22-29)
augcuggcccgccucgccagcgcg

SEQ ID NO: 45778 - RNA, 33 nt, Artificial Sequence
  COP9 signalosome complex subunit 1 (344-354)
augcuggacgagaugaaggacaaccuccugcug

SEQ ID NO: 45779 - RNA, 33 nt, Artificial Sequence
  Baculoviral IAP repeat-containing protein 6 (1752-1762)
augcuggaggacgagaaggugaccauguuccuc

SEQ ID NO: 45780 - RNA, 21 nt, Artificial Sequence
  Spectrin beta chain, non-erythrocytic 4 (2042-2048)
augcuggaggugcaccaguuc

SEQ ID NO: 45781 - RNA, 27 nt, Artificial Sequence
  Mitotic checkpoint serine/threonine-protein kinase BUB1 (998-1006)
augcuguucggcaccuacaugaaggug

SEQ ID NO: 45782 - RNA, 24 nt, Artificial Sequence
  Collagen alpha-1(XVIII) chain (1454-1461)
augcugggccaggugcacgagguc

SEQ ID NO: 45783 - RNA, 27 nt, Artificial Sequence
  Tetratricopeptide repeat protein 28 (1354-1362)
augcugaucggcagcgacgugaagcuc

SEQ ID NO: 45784 - RNA, 27 nt, Artificial Sequence
  Phosphatidylinositol 5-phosphate 4-kinase type-2 beta (65-73)
augcugaugcccgacgacuucaaggcc

SEQ ID NO: 45785 - RNA, 66 nt, Artificial Sequence
  T-complex protein 1 subunit beta (445-466)
augcugcccaccaucaucgccgacaacgccggcuacgacagcgcggaccucguggcccagcugcgc

SEQ ID NO: 45786 - RNA, 27 nt, Artificial Sequence
  DNA-binding protein SATB2 (142-150)
augcugcaggacguguaccacgucgug

SEQ ID NO: 45787 - RNA, 174 nt, Artificial Sequence
  6.8 kDa mitochondrial proteolipid (1-58)
augcugcagagcaucaucaagaacaucuggauccccaugaagccguacuacaccaagguguaccaggagaucuggaucggcauggggcucaugggcuucaucgucuacaagauccgcgccgccgacaagcgguccaaggcgcugaaggccagcgcccccgcccccgggcaccac

SEQ ID NO: 45788 - RNA, 30 nt, Artificial Sequence
  BTB/POZ domain-containing protein KCTD3 (428-437)
augcugagcgagaagcaccucguguccguc

SEQ ID NO: 45789 - RNA, 27 nt, Artificial Sequence
  Death-associated protein kinase 1 (763-771)
augauguucgagcccggccugaccaag

SEQ ID NO: 45790 - RNA, 27 nt, Artificial Sequence
  RB1-inducible coiled-coil protein 1 (107-115)
augaugcccgccguguuccacaccguc

SEQ ID NO: 45791 - RNA, 48 nt, Artificial Sequence
  Exostosin-like 1 (589-604)
augaacuucaucguggccgccgucaccaagcugcccccgaucaaggug

SEQ ID NO: 45792 - RNA, 27 nt, Artificial Sequence
  Sodium/potassium/calcium exchanger 5 (298-306)
augcccgaggccgaccugaagcgcauc

SEQ ID NO: 45793 - RNA, 24 nt, Artificial Sequence
  Filamin-B (1129-1136)
augcccuucgacccgagcaaggug

SEQ ID NO: 45794 - RNA, 69 nt, Artificial Sequence
  Heat shock cognate 71 kDa protein (621-643)
augcccggcggguucccgggcgggggcgccccccccagcgggggcgccuccagcggccccaccaucgag

SEQ ID NO: 45795 - RNA, 27 nt, Artificial Sequence
  Protein polybromo-1 (1078-1086)
augcccaucagcuccgugcgcuucguc

SEQ ID NO: 45796 - RNA, 27 nt, Artificial Sequence
  Malignant T-cell-amplified sequence 1 (45-53)
augcccaagaaggacccggugaagauc

SEQ ID NO: 45797 - RNA, 27 nt, Artificial Sequence
  Melanoma antigen preferentially expressed in tumors (218-226)
augcccaugcaggacaucaagaugauc

SEQ ID NO: 45798 - RNA, 27 nt, Artificial Sequence
  Nuclear factor related to kappa-B-binding protein (810-818)
augcccccgaaggccggccagaccauc

SEQ ID NO: 45799 - RNA, 27 nt, Artificial Sequence
  E3 ubiquitin-protein ligase Itchy homolog (380-388)
augccccagcacaucaagaucaccgug

SEQ ID NO: 45800 - RNA, 39 nt, Artificial Sequence
  Myotubularin-related protein 5 (315-327)
augccccgcuacgccgacgccagcggccggaacacccug

SEQ ID NO: 45801 - RNA, 30 nt, Artificial Sequence
  Splicing factor 3B subunit 2 (596-605)
augcccgugggcccgaacgcccacaagguc

SEQ ID NO: 45802 - RNA, 27 nt, Artificial Sequence
  Zinc finger protein 512B (211-219)
augcccgugaccaagccgaucaccguc

SEQ ID NO: 45803 - RNA, 27 nt, Artificial Sequence
  Dihydropyrimidinase-related protein 3 (192-200)
augcccuacaagggcaugaccaccgug

SEQ ID NO: 45804 - RNA, 21 nt, Artificial Sequence
  Transmembraneoprotein NMB (38-44)
augcgcgagcacaaccagcug

SEQ ID NO: 45805 - RNA, 27 nt, Artificial Sequence
  WD repeat-containing protein 81 (60-68)
augagcgaggagcacaccgccguguac

SEQ ID NO: 45806 - RNA, 27 nt, Artificial Sequence
  Bombesin receptor-activated protein C6orf89 (44-52)
augagcgagaaggccaucgagaaguuc

SEQ ID NO: 45807 - RNA, 27 nt, Artificial Sequence
  Inactive ubiquitin carboxyl-terminal hydrolase 53 (1045-1053)
augaccgacaccuaccgccugaaguac

SEQ ID NO: 45808 - RNA, 18 nt, Artificial Sequence
  Neuronal membraneoprotein M6-a (202-207)
augaccuuccaccuguuc

SEQ ID NO: 45809 - RNA, 87 nt, Artificial Sequence
  POTE ankyrin domain family member I (36-64)
augacccagaucauguucgagaccuucaacacgcccgccauguacguggccauccaggcgguccugagccucuacgccuccggccgc

SEQ ID NO: 45810 - RNA, 36 nt, Artificial Sequence
  Protein disulfide-isomerase A3 (285-296)
augguggccaagaaguuccuggacgccggccacaag

SEQ ID NO: 45811 - RNA, 24 nt, Artificial Sequence
  Unconventional myosin-Id (310-317)
augguggagaaggcccugcucuac

SEQ ID NO: 45812 - RNA, 27 nt, Artificial Sequence
  Putative eukaryotic translation initiation factor 2 subunit 3-like protein (353-361)
auggugggccagauccugggggccguc

SEQ ID NO: 45813 - RNA, 42 nt, Artificial Sequence
  MICOS complex subunit MIC60 (88-101)
auggugcugggccccgccgccuacaacgucccgcuccccaag

SEQ ID NO: 45814 - RNA, 27 nt, Artificial Sequence
  ER membrane protein complex subunit 7 (169-177)
auggugcugccccuccugaucuucguc

SEQ ID NO: 45815 - RNA, 69 nt, Artificial Sequence
  X-ray repair cross-complementing protein 5 (210-232)
auggugaugaucagccuggagggcgaggacgggcucgacgagaucuacuccuucagcgagucccugcgc

SEQ ID NO: 45816 - RNA, 30 nt, Artificial Sequence
  Threonine-tRNA ligase, cytoplasmic (655-664)
auggugguccccgugggcccgaccugcgac

SEQ ID NO: 45817 - RNA, 30 nt, Artificial Sequence
  NAD(P)H dehydrogenase (quinone) 1 (129-138)
auguacgacaagggccccuuccgcagcaag

SEQ ID NO: 45818 - RNA, 30 nt, Artificial Sequence
  Exportin-1 (545-554)
auguacaucgugggccaguacccccgcuuc

SEQ ID NO: 45819 - RNA, 27 nt, Artificial Sequence
  MICOS complex subunit MIC25 (169-177)
auguacaagcugagcuccgagcaguuc

SEQ ID NO: 45820 - RNA, 27 nt, Artificial Sequence
  F-box only protein 21 (417-425)
auguaccccgaccaggugcagcugcuc

SEQ ID NO: 45821 - RNA, 30 nt, Artificial Sequence
  Sodium/potassium-transporting ATPase subunit alpha-1 (980-989)
auguacccccugaagccgaccuggugguuc

SEQ ID NO: 45822 - RNA, 27 nt, Artificial Sequence
  Sphingomyelin phosphodiesterase 4 (377-385)
auguacaccaagcuguucgugggcuuc

SEQ ID NO: 45823 - RNA, 33 nt, Artificial Sequence
  DNA-binding protein SATB1 (453-463)
aacgccgccagcgcgaugggccccgccccgcug

SEQ ID NO: 45824 - RNA, 30 nt, Artificial Sequence
  Eukaryotic translation initiation factor 3 subunit L (169-178)
aacgccgacggccccgccccgcuggagcuc

SEQ ID NO: 45825 - RNA, 27 nt, Artificial Sequence
  Far upstream element-binding protein 1 (418-426)
aacgccgaccccaacaugaagcuguuc

SEQ ID NO: 45826 - RNA, 27 nt, Artificial Sequence
  Erythrocyte band 7 integral membrane protein (138-146)
aacgccgacagcgccacccgccugcuc

SEQ ID NO: 45827 - RNA, 27 nt, Artificial Sequence
  AP-2 complex subunit beta (874-882)
aacgccgacaccgugagcuccaagcug

SEQ ID NO: 45828 - RNA, 27 nt, Artificial Sequence
  CD44 antigen (137-145)
aacgccuucgacggccccaucaccauc

SEQ ID NO: 45829 - RNA, 36 nt, Artificial Sequence
  Catenin alpha-1 (43-54)
aacgccggcaacgagcaggaccuggggauccaguac

SEQ ID NO: 45830 - RNA, 24 nt, Artificial Sequence
  Helicase-like transcription factor (96-103)
aacgccaucaaggugaacaacguc

SEQ ID NO: 45831 - RNA, 24 nt, Artificial Sequence
  Similar to 60S ribosomal protein L7 (171-178)
aacgcccugaucgcccgcagccuc

SEQ ID NO: 45832 - RNA, 33 nt, Artificial Sequence
  Forkhead box protein C1 (212-222)
aacgcccccggcccgcagcccccccccgugcgc

SEQ ID NO: 45833 - RNA, 24 nt, Artificial Sequence
  Serine/threonine-protein phosphatase 2A regulatory subunit B'' subunit alpha (81-88)
aacgccccccugagcaucaacauc

SEQ ID NO: 45834 - RNA, 21 nt, Artificial Sequence
  Protein FAM208B (1664-1670)
aacgccacccugacccacuac

SEQ ID NO: 45835 - RNA, 24 nt, Artificial Sequence
  Rho guanine nucleotide exchange factor 11 (1029-1036)
aacgccgugcugauccgcagcguc

SEQ ID NO: 45836 - RNA, 30 nt, Artificial Sequence
  T-complex protein 1 subunit theta (48-57)
aacgacgccgccaccauccugcgcgagcuc

SEQ ID NO: 45837 - RNA, 27 nt, Artificial Sequence
  Pumilio homolog 2 (927-935)
aacgacggcccccacagcgcccuguac

SEQ ID NO: 45838 - RNA, 24 nt, Artificial Sequence
  Ribonuclease P protein subunit p21 (126-133)
aacgaccccggccaccugcucugg

SEQ ID NO: 45839 - RNA, 30 nt, Artificial Sequence
  Protein TANC1 (587-596)
aacgaggccgaguuccacaagcccgacuac

SEQ ID NO: 45840 - RNA, 30 nt, Artificial Sequence
  Hemicentin-1 (2650-2659)
aacgaggccggcgagaugaucaagcacuac

SEQ ID NO: 45841 - RNA, 30 nt, Artificial Sequence
  Hemicentin-1 (3510-3519)
aacgaggccggcgaggugagcaagcacuuc

SEQ ID NO: 45842 - RNA, 30 nt, Artificial Sequence
  E3 ubiquitin-protein ligase MYCBP2 (2115-2124)
aacgaggcccuguucagccucgagaccgcc

SEQ ID NO: 45843 - RNA, 27 nt, Artificial Sequence
  Insulin-like growth factor 1 receptor (1048-1056)
aacgaggccagcgugaugaaggaguuc

SEQ ID NO: 45844 - RNA, 30 nt, Artificial Sequence
  Neutral amino acid transporter B(0) (61-70)
aacgaggccaccauggugcuggucagcugg

SEQ ID NO: 45845 - RNA, 27 nt, Artificial Sequence
  Kinesin-like protein KIF13B (360-368)
aacgaggaccccaacgcccgcaucauc

SEQ ID NO: 45846 - RNA, 27 nt, Artificial Sequence
  Smith-Magenis syndrome chromosomal region candidate gene 8 protein (896-904)
aacgaggacgugcgcgucgugcaguac

SEQ ID NO: 45847 - RNA, 27 nt, Artificial Sequence
  RNA-binding motif, single-stranded-interacting protein 3 (399-407)
aacgagcacgcccccgccuacagcuac

SEQ ID NO: 45848 - RNA, 30 nt, Artificial Sequence
  2-hydroxyacylsphingosine 1-beta-galactosyltransferase (284-293)
aacgagcacggcuucgugcuggucagcuuc

SEQ ID NO: 45849 - RNA, 30 nt, Artificial Sequence
  Protocadherin gamma-A9 (143-152)
aacgagaucgccgugcccggcgcccgcuac

SEQ ID NO: 45850 - RNA, 33 nt, Artificial Sequence
  Protein transport protein Sec23A (436-446)
aacgagaucggcaccgggggcaccugccagugg

SEQ ID NO: 45851 - RNA, 30 nt, Artificial Sequence
  Serine incorporator 3 (396-405)
aacgagaaggagggcgugcaguacagcuac

SEQ ID NO: 45852 - RNA, 27 nt, Artificial Sequence
  Pre-rRNA-processing protein TSR1 homolog (69-77)
aacgagcugggcaacacccagaacuuc

SEQ ID NO: 45853 - RNA, 27 nt, Artificial Sequence
  T-box transcription factor TBX2 (676-684)
aacgagcugcagagcauccagcgccuc

SEQ ID NO: 45854 - RNA, 27 nt, Artificial Sequence
  Spectrin beta chain, non-erythrocytic 1 (32-40)
aacgagaacagcuccgcccgccuguuc

SEQ ID NO: 45855 - RNA, 27 nt, Artificial Sequence
  Cytoplasmic FMR1-interacting protein 2 (99-107)
aacgagcagcccaaccgcguggagauc

SEQ ID NO: 45856 - RNA, 30 nt, Artificial Sequence
  Serine incorporator 1 (377-386)
aacgagcgcgacggcgugaccuacagcuac

SEQ ID NO: 45857 - RNA, 27 nt, Artificial Sequence
  Transcription factor SOX-10 (146-154)
aacgagagcgacaagcgccccuucauc

SEQ ID NO: 45858 - RNA, 27 nt, Artificial Sequence
  Laminin subunit beta-1 (541-549)
aacgagguggagcccggcuacuacuuc

SEQ ID NO: 45859 - RNA, 21 nt, Artificial Sequence
  AP-1 complex subunit sigma-1A (105-111)
aacuucgagaaggccuacuuc

SEQ ID NO: 45860 - RNA, 18 nt, Artificial Sequence
  Serine/threonine-protein phosphatase 2A 55 kDa regulatory subunit B alpha isoform (364-369)
aacuucuuccgcauguuc

SEQ ID NO: 45861 - RNA, 27 nt, Artificial Sequence
  Astrotactin-2 (354-362)
aacuucaucaaggacuucccccagcug

SEQ ID NO: 45862 - RNA, 21 nt, Artificial Sequence
  Absent in melanoma 1 protein (1462-1468)
aacuucaccggcaaccaguac

SEQ ID NO: 45863 - RNA, 24 nt, Artificial Sequence
  RNA-binding protein 12B (194-201)
aacggcgacgccaucgugaaguuc

SEQ ID NO: 45864 - RNA, 27 nt, Artificial Sequence
  Receptor-interacting serine/threonine-protein kinase 4 (562-570)
aacggcgacgagagcuccacccgccug

SEQ ID NO: 45865 - RNA, 24 nt, Artificial Sequence
  Ankyrin-1 (403-410)
aacggcuucaccccccugcacauc

SEQ ID NO: 45866 - RNA, 33 nt, Artificial Sequence
  Insulin-like growth factor-binding protein complex acid labile subunit (458-468)
aacggccugguggggaucgaggagcagagccuc

SEQ ID NO: 45867 - RNA, 78 nt, Artificial Sequence
  RNA-binding protein Nova-2 (369-394)
aacggcuaccugggggccggcgccgggggcggggcgggcggcgggggcgggccccucguggccgccgccgccgcggcc

SEQ ID NO: 45868 - RNA, 24 nt, Artificial Sequence
  Ankyrin-1 (634-641)
aacggcuacaccccccugcacauc

SEQ ID NO: 45869 - RNA, 30 nt, Artificial Sequence
  Hemicentin-1 (4034-4043)
aaccacgccgugcugcccagcggcgggcuc

SEQ ID NO: 45870 - RNA, 45 nt, Artificial Sequence
  Tyrosine-protein phosphatase non-receptor type substrate 1 (452-466)
aaccacaccgaguacgccagcauccagaccuccccccagccggcc

SEQ ID NO: 45871 - RNA, 51 nt, Artificial Sequence
  Tyrosine-protein phosphatase non-receptor type substrate 1 (452-468)
aaccacaccgaguacgccagcauccagaccuccccccagccggccagcgag

SEQ ID NO: 45872 - RNA, 54 nt, Artificial Sequence
  Tyrosine-protein phosphatase non-receptor type substrate 1 (452-469)
aaccacaccgaguacgccagcauccagaccuccccccagccggccagcgaggac

SEQ ID NO: 45873 - RNA, 60 nt, Artificial Sequence
  Cytochrome c oxidase subunit 6A1, mitochondrial (67-86)
aaccacacccuguuccacaacccccacgugaacccgcuccccaccggcuacgaggacgag

SEQ ID NO: 45874 - RNA, 51 nt, Artificial Sequence
  Beta-2-microglobulin (82-98)
aaccacgugacccugagccagcccaagaucgucaagugggaccgcgacaug

SEQ ID NO: 45875 - RNA, 18 nt, Artificial Sequence
  Ketosamine-3-kinase (149-154)
aaccacuggaaccacuuc

SEQ ID NO: 45876 - RNA, 27 nt, Artificial Sequence
  Probable ATP-dependent RNA helicase YTHDC2 (689-697)
aacaucgccgagaccagcaucaccgug

SEQ ID NO: 45877 - RNA, 30 nt, Artificial Sequence
  Retinoic acid receptor RXR-gamma (268-277)
aacaucugccacgccgccgacaagcagcug

SEQ ID NO: 45878 - RNA, 27 nt, Artificial Sequence
  ATP-dependent RNA helicase A (346-354)
aacaucgacgagggcccccuggccuuc

SEQ ID NO: 45879 - RNA, 27 nt, Artificial Sequence
  P2X purinoceptor 7 (195-203)
aacaucgacuuccccggccacaacuac

SEQ ID NO: 45880 - RNA, 45 nt, Artificial Sequence
  Tyrosinase (122-136)
aacaucuucgaccugagcgcccccgagaaggacaaguucuucgcc

SEQ ID NO: 45881 - RNA, 36 nt, Artificial Sequence
  Glyceraldehyde-3-phosphate dehydrogenase, testis-specific (277-288)
aacaucauccccgccagcaccggcgccgcgaaggcc

SEQ ID NO: 45882 - RNA, 27 nt, Artificial Sequence
  SLIT-ROBO Rho GTPase-activating protein 2 (123-131)
aacaucaucccccgcuucgugcagguc

SEQ ID NO: 45883 - RNA, 27 nt, Artificial Sequence
  Heterogeneous nuclear ribonucleoprotein U-like protein 1 (451-459)
aacauccugggcaccaacgccaucaug

SEQ ID NO: 45884 - RNA, 78 nt, Artificial Sequence
  ATP synthase-coupling factor 6, mitochondrial (33-58)
aacaaggagcuggaccccauccagaagcucuucguggacaagauccgcgaguacaagagcaagcggcagaccuccggc

SEQ ID NO: 45885 - RNA, 90 nt, Artificial Sequence
  ATP synthase-coupling factor 6, mitochondrial (33-62)
aacaaggagcuggaccccauccagaagcucuucguggacaagauccgcgaguacaagagcaagcggcagaccuccggcgggccggucgac

SEQ ID NO: 45886 - RNA, 33 nt, Artificial Sequence
  Eukaryotic translation initiation factor 3 subunit C-like protein (131-141)
aacaagaacaacgccaaggcccugagcacccuc

SEQ ID NO: 45887 - RNA, 51 nt, Artificial Sequence
  Heat shock 70 kDa protein 4 (753-769)
aacaagcagagccugaccauggaccccguggucaaguccaaggagaucgag

SEQ ID NO: 45888 - RNA, 27 nt, Artificial Sequence
  Bifunctional glutamate/proline-tRNA ligase (1023-1031)
aaccuggccgacugguacagccaggug

SEQ ID NO: 45889 - RNA, 24 nt, Artificial Sequence
  Vimentin (177-184)
aaccuggccgaggacaucaugcgc

SEQ ID NO: 45890 - RNA, 33 nt, Artificial Sequence
  Dystonin (208-218)
aaccuggccaaccucgagcacgccuucuacgug

SEQ ID NO: 45891 - RNA, 27 nt, Artificial Sequence
  CMP-sialic acid transporter (111-119)
aaccuggacgccgccguguaccagguc

SEQ ID NO: 45892 - RNA, 27 nt, Artificial Sequence
  Cysteine andine-rich protein 1 (43-51)
aaccuggacagcaccaccguggccguc

SEQ ID NO: 45893 - RNA, 30 nt, Artificial Sequence
  Phospholipase A1 member A (42-51)
aaccuguucgagggcaccgaccucaaggug

SEQ ID NO: 45894 - RNA, 27 nt, Artificial Sequence
  Eukaryotic translation initiation factor 3 subunit L (162-170)
aaccuguucaacuacauccucaacgcc

SEQ ID NO: 45895 - RNA, 24 nt, Artificial Sequence
  Eukaryotic translation initiation factor 2-alpha kinase 4 (1314-1321)
aaccugggccucguguacaagguc

SEQ ID NO: 45896 - RNA, 27 nt, Artificial Sequence
  F-box/LRR-repeat protein 18 (261-269)
aaccugcacgccuuccucaucagcgug

SEQ ID NO: 45897 - RNA, 99 nt, Artificial Sequence
  Glia-derived nexin (344-376)
aaccugcacgugagccacauccuccagaaggccaagaucgaggucuccgaggacggcaccaaggccagcgcggccaccacggccauccugaucgcccgc

SEQ ID NO: 45898 - RNA, 102 nt, Artificial Sequence
  Glia-derived nexin (344-377)
aaccugcacgugagccacauccuccagaaggccaagaucgaggucuccgaggacggcaccaaggccagcgcggccaccacggccauccugaucgcccgcucc

SEQ ID NO: 45899 - RNA, 27 nt, Artificial Sequence
  GPI ethanolamine phosphate transferase 3 (51-59)
aaccugaucaagcagcucaccagcgcc

SEQ ID NO: 45900 - RNA, 27 nt, Artificial Sequence
  Protein EFR3 homolog B (453-461)
aaccugaucagccagcucaccaccgug

SEQ ID NO: 45901 - RNA, 30 nt, Artificial Sequence
  Protein FAM179B (401-410)
aaccugcucgacgacagcaacuucaaggug

SEQ ID NO: 45902 - RNA, 30 nt, Artificial Sequence
  FERM domain-containing protein 5 (46-55)
aaccugcucgagaaggacuacuucggcauc

SEQ ID NO: 45903 - RNA, 27 nt, Artificial Sequence
  Plexin-B3 (1375-1383)
aaccugcucaacagcaagcuguuccug

SEQ ID NO: 45904 - RNA, 27 nt, Artificial Sequence
  Vacuolar protein sorting-associated protein 53 homolog (176-184)
aaccugcuccagggcgugaugaacguc

SEQ ID NO: 45905 - RNA, 27 nt, Artificial Sequence
  Transcription factor SOX-6 (265-273)
aaccugcuccagcagcagauccaggug

SEQ ID NO: 45906 - RNA, 33 nt, Artificial Sequence
  Putative segment polarity protein dishevelled homolog DVL1P1 (257-267)
aaccugaacagcggcuccagcgggaccuccgac

SEQ ID NO: 45907 - RNA, 27 nt, Artificial Sequence
  Melanophilin (391-399)
aaccugcccaucuuccucccgcgcgug

SEQ ID NO: 45908 - RNA, 24 nt, Artificial Sequence
  CUB and sushi domain-containing protein 3 (2038-2045)
aaccugcccaucggcuucggggug

SEQ ID NO: 45909 - RNA, 27 nt, Artificial Sequence
  Krueppel-like factor 15 (273-281)
aaccugcccagcaaguucgugcgcauc

SEQ ID NO: 45910 - RNA, 30 nt, Artificial Sequence
  Clathrin heavy chain 1 (795-804)
aaccugcagaaguacaucgagaucuacgug

SEQ ID NO: 45911 - RNA, 33 nt, Artificial Sequence
  Histone-lysine N-methyltransferase, H3 lysine-79 specific (241-251)
aaccugagcgacaucggcaccaucaugcgcgug

SEQ ID NO: 45912 - RNA, 27 nt, Artificial Sequence
  Talin-1 (583-591)
aaccugaccgagaugagccgcggcgug

SEQ ID NO: 45913 - RNA, 27 nt, Artificial Sequence
  Cytoplasmic dynein 2 heavy chain 1 (271-279)
aaccugugggaggaccccuacuaccuc

SEQ ID NO: 45914 - RNA, 27 nt, Artificial Sequence
  Receptor-type tyrosine-protein phosphatase kappa (420-428)
aaccuguggaacagcacccaccacgug

SEQ ID NO: 45915 - RNA, 30 nt, Artificial Sequence
  Contactin-associated protein-like 3B (1097-1106)
aacauggccgacggccagcugcaccaggug

SEQ ID NO: 45916 - RNA, 27 nt, Artificial Sequence
  Nucleolar pre-ribosomal-associated protein 1 (1538-1546)
aacauggacaaggugcccggcuucuac

SEQ ID NO: 45917 - RNA, 36 nt, Artificial Sequence
  Unconventional myosin-Va (131-142)
aacaugggcgacauggacccccacaucuucgccgug

SEQ ID NO: 45918 - RNA, 27 nt, Artificial Sequence
  Sodium-dependent proline transporter (134-142)
aacaugaucaucgccuacgugcuguuc

SEQ ID NO: 45919 - RNA, 27 nt, Artificial Sequence
  Striatin-interacting protein 2 (728-736)
aacaugaagaccaugagcgccaucuac

SEQ ID NO: 45920 - RNA, 27 nt, Artificial Sequence
  Laminin subunit gamma-1 (71-79)
aacaugcugaagcagcuccaggaggcc

SEQ ID NO: 45921 - RNA, 27 nt, Artificial Sequence
  UDP-glucose:glycoprotein glucosyltransferase 2 (920-928)
aacaugagcgacuucaucaugaaggug

SEQ ID NO: 45922 - RNA, 27 nt, Artificial Sequence
  Lysine-tRNA ligase (423-431)
aacaugguggaggagcuggagaaggcc

SEQ ID NO: 45923 - RNA, 27 nt, Artificial Sequence
  Tetratricopeptide repeat protein 28 (1500-1508)
aacauggugggcaugcugcaccagguc

SEQ ID NO: 45924 - RNA, 30 nt, Artificial Sequence
  Sodium/potassium-transporting ATPase subunit alpha-3 (166-175)
aacauggugccccagcaggcccuggucauc

SEQ ID NO: 45925 - RNA, 27 nt, Artificial Sequence
  Inositol 1,4,5-trisphosphate receptor type 1 (2083-2091)
aacaacgccagcaagcugcuccuggcc

SEQ ID NO: 45926 - RNA, 21 nt, Artificial Sequence
  F-box only protein 25 (151-157)
aacaacauccuguaccgcuuc

SEQ ID NO: 45927 - RNA, 24 nt, Artificial Sequence
  Keratin, type II cytoskeletal 1b (325-332)
aacaaccgcagccuggaccucgac

SEQ ID NO: 45928 - RNA, 48 nt, Artificial Sequence
  Filamin-A (2114-2129)
aaccccgccgaguucguggucaacaccagcaacgccggcgcgggggcc

SEQ ID NO: 45929 - RNA, 51 nt, Artificial Sequence
  Filamin-A (2114-2130)
aaccccgccgaguucguggucaacaccagcaacgccggcgcgggggcccug

SEQ ID NO: 45930 - RNA, 30 nt, Artificial Sequence
  Ras GTPase-activating-like protein IQGAP1 (1197-1206)
aaccccgccaucguggccccggacgcguuc

SEQ ID NO: 45931 - RNA, 27 nt, Artificial Sequence
  Leucine-rich repeat serine/threonine-protein kinase 2 (1842-1850)
aaccccgaccagccgcgccugaccauc

SEQ ID NO: 45932 - RNA, 45 nt, Artificial Sequence
  Calreticulin (296-310)
aaccccgaguacagcccggaccccuccaucuacgccuacgacaac

SEQ ID NO: 45933 - RNA, 42 nt, Artificial Sequence
  Cytochrome c oxidase subunit 6A1, mitochondrial (73-86)
aacccccacgugaacccgcugcccaccggcuacgaggacgag

SEQ ID NO: 45934 - RNA, 27 nt, Artificial Sequence
  Pre-mRNA-splicing factor ATP-dependent RNA helicase PRP16 (832-840)
aacccccgcaucggcauggacgcccug

SEQ ID NO: 45935 - RNA, 54 nt, Artificial Sequence
  E3 ubiquitin-protein ligase UBR4 (202-219)
aacccccgcaccguggccagccagccgaucuccacccagacgcuggucgagggc

SEQ ID NO: 45936 - RNA, 27 nt, Artificial Sequence
  Angiomotin (27-35)
aaccccagcgagaaccgcucccugcuc

SEQ ID NO: 45937 - RNA, 30 nt, Artificial Sequence
  E3 ubiquitin-protein ligase HERC2 (1771-1780)
aaccccagcggcccgucccuggggaccauc

SEQ ID NO: 45938 - RNA, 27 nt, Artificial Sequence
  Poly (ADP-ribose) polymerase 14 (87-95)
aaccccuacaacggcgggggccgcgug

SEQ ID NO: 45939 - RNA, 24 nt, Artificial Sequence
  Ceramide synthase 2 (123-130)
aaccaggaccgccccagccugcuc

SEQ ID NO: 45940 - RNA, 27 nt, Artificial Sequence
  Exosome complex exonuclease RRP44 (115-123)
aaccaggagaagcacuucuacaccuuc

SEQ ID NO: 45941 - RNA, 60 nt, Artificial Sequence
  Heterogeneous nuclear ribonucleoprotein A1-like 2 (148-167)
aaccagggcggguacggcgggagcuccagcuccagcuccuacggcagcgggcgccgguuc

SEQ ID NO: 45942 - RNA, 21 nt, Artificial Sequence
  Mid1-interacting protein 1 (8-14)
aaccagaagcacagccuguuc

SEQ ID NO: 45943 - RNA, 27 nt, Artificial Sequence
  Splicing factor U2AF 65 kDa subunit (348-356)
aaccagacccccgugacccugcagguc

SEQ ID NO: 45944 - RNA, 21 nt, Artificial Sequence
  DNA polymerase epsilon catalytic subunit A (1795-1801)
aaccaggugaugcacuucuac

SEQ ID NO: 45945 - RNA, 30 nt, Artificial Sequence
  Ankyrin repeat domain-containing protein 26 (77-86)
aaccgcaagcugaucccccgggagaaccuc

SEQ ID NO: 45946 - RNA, 24 nt, Artificial Sequence
  Myosin-9 (710-717)
aaccgcguggucuuccaggaguuc

SEQ ID NO: 45947 - RNA, 42 nt, Artificial Sequence
  Hemicentin-1 (685-698)
aacagcgccggcaccgacaagcagaacuccacccugcgcuac

SEQ ID NO: 45948 - RNA, 24 nt, Artificial Sequence
  Mitochondrial import inner membrane translocase subunit TIM50 (276-283)
aacagcgacgaccgcgugcugcuc

SEQ ID NO: 45949 - RNA, 36 nt, Artificial Sequence
  Cell adhesion molecule-related/down-regulated by oncogenes (944-955)
aacagccugggcuccgggggcaacguggggcccgcc

SEQ ID NO: 45950 - RNA, 30 nt, Artificial Sequence
  Protein phosphatase 1 regulatory subunit 12A (714-723)
aacagccuggugggcaucaccuccgccuac

SEQ ID NO: 45951 - RNA, 42 nt, Artificial Sequence
  Synaptotagmin-like protein 2 (277-290)
aacagcuccagcuccagcaccgacuccgagacccugcgcuac

SEQ ID NO: 45952 - RNA, 33 nt, Artificial Sequence
  ATP synthase subunit epsilon-like protein, mitochondrial (41-51)
aacagcgugaagaucgucaaggugaagaaggag

SEQ ID NO: 45953 - RNA, 39 nt, Artificial Sequence
  Ankyrin-2 (1558-1570)
aacaccgagccccugcaggagcgcaucagccacuccuac

SEQ ID NO: 45954 - RNA, 27 nt, Artificial Sequence
  GRB2-associated-binding protein 1 (88-96)
aacaccaucgaccgcaucuucuaccug

SEQ ID NO: 45955 - RNA, 33 nt, Artificial Sequence
  Microphthalmia-associated transcription factor (237-247)
aacacccugcccgugagcggcaaccucaucgac

SEQ ID NO: 45956 - RNA, 36 nt, Artificial Sequence
  Microphthalmia-associated transcription factor (90-101)
aacacccugcccgugagcggcaaccucaucgaccug

SEQ ID NO: 45957 - RNA, 27 nt, Artificial Sequence
  Multidrug and toxin extrusion protein 1 (136-144)
aacacccagcacauccugcuccuguuc

SEQ ID NO: 45958 - RNA, 30 nt, Artificial Sequence
  Hemicentin-1 (2932-2941)
aacacccagaucaccgacaucggccgcuac

SEQ ID NO: 45959 - RNA, 33 nt, Artificial Sequence
  Titin (6557-6567)
aacguggccggcgacgacgccugcagcgggauc

SEQ ID NO: 45960 - RNA, 27 nt, Artificial Sequence
  Rho guanine nucleotide exchange factor 2 (401-409)
aacguggacgagggcaucuaccagcug

SEQ ID NO: 45961 - RNA, 27 nt, Artificial Sequence
  Hemicentin-1 (3845-3853)
aacguggaccagaaccagaacagcuac

SEQ ID NO: 45962 - RNA, 27 nt, Artificial Sequence
  Serine/threonine-protein phosphatase PP1-beta catalytic subunit (7-15)
aacguggacagccugaucacccgccuc

SEQ ID NO: 45963 - RNA, 48 nt, Artificial Sequence
  Alpha-enolase (36-51)
aacgugggcgacgaggggggcuucgcccccaacauccuggagaacaag

SEQ ID NO: 45964 - RNA, 21 nt, Artificial Sequence
  tRNA (adenine(58)-N(1))-methyltransferase non-catalytic subunit TRM6 (56-62)
aacgugaucggccacagcuac

SEQ ID NO: 45965 - RNA, 81 nt, Artificial Sequence
  Heat shock-related 70 kDa protein 2 (197-223)
aacgugcugaucuucgaccucggcgggggcaccuucgacgucagcauccugaccaucgaggacgggaucuucgaggugaag

SEQ ID NO: 45966 - RNA, 48 nt, Artificial Sequence
  Heat shock 70 kDa protein 1-like (170-185)
aacgugcugcgcaucaucaacgagcccaccgccgccgcgaucgccuac

SEQ ID NO: 45967 - RNA, 51 nt, Artificial Sequence
  78 kDa glucose-regulated protein (176-192)
aacgugaugcgcaucaucaacgagcccaccgccgccgcgaucgccuacggc

SEQ ID NO: 45968 - RNA, 45 nt, Artificial Sequence
  Guanine nucleotide-binding protein G(i) subunit alpha-1 (331-345)
aacgugcaguucgucuucgacgccgugaccgacgugaucaucaag

SEQ ID NO: 45969 - RNA, 24 nt, Artificial Sequence
  Nuclease-sensitive element-binding protein 1 (67-74)
aacgugcgcaacggcuacggguuc

SEQ ID NO: 45970 - RNA, 27 nt, Artificial Sequence
  Receptor-type tyrosine-protein phosphatase kappa (1423-1431)
aacguggucgacguguuccacgccgug

SEQ ID NO: 45971 - RNA, 27 nt, Artificial Sequence
  Fidgetin-like protein 1 (81-89)
aacuacgccgagaacauccugacccuc

SEQ ID NO: 45972 - RNA, 21 nt, Artificial Sequence
  DNA-directed RNA polymerases I, II, and III subunit RPABC5 (61-67)
aacuacgccccccuggagaag

SEQ ID NO: 45973 - RNA, 27 nt, Artificial Sequence
  Melanoma-associated antigen 10 (167-175)
aacuacgaggaccacuucccccugcuc

SEQ ID NO: 45974 - RNA, 33 nt, Artificial Sequence
  Protein phosphatase Slingshot homolog 1 (196-206)
aacuacuuccccggcgggguggcccugaucugg

SEQ ID NO: 45975 - RNA, 27 nt, Artificial Sequence
  Transformation/transcription domain-associated protein (1707-1715)
aacuacggcgacaucgagcugcucuuc

SEQ ID NO: 45976 - RNA, 27 nt, Artificial Sequence
  Isocitrate dehydrogenase (NAD) subunit gamma, mitochondrial (298-306)
aacuacggccacguguacgccgucuuc

SEQ ID NO: 45977 - RNA, 27 nt, Artificial Sequence
  Lathosterol oxidase (239-247)
aacuacggccaguacuucacccugugg

SEQ ID NO: 45978 - RNA, 27 nt, Artificial Sequence
  Beta-Ala-His dipeptidase (489-497)
aacuacaucgagggcaccaagcuguuc

SEQ ID NO: 45979 - RNA, 27 nt, Artificial Sequence
  Procollagen-lysine,2-oxoglutarate 5-dioxygenase 1 (255-263)
aacuacaucccccgcuucuggaccuuc

SEQ ID NO: 45980 - RNA, 27 nt, Artificial Sequence
  Probable E3 ubiquitin-protein ligase HERC3 (467-475)
aacuacaucaccgccgcccugaagcuc

SEQ ID NO: 45981 - RNA, 21 nt, Artificial Sequence
  Heat shock protein HSP 90-beta (351-357)
aacuacaagaaguucuacgag

SEQ ID NO: 45982 - RNA, 27 nt, Artificial Sequence
  Heat shock protein HSP 90-beta (351-359)
aacuacaagaaguucuacgaggccuuc

SEQ ID NO: 45983 - RNA, 33 nt, Artificial Sequence
  Muskelin (29-39)
aacuaccccccgcaguaccugauccucaagcug

SEQ ID NO: 45984 - RNA, 27 nt, Artificial Sequence
  Pleckstrin homology domain-containing family G member 2 (150-158)
aacuaccccagcucccuggcccuccug

SEQ ID NO: 45985 - RNA, 33 nt, Artificial Sequence
  DNA polymerase zeta catalytic subunit (1024-1034)
aacuacagcgacgugauguccaagcugggcuuc

SEQ ID NO: 45986 - RNA, 27 nt, Artificial Sequence
  Transmembraneoprotein NMB (275-283)
aacuacagcaccaucaacuacaagugg

SEQ ID NO: 45987 - RNA, 27 nt, Artificial Sequence
  1,2-dihydroxy-3-keto-5-methylthiopentene dioxygenase (141-149)
aacuacaccaaggccaugcgccuguuc

SEQ ID NO: 45988 - RNA, 30 nt, Artificial Sequence
  HLA class II histocompatibility antigen, DR alpha chain (103-112)
aacuacacccccaucaccaacgacaaguuc

SEQ ID NO: 45989 - RNA, 27 nt, Artificial Sequence
  DNA-dependent protein kinase catalytic subunit (289-297)
aacuacgugagccuguucgagguccuc

SEQ ID NO: 45990 - RNA, 27 nt, Artificial Sequence
  Polycystin-1 (3-11)
cccgccgccccggcgcgccuggcccuc

SEQ ID NO: 45991 - RNA, 24 nt, Artificial Sequence
  Exportin-T (609-616)
cccgccgagcgcaagcaggcccug

SEQ ID NO: 45992 - RNA, 36 nt, Artificial Sequence
  Collagen alpha-1(V) chain (1145-1156)
cccgccggcccgguggggccccccggcgaggacggg

SEQ ID NO: 45993 - RNA, 24 nt, Artificial Sequence
  tRNA pseudouridine synthase-like 1 (273-280)
cccgcccacggccuguuccucaag

SEQ ID NO: 45994 - RNA, 24 nt, Artificial Sequence
  Sushi repeat-containing protein SRPX (4-11)
cccgcccaccgcccggcccugcuc

SEQ ID NO: 45995 - RNA, 39 nt, Artificial Sequence
  Syntenin-1 (29-41)
cccgccauccugagcgaggccuccgcgccgaucccccac

SEQ ID NO: 45996 - RNA, 24 nt, Artificial Sequence
  Acetolactate synthase-like protein (225-232)
cccgccaagccgcccaagggccug

SEQ ID NO: 45997 - RNA, 27 nt, Artificial Sequence
  Calmodulin-regulated spectrin-associated protein 3 (958-966)
cccgccccggccgcgcgcgcccccgcc

SEQ ID NO: 45998 - RNA, 27 nt, Artificial Sequence
  Tissue factor pathway inhibitor 2 (3-11)
cccgcccgcccgcugggccucagcauc

SEQ ID NO: 45999 - RNA, 21 nt, Artificial Sequence
  Phosphoinositide 3-kinase regulatory subunit 5 (495-501)
cccgccagccgcccgcagcgg

SEQ ID NO: 46000 - RNA, 27 nt, Artificial Sequence
  m7GpppX diphosphatase (134-142)
cccgccaccgagaagcaccugcagaag

SEQ ID NO: 46001 - RNA, 36 nt, Artificial Sequence
  Nardilysin (738-749)
cccgccuacgaggccgacguggcgcagcuggaguac

SEQ ID NO: 46002 - RNA, 27 nt, Artificial Sequence
  Lysosome-associated membraneoprotein 1 (250-258)
cccgacgcccgcgacccggccuucaag

SEQ ID NO: 46003 - RNA, 21 nt, Artificial Sequence
  Uncharacterized protein C14orf119 (123-129)
cccgacuucguggccaaguuc

SEQ ID NO: 46004 - RNA, 24 nt, Artificial Sequence
  RNA-binding protein 12B (29-36)
cccgacggcggggugcacaucauc

SEQ ID NO: 46005 - RNA, 21 nt, Artificial Sequence
  Thyroid transcription factor 1-associated protein 26 (90-96)
cccgacaaccugaagcaccuc

SEQ ID NO: 46006 - RNA, 24 nt, Artificial Sequence
  Tubulin beta-6 chain (95-102)
cccgaccgcaucaugaacaccuuc

SEQ ID NO: 46007 - RNA, 36 nt, Artificial Sequence
  SH3 and multiple ankyrin repeat domains protein 1 (980-991)
cccgacaccccggcccccgccaccccccugcccccg

SEQ ID NO: 46008 - RNA, 30 nt, Artificial Sequence
  Copper-transporting ATPase 1 (1234-1243)
cccgaggccgagcuggccauccacauccuc

SEQ ID NO: 46009 - RNA, 45 nt, Artificial Sequence
  Putative endoplasmin-like protein (220-234)
cccgaguucgacggcaagcgcuuccagaacguggccaaggagggg

SEQ ID NO: 46010 - RNA, 33 nt, Artificial Sequence
  Fatty acid synthase (753-763)
cccgagcacgccgugguccuggagaucgccccg

SEQ ID NO: 46011 - RNA, 24 nt, Artificial Sequence
  Proteasome-associated protein ECM29 homolog (684-691)
cccgagaagcuggccaccaaguuc

SEQ ID NO: 46012 - RNA, 21 nt, Artificial Sequence
  Serine/threonine-protein kinase ULK3 (110-116)
cccgagaagguggcccgcguc

SEQ ID NO: 46013 - RNA, 33 nt, Artificial Sequence
  Alsin (1431-1441)
cccgagcugccggaggagggcagcaccaucccc

SEQ ID NO: 46014 - RNA, 30 nt, Artificial Sequence
  Serine/arginine repetitive matrix protein 2 (361-370)
cccgagccgcccgcccccaccccccugcuc

SEQ ID NO: 46015 - RNA, 36 nt, Artificial Sequence
  Homeobox protein SIX5 (88-99)
cccgagcagguggccugcgucugcgaggcccugcuc

SEQ ID NO: 46016 - RNA, 30 nt, Artificial Sequence
  Putative exonuclease GOR (33-42)
cccgagcgcccgggcggggccgugcuguuc

SEQ ID NO: 46017 - RNA, 72 nt, Artificial Sequence
  Neutral alpha-glucosidase AB (824-847)
cccgagaccagcgugcugguccuccgcaagccgggcaucaacguggccuccgacuggagcauccaccugcgg

SEQ ID NO: 46018 - RNA, 21 nt, Artificial Sequence
  Coatomer subunit alpha (635-641)
cccgagguggcccugcacuuc

SEQ ID NO: 46019 - RNA, 27 nt, Artificial Sequence
  Melanocyte protein PMEL (57-65)
cccgaguggaccgaggcccagcgccug

SEQ ID NO: 46020 - RNA, 42 nt, Artificial Sequence
  Calreticulin (297-310)
cccgaguacagcccggaccccuccaucuacgccuacgacaac

SEQ ID NO: 46021 - RNA, 24 nt, Artificial Sequence
  Tyrosine-protein phosphatase non-receptor type 11 (284-291)
cccuucgaccacacccgcgugguc

SEQ ID NO: 46022 - RNA, 24 nt, Artificial Sequence
  Polypyrimidine tract-binding protein 2 (92-99)
cccuucggcaaggugaccaacauc

SEQ ID NO: 46023 - RNA, 24 nt, Artificial Sequence
  Polypyrimidine tract-binding protein 3 (124-131)
cccuucggcaaggugaccaaccug

SEQ ID NO: 46024 - RNA, 30 nt, Artificial Sequence
  Uncharacterized protein KIAA0556 (546-555)
cccuuccacccgccccugcagcucuucuuc

SEQ ID NO: 46025 - RNA, 30 nt, Artificial Sequence
  Transmembrane and TPR repeat-containing protein 1 (393-402)
cccuucaucccggccagcaaccuguucuuc

SEQ ID NO: 46026 - RNA, 27 nt, Artificial Sequence
  Glycine dehydrogenase (decarboxylating), mitochondrial (778-786)
cccuuccugccgaaccaccccgugauc

SEQ ID NO: 46027 - RNA, 36 nt, Artificial Sequence
  Cytochrome c oxidase subunit 7C, mitochondrial (52-63)
cccuuccuggugguccgccaccagcuccugaagacc

SEQ ID NO: 46028 - RNA, 21 nt, Artificial Sequence
  Interferon-induced 35 kDa protein (53-59)
cccuucagcgugccgaagauc

SEQ ID NO: 46029 - RNA, 27 nt, Artificial Sequence
  U2 small nuclear ribonucleoprotein B'' (73-81)
cccuucuacggcaagccgaugcgcauc

SEQ ID NO: 46030 - RNA, 39 nt, Artificial Sequence
  SH2 domain-containing protein 3A (404-416)
cccggcgccgccggggaccugccgggccucgcggccgug

SEQ ID NO: 46031 - RNA, 30 nt, Artificial Sequence
  NADH dehydrogenase (ubiquinone) 1 beta subcomplex subunit 7 (126-135)
cccggcgagguggacccgaaggucgcccug

SEQ ID NO: 46032 - RNA, 48 nt, Artificial Sequence
  Heat shock cognate 71 kDa protein (622-637)
cccggcggguucccgggcgggggcgccccccccagcgggggcgccucc

SEQ ID NO: 46033 - RNA, 39 nt, Artificial Sequence
  Shadow of prion protein (108-120)
cccggcgggaacggcaccgggccgggcaucuacagcuac

SEQ ID NO: 46034 - RNA, 24 nt, Artificial Sequence
  HLA class II histocompatibility antigen, DR beta 5 chain (7-14)
cccggcgggagcuacauggccaag

SEQ ID NO: 46035 - RNA, 24 nt, Artificial Sequence
  BAG family molecular chaperone regulator 3 (334-341)
cccggccacaucccgauccaggug

SEQ ID NO: 46036 - RNA, 54 nt, Artificial Sequence
  Collagen alpha-5(IV) chain (1035-1052)
cccggcccgcaggggguggagggcccccccgggcccagcggcgucccggggcag

SEQ ID NO: 46037 - RNA, 24 nt, Artificial Sequence
  Adenomatous polyposis coli protein 2 (1191-1198)
cccggcccgcgcgccaccccccgg

SEQ ID NO: 46038 - RNA, 27 nt, Artificial Sequence
  Mucin-5B (364-372)
cccggcaccgccccgccccccaaggug

SEQ ID NO: 46039 - RNA, 60 nt, Artificial Sequence
  Elastin (116-135)
cccggcguggggggccugggggucagcgccggcgccguggugccgcagcccggggcgggc

SEQ ID NO: 46040 - RNA, 21 nt, Artificial Sequence
  Mitochondrial import inner membrane translocase subunit TIM50 (216-222)
ccccacggcuucaucagcuac

SEQ ID NO: 46041 - RNA, 18 nt, Artificial Sequence
  BolA-like protein 2 (65-70)
ccccacauccacgccuuc

SEQ ID NO: 46042 - RNA, 24 nt, Artificial Sequence
  ATP synthase subunit d, mitochondrial (130-137)
ccccaccagccgaucgagaaccug

SEQ ID NO: 46043 - RNA, 24 nt, Artificial Sequence
  Dolichyl-diphosphooligosaccharide-proteinosyltransferase subunit 2 (292-299)
ccccaccagaccuucgugcgccug

SEQ ID NO: 46044 - RNA, 60 nt, Artificial Sequence
  Syndecan-3 (6-25)
ccccaccgcgccggcgccgcgcacggggccggcgccggggccggcgccgcggccgggccg

SEQ ID NO: 46045 - RNA, 39 nt, Artificial Sequence
  Cytochrome c oxidase subunit 6A1, mitochondrial (74-86)
ccccacgugaacccgcugcccaccggcuacgaggacgag

SEQ ID NO: 46046 - RNA, 21 nt, Artificial Sequence
  BAG family molecular chaperone regulator 3 (292-298)
cccauccgcgugcacaccguc

SEQ ID NO: 46047 - RNA, 24 nt, Artificial Sequence
  Major facilitator superfamily domain-containing protein 12 (309-316)
cccaagaaguucaucgccaccauc

SEQ ID NO: 46048 - RNA, 63 nt, Artificial Sequence
  MICOS complex subunit MIC27 (248-268)
cccaagcugauggaccacggccagagccacccggaggacaucgacauguacuccacccgcagc

SEQ ID NO: 46049 - RNA, 21 nt, Artificial Sequence
  40S ribosomal protein S26 (65-71)
cccaagcuguacgugaagcuc

SEQ ID NO: 46050 - RNA, 24 nt, Artificial Sequence
  26S proteasome non-ATPase regulatory subunit 6 (12-19)
cccaagaacccggaccugcgcauc

SEQ ID NO: 46051 - RNA, 24 nt, Artificial Sequence
  Ran-binding protein 9 (351-358)
cccaagcagccgccccuggcccuc

SEQ ID NO: 46052 - RNA, 24 nt, Artificial Sequence
  High mobility group protein B1 (95-102)
cccaagcgcccgcccagcgccuuc

SEQ ID NO: 46053 - RNA, 36 nt, Artificial Sequence
  Ras-associated and pleckstrin homology domains-containing protein 1 (1085-1096)
cccaagguggccgucgugaacccgcagccccagcag

SEQ ID NO: 46054 - RNA, 42 nt, Artificial Sequence
  Annexin A2 (211-224)
cccaaguggaucagcaucaugaccgagcgcuccgugccgcac

SEQ ID NO: 46055 - RNA, 24 nt, Artificial Sequence
  Guanine nucleotide-binding protein-like 3 (296-303)
ccccuggacaagcagaucaccauc

SEQ ID NO: 46056 - RNA, 30 nt, Artificial Sequence
  MAX gene-associated protein (2401-2410)
ccccuguucagcggcccgguggucgccgug

SEQ ID NO: 46057 - RNA, 21 nt, Artificial Sequence
  A-kinase anchor protein 6 (596-602)
ccccugcucagcaagcacaag

SEQ ID NO: 46058 - RNA, 21 nt, Artificial Sequence
  Ubiquitin carboxyl-terminal hydrolase 11 (444-450)
ccccugccgaucagccacaag

SEQ ID NO: 46059 - RNA, 30 nt, Artificial Sequence
  Protein transport protein Sec23B (244-253)
ccccugcgcagcaccggcguggcccucucc

SEQ ID NO: 46060 - RNA, 21 nt, Artificial Sequence
  Muskelin (629-635)
ccccugagcgcccucaaguac

SEQ ID NO: 46061 - RNA, 24 nt, Artificial Sequence
  X-ray repair cross-complementing protein 5 (529-536)
ccccugagcaagaucaagacccuc

SEQ ID NO: 46062 - RNA, 27 nt, Artificial Sequence
  HLA class I histocompatibility antigen, B-15 alpha chain (293-301)
ccccugacccuccgcugggagccgagc

SEQ ID NO: 46063 - RNA, 63 nt, Artificial Sequence
  60 kDa heat shock protein, mitochondrial (154-174)
ccccuggugaucaucgccgaggacgucgacggcgaggcccucagcacccuggugcugaaccgc

SEQ ID NO: 46064 - RNA, 27 nt, Artificial Sequence
  Protein DBF4 homolog A (45-53)
ccccuguggggcaagguguucuaccuc

SEQ ID NO: 46065 - RNA, 27 nt, Artificial Sequence
  Extracellular matrix protein FRAS1 (1653-1661)
cccauggccaccggcgacaccuucacg

SEQ ID NO: 46066 - RNA, 24 nt, Artificial Sequence
  Alpha/beta hydrolase domain-containing protein 14B (204-211)
cccaaccaccgcgugcugaucaug

SEQ ID NO: 46067 - RNA, 24 nt, Artificial Sequence
  Ubiquitin-associated protein 2-like (269-276)
cccccggcccccuucaugcacauc

SEQ ID NO: 46068 - RNA, 27 nt, Artificial Sequence
  Transforming acidic coiled-coil-containing protein 2 (1969-1977)
cccccggcccccccccccccgcccccc

SEQ ID NO: 46069 - RNA, 30 nt, Artificial Sequence
  Rho GTPase-activating protein 33 (668-677)
cccccggccgugcuggagcuccugggcgcc

SEQ ID NO: 46070 - RNA, 48 nt, Artificial Sequence
  Transmembrane protein 238 (14-29)
cccccgggcgcccccagcgcccccgcggccgcccccgccccggccgcg

SEQ ID NO: 46071 - RNA, 36 nt, Artificial Sequence
  Homeobox protein SIX5 (441-452)
cccccgggccccgugcccgccgucgccgcgccccag

SEQ ID NO: 46072 - RNA, 36 nt, Artificial Sequence
  Collagen alpha-1(VII) chain (2384-2395)
cccccgggcgugaagggggaccugggccuccccggg

SEQ ID NO: 46073 - RNA, 27 nt, Artificial Sequence
  Mitochondrial fission regulator 1 (151-159)
cccccgcaccccccccccccgcccccc

SEQ ID NO: 46074 - RNA, 21 nt, Artificial Sequence
  Sentrin-specific protease 6 (157-163)
cccccgcacgugcagaagguc

SEQ ID NO: 46075 - RNA, 30 nt, Artificial Sequence
  CCR4-NOT transcription complex subunit 1 (574-583)
cccccgaucaccaccacgaccaccagcacc

SEQ ID NO: 46076 - RNA, 21 nt, Artificial Sequence
  Cyclin E variant ex7del (21-27)
cccccgaagcugcaccaguuc

SEQ ID NO: 46077 - RNA, 27 nt, Artificial Sequence
  Drebrin (365-373)
cccccgcugcccccccccccgcccccc

SEQ ID NO: 46078 - RNA, 42 nt, Artificial Sequence
  Tuberin (1264-1277)
cccccgcugccccgcagcaacaccguggccuccuucagcucc

SEQ ID NO: 46079 - RNA, 27 nt, Artificial Sequence
  Multiple epidermal growth factor-like domains protein 8 (2528-2536)
cccccgcccgccccccccccgcccccc

SEQ ID NO: 46080 - RNA, 27 nt, Artificial Sequence
  Shootin-1 (299-307)
cccccgccccugccccccccgcccccc

SEQ ID NO: 46081 - RNA, 39 nt, Artificial Sequence
  Serine/threonine-protein kinase WNK2 (136-148)
cccccgcccagcgacaugggcaccguggggggccaggcc

SEQ ID NO: 46082 - RNA, 42 nt, Artificial Sequence
  Retinoic acid-induced protein 1 (1033-1046)
cccccgcagggccagauggagggggccggcgcccccgggcgc

SEQ ID NO: 46083 - RNA, 27 nt, Artificial Sequence
  Retrotransposon-derived protein PEG10 (765-773)
cccccgcagcccccccccccgcccccc

SEQ ID NO: 46084 - RNA, 27 nt, Artificial Sequence
  Acrosin (110-118)
cccccgagccccccccccccgcccccc

SEQ ID NO: 46085 - RNA, 27 nt, Artificial Sequence
  Transcription factor SOX-9 (356-364)
ccccaggccccgccccagccccaggcc

SEQ ID NO: 46086 - RNA, 21 nt, Artificial Sequence
  Protein transport protein Sec23B (562-568)
ccccaguucauguuccaccug

SEQ ID NO: 46087 - RNA, 27 nt, Artificial Sequence
  Squalene monooxygenase (366-374)
ccccagaucccggaccaccugaaggag

SEQ ID NO: 46088 - RNA, 33 nt, Artificial Sequence
  Histone-lysine N-methyltransferase 2C (2512-2522)
ccccagcugcgccggagcguguccgucgacaug

SEQ ID NO: 46089 - RNA, 27 nt, Artificial Sequence
  Disintegrin and metalloproteinase domain-containing protein 18 (67-75)
ccccagaacuuccugguguacaccuac

SEQ ID NO: 46090 - RNA, 27 nt, Artificial Sequence
  Retrotransposon-derived protein PEG10 (766-774)
ccccagccgcccccccccccgcccccc

SEQ ID NO: 46091 - RNA, 39 nt, Artificial Sequence
  Serum albumin (440-452)
ccccaggugagcaccccgacccuggucgaggugucccgc

SEQ ID NO: 46092 - RNA, 24 nt, Artificial Sequence
  Neural Wiskott-Aldrich syndrome protein (83-90)
ccccgcggcuacuuccacaccuuc

SEQ ID NO: 46093 - RNA, 30 nt, Artificial Sequence
  60S ribosomal protein L13 (48-57)
ccccgcccggccagcggccccauccggccc

SEQ ID NO: 46094 - RNA, 24 nt, Artificial Sequence
  Histone H2A deubiquitinase MYSM1 (447-454)
ccccgcccgaccaagagcuccuuc

SEQ ID NO: 46095 - RNA, 24 nt, Artificial Sequence
  ATP-dependent RNA helicase DDX24 (200-207)
ccccgcccggugcugcgggcccuc

SEQ ID NO: 46096 - RNA, 24 nt, Artificial Sequence
  Splicing factor 3B subunit 3 (431-438)
ccccgcagcucccugcgggugcuc

SEQ ID NO: 46097 - RNA, 24 nt, Artificial Sequence
  Ankyrin repeat and KH domain-containing protein 1 (749-756)
ccccgcgugccgacccacacccug

SEQ ID NO: 46098 - RNA, 42 nt, Artificial Sequence
  AT-rich interactive domain-containing protein 1A (279-292)
cccagcgccgccggcgggggcaccccgcagcccaccgcgacg

SEQ ID NO: 46099 - RNA, 27 nt, Artificial Sequence
  Large proline-rich protein BAG6 (53-61)
cccagcgagaagcagcgccugaucuac

SEQ ID NO: 46100 - RNA, 33 nt, Artificial Sequence
  Ankyrin-2 (1035-1045)
cccagcggcgcccaguuccuggggccggugauc

SEQ ID NO: 46101 - RNA, 24 nt, Artificial Sequence
  Eukaryotic translation initiation factor 3 subunit C-like protein (204-211)
cccagcggcgagucccgcaaguuc

SEQ ID NO: 46102 - RNA, 27 nt, Artificial Sequence
  BAI1-associated protein 3 (124-132)
cccagccugggccuccgcgcccuggcc

SEQ ID NO: 46103 - RNA, 84 nt, Artificial Sequence
  Attractin (1008-1035)
cccagcaacaccggcaaggggaagugcaucgagggcuccuacaaggggccggugaagaugcccagccaggcccccaccggcaac

SEQ ID NO: 46104 - RNA, 54 nt, Artificial Sequence
  Zinc finger protein 469 (879-896)
cccagcuccggccacccgcugaagagcaaggccggggugacccccgaguccaag

SEQ ID NO: 46105 - RNA, 72 nt, Artificial Sequence
  Serine/threonine-protein kinase WNK1 (1547-1570)
cccagcuccagcuccagcccgggcgccgggguguccagcuacaucucccagcccggcgggcugcacccccuc

SEQ ID NO: 46106 - RNA, 36 nt, Artificial Sequence
  Fibronectin isoform 6 (769-780)
cccagcaccgccaccuccgugaacaucccggaccug

SEQ ID NO: 46107 - RNA, 21 nt, Artificial Sequence
  Transcription factor HES-1 (104-110)
cccagcgugcugggcaaguac

SEQ ID NO: 46108 - RNA, 24 nt, Artificial Sequence
  Basement membrane-specific heparan sulfate proteoglycan core protein (2626-2633)
cccagcguguccccgcccauccgc

SEQ ID NO: 46109 - RNA, 27 nt, Artificial Sequence
  Serine/threonine-protein kinase ICK (273-281)
cccaccgccagccaggcccugcgcuac

SEQ ID NO: 46110 - RNA, 27 nt, Artificial Sequence
  Myotubularin-related protein 14 (360-368)
cccaccgagauccuguaccucaccgug

SEQ ID NO: 46111 - RNA, 30 nt, Artificial Sequence
  Nicastrin (540-549)
cccaccaacaccacguacgugguccaguac

SEQ ID NO: 46112 - RNA, 21 nt, Artificial Sequence
  Sorting nexin-5 (259-265)
cccaccgugaucaagaaguac

SEQ ID NO: 46113 - RNA, 30 nt, Artificial Sequence
  Doublesex- and mab-3-related transcription factor A2 (25-34)
cccguggccagcgucgccuccguggcggcc

SEQ ID NO: 46114 - RNA, 27 nt, Artificial Sequence
  UPF0609 protein C4orf27 (230-238)
cccguggacaagaacgacgucggcuac

SEQ ID NO: 46115 - RNA, 27 nt, Artificial Sequence
  Hephaestin (425-433)
cccguggaccugcucaccggcaagguc

SEQ ID NO: 46116 - RNA, 33 nt, Artificial Sequence
  Single-stranded DNA-binding protein 3 (128-138)
cccgugccgcccggcgggagccgcuccaacuuc

SEQ ID NO: 46117 - RNA, 27 nt, Artificial Sequence
  Enolase-like protein ENO4 (194-202)
cccgugccgcccccccccccgcccccc

SEQ ID NO: 46118 - RNA, 27 nt, Artificial Sequence
  Obscurin (6294-6302)
cccguggucccgacccuguacgugacc

SEQ ID NO: 46119 - RNA, 24 nt, Artificial Sequence
  Matrin-3 (231-238)
cccuacggcaagaucaagaacuac

SEQ ID NO: 46120 - RNA, 30 nt, Artificial Sequence
  Alpha-actinin-4 (178-187)
cccuacaagaacgugaacguccagaacuuc

SEQ ID NO: 46121 - RNA, 27 nt, Artificial Sequence
  Dedicator of cytokinesis protein 7 (627-635)
cccuaccuggacaaguucuucgcccuc

SEQ ID NO: 46122 - RNA, 27 nt, Artificial Sequence
  Dedicator of cytokinesis protein 6 (722-730)
cccuaccuggacaaguucuucacccuc

SEQ ID NO: 46123 - RNA, 27 nt, Artificial Sequence
  Eukaryotic peptide chain release factor GTP-binding subunit ERF3A (285-293)
cccuaccuggacaaccucccgaacuuc

SEQ ID NO: 46124 - RNA, 27 nt, Artificial Sequence
  Melanoma antigen preferentially expressed in tumors (254-262)
cccuaccugggccagaugaucaaccuc

SEQ ID NO: 46125 - RNA, 27 nt, Artificial Sequence
  Elongation of very long chain fatty acids protein 5 (194-202)
cccuaccugugguggaagaaguacauc

SEQ ID NO: 46126 - RNA, 33 nt, Artificial Sequence
  Tubulin beta-6 chain (117-127)
cccuacaacgccacccugagcgugcaccagcuc

SEQ ID NO: 46127 - RNA, 24 nt, Artificial Sequence
  LYR motif-containing protein 1 (80-87)
cccuacccgcgccccauccaccug

SEQ ID NO: 46128 - RNA, 27 nt, Artificial Sequence
  Cubilin (2661-2669)
cccuacagccagguguggauccacuuc

SEQ ID NO: 46129 - RNA, 36 nt, Artificial Sequence
  Pumilio homolog 1 (440-451)
cccuacaccgccggccuggccgcggccgccacccuc

SEQ ID NO: 46130 - RNA, 27 nt, Artificial Sequence
  Serine/threonine-protein kinase Nek6 (236-244)
cccuacuacaugagcccggagcgcauc

SEQ ID NO: 46131 - RNA, 24 nt, Artificial Sequence
  Progestin and adipoQ receptor family member 4 (113-120)
caggccgccgcgcgccugcucgug

SEQ ID NO: 46132 - RNA, 48 nt, Artificial Sequence
  HLA class I histocompatibility antigen, B-15 alpha chain (346-361)
caggccgccagcuccgacagcgcgcagggcuccgacgugagccugacc

SEQ ID NO: 46133 - RNA, 60 nt, Artificial Sequence
  HLA class I histocompatibility antigen, A-23 alpha chain (346-365)
caggccgccagcuccgacagcgcgcagggcuccgacgugagccugaccgccugcaagguc

SEQ ID NO: 46134 - RNA, 27 nt, Artificial Sequence
  Nuclear distribution protein nudE-like 1 (66-74)
caggccgacaaccagcgccugaaguac

SEQ ID NO: 46135 - RNA, 42 nt, Artificial Sequence
  Glycogenin-1 (2-15)
caggccuucgugacccugaccacgaacgacgccuacgcgaag

SEQ ID NO: 46136 - RNA, 39 nt, Artificial Sequence
  CREB-binding protein (405-417)
caggccauccugggcagccccgccuccgggauccagaac

SEQ ID NO: 46137 - RNA, 30 nt, Artificial Sequence
  Scavenger receptor cysteine-rich type 1 protein M160 (412-421)
caggcccugguggucugcaagcagcucggc

SEQ ID NO: 46138 - RNA, 27 nt, Artificial Sequence
  Myelin basic protein (108-116)
caggacgagaaccccgugguccacuuc

SEQ ID NO: 46139 - RNA, 21 nt, Artificial Sequence
  Clathrin heavy chain 1 (723-729)
caggaccccgacgugcacuuc

SEQ ID NO: 46140 - RNA, 27 nt, Artificial Sequence
  Fatty acid synthase (1595-1603)
caggacagccugcucggcauggaguuc

SEQ ID NO: 46141 - RNA, 27 nt, Artificial Sequence
  Stathmin-3 (88-96)
caggaggcccaggugcugaagcagcuc

SEQ ID NO: 46142 - RNA, 33 nt, Artificial Sequence
  Formin-1 (1099-1109)
caggaggacgagcuggugaagauccgcaaguac

SEQ ID NO: 46143 - RNA, 27 nt, Artificial Sequence
  WD repeat-containing protein 26 (508-516)
caggaggaccaccccaucaugagcuuc

SEQ ID NO: 46144 - RNA, 33 nt, Artificial Sequence
  Large proline-rich protein BAG6 (1111-1121)
caggaggaccccaacuacagcccgcagcgcuuc

SEQ ID NO: 46145 - RNA, 27 nt, Artificial Sequence
  Vigilin (1012-1020)
caggaggaccgcgcccugcggagcuuc

SEQ ID NO: 46146 - RNA, 36 nt, Artificial Sequence
  Nestin (502-513)
caggaggaggagggcagcgcccugaagaccuccugg

SEQ ID NO: 46147 - RNA, 27 nt, Artificial Sequence
  DNA (cytosine-5)-methyltransferase 3A (426-434)
caggaguucgaccccccgaagguguac

SEQ ID NO: 46148 - RNA, 30 nt, Artificial Sequence
  AT-rich interactive domain-containing protein 1B (1797-1806)
caggaguucaacagcggccugcuccacugg

SEQ ID NO: 46149 - RNA, 27 nt, Artificial Sequence
  Hemicentin-1 (1703-1711)
caggagaucgaccgcggccaguacauc

SEQ ID NO: 46150 - RNA, 21 nt, Artificial Sequence
  Annexin A2 (141-147)
caggagaucaaccgcguguac

SEQ ID NO: 46151 - RNA, 30 nt, Artificial Sequence
  Mitogen-activated protein kinase kinase kinase kinase 5 (802-811)
caggagaucagcgacgagacccgcguguuc

SEQ ID NO: 46152 - RNA, 27 nt, Artificial Sequence
  Serine-protein kinase ATM (95-103)
caggagaucagcucccuggugaaguac

SEQ ID NO: 46153 - RNA, 39 nt, Artificial Sequence
  Desmoglein-2 (903-915)
caggagaucgugaccgagcgcagcgucuccagccggcag

SEQ ID NO: 46154 - RNA, 30 nt, Artificial Sequence
  Synemin (16-25)
caggagcugaacgcccgccucuacgacuac

SEQ ID NO: 46155 - RNA, 36 nt, Artificial Sequence
  Nestin (337-348)
caggagcugccccagagcgccgacgugcagcgcugg

SEQ ID NO: 46156 - RNA, 27 nt, Artificial Sequence
  Receptor-interacting serine/threonine-protein kinase 4 (597-605)
caggagaacaucgugcgcauccugcuc

SEQ ID NO: 46157 - RNA, 27 nt, Artificial Sequence
  TSC22 domain family protein 1 (93-101)
caggagaacaaccugcucaagacccug

SEQ ID NO: 46158 - RNA, 30 nt, Artificial Sequence
  Protein flightless-1 homolog (1024-1033)
caggagaaccccaaguuccugagccacuuc

SEQ ID NO: 46159 - RNA, 30 nt, Artificial Sequence
  RNA-binding motif, single-stranded-interacting protein 3 (126-135)
caggagcaggaccccaccaaccuguacauc

SEQ ID NO: 46160 - RNA, 33 nt, Artificial Sequence
  T-complex protein 1 subunit theta (20-30)
caggagcaggaggugggcgacgggaccaacuuc

SEQ ID NO: 46161 - RNA, 27 nt, Artificial Sequence
  ETS translocation variant 1 (65-73)
caggagcagcccuucaaguucagcuac

SEQ ID NO: 46162 - RNA, 27 nt, Artificial Sequence
  Nucleolar complex protein 2 homolog (188-196)
caggagagcgccgaggccaacaaguuc

SEQ ID NO: 46163 - RNA, 30 nt, Artificial Sequence
  Protein transport protein Sec24D (86-95)
caggagagccaguccgugauccacaaccug

SEQ ID NO: 46164 - RNA, 30 nt, Artificial Sequence
  Ankycorbin (839-848)
caggaggugaacgagcugcuccagaaguuc

SEQ ID NO: 46165 - RNA, 24 nt, Artificial Sequence
  Up-regulated during skeletal muscle growth protein 5 (11-18)
caguucaccggcaucaagaaguac

SEQ ID NO: 46166 - RNA, 30 nt, Artificial Sequence
  Proprotein convertase subtilisin/kexin type 7 (93-102)
cagggccacuaccuguucgugcagcccgcc

SEQ ID NO: 46167 - RNA, 18 nt, Artificial Sequence
  All-trans-retinol 13,14-reductase (57-62)
cagggcauccacuacauc

SEQ ID NO: 46168 - RNA, 33 nt, Artificial Sequence
  Serine/threonine-protein phosphatase 1 regulatory subunit 10 (572-582)
cagggccccgggggcgggggcaucaacgugcag

SEQ ID NO: 46169 - RNA, 36 nt, Artificial Sequence
  HLA class I histocompatibility antigen, A-23 alpha chain (354-365)
cagggcagcgacgugucccugaccgccugcaagguc

SEQ ID NO: 46170 - RNA, 30 nt, Artificial Sequence
  Fibronectin isoform 6 (1715-1724)
cagggcguggucaccacccuggagaacgug

SEQ ID NO: 46171 - RNA, 57 nt, Artificial Sequence
  Heterogeneous nuclear ribonucleoprotein L (52-70)
cagcacggcgggggcgggggcgggggcggcggggccggcgccgcggggggcgggggc

SEQ ID NO: 46172 - RNA, 66 nt, Artificial Sequence
  Splicing factor, proline- and glutamine-rich (246-267)
cagcaccaccccccguaccaccagcagcaccaccagggccccccccccgggggcccggggggccgc

SEQ ID NO: 46173 - RNA, 39 nt, Artificial Sequence
  Dynein heavy chain 8, axonemal (2665-2677)
cagcacaaggccgugcugcucaccggcgagcaggggacc

SEQ ID NO: 46174 - RNA, 33 nt, Artificial Sequence
  Synaptic vesicle membrane protein VAT-1 homolog (26-36)
cagcaccccgccgccagcgagggcgcggccgcc

SEQ ID NO: 46175 - RNA, 39 nt, Artificial Sequence
  Band 4.1-like protein 2 (54-66)
cagaucgacggcggggccggcggggacagcggcacccug

SEQ ID NO: 46176 - RNA, 24 nt, Artificial Sequence
  60S ribosomal protein L26 (66-73)
cagaucggcaaggugguccaggug

SEQ ID NO: 46177 - RNA, 27 nt, Artificial Sequence
  Cytoskeleton-associated protein 5 (1667-1675)
cagauccuggaccaccucaccaugauc

SEQ ID NO: 46178 - RNA, 27 nt, Artificial Sequence
  DNA-dependent protein kinase catalytic subunit (865-873)
cagaucaacaagaaccugcucaccgug

SEQ ID NO: 46179 - RNA, 51 nt, Artificial Sequence
  Transmembraneoprotein NMB (370-386)
cagaucaaccgcuacggccacuuccaggccaccaucaccaucguggagggg

SEQ ID NO: 46180 - RNA, 27 nt, Artificial Sequence
  Dehydrogenase/reductase SDR family member 2, mitochondrial (127-135)
cagaucugggacaagauccugagcgug

SEQ ID NO: 46181 - RNA, 36 nt, Artificial Sequence
  Nodal modulator 2 (399-410)
cagcuggccgacaucguggccaccggcuucagcguc

SEQ ID NO: 46182 - RNA, 27 nt, Artificial Sequence
  Laminin subunit alpha-4 (470-478)
cagcuggacgacuacaacgccaagcuc

SEQ ID NO: 46183 - RNA, 27 nt, Artificial Sequence
  Myotubularin-related protein 6 (229-237)
cagcuggacggcgaccccaaggaggug

SEQ ID NO: 46184 - RNA, 27 nt, Artificial Sequence
  Circadian clock protein PASD1 (383-391)
cagcuggaggagcgcaccuggcuccug

SEQ ID NO: 46185 - RNA, 21 nt, Artificial Sequence
  ATP-dependent RNA helicase DHX8 (283-289)
cagcuggagggccuccgcaag

SEQ ID NO: 46186 - RNA, 27 nt, Artificial Sequence
  Erlin-2 (26-34)
cagcugggcgccguggucgccguggcg

SEQ ID NO: 46187 - RNA, 27 nt, Artificial Sequence
  Probable histidine-tRNA ligase, mitochondrial (60-68)
cagcugggcgacuuccucaucaaggug

SEQ ID NO: 46188 - RNA, 27 nt, Artificial Sequence
  Complement factor I (347-355)
cagcugggcgaccuccccuggcaggug

SEQ ID NO: 46189 - RNA, 27 nt, Artificial Sequence
  E3 ubiquitin-protein ligase TRIM63 (281-289)
cagcugaucaagagcaucguggaggcc

SEQ ID NO: 46190 - RNA, 27 nt, Artificial Sequence
  Class E basic helix-loop-helix protein 41 (161-169)
cagcugaucaaccaccuccacgccgug

SEQ ID NO: 46191 - RNA, 27 nt, Artificial Sequence
  E3 ubiquitin-protein ligase listerin (245-253)
cagcugauccccuucaucgacgccgug

SEQ ID NO: 46192 - RNA, 27 nt, Artificial Sequence
  Intron-binding protein aquarius (224-232)
cagcugauccagaaguucaucagcgug

SEQ ID NO: 46193 - RNA, 33 nt, Artificial Sequence
  Pleckstrin homology domain-containing family H member 1 (700-710)
cagcugaucagcgagaagaagaccuacuaccuc

SEQ ID NO: 46194 - RNA, 30 nt, Artificial Sequence
  WASH complex subunit 7 (254-263)
cagcugcucgacggcaugaucuuccaggcc

SEQ ID NO: 46195 - RNA, 33 nt, Artificial Sequence
  Transmembrane protein 209 (327-337)
cagcugcucgaccacauggacagcuggaccgcc

SEQ ID NO: 46196 - RNA, 27 nt, Artificial Sequence
  StAR-related lipid transfer protein 13 (922-930)
cagcugcucggcggggugcgcgccguc

SEQ ID NO: 46197 - RNA, 27 nt, Artificial Sequence
  Small subunit processome component 20 homolog (1596-1604)
cagcugauggagggcaaggugguccuc

SEQ ID NO: 46198 - RNA, 27 nt, Artificial Sequence
  Serine/threonine-protein kinase mTOR (66-74)
cagcugaaccaccacaucuucgagcuc

SEQ ID NO: 46199 - RNA, 33 nt, Artificial Sequence
  Liprin-alpha-2 (76-86)
cagcugaacagcgcccucccccaggacaucgag

SEQ ID NO: 46200 - RNA, 27 nt, Artificial Sequence
  Protein Shroom4 (1452-1460)
cagcugcaggacuaccagcacuucgug

SEQ ID NO: 46201 - RNA, 39 nt, Artificial Sequence
  Plectin (3123-3135)
cagcugagcaccggcgggaucguggaccccuccaagagc

SEQ ID NO: 46202 - RNA, 27 nt, Artificial Sequence
  Protein wntless homolog (517-525)
cagcugaccaccacgaucacccacgug

SEQ ID NO: 46203 - RNA, 27 nt, Artificial Sequence
  Chondroitin sulfate proteoglycan 4 (77-85)
cagcuguacagcggccgccuccaggug

SEQ ID NO: 46204 - RNA, 30 nt, Artificial Sequence
  Solute carrier family 12 member 6 (45-54)
cagaugggcaccuucauggggguguaccug

SEQ ID NO: 46205 - RNA, 27 nt, Artificial Sequence
  Synemin (724-732)
cagaugaucggcgacaucaucaaccug

SEQ ID NO: 46206 - RNA, 36 nt, Artificial Sequence
  DNA-dependent protein kinase catalytic subunit (947-958)
cagaugcccgagggcgggcagggcgccccgcccaug

SEQ ID NO: 46207 - RNA, 27 nt, Artificial Sequence
  Actin-like protein 6A (239-247)
cagaugcccaccgugcacuacgaguuc

SEQ ID NO: 46208 - RNA, 27 nt, Artificial Sequence
  Talin-1 (288-296)
cagaugagcgagaucgaggccaaggug

SEQ ID NO: 46209 - RNA, 36 nt, Artificial Sequence
  L-lactate dehydrogenase A chain (20-31)
cagaacaagaucaccguggucggcgugggggccgug

SEQ ID NO: 46210 - RNA, 27 nt, Artificial Sequence
  POU domain, class 2, transcription factor 1 (208-216)
cagcccgccaccccgacccgcacgauc

SEQ ID NO: 46211 - RNA, 27 nt, Artificial Sequence
  Integrin alpha-6 (55-63)
cagcccgaggacaagcgccugcuccug

SEQ ID NO: 46212 - RNA, 33 nt, Artificial Sequence
  Beta-2-microglobulin (88-98)
cagcccaagaucgugaagugggaccgcgacaug

SEQ ID NO: 46213 - RNA, 24 nt, Artificial Sequence
  Potassium voltage-gated channel subfamily H member 2 (335-342)
cagccccuggccguggucgaccuc

SEQ ID NO: 46214 - RNA, 33 nt, Artificial Sequence
  Histone-lysine N-methyltransferase 2A (3086-3096)
cagccccuguacgugcuccagacccugccgaac

SEQ ID NO: 46215 - RNA, 27 nt, Artificial Sequence
  Rho GTPase-activating protein 31 (988-996)
cagccccaggccccgcgccgggagauc

SEQ ID NO: 46216 - RNA, 27 nt, Artificial Sequence
  Tribbles homolog 1 (15-23)
cagccccgcggcccggcccugcucuuc

SEQ ID NO: 46217 - RNA, 30 nt, Artificial Sequence
  Transcription intermediary factor 1-alpha (611-620)
cagccccgcccgcccagcaaccggaccgug

SEQ ID NO: 46218 - RNA, 27 nt, Artificial Sequence
  DNA-directed RNA polymerase II subunit RPB3 (6-14)
cagcccaccgugcgcaucaccgagcug

SEQ ID NO: 46219 - RNA, 36 nt, Artificial Sequence
  Guanine nucleotide exchange factor VAV3 (393-404)
cagcccgugcugcucuucggccgcccgcagggggac

SEQ ID NO: 46220 - RNA, 24 nt, Artificial Sequence
  Dual specificity protein kinase CLK3 (230-237)
cagcccuacccgcugccccacgug

SEQ ID NO: 46221 - RNA, 60 nt, Artificial Sequence
  CCR4-NOT transcription complex subunit 1 (48-67)
cagcagggcauccugaagaccgacgaccucaucacccgcuucuuccggcugugcacggag

SEQ ID NO: 46222 - RNA, 27 nt, Artificial Sequence
  Tetratricopeptide repeat protein 37 (642-650)
cagcagauccugggcaaguacaaggag

SEQ ID NO: 46223 - RNA, 24 nt, Artificial Sequence
  Eukaryotic initiation factor 4A-I (114-121)
cagcagauccagaagguggucaug

SEQ ID NO: 46224 - RNA, 27 nt, Artificial Sequence
  Pyridoxal kinase (30-38)
cagcagaacccccgccugguguacguc

SEQ ID NO: 46225 - RNA, 24 nt, Artificial Sequence
  Titin (12085-12092)
cagcgcgccgaggugguccccgug

SEQ ID NO: 46226 - RNA, 27 nt, Artificial Sequence
  Caprin-1 (666-674)
cagcgcgacggcuaccagcagaacuuc

SEQ ID NO: 46227 - RNA, 21 nt, Artificial Sequence
  Signal transducer and activator of transcription 6 (89-95)
cagcgcgacccccugaagcuc

SEQ ID NO: 46228 - RNA, 27 nt, Artificial Sequence
  Interleukin-24 (5-13)
cagcgccugcagagccucuggacccug

SEQ ID NO: 46229 - RNA, 27 nt, Artificial Sequence
  Tight junction protein ZO-1 (750-758)
cagcgcagcuccggcaucauccggcug

SEQ ID NO: 46230 - RNA, 27 nt, Artificial Sequence
  Mastermind-like protein 2 (349-357)
cagcgcagcaccccccggccgucccug

SEQ ID NO: 46231 - RNA, 27 nt, Artificial Sequence
  Polypyrimidine tract-binding protein 1 (384-392)
cagcgcgugaagauccuguucaacaag

SEQ ID NO: 46232 - RNA, 27 nt, Artificial Sequence
  KN motif and ankyrin repeat domain-containing protein 2 (79-87)
cagagcgagaucgccuccaugcuguac

SEQ ID NO: 46233 - RNA, 30 nt, Artificial Sequence
  Nuclear factor erythroid 2-related factor 2 (93-102)
cagagcgagaccuccggcagcgccaacuac

SEQ ID NO: 46234 - RNA, 21 nt, Artificial Sequence
  Golgin subfamily A member 4 (541-547)
cagagcgaguaccugaagauc

SEQ ID NO: 46235 - RNA, 30 nt, Artificial Sequence
  RNA-binding protein 27 (597-606)
cagagcggcggggccggcgaggacugccag

SEQ ID NO: 46236 - RNA, 33 nt, Artificial Sequence
  Heterogeneous nuclear ribonucleoprotein K (153-163)
cagagccuggccggcgggaucaucggcgugaag

SEQ ID NO: 46237 - RNA, 30 nt, Artificial Sequence
  Interphotoreceptor matrix proteoglycan 1 (289-298)
cagagccuggacgugggcaccauccaguuc

SEQ ID NO: 46238 - RNA, 27 nt, Artificial Sequence
  Hsc70-interacting protein (339-347)
cagagcaaccccaaggugaugaaccug

SEQ ID NO: 46239 - RNA, 27 nt, Artificial Sequence
  Hemicentin-1 (1877-1885)
cagagcuccggccgcgugcugcagauc

SEQ ID NO: 46240 - RNA, 27 nt, Artificial Sequence
  CUB and sushi domain-containing protein 3 (16-24)
cagaccgccagcggcuucaucuacacc

SEQ ID NO: 46241 - RNA, 27 nt, Artificial Sequence
  Nodal modulator 1 (450-458)
cagaccuucccccugaccgugacgaac

SEQ ID NO: 46242 - RNA, 36 nt, Artificial Sequence
  Receptor-type tyrosine-protein phosphatase delta (33-44)
cagaccggcgugagcgggggcgucgccuccuucauc

SEQ ID NO: 46243 - RNA, 27 nt, Artificial Sequence
  Ribosome maturation protein SBDS (52-60)
cagacccacagcguguucgucaacgug

SEQ ID NO: 46244 - RNA, 30 nt, Artificial Sequence
  Histone-lysine N-methyltransferase EHMT1 (170-179)
cagacccccgccgccccgcccgcgacccug

SEQ ID NO: 46245 - RNA, 21 nt, Artificial Sequence
  rRNA 2'-O-methyltransferase fibrillarin (239-245)
cagacccgcaucguggcccug

SEQ ID NO: 46246 - RNA, 33 nt, Artificial Sequence
  Protein FAM135A (647-657)
cagaccacccccagccugggcgugcgcacgauc

SEQ ID NO: 46247 - RNA, 30 nt, Artificial Sequence
  Catenin beta-1 (78-87)
cagguggccgacaucgacggccaguacgcc

SEQ ID NO: 46248 - RNA, 123 nt, Artificial Sequence
  E1A-binding protein p400 (51-91)
cagguggccagccugcgcgccgagcggaucgcgaaggagaagaaggcccucgccgaccagcagaaggcccagcagcccgccgucgcgcagccgccccccccccagccgcagcccccccccccg

SEQ ID NO: 46249 - RNA, 30 nt, Artificial Sequence
  Integrator complex subunit 1 (125-134)
cagguggccagccgcguccuggccaugaag

SEQ ID NO: 46250 - RNA, 27 nt, Artificial Sequence
  ATP-binding cassette sub-family A member 2 (2330-2338)
cagguguucagcaagauggagcagguc

SEQ ID NO: 46251 - RNA, 42 nt, Artificial Sequence
  Zinc finger protein 423 (1103-1116)
caggugggcgggcuggcccccccggagcccgccgaccgcccc

SEQ ID NO: 46252 - RNA, 30 nt, Artificial Sequence
  Transcription factor SOX-5 (88-97)
caggugcuggacggcaaggucgccguggug

SEQ ID NO: 46253 - RNA, 45 nt, Artificial Sequence
  T-complex protein 1 subunit beta (502-516)
caggugcugcucagcgccgccgaggcggccgaggucauccugcgc

SEQ ID NO: 46254 - RNA, 21 nt, Artificial Sequence
  Peptidyl-prolyl cis-trans isomerase FKBP9 (200-206)
caggugcagauccacaccuac

SEQ ID NO: 46255 - RNA, 63 nt, Artificial Sequence
  Poly(rC)-binding protein 2 (304-324)
caggugaccaucaccggcagcgccgccuccaucagccuggcgcaguaccucaucaacguccgc

SEQ ID NO: 46256 - RNA, 27 nt, Artificial Sequence
  Transcriptional regulator ATRX (1486-1494)
cagguggucagcuuccugcacaccgug

SEQ ID NO: 46257 - RNA, 27 nt, Artificial Sequence
  14-3-3 protein eta (46-54)
caguacgagagcaagguguucuaccug

SEQ ID NO: 46258 - RNA, 27 nt, Artificial Sequence
  TELO2-interacting protein 1 homolog (50-58)
caguacauccuguucccccuccgcuuc

SEQ ID NO: 46259 - RNA, 27 nt, Artificial Sequence
  Vam6/Vps39-like protein (296-304)
caguaccccaacccgcugcccgugcuc

SEQ ID NO: 46260 - RNA, 45 nt, Artificial Sequence
  Forkhead box protein D3 (302-316)
caguaccccuacgcccugccgcccguggcccccguccuccccccg

SEQ ID NO: 46261 - RNA, 27 nt, Artificial Sequence
  Spectrin beta chain, non-erythrocytic 1 (17-25)
caguacagcgacgugaacaaccgcugg

SEQ ID NO: 46262 - RNA, 30 nt, Artificial Sequence
  Ubiquitin-like modifier-activating enzyme 1 (717-726)
caguacagcaacaacauccgccagcugcuc

SEQ ID NO: 46263 - RNA, 30 nt, Artificial Sequence
  Golgin subfamily A member 4 (432-441)
cgcgccgccuucgaggagcuggagaaggcg

SEQ ID NO: 46264 - RNA, 27 nt, Artificial Sequence
  HDAC2 (27-35)
cgcgccuuccccgccccgcccccccug

SEQ ID NO: 46265 - RNA, 27 nt, Artificial Sequence
  Formin-like protein 2 (15-23)
cgcgcccacaacgugccccugaagcuc

SEQ ID NO: 46266 - RNA, 27 nt, Artificial Sequence
  Catenin beta-1 (151-159)
cgcgccauccccgagcugaccaagcuc

SEQ ID NO: 46267 - RNA, 33 nt, Artificial Sequence
  Fatty acid synthase (2352-2362)
cgcgccaagcugacccccggcugcgaggccgag

SEQ ID NO: 46268 - RNA, 27 nt, Artificial Sequence
  Junction plakoglobin (142-150)
cgcgcccugcccgagcucaccaagcug

SEQ ID NO: 46269 - RNA, 24 nt, Artificial Sequence
  Astrotactin-2 (360-367)
cgcgccaacacccccaucgagauc

SEQ ID NO: 46270 - RNA, 27 nt, Artificial Sequence
  Microtubule-associated protein 4 (356-364)
cgcgccagccccaucaagauggaccug

SEQ ID NO: 46271 - RNA, 27 nt, Artificial Sequence
  Protein scribble homolog (473-481)
cgcgccaccccccacccgagcgagcug

SEQ ID NO: 46272 - RNA, 33 nt, Artificial Sequence
  Perilipin-2 (230-240)
cgcgccuaccagcaggcccugagccgggugaag

SEQ ID NO: 46273 - RNA, 27 nt, Artificial Sequence
  Probable E3 ubiquitin-protein ligase HERC1 (2112-2120)
cgcgccuacagcggcaaccuguaccac

SEQ ID NO: 46274 - RNA, 27 nt, Artificial Sequence
  Fibronectin isoform 6 (1162-1170)
cgcgacgcccccaucgugaacaagguc

SEQ ID NO: 46275 - RNA, 51 nt, Artificial Sequence
  Vimentin (450-466)
cgcgacggccaggugaucaacgagaccagccagcaccacgacgaccuggag

SEQ ID NO: 46276 - RNA, 45 nt, Artificial Sequence
  Protein NipSnap homolog 2 (40-54)
cgcgaggacagcuggcugaagucccucuucgugcggaaggucgac

SEQ ID NO: 46277 - RNA, 33 nt, Artificial Sequence
  Vimentin (196-206)
cgcgaggaggccgagaacacccugcagagcuuc

SEQ ID NO: 46278 - RNA, 27 nt, Artificial Sequence
  Transcription elongation factor SPT5 (606-614)
cgcgagggcgagauccggcaccuguuc

SEQ ID NO: 46279 - RNA, 129 nt, Artificial Sequence
  Vimentin (258-300)
cgcgagaccaaccuggacagccucccccugguggacacccacuccaagcggacgcugcucaucaagaccgucgagacccgcgacggccaggugaucaacgagaccagccagcaccacgacgaccuggag

SEQ ID NO: 46280 - RNA, 24 nt, Artificial Sequence
  Myosin-7 (243-250)
cgcuucggcaaguucauccggauc

SEQ ID NO: 46281 - RNA, 36 nt, Artificial Sequence
  Protein YIF1B (85-96)
cgcuucauccccaucaccaagcugaaguacuacuuc

SEQ ID NO: 46282 - RNA, 33 nt, Artificial Sequence
  Filamin-A (2059-2069)
cgcuucaucccccgggagaacggcguguaccug

SEQ ID NO: 46283 - RNA, 27 nt, Artificial Sequence
  Uncharacterized protein C11orf96 (157-165)
cgcuucaagacccagcccgugaccuuc

SEQ ID NO: 46284 - RNA, 27 nt, Artificial Sequence
  Serine/threonine-protein phosphatase 2A 56 kDa regulatory subunit epsilon isoform (227-235)
cgcuucguguacgagaccgagcacuuc

SEQ ID NO: 46285 - RNA, 39 nt, Artificial Sequence
  NADH dehydrogenase (ubiquinone) 1 beta subcomplex subunit 5, mitochondrial (61-73)
cgcuucuacgaccggcgcuuccugaagcuccugcgguuc

SEQ ID NO: 46286 - RNA, 33 nt, Artificial Sequence
  Collagen alpha-2(I) chain (495-505)
cgcggcgcccccggggccgugggcgcgccgggg

SEQ ID NO: 46287 - RNA, 30 nt, Artificial Sequence
  Nuclear receptor corepressor 2 (1514-1523)
cgcggcgcccccgugaucgucccggagcug

SEQ ID NO: 46288 - RNA, 27 nt, Artificial Sequence
  Pre-mRNA-processing-splicing factor 8 (763-771)
cgcggcgccaccguggacaagaccguc

SEQ ID NO: 46289 - RNA, 30 nt, Artificial Sequence
  Inositol 1,4,5-trisphosphate receptor type 2 (1365-1374)
cgcggcgacgagagcgggccccuggccuac

SEQ ID NO: 46290 - RNA, 27 nt, Artificial Sequence
  Collagen alpha-2(V) chain (785-793)
cgcggcuucaccgggcugcagggccuc

SEQ ID NO: 46291 - RNA, 30 nt, Artificial Sequence
  Inactive phospholipase C-like protein 2 (6-15)
cgcggcggggccgccggcggggcgcugccc

SEQ ID NO: 46292 - RNA, 24 nt, Artificial Sequence
  Eukaryotic translation initiation factor 4 gamma 1 (993-1000)
cgcggcgggcccccgggccccccc

SEQ ID NO: 46293 - RNA, 33 nt, Artificial Sequence
  Plexin-B3 (190-200)
cgcggccuggccgggaagcucagcgccggcgug

SEQ ID NO: 46294 - RNA, 42 nt, Artificial Sequence
  Collagen alpha-1(III) chain (761-774)
cgcggccccaccgggccgaucggcccccccgggcccgccggc

SEQ ID NO: 46295 - RNA, 27 nt, Artificial Sequence
  Heat shock protein HSP 90-beta (103-111)
cgcggcaccaaggugauccugcaccuc

SEQ ID NO: 46296 - RNA, 27 nt, Artificial Sequence
  UDP-N-acetylhexosamine pyrophosphorylase-like protein 1 (111-119)
cgcggcguggaguucguccacguguac

SEQ ID NO: 46297 - RNA, 18 nt, Artificial Sequence
  Msx2-interacting protein (535-540)
cgccacuucugccgguac

SEQ ID NO: 46298 - RNA, 30 nt, Artificial Sequence
  Krueppel-like factor 15 (280-289)
cgcaucgcccccgugccgaucgccgcgaag

SEQ ID NO: 46299 - RNA, 30 nt, Artificial Sequence
  Phosphoglycerate kinase 1 (39-48)
cgcaucaaggccgccgugcccagcaucaag

SEQ ID NO: 46300 - RNA, 24 nt, Artificial Sequence
  General transcription factor II-I (492-499)
cgcaucaaguucgugaucaagcgg

SEQ ID NO: 46301 - RNA, 33 nt, Artificial Sequence
  Alpha-globin transcription factor CP2 (148-158)
cgcauccuggacaucgacauccccaugagcgug

SEQ ID NO: 46302 - RNA, 27 nt, Artificial Sequence
  Asparagine synthetase (glutamine-hydrolyzing) (153-161)
cgcauccuguucaacaacgccgugaag

SEQ ID NO: 46303 - RNA, 27 nt, Artificial Sequence
  Nuclear factor of activated T-cells, cytoplasmic 2 (247-255)
cgcauccugaagccccacgccuucuac

SEQ ID NO: 46304 - RNA, 30 nt, Artificial Sequence
  cAMP-dependent protein kinase type I-beta regulatory subunit (233-242)
cgcauccugaugggcagcacccuccggaag

SEQ ID NO: 46305 - RNA, 33 nt, Artificial Sequence
  CCR4-NOT transcription complex subunit 1 (238-248)
cgcauccugcccgacagcggcgggguggccaag

SEQ ID NO: 46306 - RNA, 27 nt, Artificial Sequence
  Centrin-2 (164-172)
cgcaucaugaagaagaccagccuguac

SEQ ID NO: 46307 - RNA, 30 nt, Artificial Sequence
  Transcription factor HES-1 (49-58)
cgcaucaacgagagccugucccagcucaag

SEQ ID NO: 46308 - RNA, 27 nt, Artificial Sequence
  Vigilin (291-299)
cgcaucaacauccccccgcccagcgug

SEQ ID NO: 46309 - RNA, 27 nt, Artificial Sequence
  Pumilio homolog 1 (920-928)
cgcauccggggccacgugcugagccuc

SEQ ID NO: 46310 - RNA, 27 nt, Artificial Sequence
  Proteasome subunit beta type-5 (76-84)
cgcaucagcggcgccaccuucuccgug

SEQ ID NO: 46311 - RNA, 33 nt, Artificial Sequence
  Cubilin (1911-1921)
cgcaucuacgacggccccagcauccacgcccgg

SEQ ID NO: 46312 - RNA, 27 nt, Artificial Sequence
  Centrosomal protein C10orf90 (654-662)
cgcaucuacgacaaccugcccgaggug

SEQ ID NO: 46313 - RNA, 39 nt, Artificial Sequence
  Probable phospholipid-transporting ATPase VB (153-165)
cgcaucuacgagcggaaggagcagaccuacgugcagaag

SEQ ID NO: 46314 - RNA, 81 nt, Artificial Sequence
  HLA class I histocompatibility antigen, A-23 alpha chain (339-365)
cgcaagggcgggagcuacucccaggccgccagcuccgacagcgcgcagggcuccgacgugagccugaccgccugcaagguc

SEQ ID NO: 46315 - RNA, 81 nt, Artificial Sequence
  HLA class I histocompatibility antigen, A-1 alpha chain (314-340)
cgcaagggcgggagcuacacccaggccgccuccagcgacuccgcgcagggcagcgacgugucccugaccgccugcaagguc

SEQ ID NO: 46316 - RNA, 27 nt, Artificial Sequence
  Ellis-van Creveld syndrome protein (396-404)
cgccuggccgccaucagccacggccuc

SEQ ID NO: 46317 - RNA, 27 nt, Artificial Sequence
  Interferon-induced protein with tetratricopeptide repeats 1 (110-118)
cgccuggccgaggcccagaccuaccuc

SEQ ID NO: 46318 - RNA, 27 nt, Artificial Sequence
  EMILIN-1 (205-213)
cgccuggccgaggacgugcagcgggcc

SEQ ID NO: 46319 - RNA, 27 nt, Artificial Sequence
  Periodic tryptophan protein 2 homolog (276-284)
cgccuggccaaguacuucuucaacaag

SEQ ID NO: 46320 - RNA, 27 nt, Artificial Sequence
  Keratin, type I cytoskeletal 24 (150-158)
cgccuggccaacuaccucgacaaggug

SEQ ID NO: 46321 - RNA, 27 nt, Artificial Sequence
  Histone-lysine N-methyltransferase 2D (2762-2770)
cgccuggcccccagcauggccauggug

SEQ ID NO: 46322 - RNA, 27 nt, Artificial Sequence
  Ankyrin-2 (1004-1012)
cgccuggccaccaugcccccgauggug

SEQ ID NO: 46323 - RNA, 30 nt, Artificial Sequence
  Coatomer subunit gamma-1 (208-217)
cgccuggccgugaacaagaugaucagcaag

SEQ ID NO: 46324 - RNA, 27 nt, Artificial Sequence
  Apolipoprotein E (246-254)
cgccuggacgaggugaaggagcagguc

SEQ ID NO: 46325 - RNA, 24 nt, Artificial Sequence
  Vimentin (217-224)
cgccuggaccucgagcggaaggug

SEQ ID NO: 46326 - RNA, 30 nt, Artificial Sequence
  Protein kinase C and casein kinase substrate in neurons protein 2 (468-477)
cgccuggacaacggccagguggggcucuac

SEQ ID NO: 46327 - RNA, 27 nt, Artificial Sequence
  Sestrin-3 (71-79)
cgccuggacaacaucacccaggugaug

SEQ ID NO: 46328 - RNA, 27 nt, Artificial Sequence
  Glutamine and serine-rich protein 1 (616-624)
cgccuggaggaccaggugaucggcguc

SEQ ID NO: 46329 - RNA, 27 nt, Artificial Sequence
  Myosin-10 (1407-1415)
cgccuggaggagaaggcccucgccuac

SEQ ID NO: 46330 - RNA, 33 nt, Artificial Sequence
  40S ribosomal protein S9 (9-19)
cgccuguucgagggcaacgcccuccugcggcgc

SEQ ID NO: 46331 - RNA, 27 nt, Artificial Sequence
  Spectrin beta chain, erythrocytic (38-46)
cgccuguucgagcggagccgcaucaag

SEQ ID NO: 46332 - RNA, 27 nt, Artificial Sequence
  Unconventional myosin-XVIIIa (821-829)
cgccuguuccacgagcggaccuucgug

SEQ ID NO: 46333 - RNA, 30 nt, Artificial Sequence
  Cytochrome P450 4V2 (390-399)
cgccuguuccccagcgugccgcucuucgcc

SEQ ID NO: 46334 - RNA, 27 nt, Artificial Sequence
  Mitogen-activated protein kinase-binding protein 1 (328-336)
cgccuguucagcggcguggccaacgcc

SEQ ID NO: 46335 - RNA, 27 nt, Artificial Sequence
  Cysteine andine-rich protein 2 (87-95)
cgccugggcaucaagcccgagagcgug

SEQ ID NO: 46336 - RNA, 24 nt, Artificial Sequence
  E3 ubiquitin-protein ligase HECTD1 (175-182)
cgccugggcgugaucagcaagguc

SEQ ID NO: 46337 - RNA, 27 nt, Artificial Sequence
  Protein fantom (56-64)
cgccugcacgacgagaacauccuccug

SEQ ID NO: 46338 - RNA, 30 nt, Artificial Sequence
  General transcription factor 3C polypeptide 1 (377-386)
cgccugaucgagagccucuucaccauccag

SEQ ID NO: 46339 - RNA, 27 nt, Artificial Sequence
  Heterogeneous nuclear ribonucleoprotein U-like protein 1 (490-498)
cgccugauccagaucgccgcccggaag

SEQ ID NO: 46340 - RNA, 27 nt, Artificial Sequence
  Cytochrome c oxidase subunit 2 (134-142)
cgccugcucgacguggacaaccggguc

SEQ ID NO: 46341 - RNA, 33 nt, Artificial Sequence
  Keratin, type I cytoskeletal 18 (324-334)
cgccugcucgaggacggcgaggacuucaaccug

SEQ ID NO: 46342 - RNA, 30 nt, Artificial Sequence
  Cytoplasmic FMR1-interacting protein 1 (113-122)
cgccugcucggcuaccaggggaucgccgug

SEQ ID NO: 46343 - RNA, 30 nt, Artificial Sequence
  Histone-lysine N-methyltransferase 2D (4468-4477)
cgccugcucaaccuggaccuggaccucugg

SEQ ID NO: 46344 - RNA, 33 nt, Artificial Sequence
  Homeobox protein Hox-B9 (220-230)
cgccugcucaaccugagcgagcggcaggugaag

SEQ ID NO: 46345 - RNA, 27 nt, Artificial Sequence
  Apolipoprotein C-II (4-12)
cgccugcuccccgcccuguuccuggug

SEQ ID NO: 46346 - RNA, 30 nt, Artificial Sequence
  Syndecan-3 (138-147)
cgccugcucccccugccgcugaccaccgug

SEQ ID NO: 46347 - RNA, 39 nt, Artificial Sequence
  Long-chain fatty acid transport protein 1 (273-285)
cgccugcucccccagguggacaccaccggcacguucaag

SEQ ID NO: 46348 - RNA, 27 nt, Artificial Sequence
  Muskelin (14-22)
cgccugcuccccuacgcccugcacaag

SEQ ID NO: 46349 - RNA, 27 nt, Artificial Sequence
  Regulator of G-protein signaling 12 (718-726)
cgccugcuccaggaccccgugggcguc

SEQ ID NO: 46350 - RNA, 33 nt, Artificial Sequence
  G2/mitotic-specific cyclin-B1 (217-227)
cgccugcuccaggagaccauguacaugaccgug

SEQ ID NO: 46351 - RNA, 33 nt, Artificial Sequence
  Interleukin-24 (90-100)
cgccugcuccagcaggaggugcugcagaacguc

SEQ ID NO: 46352 - RNA, 27 nt, Artificial Sequence
  Unconventional myosin-Ic (138-146)
cgccugcuccagagcaaccccgugcug

SEQ ID NO: 46353 - RNA, 30 nt, Artificial Sequence
  AP-1 complex subunit beta-1 (528-537)
cgccugcucagcaccgaccccguggccgcc

SEQ ID NO: 46354 - RNA, 27 nt, Artificial Sequence
  Neurochondrin (561-569)
cgccugcucagcaccucccccgcccug

SEQ ID NO: 46355 - RNA, 30 nt, Artificial Sequence
  Bombesin receptor-activated protein C6orf89 (119-128)
cgccugaugagccuccccaucgccaagaag

SEQ ID NO: 46356 - RNA, 27 nt, Artificial Sequence
  Cytochrome c oxidase subunit 2 (178-186)
cgccugaaccagaccaccuucacggcc

SEQ ID NO: 46357 - RNA, 27 nt, Artificial Sequence
  Lysosome-associated membraneoprotein 2 (273-281)
cgccugaacagcuccaccaucaaguac

SEQ ID NO: 46358 - RNA, 27 nt, Artificial Sequence
  Lysosomal thioesterase PPT2 (8-16)
cgccugcccgccgccugggugcuccug

SEQ ID NO: 46359 - RNA, 30 nt, Artificial Sequence
  Protein scribble homolog (257-266)
cgccugcccgacggcaucgggcagcucaag

SEQ ID NO: 46360 - RNA, 27 nt, Artificial Sequence
  Neuron navigator 2 (921-929)
cgccugcccgacggcauggccgugguc

SEQ ID NO: 46361 - RNA, 30 nt, Artificial Sequence
  Lysine-specific demethylase 5B (1280-1289)
cgccugcccgagggcgacgcccuccgguac

SEQ ID NO: 46362 - RNA, 33 nt, Artificial Sequence
  Transformation/transcription domain-associated protein (696-706)
cgccugcccgagaugggcagcaacguggagcuc

SEQ ID NO: 46363 - RNA, 27 nt, Artificial Sequence
  Probable E3 ubiquitin-protein ligase HERC6 (578-586)
cgccugcccgagaacaccuucaacauc

SEQ ID NO: 46364 - RNA, 27 nt, Artificial Sequence
  WD repeat-containing protein 90 (1359-1367)
cgccugcccgagccggugcacggcguc

SEQ ID NO: 46365 - RNA, 33 nt, Artificial Sequence
  YrdC domain-containing protein, mitochondrial (48-58)
cgccugcccggcagcggggccgugcaggccgcg

SEQ ID NO: 46366 - RNA, 33 nt, Artificial Sequence
  Insulin receptor substrate 2 (1043-1053)
cgccugcccccggccagcgccguggcgaccgcc

SEQ ID NO: 46367 - RNA, 27 nt, Artificial Sequence
  Zinc finger BED domain-containing protein 6 (445-453)
cgccugcccagcgagaccuacuucuuc

SEQ ID NO: 46368 - RNA, 27 nt, Artificial Sequence
  DNA-dependent protein kinase catalytic subunit (2530-2538)
cgccugcccagcaacacccucgaccgg

SEQ ID NO: 46369 - RNA, 27 nt, Artificial Sequence
  T-cell immunomodulatory protein (6-14)
cgccugcccagcuccugggcccucuuc

SEQ ID NO: 46370 - RNA, 30 nt, Artificial Sequence
  Peroxisome proliferator-activated receptor gamma coactivator-related protein 1 (1096-1105)
cgccugcaggcccccgagcucgccaacgug

SEQ ID NO: 46371 - RNA, 27 nt, Artificial Sequence
  DNA-dependent protein kinase catalytic subunit (14-22)
cgccugcaggagacccucagcgccgcc

SEQ ID NO: 46372 - RNA, 27 nt, Artificial Sequence
  DNA ligase 3 (740-748)
cgccugcagaacgagcucgacauggug

SEQ ID NO: 46373 - RNA, 33 nt, Artificial Sequence
  2'-5'-oligoadenylate synthase 3 (18-28)
cgccugcagccccggaaggaguucguggagaag

SEQ ID NO: 46374 - RNA, 27 nt, Artificial Sequence
  Plectin (2433-2441)
cgccugcgggaggccaucgccgagcuc

SEQ ID NO: 46375 - RNA, 27 nt, Artificial Sequence
  Tripeptidyl-peptidase 1 (60-68)
cgccugagcgagcucgugcaggccguc

SEQ ID NO: 46376 - RNA, 27 nt, Artificial Sequence
  Desumoylating isopeptidase 1 (23-31)
cgccugagccccaucaugcucggcaag

SEQ ID NO: 46377 - RNA, 27 nt, Artificial Sequence
  GCN1 general control of amino-acid synthesis 1-like 1 (2013-2021)
cgccugaccagcgccgacgcccuccgg

SEQ ID NO: 46378 - RNA, 36 nt, Artificial Sequence
  Melanoma antigen preferentially expressed in tumors (25-36)
cgccugguggagcucgccggccagagccugcugaag

SEQ ID NO: 46379 - RNA, 24 nt, Artificial Sequence
  Lysophosphatidic acid phosphatase type 6 (9-16)
cgccuguggacccccgugggcguc

SEQ ID NO: 46380 - RNA, 33 nt, Artificial Sequence
  Tubulin-specific chaperone C (217-227)
cgccuguacggcaaccccaacacccuccggcug

SEQ ID NO: 46381 - RNA, 30 nt, Artificial Sequence
  Tetratricopeptide repeat protein 30A (82-91)
cgccuguaccaggcccaggcccucuacaag

SEQ ID NO: 46382 - RNA, 27 nt, Artificial Sequence
  Protein asteroid homolog 1 (274-282)
cgccuguacagcggcucccucgugcac

SEQ ID NO: 46383 - RNA, 27 nt, Artificial Sequence
  Filamin-A (2280-2288)
cgccuguacagcguguccuaccuccug

SEQ ID NO: 46384 - RNA, 30 nt, Artificial Sequence
  Unconventional myosin-X (1476-1485)
cgccuguacaccaagcuccugaacgaggcc

SEQ ID NO: 46385 - RNA, 30 nt, Artificial Sequence
  Vimentin (13-22)
cgcauguucggcgggcccggcaccgccagc

SEQ ID NO: 46386 - RNA, 45 nt, Artificial Sequence
  Vimentin (13-27)
cgcauguucggcgggcccggcaccgccagccggccguccagcucc

SEQ ID NO: 46387 - RNA, 48 nt, Artificial Sequence
  Vimentin (13-28)
cgcauguucggcgggcccggcaccgccagccggccguccagcucccgc

SEQ ID NO: 46388 - RNA, 51 nt, Artificial Sequence
  Vimentin (13-29)
cgcauguucggcgggcccggcaccgccagccggccguccagcucccgcagc

SEQ ID NO: 46389 - RNA, 30 nt, Artificial Sequence
  Mitochondrial 2-oxoglutarate/malate carrier protein (240-249)
cgcaugaucgacggcaagcccgaguacaag

SEQ ID NO: 46390 - RNA, 42 nt, Artificial Sequence
  Spermine synthase (79-92)
cgcaugaaggagcugagccaggacuccaccggccgggugaag

SEQ ID NO: 46391 - RNA, 27 nt, Artificial Sequence
  Eukaryotic translation initiation factor 2 subunit 3 (352-360)
cgcauggugggccagguccugggggcc

SEQ ID NO: 46392 - RNA, 30 nt, Artificial Sequence
  tRNA (adenine(58)-N(1))-methyltransferase non-catalytic subunit TRM6 (197-206)
cgcaacgccgacggccugaucguggccagc

SEQ ID NO: 46393 - RNA, 27 nt, Artificial Sequence
  Probable global transcription activator SNF2L1 (166-174)
cgcaacauccccggcccgcacauggug

SEQ ID NO: 46394 - RNA, 27 nt, Artificial Sequence
  Melanocyte protein PMEL (241-249)
cgcaaccagccccugaccuucgcccuc

SEQ ID NO: 46395 - RNA, 96 nt, Artificial Sequence
  HLA class I histocompatibility antigen, A-23 alpha chain (334-365)
cgcaacagcuccgaccggaagggcgggagcuacucccaggccgccagcuccgacagcgcgcagggcuccgacgugagccugaccgccugcaagguc

SEQ ID NO: 46396 - RNA, 27 nt, Artificial Sequence
  Heterogeneous nuclear ribonucleoprotein K (37-45)
cgcaacaccgacgagaugguggagcug

SEQ ID NO: 46397 - RNA, 27 nt, Artificial Sequence
  V-type proton ATPase subunit D (136-144)
cgcaacuacgccaaggccguggagcug

SEQ ID NO: 46398 - RNA, 30 nt, Artificial Sequence
  Fibronectin isoform 6 (1712-1721)
cgccccgcccagggcguggucaccacccug

SEQ ID NO: 46399 - RNA, 27 nt, Artificial Sequence
  Putative inactive carbonic anhydrase 5B-like protein (84-92)
cgccccgcccagaagcacugggugcug

SEQ ID NO: 46400 - RNA, 27 nt, Artificial Sequence
  Glycosylated lysosomal membrane protein (121-129)
cgccccgcccagccgccccggcugcuc

SEQ ID NO: 46401 - RNA, 27 nt, Artificial Sequence
  Chondroitin sulfate synthase 2 (384-392)
cgccccgccagccgguucgaggugcug

SEQ ID NO: 46402 - RNA, 24 nt, Artificial Sequence
  L-dopachrome tautomerase (266-273)
cgccccgacgacccgacccugauc

SEQ ID NO: 46403 - RNA, 27 nt, Artificial Sequence
  Cancer/testis antigen 2 (82-90)
cgccccgacagccggcugcuccagcug

SEQ ID NO: 46404 - RNA, 45 nt, Artificial Sequence
  Titin (9911-9925)
cgccccggcccgcccguggggcccaucaaguucgagagcgucucc

SEQ ID NO: 46405 - RNA, 63 nt, Artificial Sequence
  Glia-derived nexin (58-78)
cgcccccacgacaacaucgugaucagcccgcacggcaucgccuccguccuggggaugcuccag

SEQ ID NO: 46406 - RNA, 51 nt, Artificial Sequence
  Collagen alpha-2(I) chain (949-965)
cgccccaaggacuacgagguggacgccacccugaagagccucaacaaccag

SEQ ID NO: 46407 - RNA, 27 nt, Artificial Sequence
  6-phosphofructo-2-kinase/fructose-2,6-bisphosphatase 2 (486-494)
cgcccccugaagccgcucagcccccug

SEQ ID NO: 46408 - RNA, 30 nt, Artificial Sequence
  Protein transport protein Sec23A (259-268)
cgcccccugcggagcuccggcguggcccuc

SEQ ID NO: 46409 - RNA, 27 nt, Artificial Sequence
  VPS10 domain-containing receptor SorCS1 (1153-1161)
cgccccaacgugccgcagaccgagcug

SEQ ID NO: 46410 - RNA, 21 nt, Artificial Sequence
  40S ribosomal protein S26 (109-115)
cgccccccgcccaagcccaug

SEQ ID NO: 46411 - RNA, 30 nt, Artificial Sequence
  Dystonin (1741-1750)
cgcccccaggagggcgggcggaucacccug

SEQ ID NO: 46412 - RNA, 24 nt, Artificial Sequence
  Kelch-like protein 20 (247-254)
cgcccccagcugccgcaggugcuc

SEQ ID NO: 46413 - RNA, 24 nt, Artificial Sequence
  Renin receptor (59-66)
cgcccccgggccaccgugaugguc

SEQ ID NO: 46414 - RNA, 27 nt, Artificial Sequence
  UPF0524 protein C3orf70 (87-95)
cgcccccgggagccgaccaacaccauc

SEQ ID NO: 46415 - RNA, 27 nt, Artificial Sequence
  Thiosulfate sulfurtransferase/rhodanese-like domain-containing protein 2 (485-493)
cgcccccggaucccgcgcgagcugcuc

SEQ ID NO: 46416 - RNA, 27 nt, Artificial Sequence
  Homocysteine-responsive endoplasmic reticulum-resident ubiquitin-like domain member 1 protein (48-56)
cgcccccggccggaggaccagcgccug

SEQ ID NO: 46417 - RNA, 27 nt, Artificial Sequence
  Transmembraneoprotein NMB (331-339)
cgccccagcaagccgacccccucccug

SEQ ID NO: 46418 - RNA, 27 nt, Artificial Sequence
  Rho GTPase-activating protein 7 (565-573)
cgccccagccugaacuccgugagccuc

SEQ ID NO: 46419 - RNA, 27 nt, Artificial Sequence
  Vimentin (45-53)
cgccccagcaccucccggagccuguac

SEQ ID NO: 46420 - RNA, 30 nt, Artificial Sequence
  Vimentin (45-54)
cgccccagcaccucccggagccuguacgcc

SEQ ID NO: 46421 - RNA, 24 nt, Artificial Sequence
  Kinase D-interacting substrate of 220 kDa (97-104)
cgccccagcgugaagaccucccug

SEQ ID NO: 46422 - RNA, 27 nt, Artificial Sequence
  Integrin beta-5 (445-453)
cgccccgugggcuuccgggacagccug

SEQ ID NO: 46423 - RNA, 27 nt, Artificial Sequence
  Dual specificity protein phosphatase 6 (6-14)
cgccccgugccguucgccagcgagaug

SEQ ID NO: 46424 - RNA, 27 nt, Artificial Sequence
  L-dopachrome tautomerase (69-77)
cgccccuggagcggcccguacauccug

SEQ ID NO: 46425 - RNA, 27 nt, Artificial Sequence
  Mannosyl-oligosaccharide 1,2-alpha-mannosidase IB (132-140)
cgccaggccgagaaguacuacauccug

SEQ ID NO: 46426 - RNA, 27 nt, Artificial Sequence
  V-type proton ATPase subunit H (132-140)
cgccaggaccccuucaccgugcacaug

SEQ ID NO: 46427 - RNA, 27 nt, Artificial Sequence
  Dol-P-Man:Man(5)GlcNAc(2)-PP-Dol alpha-1,3-mannosyltransferase (218-226)
cgccaguuccuguuccacuggaccgug

SEQ ID NO: 46428 - RNA, 39 nt, Artificial Sequence
  Cohesin subunit SA-1 (249-261)
cgccaguacgaggccgagcggaacaagaugaucggcaag

SEQ ID NO: 46429 - RNA, 27 nt, Artificial Sequence
  X-ray repair cross-complementing protein 5 (431-439)
cgccaguacauguucagcucccugaag

SEQ ID NO: 46430 - RNA, 21 nt, Artificial Sequence
  HLA class II histocompatibility antigen, DQ alpha 1 chain (55-61)
cgccgguucgacccccaguuc

SEQ ID NO: 46431 - RNA, 27 nt, Artificial Sequence
  HLA class II histocompatibility antigen, DQ alpha 1 chain (55-63)
cgccgguucgacccccaguucgcccug

SEQ ID NO: 46432 - RNA, 30 nt, Artificial Sequence
  HLA class II histocompatibility antigen, DQ alpha 1 chain (55-64)
cgccgguucgacccccaguucgcccugacc

SEQ ID NO: 46433 - RNA, 27 nt, Artificial Sequence
  Inosine-5'-monophosphate dehydrogenase 2 (355-363)
cgccgguucggcgugcccgucaucgcc

SEQ ID NO: 46434 - RNA, 27 nt, Artificial Sequence
  Basement membrane-specific heparan sulfate proteoglycan core protein (587-595)
cgccgguuccuggugcacgacagcuuc

SEQ ID NO: 46435 - RNA, 30 nt, Artificial Sequence
  C-1-tetrahydrofolate synthase, cytoplasmic (487-496)
cgccgguucagcgacauccagauccgccgg

SEQ ID NO: 46436 - RNA, 21 nt, Artificial Sequence
  PDZ domain-containing protein 2 (308-314)
cgccgguucagcaagggcggg

SEQ ID NO: 46437 - RNA, 27 nt, Artificial Sequence
  Casein kinase I isoform alpha (106-114)
cgccgguucaccaugaagaccgugcug

SEQ ID NO: 46438 - RNA, 24 nt, Artificial Sequence
  Cytochrome c oxidase subunit 7C, mitochondrial (7-14)
cgccgguucaccaccagcgugguc

SEQ ID NO: 46439 - RNA, 24 nt, Artificial Sequence
  Acyl-CoA desaturase (174-181)
cgccggggcuucuucuucagccac

SEQ ID NO: 46440 - RNA, 111 nt, Artificial Sequence
  Growth arrest-specific protein 6 (314-350)
cgccggggcccccgcccguggcaggacauccugcccugcgugcccuucagcgucgccaaguccgugaagagccucuaccuggggcggauguucuccggcacccccgugauc

SEQ ID NO: 46441 - RNA, 27 nt, Artificial Sequence
  Homeobox protein Hox-A4 (244-252)
cgccggaucgagaucgcccacacccug

SEQ ID NO: 46442 - RNA, 27 nt, Artificial Sequence
  WD repeat-containing protein 6 (233-241)
cgccggaucagcggccacguggggauc

SEQ ID NO: 46443 - RNA, 27 nt, Artificial Sequence
  Protein kinase C-binding protein 1 (354-362)
cgccggaaguucggcguguucaacuac

SEQ ID NO: 46444 - RNA, 27 nt, Artificial Sequence
  Hemicentin-1 (827-835)
cgccggcuggacaacaugcccaucuuc

SEQ ID NO: 46445 - RNA, 30 nt, Artificial Sequence
  Hemicentin-1 (827-836)
cgccggcuggacaacaugcccaucuucagc

SEQ ID NO: 46446 - RNA, 33 nt, Artificial Sequence
  Hemicentin-1 (827-837)
cgccggcuggacaacaugcccaucuucagccgc

SEQ ID NO: 46447 - RNA, 27 nt, Artificial Sequence
  Golgi resident protein GCP60 (73-81)
cgccggcuggagcagcgcuggggcuuc

SEQ ID NO: 46448 - RNA, 27 nt, Artificial Sequence
  N-alpha-acetyltransferase 10 (82-90)
cgccggcugggccucgcccagaagcug

SEQ ID NO: 46449 - RNA, 27 nt, Artificial Sequence
  Caldesmon (347-355)
cgccggcugaaggaggagaucgagcgc

SEQ ID NO: 46450 - RNA, 30 nt, Artificial Sequence
  Glyoxylate reductase/hydroxypyruvate reductase (170-179)
cgccggcugaagcccuucggcgugcagcgc

SEQ ID NO: 46451 - RNA, 27 nt, Artificial Sequence
  Ubiquitin-conjugating enzyme E2 variant 3 (9-17)
cgccggcugcucggcaaguacaaguuc

SEQ ID NO: 46452 - RNA, 30 nt, Artificial Sequence
  L-dopachrome tautomerase (529-538)
cgccggcugcgcaagggcuacaccccccuc

SEQ ID NO: 46453 - RNA, 39 nt, Artificial Sequence
  Vimentin (12-24)
cgccggauguucggcgggcccggcaccgccagccgcccg

SEQ ID NO: 46454 - RNA, 48 nt, Artificial Sequence
  Vimentin (12-27)
cgccggauguucggcgggcccggcaccgccagccgcccguccagcucc

SEQ ID NO: 46455 - RNA, 54 nt, Artificial Sequence
  Vimentin (12-29)
cgccggauguucggcgggcccggcaccgccagccgcccguccagcucccggagc

SEQ ID NO: 46456 - RNA, 27 nt, Artificial Sequence
  G-protein coupled receptor 143 (256-264)
cgccggaugggcgccgugaucaagauc

SEQ ID NO: 46457 - RNA, 27 nt, Artificial Sequence
  Polymerase I and transcript release factor (148-156)
cgccggaacuucaaggugaugaucuac

SEQ ID NO: 46458 - RNA, 99 nt, Artificial Sequence
  HLA class I histocompatibility antigen, A-23 alpha chain (333-365)
cgccggaacagcuccgaccgcaagggcgggagcuacucccaggccgccagcuccgacagcgcgcagggcuccgacgugagccugaccgccugcaagguc

SEQ ID NO: 46459 - RNA, 30 nt, Artificial Sequence
  Sodium/potassium-transporting ATPase subunit alpha-3 (943-952)
cgccggaacagcguguuccagcagggcaug

SEQ ID NO: 46460 - RNA, 27 nt, Artificial Sequence
  NADH dehydrogenase (ubiquinone) 1 alpha subcomplex subunit 13 (48-56)
cgccggcgccugcagaucgaggacuuc

SEQ ID NO: 46461 - RNA, 27 nt, Artificial Sequence
  Dual specificity protein phosphatase 4 (313-321)
cgccggagcaucaucucccccaacuuc

SEQ ID NO: 46462 - RNA, 27 nt, Artificial Sequence
  Hsp90 co-chaperone Cdc37 (166-174)
cgccggugggacgacagccagaaguac

SEQ ID NO: 46463 - RNA, 27 nt, Artificial Sequence
  Transmembraneoprotein NMB (169-177)
cgccgguggaacuucaucuacguguuc

SEQ ID NO: 46464 - RNA, 30 nt, Artificial Sequence
  Transmembraneoprotein NMB (169-178)
cgccgguggaacuucaucuacguguuccac

SEQ ID NO: 46465 - RNA, 27 nt, Artificial Sequence
  Eukaryotic translation initiation factor 3 subunit L (537-545)
cgccgguacggcgacuucuucauccgc

SEQ ID NO: 46466 - RNA, 24 nt, Artificial Sequence
  Eukaryotic initiation factor 4A-I (168-175)
cgccgguaccugagccccaaguac

SEQ ID NO: 46467 - RNA, 27 nt, Artificial Sequence
  Chondroitin sulfate glucuronyltransferase (416-424)
cgccgguaccagccccgccugcgguuc

SEQ ID NO: 46468 - RNA, 36 nt, Artificial Sequence
  60S ribosomal protein L6 (59-70)
cgcagcgccauguacucccggaaggccauguacaag

SEQ ID NO: 46469 - RNA, 27 nt, Artificial Sequence
  Krueppel-like factor 6 (250-258)
cgcagcgacgagcugacccggcacuuc

SEQ ID NO: 46470 - RNA, 27 nt, Artificial Sequence
  Synaptotagmin-like protein 2 (665-673)
cgcagcgaccccuacgugaaggccuac

SEQ ID NO: 46471 - RNA, 24 nt, Artificial Sequence
  Isoleucine-tRNA ligase, cytoplasmic (402-409)
cgcagcgacaccccccugaucuac

SEQ ID NO: 46472 - RNA, 27 nt, Artificial Sequence
  ETS homologous factor (209-217)
cgcagcgagggcguguuccgguuccug

SEQ ID NO: 46473 - RNA, 27 nt, Artificial Sequence
  Phosphatidylinositide phosphatase SAC2 (349-357)
cgcagcgagaaggagaccguggccuac

SEQ ID NO: 46474 - RNA, 60 nt, Artificial Sequence
  Keratin, type I cytoskeletal 9 (13-32)
cgcagcggcgggggcgggggcgggggccugggcuccgggggcagcauccgguccagcuac

SEQ ID NO: 46475 - RNA, 30 nt, Artificial Sequence
  Son of sevenless homolog 2 (593-602)
cgcagcggcauccccaucaucaaggggggc

SEQ ID NO: 46476 - RNA, 27 nt, Artificial Sequence
  Manganese-transporting ATPase 13A1 (667-675)
cgcagcaucgacggcuccaucgugcug

SEQ ID NO: 46477 - RNA, 27 nt, Artificial Sequence
  Basement membrane-specific heparan sulfate proteoglycan core protein (92-100)
cgcagcaucgaguacuccccccagcug

SEQ ID NO: 46478 - RNA, 27 nt, Artificial Sequence
  Fragile X mental retardation syndrome-related protein 1 (190-198)
cgcagcauccggaccaagcugaugcuc

SEQ ID NO: 46479 - RNA, 27 nt, Artificial Sequence
  LIM domain kinase 2 (381-389)
cgcagccuggaccaccccaacgugcuc

SEQ ID NO: 46480 - RNA, 48 nt, Artificial Sequence
  rRNA-processing protein UTP23 homolog (234-249)
cgcagcaaccccaaggugcuguccgagaagcagaacgccgagggcgag

SEQ ID NO: 46481 - RNA, 39 nt, Artificial Sequence
  Histone H2B type 2-F (32-44)
cgcagccggaaggaguccuacagcguguacgucuacaag

SEQ ID NO: 46482 - RNA, 27 nt, Artificial Sequence
  Deoxynucleotidyltransferase terminal-interacting protein 2 (272-280)
cgcagcuccgagaacauccugaccgug

SEQ ID NO: 46483 - RNA, 24 nt, Artificial Sequence
  DNA replication licensing factor MCM5 (603-610)
cgcagcuccauccccaucaccgug

SEQ ID NO: 46484 - RNA, 30 nt, Artificial Sequence
  DBIRD complex subunit ZNF326 (80-89)
cgcagcucccugggcgggcgggaccucuac

SEQ ID NO: 46485 - RNA, 27 nt, Artificial Sequence
  HMG box-containing protein 1 (133-141)
cgcagcucccccgugcacaucaucgcc

SEQ ID NO: 46486 - RNA, 27 nt, Artificial Sequence
  Helicase with zinc finger domain 2 (147-155)
cgcagcuccagcgaggugcugguccuc

SEQ ID NO: 46487 - RNA, 27 nt, Artificial Sequence
  Cytoplasmic dynein 1 heavy chain 1 (3474-3482)
cgcagcaccgcccugcucaagucccug

SEQ ID NO: 46488 - RNA, 27 nt, Artificial Sequence
  Cyclin-dependent kinase 5 activator 1 (179-187)
cgcagcguggaccggucccugcuccug

SEQ ID NO: 46489 - RNA, 27 nt, Artificial Sequence
  Annexin A2 (220-228)
cgcagcgugccccaccugcagaagguc

SEQ ID NO: 46490 - RNA, 27 nt, Artificial Sequence
  Proline and serine-rich protein 2 (7-15)
cgcagcgugcccaccccgcuggucaug

SEQ ID NO: 46491 - RNA, 27 nt, Artificial Sequence
  Signal peptidase complex subunit 3 (35-43)
cgcagcgugcccguccggcugcacgug

SEQ ID NO: 46492 - RNA, 33 nt, Artificial Sequence
  Zinc finger protein 770 (328-338)
cgcagcuacaacuacaagaccaucgugaagaag

SEQ ID NO: 46493 - RNA, 39 nt, Artificial Sequence
  Protein Hook homolog 3 (706-718)
cgcagcuaccccggccacgugcagccggccaccgcccgg

SEQ ID NO: 46494 - RNA, 27 nt, Artificial Sequence
  Annexin A1 (228-236)
cgcagcuacccccagcugcggcgcgug

SEQ ID NO: 46495 - RNA, 27 nt, Artificial Sequence
  Coatomer subunit alpha (1106-1114)
cgcaccgcccugaaccucuucuucaag

SEQ ID NO: 46496 - RNA, 27 nt, Artificial Sequence
  Neuron navigator 2 (898-906)
cgcaccgacgacaucaccagcggcuac

SEQ ID NO: 46497 - RNA, 27 nt, Artificial Sequence
  Glycine-tRNA ligase (606-614)
cgcaccgacgagaucggcguggccuuc

SEQ ID NO: 46498 - RNA, 27 nt, Artificial Sequence
  Cirhin (46-54)
cgcaccgacggcaccguggagaucuac

SEQ ID NO: 46499 - RNA, 27 nt, Artificial Sequence
  Origin recognition complex subunit 5 (322-330)
cgcaccgacaagcgguucuuccugaag

SEQ ID NO: 46500 - RNA, 30 nt, Artificial Sequence
  1-phosphatidylinositol 4,5-bisphosphate phosphodiesterase beta-1 (39-48)
cgcaccgacccccagggcuucuucuucuac

SEQ ID NO: 46501 - RNA, 27 nt, Artificial Sequence
  Dedicator of cytokinesis protein 9 (1494-1502)
cgcaccgaggccagccagcugcucuac

SEQ ID NO: 46502 - RNA, 27 nt, Artificial Sequence
  DDB1- and CUL4-associated factor 16 (191-199)
cgcaccgagcccaucaacaccacguac

SEQ ID NO: 46503 - RNA, 27 nt, Artificial Sequence
  Rho guanine nucleotide exchange factor 2 (679-687)
cgcaccuucaacggcagcaucgagcug

SEQ ID NO: 46504 - RNA, 33 nt, Artificial Sequence
  Insulin receptor substrate 2 (718-728)
cgcaccuuccccgccagcggcgggggcuacaag

SEQ ID NO: 46505 - RNA, 24 nt, Artificial Sequence
  Vigilin (146-153)
cgcaccggcgcccaccuggagcuc

SEQ ID NO: 46506 - RNA, 24 nt, Artificial Sequence
  E3 ubiquitin-protein ligase HERC2 (17-24)
cgcaccggcagcccccugucccuc

SEQ ID NO: 46507 - RNA, 39 nt, Artificial Sequence
  Prelamin-A/C (16-28)
cgcaccggcacccugcucgcccagcaccccgccuggggg

SEQ ID NO: 46508 - RNA, 27 nt, Artificial Sequence
  TGF-beta receptor type-1 (199-207)
cgcaccaucgcccggaccaucgugcug

SEQ ID NO: 46509 - RNA, 27 nt, Artificial Sequence
  Nuclear pore complex protein Nup155 (332-340)
cgcaccaucgaccggagcguguucaag

SEQ ID NO: 46510 - RNA, 27 nt, Artificial Sequence
  Protein CASP (616-624)
cgcaccaucggcuucuucuacacccug

SEQ ID NO: 46511 - RNA, 27 nt, Artificial Sequence
  Bifunctional glutamate/proline-tRNA ligase (1278-1286)
cgcaccaucggcgugaugaccaugguc

SEQ ID NO: 46512 - RNA, 27 nt, Artificial Sequence
  Helicase-like transcription factor (616-624)
cgcaccauccagcggcccgugaccaug

SEQ ID NO: 46513 - RNA, 27 nt, Artificial Sequence
  AF4/FMR2 family member 4 (46-54)
cgcaccaucagccaguccagcucccug

SEQ ID NO: 46514 - RNA, 27 nt, Artificial Sequence
  Ankyrin repeat domain-containing protein 17 (1031-1039)
cgcaccaaggacaccccccugagccuc

SEQ ID NO: 46515 - RNA, 27 nt, Artificial Sequence
  Inositol 1,4,5-trisphosphate receptor type 3 (1667-1675)
cgcacccugcagcagaugcuccugaag

SEQ ID NO: 46516 - RNA, 33 nt, Artificial Sequence
  Phosphatidylserine synthase 1 (8-18)
cgcacccugagcaaggacgacgugaacuacaag

SEQ ID NO: 46517 - RNA, 84 nt, Artificial Sequence
  Heat shock cognate 71 kDa protein (272-299)
cgcacccugagcuccagcacccaggccuccaucgagaucgacagccucuacgagggcaucgacuucuacacguccaucacccgg

SEQ ID NO: 46518 - RNA, 27 nt, Artificial Sequence
  60S ribosomal protein L18 (55-63)
cgcaccaaccggcccccgcugagccuc

SEQ ID NO: 46519 - RNA, 27 nt, Artificial Sequence
  60S ribosomal protein L18 (38-46)
cgcaccaacagcaccuucaaccaggug

SEQ ID NO: 46520 - RNA, 27 nt, Artificial Sequence
  HLA class II histocompatibility antigen, DM beta chain (111-119)
cgcacccggcccccgagcgugcagguc

SEQ ID NO: 46521 - RNA, 27 nt, Artificial Sequence
  Solute carrier family 22 member 6 (423-431)
cgcaccagccuggccgugcucggcaag

SEQ ID NO: 46522 - RNA, 27 nt, Artificial Sequence
  Actin-related protein 3 (290-298)
cgcaccguggacgcccggcugaagcuc

SEQ ID NO: 46523 - RNA, 27 nt, Artificial Sequence
  Dolichyl-diphosphooligosaccharide-proteinosyltransferase subunit 1 (38-46)
cgcaccguggaccugagcucccaccuc

SEQ ID NO: 46524 - RNA, 27 nt, Artificial Sequence
  Host cell factor 1 (1385-1393)
cgcaccguggagagcggccuggagguc

SEQ ID NO: 46525 - RNA, 39 nt, Artificial Sequence
  Myosin-9 (644-656)
cgcaccgugggccagcuguacaaggagcagcucgccaag

SEQ ID NO: 46526 - RNA, 24 nt, Artificial Sequence
  Probable C-mannosyltransferase DPY19L4 (518-525)
cgcaccgugcaccccauccugcuc

SEQ ID NO: 46527 - RNA, 93 nt, Artificial Sequence
  Fructose-bisphosphate aldolase A (313-343)
cgcaccgugcccccggccgucaccggcaucacguuccugagcgggggccaguccgaggaggaggccagcaucaaccucaacgcgaucaacaag

SEQ ID NO: 46528 - RNA, 39 nt, Artificial Sequence
  Programmed cell death protein 6 (100-112)
cgcaccuacgaccgggacaacagcggcaugaucgacaag

SEQ ID NO: 46529 - RNA, 27 nt, Artificial Sequence
  Chondroitin sulfate synthase 2 (347-355)
cgcaccuaccaggagauccaggagcug

SEQ ID NO: 46530 - RNA, 27 nt, Artificial Sequence
  Vimentin (36-44)
cgcaccuacagccugggcuccgcccuc

SEQ ID NO: 46531 - RNA, 27 nt, Artificial Sequence
  Mucolipin-1 (420-428)
cgcguggcccugcccagcgucaugcgg

SEQ ID NO: 46532 - RNA, 33 nt, Artificial Sequence
  Multiple epidermal growth factor-like domains protein 8 (2514-2524)
cgcguggcccccgacaccggcguccacaccgug

SEQ ID NO: 46533 - RNA, 27 nt, Artificial Sequence
  Rab11 family-interacting protein 5 (210-218)
cgcguggcccccccgcgggcccugcuc

SEQ ID NO: 46534 - RNA, 39 nt, Artificial Sequence
  FUN14 domain-containing protein 1 (35-47)
cgcguguucggccacagcuccgggcccauggucgagaag

SEQ ID NO: 46535 - RNA, 36 nt, Artificial Sequence
  Putative ATP-dependent RNA helicase DHX33 (247-258)
cgcguguuccagggcgcccccaagggguaccggaag

SEQ ID NO: 46536 - RNA, 33 nt, Artificial Sequence
  Annexin A1 (235-245)
cgcguguuccagaaguacaccaaguacagcaag

SEQ ID NO: 46537 - RNA, 27 nt, Artificial Sequence
  Centrosomal protein C10orf90 (146-154)
cgcgugggccccccggcccgggcccug

SEQ ID NO: 46538 - RNA, 27 nt, Artificial Sequence
  E3 ubiquitin-protein ligase MIB2 (385-393)
cgcgugaucggcgaccuggacaccguc

SEQ ID NO: 46539 - RNA, 39 nt, Artificial Sequence
  Protein FAM177A1 (56-68)
cgcgugauccacuucgucagcggcgagaccauggaggag

SEQ ID NO: 46540 - RNA, 39 nt, Artificial Sequence
  Glyceraldehyde-3-phosphate dehydrogenase (118-130)
cgcgugaucaucagcgcccccuccgccgacgcgccgaug

SEQ ID NO: 46541 - RNA, 30 nt, Artificial Sequence
  Nuclear valosin-containing protein-like (16-25)
cgcgugauccaguaccugaccagcaacaag

SEQ ID NO: 46542 - RNA, 30 nt, Artificial Sequence
  Translation initiation factor eIF-2B subunit alpha (136-145)
cgcgugcuggaggccgccgucgcggccaag

SEQ ID NO: 46543 - RNA, 30 nt, Artificial Sequence
  Ribosomal RNA-processing protein 8 (380-389)
cgcgugcugaagcccggcgggcuccugaag

SEQ ID NO: 46544 - RNA, 27 nt, Artificial Sequence
  Nidogen-2 (738-746)
cgcgugcugcgguucgccgucaccaac

SEQ ID NO: 46545 - RNA, 27 nt, Artificial Sequence
  HLA class I histocompatibility antigen, Cw-3 alpha chain (2-10)
cgcgugauggccccccggacccugauc

SEQ ID NO: 46546 - RNA, 27 nt, Artificial Sequence
  HLA class I histocompatibility antigen, Cw-2 alpha chain (2-10)
cgcgugauggccccccggacccugcuc

SEQ ID NO: 46547 - RNA, 27 nt, Artificial Sequence
  Carbohydrate sulfotransferase 14 (126-134)
cgcgugaugaagguccuggccggcgug

SEQ ID NO: 46548 - RNA, 27 nt, Artificial Sequence
  Polycomb group RING finger protein 1 (90-98)
cgcgugaugcaggacaucgucuacaag

SEQ ID NO: 46549 - RNA, 33 nt, Artificial Sequence
  Spectrin alpha chain, non-erythrocytic 1 (204-214)
cgcgugaacgaggucaaccaguucgccgccaag

SEQ ID NO: 46550 - RNA, 57 nt, Artificial Sequence
  Beta-2-microglobulin (80-98)
cgcgugaaccacgucacccugagccagcccaagaucgugaagugggaccgggacaug

SEQ ID NO: 46551 - RNA, 27 nt, Artificial Sequence
  Ribonuclease inhibitor (53-61)
cgcgugaaccccgcccuggccgagcuc

SEQ ID NO: 46552 - RNA, 27 nt, Artificial Sequence
  Major centromere autoantigen B (26-34)
cgcgugcagagccacauccugcaccuc

SEQ ID NO: 46553 - RNA, 27 nt, Artificial Sequence
  Mannose-1-phosphate guanyltransferase alpha (390-398)
cgcgugcggauccccgccgagguccug

SEQ ID NO: 46554 - RNA, 27 nt, Artificial Sequence
  Probable cation-transporting ATPase 13A2 (897-905)
cgcgugcggcccccgggcgcccugcuc

SEQ ID NO: 46555 - RNA, 27 nt, Artificial Sequence
  Transmembrane protein 121 (244-252)
cgcgugagcgccaucuucgucggcaag

SEQ ID NO: 46556 - RNA, 27 nt, Artificial Sequence
  Protein kinase C and casein kinase substrate in neurons protein 2 (92-100)
cgcgugagcgagcugcaccucgagguc

SEQ ID NO: 46557 - RNA, 27 nt, Artificial Sequence
  Ectonucleoside triphosphate diphosphohydrolase 6 (359-367)
cgcgugagcgagguccugcagaaccgg

SEQ ID NO: 46558 - RNA, 27 nt, Artificial Sequence
  HLA class I histocompatibility antigen, B-15 alpha chain (2-10)
cgcgugaccgccccccggaccguccug

SEQ ID NO: 46559 - RNA, 30 nt, Artificial Sequence
  F-box/LRR-repeat protein 7 (354-363)
cgcgugaccgacgucggcauccgguacgug

SEQ ID NO: 46560 - RNA, 33 nt, Artificial Sequence
  Titin (16492-16502)
cgcgugaccggccugaucgagaaccacgacuac

SEQ ID NO: 46561 - RNA, 27 nt, Artificial Sequence
  Phospholipid transfer protein (25-33)
cgcgugaccagcaaggcccuggagcuc

SEQ ID NO: 46562 - RNA, 27 nt, Artificial Sequence
  UPF0769 protein C21orf59 (33-41)
cgcguguacaacggccggcugaagguc

SEQ ID NO: 46563 - RNA, 54 nt, Artificial Sequence
  HLA class I histocompatibility antigen, A-2 alpha chain (272-289)
cgcugggagcccagcucccagccgaccauccccaucgugggcaucaucgccggg

SEQ ID NO: 46564 - RNA, 51 nt, Artificial Sequence
  HLA class I histocompatibility antigen, Cw-17 alpha chain (297-313)
cgcuggggcgggaagggcgggagcugcucccaggccgccagcuccaacagc

SEQ ID NO: 46565 - RNA, 27 nt, Artificial Sequence
  Calpain-3 (104-112)
cgcuacgccgacaagcacaugaacauc

SEQ ID NO: 46566 - RNA, 27 nt, Artificial Sequence
  Tetratricopeptide repeat protein 30A (26-34)
cgcuacgccgaggccgugcagcugcuc

SEQ ID NO: 46567 - RNA, 24 nt, Artificial Sequence
  Sodium/potassium-transporting ATPase subunit alpha-1 (276-283)
cgcuacgccaagaucguggagauc

SEQ ID NO: 46568 - RNA, 30 nt, Artificial Sequence
  Sodium/potassium-transporting ATPase subunit alpha-1 (276-285)
cgcuacgccaagaucguggagauccccuuc

SEQ ID NO: 46569 - RNA, 27 nt, Artificial Sequence
  Zinc finger and BTB domain-containing protein 11 (581-589)
cgcuacgcccugaucaugcacaagcuc

SEQ ID NO: 46570 - RNA, 30 nt, Artificial Sequence
  Bestrophin-1 (70-79)
cgcuacgccaaccugggcaacgugcucauc

SEQ ID NO: 46571 - RNA, 27 nt, Artificial Sequence
  Probable helicase with zinc finger domain (214-222)
cgcuacgccagccggcugaucaagcuc

SEQ ID NO: 46572 - RNA, 27 nt, Artificial Sequence
  (Pyruvate dehydrogenase (acetyl-transferring))-phosphatase 1, mitochondrial (106-114)
cgcuacgccagcaccccccagaaguuc

SEQ ID NO: 46573 - RNA, 27 nt, Artificial Sequence
  Kelch-like protein 20 (384-392)
cgcuacgaccccaagaccaaccagugg

SEQ ID NO: 46574 - RNA, 27 nt, Artificial Sequence
  Kelch-like protein 20 (337-345)
cgcuacgacccccagaccaacgagugg

SEQ ID NO: 46575 - RNA, 27 nt, Artificial Sequence
  Protein FAM91A1 (437-445)
cgcuacuucgaccacgcccugacccuc

SEQ ID NO: 46576 - RNA, 27 nt, Artificial Sequence
  Heterogeneous nuclear ribonucleoprotein H2 (275-283)
cgcuacggcgacgggggcagcuccuuc

SEQ ID NO: 46577 - RNA, 27 nt, Artificial Sequence
  Transmembraneoprotein NMB (373-381)
cgcuacggccacuuccaggccaccauc

SEQ ID NO: 46578 - RNA, 24 nt, Artificial Sequence
  Protocadherin gamma-A11 (881-888)
cgcuacggcccccaguucacccug

SEQ ID NO: 46579 - RNA, 27 nt, Artificial Sequence
  Melanocyte protein PMEL (486-494)
cgcuacggcagcuucuccgugacccug

SEQ ID NO: 46580 - RNA, 27 nt, Artificial Sequence
  FTS and Hook-interacting protein (249-257)
cgcuacaucgccgaccacagcuacuuc

SEQ ID NO: 46581 - RNA, 27 nt, Artificial Sequence
  Hemicentin-1 (697-705)
cgcuacaucgaggcccccaagcugaug

SEQ ID NO: 46582 - RNA, 33 nt, Artificial Sequence
  Leucine-rich repeat LGI family member 3 (441-451)
cgcuacaucggcgacagcaagauccugcggugg

SEQ ID NO: 46583 - RNA, 27 nt, Artificial Sequence
  DNA repair protein RAD50 (184-192)
cgcuacaucaaggcccuggagacccuc

SEQ ID NO: 46584 - RNA, 30 nt, Artificial Sequence
  1,2-dihydroxy-3-keto-5-methylthiopentene dioxygenase (96-105)
cgcuacauccuggacggcagcggguacuuc

SEQ ID NO: 46585 - RNA, 27 nt, Artificial Sequence
  Serine/threonine-protein phosphatase 4 regulatory subunit 3B (575-583)
cgcuacaucaccaagggcaaccuguuc

SEQ ID NO: 46586 - RNA, 27 nt, Artificial Sequence
  HLA class II histocompatibility antigen, DP beta 1 chain (22-30)
cgcuacaucuacaaccgggaggaguuc

SEQ ID NO: 46587 - RNA, 27 nt, Artificial Sequence
  Unconventional myosin-XVIIIa (834-842)
cgcuacaaggaggagaacaucgagcug

SEQ ID NO: 46588 - RNA, 27 nt, Artificial Sequence
  Tubulin polyglutamylase TTLL4 (750-758)
cgcuaccugcacaagcccuaccucauc

SEQ ID NO: 46589 - RNA, 27 nt, Artificial Sequence
  Zinc finger protein 45 (95-103)
cgcuaccugccccacgaggagcucuuc

SEQ ID NO: 46590 - RNA, 27 nt, Artificial Sequence
  Leucine-rich repeat flightless-interacting protein 2 (360-368)
cgcuacaugcagggccugaaggagcuc

SEQ ID NO: 46591 - RNA, 24 nt, Artificial Sequence
  60S ribosomal protein L28 (39-46)
cgcuacaacggccugauccaccgg

SEQ ID NO: 46592 - RNA, 27 nt, Artificial Sequence
  Leucine-rich repeat transmembrane neuronal protein 3 (444-452)
cgcuaccccgccagcaugaagcagcug

SEQ ID NO: 46593 - RNA, 27 nt, Artificial Sequence
  Serine/threonine-protein phosphatase 2A catalytic subunit beta isoform (106-114)
cgcuaccccgagcggaucaccauccug

SEQ ID NO: 46594 - RNA, 27 nt, Artificial Sequence
  SPRY domain-containing protein 3 (41-49)
cgcuaccaggagcgguucaagcacauc

SEQ ID NO: 46595 - RNA, 27 nt, Artificial Sequence
  Cation-independent mannose-6-phosphate receptor (1386-1394)
cgcuacagcgacaacugggaggccauc

SEQ ID NO: 46596 - RNA, 27 nt, Artificial Sequence
  Phosphatidylcholine translocator ABCB4 (47-55)
cgcuacagcgacuggcaggacaagcug

SEQ ID NO: 46597 - RNA, 30 nt, Artificial Sequence
  Phosphatidylinositol 3-kinase catalytic subunit type 3 (811-820)
cgcuacagcaaccugauccucaaccuguuc

SEQ ID NO: 46598 - RNA, 30 nt, Artificial Sequence
  E3 ubiquitin-protein ligase UBR2 (462-471)
cgcuacaccgcccugcaggccuucaaguuc

SEQ ID NO: 46599 - RNA, 27 nt, Artificial Sequence
  DnaJ homolog subfamily C member 3 (283-291)
cgcuacaccgacgccaccagcaaguac

SEQ ID NO: 46600 - RNA, 36 nt, Artificial Sequence
  E3 ubiquitin-protein ligase HUWE1 (156-167)
cgcuacaccgacauggagagcgaggacuaccacuuc

SEQ ID NO: 46601 - RNA, 27 nt, Artificial Sequence
  Ubiquitin carboxyl-terminal hydrolase 13 (490-498)
cgcuacaccgagcggguggacuaccug

SEQ ID NO: 46602 - RNA, 27 nt, Artificial Sequence
  Cullin-1 (190-198)
cgcuacacccugcaggccagcaccuuc

SEQ ID NO: 46603 - RNA, 27 nt, Artificial Sequence
  Serine/threonine-protein kinase SMG1 (1394-1402)
cgcuacaccauguaccagaaccagcug

SEQ ID NO: 46604 - RNA, 24 nt, Artificial Sequence
  Rho guanine nucleotide exchange factor 2 (8-15)
cgcuacaccaacggccaccuguuc

SEQ ID NO: 46605 - RNA, 33 nt, Artificial Sequence
  Rho guanine nucleotide exchange factor 2 (8-18)
cgcuacaccaacggccaccuguucaccacgauc

SEQ ID NO: 46606 - RNA, 27 nt, Artificial Sequence
  Cyclin-dependent kinase 9 (184-192)
cgcuacaccaaccggguggucacccug

SEQ ID NO: 46607 - RNA, 27 nt, Artificial Sequence
  Chloride channel protein 2 (25-33)
cgcuacacccaggaccugggcgccuuc

SEQ ID NO: 46608 - RNA, 27 nt, Artificial Sequence
  CDK5 regulatory subunit-associated protein 3 (428-436)
cgcuacguggaccgggucaccgaguuc

SEQ ID NO: 46609 - RNA, 27 nt, Artificial Sequence
  Protein orai-3 (145-153)
cgcuacguggagcuggccuggggcuuc

SEQ ID NO: 46610 - RNA, 27 nt, Artificial Sequence
  Eukaryotic translation initiation factor 2 subunit 1 (234-242)
cgcuacgugaugaccaccacgacccug

SEQ ID NO: 46611 - RNA, 39 nt, Artificial Sequence
  HLA class I histocompatibility antigen, B-51 alpha chain (82-94)
cgcuacuacaaccagagcgaggccggcucccacaccugg

SEQ ID NO: 46612 - RNA, 27 nt, Artificial Sequence
  Homeodomain-interacting protein kinase 2 (365-373)
cgcuacuaccgggcccccgagaucauc

SEQ ID NO: 46613 - RNA, 27 nt, Artificial Sequence
  Glycogen synthase kinase-3 beta (220-228)
cgcuacuaccgggcccccgagcugauc

SEQ ID NO: 46614 - RNA, 42 nt, Artificial Sequence
  Motor neuron and pancreas homeobox protein 1 (169-182)
agcgccgccgcggccgccgccgcccuggcgggccagcacccc

SEQ ID NO: 46615 - RNA, 33 nt, Artificial Sequence
  AT-rich interactive domain-containing protein 1B (270-280)
agcgccgccgcggccggcgcccccggguccaug

SEQ ID NO: 46616 - RNA, 27 nt, Artificial Sequence
  Beta-2-syntrophin (491-499)
agcgccgacgacggcauccgcaaccug

SEQ ID NO: 46617 - RNA, 30 nt, Artificial Sequence
  Eukaryotic translation initiation factor 3 subunit K (79-88)
agcgccgacgaguccggccagaucuucauc

SEQ ID NO: 46618 - RNA, 81 nt, Artificial Sequence
  Filamin-B (567-593)
agcgccgacuucguggucgaguccaucggcagcgagguggggucccugggcuucgccaucgaggggcccagccaggcgaag

SEQ ID NO: 46619 - RNA, 24 nt, Artificial Sequence
  COMM domain-containing protein 4 (177-184)
agcgccgacaaguuccaggugcug

SEQ ID NO: 46620 - RNA, 27 nt, Artificial Sequence
  COMM domain-containing protein 4 (177-185)
agcgccgacaaguuccaggugcugcuc

SEQ ID NO: 46621 - RNA, 24 nt, Artificial Sequence
  Transcription factor MafF (16-23)
agcgccgaggaggugacccgccug

SEQ ID NO: 46622 - RNA, 27 nt, Artificial Sequence
  E3 SUMO-protein ligase RanBP2 (993-1001)
agcgccgaguccaagaccaucgaguuc

SEQ ID NO: 46623 - RNA, 27 nt, Artificial Sequence
  Mucin-19 (2343-2351)
agcgccgagguguccggccgcaucgag

SEQ ID NO: 46624 - RNA, 51 nt, Artificial Sequence
  Cytochrome c oxidase subunit 7C, mitochondrial (47-63)
agcgccuucgccacccccuuccuggugguccgccaccagcuccugaagacc

SEQ ID NO: 46625 - RNA, 27 nt, Artificial Sequence
  Ankyrin repeat and KH domain-containing protein 1 (2266-2274)
agcgccuuccugggcaacuccgugcuc

SEQ ID NO: 46626 - RNA, 27 nt, Artificial Sequence
  AP-5 complex subunit mu-1 (88-96)
agcgccuucuccggccccuacaaguuc

SEQ ID NO: 46627 - RNA, 93 nt, Artificial Sequence
  PR domain zinc finger protein 8 (458-488)
agcgccuucaccuccgugccccagcugggcagcgccggguccaccagcggcgggggcgggacgggcgcgggcgccgccgggggcgccgggggc

SEQ ID NO: 46628 - RNA, 21 nt, Artificial Sequence
  Transmembrane emp24 domain-containing protein 10 (79-85)
agcgccggccacauccuguac

SEQ ID NO: 46629 - RNA, 48 nt, Artificial Sequence
  Laminin subunit gamma-1 (664-679)
agcgccggcuaccuggacgacgugacccucgccuccgcgcgccccggg

SEQ ID NO: 46630 - RNA, 51 nt, Artificial Sequence
  Laminin subunit gamma-1 (664-680)
agcgccggcuaccuggacgacgugacccucgccuccgcgcgccccgggccg

SEQ ID NO: 46631 - RNA, 54 nt, Artificial Sequence
  Laminin subunit gamma-1 (664-681)
agcgccggcuaccuggacgacgugacccucgccuccgcgcgccccgggccgggc

SEQ ID NO: 46632 - RNA, 24 nt, Artificial Sequence
  Nuclear factor of activated T-cells, cytoplasmic 2 (354-361)
agcgcccacgagcugcccauggug

SEQ ID NO: 46633 - RNA, 27 nt, Artificial Sequence
  Armadillo repeat-containing protein 1 (96-104)
agcgccaucgccuccaccaaggugaug

SEQ ID NO: 46634 - RNA, 27 nt, Artificial Sequence
  Tripeptidyl-peptidase 1 (315-323)
agcgcccugccccacgugcacaccguc

SEQ ID NO: 46635 - RNA, 42 nt, Artificial Sequence
  3-hydroxy-3-methylglutaryl-coenzyme A reductase (687-700)
agcgccauggccggcuccaucgggggcuacaacgcgcacgcc

SEQ ID NO: 46636 - RNA, 27 nt, Artificial Sequence
  Phosphoglucomutase-1 (263-271)
agcgccaacgacaagguguacaccguc

SEQ ID NO: 46637 - RNA, 30 nt, Artificial Sequence
  WD repeat and FYVE domain-containing protein 3 (1236-1245)
agcgccaaccccccgguggucuccaccgug

SEQ ID NO: 46638 - RNA, 24 nt, Artificial Sequence
  Serine/threonine-protein phosphatase 2A regulatory subunit B'' subunit gamma (114-121)
agcgcccccuccgcccugcgcgug

SEQ ID NO: 46639 - RNA, 27 nt, Artificial Sequence
  Microtubule-associated protein 9 (372-380)
agcgcccgccugaugaccuccgaguuc

SEQ ID NO: 46640 - RNA, 27 nt, Artificial Sequence
  Importin-5 (974-982)
agcgccgugggcaagaucaugaaguuc

SEQ ID NO: 46641 - RNA, 30 nt, Artificial Sequence
  Transcription factor SOX-10 (331-340)
agcgccuggaucuccaagcccccgggcgug

SEQ ID NO: 46642 - RNA, 27 nt, Artificial Sequence
  Nuclear export mediator factor NEMF (468-476)
agcgccuacgccaacgcgaagaaguac

SEQ ID NO: 46643 - RNA, 24 nt, Artificial Sequence
  Zinc finger MYM-type protein 4 (449-456)
agcgccuaccgcgugaagaugguc

SEQ ID NO: 46644 - RNA, 27 nt, Artificial Sequence
  Small subunit processome component 20 homolog (1418-1426)
agcgacuucgaguccggccugaaguac

SEQ ID NO: 46645 - RNA, 21 nt, Artificial Sequence
  Fas apoptotic inhibitory molecule 1 (47-53)
agcgacggcgugcacaagauc

SEQ ID NO: 46646 - RNA, 21 nt, Artificial Sequence
  Fructose-bisphosphate aldolase A (272-278)
agcgaccaccacaucuaccug

SEQ ID NO: 46647 - RNA, 51 nt, Artificial Sequence
  Galectin-3-binding protein (311-327)
agcgaccuggccgugcccuccgagcucgcccugcugaaggcggucgacacc

SEQ ID NO: 46648 - RNA, 87 nt, Artificial Sequence
  HLA class I histocompatibility antigen, A-23 alpha chain (337-365)
agcgaccgcaagggcggguccuacagccaggccgccuccagcgacuccgcgcagggcagcgacgugucccugaccgccugcaagguc

SEQ ID NO: 46649 - RNA, 48 nt, Artificial Sequence
  HLA class I histocompatibility antigen, A-23 alpha chain (350-365)
agcgacuccgcccagggcagcgacgugucccugaccgccugcaagguc

SEQ ID NO: 46650 - RNA, 27 nt, Artificial Sequence
  Immunoglobulin superfamily member 3 (355-363)
agcgacuccguguucguccugaagauc

SEQ ID NO: 46651 - RNA, 30 nt, Artificial Sequence
  HLA class I histocompatibility antigen, A-23 alpha chain (356-365)
agcgacgugucccugaccgccugcaagguc

SEQ ID NO: 46652 - RNA, 30 nt, Artificial Sequence
  Kelch repeat and BTB domain-containing protein 6 (137-146)
agcgaggccaacguggagcgccuguacgcc

SEQ ID NO: 46653 - RNA, 27 nt, Artificial Sequence
  YTH domain-containing family protein 1 (301-309)
agcgaggacgacauccaccgcuccauc

SEQ ID NO: 46654 - RNA, 27 nt, Artificial Sequence
  RNA-binding protein 28 (126-134)
agcgaggacgaccugaagaccguguuc

SEQ ID NO: 46655 - RNA, 27 nt, Artificial Sequence
  Sister chromatid cohesion protein PDS5 homolog A (59-67)
agcgaggacgagaagcagcaguaccug

SEQ ID NO: 46656 - RNA, 27 nt, Artificial Sequence
  Hermansky-Pudlak syndrome 5 protein (476-484)
agcgaggacgagcgcuucaaggaguuc

SEQ ID NO: 46657 - RNA, 27 nt, Artificial Sequence
  Ras-specific guanine nucleotide-releasing factor RalGPS2 (420-428)
agcgaggaccuggccgugcaccucuac

SEQ ID NO: 46658 - RNA, 30 nt, Artificial Sequence
  Peptidyl-prolyl cis-trans isomerase FKBP9 (197-206)
agcgaggaccaggugcagauccacaccuac

SEQ ID NO: 46659 - RNA, 27 nt, Artificial Sequence
  WD repeat-containing protein 6 (258-266)
agcgaggaccgcuccgugcggaucugg

SEQ ID NO: 46660 - RNA, 27 nt, Artificial Sequence
  Thioredoxin-like protein 4A (20-28)
agcgaggaggaccgcguggucgugauc

SEQ ID NO: 46661 - RNA, 27 nt, Artificial Sequence
  Vacuolar protein sorting-associated protein 41 homolog (24-32)
agcgaggaggagcccaagcugaaguac

SEQ ID NO: 46662 - RNA, 30 nt, Artificial Sequence
  Protocadherin Fat 1 (2947-2956)
agcgaggagaucaaccgccaggugaccuac

SEQ ID NO: 46663 - RNA, 27 nt, Artificial Sequence
  Thioredoxin-related transmembrane protein 2 (247-255)
agcgaggagaacgugauccgcgaguuc

SEQ ID NO: 46664 - RNA, 21 nt, Artificial Sequence
  26S proteasome non-ATPase regulatory subunit 13 (65-71)
agcgaguucgagcaccgcgug

SEQ ID NO: 46665 - RNA, 27 nt, Artificial Sequence
  Protein PRR14L (1206-1214)
agcgaguucggcaaggaguccaccuuc

SEQ ID NO: 46666 - RNA, 30 nt, Artificial Sequence
  Aldehyde dehydrogenase family 1 member A3 (328-337)
agcgaguucgugcgccgguccgucgaguac

SEQ ID NO: 46667 - RNA, 27 nt, Artificial Sequence
  Alpha-parvin (149-157)
agcgagaucgcccagaagcagaagcug

SEQ ID NO: 46668 - RNA, 30 nt, Artificial Sequence
  Microtubule cross-linking factor 1 (653-662)
agcgagaucgaggaccacaaccgccagcug

SEQ ID NO: 46669 - RNA, 27 nt, Artificial Sequence
  Protein AHNAK2 (1652-1660)
agcgagaucgagggcaacgugaccuuc

SEQ ID NO: 46670 - RNA, 30 nt, Artificial Sequence
  Manganese-transporting ATPase 13A1 (95-104)
agcgagauccgcgccgccgagaagaaguuc

SEQ ID NO: 46671 - RNA, 27 nt, Artificial Sequence
  Vesicle transport protein USE1 (81-89)
agcgagaaggcccuggccaaccaguuc

SEQ ID NO: 46672 - RNA, 30 nt, Artificial Sequence
  Centromere protein F (130-139)
agcgagcuggacaagcuccuguccagcuuc

SEQ ID NO: 46673 - RNA, 36 nt, Artificial Sequence
  Proline-rich protein 12 (622-633)
agcgagcugcucgccggccccgggggcccgcccgcc

SEQ ID NO: 46674 - RNA, 30 nt, Artificial Sequence
  LisH domain-containing protein ARMC9 (9-18)
agcgagcugcucggccuggugaaggaguac

SEQ ID NO: 46675 - RNA, 27 nt, Artificial Sequence
  T-box transcription factor TBX3 (698-706)
agcgagcugcaguccauccagcgccuc

SEQ ID NO: 46676 - RNA, 27 nt, Artificial Sequence
  Sal-like protein 1 (1206-1214)
agcgagaacggcaccaacuuccgcuuc

SEQ ID NO: 46677 - RNA, 105 nt, Artificial Sequence
  Glia-derived nexin (342-376)
agcgagaaccugcacgugucccacauccuccagaaggccaagaucgaggucagcgaggacggcaccaaggccuccgcggccaccacggccauccugaucgcccgc

SEQ ID NO: 46678 - RNA, 27 nt, Artificial Sequence
  H/ACA ribonucleoprotein complex subunit 1 (130-138)
agcgagaacaugaaggccuccagcuuc

SEQ ID NO: 46679 - RNA, 27 nt, Artificial Sequence
  Plectin (3824-3832)
agcgagcccuccgaggugcgcagcuac

SEQ ID NO: 46680 - RNA, 27 nt, Artificial Sequence
  Integrin alpha-3 (534-542)
agcgaguccgccguguuccacggcuuc

SEQ ID NO: 46681 - RNA, 30 nt, Artificial Sequence
  Arfaptin-1 (44-53)
agcgagacccagaucaccucccacggcuuc

SEQ ID NO: 46682 - RNA, 27 nt, Artificial Sequence
  Laminin subunit gamma-1 (617-625)
agcgagaccaccgugaaguacgucuuc

SEQ ID NO: 46683 - RNA, 27 nt, Artificial Sequence
  Plexin-B2 (30-38)
agcgagaccguggucgagcgcaugcug

SEQ ID NO: 46684 - RNA, 30 nt, Artificial Sequence
  U5 small nuclear ribonucleoprotein 200 kDa helicase (1230-1239)
agcgaggugauccugcaccacgaguacuuc

SEQ ID NO: 46685 - RNA, 24 nt, Artificial Sequence
  Eukaryotic translation initiation factor 3 subunit D (444-451)
agcgaguaccugaagcucggcuac

SEQ ID NO: 46686 - RNA, 27 nt, Artificial Sequence
  Homeobox protein Hox-D9 (57-65)
agcuucgccccccgcuccgccguguuc

SEQ ID NO: 46687 - RNA, 27 nt, Artificial Sequence
  Renin receptor (256-264)
agcuucgacaccucccugauccgcaag

SEQ ID NO: 46688 - RNA, 24 nt, Artificial Sequence
  Liprin-beta-1 (507-514)
agcuucggccgcggguucuucaag

SEQ ID NO: 46689 - RNA, 27 nt, Artificial Sequence
  Zinc finger protein 697 (92-100)
agcuucauccaguccagccaccugauc

SEQ ID NO: 46690 - RNA, 30 nt, Artificial Sequence
  High affinity cationic amino acid transporter 1 (57-66)
agcuuccugaucgccgcccucgcguccgug

SEQ ID NO: 46691 - RNA, 24 nt, Artificial Sequence
  Immediate early response gene 5 protein (276-283)
agcuucuccggccugcuccgcaag

SEQ ID NO: 46692 - RNA, 27 nt, Artificial Sequence
  Zinc finger protein 175 (287-295)
agcuucacccagaagucccaccuguuc

SEQ ID NO: 46693 - RNA, 69 nt, Artificial Sequence
  Eukaryotic peptide chain release factor GTP-binding subunit ERF3A (163-185)
agcuucgugcccaacaugaucggcggggccucccaggccgaccuggcgguccucgugaucagcgcccgc

SEQ ID NO: 46694 - RNA, 42 nt, Artificial Sequence
  Protein HEG homolog 1 (148-161)
agcggcgacuuccagaugucccccuacgccgaguacccgaag

SEQ ID NO: 46695 - RNA, 51 nt, Artificial Sequence
  Protein HEG homolog 1 (148-164)
agcggcgacuuccagaugucccccuacgccgaguacccgaagaacccccgc

SEQ ID NO: 46696 - RNA, 27 nt, Artificial Sequence
  Trabeculin-alpha (4239-4247)
agcggcgaccccaaggugaucgagguc

SEQ ID NO: 46697 - RNA, 27 nt, Artificial Sequence
  Nicastrin (47-55)
agcggcgacaccggggugauccacguc

SEQ ID NO: 46698 - RNA, 27 nt, Artificial Sequence
  Bifunctional apoptosis regulator (310-318)
agcggcgaggacaucgugaccaagcug

SEQ ID NO: 46699 - RNA, 66 nt, Artificial Sequence
  Beta-enolase (330-351)
agcggcgagaccgaggacaccuucaucgccgaccugguggucgggcucugcacgggccagaucaag

SEQ ID NO: 46700 - RNA, 54 nt, Artificial Sequence
  Putative ATP-dependent RNA helicase DHX57 (36-53)
agcggcgggggcgggggcgggggcggcgggggcgggggcgggaaccgcaaggcc

SEQ ID NO: 46701 - RNA, 39 nt, Artificial Sequence
  Signal recognition particle subunit SRP68 (27-39)
agcggcgggggccgcggggccggcggggaggagaacaag

SEQ ID NO: 46702 - RNA, 27 nt, Artificial Sequence
  Elongation factor 2 (418-426)
agcggccugguguccaccgggcucaag

SEQ ID NO: 46703 - RNA, 27 nt, Artificial Sequence
  ATP-dependent RNA helicase DDX39A (90-98)
agcggcauggggaagaccgccguguuc

SEQ ID NO: 46704 - RNA, 45 nt, Artificial Sequence
  Collagen alpha-1(III) chain (60-74)
agcggccccaagggggacgccggccagccgggggagaagggcucc

SEQ ID NO: 46705 - RNA, 48 nt, Artificial Sequence
  Phosphatidylethanolamine-binding protein 1 (9-24)
agcggcccccugucccuccaggagguggacgagcagccgcagcacccc

SEQ ID NO: 46706 - RNA, 42 nt, Artificial Sequence
  Laminin subunit alpha-4 (576-589)
agccacgaccuggugcaggaggccaucgaccacgcccaggac

SEQ ID NO: 46707 - RNA, 30 nt, Artificial Sequence
  Protein phosphatase 1J (227-236)
agccacgagucccugguggucggcgccgug

SEQ ID NO: 46708 - RNA, 30 nt, Artificial Sequence
  Protein unc-93 homolog B1 (264-273)
agccacggcauccuguccggguucaacaag

SEQ ID NO: 46709 - RNA, 27 nt, Artificial Sequence
  Plasma protease C1 inhibitor (350-358)
agccacaaccugucccucgugauccug

SEQ ID NO: 46710 - RNA, 21 nt, Artificial Sequence
  Protein phosphatase 1 regulatory subunit 3F (177-183)
agccacccccugggcauccuc

SEQ ID NO: 46711 - RNA, 54 nt, Artificial Sequence
  Cytochrome c oxidase subunit 7C, mitochondrial (17-34)
agccacuacgaggagggccccgggaagaaccugccguucuccguggagaacaag

SEQ ID NO: 46712 - RNA, 69 nt, Artificial Sequence
  Cytochrome c oxidase subunit 7C, mitochondrial (17-39)
agccacuacgaggagggccccgggaagaaccugccguucuccguggagaacaaguggagccuccuggcc

SEQ ID NO: 46713 - RNA, 141 nt, Artificial Sequence
  Cytochrome c oxidase subunit 7C, mitochondrial (17-63)
agccacuacgaggagggccccgggaagaaccugccguucuccguggagaacaaguggagccuccuggccaagaugugccuguacuucggcuccgccuucgcgacccccuuccucgucgugcgccaccagcugcugaagacc

SEQ ID NO: 46714 - RNA, 27 nt, Artificial Sequence
  Clustered mitochondria protein homolog (225-233)
agcaucgacuucggcaagaccgugguc

SEQ ID NO: 46715 - RNA, 27 nt, Artificial Sequence
  Charged multivesicular body protein 5 (30-38)
agcaucgacaagaagaucucccgccug

SEQ ID NO: 46716 - RNA, 27 nt, Artificial Sequence
  Nodal modulator 3 (272-280)
agcaucgacuccgagcccgcccuggug

SEQ ID NO: 46717 - RNA, 27 nt, Artificial Sequence
  Eukaryotic translation initiation factor 4 gamma 1 (1038-1046)
agcaucgacuccaacaaccagcuguuc

SEQ ID NO: 46718 - RNA, 30 nt, Artificial Sequence
  Vacuolar protein sorting-associated protein 13B (1953-1962)
agcaucuucgacgccgugcugaagggcguc

SEQ ID NO: 46719 - RNA, 27 nt, Artificial Sequence
  Transmembrane channel-like protein 4 (391-399)
agcaucuucaucgccggcgugaacuuc

SEQ ID NO: 46720 - RNA, 27 nt, Artificial Sequence
  Nischarin (214-222)
agcaucuucaagucccugcaccaggug

SEQ ID NO: 46721 - RNA, 27 nt, Artificial Sequence
  Adenylate kinase 9 (1441-1449)
agcaucggcggggcccugcgcuacgug

SEQ ID NO: 46722 - RNA, 27 nt, Artificial Sequence
  Protein ELYS (1701-1709)
agcauccacgagaccaucccccuggug

SEQ ID NO: 46723 - RNA, 27 nt, Artificial Sequence
  Hom s 5 (332-340)
agcaucaucgccgaggugaaggcccag

SEQ ID NO: 46724 - RNA, 30 nt, Artificial Sequence
  Zinc finger E-box-binding homeobox 2 (500-509)
agcaucaucgacuacacccuggagaaggug

SEQ ID NO: 46725 - RNA, 30 nt, Artificial Sequence
  Poly(rC)-binding protein 2 (27-36)
agcaucaucggcaagaagggggaguccgug

SEQ ID NO: 46726 - RNA, 165 nt, Artificial Sequence
  6.8 kDa mitochondrial proteolipid (4-58)
agcaucaucaagaacaucuggauccccaugaagccguacuacaccaagguguaccaggagaucuggaucggcauggggcugaugggcuucaucgucuacaagauccgcgccgccgacaagcgguccaaggcgcucaaggccagcgcccccgcccccgggcaccac

SEQ ID NO: 46727 - RNA, 27 nt, Artificial Sequence
  Neuron navigator 2 (1370-1378)
agcaucauccccuaccugcucgaggcc

SEQ ID NO: 46728 - RNA, 27 nt, Artificial Sequence
  Protein transport protein Sec23B (625-633)
agcauccuggccgaccgcauccuccug

SEQ ID NO: 46729 - RNA, 27 nt, Artificial Sequence
  Raftlin-2 (58-66)
agcauccuggacaucgugaccaagguc

SEQ ID NO: 46730 - RNA, 27 nt, Artificial Sequence
  Tripartite motif-containing protein 2 (120-128)
agcauccuggagaccgugaccgccguc

SEQ ID NO: 46731 - RNA, 27 nt, Artificial Sequence
  N6-adenosine-methyltransferase 70 kDa subunit (384-392)
agcauccugggcaaguucgccgugguc

SEQ ID NO: 46732 - RNA, 69 nt, Artificial Sequence
  Heat shock cognate 71 kDa protein (362-384)
agcaucaaccccgacgaggccguggccuacggcgcggccguccaggccgccauccuguccggggacaag

SEQ ID NO: 46733 - RNA, 27 nt, Artificial Sequence
  Eukaryotic translation initiation factor 4 gamma 1 (244-252)
agcauccccggcgacaccaugaccacg

SEQ ID NO: 46734 - RNA, 27 nt, Artificial Sequence
  Cyclic AMP-dependent transcription factor ATF-6 alpha (178-186)
agcauccagcccaagccgcugcuccug

SEQ ID NO: 46735 - RNA, 27 nt, Artificial Sequence
  E3 ubiquitin-protein ligase UBR5 (550-558)
agcaucuccgccggcauccccaaggug

SEQ ID NO: 46736 - RNA, 27 nt, Artificial Sequence
  Tuberin (341-349)
agcaucacccgccugaucaagaaguac

SEQ ID NO: 46737 - RNA, 27 nt, Artificial Sequence
  ATP-dependent DNA helicase Q1 (13-21)
agcaucaccuccgagcugcacgccgug

SEQ ID NO: 46738 - RNA, 30 nt, Artificial Sequence
  Alpha-2-macroglobulin (161-170)
agcaucuacaagcccggccagaccgugaag

SEQ ID NO: 46739 - RNA, 63 nt, Artificial Sequence
  Heat shock protein HSP 90-beta (408-428)
agcaucuacuacaucaccggcgaguccaaggagcagguggccaacagcgccuucgucgagcgc

SEQ ID NO: 46740 - RNA, 27 nt, Artificial Sequence
  Pre-mRNA-processing-splicing factor 8 (1179-1187)
agcaaggacaaccccaaccugcucuuc

SEQ ID NO: 46741 - RNA, 24 nt, Artificial Sequence
  Histone-lysine N-methyltransferase SETDB1 (427-434)
agcaagggccccgugguccaguac

SEQ ID NO: 46742 - RNA, 21 nt, Artificial Sequence
  Histone deacetylase 1 (88-94)
agcaagcagaugcagcgcuuc

SEQ ID NO: 46743 - RNA, 27 nt, Artificial Sequence
  AT-rich interactive domain-containing protein 1A (1821-1829)
agccuggccgcccgcgcgaucgccgug

SEQ ID NO: 46744 - RNA, 39 nt, Artificial Sequence
  Tenascin (1578-1590)
agccuggccgaccucucccccagcacccacuacaccgcc

SEQ ID NO: 46745 - RNA, 33 nt, Artificial Sequence
  Integrin alpha-7 (461-471)
agccuggccgacaccgccgugcucuuccgcgcg

SEQ ID NO: 46746 - RNA, 33 nt, Artificial Sequence
  Melanocyte protein PMEL (577-587)
agccuggccgacaccaacucccucgccgugguc

SEQ ID NO: 46747 - RNA, 27 nt, Artificial Sequence
  Sestrin-2 (190-198)
agccuggccgagcucauccaggcccug

SEQ ID NO: 46748 - RNA, 27 nt, Artificial Sequence
  Fatty acid synthase (2500-2508)
agccuggccgagccccgcguguccguc

SEQ ID NO: 46749 - RNA, 33 nt, Artificial Sequence
  Ankyrin-2 (84-94)
agccuggccggccaggccgagguggucaaggug

SEQ ID NO: 46750 - RNA, 27 nt, Artificial Sequence
  Putative WAS protein family homolog 3 (9-17)
agccuggccggccagaccuacgccgug

SEQ ID NO: 46751 - RNA, 27 nt, Artificial Sequence
  Transmembrane protein 25 isoform 5 (201-209)
agccuggcccacaaccucuccgugguc

SEQ ID NO: 46752 - RNA, 30 nt, Artificial Sequence
  T-complex protein 1 subunit beta (5-14)
agccuggcccccgugaacaucuucaaggcc

SEQ ID NO: 46753 - RNA, 30 nt, Artificial Sequence
  Hermansky-Pudlak syndrome 4 protein (570-579)
agccuggccucccucaacggccuggaggug

SEQ ID NO: 46754 - RNA, 27 nt, Artificial Sequence
  Inversin (13-21)
agccuggccucccaggugcacgccgcg

SEQ ID NO: 46755 - RNA, 30 nt, Artificial Sequence
  Serine/threonine-protein kinase SMG1 (1090-1099)
agccuggccuccgugaucaucagcgcccuc

SEQ ID NO: 46756 - RNA, 27 nt, Artificial Sequence
  Unconventional myosin-Ic (701-709)
agccuggccaccaagauccaggccgcg

SEQ ID NO: 46757 - RNA, 27 nt, Artificial Sequence
  Growth factor receptor-bound protein 10 (498-506)
agccuggacgacggcaacaccaaguuc

SEQ ID NO: 46758 - RNA, 33 nt, Artificial Sequence
  L-dopachrome tautomerase (288-298)
agccuggacgacuacaaccaccucgugacccug

SEQ ID NO: 46759 - RNA, 30 nt, Artificial Sequence
  Proline-rich protein 12 (709-718)
agccuggacgagggcgccaccgccgcgcuc

SEQ ID NO: 46760 - RNA, 27 nt, Artificial Sequence
  Heat shock protein 105 kDa (204-212)
agccuggacgagaagccccgcaucgug

SEQ ID NO: 46761 - RNA, 27 nt, Artificial Sequence
  Adenomatous polyposis coli protein (1410-1418)
agccuggacgagcccuucauccagaag

SEQ ID NO: 46762 - RNA, 30 nt, Artificial Sequence
  Sister chromatid cohesion protein PDS5 homolog A (493-502)
agccuggaccccaacgccgugaaggcccuc

SEQ ID NO: 46763 - RNA, 27 nt, Artificial Sequence
  Regulator of G-protein signaling 20 (174-182)
agccuggacucccgcgugcgggagguc

SEQ ID NO: 46764 - RNA, 27 nt, Artificial Sequence
  Protein AHNAK2 (497-505)
agccuggacguguccgcccccaagguc

SEQ ID NO: 46765 - RNA, 33 nt, Artificial Sequence
  Importin subunit alpha-4 (6-16)
agccuggagaaccaccgcaucaaguccuucaag

SEQ ID NO: 46766 - RNA, 27 nt, Artificial Sequence
  mRNA cap guanine-N7 methyltransferase (14-22)
agccuggagcaggccaaggccuccgug

SEQ ID NO: 46767 - RNA, 30 nt, Artificial Sequence
  Cytokine receptor common subunit beta (667-676)
agccuggaguccggcgggggccccgccccg

SEQ ID NO: 46768 - RNA, 27 nt, Artificial Sequence
  G-protein coupled receptor 56 (216-224)
agccuggaguccaagcucaccagcgug

SEQ ID NO: 46769 - RNA, 36 nt, Artificial Sequence
  Tetratricopeptide repeat protein 28 (808-819)
agccuguucgaccuccagaccuccagcuaccaggcc

SEQ ID NO: 46770 - RNA, 30 nt, Artificial Sequence
  WD repeat-containing protein 27 (376-385)
agccuguucggcgggaagaucgccgugcuc

SEQ ID NO: 46771 - RNA, 21 nt, Artificial Sequence
  Four and a half LIM domains protein 2 (123-129)
agccuguucggcaagaaguac

SEQ ID NO: 46772 - RNA, 27 nt, Artificial Sequence
  Four and a half LIM domains protein 2 (123-131)
agccuguucggcaagaaguacauccuc

SEQ ID NO: 46773 - RNA, 27 nt, Artificial Sequence
  Mannosyl-oligosaccharide 1,2-alpha-mannosidase IA (231-239)
agccuguucggcaacaucaagggggcc

SEQ ID NO: 46774 - RNA, 27 nt, Artificial Sequence
  Plectin (6-14)
agccuguuccccucccucguggucgug

SEQ ID NO: 46775 - RNA, 39 nt, Artificial Sequence
  GPI transamidase component PIG-T (490-502)
agccuguuccccguguccgacggcagcaacuacuucguc

SEQ ID NO: 46776 - RNA, 27 nt, Artificial Sequence
  Hsp90 co-chaperone Cdc37 (27-35)
agccuguuccgcuggcggcaccaggcc

SEQ ID NO: 46777 - RNA, 27 nt, Artificial Sequence
  Zinc finger MYM-type protein 3 (596-604)
agccuguucuccggcaagcccgaggug

SEQ ID NO: 46778 - RNA, 27 nt, Artificial Sequence
  Uracil phosphoribosyltransferase homolog (268-276)
agccuguucuccaccccccacggcgcc

SEQ ID NO: 46779 - RNA, 30 nt, Artificial Sequence
  Formin-like protein 2 (880-889)
agccuguucuacaacgagcuccacuacgug

SEQ ID NO: 46780 - RNA, 27 nt, Artificial Sequence
  Cation-independent mannose-6-phosphate receptor (2149-2157)
agccugggcgacaucuacuucaagcuc

SEQ ID NO: 46781 - RNA, 27 nt, Artificial Sequence
  Dynein heavy chain domain-containing protein 1 (1476-1484)
agccugggcgaggcccucaagcagcug

SEQ ID NO: 46782 - RNA, 27 nt, Artificial Sequence
  Neuroblast differentiation-associated protein AHNAK (969-977)
agccugggcgaggggcaccucuccgug

SEQ ID NO: 46783 - RNA, 24 nt, Artificial Sequence
  TBC1 domain family member 4 (1089-1096)
agccugggcuucguggcccgcguc

SEQ ID NO: 46784 - RNA, 30 nt, Artificial Sequence
  Caspase-4 (16-25)
agccugggcaaggacuuccucaccggggug

SEQ ID NO: 46785 - RNA, 24 nt, Artificial Sequence
  Solute carrier family 26 member 6 (325-332)
agccugggcaagaucuucgcccuc

SEQ ID NO: 46786 - RNA, 24 nt, Artificial Sequence
  Circadian clock protein PASD1 (699-706)
agccugggccccgugguccaggug

SEQ ID NO: 46787 - RNA, 24 nt, Artificial Sequence
  Vesicular glutamate transporter 2 (23-30)
agccugggccagaucuaccgcgug

SEQ ID NO: 46788 - RNA, 27 nt, Artificial Sequence
  Cathepsin K (65-73)
agccugggcgugcacaccuacgagcuc

SEQ ID NO: 46789 - RNA, 27 nt, Artificial Sequence
  Vacuolar protein sorting-associated protein 16 homolog (139-147)
agccugcacgacaccgugaccacgcuc

SEQ ID NO: 46790 - RNA, 27 nt, Artificial Sequence
  Probable phospholipid-transporting ATPase IH (690-698)
agccugcacgacgugcucuucgagcug

SEQ ID NO: 46791 - RNA, 27 nt, Artificial Sequence
  Sarcoplasmic/endoplasmic reticulum calcium ATPase 1 (817-825)
agccugcacuuccucauccuguacgug

SEQ ID NO: 46792 - RNA, 27 nt, Artificial Sequence
  Coatomer subunit alpha (27-35)
agccugcacaacggcgugauccagcuc

SEQ ID NO: 46793 - RNA, 27 nt, Artificial Sequence
  Forkhead box protein O1 (252-260)
agccugcacuccaaguucauccgcgug

SEQ ID NO: 46794 - RNA, 36 nt, Artificial Sequence
  Serum albumin (89-100)
agccugcacacccucuucggcgacaagcugugcacc

SEQ ID NO: 46795 - RNA, 27 nt, Artificial Sequence
  Adenosylhomocysteinase (198-206)
agccugaucgacggcaucaagcgcgcc

SEQ ID NO: 46796 - RNA, 27 nt, Artificial Sequence
  AP-1 complex subunit beta-1 (665-673)
agccugaucggcgggaccaacuucgug

SEQ ID NO: 46797 - RNA, 21 nt, Artificial Sequence
  Myoferlin (1042-1048)
agccugaucggcuggaaguuc

SEQ ID NO: 46798 - RNA, 27 nt, Artificial Sequence
  Protein LMBR1L (107-115)
agccugauccacggccucuggaaccug

SEQ ID NO: 46799 - RNA, 27 nt, Artificial Sequence
  Abelson tyrosine-protein kinase 2 (153-161)
agccugaucaacggcuccuuccucgug

SEQ ID NO: 46800 - RNA, 33 nt, Artificial Sequence
  RNA-binding protein 34 (218-228)
agccugauccccgccgagggcacccucuccaag

SEQ ID NO: 46801 - RNA, 27 nt, Artificial Sequence
  DENN domain-containing protein 5B (1249-1257)
agccugauccgcauccuccagaccauc

SEQ ID NO: 46802 - RNA, 27 nt, Artificial Sequence
  Putative bifunctional UDP-N-acetylglucosamine transferase and deubiquitinase ALG13 (66-74)
agccugaaggaggacauccagaaggcc

SEQ ID NO: 46803 - RNA, 27 nt, Artificial Sequence
  Manganese-transporting ATPase 13A1 (594-602)
agccugaaguucgugggcuucaucguc

SEQ ID NO: 46804 - RNA, 27 nt, Artificial Sequence
  Protocadherin gamma-C3 (402-410)
agccugaagaacuacuucacccucaag

SEQ ID NO: 46805 - RNA, 27 nt, Artificial Sequence
  AP-3 complex delta subunit (882-890)
agccugcucgccgagaacuccuacgug

SEQ ID NO: 46806 - RNA, 30 nt, Artificial Sequence
  Exocyst complex component 1 (476-485)
agccugcucgacaugggcaacauguccgcc

SEQ ID NO: 46807 - RNA, 27 nt, Artificial Sequence
  Rotatin (1619-1627)
agccugcucgacaaccugcugaccauc

SEQ ID NO: 46808 - RNA, 36 nt, Artificial Sequence
  Eukaryotic translation initiation factor 3 subunit L (282-293)
agccugcucggcgacuacuaccaggccaucaaggug

SEQ ID NO: 46809 - RNA, 27 nt, Artificial Sequence
  Long-chain-fatty-acid-CoA ligase 3 (439-447)
agccugcucggcgggaacauccgccug

SEQ ID NO: 46810 - RNA, 30 nt, Artificial Sequence
  Solute carrier family 22 member 18 (168-177)
agccugcucggcgggacccugguguccgcc

SEQ ID NO: 46811 - RNA, 27 nt, Artificial Sequence
  Neurochondrin (337-345)
agccugcucaaggagccccagaaggug

SEQ ID NO: 46812 - RNA, 24 nt, Artificial Sequence
  Melanoma-associated antigen 10 (310-317)
agccugcucaaguuccuggccaag

SEQ ID NO: 46813 - RNA, 27 nt, Artificial Sequence
  Melanoma-associated antigen 10 (310-318)
agccugcucaaguuccuggccaaggug

SEQ ID NO: 46814 - RNA, 27 nt, Artificial Sequence
  Zinc finger protein 644 (1297-1305)
agccugcucaagaagcccgccuccauc

SEQ ID NO: 46815 - RNA, 27 nt, Artificial Sequence
  Metallophosphoesterase 1 (21-29)
agccugcuccugaagcugaucgccgug

SEQ ID NO: 46816 - RNA, 27 nt, Artificial Sequence
  Chromodomain-helicase-DNA-binding protein 4 (1004-1012)
agccugcucaacguggucauggaccug

SEQ ID NO: 46817 - RNA, 27 nt, Artificial Sequence
  Importin-4 (220-228)
agccugcuccccuacuucccggccauc

SEQ ID NO: 46818 - RNA, 27 nt, Artificial Sequence
  G-protein coupled receptor 56 (5-13)
agccugcuccagaccacccuguuccug

SEQ ID NO: 46819 - RNA, 27 nt, Artificial Sequence
  Pericentrin (2516-2524)
agccugcucuccgagauccaggcccug

SEQ ID NO: 46820 - RNA, 27 nt, Artificial Sequence
  Bromodomain adjacent to zinc finger domain protein 2A (217-225)
agccugcucuccagcuccgugcugacc

SEQ ID NO: 46821 - RNA, 27 nt, Artificial Sequence
  Zinc finger ZZ-type and EF-hand domain-containing protein 1 (401-409)
agccugcucaccucccuggugaccgcc

SEQ ID NO: 46822 - RNA, 36 nt, Artificial Sequence
  Delphilin (264-275)
agccugcucgugggcgggcuggccggccccgggggc

SEQ ID NO: 46823 - RNA, 27 nt, Artificial Sequence
  Band 4.1-like protein 2 (562-570)
agccugaugaaggacuuccccggcgcc

SEQ ID NO: 46824 - RNA, 24 nt, Artificial Sequence
  Oxysterol-binding protein-related protein 5 (301-308)
agccugauguggacccuccugaag

SEQ ID NO: 46825 - RNA, 27 nt, Artificial Sequence
  EMILIN-1 (224-232)
agccugaacgagcuccagaccaccgug

SEQ ID NO: 46826 - RNA, 27 nt, Artificial Sequence
  Glutamine and serine-rich protein 1 (920-928)
agccugaacggcaaccaggugaccguc

SEQ ID NO: 46827 - RNA, 27 nt, Artificial Sequence
  Neurofibromin (545-553)
agccugcccaaguucuaccuccuguuc

SEQ ID NO: 46828 - RNA, 30 nt, Artificial Sequence
  Ras-related protein Rab-38 (113-122)
agccugcccaacggcaagccgguguccguc

SEQ ID NO: 46829 - RNA, 72 nt, Artificial Sequence
  Talin-1 (1227-1250)
agccugcccccguccaccggcaccuuccaggaggcccagagccgccucaacgaggccgcggccgggcugaac

SEQ ID NO: 46830 - RNA, 27 nt, Artificial Sequence
  Disabled homolog 2 (264-272)
agccugccccgcccgaccccccaggcc

SEQ ID NO: 46831 - RNA, 30 nt, Artificial Sequence
  P2X purinoceptor 7 (420-429)
agccugcaggacgugaagggccaggagguc

SEQ ID NO: 46832 - RNA, 27 nt, Artificial Sequence
  Unconventional myosin-Va (987-995)
agccugcaggaggagaucgccaagcuc

SEQ ID NO: 46833 - RNA, 30 nt, Artificial Sequence
  Hyccin (485-494)
agccugcaggaggagaagcucaucuacgug

SEQ ID NO: 46834 - RNA, 27 nt, Artificial Sequence
  A-kinase anchor protein 9 (576-584)
agccugcagaaggaccucucccaggug

SEQ ID NO: 46835 - RNA, 27 nt, Artificial Sequence
  Sulfate transporter (477-485)
agccugcagaaguccgugcucggcguc

SEQ ID NO: 46836 - RNA, 33 nt, Artificial Sequence
  Matrix metalloproteinase-14 (60-70)
agccuguccgccgccaucgcggccaugcagaag

SEQ ID NO: 46837 - RNA, 27 nt, Artificial Sequence
  Ethanolamine kinase 2 (36-44)
agccuguccgccgacgugcccaagguc

SEQ ID NO: 46838 - RNA, 27 nt, Artificial Sequence
  Unconventional myosin-Ic (936-944)
agccuguccgacagccucuucgugcug

SEQ ID NO: 46839 - RNA, 39 nt, Artificial Sequence
  Mucin-16 (10281-10293)
agccuguccgaggccaugaccagcuucgccaccacgggc

SEQ ID NO: 46840 - RNA, 27 nt, Artificial Sequence
  CD109 antigen (1332-1340)
agccuguccgagaccgugaagaagguc

SEQ ID NO: 46841 - RNA, 30 nt, Artificial Sequence
  Melanoma antigen preferentially expressed in tumors (355-364)
agccuguccggcgugaugcucaccgacguc

SEQ ID NO: 46842 - RNA, 27 nt, Artificial Sequence
  WD repeat-containing protein 1 (156-164)
agccuguccggcuacaucaacuaccuc

SEQ ID NO: 46843 - RNA, 27 nt, Artificial Sequence
  Protein phosphatase 1 regulatory subunit 21 (218-226)
agccuguccaucaucaacgagaaggug

SEQ ID NO: 46844 - RNA, 30 nt, Artificial Sequence
  DNA dC-dU-editing enzyme APOBEC-3B (446-455)
agccugucccccggccaccucccggugccc

SEQ ID NO: 46845 - RNA, 30 nt, Artificial Sequence
  Alpha-ketoglutarate-dependent dioxygenase alkB homolog 3 (81-90)
agccugucccccaccggcgugagccgcguc

SEQ ID NO: 46846 - RNA, 27 nt, Artificial Sequence
  E3 ubiquitin-protein ligase TRIM56 (586-594)
agccugucccaggccagccacgccgug

SEQ ID NO: 46847 - RNA, 27 nt, Artificial Sequence
  Coiled-coil domain-containing protein 91 (414-422)
agccuguccagccucgagcuguuccug

SEQ ID NO: 46848 - RNA, 27 nt, Artificial Sequence
  Centrosomal protein of 290 kDa (11-19)
agccuguccagccuccuggugaagcug

SEQ ID NO: 46849 - RNA, 33 nt, Artificial Sequence
  Transcription factor HIVEP3 (1019-1029)
agccugaccggccccuccgccccggcccccgug

SEQ ID NO: 46850 - RNA, 27 nt, Artificial Sequence
  CDK5 regulatory subunit-associated protein 2 (1447-1455)
agccugaccuccgagauccacuuccuc

SEQ ID NO: 46851 - RNA, 27 nt, Artificial Sequence
  Epsilon-sarcoglycan (250-258)
agccugguggacaagaccaagcagguc

SEQ ID NO: 46852 - RNA, 33 nt, Artificial Sequence
  Transcription factor AP-2-epsilon (290-300)
agccugguggagggcgaggccguccaccucgcc

SEQ ID NO: 46853 - RNA, 27 nt, Artificial Sequence
  Tumor suppressor candidate 3 (209-217)
agccuggugggcgggcuccuguaccug

SEQ ID NO: 46854 - RNA, 27 nt, Artificial Sequence
  U5 small nuclear ribonucleoprotein 200 kDa helicase (42-50)
agccuggugggcaagcucgaggggacc

SEQ ID NO: 46855 - RNA, 27 nt, Artificial Sequence
  Niban-like protein 1 (77-85)
agccuggugccccacaacuacggccuc

SEQ ID NO: 46856 - RNA, 21 nt, Artificial Sequence
  DNA mismatch repair protein Msh6 (342-348)
agccuggugcagaagggcuac

SEQ ID NO: 46857 - RNA, 27 nt, Artificial Sequence
  Piezo-type mechanosensitive ion channel component 1 (1709-1717)
agccuggugcgcuccgucgugggcgug

SEQ ID NO: 46858 - RNA, 30 nt, Artificial Sequence
  Arylsulfatase B (320-329)
agccugugggagggcggggugcgcggcguc

SEQ ID NO: 46859 - RNA, 33 nt, Artificial Sequence
  Cohesin subunit SA-1 (487-497)
agccugugggaguccagccaggagcuccugaag

SEQ ID NO: 46860 - RNA, 27 nt, Artificial Sequence
  Membrane magnesium transporter 1 (4-12)
agccuguggaagggccucguggggauc

SEQ ID NO: 46861 - RNA, 27 nt, Artificial Sequence
  Rho guanine nucleotide exchange factor 5 (1151-1159)
agccuguggcaggagauccccgugguc

SEQ ID NO: 46862 - RNA, 27 nt, Artificial Sequence
  Lysosomal-trafficking regulator (2437-2445)
agccuguacgacaacauccuccugcac

SEQ ID NO: 46863 - RNA, 33 nt, Artificial Sequence
  Lysosomal-trafficking regulator (2437-2447)
agccuguacgacaacauccuccugcacaacgcc

SEQ ID NO: 46864 - RNA, 27 nt, Artificial Sequence
  Chloride channel protein 2 (551-559)
agccuguacgacuccaucauccgcauc

SEQ ID NO: 46865 - RNA, 30 nt, Artificial Sequence
  WD repeat-containing protein 3 (586-595)
agccuguacggccacaagcuccccgugauc

SEQ ID NO: 46866 - RNA, 27 nt, Artificial Sequence
  Protein YIPF4 (129-137)
agccuguacggccaguuccgcgugguc

SEQ ID NO: 46867 - RNA, 33 nt, Artificial Sequence
  Glutaminyl-peptide cyclotransferase (212-222)
agccuguacggcucccgccaccucgccgccaag

SEQ ID NO: 46868 - RNA, 30 nt, Artificial Sequence
  Clathrin heavy chain 1 (1532-1541)
agccuguacaaggacgccaugcaguacgcc

SEQ ID NO: 46869 - RNA, 27 nt, Artificial Sequence
  Laminin subunit alpha-4 (855-863)
agccuguacaugaagcccccggugaag

SEQ ID NO: 46870 - RNA, 27 nt, Artificial Sequence
  Membrane-associated transporter protein (382-390)
agccuguacuccuacuuccagaaggug

SEQ ID NO: 46871 - RNA, 27 nt, Artificial Sequence
  Cytoplasmic dynein 1 heavy chain 1 (3309-3317)
agcauggccaaccccccggccgcggug

SEQ ID NO: 46872 - RNA, 27 nt, Artificial Sequence
  Charged multivesicular body protein 2a (98-106)
agcauggcccaggccaugaagggcgug

SEQ ID NO: 46873 - RNA, 27 nt, Artificial Sequence
  Probable ATP-dependent RNA helicase DDX59 (525-533)
agcauggacgaguacgugcaccagcug

SEQ ID NO: 46874 - RNA, 36 nt, Artificial Sequence
  Zinc finger protein 160 (58-69)
agcaugcuggaggagggcaaggagcccuggaccgug

SEQ ID NO: 46875 - RNA, 30 nt, Artificial Sequence
  Serine palmitoyltransferase 3 (235-244)
agcaugaacauccccgcccuggugggcaag

SEQ ID NO: 46876 - RNA, 27 nt, Artificial Sequence
  Neuroblast differentiation-associated protein AHNAK (3672-3680)
agcaugcccgacuucgaccugaaccuc

SEQ ID NO: 46877 - RNA, 27 nt, Artificial Sequence
  Eukaryotic translation initiation factor 3 subunit L (303-311)
agcauguacucccgcgugcccgagugc

SEQ ID NO: 46878 - RNA, 36 nt, Artificial Sequence
  Histone-lysine N-methyltransferase 2C (3371-3382)
agcaacgccaacccccaguccggcccgcccccccgc

SEQ ID NO: 46879 - RNA, 36 nt, Artificial Sequence
  ATP-dependent RNA helicase A (233-244)
agcaacaagaagcuggccgcccaguccugcgcgcuc

SEQ ID NO: 46880 - RNA, 24 nt, Artificial Sequence
  Voltage-dependent L-type calcium channel subunit alpha-1C (157-164)
agcaaccuggagcgcguggaguac

SEQ ID NO: 46881 - RNA, 24 nt, Artificial Sequence
  Aldehyde dehydrogenase, mitochondrial (130-137)
agcaaccugaagcgcgugacccuc

SEQ ID NO: 46882 - RNA, 27 nt, Artificial Sequence
  Protocadherin gamma-A12 (544-552)
agcaacgugucccugagccucuucguc

SEQ ID NO: 46883 - RNA, 27 nt, Artificial Sequence
  Neuropilin-2 (579-587)
agccccgccggcaucgggaugcgccug

SEQ ID NO: 46884 - RNA, 27 nt, Artificial Sequence
  Sushi repeat-containing protein SRPX (3-11)
agccccgcccaccgcccggcccugcuc

SEQ ID NO: 46885 - RNA, 30 nt, Artificial Sequence
  Sushi repeat-containing protein SRPX (3-12)
agccccgcccaccgcccggcccugcuccug

SEQ ID NO: 46886 - RNA, 24 nt, Artificial Sequence
  Staphylococcal nuclease domain-containing protein 1 (730-737)
agccccgccaagauccacguguuc

SEQ ID NO: 46887 - RNA, 27 nt, Artificial Sequence
  Plectin (1284-1292)
agccccgccaagaagccgaaggugcag

SEQ ID NO: 46888 - RNA, 27 nt, Artificial Sequence
  Integrin beta-5 (81-89)
agccccgccuccagcuuccacgugcug

SEQ ID NO: 46889 - RNA, 27 nt, Artificial Sequence
  Nesprin-1 (72-80)
agccccgaggugggccgccugucccuc

SEQ ID NO: 46890 - RNA, 27 nt, Artificial Sequence
  Tetratricopeptide repeat protein 28 (1765-1773)
agccccuuccagaaggugggcaagcug

SEQ ID NO: 46891 - RNA, 36 nt, Artificial Sequence
  Carcinoembryonic antigen-related cell adhesion molecule 1 isoform 3 (361-372)
agccccggcgccaucgccgggaucgugaucggcguc

SEQ ID NO: 46892 - RNA, 36 nt, Artificial Sequence
  Transport and Golgi organization protein 6 homolog (29-40)
agccccggcggguccggcagcuccagccugcaggug

SEQ ID NO: 46893 - RNA, 36 nt, Artificial Sequence
  Vimentin (56-67)
agccccggcgggguguacgccacccgcuccagcgcc

SEQ ID NO: 46894 - RNA, 27 nt, Artificial Sequence
  HEAT repeat-containing protein 5B (63-71)
agccccggcccgcccacccgcaagcug

SEQ ID NO: 46895 - RNA, 27 nt, Artificial Sequence
  Rho guanine nucleotide exchange factor 26 (304-312)
agccccggcucccugcgccgggggcuc

SEQ ID NO: 46896 - RNA, 27 nt, Artificial Sequence
  Glia-derived nexin (66-74)
agcccccacggcaucgccuccgugcug

SEQ ID NO: 46897 - RNA, 30 nt, Artificial Sequence
  Tensin-3 (1123-1132)
agcccccacuccggcagcaccaucuccauc

SEQ ID NO: 46898 - RNA, 27 nt, Artificial Sequence
  Ankyrin repeat and BTB/POZ domain-containing protein 2 (632-640)
agccccaucccguccauccccgagauc

SEQ ID NO: 46899 - RNA, 27 nt, Artificial Sequence
  F-box only protein 7 (406-414)
agccccaagggccgcuucgugaugcug

SEQ ID NO: 46900 - RNA, 27 nt, Artificial Sequence
  Synaptic vesicle membrane protein VAT-1 homolog (249-257)
agccccaagggcguggacaucgucaug

SEQ ID NO: 46901 - RNA, 27 nt, Artificial Sequence
  Sodium-dependent neutral amino acid transporter B(0)AT2 (30-38)
agccccaagcugggcgggaucggcuuc

SEQ ID NO: 46902 - RNA, 30 nt, Artificial Sequence
  Collagen alpha-1(XV) chain (314-323)
agccccaagcagggcuccggggagauccug

SEQ ID NO: 46903 - RNA, 27 nt, Artificial Sequence
  E3 ubiquitin-protein ligase RLIM (89-97)
agcccccugcacccgauguccgagauc

SEQ ID NO: 46904 - RNA, 30 nt, Artificial Sequence
  Cleavage stimulation factor subunit 2 (154-163)
agcccccaggaggcccgcaacaugcugcuc

SEQ ID NO: 46905 - RNA, 27 nt, Artificial Sequence
  L-dopachrome tautomerase (134-142)
agcccccaggagcgcgagcaguuccug

SEQ ID NO: 46906 - RNA, 27 nt, Artificial Sequence
  Immunoglobulin superfamily member 11 (234-242)
agcccccagccgcgcaacaucggccug

SEQ ID NO: 46907 - RNA, 27 nt, Artificial Sequence
  Collagen triple helix repeat-containing protein 1 (9-17)
agcccccagcgccugcggggccuccug

SEQ ID NO: 46908 - RNA, 27 nt, Artificial Sequence
  Ropporin-1A (153-161)
agcccccgcaucccguucuccaccuuc

SEQ ID NO: 46909 - RNA, 24 nt, Artificial Sequence
  Procollagen-lysine,2-oxoglutarate 5-dioxygenase 3 (702-709)
agcccccgcaagggcugggcccug

SEQ ID NO: 46910 - RNA, 24 nt, Artificial Sequence
  Procollagen-lysine,2-oxoglutarate 5-dioxygenase 2 (174-181)
agcccccgcaagggcugguccuuc

SEQ ID NO: 46911 - RNA, 24 nt, Artificial Sequence
  Delta-like protein 3 (3-10)
agcccccgcauguccggccugcuc

SEQ ID NO: 46912 - RNA, 33 nt, Artificial Sequence
  Delta-like protein 3 (3-13)
agcccccgcauguccggccugcucagccagacc

SEQ ID NO: 46913 - RNA, 27 nt, Artificial Sequence
  Integrin alpha-7 (803-811)
agcccccgcccgaacauccugcaccuc

SEQ ID NO: 46914 - RNA, 27 nt, Artificial Sequence
  Protocadherin gamma-C3 (65-73)
agcccccgccagacccugaccgugcuc

SEQ ID NO: 46915 - RNA, 27 nt, Artificial Sequence
  RPA-interacting protein (7-15)
agcccccgccggucccuguacaagcuc

SEQ ID NO: 46916 - RNA, 27 nt, Artificial Sequence
  E3 ubiquitin-protein ligase RING1 (9-17)
agcccccgcucccugcacagcgagcuc

SEQ ID NO: 46917 - RNA, 27 nt, Artificial Sequence
  AP-1 complex subunit sigma-1A (146-154)
agcccccgcuccgugcuggaggagaug

SEQ ID NO: 46918 - RNA, 54 nt, Artificial Sequence
  Fatty acid synthase (856-873)
agccccuccgccgccaucuacaacaucgacaccagcuccgagagcccggaccac

SEQ ID NO: 46919 - RNA, 27 nt, Artificial Sequence
  Rho GTPase-activating protein 32 (243-251)
agccccuccaccaagcugcucacccug

SEQ ID NO: 46920 - RNA, 30 nt, Artificial Sequence
  Melanoma antigen preferentially expressed in tumors (345-354)
agccccuccgugagccagcuguccguccuc

SEQ ID NO: 46921 - RNA, 27 nt, Artificial Sequence
  SAM and SH3 domain-containing protein 1 (442-450)
agccccaccgccucccgcaucagccug

SEQ ID NO: 46922 - RNA, 27 nt, Artificial Sequence
  Transcription factor Dp-2 (24-32)
agccccaccaagggcaacaucuccuuc

SEQ ID NO: 46923 - RNA, 27 nt, Artificial Sequence
  Bestrophin-1 (499-507)
agccccaccaacauccacaccacgcug

SEQ ID NO: 46924 - RNA, 27 nt, Artificial Sequence
  Nuclear factor 1 X-type (373-381)
agccccuacuucacccacccgaccauc

SEQ ID NO: 46925 - RNA, 27 nt, Artificial Sequence
  Zinc finger CCHC domain-containing protein 24 (93-101)
agccccuacggcucccugaacaacauc

SEQ ID NO: 46926 - RNA, 27 nt, Artificial Sequence
  Zinc finger protein 503 (341-349)
agccccuacaagccgggccagaccgug

SEQ ID NO: 46927 - RNA, 30 nt, Artificial Sequence
  Retinoic acid receptor RXR-gamma (68-77)
agccccuaccgcgugaucaccuccgccaug

SEQ ID NO: 46928 - RNA, 24 nt, Artificial Sequence
  Filamin-A (1603-1610)
agccccuaccgcgugcgggccguc

SEQ ID NO: 46929 - RNA, 63 nt, Artificial Sequence
  HLA class I histocompatibility antigen, A-23 alpha chain (345-365)
agccaggccgccuccagcgacuccgcgcagggcagcgacgugucccugaccgccugcaagguc

SEQ ID NO: 46930 - RNA, 72 nt, Artificial Sequence
  AT-rich interactive domain-containing protein 1A (334-357)
agccagugcuggggcgccgccgcggccgccgccgccgcggccgccgccuccgggggcgcgcagcagcgcagc

SEQ ID NO: 46931 - RNA, 24 nt, Artificial Sequence
  Hemicentin-1 (1082-1089)
agccaggacaagcccguggagauc

SEQ ID NO: 46932 - RNA, 27 nt, Artificial Sequence
  Very large A-kinase anchor protein (777-785)
agccaggaccccaaccgcguggagcug

SEQ ID NO: 46933 - RNA, 27 nt, Artificial Sequence
  Transmembrane protein 131 (324-332)
agccaguucuccggcaagaucaccgug

SEQ ID NO: 46934 - RNA, 63 nt, Artificial Sequence
  Hsp70-binding protein 1 (65-85)
agccagggcugcuccagcgggggcgggggcgggggcuccagcgccggcggguccggcaacagc

SEQ ID NO: 46935 - RNA, 30 nt, Artificial Sequence
  Histone acetyltransferase p300 (1897-1906)
agccagggcaaggccgccgggcaggugacc

SEQ ID NO: 46936 - RNA, 36 nt, Artificial Sequence
  Beta-2-microglobulin (87-98)
agccagcccaagaucgugaagugggaccgcgacaug

SEQ ID NO: 46937 - RNA, 39 nt, Artificial Sequence
  Ras-associating and dilute domain-containing protein (258-270)
agccagcagcacgacucccugguguacguccucaaccgc

SEQ ID NO: 46938 - RNA, 30 nt, Artificial Sequence
  Oxysterol-binding protein-related protein 10 (232-241)
agccaguacuccggccagcugcacgaggug

SEQ ID NO: 46939 - RNA, 27 nt, Artificial Sequence
  Transmembrane and TPR repeat-containing protein 2 (541-549)
agccgcuucgccgaggcccugcacuac

SEQ ID NO: 46940 - RNA, 27 nt, Artificial Sequence
  Pre-mRNA-processing-splicing factor 8 (979-987)
agccgcuucgagaagauguacgagaag

SEQ ID NO: 46941 - RNA, 27 nt, Artificial Sequence
  Glia-derived nexin (207-215)
agccgcuuccagcccgagaacaccaag

SEQ ID NO: 46942 - RNA, 18 nt, Artificial Sequence
  ER membrane protein complex subunit 1 (7-12)
agccgcuucuggcugugg

SEQ ID NO: 46943 - RNA, 24 nt, Artificial Sequence
  Splicing factor 3B subunit 3 (33-40)
agccgcggcaagauccuggagcuc

SEQ ID NO: 46944 - RNA, 27 nt, Artificial Sequence
  Maltase-glucoamylase (658-666)
agccgccacuaccugaacauccgguac

SEQ ID NO: 46945 - RNA, 27 nt, Artificial Sequence
  B-cell lymphoma 6 protein (444-452)
agccgccugaacaacaucgugaaccgg

SEQ ID NO: 46946 - RNA, 27 nt, Artificial Sequence
  Centrosomal protein C10orf90 (199-207)
agccgcaacuccagcgugguccggcug

SEQ ID NO: 46947 - RNA, 27 nt, Artificial Sequence
  Maltase-glucoamylase, intestinal (1482-1490)
agccgcaacgugcugcagacccgguac

SEQ ID NO: 46948 - RNA, 66 nt, Artificial Sequence
  Glia-derived nexin (57-78)
agccgcccccacgacaacaucgugaucuccccgcacggcaucgccagcguccuggggaugcuccag

SEQ ID NO: 46949 - RNA, 24 nt, Artificial Sequence
  Arylsulfatase B (42-49)
agccgccccccgcaccugguguuc

SEQ ID NO: 46950 - RNA, 27 nt, Artificial Sequence
  Fatty acid synthase (1916-1924)
agccgcuccggcauccggaccggguac

SEQ ID NO: 46951 - RNA, 27 nt, Artificial Sequence
  Vasorin (3-11)
agccgcgugccccugcuccugccgcug

SEQ ID NO: 46952 - RNA, 24 nt, Artificial Sequence
  Semaphorin-3A (543-550)
agccgcuacuuccccaccgccaag

SEQ ID NO: 46953 - RNA, 48 nt, Artificial Sequence
  Alpha-1D adrenergic receptor (23-38)
agcuccgccggcgggggcgggggcagcgccgggggcgcggcccccucc

SEQ ID NO: 46954 - RNA, 27 nt, Artificial Sequence
  Insulin receptor substrate 2 (311-319)
agcuccgccacccaccccaucagcgug

SEQ ID NO: 46955 - RNA, 27 nt, Artificial Sequence
  Protein CMSS1 (145-153)
agcuccgccgugcgcgcccuggagcuc

SEQ ID NO: 46956 - RNA, 27 nt, Artificial Sequence
  Protein FAM127A (59-67)
agcuccgacgcccugaaggugaccuuc

SEQ ID NO: 46957 - RNA, 30 nt, Artificial Sequence
  Beta-1-syntrophin (489-498)
agcuccgacgacggcauccgcaugcuguac

SEQ ID NO: 46958 - RNA, 27 nt, Artificial Sequence
  Transcription elongation factor B polypeptide 1 (7-15)
agcuccgacggccacgaguucaucgug

SEQ ID NO: 46959 - RNA, 27 nt, Artificial Sequence
  Cyclin-dependent kinase-like 3 (88-96)
agcuccgaccugcuccaccacgaguac

SEQ ID NO: 46960 - RNA, 27 nt, Artificial Sequence
  Neutrophil collagenase (228-236)
agcuccgaccccggcgcccugauguac

SEQ ID NO: 46961 - RNA, 51 nt, Artificial Sequence
  HLA class I histocompatibility antigen, A-23 alpha chain (349-365)
agcuccgacagcgcccagggcuccgacgugagccugaccgccugcaagguc

SEQ ID NO: 46962 - RNA, 84 nt, Artificial Sequence
  NADH dehydrogenase (ubiquinone) 1 beta subcomplex subunit 11, mitochondrial (31-58)
agcuccuucagccgcaccguggucgcccccuccgccguggcgggcaagcggccgcccgagcccaccacgcccuggcaggaggac

SEQ ID NO: 46963 - RNA, 39 nt, Artificial Sequence
  Keratin, type I cytoskeletal 10 (570-582)
agcuccggcagcgugggggaguccagcuccaagggcccc

SEQ ID NO: 46964 - RNA, 21 nt, Artificial Sequence
  Zinc finger protein 697 (329-335)
agcucccaccugcucagccac

SEQ ID NO: 46965 - RNA, 21 nt, Artificial Sequence
  BTB/POZ domain-containing protein KCTD20 (144-150)
agcuccaagcuguaccgcuuc

SEQ ID NO: 46966 - RNA, 39 nt, Artificial Sequence
  Voltage-dependent anion-selective channel protein 1 (240-252)
agcucccugaucggccucggguacacccagacccugaag

SEQ ID NO: 46967 - RNA, 27 nt, Artificial Sequence
  Phosphatidylinositol 4-phosphate 3-kinase C2 domain-containing subunit alpha (1113-1121)
agcuccaacgccgugccccugaagguc

SEQ ID NO: 46968 - RNA, 27 nt, Artificial Sequence
  Niemann-Pick C1 protein (167-175)
agcuccaacgacaaggcccugggccuc

SEQ ID NO: 46969 - RNA, 27 nt, Artificial Sequence
  Ligand of Numb protein X 2 (382-390)
agcuccaacgaccgcgugcuggccauc

SEQ ID NO: 46970 - RNA, 42 nt, Artificial Sequence
  Beta-secretase 2 (113-126)
agcuccaacuucgccguggccggcaccccccacagcuacauc

SEQ ID NO: 46971 - RNA, 45 nt, Artificial Sequence
  Beta-secretase 2 (113-127)
agcuccaacuucgccguggccggcaccccccacagcuacaucgac

SEQ ID NO: 46972 - RNA, 48 nt, Artificial Sequence
  Beta-secretase 2 (113-128)
agcuccaacuucgccguggccggcaccccccacagcuacaucgacacc

SEQ ID NO: 46973 - RNA, 27 nt, Artificial Sequence
  Alpha-taxilin (438-446)
agcuccaacaaggcccugcucgagaug

SEQ ID NO: 46974 - RNA, 27 nt, Artificial Sequence
  Plakophilin-4 (457-465)
agcucccagcgcagcacccugaccuac

SEQ ID NO: 46975 - RNA, 27 nt, Artificial Sequence
  Golgin subfamily B member 1 (3000-3008)
agcucccagacccagccccugaaggug

SEQ ID NO: 46976 - RNA, 33 nt, Artificial Sequence
  Transducin-like enhancer protein 3 (167-177)
agcuccagcggccugcucgcccugggggcccug

SEQ ID NO: 46977 - RNA, 42 nt, Artificial Sequence
  Keratin, type I cytoskeletal 10 (37-50)
agcuccagcaagggcucccuggggggcggguucagcuccggc

SEQ ID NO: 46978 - RNA, 45 nt, Artificial Sequence
  Keratin, type I cytoskeletal 10 (37-51)
agcuccagcaagggcucccuggggggcggguucagcuccggcggg

SEQ ID NO: 46979 - RNA, 48 nt, Artificial Sequence
  Keratin, type I cytoskeletal 10 (37-52)
agcuccagcaagggcucccuggggggcggguucagcuccggcggguuc

SEQ ID NO: 46980 - RNA, 54 nt, Artificial Sequence
  Keratin, type I cytoskeletal 10 (37-54)
agcuccagcaagggcucccuggggggcggguucagcuccggcggguucagcggc

SEQ ID NO: 46981 - RNA, 57 nt, Artificial Sequence
  Keratin, type I cytoskeletal 10 (37-55)
agcuccagcaagggcucccuggggggcggguucagcuccggcggguucagcggcggc

SEQ ID NO: 46982 - RNA, 27 nt, Artificial Sequence
  Actin, gamma-enteric smooth muscle (190-198)
agcuccagcucccuggagaagagcuac

SEQ ID NO: 46983 - RNA, 39 nt, Artificial Sequence
  Synaptotagmin-like protein 2 (277-289)
agcuccagcuccagcaccgacuccgagacccugcgcuac

SEQ ID NO: 46984 - RNA, 36 nt, Artificial Sequence
  Synaptotagmin-like protein 2 (279-290)
agcuccagcuccaccgacagcgagacccugcgcuac

SEQ ID NO: 46985 - RNA, 30 nt, Artificial Sequence
  Synaptotagmin-like protein 2 (281-290)
agcuccaccgacagcgagacccugcgcuac

SEQ ID NO: 46986 - RNA, 27 nt, Artificial Sequence
  F-actin-capping protein subunit beta (41-49)
agcuccguggaccagccccugaagauc

SEQ ID NO: 46987 - RNA, 21 nt, Artificial Sequence
  TATA-binding protein-associated factor 2N (44-50)
agcuccuacggccagaacuac

SEQ ID NO: 46988 - RNA, 27 nt, Artificial Sequence
  Poly(rC)-binding protein 4 (68-76)
agcaccgccgccguguuccacgcgguc

SEQ ID NO: 46989 - RNA, 24 nt, Artificial Sequence
  40S ribosomal protein S19 (59-66)
agcaccgcccgccaccuguaccuc

SEQ ID NO: 46990 - RNA, 33 nt, Artificial Sequence
  Regulator of G-protein signaling 12 (284-294)
agcaccgacaaggccggcguggucgccgaguac

SEQ ID NO: 46991 - RNA, 30 nt, Artificial Sequence
  Neuropilin-2 (829-838)
agcaccgacaaggagaaguccuggcuguac

SEQ ID NO: 46992 - RNA, 30 nt, Artificial Sequence
  Protein LZIC (168-177)
agcaccgaccugggccgccccccguccuac

SEQ ID NO: 46993 - RNA, 27 nt, Artificial Sequence
  Transcription factor HES-1 (101-109)
agcaccgaccccuccgugcugggcaag

SEQ ID NO: 46994 - RNA, 24 nt, Artificial Sequence
  Heterogeneous nuclear ribonucleoprotein K (188-195)
agcaccgaccgcgugguccugauc

SEQ ID NO: 46995 - RNA, 30 nt, Artificial Sequence
  CUB and sushi domain-containing protein 1 (1359-1368)
agcaccuucaacucccugacccuccaguuc

SEQ ID NO: 46996 - RNA, 24 nt, Artificial Sequence
  Transcription termination factor 2 (827-834)
agcaccggccgcccccuggugauc

SEQ ID NO: 46997 - RNA, 24 nt, Artificial Sequence
  Basic leucine zipper and W2 domain-containing protein 2 (54-61)
agcaccggcucccgccuggacuac

SEQ ID NO: 46998 - RNA, 21 nt, Artificial Sequence
  Synemin (859-865)
agcaccauccgcuacuccugg

SEQ ID NO: 46999 - RNA, 54 nt, Artificial Sequence
  Transformation/transcription domain-associated protein (377-394)
agcacccuggccgaccucgugcaccacguccgccagcaccugccccuguccgac

SEQ ID NO: 47000 - RNA, 21 nt, Artificial Sequence
  Nicalin (264-270)
agcacccuggagcaccaccuc

SEQ ID NO: 47001 - RNA, 93 nt, Artificial Sequence
  CXXC-type zinc finger protein 5 (18-48)
agcaccaacggcuccgggggcagcggguccagcggccccaaggccggggccgcggacaaguccgccguggucgccgccgccgcgccggccagc

SEQ ID NO: 47002 - RNA, 30 nt, Artificial Sequence
  Transmembraneoprotein NMB (294-303)
agcaccaaccacaccgugaaccacacguac

SEQ ID NO: 47003 - RNA, 27 nt, Artificial Sequence
  Patatin-like phospholipase domain-containing protein 2 (199-207)
agcaccaacauccacgagcugcgcgug

SEQ ID NO: 47004 - RNA, 27 nt, Artificial Sequence
  Sodium/potassium-transporting ATPase subunit alpha-3 (487-495)
agcaccaacaaguaccagcuguccauc

SEQ ID NO: 47005 - RNA, 27 nt, Artificial Sequence
  Transmembrane emp24 domain-containing protein 10 (181-189)
agcaccaacacccgcgugcuguacuuc

SEQ ID NO: 47006 - RNA, 27 nt, Artificial Sequence
  DNA-directed RNA polymerase I subunit RPA2 (156-164)
agcacccagaagcaggugcugaacuac

SEQ ID NO: 47007 - RNA, 24 nt, Artificial Sequence
  Protein-methionine sulfoxide oxidase MICAL3 (646-653)
agcacccgcucccccaucagcuuc

SEQ ID NO: 47008 - RNA, 45 nt, Artificial Sequence
  Vimentin (2-16)
agcacccgcuccgugagcuccagcuccuaccggcgcauguucggc

SEQ ID NO: 47009 - RNA, 45 nt, Artificial Sequence
  Vimentin (47-61)
agcaccucccgcagccuguacgccuccagccccggcgggguguac

SEQ ID NO: 47010 - RNA, 21 nt, Artificial Sequence
  WD repeat-containing protein 36 (352-358)
agcaccgugcacgagaaguuc

SEQ ID NO: 47011 - RNA, 27 nt, Artificial Sequence
  Zinc finger CCHC domain-containing protein 3 (228-236)
agcguggccgcccagcugaccggcguc

SEQ ID NO: 47012 - RNA, 27 nt, Artificial Sequence
  Zinc finger protein 518B (424-432)
agcguggcccugaagggccacucccuc

SEQ ID NO: 47013 - RNA, 33 nt, Artificial Sequence
  Latent-transforming growth factor beta-binding protein 3 (178-188)
agcguggccuccaagcacgccaucuacgcgguc

SEQ ID NO: 47014 - RNA, 27 nt, Artificial Sequence
  3-hydroxybutyrate dehydrogenase type 2 (133-141)
agcguggccuccagcgucaagggcgug

SEQ ID NO: 47015 - RNA, 60 nt, Artificial Sequence
  Chondroitin sulfate proteoglycan 4 (124-143)
agcguggacggcuuccugaacgccuccagcgccguccccggggcgccgcucgaggugccc

SEQ ID NO: 47016 - RNA, 27 nt, Artificial Sequence
  GDNF-inducible zinc finger protein 1 (69-77)
agcguggacggcacccgcaccaacguc

SEQ ID NO: 47017 - RNA, 27 nt, Artificial Sequence
  Protein AHNAK2 (2175-2183)
agcguggacgucucccccccgaaggug

SEQ ID NO: 47018 - RNA, 27 nt, Artificial Sequence
  Phospholipase B-like 1 (304-312)
agcguguucaacaagacccugcucaag

SEQ ID NO: 47019 - RNA, 21 nt, Artificial Sequence
  Clathrin interactor 1 (166-172)
agcgugggcggguuccgcuac

SEQ ID NO: 47020 - RNA, 57 nt, Artificial Sequence
  Prelamin-A/C (479-497)
agcgugggcggguccggcgggggcagcuucggggacaaccuggucacccgcuccuac

SEQ ID NO: 47021 - RNA, 27 nt, Artificial Sequence
  Heterogeneous nuclear ribonucleoprotein C-like 1 (47-55)
agcgugcacaagggcuucgccuucguc

SEQ ID NO: 47022 - RNA, 27 nt, Artificial Sequence
  COUP transcription factor 2 (223-231)
agcgugaucgagcagcuguucuucguc

SEQ ID NO: 47023 - RNA, 27 nt, Artificial Sequence
  Serine/threonine-protein kinase ICK (533-541)
agcgugaucuccaaggucaacagcgug

SEQ ID NO: 47024 - RNA, 69 nt, Artificial Sequence
  Glutathione reductase, mitochondrial (234-256)
agcgugaucgucggcgccggguacaucgccguggagauggcgggcauccuguccgcccucgggagcaag

SEQ ID NO: 47025 - RNA, 27 nt, Artificial Sequence
  Kelch-like protein 21 (378-386)
agcgugcuggacggccuccuguacguc

SEQ ID NO: 47026 - RNA, 30 nt, Artificial Sequence
  Protein transport protein Sec61 subunit alpha isoform 1 (353-362)
agcgugcuggaggaccccguccacgccgug

SEQ ID NO: 47027 - RNA, 21 nt, Artificial Sequence
  Tetratricopeptide repeat protein 27 (74-80)
agcgugcuguuccagcaguuc

SEQ ID NO: 47028 - RNA, 27 nt, Artificial Sequence
  Histone-lysine N-methyltransferase SETD1B (168-176)
agcgugaugggcaacaucauccacguc

SEQ ID NO: 47029 - RNA, 27 nt, Artificial Sequence
  E3 ubiquitin-protein ligase UBR4 (884-892)
agcgugaaccgcuacauccugcagcuc

SEQ ID NO: 47030 - RNA, 36 nt, Artificial Sequence
  Integral membrane protein GPR137C (4-15)
agcgugcccggcccggccgccgcggccgcccccgcc

SEQ ID NO: 47031 - RNA, 78 nt, Artificial Sequence
  CCR4-NOT transcription complex subunit 3 (392-417)
agcgugcagcccuccggcgggggcgggggcgggagcggcggcgggggcuccagcuccagcuccaacagcuccgccggg

SEQ ID NO: 47032 - RNA, 30 nt, Artificial Sequence
  Transmembrane protein 98 (124-133)
agcguguccgacaucaucgucguggccaag

SEQ ID NO: 47033 - RNA, 27 nt, Artificial Sequence
  Adipocyte enhancer-binding protein 1 (926-934)
agcguguccggcaucaaccacgggguc

SEQ ID NO: 47034 - RNA, 27 nt, Artificial Sequence
  Dimethyladenosine transferase 1, mitochondrial (145-153)
agcguguccaccccccugaucaucaag

SEQ ID NO: 47035 - RNA, 27 nt, Artificial Sequence
  Dolichyl-diphosphooligosaccharide-proteinosyltransferase subunit 2 (121-129)
agcgugacccagaucuaccacgccguc

SEQ ID NO: 47036 - RNA, 27 nt, Artificial Sequence
  Lysine-specific demethylase 4B (1000-1008)
agcgugaccucccacaucuaccagguc

SEQ ID NO: 47037 - RNA, 27 nt, Artificial Sequence
  PR domain zinc finger protein 2 (684-692)
agcguguaccuguccagcaagcucaag

SEQ ID NO: 47038 - RNA, 24 nt, Artificial Sequence
  Suppressor of tumorigenicity 7 protein (439-446)
agcguguaccccaagaaggagcug

SEQ ID NO: 47039 - RNA, 36 nt, Artificial Sequence
  Semaphorin-3D (430-441)
agcguguaccccgucgccggcgggccgaccuucaag

SEQ ID NO: 47040 - RNA, 30 nt, Artificial Sequence
  Melanophilin (449-458)
agcguguaccgcggcucccugacccagcgg

SEQ ID NO: 47041 - RNA, 30 nt, Artificial Sequence
  Cathepsin B (254-263)
agcguguacuccgacuuccugcucuacaag

SEQ ID NO: 47042 - RNA, 36 nt, Artificial Sequence
  Synaptotagmin-like protein 2 (618-629)
agcguguacuccggcgacuucgggaaccuggagguc

SEQ ID NO: 47043 - RNA, 27 nt, Artificial Sequence
  Retrotransposon gag domain-containing protein 4 (253-261)
agcuacgccgacgccuuccaguuccug

SEQ ID NO: 47044 - RNA, 27 nt, Artificial Sequence
  WD repeat-containing protein 11 (156-164)
agcuacgccgacaacauccuguccuuc

SEQ ID NO: 47045 - RNA, 27 nt, Artificial Sequence
  SH3 domain-binding protein 1 (158-166)
agcuacgccaacuacuucauccgccug

SEQ ID NO: 47046 - RNA, 60 nt, Artificial Sequence
  Thioredoxin reductase 1, cytoplasmic (10-29)
agcuacgacuacgaccugaucaucaucggcgggggcuccgggggccucgccgccgcgaag

SEQ ID NO: 47047 - RNA, 27 nt, Artificial Sequence
  Dedicator of cytokinesis protein 7 (739-747)
agcuacauccacuacguguuccgccug

SEQ ID NO: 47048 - RNA, 27 nt, Artificial Sequence
  Transportin-2 (516-524)
agcuacauccuggacacccucguguuc

SEQ ID NO: 47049 - RNA, 27 nt, Artificial Sequence
  E3 ubiquitin-protein ligase TRIM58 (431-439)
agcuacaucuacaccuucaaccagcug

SEQ ID NO: 47050 - RNA, 27 nt, Artificial Sequence
  SMC5-SMC6 complex localization factor protein 2 (901-909)
agcuacaagcccaucuucuccacccug

SEQ ID NO: 47051 - RNA, 21 nt, Artificial Sequence
  Nicotinamide phosphoribosyltransferase (17-23)
agcuacaaggugacccacuac

SEQ ID NO: 47052 - RNA, 27 nt, Artificial Sequence
  Zinc finger CCHC domain-containing protein 24 (70-78)
agcuaccugaacuccuucuuccagcuc

SEQ ID NO: 47053 - RNA, 27 nt, Artificial Sequence
  Glycogenin-1 (194-202)
agcuaccugcccgccuucaagguguuc

SEQ ID NO: 47054 - RNA, 27 nt, Artificial Sequence
  DNA-directed RNA polymerase III subunit RPC2 (532-540)
agcuaccccaacguguuccuggucuuc

SEQ ID NO: 47055 - RNA, 27 nt, Artificial Sequence
  Helicase-like transcription factor (29-37)
agcuaccccaccuucuucccgcgcuuc

SEQ ID NO: 47056 - RNA, 27 nt, Artificial Sequence
  Nesprin-1 (3393-3401)
agcuaccaggacggcgugcgccaguuc

SEQ ID NO: 47057 - RNA, 27 nt, Artificial Sequence
  RB1-inducible coiled-coil protein 1 (163-171)
agcuaccagaagcugcucuucaaguuc

SEQ ID NO: 47058 - RNA, 27 nt, Artificial Sequence
  Farnesyl pyrophosphate synthase (314-322)
agcuacucccacaucauggcccugauc

SEQ ID NO: 47059 - RNA, 24 nt, Artificial Sequence
  2',3'-cyclic-nucleotide 3'-phosphodiesterase (257-264)
agcuacuccaaggccuucacccug

SEQ ID NO: 47060 - RNA, 69 nt, Artificial Sequence
  HLA class I histocompatibility antigen, A-23 alpha chain (343-365)
agcuacucccaggccgccagcuccgacagcgcgcagggcuccgacgugagccugaccgccugcaagguc

SEQ ID NO: 47061 - RNA, 69 nt, Artificial Sequence
  HLA class I histocompatibility antigen, A-1 alpha chain (318-340)
agcuacacccaggccgccuccagcgacuccgcgcagggcagcgacgugucccugaccgccugcaagguc

SEQ ID NO: 47062 - RNA, 27 nt, Artificial Sequence
  Mediator of RNA polymerase II transcription subunit 13-like (933-941)
agcuacgugcacaagguccccuccuuc

SEQ ID NO: 47063 - RNA, 18 nt, Artificial Sequence
  Amyloid protein-binding protein 2 (340-345)
agcuacgugcaccaguac

SEQ ID NO: 47064 - RNA, 27 nt, Artificial Sequence
  Melanoma-associated antigen 12 (282-290)
agcuacgugaagguccugcaccaccuc

SEQ ID NO: 47065 - RNA, 27 nt, Artificial Sequence
  Dolichyl-diphosphooligosaccharide-proteinosyltransferase 48 kDa subunit (22-30)
accgccgcccgcgcgugggcccuguuc

SEQ ID NO: 47066 - RNA, 27 nt, Artificial Sequence
  Protein AATF (30-38)
accgccgcccgcgugaucgaccgguuc

SEQ ID NO: 47067 - RNA, 30 nt, Artificial Sequence
  Dolichyl-diphosphooligosaccharide-proteinosyltransferase 48 kDa subunit (78-87)
accgccgacgaccccagccugucccucauc

SEQ ID NO: 47068 - RNA, 24 nt, Artificial Sequence
  Triokinase/FMN cyclase (233-240)
accgccgacgagaucgugaagcug

SEQ ID NO: 47069 - RNA, 27 nt, Artificial Sequence
  Calcium homeostasis endoplasmic reticulum protein (170-178)
accgccgacggcgcccacuucgagcug

SEQ ID NO: 47070 - RNA, 27 nt, Artificial Sequence
  Transducin beta-like protein 3 (197-205)
accgccgaccacaaccugcuccuguac

SEQ ID NO: 47071 - RNA, 27 nt, Artificial Sequence
  Late secretory pathway protein AVL9 homolog (340-348)
accgccgacgugagccacaccaaccug

SEQ ID NO: 47072 - RNA, 30 nt, Artificial Sequence
  Histone acetyltransferase type B catalytic subunit (274-283)
accgccgaggaccccagcaaguccuacgug

SEQ ID NO: 47073 - RNA, 63 nt, Artificial Sequence
  3-hydroxyacyl-CoA dehydrogenase type-2 (26-46)
accgccgagcgccuggugggccagggggccagcgcgguccuccuggaccugcccaacuccggc

SEQ ID NO: 47074 - RNA, 24 nt, Artificial Sequence
  H(+)/Cl(-) exchange transporter 7 (101-108)
accgccuuccgcaccguggagauc

SEQ ID NO: 47075 - RNA, 84 nt, Artificial Sequence
  Alpha-1,6-mannosylglycoprotein 6-beta-N-acetylglucosaminyltransferase A (288-315)
accgccuucagcggcgggccccugggcgagcucgugcagugguccgaccugaucaccagccuguaccuccuggggcacgacauc

SEQ ID NO: 47076 - RNA, 24 nt, Artificial Sequence
  Cleavage and polyadenylation specificity factor subunit 2 (239-246)
accgccggccgcgugcuggagcuc

SEQ ID NO: 47077 - RNA, 27 nt, Artificial Sequence
  Biorientation of chromosomes in cell division protein 1-like 1 (1268-1276)
accgccaaggaccccagcguguccauc

SEQ ID NO: 47078 - RNA, 24 nt, Artificial Sequence
  Guanine nucleotide exchange factor for Rab-3A (87-94)
accgcccugaagacccucgugauc

SEQ ID NO: 47079 - RNA, 75 nt, Artificial Sequence
  60 kDa heat shock protein, mitochondrial (527-551)
accgcccugcucgacgccgcgggcguggccagccugcugaccacggccgaggucguggugaccgagauccccaag

SEQ ID NO: 47080 - RNA, 84 nt, Artificial Sequence
  60 kDa heat shock protein, mitochondrial (527-554)
accgcccugcucgacgccgcgggcguggccagccugcugaccacggccgaggucguggugaccgagauccccaaggaggagaag

SEQ ID NO: 47081 - RNA, 42 nt, Artificial Sequence
  Plexin-B2 (1522-1535)
accgcccagauccugagcgaccucgaccugaccucccagcgc

SEQ ID NO: 47082 - RNA, 21 nt, Artificial Sequence
  40S ribosomal protein S19 (60-66)
accgcccgccaccuguaccuc

SEQ ID NO: 47083 - RNA, 48 nt, Artificial Sequence
  Zinc finger SWIM domain-containing protein 8 (1087-1102)
accgccagccagcgcucccccagcaagcacggcgggccguccgccccc

SEQ ID NO: 47084 - RNA, 51 nt, Artificial Sequence
  Eukaryotic initiation factor 4A-I (83-99)
accgccaccuucgccaucagcauccugcagcagaucgagcucgaccugaag

SEQ ID NO: 47085 - RNA, 42 nt, Artificial Sequence
  Tubulin alpha-1C chain (249-262)
accgccguggucgagcccuacaacagcauccugaccacgcac

SEQ ID NO: 47086 - RNA, 30 nt, Artificial Sequence
  Endoplasmin (419-428)
accgacgacuuccacgacaugaugcccaag

SEQ ID NO: 47087 - RNA, 24 nt, Artificial Sequence
  GPI transamidase component PIG-T (162-169)
accgaccacuacuuccugcgcuac

SEQ ID NO: 47088 - RNA, 42 nt, Artificial Sequence
  Alpha-enolase (67-80)
accgacaagguggucaucggcauggacguggccgccagcgag

SEQ ID NO: 47089 - RNA, 48 nt, Artificial Sequence
  Alpha-enolase (67-82)
accgacaagguggucaucggcauggacguggccgccagcgaguucuuc

SEQ ID NO: 47090 - RNA, 42 nt, Artificial Sequence
  4F2 cell-surface antigen heavy chain (174-187)
accgaccugcuccagaucgaccccaacuucggcagcaaggag

SEQ ID NO: 47091 - RNA, 45 nt, Artificial Sequence
  4F2 cell-surface antigen heavy chain (174-188)
accgaccugcuccagaucgaccccaacuucggcagcaaggaggac

SEQ ID NO: 47092 - RNA, 24 nt, Artificial Sequence
  Synaptotagmin-like protein 2 (283-290)
accgacagcgagacccugcgcuac

SEQ ID NO: 47093 - RNA, 21 nt, Artificial Sequence
  40S ribosomal protein SA (150-156)
accgacagcccccugcgcuac

SEQ ID NO: 47094 - RNA, 48 nt, Artificial Sequence
  Carbonic anhydrase 14 (52-67)
accgacagcgugaccuucgaccccgaccugccggcccuccagccccac

SEQ ID NO: 47095 - RNA, 30 nt, Artificial Sequence
  CD44 antigen (47-56)
accgaggccgccgaccugugcaaggcguuc

SEQ ID NO: 47096 - RNA, 27 nt, Artificial Sequence
  Rho GTPase-activating protein 5 (467-475)
accgaggccgacagcaaggagguguac

SEQ ID NO: 47097 - RNA, 30 nt, Artificial Sequence
  Protein kinase C-binding protein 1 (210-219)
accgaggccuuccuggccgacgcgaagugg

SEQ ID NO: 47098 - RNA, 27 nt, Artificial Sequence
  Inosine-5'-monophosphate dehydrogenase 1 isoform f (446-454)
accgaggcccccggcgaguacuucuuc

SEQ ID NO: 47099 - RNA, 33 nt, Artificial Sequence
  Glycogen phosphorylase, muscle form (672-682)
accgaggccagcggcaccgggaacaugaaguuc

SEQ ID NO: 47100 - RNA, 30 nt, Artificial Sequence
  Zinc finger BED domain-containing protein 4 (394-403)
accgaggaccugcagagccaccucaacccc

SEQ ID NO: 47101 - RNA, 42 nt, Artificial Sequence
  Large neutral amino acids transporter small subunit 1 (264-277)
accgaggagaugaucaaccccuaccgcaaccugccgcucgcc

SEQ ID NO: 47102 - RNA, 21 nt, Artificial Sequence
  Nuclear factor erythroid 2-related factor 1 (9-15)
accgagggccugcuccaguuc

SEQ ID NO: 47103 - RNA, 27 nt, Artificial Sequence
  G-protein coupled receptor 98 (3712-3720)
accgagggccaggugcugagcaccauc

SEQ ID NO: 47104 - RNA, 30 nt, Artificial Sequence
  Fibronectin isoform 7 (376-385)
accgagggccgccaggacgggcaccugugg

SEQ ID NO: 47105 - RNA, 33 nt, Artificial Sequence
  Tribbles homolog 2 (117-127)
accgagaucauccugggcgagaccaaggccuac

SEQ ID NO: 47106 - RNA, 24 nt, Artificial Sequence
  Flotillin-2 (60-67)
accgagaaggagcugcucgccgug

SEQ ID NO: 47107 - RNA, 33 nt, Artificial Sequence
  Centrosomal protein of 41 kDa (40-50)
accgagaagcuggaggagaucaagaagaacuac

SEQ ID NO: 47108 - RNA, 33 nt, Artificial Sequence
  Integrin alpha-6 (905-915)
accgagaagcagaucgacgacaaccgcaaguuc

SEQ ID NO: 47109 - RNA, 27 nt, Artificial Sequence
  Programmed cell death protein 5 (103-111)
accgagaagaccacgaccgugaaguuc

SEQ ID NO: 47110 - RNA, 30 nt, Artificial Sequence
  SH3 domain-binding protein 5 (34-43)
accgagcuggaggacgcccgccagaaguuc

SEQ ID NO: 47111 - RNA, 27 nt, Artificial Sequence
  Vesicle-trafficking protein SEC22b (140-148)
accgagcugcaggacgugcagcgcauc

SEQ ID NO: 47112 - RNA, 27 nt, Artificial Sequence
  NHL repeat-containing protein 2 (296-304)
accgagaaccaccugauccgcaagauc

SEQ ID NO: 47113 - RNA, 21 nt, Artificial Sequence
  Zinc finger CCCH domain-containing protein 18 (68-74)
accgagcccuaccacaacuac

SEQ ID NO: 47114 - RNA, 30 nt, Artificial Sequence
  Baculoviral IAP repeat-containing protein 6 (1992-2001)
accgagcagcugcgcaccaucauccgguac

SEQ ID NO: 47115 - RNA, 27 nt, Artificial Sequence
  Vacuolar protein sorting-associated protein 13C (969-977)
accgagcagaccgugaaggucgccuuc

SEQ ID NO: 47116 - RNA, 27 nt, Artificial Sequence
  Centrosomal protein C10orf90 isoform X1 (20-28)
accgagaccgccgugcaccgcacguuc

SEQ ID NO: 47117 - RNA, 27 nt, Artificial Sequence
  Lysosomal-trafficking regulator (2635-2643)
accgagaccgagcuggcccagcgccuc

SEQ ID NO: 47118 - RNA, 33 nt, Artificial Sequence
  Receptor-type protein tyrosine phosphatase beta (1331-1341)
accgaggugcuggacagccacauccacgccuac

SEQ ID NO: 47119 - RNA, 27 nt, Artificial Sequence
  Apolipoprotein E (36-44)
accgaguggcagagcggccagcgcugg

SEQ ID NO: 47120 - RNA, 27 nt, Artificial Sequence
  Calmodulin-regulated spectrin-associated protein 2 (1318-1326)
accgaguacaccggccccaagcuguac

SEQ ID NO: 47121 - RNA, 27 nt, Artificial Sequence
  Telomeric repeat-binding factor 1 (223-231)
accuuccacagcuucuuccagcacuuc

SEQ ID NO: 47122 - RNA, 30 nt, Artificial Sequence
  Dolichyl-diphosphooligosaccharide-proteinosyltransferase subunit 2 (266-275)
accuucaucgccgacagccaccagaacuuc

SEQ ID NO: 47123 - RNA, 27 nt, Artificial Sequence
  Phospholipid transfer protein (118-126)
accuucaucaccagcggcaugcgcuuc

SEQ ID NO: 47124 - RNA, 18 nt, Artificial Sequence
  Ras GTPase-activating-like protein IQGAP1 (1614-1619)
accuucaugcugcacuac

SEQ ID NO: 47125 - RNA, 60 nt, Artificial Sequence
  ATP synthase-coupling factor 6, mitochondrial (89-108)
accuuccccaccuucaaguucgaggacccgaaguucgaggugaucgagaagccccaggcc

SEQ ID NO: 47126 - RNA, 27 nt, Artificial Sequence
  Zinc finger protein 480 (28-36)
accuuccgcgacguggccaucgaguuc

SEQ ID NO: 47127 - RNA, 27 nt, Artificial Sequence
  Zinc finger protein 98 (14-22)
accuuccgcgacguggcccuggaguuc

SEQ ID NO: 47128 - RNA, 27 nt, Artificial Sequence
  Zinc finger protein 697 (8-16)
accuucagcguguccagccaccuguuc

SEQ ID NO: 47129 - RNA, 24 nt, Artificial Sequence
  Bestrophin-1 (574-581)
accuucaccggcauccuggggaag

SEQ ID NO: 47130 - RNA, 30 nt, Artificial Sequence
  Glyceraldehyde-3-phosphate dehydrogenase (211-220)
accggcgccgccaaggcgguggggaagguc

SEQ ID NO: 47131 - RNA, 45 nt, Artificial Sequence
  4F2 cell-surface antigen heavy chain (120-134)
accggcgcccuguaccgcaucggggaccuccaggccuuccagggc

SEQ ID NO: 47132 - RNA, 21 nt, Artificial Sequence
  Glia-derived nexin (397-403)
accggcgccgugcuguucaug

SEQ ID NO: 47133 - RNA, 27 nt, Artificial Sequence
  DNA-dependent protein kinase catalytic subunit (402-410)
accggcgacgaccgcguguaccagaug

SEQ ID NO: 47134 - RNA, 27 nt, Artificial Sequence
  Hsp90 co-chaperone Cdc37 (370-378)
accggcgacgagaaggacgugagcguc

SEQ ID NO: 47135 - RNA, 27 nt, Artificial Sequence
  Ubiquitin carboxyl-terminal hydrolase 8 (508-516)
accggcgacgugccccacaccagcguc

SEQ ID NO: 47136 - RNA, 42 nt, Artificial Sequence
  Basement membrane-specific heparan sulfate proteoglycan core protein (351-364)
accggcgaguucaccguggagcccgucccggagggggcccag

SEQ ID NO: 47137 - RNA, 33 nt, Artificial Sequence
  Titin (7053-7063)
accggcggggugcugggcgccagcugcauccuc

SEQ ID NO: 47138 - RNA, 42 nt, Artificial Sequence
  Transferrin receptor protein 1 (518-531)
accggccaguuccuguaccaggacagcaacugggccuccaag

SEQ ID NO: 47139 - RNA, 54 nt, Artificial Sequence
  Beta-secretase 2 (111-128)
accggcagcuccaacuucgccguggccgggaccccccacagcuacaucgacacg

SEQ ID NO: 47140 - RNA, 99 nt, Artificial Sequence
  Histone-lysine N-methyltransferase, H3 lysine-36 and H4 lysine-20 specific (2131-2163)
acccaccuggccgagcagagcaccggcauggccgcgcaggcccccaagauguccgacaagccgcccgccgacacgaaccagaugcucagccuguccaag

SEQ ID NO: 47141 - RNA, 27 nt, Artificial Sequence
  Ras GTPase-activating-like protein IQGAP1 (446-454)
acccaccccgagcugagcguggccguc

SEQ ID NO: 47142 - RNA, 27 nt, Artificial Sequence
  Phosphatidylinositol 4-kinase alpha (399-407)
accaucgacgccgacgcccccgagcug

SEQ ID NO: 47143 - RNA, 24 nt, Artificial Sequence
  Protein prune homolog 2 (1960-1967)
accaucgacgacaugagcaagcug

SEQ ID NO: 47144 - RNA, 24 nt, Artificial Sequence
  DNA damage-binding protein 1 (703-710)
accaucgacgagauccagaagcug

SEQ ID NO: 47145 - RNA, 24 nt, Artificial Sequence
  Calmodulin (66-73)
accaucgacuuccccgaguuccug

SEQ ID NO: 47146 - RNA, 24 nt, Artificial Sequence
  Filamin-A (2133-2140)
accaucgacggccccagcaaggug

SEQ ID NO: 47147 - RNA, 27 nt, Artificial Sequence
  Coatomer subunit alpha (591-599)
accaucgaccccaccgaguucaaguuc

SEQ ID NO: 47148 - RNA, 27 nt, Artificial Sequence
  Alpha-actinin-1 (506-514)
accaucgaccagcuguaccucgaguac

SEQ ID NO: 47149 - RNA, 24 nt, Artificial Sequence
  HEAT repeat-containing protein 1 (38-45)
accaucgaccgcgacaccgccuuc

SEQ ID NO: 47150 - RNA, 33 nt, Artificial Sequence
  Melanoma-associated antigen C2 (347-357)
accaucgacaccgccgacgacgccacggugaug

SEQ ID NO: 47151 - RNA, 27 nt, Artificial Sequence
  Vascular endothelial growth factor receptor 2 (1076-1084)
accaucuucgaccgcguguacaccauc

SEQ ID NO: 47152 - RNA, 27 nt, Artificial Sequence
  Tripartite motif-containing protein 2 (338-346)
accaucaucggccagcccaugagcgug

SEQ ID NO: 47153 - RNA, 27 nt, Artificial Sequence
  Obscurin-like protein 1 (641-649)
accaucauccagggcaccugguuccug

SEQ ID NO: 47154 - RNA, 36 nt, Artificial Sequence
  Lysosome-associated membraneoprotein 1 (247-258)
accauccugcccgacgcccgcgacccggccuucaag

SEQ ID NO: 47155 - RNA, 27 nt, Artificial Sequence
  Eukaryotic translation initiation factor 3 subunit A (435-443)
accauccugcgccuccugcagcaggug

SEQ ID NO: 47156 - RNA, 27 nt, Artificial Sequence
  Putative ATP-dependent RNA helicase DHX30 (700-708)
accaucaacgacaucgugcacgucgug

SEQ ID NO: 47157 - RNA, 27 nt, Artificial Sequence
  Chloride intracellular channel protein 1 (198-206)
accauccccgaggccuuccgcggcgug

SEQ ID NO: 47158 - RNA, 27 nt, Artificial Sequence
  Lysosomal-trafficking regulator (1800-1808)
accauccagggcauccugcacgagauc

SEQ ID NO: 47159 - RNA, 27 nt, Artificial Sequence
  Plexin-B3 (1547-1555)
accaucacccaggugaaggagaagguc

SEQ ID NO: 47160 - RNA, 30 nt, Artificial Sequence
  Serine/threonine-protein kinase DCLK1 (231-240)
accaucguggacggcccccuguacaccguc

SEQ ID NO: 47161 - RNA, 27 nt, Artificial Sequence
  Phosphopantothenoylcysteine decarboxylase (109-117)
accaucguggacaaggucaaggaggug

SEQ ID NO: 47162 - RNA, 33 nt, Artificial Sequence
  Heat shock protein HSP 90-alpha (90-100)
accaucguggacaccggcaucgggaugacgaag

SEQ ID NO: 47163 - RNA, 27 nt, Artificial Sequence
  Mitotic checkpoint serine/threonine-protein kinase BUB1 beta (868-876)
accaucguggagaugcugcacaaggcc

SEQ ID NO: 47164 - RNA, 33 nt, Artificial Sequence
  Heat shock 70 kDa protein 13 (95-105)
accaucuacgacgccaagcgcuucaucggcaag

SEQ ID NO: 47165 - RNA, 27 nt, Artificial Sequence
  Probable dolichyl pyrophosphate Glc1Man9GlcNAc2 alpha-1,3-glucosyltransferase (438-446)
accaucuacagcaucuccagccugaag

SEQ ID NO: 47166 - RNA, 81 nt, Artificial Sequence
  Activating signal cointegrator 1 complex subunit 3 (112-138)
accaaggccaucaagcagauguucggccccuucccgagcuccagcgccaccgcggccugcaacgccacgaaccgcaucauc

SEQ ID NO: 47167 - RNA, 81 nt, Artificial Sequence
  Transmembrane protease serine 9 (436-462)
accaaggccagcaugccccuggccccgaccauggcgcccgcccccgccgcccccuccacggccuggccgaccagccccgag

SEQ ID NO: 47168 - RNA, 27 nt, Artificial Sequence
  Protein kinase C delta type (402-410)
acccuggccgccgagaaccccuuccuc

SEQ ID NO: 47169 - RNA, 27 nt, Artificial Sequence
  Hexokinase-2 (389-397)
acccuggccgccgugcuccagcgcauc

SEQ ID NO: 47170 - RNA, 27 nt, Artificial Sequence
  Protein SOGA1 (670-678)
acccuggccgacaugaaggugacccuc

SEQ ID NO: 47171 - RNA, 27 nt, Artificial Sequence
  Ethanolaminephosphotransferase 1 (355-363)
acccuggcccacauccacuacggcgug

SEQ ID NO: 47172 - RNA, 30 nt, Artificial Sequence
  WD repeat-containing protein 73 (144-153)
acccuggcccccggcgugcuccacggggcc

SEQ ID NO: 47173 - RNA, 27 nt, Artificial Sequence
  Protein kinase C delta-binding protein (77-85)
acccuggcccagcuccuggccaaggcg

SEQ ID NO: 47174 - RNA, 33 nt, Artificial Sequence
  E3 ubiquitin-protein ligase UBR4 (345-355)
acccuggacgccgccaucagcaaggugcagguc

SEQ ID NO: 47175 - RNA, 27 nt, Artificial Sequence
  Melanoma-associated antigen C2 (140-148)
acccuggacgagaagguggccgagcuc

SEQ ID NO: 47176 - RNA, 27 nt, Artificial Sequence
  Lysine-specific demethylase 5C (1342-1350)
acccuggacgagaaccacagcaucccc

SEQ ID NO: 47177 - RNA, 30 nt, Artificial Sequence
  Calcium-dependent secretion activator 2 (651-660)
acccuggaccaccgccucaacgacagcuac

SEQ ID NO: 47178 - RNA, 24 nt, Artificial Sequence
  Rho guanine nucleotide exchange factor 2 (487-494)
acccuggacaagcccagcgugguc

SEQ ID NO: 47179 - RNA, 27 nt, Artificial Sequence
  Alpha-mannosidase 2C1 (688-696)
acccuggacaacggcaucauccgcgug

SEQ ID NO: 47180 - RNA, 27 nt, Artificial Sequence
  RING finger protein 150 (368-376)
acccuggaccccgccgugcgcaccguc

SEQ ID NO: 47181 - RNA, 27 nt, Artificial Sequence
  Proteinase-activated receptor 1 (37-45)
acccuggacccccgcagcuuccuccug

SEQ ID NO: 47182 - RNA, 24 nt, Artificial Sequence
  Eukaryotic initiation factor 4A-I (242-249)
acccuggagggcauccgccaguuc

SEQ ID NO: 47183 - RNA, 45 nt, Artificial Sequence
  Kin of IRRE-like protein 1 (337-351)
acccuggagcgcuacaccguggagcggacgaacagcggcuccggg

SEQ ID NO: 47184 - RNA, 27 nt, Artificial Sequence
  TBC1 domain family member 4 (1082-1090)
acccuguucgccagccaguucucccuc

SEQ ID NO: 47185 - RNA, 27 nt, Artificial Sequence
  Centrosomal protein C10orf90 (172-180)
acccuguuccaggcccccccggcccuc

SEQ ID NO: 47186 - RNA, 33 nt, Artificial Sequence
  Ubiquitin carboxyl-terminal hydrolase 11 (92-102)
acccuguuccaggacgagaucaacuggcgccuc

SEQ ID NO: 47187 - RNA, 27 nt, Artificial Sequence
  Transmembraneoprotein NMB (202-210)
acccugggcccccagcucauggaggug

SEQ ID NO: 47188 - RNA, 30 nt, Artificial Sequence
  Transmembrane channel-like protein 4 (331-340)
acccugggccagcaggcccgcguguggcuc

SEQ ID NO: 47189 - RNA, 24 nt, Artificial Sequence
  E3 ubiquitin-protein ligase TRIP12 (804-811)
acccugggccgcguguacaccauc

SEQ ID NO: 47190 - RNA, 24 nt, Artificial Sequence
  Ubiquitin-60S ribosomal protein L40 (71-78)
acccugcaccucgugcugcgccug

SEQ ID NO: 47191 - RNA, 27 nt, Artificial Sequence
  Alpha-adducin (222-230)
acccugcacagcgccaucuacgccgcg

SEQ ID NO: 47192 - RNA, 27 nt, Artificial Sequence
  Peptidyl-tRNA hydrolase 2, mitochondrial (125-133)
acccugaucgcccuccuggcccacgcg

SEQ ID NO: 47193 - RNA, 27 nt, Artificial Sequence
  Nebulin (5609-5617)
acccugaucgagagcgaccucaaguac

SEQ ID NO: 47194 - RNA, 33 nt, Artificial Sequence
  Ethanolamine-phosphate phospho-lyase (355-365)
acccugaucggcgacauccgcgggaucggccuc

SEQ ID NO: 47195 - RNA, 27 nt, Artificial Sequence
  COP9 signalosome complex subunit 7a (29-37)
acccugauccaccaggugcucgaggcc

SEQ ID NO: 47196 - RNA, 27 nt, Artificial Sequence
  Translocating chain-associated membrane protein 1 (264-272)
acccugauccucagcgugcugaccguc

SEQ ID NO: 47197 - RNA, 27 nt, Artificial Sequence
  Essential MCU regulator, mitochondrial (82-90)
acccugaucagcaagaacuucgccgcc

SEQ ID NO: 47198 - RNA, 42 nt, Artificial Sequence
  Ryanodine receptor 1 (3790-3803)
acccugaagcucggcaucagcauccugaacgggggcaacgcc

SEQ ID NO: 47199 - RNA, 30 nt, Artificial Sequence
  General transcription factor IIH subunit 3 (90-99)
acccugcucgccggcagccuggccaaggcg

SEQ ID NO: 47200 - RNA, 36 nt, Artificial Sequence
  ETS translocation variant 5 (376-387)
acccugcucgacgaccccgccaacgcccacuucauc

SEQ ID NO: 47201 - RNA, 27 nt, Artificial Sequence
  Protein kinase C delta-binding protein (27-35)
acccugcucgagaagcuggccagcaug

SEQ ID NO: 47202 - RNA, 27 nt, Artificial Sequence
  Spermatogenesis-associated protein 20 (211-219)
acccugcucgagaacagccagcgcgug

SEQ ID NO: 47203 - RNA, 27 nt, Artificial Sequence
  E3 ubiquitin-protein ligase HERC2 (204-212)
acccugcucgagagcauccagcacgug

SEQ ID NO: 47204 - RNA, 27 nt, Artificial Sequence
  Putative WAS protein family homolog 3 (362-370)
acccugcucgagagcauccgccaggcc

SEQ ID NO: 47205 - RNA, 27 nt, Artificial Sequence
  WD repeat-containing protein 26 (56-64)
acccugcucggcaucaucgugcgcaug

SEQ ID NO: 47206 - RNA, 78 nt, Artificial Sequence
  Vimentin (275-300)
acccugcucaucaagaccguggagacgcgcgacggccaggucaucaacgagaccagccagcaccacgacgaccuggag

SEQ ID NO: 47207 - RNA, 27 nt, Artificial Sequence
  Maltase-glucoamylase (871-879)
acccugcuccccuaccuguacacccug

SEQ ID NO: 47208 - RNA, 27 nt, Artificial Sequence
  Vacuolar protein-sorting-associated protein 25 (148-156)
acccugcuccgcgcccugcaggcccug

SEQ ID NO: 47209 - RNA, 27 nt, Artificial Sequence
  Histone acetyltransferase KAT2B (310-318)
acccugcuccgcagcguguucaccguc

SEQ ID NO: 47210 - RNA, 33 nt, Artificial Sequence
  Importin-7 (679-689)
acccugcucagcgacaccaaguaccuggagaug

SEQ ID NO: 47211 - RNA, 27 nt, Artificial Sequence
  Integrator complex subunit 2 (1086-1094)
acccugcucaccgugcugacgcaggcc

SEQ ID NO: 47212 - RNA, 33 nt, Artificial Sequence
  Rho GTPase-activating protein 7 (136-146)
acccugauggaccucagcgagcgccaggaggug

SEQ ID NO: 47213 - RNA, 21 nt, Artificial Sequence
  Glutamine-fructose-6-phosphate aminotransferase (isomerizing) 1 (429-435)
acccugaugggccuccgcuac

SEQ ID NO: 47214 - RNA, 27 nt, Artificial Sequence
  Ubiquitin conjugation factor E4 B (1239-1247)
acccugaugaccgaccccgugcgccuc

SEQ ID NO: 47215 - RNA, 27 nt, Artificial Sequence
  Nuclear factor related to kappa-B-binding protein (308-316)
acccugaacgacaucaugacccgcgug

SEQ ID NO: 47216 - RNA, 27 nt, Artificial Sequence
  EMILIN-1 (236-244)
acccugaacgagauccagcaccagcuc

SEQ ID NO: 47217 - RNA, 27 nt, Artificial Sequence
  Kelch-like protein 21 (467-475)
acccugaacggccucauguacuucgug

SEQ ID NO: 47218 - RNA, 33 nt, Artificial Sequence
  Nuclear pore complex protein Nup214 (188-198)
acccugcccagcaccguggccgucacguccgug

SEQ ID NO: 47219 - RNA, 27 nt, Artificial Sequence
  Nuclear mitotic apparatus protein 1 (151-159)
acccugcaggaggcccucgcccacgcg

SEQ ID NO: 47220 - RNA, 27 nt, Artificial Sequence
  DENN domain-containing protein 5A (930-938)
acccugcaggaguucaacaucacccuc

SEQ ID NO: 47221 - RNA, 27 nt, Artificial Sequence
  Uveal autoantigen with coiled-coil domains and ankyrin repeats (714-722)
acccugcagaaggagaucgagaaggug

SEQ ID NO: 47222 - RNA, 27 nt, Artificial Sequence
  Glycogen phosphorylase, liver form (95-103)
acccugcagaacaccaugaucaaccuc

SEQ ID NO: 47223 - RNA, 30 nt, Artificial Sequence
  Hemicentin-1 (4435-4444)
acccugcagagccccccgaucaucacccuc

SEQ ID NO: 47224 - RNA, 27 nt, Artificial Sequence
  Interleukin-6 receptor subunit beta (3-11)
acccugcagaccuggcucgugcaggcc

SEQ ID NO: 47225 - RNA, 27 nt, Artificial Sequence
  Alpha-actinin-4 (226-234)
acccugagcgacaucaaggcccucauc

SEQ ID NO: 47226 - RNA, 27 nt, Artificial Sequence
  Nucleolar pre-ribosomal-associated protein 1 (546-554)
acccugagcgaggacaugauccuccug

SEQ ID NO: 47227 - RNA, 27 nt, Artificial Sequence
  Serine/threonine-protein kinase ULK2 (102-110)
acccugagcgaggacaccauccgcgug

SEQ ID NO: 47228 - RNA, 27 nt, Artificial Sequence
  Alpha-actinin-1 (426-434)
acccugagcgagaucaaggcccuccug

SEQ ID NO: 47229 - RNA, 33 nt, Artificial Sequence
  Ribosomal protein S6 kinase beta-1 (376-386)
acccugagcgaguccgccaaccagguguuccuc

SEQ ID NO: 47230 - RNA, 33 nt, Artificial Sequence
  TRPM8 channel-associated factor 1 (309-319)
acccugagcggccuccuggccguggggggcauc

SEQ ID NO: 47231 - RNA, 27 nt, Artificial Sequence
  RRP12-like protein (274-282)
acccugagccacgugcucgucaccgcc

SEQ ID NO: 47232 - RNA, 27 nt, Artificial Sequence
  CLIP-associating protein 1 (164-172)
acccugagcaagaucgugccccacauc

SEQ ID NO: 47233 - RNA, 30 nt, Artificial Sequence
  Biorientation of chromosomes in cell division protein 1-like 1 (282-291)
acccugagccccgugaaggccggcccggcc

SEQ ID NO: 47234 - RNA, 42 nt, Artificial Sequence
  Beta-2-microglobulin (85-98)
acccugagccagcccaagaucgugaagugggaccgcgacaug

SEQ ID NO: 47235 - RNA, 27 nt, Artificial Sequence
  Laminin subunit gamma-1 (1109-1117)
acccugagcucccagaucagccgccuc

SEQ ID NO: 47236 - RNA, 81 nt, Artificial Sequence
  Heat shock cognate 71 kDa protein (273-299)
acccugagcuccagcacccaggccuccaucgagaucgacagccucuacgagggcaucgacuucuacacguccaucacccgc

SEQ ID NO: 47237 - RNA, 81 nt, Artificial Sequence
  Heat shock 70 kDa protein 1B (273-299)
acccugagcuccagcacccaggccucccucgagaucgacagccuguucgagggcaucgacuucuacacguccaucacccgc

SEQ ID NO: 47238 - RNA, 27 nt, Artificial Sequence
  MAX gene-associated protein (1410-1418)
acccugagcaccgugaucuccaagguc

SEQ ID NO: 47239 - RNA, 33 nt, Artificial Sequence
  Semaphorin-4C (57-67)
acccugaccgagcccacgggccuccuguacgug

SEQ ID NO: 47240 - RNA, 27 nt, Artificial Sequence
  Ras GTPase-activating protein 3 (509-517)
acccugacccucaucagcaagacggug

SEQ ID NO: 47241 - RNA, 30 nt, Artificial Sequence
  26S proteasome non-ATPase regulatory subunit 12 (319-328)
acccugguggaggacuacggcauggagcuc

SEQ ID NO: 47242 - RNA, 27 nt, Artificial Sequence
  Aggrecan core protein (1921-1929)
acccugguggagagcgucacccaggcc

SEQ ID NO: 47243 - RNA, 27 nt, Artificial Sequence
  WD repeat-containing protein 5B (36-44)
acccuggugggccacaccgaggccguc

SEQ ID NO: 47244 - RNA, 27 nt, Artificial Sequence
  Transcription factor SOX-9 (87-95)
acccuggugcccaugccgguccgcgug

SEQ ID NO: 47245 - RNA, 27 nt, Artificial Sequence
  Eukaryotic translation initiation factor 4 gamma 1 (1438-1446)
acccuggugcgcgcccucaugaccgcc

SEQ ID NO: 47246 - RNA, 27 nt, Artificial Sequence
  Cyclin-dependent kinase 3 (165-173)
acccugugguaccgcgcccccgagauc

SEQ ID NO: 47247 - RNA, 27 nt, Artificial Sequence
  Cyclin-dependent kinase 11B (347-355)
acccugugguaccgcgcccccgagcuc

SEQ ID NO: 47248 - RNA, 27 nt, Artificial Sequence
  Cyclin-dependent kinase 4 (103-111)
acccugugguaccgcgcccccgaggug

SEQ ID NO: 47249 - RNA, 33 nt, Artificial Sequence
  Cyclin-dependent kinase 4 (103-113)
acccugugguaccgcgcccccgaggugcuccug

SEQ ID NO: 47250 - RNA, 27 nt, Artificial Sequence
  Cyclin-dependent kinase 9 (191-199)
acccugugguaccgccccccggagcuc

SEQ ID NO: 47251 - RNA, 27 nt, Artificial Sequence
  Bifunctional lysine-specific demethylase and histidyl-hydroxylase NO66 (625-633)
acccuguacgacaagggccuccugcug

SEQ ID NO: 47252 - RNA, 27 nt, Artificial Sequence
  Ubiquitin-conjugating enzyme E2 G1 (48-56)
acccuguacgagggcgggguguucaag

SEQ ID NO: 47253 - RNA, 27 nt, Artificial Sequence
  Vacuolar protein sorting-associated protein 13B (1255-1263)
accauggccggccccgugccgaccagc

SEQ ID NO: 47254 - RNA, 24 nt, Artificial Sequence
  Insulin receptor substrate 2 (544-551)
accauggaccgcccccugagccac

SEQ ID NO: 47255 - RNA, 27 nt, Artificial Sequence
  Polyadenylate-binding protein 1 (489-497)
accaugggcccccgcccggccgccgcg

SEQ ID NO: 47256 - RNA, 30 nt, Artificial Sequence
  ER membrane protein complex subunit 1 (975-984)
accaugaucaccaagcgccuggcccaggug

SEQ ID NO: 47257 - RNA, 24 nt, Artificial Sequence
  Chondroitin sulfate proteoglycan 4 (21-28)
accaugcuggcccgccucgccagc

SEQ ID NO: 47258 - RNA, 27 nt, Artificial Sequence
  Protein wntless homolog (257-265)
accaugaugagccgccccccggugcug

SEQ ID NO: 47259 - RNA, 48 nt, Artificial Sequence
  Cytoplasmic polyadenylation element-binding protein 2 (92-107)
accaugcaggacgagcugcuccugggccugacccagcagcccgcccgc

SEQ ID NO: 47260 - RNA, 27 nt, Artificial Sequence
  Gamma-aminobutyric acid receptor subunit beta-2 (6-14)
accaugaccacgaucaacacccaccug

SEQ ID NO: 47261 - RNA, 27 nt, Artificial Sequence
  Eukaryotic translation initiation factor 4 gamma 1 (249-257)
accaugaccacgauccagaugagcgug

SEQ ID NO: 47262 - RNA, 21 nt, Artificial Sequence
  Cyclin-dependent kinase 13 (257-263)
accaacaaggugaucacccug

SEQ ID NO: 47263 - RNA, 33 nt, Artificial Sequence
  Ankyrin-3 (871-881)
accaacgugagcgcccgcuucuggcuggccgac

SEQ ID NO: 47264 - RNA, 27 nt, Artificial Sequence
  Guanine nucleotide exchange factor for Rab-3A (97-105)
acccccgccagcccgaaccgcgagcug

SEQ ID NO: 47265 - RNA, 39 nt, Artificial Sequence
  Sterol regulatory element-binding protein 1 (959-971)
acccccgccagcuccagcaucgacaaggccgugcagcug

SEQ ID NO: 47266 - RNA, 48 nt, Artificial Sequence
  Clathrin heavy chain 1 (394-409)
acccccgacaccauccgccgguuccagagcgugccggcccagcccggc

SEQ ID NO: 47267 - RNA, 21 nt, Artificial Sequence
  TRAF2 and NCK-interacting protein kinase (190-196)
acccccgagauccgcaaguac

SEQ ID NO: 47268 - RNA, 24 nt, Artificial Sequence
  Importin-7 (508-515)
acccccuucauccgcccggugaug

SEQ ID NO: 47269 - RNA, 27 nt, Artificial Sequence
  (Pyruvate dehydrogenase (acetyl-transferring))-phosphatase 1, mitochondrial (83-91)
accccccacccggccuacgccaccuuc

SEQ ID NO: 47270 - RNA, 39 nt, Artificial Sequence
  Zinc finger protein 354B (90-102)
acccccaagaugaccaagagcacgcagacccaggacucc

SEQ ID NO: 47271 - RNA, 24 nt, Artificial Sequence
  ATP-dependent RNA helicase DDX51 (308-315)
accccccugcgcgugagccucguc

SEQ ID NO: 47272 - RNA, 30 nt, Artificial Sequence
  Homeobox protein TGIF1 (249-258)
acccccccgcccaccccccccgaccugaac

SEQ ID NO: 47273 - RNA, 63 nt, Artificial Sequence
  Annexin A2 (19-39)
acccccccgagcgccuacggcuccgugaaggccuacaccaacuucgacgcggagcgcgacgcc

SEQ ID NO: 47274 - RNA, 33 nt, Artificial Sequence
  Nodal modulator 1 (365-375)
accccccagcuggccgacaucaucgccaccggc

SEQ ID NO: 47275 - RNA, 27 nt, Artificial Sequence
  Glycogen phosphorylase, brain form (48-56)
accccccgcgacuacuucuucgcccug

SEQ ID NO: 47276 - RNA, 27 nt, Artificial Sequence
  Sialidase-1 (85-93)
accccccgcggcacccugcucgccuuc

SEQ ID NO: 47277 - RNA, 27 nt, Artificial Sequence
  DNA-directed RNA polymerase III subunit RPC1 (167-175)
accccccgcaacggcgagccgcugauc

SEQ ID NO: 47278 - RNA, 27 nt, Artificial Sequence
  E3 ubiquitin-protein ligase RNF169 (410-418)
accccccgcaaccugaaccggagccuc

SEQ ID NO: 47279 - RNA, 27 nt, Artificial Sequence
  Galactose-3-O-sulfotransferase 4 (2-10)
accccccgcagcccgaccuccgccuuc

SEQ ID NO: 47280 - RNA, 30 nt, Artificial Sequence
  Rho GTPase-activating protein 7 (170-179)
accccccgcaccaacagcgugaucuccguc

SEQ ID NO: 47281 - RNA, 87 nt, Artificial Sequence
  Beta-2-microglobulin (70-98)
acccccaccgagaaggacgaguacgccugccgcgugaaccacgucacgcugagccagccgaagaucgugaagugggaccgggacaug

SEQ ID NO: 47282 - RNA, 63 nt, Artificial Sequence
  HLA class I histocompatibility antigen, A-1 alpha chain (320-340)
acccaggccgccagcuccgacagcgcgcagggcuccgacgugagccugaccgccugcaagguc

SEQ ID NO: 47283 - RNA, 33 nt, Artificial Sequence
  NADH dehydrogenase (ubiquinone) iron-sulfur protein 2, mitochondrial (453-463)
acccaggacaucguguucggcgaggucgaccgc

SEQ ID NO: 47284 - RNA, 30 nt, Artificial Sequence
  Myosin-IIIa (288-297)
acccagaucgagggcaaggacgugaugcug

SEQ ID NO: 47285 - RNA, 42 nt, Artificial Sequence
  Basement membrane-specific heparan sulfate proteoglycan core protein (2340-2353)
acccagcccauccgcaucgagccgagcuccagccagguggcc

SEQ ID NO: 47286 - RNA, 45 nt, Artificial Sequence
  Basement membrane-specific heparan sulfate proteoglycan core protein (2340-2354)
acccagcccauccgcaucgagccgagcuccagccagguggccgag

SEQ ID NO: 47287 - RNA, 33 nt, Artificial Sequence
  Regulator of nonsense transcripts 1 (44-54)
acccagacccccccgggcgggcccggcgggccc

SEQ ID NO: 47288 - RNA, 27 nt, Artificial Sequence
  Cytoplasmic FMR1-interacting protein 1 (680-688)
acccgcuucaacaagcaguuccuguac

SEQ ID NO: 47289 - RNA, 30 nt, Artificial Sequence
  Alpha-1-syntrophin (178-187)
acccgccacggcguggacacccaccuguuc

SEQ ID NO: 47290 - RNA, 30 nt, Artificial Sequence
  Peroxisomal membrane protein PMP34 (90-99)
acccgccugaagcuccagggcgccaaguuc

SEQ ID NO: 47291 - RNA, 27 nt, Artificial Sequence
  Maltase-glucoamylase (1080-1088)
acccgccugcccagccaguacaucuac

SEQ ID NO: 47292 - RNA, 27 nt, Artificial Sequence
  Protein disulfide-isomerase A5 (45-53)
acccgcaacaacgugcugguccucuac

SEQ ID NO: 47293 - RNA, 30 nt, Artificial Sequence
  HLA class I histocompatibility antigen, Cw-7 alpha chain (257-266)
acccgccccgccggcgacgggaccuuccag

SEQ ID NO: 47294 - RNA, 30 nt, Artificial Sequence
  L-dopachrome tautomerase (68-77)
acccgccccuggagcggcccguacauccug

SEQ ID NO: 47295 - RNA, 27 nt, Artificial Sequence
  Glycerol-3-phosphate acyltransferase 3 (128-136)
acccgcaccaacgugaacuuccaguac

SEQ ID NO: 47296 - RNA, 27 nt, Artificial Sequence
  Multiple PDZ domain protein (66-74)
accagcgccaccuccaacaucgaguac

SEQ ID NO: 47297 - RNA, 30 nt, Artificial Sequence
  Protein prune homolog 2 (1091-1100)
accagcgacggcaugaacuucaccaaguac

SEQ ID NO: 47298 - RNA, 27 nt, Artificial Sequence
  Bifunctional glutamate/proline-tRNA ligase (269-277)
accagcgaccacuucgagaccaucaug

SEQ ID NO: 47299 - RNA, 27 nt, Artificial Sequence
  ATP-dependent RNA helicase DDX50 (268-276)
accagcgacaagggcuucgugaccaug

SEQ ID NO: 47300 - RNA, 24 nt, Artificial Sequence
  Ubinuclein-2 (527-534)
accagcgacaagccccugauguac

SEQ ID NO: 47301 - RNA, 30 nt, Artificial Sequence
  Beta-1-syntrophin (132-141)
accagcgaccccccguccagccaguccuuc

SEQ ID NO: 47302 - RNA, 24 nt, Artificial Sequence
  Polymerase delta-interacting protein 3 (356-363)
accagcgaccagcccauccugcuc

SEQ ID NO: 47303 - RNA, 27 nt, Artificial Sequence
  HEAT repeat-containing protein 5A (1033-1041)
accagcgagaacgccaagcugcacuac

SEQ ID NO: 47304 - RNA, 30 nt, Artificial Sequence
  HEAT repeat-containing protein 5A (1033-1042)
accagcgagaacgccaagcugcacuacuac

SEQ ID NO: 47305 - RNA, 24 nt, Artificial Sequence
  Nuclear pore complex protein Nup205 (1076-1083)
accagcggccccaccaugcgcuac

SEQ ID NO: 47306 - RNA, 30 nt, Artificial Sequence
  GREB1-like protein (1129-1138)
accagcggcuccaucauggagaacggggug

SEQ ID NO: 47307 - RNA, 27 nt, Artificial Sequence
  E3 ubiquitin-protein ligase UBR4 (516-524)
accagcauccagcgcauccagcggcug

SEQ ID NO: 47308 - RNA, 27 nt, Artificial Sequence
  Dolichyl-diphosphooligosaccharide-proteinosyltransferase subunit 1 (228-236)
accagcaugacccgcgugaucgagguc

SEQ ID NO: 47309 - RNA, 39 nt, Artificial Sequence
  Treacle protein (596-608)
accagccccgccggcuccagcccggccguggcggggggc

SEQ ID NO: 47310 - RNA, 24 nt, Artificial Sequence
  Chromodomain Y-like protein (94-101)
accagccccaaggcccuggugauc

SEQ ID NO: 47311 - RNA, 27 nt, Artificial Sequence
  Mitogen-activated protein kinase kinase kinase 14 (448-456)
accagcccccgcaucgugccgcuguac

SEQ ID NO: 47312 - RNA, 27 nt, Artificial Sequence
  Interferon alpha-inducible protein 27, mitochondrial (12-20)
accagcguggccaaggucgugcgcgug

SEQ ID NO: 47313 - RNA, 33 nt, Artificial Sequence
  RNA binding protein fox-1 homolog 2 (243-253)
accaccgccgccgcguuccgcggcgcccaccug

SEQ ID NO: 47314 - RNA, 30 nt, Artificial Sequence
  Transcriptional regulator ATRX (461-470)
accaccgccaaggugacgaaggagcuguac

SEQ ID NO: 47315 - RNA, 48 nt, Artificial Sequence
  ATP-citrate synthase (677-692)
accaccgacggcguguacgagggggucgccaucggcggggaccgcuac

SEQ ID NO: 47316 - RNA, 27 nt, Artificial Sequence
  Hemicentin-1 (97-105)
accaccgaccccaagaaguuccaguac

SEQ ID NO: 47317 - RNA, 21 nt, Artificial Sequence
  Elongation factor 1-alpha 1 (23-29)
accaccggccaccugaucuac

SEQ ID NO: 47318 - RNA, 27 nt, Artificial Sequence
  Signal-induced proliferation-associated 1-like protein 3 (1102-1110)
accacccccggccacgcccagagccug

SEQ ID NO: 47319 - RNA, 27 nt, Artificial Sequence
  Disabled homolog 2-interacting protein (945-953)
accacccagaagcuggugcucgaguac

SEQ ID NO: 47320 - RNA, 27 nt, Artificial Sequence
  Basement membrane-specific heparan sulfate proteoglycan core protein (3563-3571)
accacccagagccacgugcugcuccug

SEQ ID NO: 47321 - RNA, 27 nt, Artificial Sequence
  Importin-4 (577-585)
accguggccgagaagagcuucgccguc

SEQ ID NO: 47322 - RNA, 27 nt, Artificial Sequence
  Nicotinamide phosphoribosyltransferase (220-228)
accguggccggccuggcccucaucaag

SEQ ID NO: 47323 - RNA, 27 nt, Artificial Sequence
  Keratin, type I cytoskeletal 18 (86-94)
accguggacaacgcccgcaucguccug

SEQ ID NO: 47324 - RNA, 24 nt, Artificial Sequence
  Signal-induced proliferation-associated 1-like protein 2 (821-828)
accguggacaccagcgucaaguuc

SEQ ID NO: 47325 - RNA, 63 nt, Artificial Sequence
  Vimentin (446-466)
accguggagacccgcgacggccaggucaucaacgagacgagccagcaccacgacgaccuggag

SEQ ID NO: 47326 - RNA, 27 nt, Artificial Sequence
  Runt-related transcription factor 1 (36-44)
accguguucaccaaccccccgcagguc

SEQ ID NO: 47327 - RNA, 27 nt, Artificial Sequence
  Proto-oncogene tyrosine-protein kinase receptor Ret (350-358)
accgugcacgacuaccgccugguccuc

SEQ ID NO: 47328 - RNA, 48 nt, Artificial Sequence
  Endoplasmin (688-703)
accgugcuggaccucgccgucgugcuguucgagaccgccacgcugcgc

SEQ ID NO: 47329 - RNA, 27 nt, Artificial Sequence
  Transmembrane protein 9 (177-185)
accgugcuggagcgcgucgagggcgcc

SEQ ID NO: 47330 - RNA, 30 nt, Artificial Sequence
  Cytoskeleton-associated protein 5 (947-956)
accgugcugggcgacagcaagaacaacguc

SEQ ID NO: 47331 - RNA, 30 nt, Artificial Sequence
  DNA annealing helicase and endonuclease ZRANB3 (73-82)
accgugcugggcuacgggcuccugaccgcc

SEQ ID NO: 47332 - RNA, 27 nt, Artificial Sequence
  HEAT repeat-containing protein 1 (1553-1561)
accgugcugggcuacaucagcgccguc

SEQ ID NO: 47333 - RNA, 45 nt, Artificial Sequence
  Actin, cytoplasmic 2 (36-50)
accgugcugagcggcgggaccacgauguaccccggcaucgccgac

SEQ ID NO: 47334 - RNA, 27 nt, Artificial Sequence
  Neuron navigator 2 (1903-1911)
accgugaugcagcugcgcaacgagcuc

SEQ ID NO: 47335 - RNA, 27 nt, Artificial Sequence
  Ryanodine receptor 2 (3867-3875)
accgugaacaucaucaucagcaccguc

SEQ ID NO: 47336 - RNA, 90 nt, Artificial Sequence
  Fructose-bisphosphate aldolase A (314-343)
accgugcccccggccgucaccggcaucacguuccugagcgggggccaguccgaggaggaggccagcaucaaccucaacgcgaucaacaag

SEQ ID NO: 47337 - RNA, 27 nt, Artificial Sequence
  Mucin-16 (11203-11211)
accgugcagggccuggucaccagccuc

SEQ ID NO: 47338 - RNA, 84 nt, Artificial Sequence
  Nucleophosmin (46-73)
accgugagccugggcgccggggccaaggacgagcuccacaucgucgaggcggaggccaugaacuacgagggcucccccaucaag

SEQ ID NO: 47339 - RNA, 33 nt, Artificial Sequence
  Complement C4-A (408-418)
accgugagcucccccggcagcgucccggaggug

SEQ ID NO: 47340 - RNA, 27 nt, Artificial Sequence
  Exportin-6 (585-593)
accguggucgagcgccuggugaaggug

SEQ ID NO: 47341 - RNA, 33 nt, Artificial Sequence
  U4/U6 small nuclear ribonucleoprotein Prp3 (29-39)
accguggucaccgccgcccugaacugcgugggc

SEQ ID NO: 47342 - RNA, 30 nt, Artificial Sequence
  Multidrug resistance-associated protein 7 (941-950)
accguguacgccaccaucgccggcgucaac

SEQ ID NO: 47343 - RNA, 30 nt, Artificial Sequence
  MMS19 nucleotide excision repair protein homolog (150-159)
accguguacaacaucaucaccaacuucaug

SEQ ID NO: 47344 - RNA, 27 nt, Artificial Sequence
  RNA-binding protein 26 (673-681)
accguguacaaccccgccgcccugaag

SEQ ID NO: 47345 - RNA, 42 nt, Artificial Sequence
  Protein SZT2 (605-618)
accuggggccugccccacgccccgcccagccccgggccccuc

SEQ ID NO: 47346 - RNA, 30 nt, Artificial Sequence
  Tyrosine-protein phosphatase non-receptor type substrate 1 (472-481)
accuacgccgaccuggacauggugcaccuc

SEQ ID NO: 47347 - RNA, 33 nt, Artificial Sequence
  Serine/threonine-protein kinase SMG1 (743-753)
accuacgccccccuguucagccucccguccuuc

SEQ ID NO: 47348 - RNA, 27 nt, Artificial Sequence
  Muskelin (680-688)
accuacgcccagcgcacccagcuguuc

SEQ ID NO: 47349 - RNA, 24 nt, Artificial Sequence
  Low-density lipoprotein receptor-related protein 2 (585-592)
accuacgacggcauccagcgcaag

SEQ ID NO: 47350 - RNA, 27 nt, Artificial Sequence
  Diamine acetyltransferase 1 (80-88)
accuacgaccccuggaucggcaagcug

SEQ ID NO: 47351 - RNA, 24 nt, Artificial Sequence
  L-dopachrome tautomerase (302-309)
accuacgagggccugcuccgccgg

SEQ ID NO: 47352 - RNA, 27 nt, Artificial Sequence
  GPI-anchor transamidase (386-394)
accuacggcaucaagcacaugaaguuc

SEQ ID NO: 47353 - RNA, 27 nt, Artificial Sequence
  Ral GTPase-activating protein subunit beta (252-260)
accuacggccccagcuucccggccuuc

SEQ ID NO: 47354 - RNA, 27 nt, Artificial Sequence
  Talin-1 (307-315)
accuacggcgugagcuucuuccugguc

SEQ ID NO: 47355 - RNA, 24 nt, Artificial Sequence
  Parafibromin (314-321)
accuaccacggcaugacccugaag

SEQ ID NO: 47356 - RNA, 27 nt, Artificial Sequence
  Down syndrome critical region protein 3 (108-116)
accuaccacggcguguucgucaacauc

SEQ ID NO: 47357 - RNA, 27 nt, Artificial Sequence
  AP-2 complex subunit alpha-1 (544-552)
accuacaucaaguucaucaaccuguuc

SEQ ID NO: 47358 - RNA, 30 nt, Artificial Sequence
  Transmembrane protein 231 (34-43)
accuacauccccccgcugcucguggccuuc

SEQ ID NO: 47359 - RNA, 27 nt, Artificial Sequence
  Phosphatidylinositol 4-phosphate 3-kinase C2 domain-containing subunit alpha (731-739)
accuacaagaacuucuucuaccugauc

SEQ ID NO: 47360 - RNA, 27 nt, Artificial Sequence
  Serine-protein kinase ATM (2359-2367)
accuaccuggagaaggccguggagguc

SEQ ID NO: 47361 - RNA, 27 nt, Artificial Sequence
  T-complex protein 1 subunit theta (427-435)
accuaccugggcaaguacugggccauc

SEQ ID NO: 47362 - RNA, 27 nt, Artificial Sequence
  G1/S-specific cyclin-E1 (111-119)
accuaccugcgcgaccagcacuuccuc

SEQ ID NO: 47363 - RNA, 27 nt, Artificial Sequence
  Digestive organ expansion factor homolog (692-700)
accuacccccacuucuacagcgagauc

SEQ ID NO: 47364 - RNA, 27 nt, Artificial Sequence
  Sorbin and SH3 domain-containing protein 2 (215-223)
accuacccccagcacgcccagagccug

SEQ ID NO: 47365 - RNA, 27 nt, Artificial Sequence
  Exportin-T (46-54)
accuacagcgacgaccacgugaaguuc

SEQ ID NO: 47366 - RNA, 27 nt, Artificial Sequence
  Nuclear receptor subfamily 2 group C member 2 (532-540)
accuacagcgaggacaccuaccgccug

SEQ ID NO: 47367 - RNA, 27 nt, Artificial Sequence
  SRSF protein kinase 2 (426-434)
accuacagcuccagcuacgagcaguuc

SEQ ID NO: 47368 - RNA, 27 nt, Artificial Sequence
  Cartilage acidic protein 1 (144-152)
accuacaccgacaagcuguucaaguuc

SEQ ID NO: 47369 - RNA, 27 nt, Artificial Sequence
  Cation-independent mannose-6-phosphate receptor (884-892)
accuacaccacgcgcauccaccuggug

SEQ ID NO: 47370 - RNA, 27 nt, Artificial Sequence
  Cathepsin D (130-138)
accuacgugaagaacggcaccagcuuc

SEQ ID NO: 47371 - RNA, 36 nt, Artificial Sequence
  Protein YIF1B (149-160)
accuacgugcuggucgccggccucgcccuggggacc

SEQ ID NO: 47372 - RNA, 27 nt, Artificial Sequence
  Histone-binding protein RBBP4 (186-194)
guggccgacgaccagaagcugaugauc

SEQ ID NO: 47373 - RNA, 27 nt, Artificial Sequence
  E3 ubiquitin-protein ligase TRIM56 (523-531)
guggccgacgagcagaaccgcgcccug

SEQ ID NO: 47374 - RNA, 24 nt, Artificial Sequence
  Coatomer subunit gamma-1 (760-767)
guggccgaccacauccagaagguc

SEQ ID NO: 47375 - RNA, 27 nt, Artificial Sequence
  HMG domain-containing protein 4 (317-325)
guggccgaccaccccggcaucgacuuc

SEQ ID NO: 47376 - RNA, 24 nt, Artificial Sequence
  Laminin subunit gamma-1 (1042-1049)
guggccgaccaccgcgucaagcug

SEQ ID NO: 47377 - RNA, 30 nt, Artificial Sequence
  Catenin beta-1 (79-88)
guggccgacaucgacggccaguacgccaug

SEQ ID NO: 47378 - RNA, 24 nt, Artificial Sequence
  Dual specificity protein phosphatase 14 (93-100)
guggccgacaagauccacagcguc

SEQ ID NO: 47379 - RNA, 27 nt, Artificial Sequence
  Translin-associated protein X (191-199)
guggccgaccugaccggcgagcucaug

SEQ ID NO: 47380 - RNA, 27 nt, Artificial Sequence
  Neutral alpha-glucosidase AB (23-31)
guggccgaccccccgaucgcccgccug

SEQ ID NO: 47381 - RNA, 27 nt, Artificial Sequence
  Polypeptide N-acetylgalactosaminyltransferase 2 (241-249)
guggccgaggaccgcacccgggucgug

SEQ ID NO: 47382 - RNA, 27 nt, Artificial Sequence
  Protein PRR14L (111-119)
guggccgagagcgccgucuccaagcug

SEQ ID NO: 47383 - RNA, 27 nt, Artificial Sequence
  UPF0415 protein C7orf25 (292-300)
guggccuuccccaccgagaucaagguc

SEQ ID NO: 47384 - RNA, 30 nt, Artificial Sequence
  Cytoskeleton-associated protein 5 (883-892)
guggccggcaucaucaacgacgccaaguuc

SEQ ID NO: 47385 - RNA, 33 nt, Artificial Sequence
  HLA class I histocompatibility antigen, alpha chain F (305-315)
guggccggccuggucgugcucggggccgugguc

SEQ ID NO: 47386 - RNA, 24 nt, Artificial Sequence
  Phosphofurin acidic cluster sorting protein 1 (109-116)
guggccggccgcgucaugcaguac

SEQ ID NO: 47387 - RNA, 39 nt, Artificial Sequence
  CLIP-associating protein 2 (347-359)
guggccggccgcgucagcgccggguccagcaaggcgucc

SEQ ID NO: 47388 - RNA, 30 nt, Artificial Sequence
  CAD protein (1548-1557)
guggccggcagcgccgcggggcugaagcuc

SEQ ID NO: 47389 - RNA, 27 nt, Artificial Sequence
  CLOCK-interacting pacemaker (251-259)
guggccaaggcccccagccugaccuuc

SEQ ID NO: 47390 - RNA, 45 nt, Artificial Sequence
  Glucose-6-phosphate isomerase (250-264)
guggccaagcacuucgucgcccugagcaccaacaccacgaaggug

SEQ ID NO: 47391 - RNA, 48 nt, Artificial Sequence
  Glucose-6-phosphate isomerase (250-265)
guggccaagcacuucgucgcccugagcaccaacaccacgaaggugaag

SEQ ID NO: 47392 - RNA, 27 nt, Artificial Sequence
  Proline and serine-rich protein 1 (85-93)
guggcccuggagcuccuggccagcaac

SEQ ID NO: 47393 - RNA, 33 nt, Artificial Sequence
  Phosphatidylcholine translocator ABCB4 (985-995)
guggcccugggccacgccagcuccuucgcgccc

SEQ ID NO: 47394 - RNA, 30 nt, Artificial Sequence
  ATP-binding cassette sub-family A member 13 (1236-1245)
guggcccugggcaacgcccucgucagcgug

SEQ ID NO: 47395 - RNA, 27 nt, Artificial Sequence
  Neural cell adhesion molecule L1 (3-11)
guggcccugcgcuacgucuggccccuc

SEQ ID NO: 47396 - RNA, 24 nt, Artificial Sequence
  Constitutive coactivator of PPAR-gamma-like protein 1 (551-558)
guggcccccgagguccugcgcgug

SEQ ID NO: 47397 - RNA, 27 nt, Artificial Sequence
  Glutamate receptor ionotropic, kainate 3 (516-524)
guggccccccugaccaucacccacguc

SEQ ID NO: 47398 - RNA, 27 nt, Artificial Sequence
  Transcription factor p65 (404-412)
guggcccccccggcccccaagcccacc

SEQ ID NO: 47399 - RNA, 33 nt, Artificial Sequence
  Protein NLRC3 (955-965)
guggccagcaucggcgccuccggggcgcagguc

SEQ ID NO: 47400 - RNA, 24 nt, Artificial Sequence
  Endothelin B receptor (292-299)
guggccagcuggucccgcaucaag

SEQ ID NO: 47401 - RNA, 27 nt, Artificial Sequence
  Zinc finger MYM-type protein 4 (1069-1077)
guggccgucgagccccgcagccugauc

SEQ ID NO: 47402 - RNA, 27 nt, Artificial Sequence
  Transient receptor potential cation channel subfamily V member 2 (408-416)
guggccuaccaccagcccacccugaag

SEQ ID NO: 47403 - RNA, 150 nt, Artificial Sequence
  ATP synthase subunit epsilon, mitochondrial (2-51)
guggccuacuggcgccaggccggccugagcuacauccgguacucccagaucugcgcgaaggccguccgcgacgcccucaagaccgaguucaaggccaacgccgagaagaccagcggguccaacgugaagaucgugaaggucaagaaggag

SEQ ID NO: 47404 - RNA, 66 nt, Artificial Sequence
  Pyridoxal kinase (153-174)
guggacgccgucuucgugggcaccggggaccuguucgccgcgaugcuccuggccuggacccacaag

SEQ ID NO: 47405 - RNA, 30 nt, Artificial Sequence
  Titin (5174-5183)
guggacgaccugaucgcccucggcgggcag

SEQ ID NO: 47406 - RNA, 54 nt, Artificial Sequence
  HLA class I histocompatibility antigen, B-51 alpha chain (27-44)
guggacgacacccaguucguccgcuucgacagcgacgccgccuccccccggacc

SEQ ID NO: 47407 - RNA, 60 nt, Artificial Sequence
  HLA class I histocompatibility antigen, B-51 alpha chain (27-46)
guggacgacacccaguucguccgcuucgacagcgacgccgccuccccccggaccgagccg

SEQ ID NO: 47408 - RNA, 66 nt, Artificial Sequence
  Transducin-like enhancer protein 2 (117-138)
guggacgaggaccagcccagcgagccgcccucccccgccaccacccccugcggcaaggucccgauc

SEQ ID NO: 47409 - RNA, 45 nt, Artificial Sequence
  Annexin A2 (51-65)
guggacgaggucaccaucgugaacauccugaccaaccgcagcaac

SEQ ID NO: 47410 - RNA, 51 nt, Artificial Sequence
  Annexin A2 (51-67)
guggacgaggucaccaucgugaacauccugaccaaccgcagcaacgcccag

SEQ ID NO: 47411 - RNA, 36 nt, Artificial Sequence
  Glyceraldehyde-3-phosphate dehydrogenase (28-39)
guggacaucgucgccaucaacgaccccuucaucgac

SEQ ID NO: 47412 - RNA, 27 nt, Artificial Sequence
  Eukaryotic translation initiation factor 2A (267-275)
guggacaagaccggcgccagcuacuac

SEQ ID NO: 47413 - RNA, 24 nt, Artificial Sequence
  40S ribosomal protein S21 (39-46)
guggacaaggucaccggccgcuuc

SEQ ID NO: 47414 - RNA, 60 nt, Artificial Sequence
  Collagen alpha-4(IV) chain (1284-1303)
guggaccugcuccgcggcgagcccggggacugcggccugccggggccccccggccccccg

SEQ ID NO: 47415 - RNA, 33 nt, Artificial Sequence
  Immunoglobulin superfamily DCC subclass member 4 (828-838)
guggacauggacggccccuucgggagcgucgug

SEQ ID NO: 47416 - RNA, 45 nt, Artificial Sequence
  Multidrug resistance-associated protein 6 (610-624)
guggaccccggcgucguggacagcuccagcuccgggagcgccgcc

SEQ ID NO: 47417 - RNA, 24 nt, Artificial Sequence
  Histone deacetylase 9 (79-86)
guggaccccgucgugcgcgagaag

SEQ ID NO: 47418 - RNA, 51 nt, Artificial Sequence
  Neuron navigator 1 (1420-1436)
guggacagccuggucuucgagacccucauccccaagccgaugaugcagcac

SEQ ID NO: 47419 - RNA, 24 nt, Artificial Sequence
  Microtubule-actin cross-linking factor 1, isoforms 1/2/3/5 (329-336)
guggacagccgcuggcaggaguac

SEQ ID NO: 47420 - RNA, 60 nt, Artificial Sequence
  Beta-secretase 2 (109-128)
guggacaccggcagcuccaacuucgccgucgccgggaccccccacagcuacaucgacacg

SEQ ID NO: 47421 - RNA, 33 nt, Artificial Sequence
  Probable C-mannosyltransferase DPY19L1 (75-85)
guggaggcccccagcuuccugaacggcgucugg

SEQ ID NO: 47422 - RNA, 36 nt, Artificial Sequence
  Dynein heavy chain 17, axonemal (1541-1552)
guggaggccaccagcaagcccggccuguacaacaag

SEQ ID NO: 47423 - RNA, 27 nt, Artificial Sequence
  Putative RNA-binding protein 15 (166-174)
guggaggacggccuguuccacgaguuc

SEQ ID NO: 47424 - RNA, 27 nt, Artificial Sequence
  Protein phosphatase 1 regulatory subunit 12B (100-108)
guggaggaggacagcaaccgcgacuac

SEQ ID NO: 47425 - RNA, 30 nt, Artificial Sequence
  Protrudin (99-108)
guggaguucuuccgcgucgugagcgaguac

SEQ ID NO: 47426 - RNA, 30 nt, Artificial Sequence
  Glycogen phosphorylase, brain form (207-216)
guggagcacacccccgacggcgucaagugg

SEQ ID NO: 47427 - RNA, 21 nt, Artificial Sequence
  CDK5 regulatory subunit-associated protein 1 (383-389)
guggagcugguccaccacauc

SEQ ID NO: 47428 - RNA, 27 nt, Artificial Sequence
  Chondroitin sulfate glucuronyltransferase (720-728)
guggagcccggccugguccagaaguuc

SEQ ID NO: 47429 - RNA, 39 nt, Artificial Sequence
  Beta-hexosaminidase subunit alpha (437-449)
guggagccccuggccuucgagggcaccccggagcagaag

SEQ ID NO: 47430 - RNA, 42 nt, Artificial Sequence
  40S ribosomal protein S18 (64-77)
guggagcgcgucaucaccaucaugcagaacccccggcaguac

SEQ ID NO: 47431 - RNA, 45 nt, Artificial Sequence
  40S ribosomal protein S18 (64-78)
guggagcgcgucaucaccaucaugcagaacccccggcaguacaag

SEQ ID NO: 47432 - RNA, 27 nt, Artificial Sequence
  Myoferlin (1325-1333)
guggagagcgucgugaucaagaaccug

SEQ ID NO: 47433 - RNA, 60 nt, Artificial Sequence
  Vimentin (447-466)
guggagacccgcgacggccaggucaucaacgagaccagccagcaccacgacgaccuggag

SEQ ID NO: 47434 - RNA, 48 nt, Artificial Sequence
  HLA class I histocompatibility antigen, Cw-7 alpha chain (255-270)
guggagacccgccccgccggcgacgggaccuuccagaagugggccgcg

SEQ ID NO: 47435 - RNA, 27 nt, Artificial Sequence
  Integrin beta-5 (441-449)
guguucgcccugcgccccgucggcuuc

SEQ ID NO: 47436 - RNA, 27 nt, Artificial Sequence
  Ribosomal protein S6 kinase alpha-5 (487-495)
guguuccacgaccagcugcacaccuuc

SEQ ID NO: 47437 - RNA, 27 nt, Artificial Sequence
  Nuclear factor erythroid 2-related factor 3 (266-274)
guguuccacaaccacaccuaccaccug

SEQ ID NO: 47438 - RNA, 27 nt, Artificial Sequence
  Integrin alpha-7 (708-716)
guguucaucgagcugccccucagcauc

SEQ ID NO: 47439 - RNA, 27 nt, Artificial Sequence
  Leucine-rich repeat serine/threonine-protein kinase 2 (619-627)
guguucaucggcaccgggcaccugcuc

SEQ ID NO: 47440 - RNA, 30 nt, Artificial Sequence
  Putative pre-mRNA-splicing factor ATP-dependent RNA helicase DHX16 (968-977)
guguucauccaccccaacagcucccuguuc

SEQ ID NO: 47441 - RNA, 27 nt, Artificial Sequence
  E3 ubiquitin-protein ligase RNF213 (400-408)
guguucauccgcggcggggaggaguuc

SEQ ID NO: 47442 - RNA, 27 nt, Artificial Sequence
  Receptor-type tyrosine-protein phosphatase zeta (120-128)
guguucaaggccagcaagaucaccuuc

SEQ ID NO: 47443 - RNA, 27 nt, Artificial Sequence
  Baculoviral IAP repeat-containing protein 6 (448-456)
guguucaagcccaucagcuccaccugg

SEQ ID NO: 47444 - RNA, 24 nt, Artificial Sequence
  Farnesyl pyrophosphate synthase (333-340)
guguuccugggccucgcccgcaag

SEQ ID NO: 47445 - RNA, 33 nt, Artificial Sequence
  Transmembraneoprotein NMB (543-553)
guguuccugaaccgcgccaaggccgucuucuuc

SEQ ID NO: 47446 - RNA, 30 nt, Artificial Sequence
  HLA class II histocompatibility antigen, DQ alpha 1 chain (162-171)
guguuccugccccgcgaggaccaccucuuc

SEQ ID NO: 47447 - RNA, 33 nt, Artificial Sequence
  Extracellular matrix protein FRAS1 (2887-2897)
guguuccugagcuccgcccagggcgccgagcuc

SEQ ID NO: 47448 - RNA, 27 nt, Artificial Sequence
  Beta-hexosaminidase subunit alpha (311-319)
guguuccccgacuucuaccugcaccuc

SEQ ID NO: 47449 - RNA, 27 nt, Artificial Sequence
  Sal-like protein 1 (304-312)
guguuccccagcccgcugcccaacauc

SEQ ID NO: 47450 - RNA, 27 nt, Artificial Sequence
  Lysosomal-trafficking regulator (976-984)
guguuccagaagcaguucuaccgccug

SEQ ID NO: 47451 - RNA, 27 nt, Artificial Sequence
  Filamin-A (1243-1251)
guguuccgcgaggccaccaccgaguuc

SEQ ID NO: 47452 - RNA, 27 nt, Artificial Sequence
  Tubulin beta chain (336-344)
guguuccgcggccggaugagcaugaag

SEQ ID NO: 47453 - RNA, 30 nt, Artificial Sequence
  Transformation/transcription domain-associated protein (638-647)
guguucaccaugaugaacccccugaccuuc

SEQ ID NO: 47454 - RNA, 27 nt, Artificial Sequence
  Cell division cycle protein 23 homolog (185-193)
guguucgucgaggccacccacgugcug

SEQ ID NO: 47455 - RNA, 33 nt, Artificial Sequence
  Delphilin (267-277)
gugggcgggcuggccggccccgggggcgcccgc

SEQ ID NO: 47456 - RNA, 21 nt, Artificial Sequence
  Peroxisomal membrane protein 2 (69-75)
gugggcgggccccugcgcuac

SEQ ID NO: 47457 - RNA, 27 nt, Artificial Sequence
  Eukaryotic translation initiation factor 6 (64-72)
gugggcaaccgccacgggcugcucguc

SEQ ID NO: 47458 - RNA, 27 nt, Artificial Sequence
  Nuclear factor of activated T-cells, cytoplasmic 2 (274-282)
gugggcaacaccaagguccuggagauc

SEQ ID NO: 47459 - RNA, 45 nt, Artificial Sequence
  Filamin-A (1151-1165)
gugggccaguuccaggucgacugcagcuccgccgggagcgccgag

SEQ ID NO: 47460 - RNA, 33 nt, Artificial Sequence
  Cullin-4A (15-25)
gugggccgcaccaacgggcugaccaagcccgcc

SEQ ID NO: 47461 - RNA, 24 nt, Artificial Sequence
  F-box only protein 3 (82-89)
gugggccgcuacaucgaccacuac

SEQ ID NO: 47462 - RNA, 39 nt, Artificial Sequence
  HLA class I histocompatibility antigen, B-13 alpha chain (24-36)
gugggcuacgucgacgacacccaguucgugcgcuucgac

SEQ ID NO: 47463 - RNA, 27 nt, Artificial Sequence
  Lysosomal-trafficking regulator (893-901)
gugcacaucaacaccaucaaccuguuc

SEQ ID NO: 47464 - RNA, 21 nt, Artificial Sequence
  Bax inhibitor 1 (93-99)
gugcacauggucacccacuuc

SEQ ID NO: 47465 - RNA, 27 nt, Artificial Sequence
  Sterol 26-hydroxylase, mitochondrial (181-189)
gugaucgacgacuucaugacccgccug

SEQ ID NO: 47466 - RNA, 30 nt, Artificial Sequence
  Keratin, type I cytoskeletal 18 (130-139)
gugaucgacgacaccaacaucacccgccug

SEQ ID NO: 47467 - RNA, 27 nt, Artificial Sequence
  Laminin subunit alpha-4 (1790-1798)
gugaucgacggccaccccgucagcuuc

SEQ ID NO: 47468 - RNA, 24 nt, Artificial Sequence
  Prefoldin subunit 1 (20-27)
gugaucgacacccagcagaagguc

SEQ ID NO: 47469 - RNA, 27 nt, Artificial Sequence
  Protein PRRC2C (1668-1676)
gugaucgaggacccccagagcaaccug

SEQ ID NO: 47470 - RNA, 27 nt, Artificial Sequence
  Helicase SKI2W (419-427)
gugaucuucgacgagguccacuacauc

SEQ ID NO: 47471 - RNA, 63 nt, Artificial Sequence
  Dolichyl-diphosphooligosaccharide-proteinosyltransferase 48 kDa subunit (255-275)
gugaucuucagcggcucccuggacuucuucagcgacuccuucuucaacagcgccguccagaag

SEQ ID NO: 47472 - RNA, 27 nt, Artificial Sequence
  CLIP-associating protein 1 (218-226)
gugaucuucaccaaguucgacgagguc

SEQ ID NO: 47473 - RNA, 24 nt, Artificial Sequence
  Tyrosine-protein phosphatase non-receptor type 13 (1869-1876)
gugaucggccgcguccuggagcuc

SEQ ID NO: 47474 - RNA, 72 nt, Artificial Sequence
  Glyceraldehyde-3-phosphate dehydrogenase (163-186)
gugauccacgacaacuucggcaucgucgaggggcugaugaccaccgugcacgccaucacggccacccagaag

SEQ ID NO: 47475 - RNA, 24 nt, Artificial Sequence
  ELAV-like protein 1 (102-109)
gugaucaaggacgccaaccuguac

SEQ ID NO: 47476 - RNA, 21 nt, Artificial Sequence
  U5 small nuclear ribonucleoprotein 200 kDa helicase (1232-1238)
gugauccugcaccacgaguac

SEQ ID NO: 47477 - RNA, 48 nt, Artificial Sequence
  Heat shock protein HSP 90-beta (107-122)
gugauccugcaccucaaggaggaccagaccgaguaccuggaggagcgc

SEQ ID NO: 47478 - RNA, 27 nt, Artificial Sequence
  Zinc finger BED domain-containing protein 1 (183-191)
gugauccugaaggagcucgccgaggcc

SEQ ID NO: 47479 - RNA, 27 nt, Artificial Sequence
  Natural resistance-associated macrophage protein 2 (259-267)
gugaucaugccccacaacauguaccug

SEQ ID NO: 47480 - RNA, 39 nt, Artificial Sequence
  Vimentin (454-466)
gugaucaacgagaccagccagcaccacgacgaccuggag

SEQ ID NO: 47481 - RNA, 27 nt, Artificial Sequence
  NEDD8 ultimate buster 1 (130-138)
gugaucaacaagaagcagcugcagcuc

SEQ ID NO: 47482 - RNA, 27 nt, Artificial Sequence
  Spectrin beta chain, non-erythrocytic 1 (2228-2236)
gugaucaacaaccaggagaugggcuuc

SEQ ID NO: 47483 - RNA, 30 nt, Artificial Sequence
  Glia-derived nexin (64-73)
gugaucagcccccacggcaucgccuccguc

SEQ ID NO: 47484 - RNA, 27 nt, Artificial Sequence
  Serine-protein kinase ATM (120-128)
gugaucuacacccugauccacuacauc

SEQ ID NO: 47485 - RNA, 27 nt, Artificial Sequence
  Protein-L-isoaspartate(D-aspartate) O-methyltransferase (92-100)
gugaucuacgucccccugaccgacaag

SEQ ID NO: 47486 - RNA, 30 nt, Artificial Sequence
  Collagen alpha-1(XII) chain (423-432)
gugaagggcgccccccgcaaccugaagguc

SEQ ID NO: 47487 - RNA, 27 nt, Artificial Sequence
  Transferrin receptor protein 1 (188-196)
gugaagauccaggucaaggacagcgcc

SEQ ID NO: 47488 - RNA, 51 nt, Artificial Sequence
  Protocadherin Fat 3 (438-454)
gugaagaaggaggucuacaagcuggaggugaccaacaaggagggcgaccuc

SEQ ID NO: 47489 - RNA, 48 nt, Artificial Sequence
  Gamma-secretase C-terminal fragment 59 (559-574)
gugaagauggacgccgaguuccgccacgacagcggcuacgagguccac

SEQ ID NO: 47490 - RNA, 51 nt, Artificial Sequence
  Gamma-secretase C-terminal fragment 59 (559-575)
gugaagauggacgccgaguuccgccacgacagcggcuacgagguccaccac

SEQ ID NO: 47491 - RNA, 54 nt, Artificial Sequence
  Gamma-secretase C-terminal fragment 59 (559-576)
gugaagauggacgccgaguuccgccacgacagcggcuacgagguccaccaccag

SEQ ID NO: 47492 - RNA, 30 nt, Artificial Sequence
  Small conductance calcium-activated potassium channel protein 2 (419-428)
gugaagaacgccgccgcgaacguccugcgc

SEQ ID NO: 47493 - RNA, 33 nt, Artificial Sequence
  Intraflagellar transport protein 81 homolog (41-51)
gugcuggccgagaucgaccccaagcagcucguc

SEQ ID NO: 47494 - RNA, 27 nt, Artificial Sequence
  Rootletin (677-685)
gugcuggccaaggagcucgucgaggug

SEQ ID NO: 47495 - RNA, 27 nt, Artificial Sequence
  Protein FAM13B (15-23)
gugcuggccaacaagaucuucggcauc

SEQ ID NO: 47496 - RNA, 27 nt, Artificial Sequence
  A-kinase anchor protein 1, mitochondrial (363-371)
gugcuggccaccaccgucggcaaggug

SEQ ID NO: 47497 - RNA, 33 nt, Artificial Sequence
  Laminin subunit gamma-1 (20-30)
gugcuggccguccucgccgcggccgccgccgcc

SEQ ID NO: 47498 - RNA, 30 nt, Artificial Sequence
  U5 small nuclear ribonucleoprotein 200 kDa helicase (139-148)
gugcuggccguccucaagaacgagaagcug

SEQ ID NO: 47499 - RNA, 27 nt, Artificial Sequence
  Microtubule-actin cross-linking factor 1 (1174-1182)
gugcuggacgaggagaucgccaaggcc

SEQ ID NO: 47500 - RNA, 27 nt, Artificial Sequence
  E3 ubiquitin-protein ligase RNF123 (218-226)
gugcuggacggcgccgucaugauguac

SEQ ID NO: 47501 - RNA, 27 nt, Artificial Sequence
  Homologous-pairing protein 2 homolog (88-97)
gugcuggacggcaagaucgucgcccuc

SEQ ID NO: 47502 - RNA, 27 nt, Artificial Sequence
  Transcription factor SOX-5 (89-97)
gugcuggacggcaaggucgccguggug

SEQ ID NO: 47503 - RNA, 27 nt, Artificial Sequence
  Serine/arginine-rich splicing factor 2 (79-87)
gugcuggacggccgcgagcuccggguc

SEQ ID NO: 47504 - RNA, 27 nt, Artificial Sequence
  60S ribosomal protein L13a (8-16)
gugcuggacggccgcgggcaccuccug

SEQ ID NO: 47505 - RNA, 24 nt, Artificial Sequence
  Clustered mitochondria protein homolog (97-104)
gugcuggaccacuucagcgagcuc

SEQ ID NO: 47506 - RNA, 27 nt, Artificial Sequence
  Microtubule-associated proteins 1A/1B light chain 3B (46-54)
gugcuggacaagaccaaguuccucguc

SEQ ID NO: 47507 - RNA, 27 nt, Artificial Sequence
  Coilin (145-153)
gugcuggaccucgagcccaaggccguc

SEQ ID NO: 47508 - RNA, 27 nt, Artificial Sequence
  Protein flightless-1 homolog (107-115)
gugcuggaccucagccacaaccagcug

SEQ ID NO: 47509 - RNA, 27 nt, Artificial Sequence
  Cadherin-2 (399-407)
gugcuggaccgcgagagccccaacguc

SEQ ID NO: 47510 - RNA, 27 nt, Artificial Sequence
  Receptor-type protein tyrosine phosphatase beta (1333-1341)
gugcuggacagccacauccacgccuac

SEQ ID NO: 47511 - RNA, 27 nt, Artificial Sequence
  Ubiquitin carboxyl-terminal hydrolase 19 (713-721)
gugcuggacagccucucccagagcguc

SEQ ID NO: 47512 - RNA, 27 nt, Artificial Sequence
  Biorientation of chromosomes in cell division protein 1-like 1 (1543-1551)
gugcuggacagccgcaucgagaccgcc

SEQ ID NO: 47513 - RNA, 30 nt, Artificial Sequence
  Probable tRNA methyltransferase 9-like protein (350-359)
gugcuggacagcaccgccuucaugcgcuac

SEQ ID NO: 47514 - RNA, 27 nt, Artificial Sequence
  Tubulin-specific chaperone A (71-79)
gugcuggacagcgucaagcucgaggcc

SEQ ID NO: 47515 - RNA, 27 nt, Artificial Sequence
  COP9 signalosome complex subunit 7b (34-42)
gugcuggaggcccccggcgucuacgug

SEQ ID NO: 47516 - RNA, 27 nt, Artificial Sequence
  Ras GTPase-activating-like protein IQGAP3 (1063-1071)
gugcuggaggacaagguccucagcgug

SEQ ID NO: 47517 - RNA, 24 nt, Artificial Sequence
  Melanoma-associated antigen 4 (287-294)
gugcuggagcacgucgugcgcgug

SEQ ID NO: 47518 - RNA, 27 nt, Artificial Sequence
  Leucine-tRNA ligase, cytoplasmic (271-279)
gugcuggagcccuacccgagcaagcuc

SEQ ID NO: 47519 - RNA, 27 nt, Artificial Sequence
  E3 ubiquitin-protein ligase RNF123 (425-433)
gugcuguucgacguccuccgcagcgug

SEQ ID NO: 47520 - RNA, 30 nt, Artificial Sequence
  Nucleolar protein 56 (6-15)
gugcuguucgagcacgccgucggcuacgcc

SEQ ID NO: 47521 - RNA, 27 nt, Artificial Sequence
  NADH dehydrogenase (ubiquinone) iron-sulfur protein 2, mitochondrial (172-180)
gugcuguucggcgagaucacccgccuc

SEQ ID NO: 47522 - RNA, 36 nt, Artificial Sequence
  Heat shock 70 kDa protein 12A (519-530)
gugcuguucggccucgaccccgccgucaucaaggug

SEQ ID NO: 47523 - RNA, 18 nt, Artificial Sequence
  Maestro heat-like repeat-containing protein family member 1 (158-163)
gugcuguuccaccagugg

SEQ ID NO: 47524 - RNA, 27 nt, Artificial Sequence
  Exostosin-like 1 (657-665)
gugcuguucaaggaccccgucagcgug

SEQ ID NO: 47525 - RNA, 30 nt, Artificial Sequence
  Histone-lysine N-methyltransferase 2D (4817-4826)
gugcuguuccccgagagcccggcccgcgcc

SEQ ID NO: 47526 - RNA, 27 nt, Artificial Sequence
  Ribosomal protein S6 kinase alpha-3 (517-525)
gugcuguucaccaucaccaagacgguc

SEQ ID NO: 47527 - RNA, 30 nt, Artificial Sequence
  TAF6-like RNA polymerase II p300/CBP-associated factor-associated factor 65 kDa subunit 6L (168-177)
gugcugggcgacgacccccagcucaugaag

SEQ ID NO: 47528 - RNA, 33 nt, Artificial Sequence
  TAF6-like RNA polymerase II p300/CBP-associated factor-associated factor 65 kDa subunit 6L (168-178)
gugcugggcgacgacccccagcucaugaagguc

SEQ ID NO: 47529 - RNA, 24 nt, Artificial Sequence
  Kelch-like protein 21 (509-516)
gugcugggcgggaagcucuacguc

SEQ ID NO: 47530 - RNA, 24 nt, Artificial Sequence
  Lipopolysaccharide-responsive and beige-like anchor protein (137-144)
gugcugggcaagaucgagaagguc

SEQ ID NO: 47531 - RNA, 24 nt, Artificial Sequence
  EH domain-containing protein 4 (483-490)
gugcugggcaagaucuggaagcuc

SEQ ID NO: 47532 - RNA, 24 nt, Artificial Sequence
  Dynactin subunit 2 (288-295)
gugcugggcaaggucaacgagauc

SEQ ID NO: 47533 - RNA, 27 nt, Artificial Sequence
  Nuclear autoantigenic sperm protein (105-113)
gugcugggcaacgcccucgaggggguc

SEQ ID NO: 47534 - RNA, 27 nt, Artificial Sequence
  Hepatoma-derived growth factor-related protein 2 (550-558)
gugcugggccccaagaucgaggccguc

SEQ ID NO: 47535 - RNA, 27 nt, Artificial Sequence
  Zinc finger protein 518A (419-427)
gugcugggccccacccucaagaacguc

SEQ ID NO: 47536 - RNA, 27 nt, Artificial Sequence
  EAW51983.1 (1173-1181)
gugcugggccccaccccggagcucguc

SEQ ID NO: 47537 - RNA, 27 nt, Artificial Sequence
  Transferrin receptor protein 1 (488-496)
gugcugggcaccagcaacuucaagguc

SEQ ID NO: 47538 - RNA, 24 nt, Artificial Sequence
  HEAT repeat-containing protein 1 (1554-1561)
gugcugggcuacaucagcgccguc

SEQ ID NO: 47539 - RNA, 30 nt, Artificial Sequence
  Integrin-linked protein kinase (219-228)
gugcugcacgagggcaccaacuucgucgug

SEQ ID NO: 47540 - RNA, 27 nt, Artificial Sequence
  Dolichyl-diphosphooligosaccharide-proteinosyltransferase subunit 1 (138-146)
gugcugcaccccuacccgacccagauc

SEQ ID NO: 47541 - RNA, 27 nt, Artificial Sequence
  Ral GTPase-activating protein subunit beta (21-29)
gugcugcacagcuaccccgaguccguc

SEQ ID NO: 47542 - RNA, 27 nt, Artificial Sequence
  Alpha-parvin (100-108)
gugcugaucgacuggaucaacgacguc

SEQ ID NO: 47543 - RNA, 27 nt, Artificial Sequence
  Leucine-tRNA ligase, cytoplasmic (203-211)
gugcugauccacagcucccaguaccuc

SEQ ID NO: 47544 - RNA, 27 nt, Artificial Sequence
  Hemicentin-1 (1559-1567)
gugcugaucaacagccucaucaagcug

SEQ ID NO: 47545 - RNA, 27 nt, Artificial Sequence
  Neuron navigator 2 (119-127)
gugcugcucgcccagaucauccagguc

SEQ ID NO: 47546 - RNA, 27 nt, Artificial Sequence
  Protein MON2 homolog (1145-1153)
gugcugcucgaccacauccagagcgcc

SEQ ID NO: 47547 - RNA, 33 nt, Artificial Sequence
  Ankyrin-2 (527-537)
gugcugcucgaggccggcgccgcgcacagccug

SEQ ID NO: 47548 - RNA, 27 nt, Artificial Sequence
  Protein wntless homolog (264-272)
gugcugcucgagaaggucaucuucgcc

SEQ ID NO: 47549 - RNA, 36 nt, Artificial Sequence
  Tumor necrosis factor receptor superfamily member 19 (5-16)
gugcugcucgagcaggagaagaccuucuucacccug

SEQ ID NO: 47550 - RNA, 27 nt, Artificial Sequence
  Hemicentin-1 (3258-3266)
gugcugcucggcgagaacgucgagcug

SEQ ID NO: 47551 - RNA, 30 nt, Artificial Sequence
  Nucleolar protein 56 (91-100)
gugcugcucggcgucggggaccccaagauc

SEQ ID NO: 47552 - RNA, 27 nt, Artificial Sequence
  Receptor tyrosine-protein kinase erbB-3 (840-848)
gugcugcucaagagccccucccagguc

SEQ ID NO: 47553 - RNA, 33 nt, Artificial Sequence
  A-kinase anchor protein 6 (1028-1038)
gugcugcuccccaacgaccugcuggagaagguc

SEQ ID NO: 47554 - RNA, 27 nt, Artificial Sequence
  Lysosomal-trafficking regulator (260-268)
gugcugcucagccugcuggagaagguc

SEQ ID NO: 47555 - RNA, 27 nt, Artificial Sequence
  Cyclic AMP-dependent transcription factor ATF-6 alpha (233-241)
gugcugcucagccagcccaccgucgug

SEQ ID NO: 47556 - RNA, 27 nt, Artificial Sequence
  Regulatory-associated protein of mTOR (223-231)
gugcugcucagccagguccaccgccug

SEQ ID NO: 47557 - RNA, 33 nt, Artificial Sequence
  Synaptic vesicle membrane protein VAT-1 homolog (379-389)
gugcugcucguccccggcccggagaaggagaac

SEQ ID NO: 47558 - RNA, 33 nt, Artificial Sequence
  Serine/threonine-protein phosphatase 6 regulatory ankyrin repeat subunit A (378-388)
gugcugauggagaccagcggcaccgacaugcuc

SEQ ID NO: 47559 - RNA, 27 nt, Artificial Sequence
  HEAT repeat-containing protein 1 (847-855)
gugcugaugaagcucuucaucaagguc

SEQ ID NO: 47560 - RNA, 27 nt, Artificial Sequence
  Urocortin-2 (11-19)
gugcugaugcucggccgcguccuggug

SEQ ID NO: 47561 - RNA, 27 nt, Artificial Sequence
  Structural maintenance of chromosomes protein 2 (153-161)
gugcugaacaugaagcccccggagauc

SEQ ID NO: 47562 - RNA, 27 nt, Artificial Sequence
  Bifunctional 3'-phosphoadenosine 5'-phosphosulfate synthase 1 (479-487)
gugcugaaccccgagaccaccgucgug

SEQ ID NO: 47563 - RNA, 27 nt, Artificial Sequence
  Receptor activity-modifying protein 2 (34-42)
gugcugaacccccacgaggcccucgcc

SEQ ID NO: 47564 - RNA, 27 nt, Artificial Sequence
  Probable cytosolic iron-sulfur protein assembly protein CIAO1 (145-153)
gugcugaacagccacacccaggacguc

SEQ ID NO: 47565 - RNA, 27 nt, Artificial Sequence
  Nucleosome-remodeling factor subunit BPTF (2314-2322)
gugcugcccggcccggggcagcagcuc

SEQ ID NO: 47566 - RNA, 27 nt, Artificial Sequence
  Transmembrane protein 94 (322-330)
gugcugcccauccucccgcugcuguuc

SEQ ID NO: 47567 - RNA, 21 nt, Artificial Sequence
  40S ribosomal protein S26 (63-69)
gugcugcccaagcucuacguc

SEQ ID NO: 47568 - RNA, 33 nt, Artificial Sequence
  Protocadherin Fat 3 (2698-2708)
gugcugcccccggagaccuuccuccccagcuuc

SEQ ID NO: 47569 - RNA, 27 nt, Artificial Sequence
  Oxysterol-binding protein-related protein 10 (353-361)
gugcugcccaccuucauccucgagaag

SEQ ID NO: 47570 - RNA, 27 nt, Artificial Sequence
  Oxysterol-binding protein-related protein 9 (402-410)
gugcugcccaccuucauccucgagcgc

SEQ ID NO: 47571 - RNA, 30 nt, Artificial Sequence
  Protein-associating with the carboxyl-terminal domain of ezrin (30-39)
gugcugcaggacggcaaguucgccagcguc

SEQ ID NO: 47572 - RNA, 27 nt, Artificial Sequence
  Zinc finger MYM-type protein 4 (793-801)
gugcugcagggcgccguccccaccgug

SEQ ID NO: 47573 - RNA, 30 nt, Artificial Sequence
  Serum paraoxonase/arylesterase 2 (326-335)
gugcugcagggcagcuccgucgccagcgug

SEQ ID NO: 47574 - RNA, 30 nt, Artificial Sequence
  Microspherule protein 1 (219-228)
gugcugcagaccaacgaccucaccagcguc

SEQ ID NO: 47575 - RNA, 42 nt, Artificial Sequence
  Heat shock 70 kDa protein 1-like (171-184)
gugcugcgcaucaucaacgagcccaccgccgccgcgaucgcc

SEQ ID NO: 47576 - RNA, 27 nt, Artificial Sequence
  Probable helicase with zinc finger domain (252-260)
gugcugagcgagugcaucgagggcguc

SEQ ID NO: 47577 - RNA, 27 nt, Artificial Sequence
  Magnesium transporter protein 1 (68-76)
gugcugagcgagaaggucucccagcuc

SEQ ID NO: 47578 - RNA, 30 nt, Artificial Sequence
  Protein misato homolog 1 (109-118)
gugcugagcuccgacggcgucuggcgcgug

SEQ ID NO: 47579 - RNA, 24 nt, Artificial Sequence
  Small integral membrane protein 15 (39-46)
gugcugagcuggaagcucgccaag

SEQ ID NO: 47580 - RNA, 27 nt, Artificial Sequence
  Autophagy-related protein 16-1 (517-525)
gugcugaccggcaaggucgagaaggug

SEQ ID NO: 47581 - RNA, 27 nt, Artificial Sequence
  Transmembraneoprotein NMB (81-89)
gugcugaccagcgacucccccgcccuc

SEQ ID NO: 47582 - RNA, 27 nt, Artificial Sequence
  E3 ubiquitin-protein ligase XIAP (409-417)
gugcuggucgccgaccucgugaacgcc

SEQ ID NO: 47583 - RNA, 27 nt, Artificial Sequence
  Eukaryotic translation initiation factor 3 subunit E (318-326)
gugcuggucaacgacuucuuccucgug

SEQ ID NO: 47584 - RNA, 27 nt, Artificial Sequence
  Hemicentin-1 (2884-2892)
gugcuggucaacaagagcgcccucauc

SEQ ID NO: 47585 - RNA, 30 nt, Artificial Sequence
  Cadherin EGF LAG seven-pass G-type receptor 2 (1100-1109)
gugcuggucagcgacggcgugcacuccgug

SEQ ID NO: 47586 - RNA, 30 nt, Artificial Sequence
  Protocadherin beta-8 (440-449)
gugcuggucagcgacgugaacgacaacgcc

SEQ ID NO: 47587 - RNA, 27 nt, Artificial Sequence
  Elongator complex protein 2 (41-49)
gugcuguacgacccccucaagcgcguc

SEQ ID NO: 47588 - RNA, 33 nt, Artificial Sequence
  Maltase-glucoamylase (708-718)
gugcuguacgagggcgucgacgaggugaaggcc

SEQ ID NO: 47589 - RNA, 30 nt, Artificial Sequence
  Slit homolog 3 protein (361-370)
gugcuguacggcaacaagaucaccgagauc

SEQ ID NO: 47590 - RNA, 30 nt, Artificial Sequence
  Slit homolog 2 protein (354-363)
gugcuguacggcaacaagaucaccgagcuc

SEQ ID NO: 47591 - RNA, 27 nt, Artificial Sequence
  Protein nepro homolog (10-18)
gugcuguacaagggcguccucaagcgc

SEQ ID NO: 47592 - RNA, 36 nt, Artificial Sequence
  Melanocyte protein PMEL (483-494)
gugcuguaccgcuacggcagcuucuccgucacccuc

SEQ ID NO: 47593 - RNA, 27 nt, Artificial Sequence
  Putative eukaryotic translation initiation factor 2 subunit 3-like protein (151-159)
gugauggacgccgcccugcuccugauc

SEQ ID NO: 47594 - RNA, 30 nt, Artificial Sequence
  Putative eukaryotic translation initiation factor 2 subunit 3-like protein (151-160)
gugauggacgccgcccugcuccugaucgcg

SEQ ID NO: 47595 - RNA, 27 nt, Artificial Sequence
  Carboxypeptidase Q (442-450)
gugauggaccccaagcagaugaacguc

SEQ ID NO: 47596 - RNA, 33 nt, Artificial Sequence
  Lipopolysaccharide-responsive and beige-like anchor protein (1389-1399)
gugauguucaacuuccccgacccggccaccguc

SEQ ID NO: 47597 - RNA, 54 nt, Artificial Sequence
  Cytochrome c oxidase subunit 6C (58-75)
gugaugaaggacuucgaggagaugcgcaaggccggcaucuuccagagcgucaag

SEQ ID NO: 47598 - RNA, 30 nt, Artificial Sequence
  Scavenger receptor class B member 1 (146-155)
gugaugauggagaacaagcccaugacccug

SEQ ID NO: 47599 - RNA, 27 nt, Artificial Sequence
  Xylosyltransferase 1 (587-595)
gugaugcccaagaaggucuucaagauc

SEQ ID NO: 47600 - RNA, 42 nt, Artificial Sequence
  78 kDa glucose-regulated protein (177-190)
gugaugcgcaucaucaacgagcccaccgccgccgcgaucgcc

SEQ ID NO: 47601 - RNA, 45 nt, Artificial Sequence
  78 kDa glucose-regulated protein (177-191)
gugaugcgcaucaucaacgagcccaccgccgccgcgaucgccuac

SEQ ID NO: 47602 - RNA, 27 nt, Artificial Sequence
  Non-structural maintenance of chromosomes element 1 homolog (4-12)
gugaugaccgacguccaccgccgguuc

SEQ ID NO: 47603 - RNA, 33 nt, Artificial Sequence
  DNA (cytosine-5)-methyltransferase 3A (139-149)
gugaugugguucggcgacgggaaguucagcguc

SEQ ID NO: 47604 - RNA, 21 nt, Artificial Sequence
  Interferon-induced protein with tetratricopeptide repeats 1 (396-402)
gugaacgccaucauccacuac

SEQ ID NO: 47605 - RNA, 54 nt, Artificial Sequence
  Beta-2-microglobulin (81-98)
gugaaccacgucacccugagccagcccaagaucgugaagugggaccgcgacaug

SEQ ID NO: 47606 - RNA, 42 nt, Artificial Sequence
  Protocadherin gamma-C3 (553-566)
gugaacaucuucgucaccgaccgcaacgacaacgccccccag

SEQ ID NO: 47607 - RNA, 27 nt, Artificial Sequence
  T-complex protein 1 subunit eta (46-54)
gugaacaagaucaaggagaucgccguc

SEQ ID NO: 47608 - RNA, 33 nt, Artificial Sequence
  Cytochrome c oxidase subunit 6A1, mitochondrial (76-86)
gugaacccccugccgaccggcuacgaggacgag

SEQ ID NO: 47609 - RNA, 33 nt, Artificial Sequence
  Pumilio homolog 1 (533-543)
gugaacagcgcccuggccuucggccaggggcuc

SEQ ID NO: 47610 - RNA, 21 nt, Artificial Sequence
  T-complex protein 1 subunit zeta-2 (199-205)
gugaacagcggcuucuucuac

SEQ ID NO: 47611 - RNA, 21 nt, Artificial Sequence
  Bifunctional glutamate/proline-tRNA ligase (51-57)
gugaacagcauccugcgcuac

SEQ ID NO: 47612 - RNA, 72 nt, Artificial Sequence
  Ras GTPase-activating-like protein IQGAP1 (303-326)
gugaacaccuucagcgcccuggccaacaucgaccucgcgcuggagcagggcgacgcccuggcccucuuccgc

SEQ ID NO: 47613 - RNA, 27 nt, Artificial Sequence
  40S ribosomal protein S30 (117-125)
gugaacgucgugcccaccuucggcaag

SEQ ID NO: 47614 - RNA, 30 nt, Artificial Sequence
  Transmembraneoprotein NMB (485-494)
gugcccgaccgcgacccggccagcccccug

SEQ ID NO: 47615 - RNA, 27 nt, Artificial Sequence
  Endothelin B receptor (266-274)
gugcccuucauccagaaggccagcguc

SEQ ID NO: 47616 - RNA, 27 nt, Artificial Sequence
  Nectin-3 (335-343)
gugcccuucaagcagaccagcuccauc

SEQ ID NO: 47617 - RNA, 24 nt, Artificial Sequence
  Heat shock protein 105 kDa (412-419)
gugcccuucccgaucagccugauc

SEQ ID NO: 47618 - RNA, 33 nt, Artificial Sequence
  Elastin (436-446)
gugcccggcgccccgggggccguccccggcgug

SEQ ID NO: 47619 - RNA, 51 nt, Artificial Sequence
  Carboxypeptidase D (836-852)
gugcccggcaccuacaagaucaccgccagcgcccgcggguacaacccgguc

SEQ ID NO: 47620 - RNA, 45 nt, Artificial Sequence
  Transmembraneoprotein NMB (221-235)
gugcccaucgcccaggucaaggacguguacguggucaccgaccag

SEQ ID NO: 47621 - RNA, 78 nt, Artificial Sequence
  Transmembraneoprotein NMB (221-246)
gugcccaucgcccaggucaaggacguguacguggucaccgaccagaucccgguguucgugaccauguuccagaagaac

SEQ ID NO: 47622 - RNA, 36 nt, Artificial Sequence
  Neuronal cell adhesion molecule (399-410)
gugcccaucgagaucgccccggacgaccccagccgc

SEQ ID NO: 47623 - RNA, 39 nt, Artificial Sequence
  Neuronal cell adhesion molecule (399-411)
gugcccaucgagaucgccccggacgaccccagccgcaag

SEQ ID NO: 47624 - RNA, 48 nt, Artificial Sequence
  Neuronal cell adhesion molecule (399-414)
gugcccaucgagaucgccccggacgaccccagccgcaagaucgacggc

SEQ ID NO: 47625 - RNA, 27 nt, Artificial Sequence
  pre-rRNA processing protein FTSJ3 (78-86)
gugcccaucaagccgcugcccaacguc

SEQ ID NO: 47626 - RNA, 42 nt, Artificial Sequence
  Thioredoxin reductase 1, cytoplasmic (252-265)
gugcccaucaaggucgagcagaucgaggccggcaccccgggg

SEQ ID NO: 47627 - RNA, 27 nt, Artificial Sequence
  Endoglin (526-534)
gugcccaucccgaagaccggcacccug

SEQ ID NO: 47628 - RNA, 27 nt, Artificial Sequence
  Interferon-induced 35 kDa protein (73-81)
gugcccaagagccuggucuccaaccuc

SEQ ID NO: 47629 - RNA, 42 nt, Artificial Sequence
  Solute carrier family 2, facilitated glucose transporter member 14 (177-190)
gugcccauguacaucggcgagaucagcccgaccgcccugcgc

SEQ ID NO: 47630 - RNA, 45 nt, Artificial Sequence
  Solute carrier family 2, facilitated glucose transporter member 1 (140-154)
gugcccauguacgucggcgaggugagcccgaccgcccugcgcggg

SEQ ID NO: 47631 - RNA, 27 nt, Artificial Sequence
  Nucleosome-remodeling factor subunit BPTF (238-246)
gugcccaacgagcacaucaugaacguc

SEQ ID NO: 47632 - RNA, 30 nt, Artificial Sequence
  COMM domain-containing protein 7 (78-87)
gugcccaacggcgcccugaagaagagccuc

SEQ ID NO: 47633 - RNA, 27 nt, Artificial Sequence
  Diacylglycerol O-acyltransferase 1 (328-336)
gugcccaaccaccugaucuggcucauc

SEQ ID NO: 47634 - RNA, 27 nt, Artificial Sequence
  Selenoprotein N (214-222)
gugcccaaccaccgcagccugaacguc

SEQ ID NO: 47635 - RNA, 24 nt, Artificial Sequence
  Polymerase I and transcript release factor (228-235)
gugcccccguucaccuuccacguc

SEQ ID NO: 47636 - RNA, 24 nt, Artificial Sequence
  Sodium/potassium-transporting ATPase subunit alpha-3 (168-175)
gugccccagcaggcccuggucauc

SEQ ID NO: 47637 - RNA, 27 nt, Artificial Sequence
  Neurofibromin (199-207)
gugccccagagccacaugccggagauc

SEQ ID NO: 47638 - RNA, 27 nt, Artificial Sequence
  Krueppel-like factor 15 (133-141)
gugccccgcccguuccagcccacccug

SEQ ID NO: 47639 - RNA, 24 nt, Artificial Sequence
  Transmembrane emp24 domain-containing protein 7 (5-12)
gugccccgcagcgccuccguccug

SEQ ID NO: 47640 - RNA, 27 nt, Artificial Sequence
  Transmembrane emp24 domain-containing protein 7 (5-13)
gugccccgcagcgccuccguccugcuc

SEQ ID NO: 47641 - RNA, 30 nt, Artificial Sequence
  Transmembrane emp24 domain-containing protein 7 (5-14)
gugccccgcagcgccuccguccugcuccug

SEQ ID NO: 47642 - RNA, 27 nt, Artificial Sequence
  F-box/WD repeat-containing protein 9 (435-443)
gugcccaccgacccgccccgcaccauc

SEQ ID NO: 47643 - RNA, 24 nt, Artificial Sequence
  Protein Smaug homolog 1 (103-110)
gugcccaccaccaucaacacgauc

SEQ ID NO: 47644 - RNA, 27 nt, Artificial Sequence
  Major facilitator superfamily domain-containing protein 12 (214-222)
gugcccgucuuccgcaaccugagccuc

SEQ ID NO: 47645 - RNA, 27 nt, Artificial Sequence
  Mitogen-activated protein kinase 7 (125-133)
gugcccuacggcgaguucaagagcguc

SEQ ID NO: 47646 - RNA, 24 nt, Artificial Sequence
  Solute carrier family 22 member 18 (47-54)
gugcccuaccugagccgcaagcuc

SEQ ID NO: 47647 - RNA, 24 nt, Artificial Sequence
  Glycogen debranching enzyme (1050-1057)
gugcccuaccgccugaacgagauc

SEQ ID NO: 47648 - RNA, 27 nt, Artificial Sequence
  Phosphatidylinositol 3-kinase catalytic subunit type 3 (400-408)
gugcaggcccugaaguacgagaacuuc

SEQ ID NO: 47649 - RNA, 27 nt, Artificial Sequence
  Adipocyte enhancer-binding protein 1 (657-665)
gugcaggacacccgcauccaccugguc

SEQ ID NO: 47650 - RNA, 27 nt, Artificial Sequence
  Spectrin beta chain, non-erythrocytic 5 (994-1002)
gugcagcuggcccacagcgucgaggug

SEQ ID NO: 47651 - RNA, 27 nt, Artificial Sequence
  Mitochondrial pyruvate carrier 1 (19-27)
gugcagccccgcaacuggcugcucuuc

SEQ ID NO: 47652 - RNA, 27 nt, Artificial Sequence
  Mitogen-activated protein kinase kinase kinase 6 (125-133)
gugcagcccagccuguucuaccaccuc

SEQ ID NO: 47653 - RNA, 24 nt, Artificial Sequence
  CD99 antigen (178-185)
gugcagcgcacccugcucgagaag

SEQ ID NO: 47654 - RNA, 27 nt, Artificial Sequence
  eIF-2-alpha kinase activator GCN1 (1752-1760)
gugcgcgacggcuacaucaugauguuc

SEQ ID NO: 47655 - RNA, 27 nt, Artificial Sequence
  Lysosomal-trafficking regulator (3248-3256)
gugcgcaugcccccguucaccaagaug

SEQ ID NO: 47656 - RNA, 27 nt, Artificial Sequence
  Tripeptidyl-peptidase 1 (151-159)
gugcgcagcccccacccguaccagcug

SEQ ID NO: 47657 - RNA, 24 nt, Artificial Sequence
  Anion exchange protein (986-993)
gugagcgccgccgcggucguguuc

SEQ ID NO: 47658 - RNA, 24 nt, Artificial Sequence
  V-type proton ATPase subunit H (400-407)
gugagcgacgacccccagguccug

SEQ ID NO: 47659 - RNA, 24 nt, Artificial Sequence
  Cofilin-1 (7-14)
gugagcgacggcgucaucaaggug

SEQ ID NO: 47660 - RNA, 27 nt, Artificial Sequence
  Cofilin-1 (7-15)
gugagcgacggcgucaucaagguguuc

SEQ ID NO: 47661 - RNA, 24 nt, Artificial Sequence
  HLA class I histocompatibility antigen, Cw-3 alpha chain (218-225)
gugagcgaccacgaggccacccug

SEQ ID NO: 47662 - RNA, 24 nt, Artificial Sequence
  Proteasome subunit beta type-8 (264-271)
gugagcgaccugcuccaccaguac

SEQ ID NO: 47663 - RNA, 27 nt, Artificial Sequence
  Baculoviral IAP repeat-containing protein 6 (689-697)
gugagcgaccccaaccugauccacguc

SEQ ID NO: 47664 - RNA, 39 nt, Artificial Sequence
  Microtubule-associated protein (1369-1381)
gugagcgaggagaacaagaccgacgccgccaaccgcuac

SEQ ID NO: 47665 - RNA, 24 nt, Artificial Sequence
  Neuroblast differentiation-associated protein AHNAK (3336-3343)
gugagcggccccaagcugaacauc

SEQ ID NO: 47666 - RNA, 42 nt, Artificial Sequence
  PR domain zinc finger protein 10 (909-922)
gugagcggccagccccuguccccgagcgcccagcaggcccag

SEQ ID NO: 47667 - RNA, 30 nt, Artificial Sequence
  Melanocyte protein PMEL (412-421)
gugagcaucgucgugcuguccggcaccacc

SEQ ID NO: 47668 - RNA, 27 nt, Artificial Sequence
  Kinesin-like protein KIF27 (522-530)
gugagccugaaggaggcccagaagguc

SEQ ID NO: 47669 - RNA, 24 nt, Artificial Sequence
  HLA class I histocompatibility antigen, A-23 alpha chain (358-365)
gugagccugaccgccugcaagguc

SEQ ID NO: 47670 - RNA, 27 nt, Artificial Sequence
  Potassium-transporting ATPase alpha chain 1 (600-608)
gugagcaugaucgaccccccgcgcgcc

SEQ ID NO: 47671 - RNA, 27 nt, Artificial Sequence
  Cyclic AMP-dependent transcription factor ATF-6 alpha (445-453)
gugagcaacgacaaggcccugaugguc

SEQ ID NO: 47672 - RNA, 27 nt, Artificial Sequence
  Vacuolar protein sorting-associated protein 13D (2458-2466)
gugagcaacgagcgccaccuggagguc

SEQ ID NO: 47673 - RNA, 27 nt, Artificial Sequence
  Transcription initiation factor TFIID subunit 1 (307-315)
gugagccagaagucccuguggaacuac

SEQ ID NO: 47674 - RNA, 27 nt, Artificial Sequence
  Neuron navigator 3 (198-206)
gugagcuccaagaccacccugcaguac

SEQ ID NO: 47675 - RNA, 27 nt, Artificial Sequence
  Dolichyl-diphosphooligosaccharide-proteinosyltransferase subunit 1 (300-308)
gugagcaccucccaccugcucauccug

SEQ ID NO: 47676 - RNA, 27 nt, Artificial Sequence
  DNA damage-binding protein 1 (7-15)
gugaccgcccagaagcccaccgccguc

SEQ ID NO: 47677 - RNA, 27 nt, Artificial Sequence
  General transcription factor II-I (201-209)
gugaccgacgccgaccgcagcauccug

SEQ ID NO: 47678 - RNA, 69 nt, Artificial Sequence
  Nebulin (5596-5618)
gugaccgacgacaagaacaccguccuggcccuccgcaacacgcugaucgagagcgaccugaaguacaag

SEQ ID NO: 47679 - RNA, 27 nt, Artificial Sequence
  HLA class II histocompatibility antigen, DQ beta 1 chain (114-122)
gugaccgacuucuaccccgcccagauc

SEQ ID NO: 47680 - RNA, 27 nt, Artificial Sequence
  Protein dopey-2 (2274-2282)
gugaccgacagcccccgcauccugaag

SEQ ID NO: 47681 - RNA, 27 nt, Artificial Sequence
  Williams-Beuren syndrome chromosomal region 16 protein (318-326)
gugaccgacagcacccaggucaacgug

SEQ ID NO: 47682 - RNA, 30 nt, Artificial Sequence
  Nebulin (5327-5336)
gugaccgacaccgucagcgacgugaaguac

SEQ ID NO: 47683 - RNA, 51 nt, Artificial Sequence
  Cytochrome c oxidase subunit 6B1 (1-17)
gugaccgacugggacgagcagcgcgccgagggcaccuuccccgggaagauc

SEQ ID NO: 47684 - RNA, 27 nt, Artificial Sequence
  Insulin-like growth factor 1 receptor (683-691)
gugaccgagaaccccaagaccgagguc

SEQ ID NO: 47685 - RNA, 27 nt, Artificial Sequence
  Ras association domain-containing protein 3 (64-72)
gugaccgagagccccgccaaguucgcc

SEQ ID NO: 47686 - RNA, 30 nt, Artificial Sequence
  Large neutral amino acids transporter small subunit 2 (80-89)
gugaccuucggcgagaagcugcucgggguc

SEQ ID NO: 47687 - RNA, 27 nt, Artificial Sequence
  Cadherin EGF LAG seven-pass G-type receptor 1 (634-642)
gugaccuucagcgcccugcuccccggc

SEQ ID NO: 47688 - RNA, 63 nt, Artificial Sequence
  Heterogeneous nuclear ribonucleoprotein F (327-347)
gugaccggcgaggccgacgucgaguucgccacccacgaggaggcgguggccgccaugagcaag

SEQ ID NO: 47689 - RNA, 36 nt, Artificial Sequence
  Mucin-19 (3971-3982)
gugaccggcaucaccgggcccagcgccggcaucacg

SEQ ID NO: 47690 - RNA, 72 nt, Artificial Sequence
  Splicing factor 3B subunit 4 (49-72)
gugaccggccagcaccagggguacggcuucgucgaguuccugagcgaggaggacgccgacuacgccaucaag

SEQ ID NO: 47691 - RNA, 27 nt, Artificial Sequence
  Melanotransferrin (119-127)
gugaccaucgacacccugaagggcguc

SEQ ID NO: 47692 - RNA, 30 nt, Artificial Sequence
  Adhesion G protein-coupled receptor F5 (269-278)
gugaccaucaacgagagcaacuucuucguc

SEQ ID NO: 47693 - RNA, 27 nt, Artificial Sequence
  Maltase-glucoamylase (886-894)
gugaccaucaccgaccugcagggccuc

SEQ ID NO: 47694 - RNA, 36 nt, Artificial Sequence
  Annexin A2 (54-65)
gugaccaucgucaacauccugaccaaccgcagcaac

SEQ ID NO: 47695 - RNA, 42 nt, Artificial Sequence
  Annexin A2 (54-67)
gugaccaucgucaacauccugaccaaccgcagcaacgcccag

SEQ ID NO: 47696 - RNA, 57 nt, Artificial Sequence
  Prelamin-A/C (346-364)
gugaccaucugggccgccggcgcgggggccacccacagccccccgacggaccugguc

SEQ ID NO: 47697 - RNA, 39 nt, Artificial Sequence
  Laminin subunit gamma-1 (671-683)
gugacccuggccagcgcccgccccggcccgggggucccc

SEQ ID NO: 47698 - RNA, 33 nt, Artificial Sequence
  Heat shock transcription factor, X-linked (369-379)
gugacccuggucgccgccggcgcggcccagccc

SEQ ID NO: 47699 - RNA, 27 nt, Artificial Sequence
  Trafficking protein particle complex subunit 2-like protein (73-81)
gugaccaacagcaaggucaaguucgug

SEQ ID NO: 47700 - RNA, 27 nt, Artificial Sequence
  Solute carrier family 26 member 10 (164-172)
gugacccccgaccagcuguucgucagc

SEQ ID NO: 47701 - RNA, 30 nt, Artificial Sequence
  Treacle protein (248-257)
gugaccccccaggucaagggcggggcccug

SEQ ID NO: 47702 - RNA, 45 nt, Artificial Sequence
  Desmoglein-2 (901-915)
gugacccaggagaucgucaccgagcgcagcguguccagccggcag

SEQ ID NO: 47703 - RNA, 48 nt, Artificial Sequence
  Desmoglein-2 (901-916)
gugacccaggagaucgucaccgagcgcagcguguccagccggcaggcc

SEQ ID NO: 47704 - RNA, 48 nt, Artificial Sequence
  Voltage-dependent anion-selective channel protein 1 (164-179)
gugacccagagcaacuucgccgucggcuacaagaccgacgaguuccag

SEQ ID NO: 47705 - RNA, 27 nt, Artificial Sequence
  Bifunctional glutamate/proline-tRNA ligase (1104-1112)
gugacccgcagcggcaagaccgagcug

SEQ ID NO: 47706 - RNA, 33 nt, Artificial Sequence
  HMG domain-containing protein 4 (358-368)
gugaccagcggccccccgcccuccauccccuac

SEQ ID NO: 47707 - RNA, 39 nt, Artificial Sequence
  Vimentin (31-43)
gugaccaccagcacgcgcaccuacucccugggcagcgcc

SEQ ID NO: 47708 - RNA, 27 nt, Artificial Sequence
  Low-density lipoprotein receptor-related protein 2 (584-592)
gugaccuacgacggcauccagcgcaag

SEQ ID NO: 47709 - RNA, 27 nt, Artificial Sequence
  Unconventional myosin-Ic (1036-1044)
guggucgccccccgccugaacagccgg

SEQ ID NO: 47710 - RNA, 30 nt, Artificial Sequence
  Echinoderm microtubule-associated protein-like 3 (378-387)
guggucgacgacagcaacgagcacaugcug

SEQ ID NO: 47711 - RNA, 27 nt, Artificial Sequence
  Helicase with zinc finger domain 2 (2588-2596)
guggucgaccccaaccaggugaacgug

SEQ ID NO: 47712 - RNA, 27 nt, Artificial Sequence
  Catenin alpha-1 (33-41)
guggucgaggacggcauccugaagcuc

SEQ ID NO: 47713 - RNA, 42 nt, Artificial Sequence
  Beta-hexosaminidase subunit alpha (397-410)
guggucgagccccuggccuucgagggcaccccggagcagaag

SEQ ID NO: 47714 - RNA, 39 nt, Artificial Sequence
  Glyceraldehyde-3-phosphate dehydrogenase (95-107)
guggucgagagcaccggcguguucaccacgauggagaag

SEQ ID NO: 47715 - RNA, 45 nt, Artificial Sequence
  Glyceraldehyde-3-phosphate dehydrogenase (95-109)
guggucgagagcaccggcguguucaccacgauggagaaggccggg

SEQ ID NO: 47716 - RNA, 48 nt, Artificial Sequence
  Glyceraldehyde-3-phosphate dehydrogenase (95-110)
guggucgagagcaccggcguguucaccacgauggagaaggccggggcc

SEQ ID NO: 47717 - RNA, 27 nt, Artificial Sequence
  Thioredoxin-interacting protein (12-20)
guggucuucaacgaccccgagaaggug

SEQ ID NO: 47718 - RNA, 27 nt, Artificial Sequence
  Ribosomal RNA-processing protein 7 homolog A (119-127)
guggucuuccagaagcccagcggcgug

SEQ ID NO: 47719 - RNA, 27 nt, Artificial Sequence
  F-box only protein 7 (293-301)
gugguccugccccucgagcugaagcug

SEQ ID NO: 47720 - RNA, 27 nt, Artificial Sequence
  ABCB9 protein (422-430)
gugguccaggugagcauccuguacuac

SEQ ID NO: 47721 - RNA, 24 nt, Artificial Sequence
  Unconventional myosin-Ic (251-258)
gugguccgcaaggcccugaccgug

SEQ ID NO: 47722 - RNA, 27 nt, Artificial Sequence
  Cancer/testis antigen 55 (63-71)
guggucaccggcaacgugccccugaag

SEQ ID NO: 47723 - RNA, 24 nt, Artificial Sequence
  Protein FAM65B (860-867)
guggucaccguguuccaguacuac

SEQ ID NO: 47724 - RNA, 27 nt, Artificial Sequence
  Leucine-rich repeat LGI family member 4 (16-24)
guggucguggccuggcgccccccgaag

SEQ ID NO: 47725 - RNA, 36 nt, Artificial Sequence
  Glutamate receptor ionotropic, kainate 2 (174-185)
guggucuacgacgacagcaccggccugauccgccuc

SEQ ID NO: 47726 - RNA, 45 nt, Artificial Sequence
  Calcium-binding mitochondrial carrier protein SCaMC-1 (444-458)
guggucuacgagaacaugaagcagacccugggcgugacccagaag

SEQ ID NO: 47727 - RNA, 33 nt, Artificial Sequence
  N-acetyllactosaminide beta-1,6-N-acetylglucosaminyl-transferase, isoform A (159-169)
guggucuacggcgggaucagccgccugcaggcc

SEQ ID NO: 47728 - RNA, 36 nt, Artificial Sequence
  m7GpppX diphosphatase (131-142)
guggucuaccccgccaccgagaagcaccugcagaag

SEQ ID NO: 47729 - RNA, 27 nt, Artificial Sequence
  Melanoma-derived growth regulatory protein (69-77)
guggucuacguguucagcaagcugaag

SEQ ID NO: 47730 - RNA, 30 nt, Artificial Sequence
  2-hydroxyacylsphingosine 1-beta-galactosyltransferase (258-267)
guggucuacgugggcgggauccugaccaag

SEQ ID NO: 47731 - RNA, 27 nt, Artificial Sequence
  N-acylglucosamine 2-epimerase (48-56)
guguacgacgaccugaaguacgucugg

SEQ ID NO: 47732 - RNA, 30 nt, Artificial Sequence
  Cleft lip and palate transmembrane protein 1 (470-479)
guguacgacgacauggccuuccgcuaccug

SEQ ID NO: 47733 - RNA, 36 nt, Artificial Sequence
  Protein phosphatase 1A (58-69)
guguacgacggccacgccgggagccaggucgccaag

SEQ ID NO: 47734 - RNA, 27 nt, Artificial Sequence
  Melanoma-associated antigen 4 (231-239)
guguacgacggccgcgagcacaccguc

SEQ ID NO: 47735 - RNA, 30 nt, Artificial Sequence
  Nuclear pore complex protein Nup160 (1114-1123)
guguacgaccgccccggcgccagcccgaag

SEQ ID NO: 47736 - RNA, 24 nt, Artificial Sequence
  Retinoic acid receptor alpha (49-56)
guguacgagaccgacgucuucgug

SEQ ID NO: 47737 - RNA, 27 nt, Artificial Sequence
  Origin recognition complex subunit 3 (436-444)
guguacuucagcgccgcccacgcgcug

SEQ ID NO: 47738 - RNA, 27 nt, Artificial Sequence
  Melanoma-associated antigen C2 (266-274)
guguacggcgagccccgcgagcugcuc

SEQ ID NO: 47739 - RNA, 27 nt, Artificial Sequence
  UBX domain-containing protein 6 (214-222)
guguacggcuucguccgcgaggcccug

SEQ ID NO: 47740 - RNA, 27 nt, Artificial Sequence
  Tripartite motif-containing protein 55 (92-100)
guguacggccugcagcgcaaccuccug

SEQ ID NO: 47741 - RNA, 27 nt, Artificial Sequence
  Sulfate transporter (138-146)
guguacggccuguacaccagcuucuuc

SEQ ID NO: 47742 - RNA, 24 nt, Artificial Sequence
  Filamin-A (747-754)
guguacggccccggggucgccaag

SEQ ID NO: 47743 - RNA, 24 nt, Artificial Sequence
  Serine palmitoyltransferase 2 (238-245)
guguacggccagccccgcacccgg

SEQ ID NO: 47744 - RNA, 27 nt, Artificial Sequence
  Rho-related BTB domain-containing protein 3 (463-471)
guguacggcgucagcaaggagaccuuc

SEQ ID NO: 47745 - RNA, 27 nt, Artificial Sequence
  Beta-galactoside alpha-2,6-sialyltransferase 1 (260-268)
guguaccacagcgacauccccaagugg

SEQ ID NO: 47746 - RNA, 27 nt, Artificial Sequence
  Heterogeneous nuclear ribonucleoprotein L-like (131-139)
guguacaucgccggccagcaggccuuc

SEQ ID NO: 47747 - RNA, 27 nt, Artificial Sequence
  Kinesin-like protein KIF3C (175-183)
guguacaucaaggaccugagcuccuuc

SEQ ID NO: 47748 - RNA, 27 nt, Artificial Sequence
  Ubiquitin carboxyl-terminal hydrolase 40 (308-316)
guguacaucaaggacgucgaccaccug

SEQ ID NO: 47749 - RNA, 24 nt, Artificial Sequence
  26S proteasome non-ATPase regulatory subunit 8 (131-138)
guguacaucaagcaccccgucagc

SEQ ID NO: 47750 - RNA, 30 nt, Artificial Sequence
  Protocadherin gamma-A11 (898-907)
guguacauccccggcagcaacgccacccug

SEQ ID NO: 47751 - RNA, 30 nt, Artificial Sequence
  Myotubularin (63-72)
guguacaucaccaacuaccgccuguaccuc

SEQ ID NO: 47752 - RNA, 27 nt, Artificial Sequence
  Polycystic kidney disease 2-like 1 protein (265-273)
guguacaacgccaacaucaaccuguuc

SEQ ID NO: 47753 - RNA, 27 nt, Artificial Sequence
  Intron-binding protein aquarius (344-352)
guguacaacauguacaugcaccugauc

SEQ ID NO: 47754 - RNA, 27 nt, Artificial Sequence
  Unconventional myosin-X (213-221)
guguacaacaacaacagcucccgcuuc

SEQ ID NO: 47755 - RNA, 27 nt, Artificial Sequence
  Exocyst complex component 6B (535-543)
guguacaaccagaucaaggaguucauc

SEQ ID NO: 47756 - RNA, 27 nt, Artificial Sequence
  HLA class II histocompatibility antigen, DR beta 5 chain (96-104)
guguaccccgcccgcacccagacccug

SEQ ID NO: 47757 - RNA, 27 nt, Artificial Sequence
  HLA class II histocompatibility antigen, DO beta chain (127-135)
guguaccccgagcgcaccccgcugcuc

SEQ ID NO: 47758 - RNA, 27 nt, Artificial Sequence
  tRNA-splicing endonuclease subunit Sen34 (246-254)
guguaccccggcgacccgcugcgcuuc

SEQ ID NO: 47759 - RNA, 27 nt, Artificial Sequence
  Cullin-associated NEDD8-dissociated protein 1 (651-659)
guguaccccagcucccugagcaagauc

SEQ ID NO: 47760 - RNA, 30 nt, Artificial Sequence
  Zinc finger protein 529 (226-235)
guguaccagaagauccacaacgagaaguuc

SEQ ID NO: 47761 - RNA, 27 nt, Artificial Sequence
  DNA-directed RNA polymerase I subunit RPA1 (1314-1322)
guguaccagcugcgcuuccaguuccuc

SEQ ID NO: 47762 - RNA, 27 nt, Artificial Sequence
  Protein CDV3 homolog (66-74)
guguaccgccccccgggcgcccggcug

SEQ ID NO: 47763 - RNA, 27 nt, Artificial Sequence
  Polynucleotide 5'-hydroxyl-kinase NOL9 (499-507)
guguacaccgacuucgccuuccgcauc

SEQ ID NO: 47764 - RNA, 27 nt, Artificial Sequence
  HEAT repeat-containing protein 5A (1098-1106)
guguacaccgaccgcuuccaccugauc

SEQ ID NO: 47765 - RNA, 27 nt, Artificial Sequence
  Ral GTPase-activating protein subunit beta (89-97)
guguacaccgacuggaucauggcccug

SEQ ID NO: 47766 - RNA, 27 nt, Artificial Sequence
  Kidney mitochondrial carrier protein 1 (125-133)
guguacacccacuuccugagcuccuuc

SEQ ID NO: 47767 - RNA, 27 nt, Artificial Sequence
  Uncharacterized protein C18orf8 (400-408)
guguacacccacguccugagcgccuuc

SEQ ID NO: 47768 - RNA, 27 nt, Artificial Sequence
  Sprouty-related, EVH1 domain-containing protein 2 (80-88)
guguacaccaaggccaaccccaccuuc

SEQ ID NO: 47769 - RNA, 27 nt, Artificial Sequence
  2'-5'-oligoadenylate synthase 3 (909-917)
guguacgucgaccugauccacagcuac

SEQ ID NO: 47770 - RNA, 24 nt, Artificial Sequence
  Melanoma-derived growth regulatory protein (70-77)
guguacgucuucagcaagcugaag

SEQ ID NO: 47771 - RNA, 30 nt, Artificial Sequence
  Long-chain fatty acid transport protein 1 (34-43)
guguacgucggcagcgggggcuggcgcuuc

SEQ ID NO: 47772 - RNA, 27 nt, Artificial Sequence
  Hemicentin-1 (4343-4351)
guguacgucaaggagcccccgguguuc

SEQ ID NO: 47773 - RNA, 27 nt, Artificial Sequence
  AP-3 complex subunit mu-2 (274-282)
guguacgucaagcacaacaucagcuuc

SEQ ID NO: 47774 - RNA, 30 nt, Artificial Sequence
  Large neutral amino acids transporter small subunit 1 (22-31)
guguacguccugaccaaccucgccuacuuc

SEQ ID NO: 47775 - RNA, 24 nt, Artificial Sequence
  Histone H2B type 2-F (40-47)
guguacgucuacaaggugcugaag

SEQ ID NO: 47776 - RNA, 27 nt, Artificial Sequence
  Leptin receptor gene-related protein (27-35)
guguacuggccccuguucguccucauc

SEQ ID NO: 47777 - RNA, 27 nt, Artificial Sequence
  GDP-fucose protein O-fucosyltransferase 1 (6-14)
ugggcccgcccccugagcguguccuuc

SEQ ID NO: 47778 - RNA, 66 nt, Artificial Sequence
  Modulator of apoptosis 1 (9-30)
uggugccgcggcauggacaugaacccccggaaggcccugcucaucgccgggaucagccaguccugc

SEQ ID NO: 47779 - RNA, 36 nt, Artificial Sequence
  Puromycin-sensitive aminopeptidase (479-490)
ugggagagccuggagaacgccuccggcaagcccauc

SEQ ID NO: 47780 - RNA, 42 nt, Artificial Sequence
  Protein CREG1 (68-81)
uggggcgcccuggccaccaucagcacccucgaggcggugcgc

SEQ ID NO: 47781 - RNA, 45 nt, Artificial Sequence
  Protein CREG1 (68-82)
uggggcgcccuggccaccaucagcacccucgaggcggugcgcggg

SEQ ID NO: 47782 - RNA, 18 nt, Artificial Sequence
  Dedicator of cytokinesis protein 9 (121-126)
uggcaccuggugaacuac

SEQ ID NO: 47783 - RNA, 18 nt, Artificial Sequence
  Dedicator of cytokinesis protein 10 (114-119)
uggcacguggucaacuac

SEQ ID NO: 47784 - RNA, 18 nt, Artificial Sequence
  Forkhead box protein N2 (51-56)
uggauccuggaccacuuc

SEQ ID NO: 47785 - RNA, 27 nt, Artificial Sequence
  Neutral amino acid transporter A (155-163)
uggaucguggaccgcaccaccacgguc

SEQ ID NO: 47786 - RNA, 27 nt, Artificial Sequence
  Bifunctional glutamate/proline-tRNA ligase (616-624)
uggcuggccgagaccacccacgcccuc

SEQ ID NO: 47787 - RNA, 30 nt, Artificial Sequence
  60S ribosomal protein L19 (4-13)
uggcuggaccccaacgagaccaacgagauc

SEQ ID NO: 47788 - RNA, 30 nt, Artificial Sequence
  Solute carrier family 12 member 2 (1012-1021)
uggcuguucgacgacggcgggcucacccug

SEQ ID NO: 47789 - RNA, 18 nt, Artificial Sequence
  Serine/arginine-rich splicing factor 6 (107-112)
uggcuguuccacacccuc

SEQ ID NO: 47790 - RNA, 27 nt, Artificial Sequence
  Nuclear migration protein nudC (184-192)
uggcugaucgaggacggcaaggugguc

SEQ ID NO: 47791 - RNA, 18 nt, Artificial Sequence
  ATP-dependent RNA helicase DHX36 (885-890)
uggcugaucuaccaccuc

SEQ ID NO: 47792 - RNA, 33 nt, Artificial Sequence
  Liprin-beta-1 (649-659)
uggcugauggagcagggccucgggagcuaccug

SEQ ID NO: 47793 - RNA, 30 nt, Artificial Sequence
  Tuberin (56-65)
uggcuggugggcaacaagcucgucaccgug

SEQ ID NO: 47794 - RNA, 27 nt, Artificial Sequence
  Vacuole membrane protein 1 (366-374)
uggauguucgagaagcugguggucgug

SEQ ID NO: 47795 - RNA, 27 nt, Artificial Sequence
  Hemicentin-1 (236-244)
uggcgcauccccuucgacccgagccug

SEQ ID NO: 47796 - RNA, 27 nt, Artificial Sequence
  Hemicentin-2 (233-241)
uggcgccugcccuucgacccgagccuc

SEQ ID NO: 47797 - RNA, 141 nt, Artificial Sequence
  ATP synthase subunit epsilon, mitochondrial (5-51)
uggcgccaggccggccugagcuacauccgguacucccagaucugcgccaaggcggugcgcgacgcccucaagaccgaguucaaggccaacgccgagaagaccagcggguccaacgucaagaucgugaaggugaagaaggag

SEQ ID NO: 47798 - RNA, 27 nt, Artificial Sequence
  Pleckstrin homology domain-containing family B member 2 (27-35)
uggagcgacggccaccugaucuacuac

SEQ ID NO: 47799 - RNA, 24 nt, Artificial Sequence
  Low-density lipoprotein receptor-related protein 2 (440-447)
uggaccgacaccgugcagaacaag

SEQ ID NO: 47800 - RNA, 18 nt, Artificial Sequence
  Importin-7 (450-455)
ugggugcugcacuacuuc

SEQ ID NO: 47801 - RNA, 27 nt, Artificial Sequence
  Vimentin (290-298)
ugguacaagagcaaguucgccgaccug

SEQ ID NO: 47802 - RNA, 24 nt, Artificial Sequence
  Suppressor of SWI4 1 homolog (25-32)
uacgccgccaacccccacagcuuc

SEQ ID NO: 47803 - RNA, 30 nt, Artificial Sequence
  Putative eukaryotic translation initiation factor 2 subunit 3-like protein (330-339)
uacgccgcccccggcgggcugaucggcgug

SEQ ID NO: 47804 - RNA, 24 nt, Artificial Sequence
  A-kinase anchor protein 9 (284-291)
uacgccgacgagaagacccuguuc

SEQ ID NO: 47805 - RNA, 24 nt, Artificial Sequence
  E3 SUMO-protein ligase RanBP2 (3010-3017)
uacgccgacggcgaggccaaggug

SEQ ID NO: 47806 - RNA, 24 nt, Artificial Sequence
  Proteasome subunit beta type-4 (160-167)
uacgccgacggcgagagcuuccug

SEQ ID NO: 47807 - RNA, 27 nt, Artificial Sequence
  ATP-binding cassette sub-family A member 2 (14-22)
uacgccgacaagcccgccggcaccuac

SEQ ID NO: 47808 - RNA, 27 nt, Artificial Sequence
  Ankyrin repeat domain-containing protein 17 (1180-1188)
uacgccgaggugggccgcguccugcuc

SEQ ID NO: 47809 - RNA, 27 nt, Artificial Sequence
  Protein FAM208B (753-761)
uacgccuucagccuggacuccaaguac

SEQ ID NO: 47810 - RNA, 30 nt, Artificial Sequence
  Heterogeneous nuclear ribonucleoprotein L (250-259)
uacgccaagcccacccgccugaacguguuc

SEQ ID NO: 47811 - RNA, 30 nt, Artificial Sequence
  Rho GTPase-activating protein 5 (623-632)
uacgcccuggacggcaagaucuacgagcuc

SEQ ID NO: 47812 - RNA, 69 nt, Artificial Sequence
  Keratin, type I cytoskeletal 18 (273-295)
uacgcccugcagauggagcagcucaacggcauccugcugcaccucgagagcgagcuggcccagacccgc

SEQ ID NO: 47813 - RNA, 33 nt, Artificial Sequence
  NAD(P)H dehydrogenase (quinone) 1 (43-53)
uacgccaugaacuucaaccccaucaucagccgc

SEQ ID NO: 47814 - RNA, 30 nt, Artificial Sequence
  Protein FAM73A (152-161)
uacgccaacggcgggcuguucagcaaguac

SEQ ID NO: 47815 - RNA, 27 nt, Artificial Sequence
  Coiled-coil domain-containing protein 34 (296-304)
uacgccaacggcaagcugaccggguuc

SEQ ID NO: 47816 - RNA, 24 nt, Artificial Sequence
  Tubulin alpha-1C chain (173-180)
uacgcccgcggccacuacaccauc

SEQ ID NO: 47817 - RNA, 33 nt, Artificial Sequence
  Synaptojanin-2 (4-14)
uacgccagcggccccgccccgcccgcggggacc

SEQ ID NO: 47818 - RNA, 30 nt, Artificial Sequence
  Destrin (117-126)
uacgccagcuccaaggacgccaucaagaag

SEQ ID NO: 47819 - RNA, 27 nt, Artificial Sequence
  Tetratricopeptide repeat protein 14 (351-359)
uacgccaccaagggcagccugaacaag

SEQ ID NO: 47820 - RNA, 21 nt, Artificial Sequence
  Serine/threonine-protein kinase LATS1 (731-737)
uacgccaccaagacccugcgc

SEQ ID NO: 47821 - RNA, 24 nt, Artificial Sequence
  MAGUK p55 subfamily member 5 (117-124)
uacgccgugaagauccuggagauc

SEQ ID NO: 47822 - RNA, 27 nt, Artificial Sequence
  60S ribosomal protein L4 (52-60)
uacgccgugagcgagcuggccggccac

SEQ ID NO: 47823 - RNA, 24 nt, Artificial Sequence
  Melanoma-associated antigen 4 (232-239)
uacgacggccgcgagcacaccgug

SEQ ID NO: 47824 - RNA, 27 nt, Artificial Sequence
  Neurobeachin-like protein 1 (2364-2372)
uacgaccgcaacaucagcaacuacuuc

SEQ ID NO: 47825 - RNA, 21 nt, Artificial Sequence
  Signal recognition particle subunit SRP68 (455-461)
uacgaccgcgugcugaaguac

SEQ ID NO: 47826 - RNA, 27 nt, Artificial Sequence
  DNA topoisomerase 2-alpha (1082-1090)
uacgacagcgaccccgugaaggccugg

SEQ ID NO: 47827 - RNA, 27 nt, Artificial Sequence
  Seizure 6-like protein 2 (844-852)
uacgaggccggcgacacccgcgaguac

SEQ ID NO: 47828 - RNA, 27 nt, Artificial Sequence
  Protein SSX5 (55-63)
uacgaggccaugaccaagcugggcuuc

SEQ ID NO: 47829 - RNA, 27 nt, Artificial Sequence
  ATP-binding cassette sub-family C member 8 (1326-1334)
uacgagggccugcucgcccccagccug

SEQ ID NO: 47830 - RNA, 21 nt, Artificial Sequence
  L-dopachrome tautomerase (303-309)
uacgagggccugcuccgccgg

SEQ ID NO: 47831 - RNA, 24 nt, Artificial Sequence
  Melanophilin (122-129)
uacgagcacgugaaggcccgcuuc

SEQ ID NO: 47832 - RNA, 21 nt, Artificial Sequence
  Annexin A5 (94-100)
uacgagcugaagcacgcccuc

SEQ ID NO: 47833 - RNA, 27 nt, Artificial Sequence
  Gamma-secretase C-terminal fragment 59 (647-655)
uacgagaaccccaccuacaaguucuuc

SEQ ID NO: 47834 - RNA, 21 nt, Artificial Sequence
  39S ribosomal protein L20, mitochondrial (108-114)
uacgagcccaagaccuucaag

SEQ ID NO: 47835 - RNA, 27 nt, Artificial Sequence
  Migration stimulation factor FN70 (392-400)
uacgagcaggaccagaaguacagcuuc

SEQ ID NO: 47836 - RNA, 36 nt, Artificial Sequence
  Spectrin beta chain, non-erythrocytic 5 (750-761)
uacuucgccgacgccgcggaggccgccagcuggcug

SEQ ID NO: 47837 - RNA, 21 nt, Artificial Sequence
  Glia-derived nexin (200-206)
uacuucaagggccuguggaag

SEQ ID NO: 47838 - RNA, 27 nt, Artificial Sequence
  Serine-tRNA ligase, cytoplasmic (194-202)
uacuuccugaagggcgugcucgucuuc

SEQ ID NO: 47839 - RNA, 30 nt, Artificial Sequence
  Tyrosine-protein kinase receptor (124-133)
uacggcgccgccgggggcaagggggcgaag

SEQ ID NO: 47840 - RNA, 30 nt, Artificial Sequence
  Hemoglobin subunit alpha (25-34)
uacggcgccgaggcccuggagcgcauguuc

SEQ ID NO: 47841 - RNA, 51 nt, Artificial Sequence
  Hemoglobin subunit alpha (25-41)
uacggcgccgaggcccuggagcgcauguuccucagcuuccccaccaccaag

SEQ ID NO: 47842 - RNA, 24 nt, Artificial Sequence
  Tubulin beta-6 chain (157-164)
uacggcgaccugaaccaccucgug

SEQ ID NO: 47843 - RNA, 24 nt, Artificial Sequence
  WD repeat-containing protein 3 (588-595)
uacggccacaagcugcccgugauc

SEQ ID NO: 47844 - RNA, 27 nt, Artificial Sequence
  Translocating chain-associated membrane protein 1 (75-83)
uacggcaucaaggaccuggccaccgug

SEQ ID NO: 47845 - RNA, 21 nt, Artificial Sequence
  U2 small nuclear ribonucleoprotein B'' (75-81)
uacggcaagcccaugcgcauc

SEQ ID NO: 47846 - RNA, 21 nt, Artificial Sequence
  Nucleoporin NUP53 (179-185)
uacggcaacauccugaagcac

SEQ ID NO: 47847 - RNA, 27 nt, Artificial Sequence
  Filamin-A (1844-1852)
uacggccccgggcugacccacggcgug

SEQ ID NO: 47848 - RNA, 21 nt, Artificial Sequence
  Vacuolar protein sorting-associated protein 51 homolog (123-129)
uacggccaggccgugcgcuac

SEQ ID NO: 47849 - RNA, 21 nt, Artificial Sequence
  Serine palmitoyltransferase 3 (290-296)
uacggccagccccgcacccgg

SEQ ID NO: 47850 - RNA, 21 nt, Artificial Sequence
  Tyrosine-protein kinase Fyn (385-391)
uacggccgcuucaccaucaag

SEQ ID NO: 47851 - RNA, 48 nt, Artificial Sequence
  Annexin A2 (24-39)
uacggcagcgugaaggccuacaccaacuucgacgccgagcgcgacgcg

SEQ ID NO: 47852 - RNA, 24 nt, Artificial Sequence
  Band 4.1-like protein 3 (187-194)
uacggcguggaccugcaccacgcc

SEQ ID NO: 47853 - RNA, 21 nt, Artificial Sequence
  Parafibromin (315-321)
uaccacggcaugacccugaag

SEQ ID NO: 47854 - RNA, 18 nt, Artificial Sequence
  Fibronectin type III domain-containing protein 3B (351-356)
uaccacgugcgcgucuac

SEQ ID NO: 47855 - RNA, 33 nt, Artificial Sequence
  cAMP-responsive element modulator (185-195)
uacaucgccaucgcccagggcgggaccauccag

SEQ ID NO: 47856 - RNA, 27 nt, Artificial Sequence
  HEAT repeat-containing protein 1 (1013-1021)
uacaucgccaaggaccugaugaaggug

SEQ ID NO: 47857 - RNA, 27 nt, Artificial Sequence
  Gamma-tubulin complex component 6 (1683-1691)
uacaucgccaaccagauccugcacgug

SEQ ID NO: 47858 - RNA, 27 nt, Artificial Sequence
  CAAX prenyl protease 1 homolog (218-226)
uacaucgccccccuguucgacaaguuc

SEQ ID NO: 47859 - RNA, 36 nt, Artificial Sequence
  Serum albumin (287-298)
uacaucugcgagaaccaggacagcaucuccagcaag

SEQ ID NO: 47860 - RNA, 27 nt, Artificial Sequence
  Ankyrin-2 (1793-1801)
uacaucgacgagcacggccacaccgug

SEQ ID NO: 47861 - RNA, 18 nt, Artificial Sequence
  E3 ubiquitin-protein ligase RNF216 (59-64)
uacaucgacuucaaguuc

SEQ ID NO: 47862 - RNA, 27 nt, Artificial Sequence
  Ribonuclease 3 (577-585)
uacaucgacaaggaccuggaguacgug

SEQ ID NO: 47863 - RNA, 27 nt, Artificial Sequence
  Eukaryotic translation initiation factor 3 subunit L (522-530)
uacaucgacaaggacaugauccacauc

SEQ ID NO: 47864 - RNA, 24 nt, Artificial Sequence
  Receptor tyrosine-protein kinase erbB-3 (148-155)
uacaucgagaagaacgacaagcug

SEQ ID NO: 47865 - RNA, 27 nt, Artificial Sequence
  Laminin subunit beta-1 (396-404)
uacaucgagaagguggucuacaccgug

SEQ ID NO: 47866 - RNA, 24 nt, Artificial Sequence
  26S proteasome non-ATPase regulatory subunit 8 (132-139)
uacaucaagcaccccgugagccug

SEQ ID NO: 47867 - RNA, 24 nt, Artificial Sequence
  Retinoblastoma-like protein 2 (1013-1020)
uacaucaagcagaucaagaccuuc

SEQ ID NO: 47868 - RNA, 27 nt, Artificial Sequence
  Exostosin-2 (348-356)
uacauccugcccuucagcgaggugcuc

SEQ ID NO: 47869 - RNA, 30 nt, Artificial Sequence
  E3 ubiquitin-protein ligase RNF114 (116-125)
uacaucauggagggcgugaaggccaccauc

SEQ ID NO: 47870 - RNA, 27 nt, Artificial Sequence
  Cytoplasmic dynein 1 heavy chain 1 (2489-2497)
uacauccagcgcuaccugguguacgcc

SEQ ID NO: 47871 - RNA, 27 nt, Artificial Sequence
  Ceramide synthase 2 (78-86)
uacauccgcgccggcacccugaucaug

SEQ ID NO: 47872 - RNA, 27 nt, Artificial Sequence
  Kinesin-like protein KIF11 (399-407)
uacaucagcgaggagaacuuccgcgug

SEQ ID NO: 47873 - RNA, 24 nt, Artificial Sequence
  Cleft lip and palate transmembrane protein 1 (108-115)
uacaucagcgagcacgagcacuuc

SEQ ID NO: 47874 - RNA, 27 nt, Artificial Sequence
  V-type proton ATPase subunit B, brain isoform (266-274)
uacaucaccgagggccagaucuacgug

SEQ ID NO: 47875 - RNA, 30 nt, Artificial Sequence
  E3 ubiquitin-protein ligase HERC2 (1123-1132)
uacaucguggagggcgacuucaccgggguc

SEQ ID NO: 47876 - RNA, 30 nt, Artificial Sequence
  Dedicator of cytokinesis protein 7 (457-466)
uacaucuacccccagagccugaacuucgcc

SEQ ID NO: 47877 - RNA, 21 nt, Artificial Sequence
  Eukaryotic peptide chain release factor GTP-binding subunit ERF3A (309-315)
uacaaggacaugggcaccgug

SEQ ID NO: 47878 - RNA, 21 nt, Artificial Sequence
  Store-operated calcium entry-associated regulatory factor (105-111)
uacaaguucggcaagaccgug

SEQ ID NO: 47879 - RNA, 21 nt, Artificial Sequence
  Ras-related protein Rab-20 (158-164)
uacaagaagauccugaaguac

SEQ ID NO: 47880 - RNA, 30 nt, Artificial Sequence
  Cytochrome c oxidase subunit 5B, mitochondrial (120-129)
uacaagcuggugccccagcagcucgcccac

SEQ ID NO: 47881 - RNA, 24 nt, Artificial Sequence
  Alpha-2-macroglobulin (163-170)
uacaagcccggccagaccgugaag

SEQ ID NO: 47882 - RNA, 24 nt, Artificial Sequence
  Fanconi anemia group I protein (1039-1046)
uacaagagccccgugauccugcuc

SEQ ID NO: 47883 - RNA, 27 nt, Artificial Sequence
  Thioredoxin-interacting protein (221-229)
uaccuggccaacggccagaccaaggug

SEQ ID NO: 47884 - RNA, 30 nt, Artificial Sequence
  Laminin subunit gamma-1 (667-676)
uaccuggacgacgugacccucgccagcgcc

SEQ ID NO: 47885 - RNA, 27 nt, Artificial Sequence
  Dedicator of cytokinesis protein 7 (628-636)
uaccuggacaaguucuucgcccucgug

SEQ ID NO: 47886 - RNA, 27 nt, Artificial Sequence
  Dedicator of cytokinesis protein 6 (723-731)
uaccuggacaaguucuucacccucgug

SEQ ID NO: 47887 - RNA, 27 nt, Artificial Sequence
  Zinc finger protein 573 (42-50)
uaccuggaccccaaccagcgcgaccuc

SEQ ID NO: 47888 - RNA, 27 nt, Artificial Sequence
  Kinesin-like protein KIF13B (1105-1113)
uaccuggaccagcagcuccagaagcug

SEQ ID NO: 47889 - RNA, 24 nt, Artificial Sequence
  ATP-binding cassette sub-family E member 1 (491-498)
uaccuggacagcgagcagcgccuc

SEQ ID NO: 47890 - RNA, 27 nt, Artificial Sequence
  Laminin subunit beta-1 (1753-1761)
uaccuggaggacaaggcccaggagcuc

SEQ ID NO: 47891 - RNA, 27 nt, Artificial Sequence
  Enhancer of mRNA-decapping protein 4 (906-914)
uaccuggaggaggccgugaugcaccuc

SEQ ID NO: 47892 - RNA, 27 nt, Artificial Sequence
  Inositol-trisphosphate 3-kinase A (270-278)
uaccuggaggaggagcucaccaaggcc

SEQ ID NO: 47893 - RNA, 24 nt, Artificial Sequence
  Ubiquitin carboxyl-terminal hydrolase 7 (1093-1100)
uaccuggagaaggccaucaagauc

SEQ ID NO: 47894 - RNA, 24 nt, Artificial Sequence
  Plectin (1070-1077)
uaccuggagaagcucaagaccauc

SEQ ID NO: 47895 - RNA, 27 nt, Artificial Sequence
  Heparan-sulfate 6-O-sulfotransferase 2 (442-450)
uaccuguucgagaagaccuucaacaug

SEQ ID NO: 47896 - RNA, 27 nt, Artificial Sequence
  Thioredoxin domain-containing protein 16 (103-111)
uaccuguucaagggcaacauccuccug

SEQ ID NO: 47897 - RNA, 27 nt, Artificial Sequence
  Bax inhibitor 1 (186-194)
uaccuguuccucggcgggauccugaug

SEQ ID NO: 47898 - RNA, 27 nt, Artificial Sequence
  T-box transcription factor TBX3 (251-259)
uaccuguuccccgagaccgaguucauc

SEQ ID NO: 47899 - RNA, 27 nt, Artificial Sequence
  Cyclin-dependent kinase 2 (107-115)
uaccuguuccagcuccugcagggccug

SEQ ID NO: 47900 - RNA, 27 nt, Artificial Sequence
  Electroneutral sodium bicarbonate exchanger 1 (1036-1044)
uaccugggcgccagcaacuaccgcacc

SEQ ID NO: 47901 - RNA, 27 nt, Artificial Sequence
  Hexokinase-1 (749-757)
uaccugggcgagaucgugcgcaacauc

SEQ ID NO: 47902 - RNA, 24 nt, Artificial Sequence
  Clustered mitochondria protein homolog (510-517)
uaccugggcaaggugcucgagcug

SEQ ID NO: 47903 - RNA, 27 nt, Artificial Sequence
  Putative ATP-dependent RNA helicase DHX33 (179-187)
uaccugcacgccgcccucgugagcguc

SEQ ID NO: 47904 - RNA, 21 nt, Artificial Sequence
  Rho-related BTB domain-containing protein 3 (560-566)
uaccugaucuucagccagaag

SEQ ID NO: 47905 - RNA, 27 nt, Artificial Sequence
  E3 ubiquitin-protein ligase TRIM36 (266-274)
uaccugaucggcaaggagagccaggug

SEQ ID NO: 47906 - RNA, 27 nt, Artificial Sequence
  ER membrane protein complex subunit 4 (136-144)
uaccugaucggcaaccucauggggcug

SEQ ID NO: 47907 - RNA, 27 nt, Artificial Sequence
  F-box only protein 21 (364-372)
uaccugaucggccagcacgugaccgcc

SEQ ID NO: 47908 - RNA, 27 nt, Artificial Sequence
  Dolichyl-diphosphooligosaccharide-proteinosyltransferase subunit 2 (343-351)
uaccugaucaucggcgacgccacccuc

SEQ ID NO: 47909 - RNA, 30 nt, Artificial Sequence
  Nuclear export mediator factor NEMF (539-548)
uaccugaucaucggcgggcgcgaccagcag

SEQ ID NO: 47910 - RNA, 27 nt, Artificial Sequence
  60S ribosomal protein L3 (286-294)
uaccugaucaaggacggcaagcucauc

SEQ ID NO: 47911 - RNA, 27 nt, Artificial Sequence
  WD repeat-containing protein 6 (703-711)
uaccugaaggacggcgacgugaugcuc

SEQ ID NO: 47912 - RNA, 21 nt, Artificial Sequence
  SFRS17A protein (23-29)
uaccugaagcccaucaccaag

SEQ ID NO: 47913 - RNA, 30 nt, Artificial Sequence
  TRPM8 channel-associated factor 2 (446-455)
uaccugcucgagggccagaacgccgaggug

SEQ ID NO: 47914 - RNA, 27 nt, Artificial Sequence
  Maestro heat-like repeat-containing protein family member 7 (965-973)
uaccugcucaucccccugcuggagcgc

SEQ ID NO: 47915 - RNA, 30 nt, Artificial Sequence
  Translocating chain-associated membrane protein 1 (211-220)
uaccugcucaaccugaaccaccugggccuc

SEQ ID NO: 47916 - RNA, 30 nt, Artificial Sequence
  Synemin (706-715)
uaccugcucagcaaggacaucaaggaggug

SEQ ID NO: 47917 - RNA, 33 nt, Artificial Sequence
  E3 ubiquitin-protein ligase RNF213 (2078-2088)
uaccugauggacaucaacggcaagauguggcuc

SEQ ID NO: 47918 - RNA, 27 nt, Artificial Sequence
  Nesprin-1 (1560-1568)
uaccugauggaggcccgcuacagccuc

SEQ ID NO: 47919 - RNA, 27 nt, Artificial Sequence
  Leucine-rich repeat and calponin homology domain-containing protein 1 (147-155)
uaccugaaccucagccgcaaccagcug

SEQ ID NO: 47920 - RNA, 27 nt, Artificial Sequence
  Kinesin-like protein KIF13B (1450-1458)
uaccugaaccccgugaagagcuucguc

SEQ ID NO: 47921 - RNA, 27 nt, Artificial Sequence
  Inactive ubiquitin carboxyl-terminal hydrolase 53 (271-279)
uaccugcccggccucuucuaccgcgug

SEQ ID NO: 47922 - RNA, 27 nt, Artificial Sequence
  Sterol regulatory element-binding protein 1 (1096-1104)
uaccugcccccgggcuuccucagcgcc

SEQ ID NO: 47923 - RNA, 27 nt, Artificial Sequence
  La-related protein 4 (424-432)
uaccugcagaaggagaccagcacccuc

SEQ ID NO: 47924 - RNA, 30 nt, Artificial Sequence
  Calcium/calmodulin-dependent 3',5'-cyclic nucleotide phosphodiesterase 1C (18-27)
uaccugcagcccgagcagaucgagaagauc

SEQ ID NO: 47925 - RNA, 18 nt, Artificial Sequence
  Tyrosine-protein phosphatase non-receptor type 23 (30-35)
uaccugcgcgagcacuuc

SEQ ID NO: 47926 - RNA, 30 nt, Artificial Sequence
  Ubiquitin-like modifier-activating enzyme 7 (247-256)
uaccugcgcggcggggccaucaccgaggug

SEQ ID NO: 47927 - RNA, 33 nt, Artificial Sequence
  Protein dopey-1 (743-753)
uaccugagcgccuuccucgccgcgugccagcug

SEQ ID NO: 47928 - RNA, 30 nt, Artificial Sequence
  2-hydroxyacylsphingosine 1-beta-galactosyltransferase (299-308)
uaccugagcgaggacaucgccaacaagcuc

SEQ ID NO: 47929 - RNA, 27 nt, Artificial Sequence
  Trafficking kinesin-binding protein 2 (496-504)
uaccugagcgagaagcaguucuucgcc

SEQ ID NO: 47930 - RNA, 27 nt, Artificial Sequence
  Coatomer subunit beta' (490-498)
uaccugagcgagaaggugcucgccgcc

SEQ ID NO: 47931 - RNA, 27 nt, Artificial Sequence
  Rho GTPase-activating protein 1 (214-222)
uaccugagcgagcucuccgagcacgug

SEQ ID NO: 47932 - RNA, 24 nt, Artificial Sequence
  Polyadenylate-binding protein-interacting protein 1 (112-119)
uaccugagccaccaccucaccauc

SEQ ID NO: 47933 - RNA, 27 nt, Artificial Sequence
  Alpha-N-acetylglucosaminidase (583-591)
uaccugagcaaggagcucgccucccug

SEQ ID NO: 47934 - RNA, 27 nt, Artificial Sequence
  Cytoplasmic dynein 1 heavy chain 1 (3552-3560)
uaccugagcaacgccgacgagcgccuc

SEQ ID NO: 47935 - RNA, 27 nt, Artificial Sequence
  Serine/threonine-protein kinase A-Raf (529-537)
uaccugagccccgaccucuccaagauc

SEQ ID NO: 47936 - RNA, 27 nt, Artificial Sequence
  UDP-glucose:glycoprotein glucosyltransferase 2 (1269-1277)
uaccugagccccaccuucaaggaggug

SEQ ID NO: 47937 - RNA, 27 nt, Artificial Sequence
  Cathepsin D (150-158)
uaccugagccaggacaccguguccguc

SEQ ID NO: 47938 - RNA, 27 nt, Artificial Sequence
  Plexin-B3 (1418-1426)
uaccugaccgacaucaugcgcacccuc

SEQ ID NO: 47939 - RNA, 42 nt, Artificial Sequence
  Plexin-B3 (1418-1431)
uaccugaccgacaucaugcgcacccuccugggcgaccuggcc

SEQ ID NO: 47940 - RNA, 27 nt, Artificial Sequence
  Alpha-1,3-mannosyl-glycoprotein 4-beta-N-acetylglucosaminyltransferase B (56-64)
uaccugaccgacacccuccacagccug

SEQ ID NO: 47941 - RNA, 27 nt, Artificial Sequence
  Apoptosis-associated speck-like protein containing a CARD (184-192)
uaccugguggaggaccucgagcgcagc

SEQ ID NO: 47942 - RNA, 27 nt, Artificial Sequence
  Probable ATP-dependent RNA helicase DDX47 (248-256)
uaccugguguacauccucaacgagcug

SEQ ID NO: 47943 - RNA, 21 nt, Artificial Sequence
  Serum albumin (162-168)
uaccuguacgagaucgcccgc

SEQ ID NO: 47944 - RNA, 27 nt, Artificial Sequence
  Protein sel-1 homolog 1 (457-465)
uaccuguacggccgcggggugcagguc

SEQ ID NO: 47945 - RNA, 30 nt, Artificial Sequence
  Probable G-protein coupled receptor 158 (82-91)
uaccuguacaccggcgacagccaccagcuc

SEQ ID NO: 47946 - RNA, 27 nt, Artificial Sequence
  Cytochrome c oxidase subunit 7A-related protein, mitochondrial (106-114)
uacauggccagccagcccaagaacaag

SEQ ID NO: 47947 - RNA, 27 nt, Artificial Sequence
  Hemicentin-2 (2923-2931)
uacaugugcguggccgagaaccaggcc

SEQ ID NO: 47948 - RNA, 27 nt, Artificial Sequence
  Protein shisa-5 (129-137)
uacauggacgcccccaaggccgcgcug

SEQ ID NO: 47949 - RNA, 30 nt, Artificial Sequence
  Lysosomal-trafficking regulator (1891-1900)
uacaugaacgagaacggcgaguucaagcug

SEQ ID NO: 47950 - RNA, 27 nt, Artificial Sequence
  Phosphatidylinositol N-acetylglucosaminyltransferase subunit H (129-137)
uacaugcagaaggugaucuacuaccug

SEQ ID NO: 47951 - RNA, 24 nt, Artificial Sequence
  Transmembraneoprotein NMB (37-44)
uacaugcgcgagcacaaccagcug

SEQ ID NO: 47952 - RNA, 18 nt, Artificial Sequence
  Histone-lysine N-methyltransferase ASH1L (2260-2265)
uacaacuuccacagcuuc

SEQ ID NO: 47953 - RNA, 27 nt, Artificial Sequence
  Actin-related protein 2 (225-233)
uacaacaucgagcaggagcagaagcug

SEQ ID NO: 47954 - RNA, 24 nt, Artificial Sequence
  26S proteasome non-ATPase regulatory subunit 8 (148-155)
uacaacaagguguuccuggccaag

SEQ ID NO: 47955 - RNA, 24 nt, Artificial Sequence
  Serine-protein kinase ATM (1148-1155)
uacaaccgcaagagcgugcugcuc

SEQ ID NO: 47956 - RNA, 72 nt, Artificial Sequence
  Alanine-tRNA ligase, cytoplasmic (487-510)
uacaacuaccaccuggacagcuccggcagcuacguguucgagaacaccgucgccaccgugauggcccuccgc

SEQ ID NO: 47957 - RNA, 24 nt, Artificial Sequence
  PHD finger protein 20 (103-110)
uaccccgccaaggugaccgccguc

SEQ ID NO: 47958 - RNA, 27 nt, Artificial Sequence
  Supervillin (1594-1602)
uaccccgcccgcgccccgagcgugguc

SEQ ID NO: 47959 - RNA, 30 nt, Artificial Sequence
  Ras GTPase-activating protein nGAP (628-637)
uaccccgacgaccgcaccagccggacccug

SEQ ID NO: 47960 - RNA, 24 nt, Artificial Sequence
  Splicing factor 3B subunit 3 (520-527)
uaccccgacggcauccgccacauc

SEQ ID NO: 47961 - RNA, 27 nt, Artificial Sequence
  Vacuolar protein sorting-associated protein 13B (2316-2324)
uaccccgagccgcgcgugcugacccuc

SEQ ID NO: 47962 - RNA, 24 nt, Artificial Sequence
  Constitutive coactivator of peroxisome proliferator-activated receptor gamma (665-672)
uaccccggcaacccgcugcgccac

SEQ ID NO: 47963 - RNA, 21 nt, Artificial Sequence
  Heterogeneous nuclear ribonucleoprotein U-like protein 1 (369-375)
uacccccacgugcuggucaag

SEQ ID NO: 47964 - RNA, 27 nt, Artificial Sequence
  Actin, cytoplasmic 2 (69-77)
uaccccaucgagcacggcaucgugacc

SEQ ID NO: 47965 - RNA, 27 nt, Artificial Sequence
  Isoleucine-tRNA ligase, cytoplasmic (845-853)
uacccccugaaggagaucguggucauc

SEQ ID NO: 47966 - RNA, 27 nt, Artificial Sequence
  Transmembrane protein 98 (147-155)
uaccccccgcuggaccccaagcuccug

SEQ ID NO: 47967 - RNA, 27 nt, Artificial Sequence
  Fatty aldehyde dehydrogenase (440-448)
uaccccccgaacagccaguccaaggug

SEQ ID NO: 47968 - RNA, 33 nt, Artificial Sequence
  All-trans-retinol 13,14-reductase (15-25)
uacccccgcggcgggagcuccgagaucgccuuc

SEQ ID NO: 47969 - RNA, 24 nt, Artificial Sequence
  Syntenin-1 (46-53)
uacccccgccuguacccggagcuc

SEQ ID NO: 47970 - RNA, 27 nt, Artificial Sequence
  Protocadherin gamma-C3 (569-577)
uacccccgcccgggcgggagcuccgug

SEQ ID NO: 47971 - RNA, 30 nt, Artificial Sequence
  Phosphatidylcholine translocator ABCB4 (403-412)
uaccccagccgcgccaacgugaagauccug

SEQ ID NO: 47972 - RNA, 30 nt, Artificial Sequence
  AT-rich interactive domain-containing protein 1A (921-930)
uaccccuacggcgggccguacgaccgcgug

SEQ ID NO: 47973 - RNA, 27 nt, Artificial Sequence
  Ataxin-2-like protein (1021-1029)
uaccccuacaucggccacccgcaggug

SEQ ID NO: 47974 - RNA, 27 nt, Artificial Sequence
  Desmin (387-395)
uaccaggaccugcucaacgugaagaug

SEQ ID NO: 47975 - RNA, 27 nt, Artificial Sequence
  Laminin subunit beta-1 (934-942)
uaccaggaccccgugacccugcagcuc

SEQ ID NO: 47976 - RNA, 24 nt, Artificial Sequence
  Vimentin (358-365)
uaccaggacaccaucggccgccug

SEQ ID NO: 47977 - RNA, 36 nt, Artificial Sequence
  Regulator of nonsense transcripts 1 (154-165)
uaccagcacggcggggugaccggccugagccaguac

SEQ ID NO: 47978 - RNA, 24 nt, Artificial Sequence
  AP-5 complex subunit zeta-1 (389-396)
uaccagcaccuguucacccgcauc

SEQ ID NO: 47979 - RNA, 21 nt, Artificial Sequence
  Cytoplasmic dynein 1 heavy chain 1 (2959-2965)
uaccagaucaaggugcaccgc

SEQ ID NO: 47980 - RNA, 24 nt, Artificial Sequence
  Bardet-Biedl syndrome 4 protein (46-53)
uaccagaaggccuucgagcaccug

SEQ ID NO: 47981 - RNA, 27 nt, Artificial Sequence
  Remodeling and spacing factor 1 (52-60)
uaccagcuggaccaggaccacaacgug

SEQ ID NO: 47982 - RNA, 27 nt, Artificial Sequence
  Exportin-7 (341-349)
uaccagcugggcgagcucgugaagguc

SEQ ID NO: 47983 - RNA, 27 nt, Artificial Sequence
  T-box transcription factor TBX3 (264-272)
uaccagaacgacaagaucacccagcug

SEQ ID NO: 47984 - RNA, 24 nt, Artificial Sequence
  Rho GTPase-activating protein 5 (414-421)
uaccagaaccacgugcagcaccug

SEQ ID NO: 47985 - RNA, 24 nt, Artificial Sequence
  Zinc finger MYM-type protein 4 (345-352)
uaccagaacgugguccacaagcug

SEQ ID NO: 47986 - RNA, 24 nt, Artificial Sequence
  Signal transducer and activator of transcription 6 (88-95)
uaccagcgcgacccccugaagcuc

SEQ ID NO: 47987 - RNA, 27 nt, Artificial Sequence
  TBC1 domain family member 16 (260-268)
uaccagaccgacuacuuccaccuguuc

SEQ ID NO: 47988 - RNA, 30 nt, Artificial Sequence
  Fatty acid synthase (959-968)
uaccagugggacgaccccgacccgcgccug

SEQ ID NO: 47989 - RNA, 24 nt, Artificial Sequence
  Homeodomain-interacting protein kinase 4 (181-188)
uaccgcgcccccgagauccugcuc

SEQ ID NO: 47990 - RNA, 24 nt, Artificial Sequence
  Glycogen synthase kinase-3 beta (222-229)
uaccgcgcccccgagcugaucuuc

SEQ ID NO: 47991 - RNA, 27 nt, Artificial Sequence
  Protocadherin gamma-C3 (727-735)
uaccgcgcccccgugagcucccuguac

SEQ ID NO: 47992 - RNA, 27 nt, Artificial Sequence
  Proteasome subunit beta type-4 (223-231)
uaccgcgacgcccggagcuacaaccgc

SEQ ID NO: 47993 - RNA, 24 nt, Artificial Sequence
  Pyruvate kinase PKM (392-399)
uaccgcggcaucuuccccgugcug

SEQ ID NO: 47994 - RNA, 36 nt, Artificial Sequence
  Alpha-enolase (33-44)
uaccgccacaucgccgaccuggccggcaacagcgag

SEQ ID NO: 47995 - RNA, 33 nt, Artificial Sequence
  Chondroitin sulfate proteoglycan 4 (1979-1989)
uaccgccugauccagggcccccaguacgggcac

SEQ ID NO: 47996 - RNA, 27 nt, Artificial Sequence
  SLIT and NTRK-like protein 2 (712-720)
uaccgcaaccugcaggaguucagcuac

SEQ ID NO: 47997 - RNA, 24 nt, Artificial Sequence
  HIG1 domain family member 2A, mitochondrial (29-36)
uaccgcaaccccgagagcuucaag

SEQ ID NO: 47998 - RNA, 27 nt, Artificial Sequence
  Glycogen phosphorylase, brain form (792-800)
uaccgcaaccccaaggaguggaccaag

SEQ ID NO: 47999 - RNA, 24 nt, Artificial Sequence
  Dual specificity protein kinase CLK3 (317-324)
uaccgccccccggaggugauccug

SEQ ID NO: 48000 - RNA, 21 nt, Artificial Sequence
  Chromodomain-helicase-DNA-binding protein 4 (169-175)
uaccgcacccugaccaacuac

SEQ ID NO: 48001 - RNA, 27 nt, Artificial Sequence
  ATP-dependent RNA helicase DDX3X (243-251)
uacagcgacggccccggggaggcccug

SEQ ID NO: 48002 - RNA, 30 nt, Artificial Sequence
  Transcription factor SOX-10 (402-411)
uacagcgaccaccagcccuccggcccguac

SEQ ID NO: 48003 - RNA, 33 nt, Artificial Sequence
  Transcription factor SOX-10 (402-412)
uacagcgaccaccagcccuccggcccguacuac

SEQ ID NO: 48004 - RNA, 27 nt, Artificial Sequence
  Rab3 effector-like (158-166)
uacagcgaccccuucgugaaggucuac

SEQ ID NO: 48005 - RNA, 36 nt, Artificial Sequence
  Lysosomal-trafficking regulator (864-875)
uacagcgacuccccccagagccuguccaaguucuac

SEQ ID NO: 48006 - RNA, 27 nt, Artificial Sequence
  Unconventional myosin-XVIIIa (454-462)
uacagcgagaaggugaugcacauguuc

SEQ ID NO: 48007 - RNA, 27 nt, Artificial Sequence
  DNA polymerase alpha catalytic subunit (732-740)
uacagcgaguccagccagcugcucuac

SEQ ID NO: 48008 - RNA, 30 nt, Artificial Sequence
  AF4/FMR2 family member 4 (970-979)
uacagcgagaccguggaccugaucaaguac

SEQ ID NO: 48009 - RNA, 24 nt, Artificial Sequence
  CDK5 regulatory subunit-associated protein 3 (494-501)
uacagcggccgccccgugaaccug

SEQ ID NO: 48010 - RNA, 21 nt, Artificial Sequence
  SAM and SH3 domain-containing protein 1 (307-313)
uacagcggcgugcacaagaag

SEQ ID NO: 48011 - RNA, 27 nt, Artificial Sequence
  Nucleolar pre-ribosomal-associated protein 1 (1469-1477)
uacagccaccuggagggcgcccgcuuc

SEQ ID NO: 48012 - RNA, 24 nt, Artificial Sequence
  Inositol 1,4,5-trisphosphate receptor type 3 (2259-2266)
uacagcauccgcccccugaucgug

SEQ ID NO: 48013 - RNA, 21 nt, Artificial Sequence
  Rho-associated protein kinase 1 (287-293)
uacagcaagaucaugaaccac

SEQ ID NO: 48014 - RNA, 21 nt, Artificial Sequence
  Proteasome activator complex subunit 4 (40-46)
uacagcaagaccgagcaccug

SEQ ID NO: 48015 - RNA, 27 nt, Artificial Sequence
  Melanoma-associated antigen D2 (326-334)
uacagccuggagaagguguucggcauc

SEQ ID NO: 48016 - RNA, 48 nt, Artificial Sequence
  PERQ amino acid-rich with GYF domain-containing protein 1 (739-754)
uacagccugcacggcuccagcggggagaucgaguccguggacgacuac

SEQ ID NO: 48017 - RNA, 24 nt, Artificial Sequence
  60S ribosomal protein L6 (63-70)
uacagccgcaaggccauguacaag

SEQ ID NO: 48018 - RNA, 24 nt, Artificial Sequence
  BTB/POZ domain-containing protein KCTD20 (143-150)
uacagcuccaagcuguaccgcuuc

SEQ ID NO: 48019 - RNA, 42 nt, Artificial Sequence
  Eukaryotic translation initiation factor 3 subunit D (59-72)
uacagcucccaguucggcgggggcagccaguacgccuacuuc

SEQ ID NO: 48020 - RNA, 27 nt, Artificial Sequence
  Bromo adjacent homology domain-containing 1 protein (744-752)
uacagcacccccccgcaccgcaccgug

SEQ ID NO: 48021 - RNA, 69 nt, Artificial Sequence
  Actin, gamma-enteric smooth muscle (295-317)
uacagcguguggaucggcggguccauccuggccagccucuccaccuuccagcagauguggaucagcaag

SEQ ID NO: 48022 - RNA, 108 nt, Artificial Sequence
  Actin, cytoplasmic 2 (337-372)
uacagcguguggaucggcggguccauccuggccagccucuccaccuuccagcagauguggaucagcaagcaggaguacgacgaguccggccccagcaucguccaccgc

SEQ ID NO: 48023 - RNA, 27 nt, Artificial Sequence
  Uncharacterized protein C5orf34 (326-334)
uacagcuaccccgagcuggugaagaug

SEQ ID NO: 48024 - RNA, 27 nt, Artificial Sequence
  Citrate synthase, mitochondrial (189-197)
uacaccgaccaccaguucaccgagcug

SEQ ID NO: 48025 - RNA, 24 nt, Artificial Sequence
  Guanine nucleotide-binding protein subunit beta-2-like 1 (302-309)
uacaccgacaaccuggugcgcguc

SEQ ID NO: 48026 - RNA, 30 nt, Artificial Sequence
  Transcription factor SOX-10 (369-378)
uacaccgaccagcccagcaccucccagauc

SEQ ID NO: 48027 - RNA, 24 nt, Artificial Sequence
  WD repeat-containing protein 1 (54-61)
uacaccgagcacgcccaccaggug

SEQ ID NO: 48028 - RNA, 21 nt, Artificial Sequence
  Protocadherin Fat 2 (2518-2524)
uacaccaucaucaacaagcug

SEQ ID NO: 48029 - RNA, 24 nt, Artificial Sequence
  1,2-dihydroxy-3-keto-5-methylthiopentene dioxygenase (142-149)
uacaccaaggccaugcgccuguuc

SEQ ID NO: 48030 - RNA, 39 nt, Artificial Sequence
  Syndecan-3 (419-431)
uacacccuggaggagcccaagcaggccagcgugaccuac

SEQ ID NO: 48031 - RNA, 27 nt, Artificial Sequence
  Trophinin (94-102)
uacacccuggagaagauguuccgcgug

SEQ ID NO: 48032 - RNA, 27 nt, Artificial Sequence
  Zinc finger E-box-binding homeobox 2 (504-512)
uacacccuggagaaggugaacgaggcc

SEQ ID NO: 48033 - RNA, 30 nt, Artificial Sequence
  Probable ATP-dependent RNA helicase DDX5 (540-549)
uacaccaacggcagcuucggguccaacuuc

SEQ ID NO: 48034 - RNA, 66 nt, Artificial Sequence
  Fructose-bisphosphate aldolase A (397-418)
uacacccccagcggccaggccggggccgcggccuccgagagccuguucguguccaaccacgccuac

SEQ ID NO: 48035 - RNA, 27 nt, Artificial Sequence
  DNA replication licensing factor MCM3 (251-259)
uacaccagcggcaccuuccgcacggug

SEQ ID NO: 48036 - RNA, 42 nt, Artificial Sequence
  Melanocyte protein PMEL (265-278)
uacaccugggacuucggcgacagcuccgggacccugaucagc

SEQ ID NO: 48037 - RNA, 51 nt, Artificial Sequence
  Melanocyte protein PMEL (265-281)
uacaccugggacuucggcgacagcuccgggacccugaucagccgcgcccuc

SEQ ID NO: 48038 - RNA, 30 nt, Artificial Sequence
  Adenylate cyclase type 6 (111-120)
uacguggccugcgcccugcucgucuucugc

SEQ ID NO: 48039 - RNA, 30 nt, Artificial Sequence
  Lysine-specific histone demethylase 1A (121-130)
uacguggccgaccugggcgccauggucgug

SEQ ID NO: 48040 - RNA, 24 nt, Artificial Sequence
  HLA class I histocompatibility antigen, B-49 alpha chain (51-58)
uacguggacgacacccuguucguc

SEQ ID NO: 48041 - RNA, 24 nt, Artificial Sequence
  HLA class I histocompatibility antigen, B-13 alpha chain (26-33)
uacguggacgacacccaguucguc

SEQ ID NO: 48042 - RNA, 30 nt, Artificial Sequence
  HLA class I histocompatibility antigen, Cw-5 alpha chain (51-60)
uacguggacgacacccaguucguccaguuc

SEQ ID NO: 48043 - RNA, 33 nt, Artificial Sequence
  HLA class I histocompatibility antigen, B-13 alpha chain (26-36)
uacguggacgacacccaguucguccgcuucgac

SEQ ID NO: 48044 - RNA, 36 nt, Artificial Sequence
  HLA class I histocompatibility antigen, B-13 alpha chain (26-37)
uacguggacgacacccaguucguccgcuucgacagc

SEQ ID NO: 48045 - RNA, 30 nt, Artificial Sequence
  Helicase SKI2W (1066-1075)
uacguggacgaggccggcaccgucaagcug

SEQ ID NO: 48046 - RNA, 30 nt, Artificial Sequence
  40S ribosomal protein S16 (98-107)
uacguggacgaggccagcaagaaggagauc

SEQ ID NO: 48047 - RNA, 24 nt, Artificial Sequence
  Angiomotin-like protein 1 (605-612)
uacguggagaaggucgagaagcug

SEQ ID NO: 48048 - RNA, 24 nt, Artificial Sequence
  Angiomotin-like protein 2 (482-489)
uacguggagaaggucgagcgccug

SEQ ID NO: 48049 - RNA, 21 nt, Artificial Sequence
  Melanoma-derived growth regulatory protein (71-77)
uacguguucagcaagcugaag

SEQ ID NO: 48050 - RNA, 27 nt, Artificial Sequence
  Glutamine-tRNA ligase (632-640)
uacgugaucgagcugcagcacgucgug

SEQ ID NO: 48051 - RNA, 30 nt, Artificial Sequence
  E3 ubiquitin-protein ligase Arkadia (683-692)
uacgugaucccccacccgguccacgccuuc

SEQ ID NO: 48052 - RNA, 27 nt, Artificial Sequence
  Apoptosis-resistant E3 ubiquitin protein ligase 1 (356-364)
uacgugagccccaagcaguucuccguc

SEQ ID NO: 48053 - RNA, 24 nt, Artificial Sequence
  Signal transducer and activator of transcription 2 (829-836)
uacgugagccgccccucccacuuc

SEQ ID NO: 48054 - RNA, 27 nt, Artificial Sequence
  Serine/threonine-protein kinase SMG1 (424-432)
uacgugaccgacguccuguaccgcgug

SEQ ID NO: 48055 - RNA, 36 nt, Artificial Sequence
  Filamin-A (2047-2058)
uacgugaccgagaucgaccaggacaaguacgccguc

SEQ ID NO: 48056 - RNA, 27 nt, Artificial Sequence
  Fructose-bisphosphate aldolase A (258-266)
uacgugaccgagaagguccuggccgcc

SEQ ID NO: 48057 - RNA, 27 nt, Artificial Sequence
  Tensin-1 (17-25)
uacgugaccgagcgcaucaucgccguc

SEQ ID NO: 48058 - RNA, 27 nt, Artificial Sequence
  Membrane-associated transporter protein (55-63)
uacgugacccccguccugcucagcgug

SEQ ID NO: 48059 - RNA, 30 nt, Artificial Sequence
  Attractin (187-196)
uacguguacgacggcgacagcaucuacgcc

SEQ ID NO: 48060 - RNA, 21 nt, Artificial Sequence
  Histone H2B type 2-F (41-47)
uacguguacaagguccugaag

SEQ ID NO: 48061 - RNA, 21 nt, Artificial Sequence
  40S ribosomal protein S29 (7-13)
uacuggagccacccccgcaag

SEQ ID NO: 48062 - RNA, 96 nt, Artificial Sequence
  Keratin, type I cytoskeletal 18 (212-243)
uacuggagccagcagaucgaggaguccaccaccguggucacgacccagagcgccgaggugggcgccgcggagaccacccugacggagcuccgccgg

SEQ ID NO: 48063 - RNA, 27 nt, Artificial Sequence
  Dual specificity tyrosine-phosphorylation-regulated kinase 1A (471-479)
uacuacgcccugcagcacagcuucuuc

SEQ ID NO: 48064 - RNA, 27 nt, Artificial Sequence
  Cap-specific mRNAucleoside-2'-O-)-methyltransferase 1 (795-803)
uacuacggccgccuguucugggagugg

SEQ ID NO: 48065 - RNA, 27 nt, Artificial Sequence
  Motile sperm domain-containing protein 2 (174-182)
uacuaccccaaguaccugagcaagauc

SEQ ID NO: 48066 - RNA, 27 nt, Artificial Sequence
  Procollagen-lysine,2-oxoglutarate 5-dioxygenase 2 (114-122)
uacuacaccaagggcuucgcccugcuc

SEQ ID NO: 48067 - RNA, 27 nt, Artificial Sequence
  Receptor-type protein tyrosine phosphatase beta (1197-1205)
uacuacaccgugcgcaacuucacccug

SEQ ID NO: 48068 - RNA, 27 nt, Artificial Sequence
  CASP8 and FADD-like apoptosis regulator (367-375)
uacuacguguggcugcagcacacccuc

SEQ ID NO: 48069 - RNA, 27 nt, Artificial Sequence
  Tyrosine-protein kinase JAK1 (67-75)
gcccuguacgacgagaacaccaagcuc

SEQ ID NO: 48070 - RNA, 27 nt, Artificial Sequence
  RNA-binding protein 4 (259-267)
gccauggccagccaccugaccuccacc

SEQ ID NO: 48071 - RNA, 27 nt, Artificial Sequence
  Neuroligin-3 (389-397)
gagggccugaaguucguggaggggguc

SEQ ID NO: 48072 - RNA, 27 nt, Artificial Sequence
  StAR-related lipid transfer protein 7, mitochondrial (235-243)
ggcaugcccgacuuccuggagaagcuc

SEQ ID NO: 48073 - RNA, 27 nt, Artificial Sequence
  Katanin p60 ATPase-containing subunit A1 (77-85)
aagcuggacagcaccccccucaaggcc

SEQ ID NO: 48074 - RNA, 27 nt, Artificial Sequence
  YrdC domain-containing protein, mitochondrial (184-192)
cagauguucgagggcccccuggcccuc

SEQ ID NO: 48075 - RNA, 27 nt, Artificial Sequence
  Protein FAM72C (114-122)
cgccuggacagcaccggcgugaacguc

SEQ ID NO: 48076 - RNA, 33 nt, Artificial Sequence
  ATP-dependent RNA helicase DHX36 (643-653)
cgccugauggaccccccgagcaacgaggccgug

SEQ ID NO: 48077 - RNA, 27 nt, Artificial Sequence
  Serine/arginine repetitive matrix protein 2 (2370-2378)
cgcauggcccccgcccugagcggcgcg

SEQ ID NO: 48078 - RNA, 27 nt, Artificial Sequence
  Nuclear receptor coactivator 1 (835-843)
cgcauggacggcgccgugaccagcguc

SEQ ID NO: 48079 - RNA, 27 nt, Artificial Sequence
  Ethanolamine kinase 1 (232-240)
cgccagcuggccaagauccacgccauc

SEQ ID NO: 48080 - RNA, 27 nt, Artificial Sequence
  Clathrin heavy chain 1 (1039-1047)
cgcgugauggaguacaucaaccggcug

SEQ ID NO: 48081 - RNA, 27 nt, Artificial Sequence
  Large proline-rich protein BAG6 (530-538)
agccuggcccagaugguguccggccuc

SEQ ID NO: 48082 - RNA, 27 nt, Artificial Sequence
  Mediator of RNA polymerase II transcription subunit 8 (11-19)
agccuggacgcccuccugucccaggug

SEQ ID NO: 48083 - RNA, 33 nt, Artificial Sequence
  Cathepsin L1 (247-257)
guggccaucgacgccggccacgagagcuuccug

SEQ ID NO: 48084 - RNA, 27 nt, Artificial Sequence
  UDP-glucose:glycoprotein glucosyltransferase 2 (187-195)
uacgccgagaugggcacccgcaccuuc

SEQ ID NO: 48085 - RNA, 30 nt, Artificial Sequence
  Alkyldihydroxyacetonephosphate synthase, peroxisomal (308-317)
agcaccgugggcgggugggucuccacccgc

SEQ ID NO: 48086 - RNA, 54 nt, Artificial Sequence
  Paired box protein Pax-2 (160-177)
gcccccggccacaccaucgugccgagcaccgccuccccccccgucagcuccgcg

SEQ ID NO: 48087 - RNA, 45 nt, Artificial Sequence
  Glutamyl aminopeptidase (290-304)
gccgugcaccaguucgacagcgucaagcgcaucuccaacagcggc

SEQ ID NO: 48088 - RNA, 24 nt, Artificial Sequence
  Inositol 1,4,5-trisphosphate receptor type 3 (333-340)
gacauccugauccgcaccgagcuc

SEQ ID NO: 48089 - RNA, 27 nt, Artificial Sequence
  Fatty acid synthase (1644-1652)
gaggccgccagcgugcccgucguguac

SEQ ID NO: 48090 - RNA, 36 nt, Artificial Sequence
  POTE ankyrin domain family member E (1064-1075)
gagagcggccccuccaucgugcaccgcaagugcuuc

SEQ ID NO: 48091 - RNA, 27 nt, Artificial Sequence
  Beta-1-syntrophin (163-171)
cuggccgaccccgagaaccgccagcuc

SEQ ID NO: 48092 - RNA, 27 nt, Artificial Sequence
  Egl nine homolog 3 (194-202)
aacccccacgaggugcagccgagcuac

SEQ ID NO: 48093 - RNA, 24 nt, Artificial Sequence
  GRB2-related adapter protein (34-41)
cagaacugguacaaggccgagcug

SEQ ID NO: 48094 - RNA, 27 nt, Artificial Sequence
  Protein-lysine 6-oxidase (86-94)
cagccccgcaccccgauccugcucauc

SEQ ID NO: 48095 - RNA, 24 nt, Artificial Sequence
  Adenomatous polyposis coli protein (222-229)
cagcagaucgagaaggacauccug

SEQ ID NO: 48096 - RNA, 27 nt, Artificial Sequence
  Insulin-like growth factor-binding protein 3 (5-13)
cgccccacccugugggccgccgcgcuc

SEQ ID NO: 48097 - RNA, 42 nt, Artificial Sequence
  Thrombospondin-1 (56-69)
agccccgccuuccgcaucgaggacgccaaccugaucccgccc

SEQ ID NO: 48098 - RNA, 30 nt, Artificial Sequence
  Epidermal growth factor receptor (1026-1035)
agccccuccaccagccgcaccccgcugcuc

SEQ ID NO: 48099 - RNA, 48 nt, Artificial Sequence
  Thrombospondin-2 (96-111)
agccgcggcacccugcucgcccuggaggggcccggccugucccagcgg

SEQ ID NO: 48100 - RNA, 27 nt, Artificial Sequence
  Transforming growth factor beta-1 (263-271)
accccccuggagcgcgcccagcaccuc

SEQ ID NO: 48101 - RNA, 51 nt, Artificial Sequence
  Transforming growth factor-beta-induced protein ig-h3 (579-595)
gugagcggcgggaucggcgcccugguccgccucaagucccugcagggggac

SEQ ID NO: 48102 - RNA, 30 nt, Artificial Sequence
  Matrilysin (167-176)
uaccccuucgacggcccggggaacacccug

SEQ ID NO: 48103 - RNA, 30 nt, Artificial Sequence
  Cytochrome b-c1 complex subunit Rieske, mitochondrial (82-91)
gacaucaaggugcccgacuucagcgaguac

SEQ ID NO: 48104 - RNA, 36 nt, Artificial Sequence
  Thioredoxin-related transmembrane protein 4 (92-103)
gacgugauccaggagcccggccugagcgggcgcuuc

SEQ ID NO: 48105 - RNA, 36 nt, Artificial Sequence
  Keratin, type I cytoskeletal 9 (29-40)
gaggaggccaacaacgaccuggagaacaagauccag

SEQ ID NO: 48106 - RNA, 42 nt, Artificial Sequence
  POTE ankyrin domain family member E (805-818)
cugaccgaggccccccucaacccgaaggccaaccgcgagaag

SEQ ID NO: 48107 - RNA, 51 nt, Artificial Sequence
  POTE ankyrin domain family member E (805-821)
cugaccgaggccccccucaacccgaaggccaaccgcgagaagaugacccag

SEQ ID NO: 48108 - RNA, 36 nt, Artificial Sequence
  40S ribosomal protein S21 (35-46)
aacguggccgaggucgacaaggugaccggccgcuuc

SEQ ID NO: 48109 - RNA, 27 nt, Artificial Sequence
  Keratin, type II cytoskeletal 2 epidermal (170-178)
aacgugaaggucgaccccgagauccag

SEQ ID NO: 48110 - RNA, 54 nt, Artificial Sequence
  Heat shock protein beta-1 (188-205)
cgcgcccagcugggcgggcccgaggccgcgaagagcgacgagaccgccgccaag

SEQ ID NO: 48111 - RNA, 33 nt, Artificial Sequence
  Actin, alpha skeletal muscle (2-12)
cgcgagaucgugcgggacaucaaggagaagcug

SEQ ID NO: 48112 - RNA, 42 nt, Artificial Sequence
  ATP synthase subunit gamma, mitochondrial (176-189)
agcggcuacgaguucgacgagggguccaucaucuucaacaag

SEQ ID NO: 48113 - RNA, 36 nt, Artificial Sequence
  Fibronectin (1340-1351)
agcguguacgagcagcacgaguccaccccccugcgc

SEQ ID NO: 48114 - RNA, 48 nt, Artificial Sequence
  Vimentin (38-53)
uacagccugggcuccgcccuccgccccagcaccucccggagccuguac

SEQ ID NO: 48115 - RNA, 27 nt, Artificial Sequence
  Guanylate kinase (10-18)
gccgccgcggcccugggccgcgccccc

SEQ ID NO: 48116 - RNA, 27 nt, Artificial Sequence
  T-box transcription factor TBX2 (59-67)
gccgccgcggaggccggccugcacgug

SEQ ID NO: 48117 - RNA, 36 nt, Artificial Sequence
  Heterogeneous nuclear ribonucleoprotein L (36-47)
gccgccgcgggcgggggcgggggcgggggccgcuac

SEQ ID NO: 48118 - RNA, 39 nt, Artificial Sequence
  Heterogeneous nuclear ribonucleoprotein L (36-48)
gccgccgcgggcgggggcgggggcgggggccgcuacuac

SEQ ID NO: 48119 - RNA, 24 nt, Artificial Sequence
  Exocyst complex component 4 (16-23)
gccgccgcgcacagcgugguccug

SEQ ID NO: 48120 - RNA, 27 nt, Artificial Sequence
  Fumarate hydratase, mitochondrial (155-163)
gccgccgcgaucgaggugcacgagguc

SEQ ID NO: 48121 - RNA, 27 nt, Artificial Sequence
  Calcium-binding mitochondrial carrier protein Aralar2 (2-10)
gccgccgcgaagguggcccugaccaag

SEQ ID NO: 48122 - RNA, 27 nt, Artificial Sequence
  ATP-binding cassette sub-family B member 10, mitochondrial (226-234)
gccgccgcgaacgccauccgcguguac

SEQ ID NO: 48123 - RNA, 33 nt, Artificial Sequence
  Iroquois-class homeodomain protein IRX-2 (414-424)
gccgccgcgcccggcgaggcccugcacaccgcc

SEQ ID NO: 48124 - RNA, 24 nt, Artificial Sequence
  Bcl-2-binding component 3 (195-202)
gccgccgcgcccccgcugacccuc

SEQ ID NO: 48125 - RNA, 27 nt, Artificial Sequence
  Polyadenylate-binding protein 4 (547-555)
gccgccgcgcccccgcaggagcagaag

SEQ ID NO: 48126 - RNA, 27 nt, Artificial Sequence
  Protein Shroom2 (289-297)
gccgccgcgcagcacuucaccgcccug

SEQ ID NO: 48127 - RNA, 27 nt, Artificial Sequence
  LRRN4 C-terminal-like protein (230-238)
gccgccgcgcgcgccgccggcgcccug

SEQ ID NO: 48128 - RNA, 30 nt, Artificial Sequence
  Pyridoxal-dependent decarboxylase domain-containing protein 1 (179-188)
gccgccgcgcgccccggccuggggcaguac

SEQ ID NO: 48129 - RNA, 27 nt, Artificial Sequence
  T-complex protein 1 subunit alpha (24-32)
gccgccgcgagcaucgccaacaucgug

SEQ ID NO: 48130 - RNA, 27 nt, Artificial Sequence
  Neuronal pentraxin receptor (38-46)
gccgccgcgagccccggcccgcagcgc

SEQ ID NO: 48131 - RNA, 27 nt, Artificial Sequence
  Disco-interacting protein 2 homolog C (25-33)
gccgccgcgguggacguccgcaccugg

SEQ ID NO: 48132 - RNA, 33 nt, Artificial Sequence
  Tubulin beta-4B chain (10-20)
gccgccugcgacccccgccacggccgguaccug

SEQ ID NO: 48133 - RNA, 27 nt, Artificial Sequence
  Cartilage-associated protein (245-253)
gccgccugcgagggcagccgcgagauc

SEQ ID NO: 48134 - RNA, 27 nt, Artificial Sequence
  Phenylalanine-tRNA ligase alpha subunit (118-126)
gccgccgacggcccccgcguguuccgg

SEQ ID NO: 48135 - RNA, 27 nt, Artificial Sequence
  Importin-4 (48-56)
gccgccgacccccagauccgccaguuc

SEQ ID NO: 48136 - RNA, 24 nt, Artificial Sequence
  UBA-like domain-containing protein 1 (24-31)
gccgccgaccaggcgaagcagcug

SEQ ID NO: 48137 - RNA, 33 nt, Artificial Sequence
  Melanoma antigen preferentially expressed in tumors (59-69)
gccgccuucgacggccgccacagccagacccug

SEQ ID NO: 48138 - RNA, 27 nt, Artificial Sequence
  Cleavage and polyadenylation specificity factor subunit 2 (121-129)
gccgccuucgacaagauccagcagcug

SEQ ID NO: 48139 - RNA, 27 nt, Artificial Sequence
  Splicing factor 3B subunit 1 (744-752)
gccgccuuccugaaggcgaucggcuac

SEQ ID NO: 48140 - RNA, 27 nt, Artificial Sequence
  V-type proton ATPase subunit H (287-295)
gccgccuuccgcaacuuccuggagaag

SEQ ID NO: 48141 - RNA, 27 nt, Artificial Sequence
  Macrophage-capping protein (134-142)
gccgccaucaagaagcuguaccaggug

SEQ ID NO: 48142 - RNA, 27 nt, Artificial Sequence
  Ferritin heavy chain (81-89)
gccgccaucaaccgccagaucaaccug

SEQ ID NO: 48143 - RNA, 27 nt, Artificial Sequence
  Growth arrest-specific protein 8 (268-276)
gccgccauccaggaggugcagcagaag

SEQ ID NO: 48144 - RNA, 27 nt, Artificial Sequence
  Malate dehydrogenase, cytoplasmic (114-122)
gccgcccuggacaaguacgcgaagaag

SEQ ID NO: 48145 - RNA, 33 nt, Artificial Sequence
  Numb-like protein (541-551)
gccgcccuggagggcaaggcgaccguggagaag

SEQ ID NO: 48146 - RNA, 27 nt, Artificial Sequence
  Leucine-rich repeat-containing protein 41 (525-533)
gccgccaugaagggcaacagcacccug

SEQ ID NO: 48147 - RNA, 30 nt, Artificial Sequence
  Alkyldihydroxyacetonephosphate synthase, peroxisomal (76-85)
gccgcccaggagagcggcaccauccccaag

SEQ ID NO: 48148 - RNA, 27 nt, Artificial Sequence
  HEAT repeat-containing protein 5B (541-549)
gccgcccagaacagccgccugucccuc

SEQ ID NO: 48149 - RNA, 27 nt, Artificial Sequence
  cAMP-dependent protein kinase type I-alpha regulatory subunit (7-15)
gccgccagcgaggaggcgcgcucccug

SEQ ID NO: 48150 - RNA, 27 nt, Artificial Sequence
  WD repeat-containing protein 54 (75-83)
gccgccagcggccacuucaucugcgug

SEQ ID NO: 48151 - RNA, 27 nt, Artificial Sequence
  Sterol regulatory element-binding protein 2 (104-112)
gccgccagcccccaggcgccgacccug

SEQ ID NO: 48152 - RNA, 27 nt, Artificial Sequence
  Vesicle transport through interaction with t-SNAREs homolog 1B (5-13)
gccgccagcuccgagcacuucgagaag

SEQ ID NO: 48153 - RNA, 27 nt, Artificial Sequence
  Actin, cytoplasmic 2 (21-29)
gccgccagcuccagcucccuggagaag

SEQ ID NO: 48154 - RNA, 27 nt, Artificial Sequence
  Talin-1 (770-778)
gccgccaccgcggugacccaggcccug

SEQ ID NO: 48155 - RNA, 27 nt, Artificial Sequence
  Serine/threonine-protein phosphatase 4 regulatory subunit 3B (382-390)
gccgccaccgacaucuucagcuaccug

SEQ ID NO: 48156 - RNA, 27 nt, Artificial Sequence
  Long-chain fatty acid transport protein 1 (241-249)
gccgccguggcggacccccacagccug

SEQ ID NO: 48157 - RNA, 27 nt, Artificial Sequence
  Bifunctional apoptosis regulator (156-164)
gccgccgugaaccccggccgcagccug

SEQ ID NO: 48158 - RNA, 33 nt, Artificial Sequence
  Ligand-dependent nuclear receptor-interacting factor 1 (176-186)
gccgccuacgagcagagccacuucuucaacaag

SEQ ID NO: 48159 - RNA, 27 nt, Artificial Sequence
  Drebrin (97-105)
gccugcgccagccacguggcgaagguc

SEQ ID NO: 48160 - RNA, 27 nt, Artificial Sequence
  WASH complex subunit strumpellin (384-392)
gccugcgaccccaacaacaagcgccug

SEQ ID NO: 48161 - RNA, 27 nt, Artificial Sequence
  Zinc finger protein 106 (941-949)
gccugccuggacaaguucgugcgcguc

SEQ ID NO: 48162 - RNA, 33 nt, Artificial Sequence
  Fructose-bisphosphate aldolase A (33-43)
gccgacgagagcaccggcuccaucgccaagcgc

SEQ ID NO: 48163 - RNA, 33 nt, Artificial Sequence
  Selenoprotein N (53-63)
gccgaggcccaggcggccgcccgccaggagcug

SEQ ID NO: 48164 - RNA, 33 nt, Artificial Sequence
  Myosin-11 (2-12)
gccgaggcccgcgagaaggagaccaaggcgcug

SEQ ID NO: 48165 - RNA, 27 nt, Artificial Sequence
  Tetratricopeptide repeat protein 37 (1248-1256)
gccgaggacgagaagaacaccgcccug

SEQ ID NO: 48166 - RNA, 27 nt, Artificial Sequence
  Heat shock factor protein 1 (137-145)
gccgaggaccccaccaucagccugcuc

SEQ ID NO: 48167 - RNA, 30 nt, Artificial Sequence
  Melanoma antigen recognized by T-cells 1 (24-33)
gccgaggaggccgcgggcaucgggauccug

SEQ ID NO: 48168 - RNA, 27 nt, Artificial Sequence
  Protein SFI1 homolog (356-364)
gccgaggagccccacgcccuggagcuc

SEQ ID NO: 48169 - RNA, 33 nt, Artificial Sequence
  Metalloproteinase inhibitor 2 (114-124)
gccgagggcgacgggaagaugcacaucacccug

SEQ ID NO: 48170 - RNA, 27 nt, Artificial Sequence
  T-complex protein 1 subunit zeta (326-334)
gccgagcacagcgaguccggccagcug

SEQ ID NO: 48171 - RNA, 33 nt, Artificial Sequence
  ALK tyrosine kinase receptor (403-413)
gccgagaucaagaccaccaacgaggugguccug

SEQ ID NO: 48172 - RNA, 33 nt, Artificial Sequence
  Junction plakoglobin (137-147)
gccgagcuggccacccgcgcgcuccccgagcug

SEQ ID NO: 48173 - RNA, 27 nt, Artificial Sequence
  E3 ubiquitin-protein ligase BRE1A (672-680)
gccgagcuggaggaccuccgccagcgg

SEQ ID NO: 48174 - RNA, 30 nt, Artificial Sequence
  Disheveled-associated activator of morphogenesis 2 (875-884)
gccgagcuggagaaggaggugggcaaccuc

SEQ ID NO: 48175 - RNA, 30 nt, Artificial Sequence
  MAD2L1-binding protein (129-138)
gccgagcuggagagcgugcucucccaccug

SEQ ID NO: 48176 - RNA, 30 nt, Artificial Sequence
  Inactive ubiquitin carboxyl-terminal hydrolase 54 (1171-1180)
gccgagcccgacaucuaccaggagaagcug

SEQ ID NO: 48177 - RNA, 33 nt, Artificial Sequence
  Stathmin-3 (108-118)
gccgagcgccgggagcacgagcgcgaggugcug

SEQ ID NO: 48178 - RNA, 24 nt, Artificial Sequence
  Cytoplasmic dynein 1 light intermediate chain 2 (86-93)
gccgagagccugcccgagacccuc

SEQ ID NO: 48179 - RNA, 30 nt, Artificial Sequence
  Neurosecretory protein VGF (183-192)
gccgagaccgagacccgcacgcacacccug

SEQ ID NO: 48180 - RNA, 27 nt, Artificial Sequence
  Gamma-interferon-inducible protein 16 (79-87)
gccgagacccugaagaaggagaagcuc

SEQ ID NO: 48181 - RNA, 30 nt, Artificial Sequence
  Formin-binding protein 1-like (452-461)
gccgagaccaugaacaacaucgaccgccug

SEQ ID NO: 48182 - RNA, 30 nt, Artificial Sequence
  Tumor susceptibility gene 101 protein (282-291)
gccgagguggacaagaacaucgagcugcuc

SEQ ID NO: 48183 - RNA, 27 nt, Artificial Sequence
  Consortin (611-619)
gccgaggugguccccaccgagggccug

SEQ ID NO: 48184 - RNA, 27 nt, Artificial Sequence
  Nuclear mitotic apparatus protein 1 (857-865)
gccggcaucgagagccacuccgagcug

SEQ ID NO: 48185 - RNA, 27 nt, Artificial Sequence
  Nuclear receptor corepressor 2 (1168-1176)
gccggccccccggagagccugggggug

SEQ ID NO: 48186 - RNA, 33 nt, Artificial Sequence
  Hermansky-Pudlak syndrome 5 protein (284-294)
gccggcagcucccagagccuguccuuccccaag

SEQ ID NO: 48187 - RNA, 27 nt, Artificial Sequence
  Actin-related protein 2/3 complex subunit 1B (24-32)
gccaucugccccaacaaccacgaggug

SEQ ID NO: 48188 - RNA, 42 nt, Artificial Sequence
  Syndecan-3 (292-305)
gccaucgacagcggcuccagcgccgcgcagcugccccagaag

SEQ ID NO: 48189 - RNA, 27 nt, Artificial Sequence
  Ewing's tumor-associated antigen 1 (284-292)
gccaucuucgacggcagcacccagaag

SEQ ID NO: 48190 - RNA, 33 nt, Artificial Sequence
  Tectonic-3 (478-488)
gccaucuucggcaacgccgaccccgcgcagaag

SEQ ID NO: 48191 - RNA, 27 nt, Artificial Sequence
  Kinesin-like protein KIF20B (640-648)
gccaucuucaaggaccuggugggcaag

SEQ ID NO: 48192 - RNA, 27 nt, Artificial Sequence
  Rho-related GTP-binding protein RhoQ (186-194)
gccaucaucgccauccugacccccaag

SEQ ID NO: 48193 - RNA, 27 nt, Artificial Sequence
  Protein wntless homolog (4-12)
gccaucaucgagaacaugagcaccaag

SEQ ID NO: 48194 - RNA, 27 nt, Artificial Sequence
  Eukaryotic translation initiation factor 3 subunit C-like protein (482-490)
gccaucaucgagcgcgugcagcgguac

SEQ ID NO: 48195 - RNA, 33 nt, Artificial Sequence
  40S ribosomal protein S17 (39-49)
gccaucauccccagcaagaagcugcgcaacaag

SEQ ID NO: 48196 - RNA, 30 nt, Artificial Sequence
  Ribulose-phosphate 3-epimerase (118-127)
gccaucaagcccggcaccagcguggaguac

SEQ ID NO: 48197 - RNA, 33 nt, Artificial Sequence
  Serine/threonine-protein kinase Sgk1 (47-57)
gccaucaagcccccgcugaaggccuucaugaag

SEQ ID NO: 48198 - RNA, 27 nt, Artificial Sequence
  NF-kappa-B inhibitor beta (102-110)
gccauccugggcgagaccagcaccgug

SEQ ID NO: 48199 - RNA, 30 nt, Artificial Sequence
  GTP-binding protein Rheb (10-19)
gccauccugggcuaccgcagcguggggaag

SEQ ID NO: 48200 - RNA, 33 nt, Artificial Sequence
  Fibroblast growth factor 14 isoform 6 (201-211)
gccaucaugaacggcgggaagcccgugaacaag

SEQ ID NO: 48201 - RNA, 27 nt, Artificial Sequence
  Puratrophin-1 (1020-1028)
gccaucaacgaccgcaccgugaacuac

SEQ ID NO: 48202 - RNA, 27 nt, Artificial Sequence
  Mitotic spindle assembly checkpoint protein MAD2A (123-131)
gccauccaggacgagauccgcagcgug

SEQ ID NO: 48203 - RNA, 27 nt, Artificial Sequence
  Radixin (19-27)
gccauccagcccaacaccaccggcaag

SEQ ID NO: 48204 - RNA, 33 nt, Artificial Sequence
  ATP-dependent 6-phosphofructokinase, platelet type (229-239)
gccaucuacgacggcuucgacggguucgccaag

SEQ ID NO: 48205 - RNA, 39 nt, Artificial Sequence
  Cytochrome b-c1 complex subunit 9 (42-54)
gccaucuacgaccacaucaacgagggcaagcuguggaag

SEQ ID NO: 48206 - RNA, 36 nt, Artificial Sequence
  Transcription initiation factor IIB (257-268)
gccaucuacauggccagccaggcguccgccgagaag

SEQ ID NO: 48207 - RNA, 27 nt, Artificial Sequence
  Serine dehydratase-like (282-290)
gccaucuacagcggccugcuccgccgg

SEQ ID NO: 48208 - RNA, 39 nt, Artificial Sequence
  Keratin, type II cytoskeletal 1 (303-315)
gccaagcuggacaaccuccagcaggagaucgacuuccug

SEQ ID NO: 48209 - RNA, 24 nt, Artificial Sequence
  Kv channel-interacting protein 2 (72-79)
gcccuggccgcgcccgccagccuc

SEQ ID NO: 48210 - RNA, 27 nt, Artificial Sequence
  GPI ethanolamine phosphate transferase 3 (917-925)
gcccuggccgcgagcauccuccgccgg

SEQ ID NO: 48211 - RNA, 33 nt, Artificial Sequence
  Core histone macro-H2A.1 (296-306)
gcccuggccgacgacaagaagcucaagagcauc

SEQ ID NO: 48212 - RNA, 33 nt, Artificial Sequence
  Phosphatidylinositol 3-kinase regulatory subunit beta (169-179)
gcccuggccgacggcaucaagagcuuccuccug

SEQ ID NO: 48213 - RNA, 33 nt, Artificial Sequence
  Basement membrane-specific heparan sulfate proteoglycan core protein (1484-1494)
gcccuggccgaccucgacgagcugcugauccgc

SEQ ID NO: 48214 - RNA, 33 nt, Artificial Sequence
  Protein SHQ1 homolog (400-410)
gcccuggccgaggcgcucaaggaggugagccug

SEQ ID NO: 48215 - RNA, 33 nt, Artificial Sequence
  Tropomodulin-1 (243-253)
gcccuggccgagaugcucaaggagaacaaggug

SEQ ID NO: 48216 - RNA, 30 nt, Artificial Sequence
  Beta-1,4-glucuronyltransferase 1 (66-75)
gcccuggccagcggcggggugcucgacgcg

SEQ ID NO: 48217 - RNA, 27 nt, Artificial Sequence
  Zinc finger FYVE domain-containing protein 16 (1461-1469)
gcccugugcccccaccucaagacccug

SEQ ID NO: 48218 - RNA, 27 nt, Artificial Sequence
  V-type proton ATPase subunit F (77-85)
gcccuggacgcccaccagcagagcauc

SEQ ID NO: 48219 - RNA, 27 nt, Artificial Sequence
  17-beta-hydroxysteroid dehydrogenase 14 (169-177)
gcccuggacgagagccccuacggcgug

SEQ ID NO: 48220 - RNA, 33 nt, Artificial Sequence
  17-beta-hydroxysteroid dehydrogenase 14 (169-179)
gcccuggacgagagccccuacggcgugcgcguc

SEQ ID NO: 48221 - RNA, 27 nt, Artificial Sequence
  Arf-GAP with SH3 domain, ANK repeat and PH domain-containing protein 1 (493-501)
gcccuggacaucgccaagcgccucaag

SEQ ID NO: 48222 - RNA, 27 nt, Artificial Sequence
  TATA box-binding protein-like protein 1 (8-16)
gcccuggacauccucaucaccaacgug

SEQ ID NO: 48223 - RNA, 27 nt, Artificial Sequence
  Glutaminyl-peptide cyclotransferase (173-181)
gcccuggacaagaagcuccugagccug

SEQ ID NO: 48224 - RNA, 33 nt, Artificial Sequence
  Pre-mRNA-processing factor 17 (138-148)
gcccuggaccccagccucgacaaccaccaggug

SEQ ID NO: 48225 - RNA, 33 nt, Artificial Sequence
  60S ribosomal protein L7a (86-96)
gcccuggaccgccagaccgccacccagcuccug

SEQ ID NO: 48226 - RNA, 33 nt, Artificial Sequence
  Chromodomain-helicase-DNA-binding protein 1-like (822-832)
gcccuggaggagggccucaagaagaucuuccug

SEQ ID NO: 48227 - RNA, 30 nt, Artificial Sequence
  Keratin, type I cytoskeletal 10 (217-226)
gcccuggaggagcagcuccagcagauccgc

SEQ ID NO: 48228 - RNA, 27 nt, Artificial Sequence
  Ribonuclease pancreatic (2-10)
gcccuggagaagagccucgugcgccug

SEQ ID NO: 48229 - RNA, 33 nt, Artificial Sequence
  Ribonuclease pancreatic (2-12)
gcccuggagaagagccucgugcgccugcugcuc

SEQ ID NO: 48230 - RNA, 39 nt, Artificial Sequence
  NADPH oxidase 5 (49-61)
gcccuguucgacagcgaccgcuccggcaccaucacccuc

SEQ ID NO: 48231 - RNA, 33 nt, Artificial Sequence
  Ankyrin repeat and SAM domain-containing protein 1A (255-265)
gcccuguucggcaagaccgacgugguccagauc

SEQ ID NO: 48232 - RNA, 36 nt, Artificial Sequence
  Alpha-1,6-mannosylglycoprotein 6-beta-N-acetylglucosaminyltransferase A (2-13)
gcccuguucacccccuggaagcucagcucccagaag

SEQ ID NO: 48233 - RNA, 33 nt, Artificial Sequence
  Cell division cycle protein 16 homolog (22-32)
gcccuguucugggccgacaagguggcgagccuc

SEQ ID NO: 48234 - RNA, 27 nt, Artificial Sequence
  Cleft lip and palate transmembrane protein 1 (123-131)
gcccuguucugggagcagcacgaccuc

SEQ ID NO: 48235 - RNA, 36 nt, Artificial Sequence
  Ras-related protein Rab-27A (14-25)
gcccugggcgacagcggggugggcaagaccuccguc

SEQ ID NO: 48236 - RNA, 27 nt, Artificial Sequence
  Membrane-associated transporter protein (129-137)
gcccugaucgccaacccccgccggaag

SEQ ID NO: 48237 - RNA, 36 nt, Artificial Sequence
  E3 ubiquitin-protein ligase CBL-B (341-352)
gcccugaucgacggcagccgcgagggguucuaccuc

SEQ ID NO: 48238 - RNA, 30 nt, Artificial Sequence
  Polypyrimidine tract-binding protein 1 (173-182)
gcccugaucgaccuccacaaccacgaccug

SEQ ID NO: 48239 - RNA, 27 nt, Artificial Sequence
  Protein S100-B (10-18)
gcccugaucgacguguuccaccaguac

SEQ ID NO: 48240 - RNA, 33 nt, Artificial Sequence
  Melanoma-associated antigen C2 (196-206)
gcccugaucgaggugggccccgaccacuucugc

SEQ ID NO: 48241 - RNA, 30 nt, Artificial Sequence
  Coatomer subunit zeta-1 (3-12)
gcccugauccucgagcccagccuguacacc

SEQ ID NO: 48242 - RNA, 27 nt, Artificial Sequence
  S-adenosylmethionine synthase isoform type-2 (221-229)
gcccugaaggagaaggugaucaaggcc

SEQ ID NO: 48243 - RNA, 30 nt, Artificial Sequence
  Zinc finger protein 318 (262-271)
gcccugaaggagccccagggcaaccucuac

SEQ ID NO: 48244 - RNA, 27 nt, Artificial Sequence
  Spliceosome-associated protein CWC15 homolog (128-136)
gcccugcucgccgagcuggagaagauc

SEQ ID NO: 48245 - RNA, 21 nt, Artificial Sequence
  Protein DGCR6L (54-60)
gcccugcucgacggcaccgug

SEQ ID NO: 48246 - RNA, 36 nt, Artificial Sequence
  Eukaryotic translation initiation factor 3 subunit C-like protein (633-644)
gcccugcucgacauccagagcuccggccgcgccaag

SEQ ID NO: 48247 - RNA, 36 nt, Artificial Sequence
  Neural Wiskott-Aldrich syndrome protein (408-419)
gcccugcucgaccagauccgcgagggcgcccagcug

SEQ ID NO: 48248 - RNA, 36 nt, Artificial Sequence
  Wiskott-Aldrich syndrome protein (433-444)
gcccugcucgaccagauccgccagggcauccagcug

SEQ ID NO: 48249 - RNA, 33 nt, Artificial Sequence
  Serine/threonine-protein kinase PRP4 homolog (104-114)
gcccugcucgaggaccuggagaagcagcgcgcc

SEQ ID NO: 48250 - RNA, 30 nt, Artificial Sequence
  Melanoma antigen preferentially expressed in tumors (371-380)
gcccugcucgagcgcgccagcgcgacccug

SEQ ID NO: 48251 - RNA, 30 nt, Artificial Sequence
  Cleft lip and palate transmembrane protein 1 (348-357)
gcccugcucgagaccaaccccuaccugcug

SEQ ID NO: 48252 - RNA, 45 nt, Artificial Sequence
  Proteasome subunit alpha type-7 (194-208)
gcccugcucgaggugguccagagcggcgggaagaacaucgagcug

SEQ ID NO: 48253 - RNA, 30 nt, Artificial Sequence
  Ankyrin repeat domain-containing protein 17 (368-377)
gcccugcucaucgagcgcggcgccagccug

SEQ ID NO: 48254 - RNA, 27 nt, Artificial Sequence
  Down syndrome critical region protein 3 (171-179)
gcccugcuccccaaguuccugcugcgc

SEQ ID NO: 48255 - RNA, 27 nt, Artificial Sequence
  Melanoma antigen preferentially expressed in tumors (397-405)
gcccugcuccccagccugucccacugc

SEQ ID NO: 48256 - RNA, 27 nt, Artificial Sequence
  Neuronal membraneoprotein M6-b (96-104)
gcccugcucagcgaggugauccagcug

SEQ ID NO: 48257 - RNA, 27 nt, Artificial Sequence
  Ragulator complex protein LAMTOR1 (52-60)
gcccugcucagcuccauccuggccaag

SEQ ID NO: 48258 - RNA, 27 nt, Artificial Sequence
  Sulfate transporter (523-531)
gcccugcucagcaccgagaucggccug

SEQ ID NO: 48259 - RNA, 30 nt, Artificial Sequence
  Activator of 90 kDa heat shock protein ATPase homolog 1 (58-67)
gcccugaugaaggaggagggcgugaagcuc

SEQ ID NO: 48260 - RNA, 27 nt, Artificial Sequence
  rRNA 2'-O-methyltransferase fibrillarin (244-252)
gcccugaacgcccacaccuuccuccgc

SEQ ID NO: 48261 - RNA, 33 nt, Artificial Sequence
  Catenin alpha-1 (363-373)
gcccugaacagcgccaucgacaagaugaccaag

SEQ ID NO: 48262 - RNA, 27 nt, Artificial Sequence
  Cytoglobin (88-96)
gcccugaacaccguggucgagaaccuc

SEQ ID NO: 48263 - RNA, 27 nt, Artificial Sequence
  Growth/differentiation factor 15 (96-104)
gcccugcccgagggccucccggaggcc

SEQ ID NO: 48264 - RNA, 27 nt, Artificial Sequence
  Homer protein homolog 3 (191-199)
gcccugcaggacagcaacaacaagcuc

SEQ ID NO: 48265 - RNA, 33 nt, Artificial Sequence
  Metastasis suppressor protein 1 (165-175)
gcccugcaggacgugaacgacaaguaccuccug

SEQ ID NO: 48266 - RNA, 27 nt, Artificial Sequence
  1-acyl-sn-glycerol-3-phosphate acyltransferase gamma (283-291)
gcccugcaggagaucuacaaccagaag

SEQ ID NO: 48267 - RNA, 30 nt, Artificial Sequence
  Neuralized-like protein 4 (559-568)
gcccugcgcgacggcgagguguuccagguc

SEQ ID NO: 48268 - RNA, 27 nt, Artificial Sequence
  Neurosecretory protein VGF (3-11)
gcccugcgccucagcgccuccgcgcug

SEQ ID NO: 48269 - RNA, 27 nt, Artificial Sequence
  Dystonin (375-383)
gcccugcgccccgagguggagcggcuc

SEQ ID NO: 48270 - RNA, 36 nt, Artificial Sequence
  Vimentin (308-319)
gcccugcgccaggccaagcaggagagcaccgaguac

SEQ ID NO: 48271 - RNA, 27 nt, Artificial Sequence
  Coiled-coil domain-containing protein 154 (502-510)
gcccugcgccaggagcucgccacccug

SEQ ID NO: 48272 - RNA, 45 nt, Artificial Sequence
  60S ribosomal protein L36 (2-16)
gcccugcgcuaccccauggccgugggccucaacaaggggcacaag

SEQ ID NO: 48273 - RNA, 30 nt, Artificial Sequence
  Integrin alpha-V (893-902)
gcccugagcgagggcgacauccacacccuc

SEQ ID NO: 48274 - RNA, 27 nt, Artificial Sequence
  Kinesin-like protein KIF20B (1148-1156)
gcccugagcgagcucacccagggcgug

SEQ ID NO: 48275 - RNA, 27 nt, Artificial Sequence
  Ankycorbin (690-698)
gcccugagcgagaugaagucccaguac

SEQ ID NO: 48276 - RNA, 27 nt, Artificial Sequence
  Lysine-specific demethylase 5A (119-127)
gcccugagcaagaucguggccuccaag

SEQ ID NO: 48277 - RNA, 27 nt, Artificial Sequence
  Probable phospholipid-transporting ATPase IIA (685-693)
gcccugagccaguucgugauccaccgc

SEQ ID NO: 48278 - RNA, 27 nt, Artificial Sequence
  Chondroitin sulfate proteoglycan 4 (45-53)
gcccugaccgacaucgaccuccagcug

SEQ ID NO: 48279 - RNA, 27 nt, Artificial Sequence
  HRAS-like suppressor 3 (84-92)
gcccugaccgacaaggccaucgugaag

SEQ ID NO: 48280 - RNA, 27 nt, Artificial Sequence
  Neuroblastoma breakpoint family member 6 (396-404)
gcccugguggacaagaucaagaaggac

SEQ ID NO: 48281 - RNA, 30 nt, Artificial Sequence
  Glycosylphosphatidylinositol anchor attachment 1 protein (38-47)
gcccugguguuccccccgcucacccagcgc

SEQ ID NO: 48282 - RNA, 36 nt, Artificial Sequence
  Nuclear nucleic acid-binding protein C1D (121-132)
gcccugugggagcccaagagcaagaacgccuccaag

SEQ ID NO: 48283 - RNA, 27 nt, Artificial Sequence
  Separin (752-760)
gcccuguggaaggagcuccugaccaag

SEQ ID NO: 48284 - RNA, 27 nt, Artificial Sequence
  Fucose mutarotase (91-99)
gcccuguacggcaaccucauccugcgc

SEQ ID NO: 48285 - RNA, 27 nt, Artificial Sequence
  Proteasome subunit beta type-4 (6-14)
gcccuguaccgcggccccaucacccgg

SEQ ID NO: 48286 - RNA, 27 nt, Artificial Sequence
  Mitofusin-2 (433-441)
gccauggccgaggagauccgccggcug

SEQ ID NO: 48287 - RNA, 33 nt, Artificial Sequence
  Methionine synthase (1208-1218)
gccauggcccccgcgagcgccguguccggccug

SEQ ID NO: 48288 - RNA, 27 nt, Artificial Sequence
  Basement membrane-specific heparan sulfate proteoglycan core protein (3206-3214)
gccauggcccccggcgcgccgcaggug

SEQ ID NO: 48289 - RNA, 30 nt, Artificial Sequence
  Unconventional myosin-IXa (1913-1922)
gccauggacgacggcaagagcauccgcuac

SEQ ID NO: 48290 - RNA, 33 nt, Artificial Sequence
  Ubiquitin carboxyl-terminal hydrolase 4 (692-702)
gccauggacugggacagcgagacccgccggcug

SEQ ID NO: 48291 - RNA, 30 nt, Artificial Sequence
  Myosin regulatory light polypeptide 9 (24-33)
gccauguucgaccagagccagauccaggag

SEQ ID NO: 48292 - RNA, 36 nt, Artificial Sequence
  Eukaryotic translation initiation factor 3 subunit K (2-13)
gccauguucgagcagaugcgcgccaacgugggcaag

SEQ ID NO: 48293 - RNA, 36 nt, Artificial Sequence
  Exportin-4 (248-259)
gccauguucgagagcucccagaacgugcugcucaag

SEQ ID NO: 48294 - RNA, 27 nt, Artificial Sequence
  Ankyrin repeat domain-containing protein SOWAHC (349-357)
gccaugcacggccacguggaggucgug

SEQ ID NO: 48295 - RNA, 27 nt, Artificial Sequence
  Calpain-7 (409-417)
gccaugcacagcgacucccagaccuuc

SEQ ID NO: 48296 - RNA, 27 nt, Artificial Sequence
  Cytoplasmic FMR1-interacting protein 1 (490-498)
gccaugaucaagggccugcaggugcuc

SEQ ID NO: 48297 - RNA, 27 nt, Artificial Sequence
  DNA repair protein RAD50 (657-665)
gccaugcuggccggcgcgaccgccgug

SEQ ID NO: 48298 - RNA, 36 nt, Artificial Sequence
  Melanocyte protein PMEL (184-195)
gccaugcugggcacccacaccauggaggugacgguc

SEQ ID NO: 48299 - RNA, 24 nt, Artificial Sequence
  Protein AAR2 homolog (287-294)
gccaugaugaagcaccacacccug

SEQ ID NO: 48300 - RNA, 33 nt, Artificial Sequence
  Atherin (156-166)
gccaugaacaaggagggcgggaccgccagcgug

SEQ ID NO: 48301 - RNA, 30 nt, Artificial Sequence
  Guanine nucleotide-binding protein G(s) subunit alpha isoforms short (95-104)
gccaugagcaaccuggugcccccggucgag

SEQ ID NO: 48302 - RNA, 30 nt, Artificial Sequence
  Ubiquitin-conjugating enzyme E2 H (97-106)
gccauguaccugcaccgccccgaggaguac

SEQ ID NO: 48303 - RNA, 36 nt, Artificial Sequence
  Copine-1 (72-83)
gcccaggccgcgcaccagggcaccgccagccaguac

SEQ ID NO: 48304 - RNA, 33 nt, Artificial Sequence
  Copine-1 (403-413)
gcccaggccgcgcaccagggcaccgccagcuac

SEQ ID NO: 48305 - RNA, 30 nt, Artificial Sequence
  Fatty acid synthase (1283-1292)
gcccaggccgagcugcagcagcacgacgug

SEQ ID NO: 48306 - RNA, 27 nt, Artificial Sequence
  Catenin beta-1 (702-710)
gcccagggcgagccccugggguaccgc

SEQ ID NO: 48307 - RNA, 27 nt, Artificial Sequence
  Protein tyrosine phosphatase type IVA 1 (36-44)
gcccagcacgaccuguacgccgacaag

SEQ ID NO: 48308 - RNA, 24 nt, Artificial Sequence
  Glutathione S-transferase A4 (32-39)
gcccagaaggccaucauccgcuac

SEQ ID NO: 48309 - RNA, 27 nt, Artificial Sequence
  Patatin-like phospholipase domain-containing protein 7 (872-880)
gcccagaagcagcugauccuccugcac

SEQ ID NO: 48310 - RNA, 27 nt, Artificial Sequence
  Vigilin (548-556)
gcccagaagagcgacaucgugcagcug

SEQ ID NO: 48311 - RNA, 24 nt, Artificial Sequence
  CD276 antigen (61-68)
gcccagcugaaccucaucuggcag

SEQ ID NO: 48312 - RNA, 30 nt, Artificial Sequence
  Zinc finger protein 507 (116-125)
gcccagaacgagggcaaggccaugagcuac

SEQ ID NO: 48313 - RNA, 27 nt, Artificial Sequence
  Hemicentin-1 (4060-4068)
gcccagaaccccgccggcaccgcgcug

SEQ ID NO: 48314 - RNA, 27 nt, Artificial Sequence
  NAD(P) transhydrogenase, mitochondrial (158-166)
gcccagaaccccgagcugcucaacaag

SEQ ID NO: 48315 - RNA, 27 nt, Artificial Sequence
  Elongator complex protein 2 (42-50)
gcccagcagaacgaccaguuccagaag

SEQ ID NO: 48316 - RNA, 27 nt, Artificial Sequence
  Microphthalmia-associated transcription factor (118-126)
gcccagcgccagcaggugaagcaguac

SEQ ID NO: 48317 - RNA, 27 nt, Artificial Sequence
  Cytoplasmic polyadenylation element-binding protein 1 (45-53)
gcccagagcuccacccacagcgugcug

SEQ ID NO: 48318 - RNA, 27 nt, Artificial Sequence
  GMP synthase (glutamine-hydrolyzing) (130-138)
gcccaguacggcaaggugaucgaccgc

SEQ ID NO: 48319 - RNA, 27 nt, Artificial Sequence
  1,2-dihydroxy-3-keto-5-methylthiopentene dioxygenase (181-189)
gcccgcggccaguacgugaaguuccug

SEQ ID NO: 48320 - RNA, 27 nt, Artificial Sequence
  Ankyrin repeat and LEM domain-containing protein 2 (211-219)
gcccgcaacgagcggaucuacguguac

SEQ ID NO: 48321 - RNA, 27 nt, Artificial Sequence
  Dolichyl-diphosphooligosaccharide-proteinosyltransferase subunit 2 (256-264)
gccagcgccgcggccgugcugucccac

SEQ ID NO: 48322 - RNA, 30 nt, Artificial Sequence
  Probable RNA-binding protein 19 (488-497)
gccagcgcccugggcuccagcuccuacaag

SEQ ID NO: 48323 - RNA, 27 nt, Artificial Sequence
  E3 ubiquitin-protein ligase MSL2 (294-302)
gccagcgcccccgugaccgucaagcgc

SEQ ID NO: 48324 - RNA, 27 nt, Artificial Sequence
  Gelsolin (362-370)
gccagcgacuucaucaccaagauggac

SEQ ID NO: 48325 - RNA, 33 nt, Artificial Sequence
  Transient receptor potential cation channel subfamily M member 1 (215-225)
gccagcgacauccuguccuucgcccacaaguac

SEQ ID NO: 48326 - RNA, 30 nt, Artificial Sequence
  Suppressor of IKBKE 1 (58-67)
gccagcgacaugaaggacauguccaaguac

SEQ ID NO: 48327 - RNA, 30 nt, Artificial Sequence
  FERM domain-containing protein 4A (516-525)
gccagcgaccccaacguguccaagaagcug

SEQ ID NO: 48328 - RNA, 33 nt, Artificial Sequence
  FERM domain-containing protein 4A (483-493)
gccagcgaccccaacguguccaagaagcugaag

SEQ ID NO: 48329 - RNA, 30 nt, Artificial Sequence
  Centrosomal protein of 68 kDa (12-21)
gccagcgaggacaccaaggcccaguccuac

SEQ ID NO: 48330 - RNA, 30 nt, Artificial Sequence
  Nucleoside diphosphate kinase (158-167)
gccagcgaggagcaccugaagcagcacuac

SEQ ID NO: 48331 - RNA, 36 nt, Artificial Sequence
  Unconventional myosin-Ic (842-853)
gccagcgagaucuucaagggcaagaaggacaacuac

SEQ ID NO: 48332 - RNA, 33 nt, Artificial Sequence
  Amino-terminal enhancer of split (51-61)
gccagcgagaaguccgagaugcagcgccacuac

SEQ ID NO: 48333 - RNA, 27 nt, Artificial Sequence
  Retinal dehydrogenase 1 (82-90)
gccagcgagcgcggccggcugcucuac

SEQ ID NO: 48334 - RNA, 30 nt, Artificial Sequence
  Macrophage metalloelastase (13-22)
gccagcggcgcccugccccucaacuccagc

SEQ ID NO: 48335 - RNA, 33 nt, Artificial Sequence
  Nuclear factor interleukin-3-regulated protein (14-24)
gccagccuggacgccuccagcaacguggacaag

SEQ ID NO: 48336 - RNA, 33 nt, Artificial Sequence
  Melanocyte protein PMEL (619-629)
gccagccugaucuaccgccggcgccucaugaag

SEQ ID NO: 48337 - RNA, 33 nt, Artificial Sequence
  SH2B adapter protein 3 (209-219)
gccagcauggacuccggcgcccgcuggcagcgg

SEQ ID NO: 48338 - RNA, 30 nt, Artificial Sequence
  Protein argonaute-1 (168-177)
gccagcaugcgcuacacccccgugggccgg

SEQ ID NO: 48339 - RNA, 27 nt, Artificial Sequence
  5'-3' exoribonuclease 2 (454-462)
gccagcaacccccgccaggccgcguac

SEQ ID NO: 48340 - RNA, 45 nt, Artificial Sequence
  PERQ amino acid-rich with GYF domain-containing protein 2 (1277-1291)
gccagcuccgagcgccugaacaugggcgagaucgagacccucgac

SEQ ID NO: 48341 - RNA, 48 nt, Artificial Sequence
  PERQ amino acid-rich with GYF domain-containing protein 2 (1277-1292)
gccagcuccgagcgccugaacaugggcgagaucgagacccucgacgac

SEQ ID NO: 48342 - RNA, 51 nt, Artificial Sequence
  PERQ amino acid-rich with GYF domain-containing protein 2 (1277-1293)
gccagcuccgagcgccugaacaugggcgagaucgagacccucgacgacuac

SEQ ID NO: 48343 - RNA, 54 nt, Artificial Sequence
  Vimentin (54-71)
gccagcucccccggcgggguguacgccacccgcagcuccgcgguccggcugcgc

SEQ ID NO: 48344 - RNA, 42 nt, Artificial Sequence
  Chondroitin sulfate proteoglycan 4 (1607-1620)
gccagcuccagcgccggcaccgacccccagcugcuccuguac

SEQ ID NO: 48345 - RNA, 27 nt, Artificial Sequence
  Contactin-associated protein-like 3B (2-10)
gccagcguggccugggcgguccugaag

SEQ ID NO: 48346 - RNA, 27 nt, Artificial Sequence
  Sister chromatid cohesion protein PDS5 homolog B (520-528)
gccagcgugaaggccaucuucuccaag

SEQ ID NO: 48347 - RNA, 45 nt, Artificial Sequence
  RNA-binding protein 14 (526-540)
gccagcuacgccgcgcagcagcacccccaggccgccgccuccuac

SEQ ID NO: 48348 - RNA, 33 nt, Artificial Sequence
  N6-adenosine-methyltransferase subunit METTL14 (53-63)
gccagcuacgacaccuccgcccccaacgcgaag

SEQ ID NO: 48349 - RNA, 30 nt, Artificial Sequence
  Origin recognition complex subunit 5 (316-325)
gccagcuacaaccccgcccgcaccgacaag

SEQ ID NO: 48350 - RNA, 36 nt, Artificial Sequence
  SPRY domain-containing SOCS box protein 1 (216-227)
gccaccgccgacgcgccccugcacagcgugggcuac

SEQ ID NO: 48351 - RNA, 27 nt, Artificial Sequence
  Laminin subunit beta-2 (265-273)
gccaccgccgaccuggcgcucggccgc

SEQ ID NO: 48352 - RNA, 30 nt, Artificial Sequence
  Oxidative stress-induced growth inhibitor 1 (253-262)
gccaccgccggcgacaucgcgcacuacuac

SEQ ID NO: 48353 - RNA, 27 nt, Artificial Sequence
  Uncharacterized protein KIAA0355 (675-683)
gccaccgccauggugaccgagcagaag

SEQ ID NO: 48354 - RNA, 27 nt, Artificial Sequence
  E1A-binding protein p400 (1093-1101)
gccaccgcccaggugguccagcagaag

SEQ ID NO: 48355 - RNA, 33 nt, Artificial Sequence
  Huntingtin-interacting protein 1 (499-509)
gccaccgcccgcaucgaggagaugcugagcaag

SEQ ID NO: 48356 - RNA, 36 nt, Artificial Sequence
  Coatomer subunit beta' (703-714)
gccaccgccagcggcaacgcgaacauggugaacaag

SEQ ID NO: 48357 - RNA, 30 nt, Artificial Sequence
  Vacuolar protein sorting-associated protein 18 homolog (854-863)
gccaccugcgacuucccccugcucaaccgc

SEQ ID NO: 48358 - RNA, 24 nt, Artificial Sequence
  PH domain leucine-rich repeat-containing protein phosphatase 1 (536-543)
gccaccgacgccccccugcgcaag

SEQ ID NO: 48359 - RNA, 27 nt, Artificial Sequence
  Myomegalin (2167-2175)
gccaccgacggcagcuucgccaacaag

SEQ ID NO: 48360 - RNA, 33 nt, Artificial Sequence
  Slit homolog 3 protein (1187-1197)
gccaccgacaaggacaacggcauccugcucuac

SEQ ID NO: 48361 - RNA, 33 nt, Artificial Sequence
  Protocadherin Fat 2 (739-749)
gccaccgaccccgacgccggcuucaacgggaag

SEQ ID NO: 48362 - RNA, 33 nt, Artificial Sequence
  DNA-dependent protein kinase catalytic subunit (4080-4090)
gccaccgaccccaacauccugggccgcaccugg

SEQ ID NO: 48363 - RNA, 30 nt, Artificial Sequence
  Apolipoprotein D (122-131)
gccaccgacuacgagaacuacgcccuggug

SEQ ID NO: 48364 - RNA, 33 nt, Artificial Sequence
  Apolipoprotein D (122-132)
gccaccgacuacgagaacuacgcccugguguac

SEQ ID NO: 48365 - RNA, 27 nt, Artificial Sequence
  Semaphorin-5A (423-431)
gccaccgacuacggcaccaucaagaag

SEQ ID NO: 48366 - RNA, 21 nt, Artificial Sequence
  Fibronectin type III domain-containing protein 3B (348-354)
gccaccgacuaccacgugcgc

SEQ ID NO: 48367 - RNA, 33 nt, Artificial Sequence
  Zinc finger MYM-type protein 3 (76-86)
gccaccgagcugcucggccuggggggccugcuc

SEQ ID NO: 48368 - RNA, 27 nt, Artificial Sequence
  B-cell CLL/lymphoma 9 protein (163-171)
gccaccgagcccaccccggcccagaag

SEQ ID NO: 48369 - RNA, 33 nt, Artificial Sequence
  Ribosome-binding protein 1 (277-287)
gccaccgagcaggaggacgccgcgguggccaag

SEQ ID NO: 48370 - RNA, 39 nt, Artificial Sequence
  Centrosome-associated protein 350 (621-633)
gccaccgagcagaagaacaagcgccugcaggagcucuac

SEQ ID NO: 48371 - RNA, 33 nt, Artificial Sequence
  Uncharacterized aarF domain-containing protein kinase 2 (137-147)
gccaccgagaccagcggccccacguacaucaag

SEQ ID NO: 48372 - RNA, 36 nt, Artificial Sequence
  Protein Tob1 (180-191)
gccaccuucgccgcgaccaaguucggcagcacgaag

SEQ ID NO: 48373 - RNA, 30 nt, Artificial Sequence
  FAST kinase domain-containing protein 2 (426-435)
gccaccuucgacaucuggaaguuccgcaag

SEQ ID NO: 48374 - RNA, 33 nt, Artificial Sequence
  Nephrocystin-3 (43-53)
gccaccuucgagcacgaccgcgacaaggugaag

SEQ ID NO: 48375 - RNA, 30 nt, Artificial Sequence
  Calcium-binding protein 39 (186-195)
gccaccuucaaggaccugcucacccgccac

SEQ ID NO: 48376 - RNA, 27 nt, Artificial Sequence
  cAMP-specific 3',5'-cyclic phosphodiesterase 4B (107-115)
gccaccuuccccggccacagccagcgc

SEQ ID NO: 48377 - RNA, 27 nt, Artificial Sequence
  Kynurenine-oxoglutarate transaminase 3 (99-107)
gccaccuuccccggcaugugggagcgc

SEQ ID NO: 48378 - RNA, 27 nt, Artificial Sequence
  Pleckstrin homology domain-containing family H member 1 (733-741)
gccaccggccccccggcccugcuccgc

SEQ ID NO: 48379 - RNA, 33 nt, Artificial Sequence
  von Willebrand factor A domain-containing protein 5A (184-194)
gccaccaucgacagccagcacggcaucgagaag

SEQ ID NO: 48380 - RNA, 33 nt, Artificial Sequence
  General transcription factor IIH subunit 2 (32-42)
gccaccaucgaggacauccuguucaaggccaag

SEQ ID NO: 48381 - RNA, 27 nt, Artificial Sequence
  F-BAR domain only protein 2 (41-49)
gccaccaucgaggaggccuacagccgc

SEQ ID NO: 48382 - RNA, 39 nt, Artificial Sequence
  DNA-binding protein RFX7 (683-695)
gccaccaucgagggccagaagcaggggagcgugaagaag

SEQ ID NO: 48383 - RNA, 27 nt, Artificial Sequence
  Mitochondrial Rho GTPase 2 (88-96)
gccaccaucgagaagauccgcaccaag

SEQ ID NO: 48384 - RNA, 33 nt, Artificial Sequence
  Transformation/transcription domain-associated protein (1416-1426)
gccaccaucgagguggaccagauccacacccac

SEQ ID NO: 48385 - RNA, 36 nt, Artificial Sequence
  Vacuolar-sorting protein SNF8 (73-84)
gccaccaucggcguggacccccuggccagcgggaag

SEQ ID NO: 48386 - RNA, 27 nt, Artificial Sequence
  Inhibitor of Bruton tyrosine kinase (45-53)
gccaccaucaaggacguguucggccgc

SEQ ID NO: 48387 - RNA, 33 nt, Artificial Sequence
  Probable ATP-dependent RNA helicase DDX60-like (899-909)
gccaccaucaacaaccccaaccugcucaccaag

SEQ ID NO: 48388 - RNA, 30 nt, Artificial Sequence
  Ankyrin repeat domain-containing protein 17 (1306-1315)
gccaccaucaccgacaaggagaugcugaag

SEQ ID NO: 48389 - RNA, 27 nt, Artificial Sequence
  Signal recognition particle 54 kDa protein (152-160)
gccaccaaggcccgcauccccuucuac

SEQ ID NO: 48390 - RNA, 27 nt, Artificial Sequence
  Fanconi anemia group I protein (138-146)
gccaccaagaaggagaaccuggccuac

SEQ ID NO: 48391 - RNA, 30 nt, Artificial Sequence
  Gephyrin (610-619)
gccacccuggacaucgacggcgugcgcaag

SEQ ID NO: 48392 - RNA, 27 nt, Artificial Sequence
  Histone deacetylase 10 (469-477)
gccacccuggacguggccguccgccgg

SEQ ID NO: 48393 - RNA, 30 nt, Artificial Sequence
  MOB kinase activator 1A (76-85)
gccacccugggcagcgggaaccuccgccag

SEQ ID NO: 48394 - RNA, 27 nt, Artificial Sequence
  ADP-ribosylation factor-like protein 2 (118-126)
gccacccugcucaucuucgccaacaag

SEQ ID NO: 48395 - RNA, 33 nt, Artificial Sequence
  Telomerase protein component 1 (53-63)
gccacccugcccgaccucaagaccauggagaag

SEQ ID NO: 48396 - RNA, 27 nt, Artificial Sequence
  Septin-4 (109-117)
gccacccugcccaaccaggugcaccgc

SEQ ID NO: 48397 - RNA, 30 nt, Artificial Sequence
  Glycogen phosphorylase, muscle form (303-312)
gccacccugcaggacaucauccgccgguuc

SEQ ID NO: 48398 - RNA, 33 nt, Artificial Sequence
  PH domain leucine-rich repeat-containing protein phosphatase 1 (228-238)
gccacccugagcgaggagaccaacuccauccuc

SEQ ID NO: 48399 - RNA, 27 nt, Artificial Sequence
  Kazrin (140-148)
gccacccugaccaaggacgugcccaag

SEQ ID NO: 48400 - RNA, 33 nt, Artificial Sequence
  BUB3-interacting and GLEBS motif-containing protein ZNF207 (352-362)
gccacccugaccacgaccagcgccaccuccaag

SEQ ID NO: 48401 - RNA, 30 nt, Artificial Sequence
  Eukaryotic initiation factor 4A-III (5-14)
gccaccauggccaccagcggcuccgcgcgc

SEQ ID NO: 48402 - RNA, 39 nt, Artificial Sequence
  Eukaryotic translation initiation factor 3 subunit J (234-246)
gccaccaugaaggacgaccuggccgacuacggcggguac

SEQ ID NO: 48403 - RNA, 48 nt, Artificial Sequence
  Eukaryotic translation initiation factor 3 subunit J (234-249)
gccaccaugaaggacgaccuggccgacuacggcggguacgacggcggg

SEQ ID NO: 48404 - RNA, 30 nt, Artificial Sequence
  Growth hormone-inducible transmembrane protein (334-343)
gccaccaugcuggccaccggcgggaaccgc

SEQ ID NO: 48405 - RNA, 36 nt, Artificial Sequence
  Growth hormone-inducible transmembrane protein (334-345)
gccaccaugcuggccaccggcgggaaccgcaagaag

SEQ ID NO: 48406 - RNA, 33 nt, Artificial Sequence
  Signal recognition particle subunit SRP68 (260-270)
gccaccaugagcgagguggaguggcgcggccgg

SEQ ID NO: 48407 - RNA, 33 nt, Artificial Sequence
  Protein phosphatase 1G (149-159)
gccaccaugaccaucgaggagcugcucacgcgc

SEQ ID NO: 48408 - RNA, 27 nt, Artificial Sequence
  E3 ubiquitin-protein ligase HECTD1 (175-183)
gccaccaacaacaugaaccugagccgc

SEQ ID NO: 48409 - RNA, 30 nt, Artificial Sequence
  X-ray repair cross-complementing protein 6 (454-463)
gccacccccgagcaggugggcaagaugaag

SEQ ID NO: 48410 - RNA, 30 nt, Artificial Sequence
  Cytoplasmic dynein 1 heavy chain 1 (3980-3989)
gccacccccaucggccaggccauccaccgc

SEQ ID NO: 48411 - RNA, 27 nt, Artificial Sequence
  Estradiol 17-beta-dehydrogenase 11 (131-139)
gccacccaggacccccagaucgagaag

SEQ ID NO: 48412 - RNA, 45 nt, Artificial Sequence
  Calsyntenin-1 (947-961)
gccacccgccagcagcagcuggagugggacgacagcacccucucc

SEQ ID NO: 48413 - RNA, 48 nt, Artificial Sequence
  Calsyntenin-1 (947-962)
gccacccgccagcagcagcuggagugggacgacagcacccucuccuac

SEQ ID NO: 48414 - RNA, 27 nt, Artificial Sequence
  Intron-binding protein aquarius (1477-1485)
gccaccagcgcccccgaggagaccaag

SEQ ID NO: 48415 - RNA, 27 nt, Artificial Sequence
  Kelch repeat and BTB domain-containing protein 4 (535-543)
gccaccagcgccgugaccgucacgcgc

SEQ ID NO: 48416 - RNA, 33 nt, Artificial Sequence
  Basement membrane-specific heparan sulfate proteoglycan core protein (2027-2037)
gccaccagccccgccggcaccgcgcaggcccgc

SEQ ID NO: 48417 - RNA, 27 nt, Artificial Sequence
  Neural cell adhesion molecule L1 (1237-1245)
gccaccagccccaucaacccggccgug

SEQ ID NO: 48418 - RNA, 27 nt, Artificial Sequence
  G-protein coupled receptor 143 (61-69)
gccaccagccccccggccuccgugcgc

SEQ ID NO: 48419 - RNA, 30 nt, Artificial Sequence
  Melanoma-associated antigen D1 (132-141)
gccaccaccggcgagcuggccgcgaacaag

SEQ ID NO: 48420 - RNA, 33 nt, Artificial Sequence
  Sterol regulatory element-binding protein 1 (957-967)
gccaccacccccgccagcuccagcaucgacaag

SEQ ID NO: 48421 - RNA, 27 nt, Artificial Sequence
  Helicase SKI2W (127-135)
gccaccaccagccugucccuccgccgg

SEQ ID NO: 48422 - RNA, 27 nt, Artificial Sequence
  E3 ubiquitin-protein ligase RING1 (290-298)
gccaccguggaccaccugagcaaguac

SEQ ID NO: 48423 - RNA, 33 nt, Artificial Sequence
  ATP-dependent RNA helicase DHX29 (735-745)
gccaccguggacagcgagaaguucuccaccuac

SEQ ID NO: 48424 - RNA, 27 nt, Artificial Sequence
  Multidrug resistance-associated protein 4 (364-372)
gccaccgugcuguucggcaucgcccgc

SEQ ID NO: 48425 - RNA, 27 nt, Artificial Sequence
  FACT complex subunit SPT16 (415-423)
gccaccgugcugaccagcgucaagaag

SEQ ID NO: 48426 - RNA, 30 nt, Artificial Sequence
  Putative phospholipase B-like 2 (360-369)
gccaccugggccgacaucuucaagcgcuuc

SEQ ID NO: 48427 - RNA, 27 nt, Artificial Sequence
  Arf-GAP with GTPase, ANK repeat and PH domain-containing protein 3 (232-240)
gccaccuacggccugaacguggagcgc

SEQ ID NO: 48428 - RNA, 27 nt, Artificial Sequence
  Histone acetyltransferase p300 (1189-1197)
gccaccuacuacagcuaccagaaccgc

SEQ ID NO: 48429 - RNA, 27 nt, Artificial Sequence
  Girdin (155-163)
gccguggccgcgcacauccaggagguc

SEQ ID NO: 48430 - RNA, 39 nt, Artificial Sequence
  Sodium/potassium-transporting ATPase subunit alpha-1 (249-261)
gccguggccggcgacgcgagcgaguccgcccugcucaag

SEQ ID NO: 48431 - RNA, 36 nt, Artificial Sequence
  RanBP-type and C3HC4-type zinc finger-containing protein 1 (18-29)
gccguggccggcggggacgagcaggucgcgaugaag

SEQ ID NO: 48432 - RNA, 33 nt, Artificial Sequence
  Mitochondrial import inner membrane translocase subunit Tim13 (31-41)
gccguggccaacgcgcaggagcugcuccagcgc

SEQ ID NO: 48433 - RNA, 33 nt, Artificial Sequence
  cDNA FLJ78342 (66-76)
gccguggcccagauggacuucaucaagcuguac

SEQ ID NO: 48434 - RNA, 30 nt, Artificial Sequence
  Serine/threonine-protein kinase ATR (1642-1651)
gccguggccagcuuccgcuccaaggcguac

SEQ ID NO: 48435 - RNA, 27 nt, Artificial Sequence
  G-protein coupled receptor 143 (219-227)
gccguggccagccugcucaagggccgc

SEQ ID NO: 48436 - RNA, 27 nt, Artificial Sequence
  Cadherin EGF LAG seven-pass G-type receptor 2 (2176-2184)
gccguggccagcgucaucaucuaccgc

SEQ ID NO: 48437 - RNA, 27 nt, Artificial Sequence
  Signal peptidase complex catalytic subunit SEC11A (119-127)
gccguggacgaccgcggccuguacaag

SEQ ID NO: 48438 - RNA, 33 nt, Artificial Sequence
  MICOS complex subunit MIC60 (276-286)
gccguggacgaggccgcggacgcccugcucaag

SEQ ID NO: 48439 - RNA, 30 nt, Artificial Sequence
  Multivesicular body subunit 12A (118-127)
gccguguucgacguccgccugagcggcaag

SEQ ID NO: 48440 - RNA, 27 nt, Artificial Sequence
  Peroxisomal multifunctional enzyme type 2 (271-279)
gccguguucgaguggcacaucaccaag

SEQ ID NO: 48441 - RNA, 48 nt, Artificial Sequence
  Peroxisomal multifunctional enzyme type 2 (648-663)
gccguguucgaguggcacaucaccaagggcgggaacaucggcgccaag

SEQ ID NO: 48442 - RNA, 30 nt, Artificial Sequence
  Transmembraneoprotein NMB (550-559)
gccguguucuuccccggcaaccaggagaag

SEQ ID NO: 48443 - RNA, 27 nt, Artificial Sequence
  Transmembrane protein 50A (132-140)
gccguguucuuccagaacgccuucauc

SEQ ID NO: 48444 - RNA, 27 nt, Artificial Sequence
  tRNA-splicing endonuclease subunit Sen2 (4-12)
gccguguuccacgcccccaagcgcaag

SEQ ID NO: 48445 - RNA, 27 nt, Artificial Sequence
  Kinesin-like protein KIF13B (224-232)
gccguguucaagaucacccugacccac

SEQ ID NO: 48446 - RNA, 30 nt, Artificial Sequence
  Kinesin-like protein KIF1B (252-261)
gccguguucaccaucgucuucacccagaag

SEQ ID NO: 48447 - RNA, 33 nt, Artificial Sequence
  GMP synthase (glutamine-hydrolyzing) (400-410)
gccgugcacaucgacaacggcuucaugcgcaag

SEQ ID NO: 48448 - RNA, 27 nt, Artificial Sequence
  Lysosomal-trafficking regulator (2018-2026)
gccgugcaccccccgaccaacaccuac

SEQ ID NO: 48449 - RNA, 27 nt, Artificial Sequence
  Disintegrin and metalloproteinase domain-containing protein 10 (184-192)
gccgugaucgcccagaucagcucccac

SEQ ID NO: 48450 - RNA, 36 nt, Artificial Sequence
  UDP-N-acetylglucosamine-peptide N-acetylglucosaminyltransferase 110 kDa subunit (593-604)
gccgugaucgacuucaagagcaacggccacaucuac

SEQ ID NO: 48451 - RNA, 30 nt, Artificial Sequence
  Armadillo repeat-containing X-linked protein 5 (128-137)
gccgugaucgaggccaacauccgcagcuac

SEQ ID NO: 48452 - RNA, 30 nt, Artificial Sequence
  Cytoplasmic dynein 1 heavy chain 1 (3288-3297)
gccgugaucgaggcccagaacgcggucaag

SEQ ID NO: 48453 - RNA, 30 nt, Artificial Sequence
  Tyrosine-protein phosphatase non-receptor type 1 (109-118)
gccgugaucgagggcgccaaguucaucaug

SEQ ID NO: 48454 - RNA, 27 nt, Artificial Sequence
  Adenosine 3'-phospho 5'-phosphosulfate transporter 2 (240-248)
gccgugaucggcaacguccaggagaag

SEQ ID NO: 48455 - RNA, 30 nt, Artificial Sequence
  Protocadherin Fat 4 (1541-1550)
gccgugaucggcagcguccugaccaccauc

SEQ ID NO: 48456 - RNA, 30 nt, Artificial Sequence
  Kinesin-like protein KIF1B (391-400)
gccgugaucaacgaggaccccaacgccaag

SEQ ID NO: 48457 - RNA, 39 nt, Artificial Sequence
  RING finger protein 37 (351-363)
gccgugauccccagcuccaucguccugccgagccagaag

SEQ ID NO: 48458 - RNA, 27 nt, Artificial Sequence
  DNA repair protein SWI5 homolog isoform 2 (175-183)
gccgugauccgcggcgucaccaccaag

SEQ ID NO: 48459 - RNA, 30 nt, Artificial Sequence
  Zinc finger protein 28 homolog (116-125)
gccgugaucaccgagcgccugaccagcuac

SEQ ID NO: 48460 - RNA, 30 nt, Artificial Sequence
  Eukaryotic translation initiation factor 3 subunit E (260-269)
gccgugaucaccaacaaggacguccgcaag

SEQ ID NO: 48461 - RNA, 30 nt, Artificial Sequence
  Proline-rich protein 13 (52-61)
gccgugaucgucgacaagaagaugcagaag

SEQ ID NO: 48462 - RNA, 27 nt, Artificial Sequence
  Heat shock 70 kDa protein 4 (349-357)
gccgugaaggagaagaucagcaaguuc

SEQ ID NO: 48463 - RNA, 27 nt, Artificial Sequence
  Very long-chain specific acyl-CoA dehydrogenase, mitochondrial (252-260)
gccgugaaggagaagaucaccgccuuc

SEQ ID NO: 48464 - RNA, 27 nt, Artificial Sequence
  Heat shock protein 105 kDa (349-357)
gccgugaaggagcgcaucgccaaguuc

SEQ ID NO: 48465 - RNA, 27 nt, Artificial Sequence
  Hermansky-Pudlak syndrome 5 protein (25-33)
gccgugaaggagagcgucuccagcuuc

SEQ ID NO: 48466 - RNA, 33 nt, Artificial Sequence
  Interleukin-1 receptor accessory protein (505-515)
gccgugaaggagaccaaggucaaggagcugaag

SEQ ID NO: 48467 - RNA, 30 nt, Artificial Sequence
  Actin-related protein 2/3 complex subunit 4 (75-84)
gccgugaagcaggccgacgagaucgagaag

SEQ ID NO: 48468 - RNA, 27 nt, Artificial Sequence
  Phosphatidylinositol 4,5-bisphosphate 3-kinase catalytic subunit beta isoform (406-414)
gccgugcuggacaaggucaagaccaag

SEQ ID NO: 48469 - RNA, 27 nt, Artificial Sequence
  Periodic tryptophan protein 1 homolog (46-54)
gccgugcuggaccucagcuggaacaag

SEQ ID NO: 48470 - RNA, 27 nt, Artificial Sequence
  Glutamate receptor ionotropic, NMDA 2A (236-244)
gccgugcugauccucagcgaggcccgc

SEQ ID NO: 48471 - RNA, 27 nt, Artificial Sequence
  ADP-ribosylation factor 5 (119-127)
gccgugcugcucgucuucgccaacaag

SEQ ID NO: 48472 - RNA, 33 nt, Artificial Sequence
  Casein kinase II subunit alpha' (340-350)
gccgugcugagcuccggccucaccgccgcgcgc

SEQ ID NO: 48473 - RNA, 36 nt, Artificial Sequence
  COP9 signalosome complex subunit 8 (4-15)
gccgugauggccgagagcgcguucuccuucaagaag

SEQ ID NO: 48474 - RNA, 30 nt, Artificial Sequence
  FACT complex subunit SPT16 (328-337)
gccgugauggacgucgugaagaagcagaag

SEQ ID NO: 48475 - RNA, 27 nt, Artificial Sequence
  Prefoldin subunit 5 (143-151)
gccgugauggagaugaugagccagaag

SEQ ID NO: 48476 - RNA, 33 nt, Artificial Sequence
  DNA-directed RNA polymerase I subunit RPA1 (330-340)
gccgugaugaaggacgucgugcugauccgcaag

SEQ ID NO: 48477 - RNA, 27 nt, Artificial Sequence
  Pleckstrin homology domain-containing family A member 1 (203-211)
gccgugaugaagaacuggaagcgccgg

SEQ ID NO: 48478 - RNA, 27 nt, Artificial Sequence
  Catenin beta-1 (172-180)
gccgugaugguccaccagcugagcaag

SEQ ID NO: 48479 - RNA, 30 nt, Artificial Sequence
  Galectin-3 (212-221)
gccgugaacgacgcccaccugcuccaguac

SEQ ID NO: 48480 - RNA, 27 nt, Artificial Sequence
  CDC42 small effector protein 1 (56-64)
gccgugcaggagcagaugcgcagcaag

SEQ ID NO: 48481 - RNA, 30 nt, Artificial Sequence
  Transforming growth factor-beta-induced protein ig-h3 (50-59)
gccgugcagaaggucaucggcaccaaccgc

SEQ ID NO: 48482 - RNA, 30 nt, Artificial Sequence
  26S proteasome non-ATPase regulatory subunit 6 (44-53)
gccgugcgcgacaacaacauggcccccuac

SEQ ID NO: 48483 - RNA, 27 nt, Artificial Sequence
  Amidophosphoribosyltransferase (196-204)
gccgugcgcgaccccuacggcaaccgg

SEQ ID NO: 48484 - RNA, 30 nt, Artificial Sequence
  WD repeat-containing protein 63 (83-92)
gccgugagcgacuuccaccccgucaagaag

SEQ ID NO: 48485 - RNA, 27 nt, Artificial Sequence
  GRAM domain-containing protein 4 (475-483)
gccgugagcacccccuccacccagaag

SEQ ID NO: 48486 - RNA, 27 nt, Artificial Sequence
  Hyaluronidase-2 (16-24)
gccgugagcugggccauggagcugaag

SEQ ID NO: 48487 - RNA, 36 nt, Artificial Sequence
  72 kDa type IV collagenase (603-614)
gccguggucgaccugcagggcgggggccacagcuac

SEQ ID NO: 48488 - RNA, 27 nt, Artificial Sequence
  Folliculin-interacting protein 1 (548-556)
gccguggucgaccagaucacccgccac

SEQ ID NO: 48489 - RNA, 30 nt, Artificial Sequence
  Calcineurin subunit B type 1 (155-164)
gccguggucggcgggcuggacauccacaag

SEQ ID NO: 48490 - RNA, 33 nt, Artificial Sequence
  Calcineurin subunit B type 1 (155-165)
gccguggucggcgggcuggacauccacaagaag

SEQ ID NO: 48491 - RNA, 27 nt, Artificial Sequence
  Dolichyl-diphosphooligosaccharide-proteinosyltransferase subunit STT3A (152-160)
gccgugguccccggcuacaucagccgc

SEQ ID NO: 48492 - RNA, 33 nt, Artificial Sequence
  Nodal modulator 3 (366-376)
gccguggucagcggcgaguccugccccgggaag

SEQ ID NO: 48493 - RNA, 30 nt, Artificial Sequence
  Protein phosphatase 1B (57-66)
gccguguacgacggccacgccgggagccgc

SEQ ID NO: 48494 - RNA, 33 nt, Artificial Sequence
  Biotinidase (61-71)
gccguguacgagcaccccagcauccugucccuc

SEQ ID NO: 48495 - RNA, 30 nt, Artificial Sequence
  Protein-lysine N-methyltransferase METTL10 (40-49)
gccguguacgagcgcgagcugcagaccuuc

SEQ ID NO: 48496 - RNA, 33 nt, Artificial Sequence
  Carbonic anhydrase 14 (307-317)
gccguguacuucaucgcccgcaagauccggaag

SEQ ID NO: 48497 - RNA, 27 nt, Artificial Sequence
  TBC1 domain family member 16 (146-154)
gccguguacaaccccgccgucggcuac

SEQ ID NO: 48498 - RNA, 27 nt, Artificial Sequence
  Tetraspanin-4 (42-50)
gccuacaccgacaagaucgaccgcuac

SEQ ID NO: 48499 - RNA, 33 nt, Artificial Sequence
  Protein HIRA (749-759)
ugcguggccugcgagaagcgcaugcugagcguc

SEQ ID NO: 48500 - RNA, 33 nt, Artificial Sequence
  Heterogeneous nuclear ribonucleoprotein A0 (150-160)
gacgccgccgacaaggcggccguggucaaguuc

SEQ ID NO: 48501 - RNA, 33 nt, Artificial Sequence
  Gelsolin (291-301)
gacgccgccaaccgcaagcuggcgaagcucuac

SEQ ID NO: 48502 - RNA, 33 nt, Artificial Sequence
  Thimet oligopeptidase (401-411)
gacgccgccagcggcgagguggucgggaaguuc

SEQ ID NO: 48503 - RNA, 27 nt, Artificial Sequence
  WD repeat-containing protein 61 (85-93)
gacgcccacauccgccugugggaccuc

SEQ ID NO: 48504 - RNA, 27 nt, Artificial Sequence
  Delta-1-pyrroline-5-carboxylate synthase (648-656)
gacgccaucgaccacauccacaaguac

SEQ ID NO: 48505 - RNA, 27 nt, Artificial Sequence
  Serine/arginine-rich splicing factor 9 (67-75)
gacgccaucuacggccgcaacggguac

SEQ ID NO: 48506 - RNA, 33 nt, Artificial Sequence
  DNA-directed RNA polymerases I, II, and III subunit RPABC5 (33-43)
gacgcccuggacgcccucggccugaagcgcuac

SEQ ID NO: 48507 - RNA, 33 nt, Artificial Sequence
  Cell division cycle protein 16 homolog (140-150)
gacgcccuggacaaccgcacccucgccaccuac

SEQ ID NO: 48508 - RNA, 27 nt, Artificial Sequence
  Mitogen-activated protein kinase kinase kinase 1 (693-701)
gacgccaacagccgcaccucccagcug

SEQ ID NO: 48509 - RNA, 27 nt, Artificial Sequence
  28S ribosomal protein S22, mitochondrial (296-304)
gacgccaccaaccuggugcagcucuac

SEQ ID NO: 48510 - RNA, 30 nt, Artificial Sequence
  Kinase D-interacting substrate of 220 kDa (264-273)
gacgccuaccgcgaguacaucgcccagaug

SEQ ID NO: 48511 - RNA, 33 nt, Artificial Sequence
  Actin, aortic smooth muscle (58-68)
gacgaggcccagagcaagcgcggcauccugacc

SEQ ID NO: 48512 - RNA, 27 nt, Artificial Sequence
  Remodeling and spacing factor 1 (1413-1421)
gacgagcugcuccgcgugaccgaccug

SEQ ID NO: 48513 - RNA, 27 nt, Artificial Sequence
  28S ribosomal protein S14, mitochondrial (49-57)
gacgagcgccugcggaucaacagccuc

SEQ ID NO: 48514 - RNA, 27 nt, Artificial Sequence
  Kinesin-like protein KIF15 (1289-1297)
gacgagguggagcgcacccagacccug

SEQ ID NO: 48515 - RNA, 27 nt, Artificial Sequence
  CAP-Gly domain-containing linker protein 1 (519-527)
gaccaccagcgcgagaucaccagccug

SEQ ID NO: 48516 - RNA, 27 nt, Artificial Sequence
  Peroxisome proliferator-activated receptor gamma coactivator-related protein 1 (1261-1269)
gaccacuaccagcgccagcgggugcug

SEQ ID NO: 48517 - RNA, 27 nt, Artificial Sequence
  Poly (ADP-ribose) polymerase 1 (993-1001)
gacaucgcccaggugaaccugaaguac

SEQ ID NO: 48518 - RNA, 30 nt, Artificial Sequence
  RILP-like protein 1 (29-38)
gacaucgccagccuggugggccacgaguuc

SEQ ID NO: 48519 - RNA, 30 nt, Artificial Sequence
  Probable ATP-dependent RNA helicase DDX58 (896-905)
gacaucgccaccggcgugcagacccuguac

SEQ ID NO: 48520 - RNA, 27 nt, Artificial Sequence
  RNA-binding protein 8A (72-80)
gacauccacgacaaguucgccgaguac

SEQ ID NO: 48521 - RNA, 30 nt, Artificial Sequence
  Filamin-A (897-906)
gacaucaucgaccaccacgacaacaccuac

SEQ ID NO: 48522 - RNA, 36 nt, Artificial Sequence
  SURP and G-patch domain-containing protein 2 (265-276)
gacaucaucgacaagagcgacguguucucccgcuuc

SEQ ID NO: 48523 - RNA, 27 nt, Artificial Sequence
  Lymphocyte cytosolic protein 2 (500-508)
gacaucaucgacuacuuccgcaagaug

SEQ ID NO: 48524 - RNA, 30 nt, Artificial Sequence
  Cytoplasmic dynein 2 heavy chain 1 (253-262)
gacaucaucggcgggagcuucggccgcuuc

SEQ ID NO: 48525 - RNA, 33 nt, Artificial Sequence
  Protein farnesyltransferase subunit beta (120-130)
gacaucaucaaccgcgagaagcugcuccaguac

SEQ ID NO: 48526 - RNA, 39 nt, Artificial Sequence
  Delta(24)-sterol reductase (252-264)
gacaucauccccuucggcaacaacccgaucuuccgcuac

SEQ ID NO: 48527 - RNA, 39 nt, Artificial Sequence
  Putative annexin A2-like protein (158-170)
gacaucaucagcgacaccuccggcgacuuccgcaagcug

SEQ ID NO: 48528 - RNA, 27 nt, Artificial Sequence
  Nucleophosmin (246-254)
gacaucaaggccaagaugcaggccagc

SEQ ID NO: 48529 - RNA, 27 nt, Artificial Sequence
  Actin, alpha skeletal muscle (7-15)
gacaucaaggagaagcugugcuacgug

SEQ ID NO: 48530 - RNA, 27 nt, Artificial Sequence
  Ubiquitin fusion degradation protein 1 homolog (289-297)
gacaucaagcgcggcauccccaacuac

SEQ ID NO: 48531 - RNA, 30 nt, Artificial Sequence
  POZ-, AT hook-, and zinc finger-containing protein 1 (116-125)
gacauccuggacuucgccuacaccagccgc

SEQ ID NO: 48532 - RNA, 27 nt, Artificial Sequence
  Pre-mRNA-processing-splicing factor 8 (298-306)
gacaucaacaagaucaucauccgccag

SEQ ID NO: 48533 - RNA, 27 nt, Artificial Sequence
  Trimethyllysine dioxygenase, mitochondrial (352-360)
gacauccccgagcgcauccugaccuac

SEQ ID NO: 48534 - RNA, 30 nt, Artificial Sequence
  5'-nucleotidase domain-containing protein 1 (161-170)
gacaucguggccgccauccagcacaacuac

SEQ ID NO: 48535 - RNA, 27 nt, Artificial Sequence
  Integrin-linked protein kinase (81-89)
gacaucgugcagaagcugcuccaguac

SEQ ID NO: 48536 - RNA, 30 nt, Artificial Sequence
  Calcium/calmodulin-dependent protein kinase type 1 (83-92)
gacaucuacgagagcggcgggcaccuguac

SEQ ID NO: 48537 - RNA, 30 nt, Artificial Sequence
  Pantothenate kinase 2, mitochondrial (45-54)
gacaucuacggcggggacuacgagcgcuuc

SEQ ID NO: 48538 - RNA, 30 nt, Artificial Sequence
  F-box only protein 11 (39-48)
gacaucuacaaccacauguacagcggcgug

SEQ ID NO: 48539 - RNA, 27 nt, Artificial Sequence
  Translin-associated protein X (51-59)
gacaaguacgagcgccuggugaagcuc

SEQ ID NO: 48540 - RNA, 27 nt, Artificial Sequence
  R3H and coiled-coil domain-containing protein 1 (315-323)
gaccuggcccacguggucgagaucuac

SEQ ID NO: 48541 - RNA, 27 nt, Artificial Sequence
  CUGBP Elav-like family member 5 (41-49)
gaccuggacgccaucaagcucuucgug

SEQ ID NO: 48542 - RNA, 36 nt, Artificial Sequence
  Lanosterol 14-alpha demethylase (473-484)
gaccugaucgacggcuacuuccccaccgugaacuac

SEQ ID NO: 48543 - RNA, 27 nt, Artificial Sequence
  Heterogeneous nuclear ribonucleoprotein A0 (113-121)
gaccugaucgagcacuucagccaguuc

SEQ ID NO: 48544 - RNA, 27 nt, Artificial Sequence
  DNA polymerase zeta catalytic subunit (2457-2465)
gaccugaucggcaagaccagcgagaug

SEQ ID NO: 48545 - RNA, 33 nt, Artificial Sequence
  Probable fibrosin-1 (455-465)
gaccugaucggccaggaccucaacagccgcuac

SEQ ID NO: 48546 - RNA, 36 nt, Artificial Sequence
  DNA repair endonuclease XPF (720-731)
gaccugaucggcagccucaacaacgggcgccuguac

SEQ ID NO: 48547 - RNA, 27 nt, Artificial Sequence
  Alpha-catulin (622-630)
gaccugauccaccagcucgagguguuc

SEQ ID NO: 48548 - RNA, 27 nt, Artificial Sequence
  Spermidine synthase (215-223)
gaccugaucaaggagaugcgccaguuc

SEQ ID NO: 48549 - RNA, 27 nt, Artificial Sequence
  Reticulon-4 (494-502)
gaccugaucaaggagaccaagcucagc

SEQ ID NO: 48550 - RNA, 33 nt, Artificial Sequence
  Rho guanine nucleotide exchange factor 1 (77-87)
gaccugaucagcgaggacgugcagcgccgguuc

SEQ ID NO: 48551 - RNA, 30 nt, Artificial Sequence
  Microtubule-associated serine/threonine-protein kinase 4 (1003-1012)
gaccugaucacccacaucaacggcgagccc

SEQ ID NO: 48552 - RNA, 27 nt, Artificial Sequence
  Calcium/calmodulin-dependent protein kinase kinase 2 (186-194)
gaccugaaggaccucaucacccgcaug

SEQ ID NO: 48553 - RNA, 27 nt, Artificial Sequence
  Heterogeneous nuclear ribonucleoprotein A/B (85-93)
gaccugaaggacuacuucaccaaguuc

SEQ ID NO: 48554 - RNA, 27 nt, Artificial Sequence
  Mediator of RNA polymerase II transcription subunit 8 (21-29)
gaccugaagaacagccucggcuccuuc

SEQ ID NO: 48555 - RNA, 27 nt, Artificial Sequence
  CASP8 and FADD-like apoptosis regulator (163-171)
gaccugaagaccaagauccagaaguac

SEQ ID NO: 48556 - RNA, 33 nt, Artificial Sequence
  Glycogen (starch) synthase, muscle (593-603)
gaccugcucgacuggaaguaccugggccgcuac

SEQ ID NO: 48557 - RNA, 30 nt, Artificial Sequence
  Fez family zinc finger protein 1 isoform 2 (119-128)
gaccugcucaacugcgcccugagccugaag

SEQ ID NO: 48558 - RNA, 27 nt, Artificial Sequence
  EPM2A-interacting protein 1 (205-213)
gaccugcucaccaucaucaaccugacc

SEQ ID NO: 48559 - RNA, 30 nt, Artificial Sequence
  Sorting nexin-17 (151-160)
gaccugcccgacgaccucaucggcuacuuc

SEQ ID NO: 48560 - RNA, 27 nt, Artificial Sequence
  UBAP1-MVB12-associated (UMA)-domain containing protein 1 isoform b (71-79)
gaccugcccgaccaccuccugagcuac

SEQ ID NO: 48561 - RNA, 30 nt, Artificial Sequence
  Rap guanine nucleotide exchange factor 2 (604-613)
gaccugcccgaccaggugcuccgcgucuuc

SEQ ID NO: 48562 - RNA, 33 nt, Artificial Sequence
  Class E basic helix-loop-helix protein 40 (21-31)
gaccugcccggcauguacccggcccacauguac

SEQ ID NO: 48563 - RNA, 27 nt, Artificial Sequence
  Coiled-coil domain-containing protein 22 (96-104)
gaccugcgcgaccuccugcuguuccuc

SEQ ID NO: 48564 - RNA, 33 nt, Artificial Sequence
  Transient receptor potential cation channel subfamily M member 1 (109-119)
gaccuggugggcaaggacgucacccgcguguac

SEQ ID NO: 48565 - RNA, 30 nt, Artificial Sequence
  Regulatory-associated protein of mTOR (292-301)
gaccuggugaaggacaacggccacaaguac

SEQ ID NO: 48566 - RNA, 30 nt, Artificial Sequence
  Holliday junction recognition protein (177-186)
gaccuguacgccggcaugcuccacagcaug

SEQ ID NO: 48567 - RNA, 27 nt, Artificial Sequence
  Zinc finger protein 1 homolog (74-82)
gaccuguacgagaagacccucaaguac

SEQ ID NO: 48568 - RNA, 27 nt, Artificial Sequence
  Cytoplasmic FMR1-interacting protein 1 (703-711)
gaccuguacaacgacagcgcccacuac

SEQ ID NO: 48569 - RNA, 30 nt, Artificial Sequence
  DNA (cytosine-5)-methyltransferase 1 (862-871)
gaccuguaccccgagcacuaccgcaaguac

SEQ ID NO: 48570 - RNA, 27 nt, Artificial Sequence
  Phosphoglycerate kinase 1 (52-60)
gacaacggcgccaagagcgugguccug

SEQ ID NO: 48571 - RNA, 27 nt, Artificial Sequence
  60S ribosomal protein L23 (30-38)
gacaacaccggcgccaagaaccuguac

SEQ ID NO: 48572 - RNA, 27 nt, Artificial Sequence
  Nuclear pore complex protein Nup88 (194-202)
gacaacgugauccgcaucuacagccug

SEQ ID NO: 48573 - RNA, 36 nt, Artificial Sequence
  KAT8 regulatory NSL complex subunit 2 (176-187)
gaccaggaggacccccugaagcacgccggcguguac

SEQ ID NO: 48574 - RNA, 36 nt, Artificial Sequence
  EH domain-containing protein 1 (222-233)
gaccagaucgagacccagcagcugaugcgcguguac

SEQ ID NO: 48575 - RNA, 39 nt, Artificial Sequence
  Eukaryotic translation initiation factor 3 subunit C-like protein (888-900)
gaccagaaggacggcuaccgcaagaacgagggguacaug

SEQ ID NO: 48576 - RNA, 27 nt, Artificial Sequence
  Isoleucine-tRNA ligase, cytoplasmic (424-432)
gaccagcugcuccgcaacaacgaccug

SEQ ID NO: 48577 - RNA, 27 nt, Artificial Sequence
  V-type proton ATPase subunit H (445-453)
gaccagcaggugcgcuacaacgcccug

SEQ ID NO: 48578 - RNA, 27 nt, Artificial Sequence
  Neuroblastoma-amplified sequence (1664-1672)
gaccaguacaagcgcgagaccauccug

SEQ ID NO: 48579 - RNA, 30 nt, Artificial Sequence
  GTPase KRas (69-78)
gaccaguacaugcgcaccggcgagggguuc

SEQ ID NO: 48580 - RNA, 27 nt, Artificial Sequence
  Vigilin (368-376)
gaccgcgcccugcggagcuucaagcuc

SEQ ID NO: 48581 - RNA, 27 nt, Artificial Sequence
  Tyrosine-protein kinase BAZ1B (189-197)
gaccgcgaggacaagcggagcgcccug

SEQ ID NO: 48582 - RNA, 27 nt, Artificial Sequence
  Clathrin heavy chain 1 (779-787)
gaccgcuucgacuucgugcacgaccug

SEQ ID NO: 48583 - RNA, 27 nt, Artificial Sequence
  KxDL motif-containing protein 1 (43-51)
gaccgcuucgagaagaccaacgagaug

SEQ ID NO: 48584 - RNA, 27 nt, Artificial Sequence
  PAB-dependent poly(A)-specific ribonuclease subunit PAN2 (264-272)
gaccgcuuccugaagguguacgaccuc

SEQ ID NO: 48585 - RNA, 27 nt, Artificial Sequence
  Monofunctional C1-tetrahydrofolate synthase, mitochondrial (503-511)
gaccgcuuccugcggaagaucaccauc

SEQ ID NO: 48586 - RNA, 27 nt, Artificial Sequence
  Cyclin-G1 (81-89)
gaccgcuuccugagcaagaugaaggug

SEQ ID NO: 48587 - RNA, 27 nt, Artificial Sequence
  Lanosterol synthase (287-295)
gaccgcuucaccaagagcaucuccauc

SEQ ID NO: 48588 - RNA, 27 nt, Artificial Sequence
  Vacuolar protein sorting-associated protein 51 homolog (86-94)
gaccgccacgagcggaucaccaagcug

SEQ ID NO: 48589 - RNA, 27 nt, Artificial Sequence
  Endoplasmin (716-724)
gaccgcaucgagcggaugcugcgccuc

SEQ ID NO: 48590 - RNA, 27 nt, Artificial Sequence
  Transcription elongation factor SPT5 (314-322)
gaccgcaucaaggcccggaugagccug

SEQ ID NO: 48591 - RNA, 27 nt, Artificial Sequence
  Regulator of nonsense transcripts 3B (254-262)
gaccgcauccccgagcgggacaagcug

SEQ ID NO: 48592 - RNA, 30 nt, Artificial Sequence
  Coatomer subunit epsilon (160-169)
gaccgccuggaccucgcccggaaggagcug

SEQ ID NO: 48593 - RNA, 27 nt, Artificial Sequence
  DNA-dependent protein kinase catalytic subunit (2537-2545)
gaccgccugcucgcccugaacagccug

SEQ ID NO: 48594 - RNA, 27 nt, Artificial Sequence
  DNA replication complex GINS protein PSF1 (82-90)
gaccgccugcuccggauccgcgcccug

SEQ ID NO: 48595 - RNA, 27 nt, Artificial Sequence
  Telomerase-binding protein EST1A (484-492)
gaccgcaaccugcgggugaaggcccuc

SEQ ID NO: 48596 - RNA, 27 nt, Artificial Sequence
  SUMO-activating enzyme subunit 1 (20-28)
gaccgccagauccggcuguggggccuc

SEQ ID NO: 48597 - RNA, 27 nt, Artificial Sequence
  Phenylalanine-tRNA ligase alpha subunit (353-361)
gaccgcguguuccggaacgagacccug

SEQ ID NO: 48598 - RNA, 27 nt, Artificial Sequence
  T-complex protein 1 subunit zeta (127-135)
gaccgcgugaagaagaucaucgagcug

SEQ ID NO: 48599 - RNA, 27 nt, Artificial Sequence
  39S ribosomal protein L20, mitochondrial (16-24)
gaccgcuacuuccggauccaggaggug

SEQ ID NO: 48600 - RNA, 27 nt, Artificial Sequence
  Spectrin alpha chain, non-erythrocytic 1 (24-32)
gaccgcuaccaccgguucaaggagcug

SEQ ID NO: 48601 - RNA, 27 nt, Artificial Sequence
  Small nuclear ribonucleoprotein Sm D2 (93-101)
gaccgcuacaucagcaagauguuccug

SEQ ID NO: 48602 - RNA, 27 nt, Artificial Sequence
  Nuclear factor of activated T-cells, cytoplasmic 3 (487-495)
gaccgcuaccugcggccccacgccuuc

SEQ ID NO: 48603 - RNA, 27 nt, Artificial Sequence
  60S ribosomal protein L27 (47-55)
gaccgcuacccccggaaggugaccgcc

SEQ ID NO: 48604 - RNA, 27 nt, Artificial Sequence
  Ubiquitin carboxyl-terminal hydrolase 45 (410-418)
gaccgcuacagcggcaacgugaccauc

SEQ ID NO: 48605 - RNA, 27 nt, Artificial Sequence
  Major prion protein (147-155)
gaccgcuacuaccgggagaacaugcac

SEQ ID NO: 48606 - RNA, 30 nt, Artificial Sequence
  Nucleolar protein 4-like (309-318)
gacagcgccgccaucacccacuccaccuac

SEQ ID NO: 48607 - RNA, 30 nt, Artificial Sequence
  Splicing factor U2AF 65 kDa subunit (293-302)
gacagcgccaccggccuguccaagggguac

SEQ ID NO: 48608 - RNA, 30 nt, Artificial Sequence
  Eukaryotic translation initiation factor 4 gamma 3 (1501-1510)
gacagcgacaccgagaaggagcugcaggcc

SEQ ID NO: 48609 - RNA, 30 nt, Artificial Sequence
  Gamma-glutamylaminecyclotransferase (138-147)
gacagcgagggcccccacgggcugcgcuac

SEQ ID NO: 48610 - RNA, 36 nt, Artificial Sequence
  Bromodomain and WD repeat-containing protein 1 (1792-1803)
gacagcgagcccggccgcuccgggggccggaaguac

SEQ ID NO: 48611 - RNA, 30 nt, Artificial Sequence
  RNA-binding protein 39 (262-271)
gacagcgagaccggccgcuccaagggguac

SEQ ID NO: 48612 - RNA, 27 nt, Artificial Sequence
  Bcl-2-like protein 12 (183-191)
gacagcuucgcccgccugguggagcuc

SEQ ID NO: 48613 - RNA, 27 nt, Artificial Sequence
  Melanophilin (443-451)
gacagcuucgaccgcaaguccguguac

SEQ ID NO: 48614 - RNA, 27 nt, Artificial Sequence
  TBC1 domain family member 4 (590-598)
gacagcuucgagcgcuccaacagccug

SEQ ID NO: 48615 - RNA, 30 nt, Artificial Sequence
  Signal transducer and activator of transcription 1-alpha/beta (24-33)
gacagcuuccccauggagauccgccaguac

SEQ ID NO: 48616 - RNA, 33 nt, Artificial Sequence
  Signal transducer and activator of transcription 1-alpha/beta (24-34)
gacagcuuccccauggagauccgccaguaccug

SEQ ID NO: 48617 - RNA, 30 nt, Artificial Sequence
  Signal transducer and activator of transcription 3 (24-33)
gacagcuuccccauggagcugcgccaguuc

SEQ ID NO: 48618 - RNA, 36 nt, Artificial Sequence
  Syndecan-3 (294-305)
gacagcggcuccagcgccgcccagcugccccagaag

SEQ ID NO: 48619 - RNA, 30 nt, Artificial Sequence
  Protein MON2 homolog (1214-1223)
gacagcaucggcgagaagcuggggcgcuac

SEQ ID NO: 48620 - RNA, 27 nt, Artificial Sequence
  Disco-interacting protein 2 homolog A (882-890)
gacagcauccaccaggugggcgucuac

SEQ ID NO: 48621 - RNA, 27 nt, Artificial Sequence
  ATP-dependent RNA helicase DDX54 (547-555)
gacagcaucaagaacuaccgcucccgg

SEQ ID NO: 48622 - RNA, 27 nt, Artificial Sequence
  Peptidyl-prolyl cis-trans isomerase FKBP9 (369-377)
gacagcaucuccaucaccagccacuac

SEQ ID NO: 48623 - RNA, 27 nt, Artificial Sequence
  Methyltransferase-like protein 13 (209-217)
gacagcaaggaccccacccugggcaug

SEQ ID NO: 48624 - RNA, 27 nt, Artificial Sequence
  Protein AHNAK2 (672-680)
gacagcaaguucaagaugcccaaguuc

SEQ ID NO: 48625 - RNA, 30 nt, Artificial Sequence
  Arf-GAP with SH3 domain, ANK repeat and PH domain-containing protein 2 (284-293)
gacagccagauccgccaguccaccgccuac

SEQ ID NO: 48626 - RNA, 27 nt, Artificial Sequence
  RNA-binding protein 3 (119-127)
gacagccgccccggcggguacggcuac

SEQ ID NO: 48627 - RNA, 27 nt, Artificial Sequence
  T-complex protein 1 subunit alpha (459-467)
gacagcaccgaccugguggccaagcuc

SEQ ID NO: 48628 - RNA, 27 nt, Artificial Sequence
  Signal-induced proliferation-associated 1-like protein 2 (438-446)
gacagcaccggcacccacucccuguac

SEQ ID NO: 48629 - RNA, 33 nt, Artificial Sequence
  Heterogeneous nuclear ribonucleoprotein A1-like 2 (4-14)
gacagcguggacaagaucgucauccagaaguac

SEQ ID NO: 48630 - RNA, 33 nt, Artificial Sequence
  Mitochondrial import inner membrane translocase subunit TIM50 (212-222)
gacagcguggacccccacggcuucaucuccuac

SEQ ID NO: 48631 - RNA, 27 nt, Artificial Sequence
  Basement membrane-specific heparan sulfate proteoglycan core protein (608-616)
gacagcuacggcgggucccugcgcuac

SEQ ID NO: 48632 - RNA, 27 nt, Artificial Sequence
  Transmembrane and TPR repeat-containing protein 1 (529-537)
gacaccgccgaggccaagauguacuac

SEQ ID NO: 48633 - RNA, 27 nt, Artificial Sequence
  Methylthioribose-1-phosphate isomerase (208-216)
gacaccgccaacaaggugggcaccuac

SEQ ID NO: 48634 - RNA, 30 nt, Artificial Sequence
  Apoptogenic protein 1, mitochondrial (36-45)
gacaccgcccccagcggcgugucccgcuuc

SEQ ID NO: 48635 - RNA, 39 nt, Artificial Sequence
  Solute carrier family 35 member B1 (75-87)
gacaccgcccgcguggaccggacccgcagcuggcuguac

SEQ ID NO: 48636 - RNA, 42 nt, Artificial Sequence
  Heterogeneous nuclear ribonucleoproteins A2/B1 (110-123)
gacaccgaggagcaccaccugcgcgacuacuucgaggaguac

SEQ ID NO: 48637 - RNA, 42 nt, Artificial Sequence
  Heat shock 70 kDa protein 1-like (48-61)
gacaccgagcgccugaucggcgacgccgccaagaaccaggug

SEQ ID NO: 48638 - RNA, 27 nt, Artificial Sequence
  N-acetylglucosamine-1-phosphotransferase subunits alpha/beta (929-937)
gacaccuucgccgacagccugcgcuac

SEQ ID NO: 48639 - RNA, 27 nt, Artificial Sequence
  AT-rich interactive domain-containing protein 5B (227-235)
gacaccuucgaccaccccacccugauc

SEQ ID NO: 48640 - RNA, 33 nt, Artificial Sequence
  Transcription factor SOX-6 (351-361)
gacaccuucgagcacggcgggggccacagcuac

SEQ ID NO: 48641 - RNA, 27 nt, Artificial Sequence
  Triple functional domain protein (2621-2629)
gacaccuucgagacccccacgagcuac

SEQ ID NO: 48642 - RNA, 33 nt, Artificial Sequence
  Dolichyl-diphosphooligosaccharide-proteinosyltransferase subunit 1 (402-412)
gacaccuucggccgccccgugaucgucgccuac

SEQ ID NO: 48643 - RNA, 33 nt, Artificial Sequence
  CTTNBP2 N-terminal-like protein (57-67)
gacaccuucaucgaggagcgcuacggcaaguac

SEQ ID NO: 48644 - RNA, 30 nt, Artificial Sequence
  UTP-glucose-1-phosphate uridylyltransferase (237-246)
gacaccuucaucggcgaggggaaggaguac

SEQ ID NO: 48645 - RNA, 39 nt, Artificial Sequence
  Interferon-related developmental regulator 1 (375-387)
gacaccuucaaggaggugcugggcagcgggaugcaguac

SEQ ID NO: 48646 - RNA, 30 nt, Artificial Sequence
  H2.0-like homeobox protein (254-263)
gacaccuuccccggcccguacgccgugcug

SEQ ID NO: 48647 - RNA, 27 nt, Artificial Sequence
  G-protein coupled receptor 126 (533-541)
gacaccuucagccacuccaccaaguuc

SEQ ID NO: 48648 - RNA, 27 nt, Artificial Sequence
  Rhophilin-2 (261-269)
gacaccuucacccacacgcccagcuac

SEQ ID NO: 48649 - RNA, 27 nt, Artificial Sequence
  40S ribosomal protein S14 (39-47)
gacaccuucgugcacgucaccgaccug

SEQ ID NO: 48650 - RNA, 30 nt, Artificial Sequence
  Lysosomal glucocerebrosidase precursor (428-437)
gacaccuucuacaagcagcccauguucuac

SEQ ID NO: 48651 - RNA, 27 nt, Artificial Sequence
  Zinc finger CCCH-type with G patch domain-containing protein (515-523)
gacacccacaagaagaugaccgaguuc

SEQ ID NO: 48652 - RNA, 27 nt, Artificial Sequence
  Utrophin (3189-3197)
gacacccacagccgcaucgagcaguac

SEQ ID NO: 48653 - RNA, 30 nt, Artificial Sequence
  C2 domain-containing protein 5 (611-620)
gacaccaucgccaagaacaaggagcuguac

SEQ ID NO: 48654 - RNA, 36 nt, Artificial Sequence
  Polyadenylate-binding protein 4 (303-314)
gacaccaucgacgacgagaagcugcgcaaggaguuc

SEQ ID NO: 48655 - RNA, 33 nt, Artificial Sequence
  Plastin-3 (116-126)
gacaccaucgacgagcgcgccaucaacaagaag

SEQ ID NO: 48656 - RNA, 27 nt, Artificial Sequence
  Kin of IRRE-like protein 1 (277-285)
gacaccaucgacacccgcgaggaguac

SEQ ID NO: 48657 - RNA, 42 nt, Artificial Sequence
  Small ubiquitin-related modifier 2 isoform b precursor (58-71)
gacaccaucgacguguuccagcagcagaccggcggggucuac

SEQ ID NO: 48658 - RNA, 36 nt, Artificial Sequence
  SUMO-activating enzyme subunit 2 (50-61)
gacaccaucgacgugagcaaccugaaccgccaguuc

SEQ ID NO: 48659 - RNA, 27 nt, Artificial Sequence
  Tryptophan-tRNA ligase, cytoplasmic (382-390)
gacaccaucgaggagcaccgccaguuc

SEQ ID NO: 48660 - RNA, 39 nt, Artificial Sequence
  Heterogeneous nuclear ribonucleoproteins A2/B1 (127-139)
gacaccaucgagaucaucaccgaccgccagagcggcaag

SEQ ID NO: 48661 - RNA, 27 nt, Artificial Sequence
  Unconventional myosin-Id (61-69)
gacaccaucgagcaguacaagggccgc

SEQ ID NO: 48662 - RNA, 36 nt, Artificial Sequence
  Ubiquitin-like protein 5 (22-33)
gacaccaucggcgaccugaagaagcucaucgccgcc

SEQ ID NO: 48663 - RNA, 30 nt, Artificial Sequence
  Trifunctional purine biosynthetic protein adenosine-3 (45-54)
gacaccaucggccaggaccugguggccaug

SEQ ID NO: 48664 - RNA, 27 nt, Artificial Sequence
  Cytoplasmic polyadenylation element-binding protein 4 (17-25)
gacaccaucaagggccgccugaacuac

SEQ ID NO: 48665 - RNA, 27 nt, Artificial Sequence
  Mitochondrial dynamics protein MID51 (222-230)
gacaccaucaugaacgugcccggcuuc

SEQ ID NO: 48666 - RNA, 33 nt, Artificial Sequence
  UPF0489 protein C5orf22 (148-158)
gacaccauccaggagaaggugcugaacaugcuc

SEQ ID NO: 48667 - RNA, 30 nt, Artificial Sequence
  Coiled-coil and C2 domain-containing protein 2A (426-435)
gacaccauccagaagaccaucaacgaguac

SEQ ID NO: 48668 - RNA, 27 nt, Artificial Sequence
  Interferon-induced helicase C domain-containing protein 1 (615-623)
gacaccauccgcaugaucgacgccuac

SEQ ID NO: 48669 - RNA, 27 nt, Artificial Sequence
  Zinc finger protein 143 (92-100)
gacaccaucagcgcccuggagcaguac

SEQ ID NO: 48670 - RNA, 30 nt, Artificial Sequence
  Gamma-interferon-inducible protein 16 (447-456)
gacaccaucagcaagaugaacgacuucaug

SEQ ID NO: 48671 - RNA, 36 nt, Artificial Sequence
  Gamma-interferon-inducible protein 16 (447-458)
gacaccaucagcaagaugaacgacuucaugcgcaug

SEQ ID NO: 48672 - RNA, 27 nt, Artificial Sequence
  Sphingolipid delta(4)-desaturase DES1 (268-276)
gacaccaucagccccuacucccgcaug

SEQ ID NO: 48673 - RNA, 33 nt, Artificial Sequence
  Pre-mRNA-splicing factor RBM22 (241-251)
gacaccaucaccgagacggaccugcgcaaccac

SEQ ID NO: 48674 - RNA, 36 nt, Artificial Sequence
  Pre-mRNA-splicing factor RBM22 (241-252)
gacaccaucaccgagacggaccugcgcaaccacuuc

SEQ ID NO: 48675 - RNA, 39 nt, Artificial Sequence
  Pre-mRNA-splicing factor RBM22 (241-253)
gacaccaucaccgagacggaccugcgcaaccacuucuac

SEQ ID NO: 48676 - RNA, 33 nt, Artificial Sequence
  Intermediate filament family orphan 1 (232-242)
gacaccaucacccccgagauccgcgcccuguac

SEQ ID NO: 48677 - RNA, 30 nt, Artificial Sequence
  Condensin complex subunit 1 (61-70)
gacaccaucuacagcauccugcaccacuuc

SEQ ID NO: 48678 - RNA, 27 nt, Artificial Sequence
  Protein SCO1 homolog, mitochondrial (97-105)
gacaccaaggaggccaucgccaacuac

SEQ ID NO: 48679 - RNA, 27 nt, Artificial Sequence
  Amyloid beta A4 protein (64-72)
gacaccaaggagggcauccugcaguac

SEQ ID NO: 48680 - RNA, 27 nt, Artificial Sequence
  Intraflagellar transport protein 74 homolog (328-336)
gacaccaaggagaagaucaaccaguuc

SEQ ID NO: 48681 - RNA, 27 nt, Artificial Sequence
  Charged multivesicular body protein 5 (21-29)
gacaccaagaccacgguggacgccaug

SEQ ID NO: 48682 - RNA, 27 nt, Artificial Sequence
  DNA-directed RNA polymerase II subunit RPB2 (738-746)
gacacccuggcccacgugcucuacuac

SEQ ID NO: 48683 - RNA, 27 nt, Artificial Sequence
  Presenilin-2 (439-447)
gacacccuggccagccaccagcucuac

SEQ ID NO: 48684 - RNA, 27 nt, Artificial Sequence
  Acidic fibroblast growth factor intracellular-binding protein (55-63)
gacaccauggaccacuaccgcaccuuc

SEQ ID NO: 48685 - RNA, 27 nt, Artificial Sequence
  Parafibromin (134-142)
gacaccaugggcaccuaccacgggaug

SEQ ID NO: 48686 - RNA, 30 nt, Artificial Sequence
  Dual specificity protein phosphatase 10 (341-350)
gacaccaugcagcgccugaacaucggcuac

SEQ ID NO: 48687 - RNA, 27 nt, Artificial Sequence
  FRAS1-related extracellular matrix protein 2 (1562-1570)
gacacccccgacaagcugcucaaguuc

SEQ ID NO: 48688 - RNA, 27 nt, Artificial Sequence
  Translin-associated protein X (212-220)
gacacccccuucgaggugagccaguuc

SEQ ID NO: 48689 - RNA, 30 nt, Artificial Sequence
  Translation factor GUF1, mitochondrial (140-149)
gacacccccggccacguggacuucagcuac

SEQ ID NO: 48690 - RNA, 27 nt, Artificial Sequence
  Protein KIAA0100 (293-301)
gacacccccccguucgcccugggcuuc

SEQ ID NO: 48691 - RNA, 27 nt, Artificial Sequence
  Nuclear receptor subfamily 4 group A member 2 (395-403)
gacacccagcacauccagcaguucuac

SEQ ID NO: 48692 - RNA, 27 nt, Artificial Sequence
  Nuclear protein localization protein 4 homolog (319-327)
gacacccgcaagggcaccgugcgguac

SEQ ID NO: 48693 - RNA, 27 nt, Artificial Sequence
  Nuclear pore complex protein Nup205 (1075-1083)
gacaccagcggccccaccaugcgcuac

SEQ ID NO: 48694 - RNA, 27 nt, Artificial Sequence
  Disintegrin and metalloproteinase domain-containing protein 10 (98-106)
gacaccagccacaucuacaccggccac

SEQ ID NO: 48695 - RNA, 30 nt, Artificial Sequence
  Protein YIF1B (38-47)
gacaccagcuccgcccagagccgcggcuac

SEQ ID NO: 48696 - RNA, 27 nt, Artificial Sequence
  NHS-like protein 1 (768-776)
gacaccagcuccgugaagagcgaguac

SEQ ID NO: 48697 - RNA, 27 nt, Artificial Sequence
  Peptidyl-glycine alpha-amidating monooxygenase (99-107)
gacaccgugcaccacaugcugcucuuc

SEQ ID NO: 48698 - RNA, 27 nt, Artificial Sequence
  E3 SUMO-protein ligase RanBP2 (3197-3205)
gacaccgugaagaagaucgagagcuuc

SEQ ID NO: 48699 - RNA, 27 nt, Artificial Sequence
  Nodal modulator 3 (6-14)
gacaccgugaagcagaugaacaaguac

SEQ ID NO: 48700 - RNA, 27 nt, Artificial Sequence
  Rho GTPase-activating protein 31 (892-900)
gacaccgugaccgacaucgcccagcac

SEQ ID NO: 48701 - RNA, 33 nt, Artificial Sequence
  E3 ubiquitin-protein ligase MYLIP (278-288)
gacaccgugaccagcgccgucaugaugcaguac

SEQ ID NO: 48702 - RNA, 33 nt, Artificial Sequence
  Eukaryotic translation initiation factor 4H (5-15)
gacaccuacgacgaccgcgccuacagcuccuuc

SEQ ID NO: 48703 - RNA, 33 nt, Artificial Sequence
  Vacuolar fusion protein CCZ1 homolog (308-318)
gacaccuacgaggagcugcaccucaucguguac

SEQ ID NO: 48704 - RNA, 36 nt, Artificial Sequence
  Ethanolamine-phosphate cytidylyltransferase (124-135)
gacaccuacgaggaggugaagcaggccggccgcuac

SEQ ID NO: 48705 - RNA, 36 nt, Artificial Sequence
  Beta-secretase 2 (127-138)
gacaccuacuucgacaccgagcgcagcuccacguac

SEQ ID NO: 48706 - RNA, 30 nt, Artificial Sequence
  Glycoprotein endo-alpha-1,2-mannosidase-like protein (245-254)
gacaccuacggcagccacggggccuucuac

SEQ ID NO: 48707 - RNA, 30 nt, Artificial Sequence
  Mid1-interacting protein 1 (5-14)
gacaccuacaaccagaagcacagccuguuc

SEQ ID NO: 48708 - RNA, 30 nt, Artificial Sequence
  Tetratricopeptide repeat protein 37 (1017-1026)
gacaccuacaacguggccauccgcaacuac

SEQ ID NO: 48709 - RNA, 30 nt, Artificial Sequence
  Zinc finger CCCH domain-containing protein 13 (520-529)
gacaccuaccccgaggagagccgcuccuac

SEQ ID NO: 48710 - RNA, 33 nt, Artificial Sequence
  Cartilage acidic protein 1 (17-27)
gacguggccgccgaggcgggcgucagcaaguac

SEQ ID NO: 48711 - RNA, 33 nt, Artificial Sequence
  Putative GTP-binding protein 6 (258-268)
gacguggcccacagcgaccugauccuccacguc

SEQ ID NO: 48712 - RNA, 27 nt, Artificial Sequence
  Polynucleotide 5'-hydroxyl-kinase NOL9 (563-571)
gacguggcccccacccacauccuguac

SEQ ID NO: 48713 - RNA, 36 nt, Artificial Sequence
  Hsc70-interacting protein (337-348)
gacguggcccagaaccccgccaacaugagcaaguac

SEQ ID NO: 48714 - RNA, 33 nt, Artificial Sequence
  WD repeat domain-containing protein 83 (95-105)
gacguggccagcggccaggucgugcgcaaguuc

SEQ ID NO: 48715 - RNA, 27 nt, Artificial Sequence
  Protein S100-B (13-21)
gacguguuccaccaguacagcggccgc

SEQ ID NO: 48716 - RNA, 30 nt, Artificial Sequence
  Sentrin-specific protease 5 (531-540)
gacguguucaacgaggacuucagcaaccgc

SEQ ID NO: 48717 - RNA, 30 nt, Artificial Sequence
  Nicotinamide phosphoribosyltransferase (94-103)
gacguguucaacgagaagggcuggaacuac

SEQ ID NO: 48718 - RNA, 30 nt, Artificial Sequence
  DNA excision repair protein ERCC-8 (78-87)
gacguguucaacuucgaggagaccgucuac

SEQ ID NO: 48719 - RNA, 33 nt, Artificial Sequence
  Phosphomannomutase 1 (190-200)
gacguguuccccgagggcugggacaagcgcuac

SEQ ID NO: 48720 - RNA, 30 nt, Artificial Sequence
  Serine/threonine-protein kinase N3 (654-663)
gacguguuccccgagccgcaggcccgcuuc

SEQ ID NO: 48721 - RNA, 30 nt, Artificial Sequence
  Solute carrier family 23 member 2 (334-343)
gacguguuccccccggacagcaccaaguac

SEQ ID NO: 48722 - RNA, 39 nt, Artificial Sequence
  Solute carrier family 23 member 2 (334-346)
gacguguuccccccggacagcaccaaguacggcuucuac

SEQ ID NO: 48723 - RNA, 33 nt, Artificial Sequence
  MOB kinase activator 2 (126-136)
gacguguuccccaccaaguacggccgcgaguuc

SEQ ID NO: 48724 - RNA, 30 nt, Artificial Sequence
  U4/U6.U5 tri-snRNP-associated protein 2 (186-195)
gacguguuccagggcagcaugcgcaucuuc

SEQ ID NO: 48725 - RNA, 27 nt, Artificial Sequence
  Ankyrin repeat and BTB/POZ domain-containing protein 1 (59-67)
gacguguucacccacguccuguacuac

SEQ ID NO: 48726 - RNA, 39 nt, Artificial Sequence
  General transcription factor II-I (53-65)
gacguguucgucgugggcaccgagcgcgggcgggccuuc

SEQ ID NO: 48727 - RNA, 36 nt, Artificial Sequence
  HLA class I histocompatibility antigen, A-1 alpha chain (101-112)
gacgugggccccgacgggcgcuuccugcggggcuac

SEQ ID NO: 48728 - RNA, 30 nt, Artificial Sequence
  Histone deacetylase 6 (104-113)
gacgugcaccacggccaggggacccaguuc

SEQ ID NO: 48729 - RNA, 30 nt, Artificial Sequence
  Kaptin (205-214)
gacgugcacaacuuccccggcaccagccgc

SEQ ID NO: 48730 - RNA, 30 nt, Artificial Sequence
  Neutral alpha-glucosidase AB (329-338)
gacgugcacaacaucuacggccuguacguc

SEQ ID NO: 48731 - RNA, 27 nt, Artificial Sequence
  Speriolin-like protein (115-123)
gacgugcaccccgccuucagcgaguuc

SEQ ID NO: 48732 - RNA, 36 nt, Artificial Sequence
  Caveolin-1 (5-16)
gacgugaucgccgagcccgagggcacccacagcuuc

SEQ ID NO: 48733 - RNA, 33 nt, Artificial Sequence
  Death effector domain-containing protein (51-61)
gacgugaucgacgaccacgagcgcggccugauc

SEQ ID NO: 48734 - RNA, 27 nt, Artificial Sequence
  Protein LDOC1L (24-32)
gacgugaucgacacccugaccagccuc

SEQ ID NO: 48735 - RNA, 27 nt, Artificial Sequence
  Uncharacterized protein C20orf194 (832-840)
gacgugaucgacgucgugcaggcccug

SEQ ID NO: 48736 - RNA, 27 nt, Artificial Sequence
  ATP-dependent RNA helicase DHX36 (400-408)
gacgugaucgagaagauccgcuacguc

SEQ ID NO: 48737 - RNA, 33 nt, Artificial Sequence
  E3 ubiquitin-protein ligase RNF213 (1304-1314)
gacgugaucuucaaggacuucgucaacaaguac

SEQ ID NO: 48738 - RNA, 27 nt, Artificial Sequence
  60S ribosomal protein L3 (213-221)
gacgugaucggcgucaccaaggggaag

SEQ ID NO: 48739 - RNA, 33 nt, Artificial Sequence
  60S ribosomal protein L3 (213-223)
gacgugaucggcgucaccaaggggaagggcuac

SEQ ID NO: 48740 - RNA, 36 nt, Artificial Sequence
  Triple functional domain protein (785-796)
gacgugauccaccagggccaggaccugcuccaguac

SEQ ID NO: 48741 - RNA, 27 nt, Artificial Sequence
  Ran GTPase-activating protein 1 (40-48)
gacgugaucaaggagaucgaggacuuc

SEQ ID NO: 48742 - RNA, 27 nt, Artificial Sequence
  Spindle and kinetochore-associated protein 1 (163-171)
gacgugaucaaggagaucaacaaggcc

SEQ ID NO: 48743 - RNA, 30 nt, Artificial Sequence
  Cytoplasmic dynein 2 heavy chain 1 (2609-2618)
gacgugaucaagaagggccugauccacuac

SEQ ID NO: 48744 - RNA, 27 nt, Artificial Sequence
  Fanconi anemia group D2 protein (348-356)
gacgugaucaagagcgccauccgcuac

SEQ ID NO: 48745 - RNA, 27 nt, Artificial Sequence
  Elongation factor G, mitochondrial (730-738)
gacgugaucaacaaguaccuggaggcc

SEQ ID NO: 48746 - RNA, 39 nt, Artificial Sequence
  Thioredoxin-related transmembrane protein 4 (92-104)
gacgugauccaggagcccggccugagcgggcgcuucuuc

SEQ ID NO: 48747 - RNA, 27 nt, Artificial Sequence
  WD repeat-containing protein 26 (126-134)
gacgugauccgccugaucggccagcac

SEQ ID NO: 48748 - RNA, 27 nt, Artificial Sequence
  Coenzyme Q-binding protein COQ10 homolog B, mitochondrial (62-70)
gacgugaucagcaagcgcuccggcuac

SEQ ID NO: 48749 - RNA, 27 nt, Artificial Sequence
  Mediator of RNA polymerase II transcription subunit 27 (126-134)
gacgugaucagccgcaucgaccggaug

SEQ ID NO: 48750 - RNA, 30 nt, Artificial Sequence
  Antigen KI-67 (86-95)
gacgugaucaccaucaucgaccgcagcuuc

SEQ ID NO: 48751 - RNA, 36 nt, Artificial Sequence
  Antigen KI-67 (86-97)
gacgugaucaccaucaucgaccgcagcuuccgguac

SEQ ID NO: 48752 - RNA, 36 nt, Artificial Sequence
  ER membrane protein complex subunit 1 (96-107)
gacgugaucaccgucagcaacggcgggcgcaucaug

SEQ ID NO: 48753 - RNA, 30 nt, Artificial Sequence
  40S ribosomal protein S18 (89-98)
gacgugaaggacggcaaguacagccagguc

SEQ ID NO: 48754 - RNA, 27 nt, Artificial Sequence
  Cell cycle progression protein 1 (703-711)
gacgugaaggacuaccugcgcaacaug

SEQ ID NO: 48755 - RNA, 27 nt, Artificial Sequence
  Transmembrane protein 168 (117-125)
gacgugaaggaggagagcaccaaguac

SEQ ID NO: 48756 - RNA, 27 nt, Artificial Sequence
  Nuclear pore complex protein Nup107 (812-820)
gacgugaaggagaagauguacaacguc

SEQ ID NO: 48757 - RNA, 30 nt, Artificial Sequence
  UTP-glucose-1-phosphate uridylyltransferase (289-298)
gacgugaagggcgggacccugacccaguac

SEQ ID NO: 48758 - RNA, 27 nt, Artificial Sequence
  Lon protease homolog, mitochondrial (277-285)
gacgugaagaagcgcauccuggaguuc

SEQ ID NO: 48759 - RNA, 27 nt, Artificial Sequence
  DDB1- and CUL4-associated factor 4 (130-138)
gacgugaaggucggcgggagcaaguac

SEQ ID NO: 48760 - RNA, 39 nt, Artificial Sequence
  Lon protease homolog, mitochondrial (129-141)
gacgugcuggaggagaccaacauccccaagcgccucuac

SEQ ID NO: 48761 - RNA, 27 nt, Artificial Sequence
  AP-2 complex subunit mu (176-184)
gacgugcuggagagcgucaaccuccug

SEQ ID NO: 48762 - RNA, 51 nt, Artificial Sequence
  PRKR-interacting protein 1 (66-82)
gacgugaugggcagcuccgccggggccggcagcggggaguuccacgucuac

SEQ ID NO: 48763 - RNA, 27 nt, Artificial Sequence
  Rho-associated protein kinase 2 (99-107)
gacgugcccgagaagugggccaaguuc

SEQ ID NO: 48764 - RNA, 27 nt, Artificial Sequence
  Rho-associated protein kinase 1 (169-177)
gacgugcccgagaagugggcccgcuuc

SEQ ID NO: 48765 - RNA, 27 nt, Artificial Sequence
  Protein diaphanous homolog 2 (54-62)
gacgugcgcgaccggaucaccagcuuc

SEQ ID NO: 48766 - RNA, 27 nt, Artificial Sequence
  RIB43A-like with coiled-coils protein 2 (62-70)
gacgugcgcaacaccaucagcggcaug

SEQ ID NO: 48767 - RNA, 27 nt, Artificial Sequence
  Dipeptidyl peptidase 1 (107-115)
gacgugaccgacuucaucagccaccug

SEQ ID NO: 48768 - RNA, 27 nt, Artificial Sequence
  RANBP2-like and GRIP domain-containing protein 2 (107-115)
gacgugaccgacggccgcgccaaguac

SEQ ID NO: 48769 - RNA, 27 nt, Artificial Sequence
  TATA box-binding protein-associated factor RNA polymerase I subunit C (102-110)
gacgugaccgagcagaucagccgcuuc

SEQ ID NO: 48770 - RNA, 30 nt, Artificial Sequence
  Zinc finger protein 552 (41-50)
gacgugacccuggagaaccucgcccugaug

SEQ ID NO: 48771 - RNA, 27 nt, Artificial Sequence
  Bromodomain adjacent to zinc finger domain protein 1A (531-539)
gacgugaccagcgccaacgccaaguac

SEQ ID NO: 48772 - RNA, 30 nt, Artificial Sequence
  Trafficking protein particle complex subunit 2-like protein (7-16)
gacguggucgacgagaagaucagcgccaug

SEQ ID NO: 48773 - RNA, 27 nt, Artificial Sequence
  Sorting nexin-8 (312-320)
gacguggucgagaagcugaaccucuuc

SEQ ID NO: 48774 - RNA, 33 nt, Artificial Sequence
  DCN1-like protein 4 (58-68)
gacguggucggccccgaggggauggagaaguuc

SEQ ID NO: 48775 - RNA, 27 nt, Artificial Sequence
  Inositol-trisphosphate 3-kinase B (718-726)
gacguggucaaggacggcgagcgcuac

SEQ ID NO: 48776 - RNA, 27 nt, Artificial Sequence
  Cold shock domain-containing protein E1 (173-181)
gacguggucaaggagaucuucuuccac

SEQ ID NO: 48777 - RNA, 30 nt, Artificial Sequence
  Cold shock domain-containing protein E1 (173-182)
gacguggucaaggagaucuucuuccacuac

SEQ ID NO: 48778 - RNA, 39 nt, Artificial Sequence
  Peptidyl-prolyl cis-trans isomerase H (34-46)
gacgugguccccaagaccgccgagaacuuccgccaguuc

SEQ ID NO: 48779 - RNA, 27 nt, Artificial Sequence
  Glypican-1 (232-240)
gacgugguccgcaagguggcccaggug

SEQ ID NO: 48780 - RNA, 30 nt, Artificial Sequence
  F-box only protein 31 (25-34)
gacguguacgccaagcugcuccaccgcuac

SEQ ID NO: 48781 - RNA, 33 nt, Artificial Sequence
  26S proteasome non-ATPase regulatory subunit 1 (492-502)
gacguguacgaccugcucaagaccaaccuguac

SEQ ID NO: 48782 - RNA, 33 nt, Artificial Sequence
  RNA polymerase II-associated factor 1 homolog (252-262)
gacguguacgacuacaagaucgcccgcgaguac

SEQ ID NO: 48783 - RNA, 33 nt, Artificial Sequence
  Cat eye syndrome critical region protein 5 (318-328)
gacguguacggcgccaaccuguuccaccaguac

SEQ ID NO: 48784 - RNA, 27 nt, Artificial Sequence
  Cystathionine gamma-lyase (112-120)
gacguguacggcgggaccaaccgcuac

SEQ ID NO: 48785 - RNA, 30 nt, Artificial Sequence
  Cystathionine gamma-lyase (112-121)
gacguguacggcgggaccaaccgcuacuuc

SEQ ID NO: 48786 - RNA, 30 nt, Artificial Sequence
  Transcription elongation factor SPT6 (339-348)
gacguguacaaccacuuccugcucuacuac

SEQ ID NO: 48787 - RNA, 30 nt, Artificial Sequence
  Inactive tyrosine-protein kinase 7 (954-963)
gacguguacaacagcgaguacuaccacuuc

SEQ ID NO: 48788 - RNA, 30 nt, Artificial Sequence
  Melanoma-associated antigen D1 (507-516)
gacguguaccccgagaucaucgagcgcgcc

SEQ ID NO: 48789 - RNA, 36 nt, Artificial Sequence
  Melanoma-associated antigen D2 (315-326)
gacguguaccccgagaucaucgagcgcgccggcuac

SEQ ID NO: 48790 - RNA, 33 nt, Artificial Sequence
  ATP synthase mitochondrial F1 complex assembly factor 1 (232-242)
gaggccgccgcgagccagcugauccucuaccac

SEQ ID NO: 48791 - RNA, 33 nt, Artificial Sequence
  Uncharacterized protein C20orf194 (141-151)
gaggccgccgaggaguucaagaucaccagcuuc

SEQ ID NO: 48792 - RNA, 36 nt, Artificial Sequence
  Calpain small subunit 1 (199-210)
gaggccgccggcuuccaccugaacgagcaccucuac

SEQ ID NO: 48793 - RNA, 27 nt, Artificial Sequence
  Protein GREB1 (686-694)
gaggccgcccccgacaucaugcacuac

SEQ ID NO: 48794 - RNA, 33 nt, Artificial Sequence
  ATP-dependent DNA helicase Q4 (32-42)
gaggccgcccccgaggagacccgcgcgcuguac

SEQ ID NO: 48795 - RNA, 33 nt, Artificial Sequence
  Metal transporter CNNM3 (26-36)
gaggccgcccccggcccgcgcgugcugggguuc

SEQ ID NO: 48796 - RNA, 33 nt, Artificial Sequence
  Nucleoside diphosphate kinase, mitochondrial (131-141)
gaggccgcccccggcaccauccgcggggacuuc

SEQ ID NO: 48797 - RNA, 27 nt, Artificial Sequence
  3-hydroxy-3-methylglutaryl-coenzyme A reductase (567-575)
gaggccuucgacagcaccucccgcuuc

SEQ ID NO: 48798 - RNA, 30 nt, Artificial Sequence
  Isovaleryl-CoA dehydrogenase, mitochondrial (310-319)
gaggccuucggccagaagaucgggcacuuc

SEQ ID NO: 48799 - RNA, 33 nt, Artificial Sequence
  Proteasome activator complex subunit 3 (94-104)
gaggccuuccagggcaccaagguguucgucaug

SEQ ID NO: 48800 - RNA, 30 nt, Artificial Sequence
  Proteasome activator complex subunit 2 (158-167)
gaggccuuccagaccaccaucagcaaguac

SEQ ID NO: 48801 - RNA, 27 nt, Artificial Sequence
  Chloride intracellular channel protein 1 (201-209)
gaggccuuccgcggcgugcaccgguac

SEQ ID NO: 48802 - RNA, 30 nt, Artificial Sequence
  Growth arrest-specific protein 8 (145-154)
gaggccuucaccgacaucaagaacuacuac

SEQ ID NO: 48803 - RNA, 27 nt, Artificial Sequence
  Ras-related protein Rab-27A (147-155)
gaggccaucgcccuggcggagaaguac

SEQ ID NO: 48804 - RNA, 30 nt, Artificial Sequence
  Alpha-actinin-4 (524-533)
gaggccaucgaccagcugcaccucgaguac

SEQ ID NO: 48805 - RNA, 30 nt, Artificial Sequence
  Small integral membrane protein 8 (79-88)
gaggccaucgacagcgagggccacuccuac

SEQ ID NO: 48806 - RNA, 33 nt, Artificial Sequence
  Small integral membrane protein 8 (79-89)
gaggccaucgacagcgagggccacuccuacaug

SEQ ID NO: 48807 - RNA, 33 nt, Artificial Sequence
  Condensin complex subunit 1 (636-646)
gaggccaucggcaucaucagcaagaugauguac

SEQ ID NO: 48808 - RNA, 33 nt, Artificial Sequence
  Nuclear pore complex protein Nup133 (332-342)
gaggccaucaaggagggcgugaacauccgcuac

SEQ ID NO: 48809 - RNA, 30 nt, Artificial Sequence
  Synergin gamma (170-179)
gaggccaucaagggcaaccuggacggguuc

SEQ ID NO: 48810 - RNA, 27 nt, Artificial Sequence
  N-lysine methyltransferase SMYD2 (289-297)
gaggccauccgcgacauggugcgguac

SEQ ID NO: 48811 - RNA, 33 nt, Artificial Sequence
  Trabeculin-alpha (3748-3758)
gaggccaucagccugcucaacuccgagcgcuac

SEQ ID NO: 48812 - RNA, 30 nt, Artificial Sequence
  KN motif and ankyrin repeat domain-containing protein 1 (1144-1153)
gaggccaucagccccgacgugcugcgcuac

SEQ ID NO: 48813 - RNA, 39 nt, Artificial Sequence
  E3 ubiquitin-protein ligase Praja-1 (266-278)
gaggccaucagcuacguggacccccaguuccugaccuac

SEQ ID NO: 48814 - RNA, 27 nt, Artificial Sequence
  DNA replication licensing factor MCM5 (614-622)
gaggccaucgugcgcaucgccgaggcg

SEQ ID NO: 48815 - RNA, 30 nt, Artificial Sequence
  Nucleoporin Nup43 (370-379)
gaggccaucuacgugacccgccaccuguuc

SEQ ID NO: 48816 - RNA, 33 nt, Artificial Sequence
  UDP-glucose 6-dehydrogenase (76-86)
gaggcccugaaccuccccgagguggcccgcuac

SEQ ID NO: 48817 - RNA, 27 nt, Artificial Sequence
  Centromere protein F (1214-1222)
gaggccaugcugcgcaacaaggagcuc

SEQ ID NO: 48818 - RNA, 27 nt, Artificial Sequence
  Heme-binding protein 1 (57-65)
gaggccaugcccaagguggccaaguac

SEQ ID NO: 48819 - RNA, 30 nt, Artificial Sequence
  Cytoskeleton-associated protein 5 (1575-1584)
gaggccaugagcggccacaucgaccaguuc

SEQ ID NO: 48820 - RNA, 27 nt, Artificial Sequence
  Pre-mRNA-processing-splicing factor 8 (1105-1113)
gaggcccgcgaccugauccagcgguac

SEQ ID NO: 48821 - RNA, 39 nt, Artificial Sequence
  Syntenin-1 (34-46)
gaggccagcgcccccaucccgcacgacggcaaccuguac

SEQ ID NO: 48822 - RNA, 27 nt, Artificial Sequence
  Lysine-specific demethylase 7A (449-457)
gaggccaccagccccuaccacucccgc

SEQ ID NO: 48823 - RNA, 33 nt, Artificial Sequence
  TNF receptor-associated factor 5 (400-410)
gaggccguggacggccacaccgucagcaucuuc

SEQ ID NO: 48824 - RNA, 36 nt, Artificial Sequence
  Mitochondrial-processing peptidase subunit alpha (283-294)
gaggccguggacaucgaccgcagcgucgcccaguac

SEQ ID NO: 48825 - RNA, 27 nt, Artificial Sequence
  Transcriptional enhancer factor TEF-3 (263-271)
gaggccguggacauccgccagaucuac

SEQ ID NO: 48826 - RNA, 30 nt, Artificial Sequence
  LIX1-like protein (28-37)
gaggccguggaggccgucgugcgcagcuuc

SEQ ID NO: 48827 - RNA, 30 nt, Artificial Sequence
  Integrin alpha-7 (432-441)
gaggccgugggcaucaagagcuucggguac

SEQ ID NO: 48828 - RNA, 30 nt, Artificial Sequence
  Phosphatidylinositol 3-kinase regulatory subunit alpha (173-182)
gaggccgugggcaagaagcugcacgaguac

SEQ ID NO: 48829 - RNA, 30 nt, Artificial Sequence
  26S protease regulatory subunit 7 (411-420)
gaggccgugaacaaggucaucaagagcuac

SEQ ID NO: 48830 - RNA, 27 nt, Artificial Sequence
  Methyltransferase-like protein 13 (244-252)
gaggccgugcaggagcgccagcaguac

SEQ ID NO: 48831 - RNA, 27 nt, Artificial Sequence
  Renalase (186-194)
gaggccgugagcuacuccagccgcuac

SEQ ID NO: 48832 - RNA, 30 nt, Artificial Sequence
  Poly (ADP-ribose) polymerase 4 (695-704)
gaggccgugacccagggccacggggccuac

SEQ ID NO: 48833 - RNA, 27 nt, Artificial Sequence
  Importin subunit alpha-1 (396-404)
gaggccgugugggccgucaccaacuac

SEQ ID NO: 48834 - RNA, 30 nt, Artificial Sequence
  DNA replication licensing factor MCM4 (656-665)
gaggccuacgaccgccggcuggcccaccac

SEQ ID NO: 48835 - RNA, 27 nt, Artificial Sequence
  Trafficking protein particle complex subunit 12 (300-308)
gaggccuaccacagcgugaucaaguac

SEQ ID NO: 48836 - RNA, 30 nt, Artificial Sequence
  Leucine-rich PPR motif-containing protein, mitochondrial (1198-1207)
gaggccuacaacagccugaugaaguccuac

SEQ ID NO: 48837 - RNA, 27 nt, Artificial Sequence
  Protein mago nashi homolog 2 (5-13)
gaggccuacgugcacaagagcgucaug

SEQ ID NO: 48838 - RNA, 27 nt, Artificial Sequence
  Coatomer subunit beta (79-87)
gaggccuacgugcacgucaaccaguac

SEQ ID NO: 48839 - RNA, 33 nt, Artificial Sequence
  Sorting and assembly machinery component 50 homolog (365-375)
gaggccuacugggccggcgggcugcaccucuac

SEQ ID NO: 48840 - RNA, 27 nt, Artificial Sequence
  Superkiller viralicidic activity 2-like 2 (938-946)
gagugcgccaagcgcaucgccaaggug

SEQ ID NO: 48841 - RNA, 30 nt, Artificial Sequence
  Vimentin (180-189)
gaggacaucaugcgccugcgggagaagcuc

SEQ ID NO: 48842 - RNA, 27 nt, Artificial Sequence
  U3 small nucleolar ribonucleoprotein protein IMP3 (43-51)
gaggacuacacccgcuacaaccagcug

SEQ ID NO: 48843 - RNA, 27 nt, Artificial Sequence
  Ataxin-10 (298-306)
gaggaggcccuggccaccauccgccuc

SEQ ID NO: 48844 - RNA, 30 nt, Artificial Sequence
  Transmembrane protein 150C (126-135)
gaggagauccacaacgugggcaccagccug

SEQ ID NO: 48845 - RNA, 27 nt, Artificial Sequence
  Zinc finger FYVE domain-containing protein 16 (415-423)
gaggagauccagaacagcgugguccug

SEQ ID NO: 48846 - RNA, 27 nt, Artificial Sequence
  Cofilin-1 (141-149)
gaggaggugaaggaccgcugcacccug

SEQ ID NO: 48847 - RNA, 42 nt, Artificial Sequence
  Phosphoglycerate kinase 1 (404-417)
gagggcaaggugcugcccggggucgacgcccucagcaacauc

SEQ ID NO: 48848 - RNA, 27 nt, Artificial Sequence
  NADH dehydrogenase (ubiquinone) 1 alpha subcomplex subunit 11 (51-59)
gagggcguggccaaggucgggcaguac

SEQ ID NO: 48849 - RNA, 27 nt, Artificial Sequence
  (Pyruvate dehydrogenase (acetyl-transferring)) kinase isozyme 4, mitochondrial (229-237)
gagcaccaggagaaccagcccagccug

SEQ ID NO: 48850 - RNA, 30 nt, Artificial Sequence
  Intraflagellar transport protein 172 homolog (6-15)
gagaucgccgaccaggugagccgcgaguac

SEQ ID NO: 48851 - RNA, 27 nt, Artificial Sequence
  Alpha- and gamma-adaptin-binding protein p34 (72-80)
gagaucgccgagagcgugcaggccuuc

SEQ ID NO: 48852 - RNA, 27 nt, Artificial Sequence
  Cleavage and polyadenylation specificity factor subunit 3 (29-37)
gagaucgccggcgugaagcugcucuac

SEQ ID NO: 48853 - RNA, 30 nt, Artificial Sequence
  Carbohydrate sulfotransferase 10 (216-225)
gagaucgcccccggcaucauccgcaaguac

SEQ ID NO: 48854 - RNA, 30 nt, Artificial Sequence
  Fatty acid synthase (760-769)
gagaucgccccccacgcccugcuccaggcg

SEQ ID NO: 48855 - RNA, 30 nt, Artificial Sequence
  Cullin-7 (1259-1268)
gagaucgccaccaccuucgagcacuacuac

SEQ ID NO: 48856 - RNA, 30 nt, Artificial Sequence
  Exportin-2 (752-761)
gagaucuucgacggcauccagcccaagaug

SEQ ID NO: 48857 - RNA, 33 nt, Artificial Sequence
  Exportin-2 (752-762)
gagaucuucgacggcauccagcccaagauguuc

SEQ ID NO: 48858 - RNA, 27 nt, Artificial Sequence
  Utrophin (1655-1663)
gagaucuucgacggcaacguggcccac

SEQ ID NO: 48859 - RNA, 27 nt, Artificial Sequence
  Cold shock domain-containing protein E1 (177-185)
gagaucuucuuccacuacagcgaguuc

SEQ ID NO: 48860 - RNA, 33 nt, Artificial Sequence
  Neuron navigator 2 (2237-2247)
gagaucuucaacggccugcucaacugcaaguac

SEQ ID NO: 48861 - RNA, 30 nt, Artificial Sequence
  F-box only protein 25 (53-62)
gagaucuucaacaacgaggagcacgaguac

SEQ ID NO: 48862 - RNA, 30 nt, Artificial Sequence
  Ubiquitin-protein ligase E3A (558-567)
gagaucuucaaccccgacaucggcauguuc

SEQ ID NO: 48863 - RNA, 30 nt, Artificial Sequence
  Exportin-4 (988-997)
gagaucuuccccgagaagaucccgcagcug

SEQ ID NO: 48864 - RNA, 27 nt, Artificial Sequence
  Interferon-induced GTP-binding protein Mx1 (576-584)
gagaucuuccagcaccugauggccuac

SEQ ID NO: 48865 - RNA, 27 nt, Artificial Sequence
  Zinc finger CCCH-type antiviral protein 1 (57-65)
gagauccaccaccugcaccccgaguac

SEQ ID NO: 48866 - RNA, 39 nt, Artificial Sequence
  Nuclear pore complex protein Nup205 (794-806)
gagaucaucgccuacaagcccccgggcuucagccugaug

SEQ ID NO: 48867 - RNA, 30 nt, Artificial Sequence
  Caseinolytic peptidase B protein homolog (651-660)
gagaucaucgacaaggacagcaagacccgc

SEQ ID NO: 48868 - RNA, 30 nt, Artificial Sequence
  Mitogen-activated protein kinase kinase kinase 6 (286-295)
gagaucaucgaccagggcccccgcggguac

SEQ ID NO: 48869 - RNA, 27 nt, Artificial Sequence
  Leucine-rich repeat and coiled-coil domain-containing protein 1 (237-245)
gagaucaucgaccgcaugcccgugauc

SEQ ID NO: 48870 - RNA, 30 nt, Artificial Sequence
  Brefeldin A-inhibited guanine nucleotide-exchange protein 2 (645-654)
gagaucaucgagcacggcaucgagcuguuc

SEQ ID NO: 48871 - RNA, 27 nt, Artificial Sequence
  Nuclear envelope integral membrane protein 1 (143-151)
gagaucaucgagaaggacaccaaguac

SEQ ID NO: 48872 - RNA, 27 nt, Artificial Sequence
  Complex I assembly factor TMEM126B, mitochondrial (25-33)
gagaucaucgagaagaacuucgacuac

SEQ ID NO: 48873 - RNA, 27 nt, Artificial Sequence
  MAGUK p55 subfamily member 5 (623-631)
gagaucaucgagaagacccgcgagaug

SEQ ID NO: 48874 - RNA, 30 nt, Artificial Sequence
  Nucleolar pre-ribosomal-associated protein 1 (606-615)
gagaucaucggcggggagcgcagcguguuc

SEQ ID NO: 48875 - RNA, 33 nt, Artificial Sequence
  Ribosome-releasing factor 2, mitochondrial (541-551)
gagaucauccacgaccgcaucaagcgggaguac

SEQ ID NO: 48876 - RNA, 36 nt, Artificial Sequence
  ATP-dependent RNA helicase DDX3X (189-200)
gagaucaucaugggcaacaucgagcugacccgcuac

SEQ ID NO: 48877 - RNA, 30 nt, Artificial Sequence
  Bifunctional 3'-phosphoadenosine 5'-phosphosulfate synthase 2 (546-555)
gagaucauccccuuccgcguggccgccuac

SEQ ID NO: 48878 - RNA, 30 nt, Artificial Sequence
  Zinc finger protein 322 (34-43)
gagaucauccagaucgacggccacaucuac

SEQ ID NO: 48879 - RNA, 33 nt, Artificial Sequence
  Tuftelin-interacting protein 11 (334-344)
gagaucauccagaacgaccgccagcugcaguac

SEQ ID NO: 48880 - RNA, 27 nt, Artificial Sequence
  Polyadenylate-binding protein-interacting protein 1 (232-240)
gagaucauccagcgcaucgagaacgug

SEQ ID NO: 48881 - RNA, 27 nt, Artificial Sequence
  AF4/FMR2 family member 3 (304-312)
gagaucauccgcgagaugaccuggcug

SEQ ID NO: 48882 - RNA, 36 nt, Artificial Sequence
  Centrosomal protein of 95 kDa (16-27)
gagaucauccgccugggcgacaccgcccacaccuuc

SEQ ID NO: 48883 - RNA, 33 nt, Artificial Sequence
  Plectin (3616-3626)
gagaucauccgccagcagggccuggccagcuac

SEQ ID NO: 48884 - RNA, 30 nt, Artificial Sequence
  Shugoshin-like 2 (621-630)
gagaucaucagcggcaugaaccacauguac

SEQ ID NO: 48885 - RNA, 27 nt, Artificial Sequence
  Serine/threonine-protein phosphatase 2A 55 kDa regulatory subunit B alpha isoform (283-291)
gagaucaucagcuccaucagcgacgug

SEQ ID NO: 48886 - RNA, 30 nt, Artificial Sequence
  Mitochondrial-processing peptidase subunit alpha (407-416)
gagaucaucaccaaggaguucauccugaug

SEQ ID NO: 48887 - RNA, 30 nt, Artificial Sequence
  NEDD4-binding protein 1 (737-746)
gagaucaucaccaagcgccugcuccaguac

SEQ ID NO: 48888 - RNA, 27 nt, Artificial Sequence
  Arf-GAP with Rho-GAP domain, ANK repeat and PH domain-containing protein 2 (579-587)
gagaucaucacccccuaccgcagcuuc

SEQ ID NO: 48889 - RNA, 27 nt, Artificial Sequence
  40S ribosomal protein S16 (106-114)
gagaucaaggacauccugauccaguac

SEQ ID NO: 48890 - RNA, 27 nt, Artificial Sequence
  Peroxisomal NADH pyrophosphatase NUDT12 (204-212)
gagaucaaggacaagcugcucaacuac

SEQ ID NO: 48891 - RNA, 27 nt, Artificial Sequence
  Double-stranded RNA-specific adenosine deaminase (298-306)
gagaucaaggagaagaucugcgacuac

SEQ ID NO: 48892 - RNA, 27 nt, Artificial Sequence
  Ras association domain-containing protein 3 (53-61)
gagaucaaggagaaggugcacaaguac

SEQ ID NO: 48893 - RNA, 27 nt, Artificial Sequence
  Hsc70-interacting protein (246-254)
gagaucaaggagcgcaucgagcgggug

SEQ ID NO: 48894 - RNA, 27 nt, Artificial Sequence
  Mixed lineage kinase domain-like protein (171-179)
gagaucaaggagacccugcgccaguac

SEQ ID NO: 48895 - RNA, 30 nt, Artificial Sequence
  Radixin (207-216)
gagaucaagaacaagaagggcaccgagcug

SEQ ID NO: 48896 - RNA, 30 nt, Artificial Sequence
  40S ribosomal protein S15 (106-115)
gagaucaagcccgagaugaucggccacuac

SEQ ID NO: 48897 - RNA, 27 nt, Artificial Sequence
  G1/S-specific cyclin-D3 (51-59)
gagaucaagccccacaugcgcaagaug

SEQ ID NO: 48898 - RNA, 27 nt, Artificial Sequence
  Coiled-coil domain-containing protein 93 (285-293)
gagaucaagcagaucgugagcgaguac

SEQ ID NO: 48899 - RNA, 27 nt, Artificial Sequence
  Ras association domain-containing protein 5 (16-24)
gagaucaagcagaagaucgacagcuac

SEQ ID NO: 48900 - RNA, 30 nt, Artificial Sequence
  Heterogeneous nuclear ribonucleoprotein Q (352-361)
gagauccuggagaaggccuucagccaguuc

SEQ ID NO: 48901 - RNA, 30 nt, Artificial Sequence
  Heterogeneous nuclear ribonucleoprotein R (257-266)
gagauccuggagaagagcuucuccgaguuc

SEQ ID NO: 48902 - RNA, 36 nt, Artificial Sequence
  MRG/MORF4L-binding protein (94-105)
gagauccugcccuucccgaaccccgagcgcaacuuc

SEQ ID NO: 48903 - RNA, 30 nt, Artificial Sequence
  Vacuolar protein sorting-associated protein 13A (700-709)
gagaucauggaccgcgccuacgacagcuuc

SEQ ID NO: 48904 - RNA, 30 nt, Artificial Sequence
  Structural maintenance of chromosomes protein 6 (921-930)
gagaucauggagcaccgcuucaagaccuac

SEQ ID NO: 48905 - RNA, 33 nt, Artificial Sequence
  Tyrosine-protein phosphatase non-receptor type 3 (704-714)
gagauccccgccgccaaccuggugaacaaguac

SEQ ID NO: 48906 - RNA, 36 nt, Artificial Sequence
  Transmembrane emp24 domain-containing protein 4 (45-56)
gagauccccgacgagaccauggugaucggcaacuac

SEQ ID NO: 48907 - RNA, 30 nt, Artificial Sequence
  Prostacyclin synthase (472-481)
gagauccccgaguucgaccugagccgcuac

SEQ ID NO: 48908 - RNA, 27 nt, Artificial Sequence
  5,6-dihydroxyindole-2-carboxylic acid oxidase (465-473)
gagauccaguggcccagccgcgaguuc

SEQ ID NO: 48909 - RNA, 33 nt, Artificial Sequence
  Fibronectin type III domain-containing protein 3B (823-833)
gagauccgcgaccugcuccccgccgcccaguac

SEQ ID NO: 48910 - RNA, 27 nt, Artificial Sequence
  Elongation factor Tu, mitochondrial (198-206)
gagauccgcgagcugcucaccgaguuc

SEQ ID NO: 48911 - RNA, 30 nt, Artificial Sequence
  Protein FAM46D (230-239)
gagauccgcggcgggggccugcucaaguac

SEQ ID NO: 48912 - RNA, 30 nt, Artificial Sequence
  Transcriptional repressor NF-X1 (64-73)
gagaucagcgccgugcaccagcacuccuac

SEQ ID NO: 48913 - RNA, 27 nt, Artificial Sequence
  DNA replication licensing factor MCM3 (496-504)
gagaucagcgaccacgugcugcgcaug

SEQ ID NO: 48914 - RNA, 27 nt, Artificial Sequence
  Phospholipase D2 (660-668)
gagaucguggaccgcauccugaaggcc

SEQ ID NO: 48915 - RNA, 27 nt, Artificial Sequence
  DNA-directed RNA polymerase III subunit RPC3 (19-27)
gagaucguggagaagaucggcguccac

SEQ ID NO: 48916 - RNA, 30 nt, Artificial Sequence
  BRCA1-associated protein (136-145)
gagaucgugcacggcaucaugcaccuguac

SEQ ID NO: 48917 - RNA, 27 nt, Artificial Sequence
  DNA mismatch repair protein Msh2 (580-588)
gagaucgugaacaucagcuccggcuac

SEQ ID NO: 48918 - RNA, 27 nt, Artificial Sequence
  DNA-directed RNA polymerase III subunit RPC3 (265-273)
gagaucgugcgcaccaugcugcggaug

SEQ ID NO: 48919 - RNA, 30 nt, Artificial Sequence
  Nuclear pore complex protein Nup160 (917-926)
gagaucgugagcaccccccgccugcaguac

SEQ ID NO: 48920 - RNA, 30 nt, Artificial Sequence
  Alpha-soluble NSF attachment protein (43-52)
gagaucuacgcccgcgccgcgaacauguuc

SEQ ID NO: 48921 - RNA, 30 nt, Artificial Sequence
  Isocitrate dehydrogenase (NADP) cytoplasmic (130-139)
gagaucuacgacaagcaguacaagagccag

SEQ ID NO: 48922 - RNA, 30 nt, Artificial Sequence
  Oligodendrocyte transcription factor 2 (209-218)
gagaucuacggcgggcaccacgccggcuuc

SEQ ID NO: 48923 - RNA, 39 nt, Artificial Sequence
  Splicing factor 3B subunit 1 (42-54)
gagaucuacggcgggagcgacucccgcuucgccggcuac

SEQ ID NO: 48924 - RNA, 27 nt, Artificial Sequence
  Plexin-C1 (1523-1531)
gagaucuacaaguacaucgugaaguac

SEQ ID NO: 48925 - RNA, 30 nt, Artificial Sequence
  Kinesin-like protein KIF2C (403-412)
gagaucuacaacggcaagcuguucgaccuc

SEQ ID NO: 48926 - RNA, 30 nt, Artificial Sequence
  Cyclin E variant ex7del (18-27)
gagaucuaccccccgaagcugcaccaguuc

SEQ ID NO: 48927 - RNA, 27 nt, Artificial Sequence
  Coatomer subunit beta' (352-360)
gagaucuacccccagaccauccagcac

SEQ ID NO: 48928 - RNA, 27 nt, Artificial Sequence
  Replication factor C subunit 2 (159-167)
gagaucuacagcaagaccacccgcuuc

SEQ ID NO: 48929 - RNA, 27 nt, Artificial Sequence
  Alpha-soluble NSF attachment protein (109-117)
gagaucuacaccgacaugggccgcuuc

SEQ ID NO: 48930 - RNA, 27 nt, Artificial Sequence
  FYVE and coiled-coil domain-containing protein 1 (1096-1104)
gagaaggccaccaccaagauccaggag

SEQ ID NO: 48931 - RNA, 27 nt, Artificial Sequence
  Tripartite motif-containing protein 42 (167-175)
gagaagugccugcgccagcuccagaag

SEQ ID NO: 48932 - RNA, 30 nt, Artificial Sequence
  Protein Mis18-beta (196-205)
gagaagaucgccgagcugaaggagaagauc

SEQ ID NO: 48933 - RNA, 30 nt, Artificial Sequence
  E3 ubiquitin-protein ligase TRIM13 (190-199)
gagaagcugcagcacacccucgaccagaag

SEQ ID NO: 48934 - RNA, 27 nt, Artificial Sequence
  AP-2 complex subunit alpha-1 (36-44)
gagcuggccaacauccgcagcaaguuc

SEQ ID NO: 48935 - RNA, 33 nt, Artificial Sequence
  L-dopachrome tautomerase (109-119)
gagcuggcccccaucggccacaaccgcauguac

SEQ ID NO: 48936 - RNA, 27 nt, Artificial Sequence
  Prelamin-A/C (122-130)
gagcuggacuuccagaagaacaucuac

SEQ ID NO: 48937 - RNA, 33 nt, Artificial Sequence
  Unconventional myosin-Va (1068-1078)
gagcuggaccucaacgacgagcgccugcgguac

SEQ ID NO: 48938 - RNA, 30 nt, Artificial Sequence
  Centrosomal protein of 112 kDa (922-931)
gagcuggaggacaccaucagcucccucaag

SEQ ID NO: 48939 - RNA, 30 nt, Artificial Sequence
  Coatomer subunit epsilon (18-27)
gagcuguucgacgugaagaacgccuucuac

SEQ ID NO: 48940 - RNA, 30 nt, Artificial Sequence
  Histone H2A deubiquitinase MYSM1 (25-34)
gagcuguucgagcagggccucgccaaguuc

SEQ ID NO: 48941 - RNA, 30 nt, Artificial Sequence
  General transcription factor II-I (326-335)
gagcuguucgagcgcaaguacgcccaggcc

SEQ ID NO: 48942 - RNA, 30 nt, Artificial Sequence
  Vacuolar protein sorting-associated protein 13A (890-899)
gagcuguuccacaaggacaucgaggccuuc

SEQ ID NO: 48943 - RNA, 36 nt, Artificial Sequence
  THO complex subunit 3 (40-51)
gagcuguuccgcggccacagcaagacccgggaguuc

SEQ ID NO: 48944 - RNA, 27 nt, Artificial Sequence
  Integrator complex subunit 8 (283-291)
gagcugaucgccgagaucggcagccuc

SEQ ID NO: 48945 - RNA, 33 nt, Artificial Sequence
  Influenza virus NS1A-binding protein (345-355)
gagcugaucgagaagcccaugagcccgaugcag

SEQ ID NO: 48946 - RNA, 33 nt, Artificial Sequence
  Switch-associated protein 70 (177-187)
gagcugaucgagcucaucggcaacgggcaguuc

SEQ ID NO: 48947 - RNA, 27 nt, Artificial Sequence
  Uncharacterized protein C20orf96 (128-136)
gagcugaucgagaccauccaggagaug

SEQ ID NO: 48948 - RNA, 33 nt, Artificial Sequence
  Derlin-1 (173-183)
gagcugaucggcaaccucguggggcaccuguac

SEQ ID NO: 48949 - RNA, 33 nt, Artificial Sequence
  Endoplasmin (169-179)
gagcugaucggccaguucggggugggcuucuac

SEQ ID NO: 48950 - RNA, 30 nt, Artificial Sequence
  High affinity cationic amino acid transporter 1 (138-147)
gagcugaucggccgccccaucggggaguuc

SEQ ID NO: 48951 - RNA, 27 nt, Artificial Sequence
  F-BAR domain only protein 2 (94-102)
gagcugaucaaggaggugcagaaguac

SEQ ID NO: 48952 - RNA, 27 nt, Artificial Sequence
  Regulatory-associated protein of mTOR (80-88)
gagcugaucaacaacaucaaguacuac

SEQ ID NO: 48953 - RNA, 27 nt, Artificial Sequence
  Heat shock protein HSP 90-alpha (498-506)
gagcugauccccgaguaccucaacuuc

SEQ ID NO: 48954 - RNA, 24 nt, Artificial Sequence
  ATP-dependent DNA helicase Q1 (34-41)
gagcugauccagaagaagaaggug

SEQ ID NO: 48955 - RNA, 27 nt, Artificial Sequence
  LisH domain-containing protein FOPNL (55-63)
gagcugauccgcgaguaccucgaguuc

SEQ ID NO: 48956 - RNA, 27 nt, Artificial Sequence
  Condensin complex subunit 1 (994-1002)
gagcugauccgcggcaucugcgagaug

SEQ ID NO: 48957 - RNA, 27 nt, Artificial Sequence
  Inositol-tetrakisphosphate 1-kinase (111-119)
gagcugauccgcaagaucgaggccuac

SEQ ID NO: 48958 - RNA, 27 nt, Artificial Sequence
  Probable ubiquitin carboxyl-terminal hydrolase FAF-X (1964-1972)
gagcugauccgcuacaucagcgagcuc

SEQ ID NO: 48959 - RNA, 27 nt, Artificial Sequence
  Cyclin-dependent kinase 17 (448-456)
gagcugaucaccaaguuccuccaguac

SEQ ID NO: 48960 - RNA, 33 nt, Artificial Sequence
  AP-1 complex subunit sigma-1A (76-86)
gagcugaucacccucgagcugauccaccgcuac

SEQ ID NO: 48961 - RNA, 27 nt, Artificial Sequence
  Ras GTPase-activating protein-binding protein 1 (355-363)
gagcugaaggacuucuuccagagcuac

SEQ ID NO: 48962 - RNA, 27 nt, Artificial Sequence
  Polypeptide N-acetylgalactosaminyltransferase 18 (200-208)
gagcugaaggagaagcucaccgaguac

SEQ ID NO: 48963 - RNA, 27 nt, Artificial Sequence
  Zinc finger CCCH domain-containing protein 13 (909-917)
gagcugaaggagaaggugagcuccguc

SEQ ID NO: 48964 - RNA, 27 nt, Artificial Sequence
  Ankyrin repeat and LEM domain-containing protein 2 (463-471)
gagcugaaggagcgcauccgggaguac

SEQ ID NO: 48965 - RNA, 27 nt, Artificial Sequence
  Histone-lysine N-methyltransferase SUV420H1 (136-144)
gagcugaaggaggugaucgagcgcuuc

SEQ ID NO: 48966 - RNA, 27 nt, Artificial Sequence
  Glyceraldehyde-3-phosphate dehydrogenase, testis-specific (295-303)
gagcugaagggcaagcucaccgggaug

SEQ ID NO: 48967 - RNA, 27 nt, Artificial Sequence
  Periphilin-1 (355-363)
gagcugaagcacuucaucgccgaguac

SEQ ID NO: 48968 - RNA, 27 nt, Artificial Sequence
  Probable ATP-dependent RNA helicase DDX46 (184-192)
gagcugaagaaggagaucgaggagaug

SEQ ID NO: 48969 - RNA, 27 nt, Artificial Sequence
  Serine/threonine-protein kinase Nek2 (90-98)
gagcugaagcucaaggagauccagcug

SEQ ID NO: 48970 - RNA, 27 nt, Artificial Sequence
  Golgin subfamily A member 4 (1075-1083)
gagcugaagcagaagauccuccuguuc

SEQ ID NO: 48971 - RNA, 27 nt, Artificial Sequence
  CAP-Gly domain-containing linker protein 1 (612-620)
gagcugaagacccagaucgagaagaug

SEQ ID NO: 48972 - RNA, 36 nt, Artificial Sequence
  Stromal cell-derived factor 2 (200-211)
gagcugcucaaggccgaggcccaccacgcggagcug

SEQ ID NO: 48973 - RNA, 24 nt, Artificial Sequence
  Heat shock protein 105 kDa (312-319)
gagcugcuccagaagaucgaggug

SEQ ID NO: 48974 - RNA, 33 nt, Artificial Sequence
  26S proteasome non-ATPase regulatory subunit 6 (212-222)
gagcugauggacuacaagaccuucgugaccuac

SEQ ID NO: 48975 - RNA, 30 nt, Artificial Sequence
  Centrosomal protein CEP57L1 (4-13)
gagcugaugcacagcaucgugggcuccuac

SEQ ID NO: 48976 - RNA, 30 nt, Artificial Sequence
  ATP-dependent RNA helicase DDX18 (213-222)
gagcugaugacccaccacgugcacaccuac

SEQ ID NO: 48977 - RNA, 30 nt, Artificial Sequence
  Puromycin-sensitive aminopeptidase (151-160)
gagcugaacgacaagaugaagggcuucuac

SEQ ID NO: 48978 - RNA, 27 nt, Artificial Sequence
  Vimentin (109-117)
gagcugaacgaccgcuucgccaacuac

SEQ ID NO: 48979 - RNA, 27 nt, Artificial Sequence
  Serine/threonine-protein kinase Nek2 (28-36)
gagcugaacgagaucaucacccgcaug

SEQ ID NO: 48980 - RNA, 27 nt, Artificial Sequence
  Semaphorin-4C (385-393)
gagcugcccgacaacauccucaacuuc

SEQ ID NO: 48981 - RNA, 27 nt, Artificial Sequence
  RNA polymerase II elongation factor ELL2 (524-532)
gagcugcccgacuaccucaucaaguac

SEQ ID NO: 48982 - RNA, 24 nt, Artificial Sequence
  Zinc finger CCCH domain-containing protein 4 (417-424)
gagcugcccaagaagcgcgagcuc

SEQ ID NO: 48983 - RNA, 27 nt, Artificial Sequence
  Nuclear pore complex protein Nup205 (523-531)
gagcugcagggccacaucgggcgcuuc

SEQ ID NO: 48984 - RNA, 30 nt, Artificial Sequence
  Alpha-enolase (15-24)
gagcugcgcgacaacgacaagacccgguac

SEQ ID NO: 48985 - RNA, 27 nt, Artificial Sequence
  TAR DNA-binding protein 43 (206-214)
gagcugcgcgaguucuucagccaguac

SEQ ID NO: 48986 - RNA, 27 nt, Artificial Sequence
  Serine/threonine-protein kinase TAO3 (456-464)
gagcugcgcgagcagaugagcggcuac

SEQ ID NO: 48987 - RNA, 27 nt, Artificial Sequence
  Rho guanine nucleotide exchange factor 2 (258-266)
gagcugagcgacauccacacccgcuuc

SEQ ID NO: 48988 - RNA, 27 nt, Artificial Sequence
  dCTP pyrophosphatase 1 (95-103)
gagcugagcgacgugcucaucuaccug

SEQ ID NO: 48989 - RNA, 27 nt, Artificial Sequence
  Protein phosphatase 1 regulatory subunit 12A (956-964)
gagcugaccgaccucaagcugcagcug

SEQ ID NO: 48990 - RNA, 33 nt, Artificial Sequence
  Clustered mitochondria protein homolog (607-617)
gagcugguggacgccuucgucgagcaccgcuac

SEQ ID NO: 48991 - RNA, 27 nt, Artificial Sequence
  Splicing factor 3B subunit 2 (26-34)
gagcugguggagcgccuccagagcuac

SEQ ID NO: 48992 - RNA, 36 nt, Artificial Sequence
  F-box only protein 34 (410-421)
gagcuggugggccuccccuucagcucccacaccuac

SEQ ID NO: 48993 - RNA, 27 nt, Artificial Sequence
  Inositol-tetrakisphosphate 1-kinase (76-84)
gagcuggugcaccgcuuccaggaguac

SEQ ID NO: 48994 - RNA, 27 nt, Artificial Sequence
  Protein DEK (174-182)
gagcuggugaagcgcauccucaacuuc

SEQ ID NO: 48995 - RNA, 30 nt, Artificial Sequence
  Sorting nexin-4 (344-353)
gagcuggugaccggcaccguccgcacguuc

SEQ ID NO: 48996 - RNA, 27 nt, Artificial Sequence
  DNA replication complex GINS protein PSF2 (13-21)
gagcuggugaccaucauccccaacuuc

SEQ ID NO: 48997 - RNA, 30 nt, Artificial Sequence
  U3 small nucleolar RNA-associated protein 15 homolog (362-371)
gagcuguacgaccgcgaccucaagcacuuc

SEQ ID NO: 48998 - RNA, 30 nt, Artificial Sequence
  Pumilio homolog 3 (274-283)
gagcuguacggcaacaccuuccagcucuac

SEQ ID NO: 48999 - RNA, 27 nt, Artificial Sequence
  TELO2-interacting protein 1 homolog (510-518)
gagcuguaccaccagagcguggucuac

SEQ ID NO: 49000 - RNA, 30 nt, Artificial Sequence
  Protein RRP5 homolog (1712-1721)
gagcuguacaaccgcaugcucaagcgguuc

SEQ ID NO: 49001 - RNA, 30 nt, Artificial Sequence
  Tetratricopeptide repeat protein 37 (950-959)
gagcuguaccaguacaacauccuccagaug

SEQ ID NO: 49002 - RNA, 27 nt, Artificial Sequence
  Vacuolar fusion protein CCZ1 homolog (448-456)
gagcuguacgugauccucaaccagaag

SEQ ID NO: 49003 - RNA, 30 nt, Artificial Sequence
  Clathrin heavy chain 1 (1402-1411)
gagcuguacuaccgcgccauccaguucuac

SEQ ID NO: 49004 - RNA, 27 nt, Artificial Sequence
  Dedicator of cytokinesis protein 7 (167-175)
gagaugaaggaccgcaucaccuacuuc

SEQ ID NO: 49005 - RNA, 27 nt, Artificial Sequence
  Kinetochore-associated protein DSN1 homolog (194-202)
gagaugaaggaguacaucaccaaguuc

SEQ ID NO: 49006 - RNA, 27 nt, Artificial Sequence
  Actin-related protein 5 (513-521)
gagaugcgccccuuccggagcuccuuc

SEQ ID NO: 49007 - RNA, 33 nt, Artificial Sequence
  5,6-dihydroxyindole-2-carboxylic acid oxidase (428-438)
gagaacgcccccaucggccacaaccgccaguac

SEQ ID NO: 49008 - RNA, 33 nt, Artificial Sequence
  Eukaryotic translation initiation factor 3 subunit L (295-305)
gagaacaucgagcugaacaagaagagcauguac

SEQ ID NO: 49009 - RNA, 27 nt, Artificial Sequence
  Inositol-3-phosphate synthase 1 (246-254)
gagaaccugcuccgcaccaucgagcug

SEQ ID NO: 49010 - RNA, 27 nt, Artificial Sequence
  15-hydroxyprostaglandin dehydrogenase (NAD(+)) (198-206)
gagaacaugggccaguacaucgaguac

SEQ ID NO: 49011 - RNA, 27 nt, Artificial Sequence
  Mitogen-activated protein kinase 8 (261-269)
gagaaccgccccaaguacgccggcuac

SEQ ID NO: 49012 - RNA, 27 nt, Artificial Sequence
  THO complex subunit 1 (70-78)
gagaacgugcuggccaucaucagccuc

SEQ ID NO: 49013 - RNA, 30 nt, Artificial Sequence
  Protein-methionine sulfoxide oxidase MICAL1 (261-270)
gagcagcaccccggcgacgggcacuucuac

SEQ ID NO: 49014 - RNA, 27 nt, Artificial Sequence
  Gamma-tubulin complex component 2 (486-494)
gagcagaucgagaaggccuucaacuac

SEQ ID NO: 49015 - RNA, 27 nt, Artificial Sequence
  Dual specificity protein phosphatase 19 (169-177)
gagcagaccagcuucaccuccgccuuc

SEQ ID NO: 49016 - RNA, 27 nt, Artificial Sequence
  Semaphorin-4C (402-410)
gagcaggugggcccccgcuggagccgg

SEQ ID NO: 49017 - RNA, 27 nt, Artificial Sequence
  Eukaryotic translation initiation factor 3 subunit A (577-585)
gagcgcaaggagcggcuggagagccuc

SEQ ID NO: 49018 - RNA, 27 nt, Artificial Sequence
  Protein enabled homolog (159-167)
gagcgccuggagcggcaggagcgccuc

SEQ ID NO: 49019 - RNA, 24 nt, Artificial Sequence
  Endoplasmin (719-726)
gagcgcaugcugcggcucagccug

SEQ ID NO: 49020 - RNA, 27 nt, Artificial Sequence
  Nuclear factor NF-kappa-B p100 subunit (588-596)
gagcgccagggcgggcggaccgcccug

SEQ ID NO: 49021 - RNA, 27 nt, Artificial Sequence
  Dual specificity protein phosphatase 4 (110-118)
gagcgcagcccccgggccgagucccug

SEQ ID NO: 49022 - RNA, 27 nt, Artificial Sequence
  Zinc finger protein 264 (382-390)
gagagcgccgcccugauccaccacuac

SEQ ID NO: 49023 - RNA, 27 nt, Artificial Sequence
  Histone acetyltransferase p300 (621-629)
gagagcgccaacaaccgcgccgaguac

SEQ ID NO: 49024 - RNA, 33 nt, Artificial Sequence
  Glutamine and serine-rich protein 1 (139-149)
gagagcgccccccaccugcuccagccgcaguuc

SEQ ID NO: 49025 - RNA, 30 nt, Artificial Sequence
  Chromodomain-helicase-DNA-binding protein 9 (1356-1365)
gagagcgccuacauccugcagggcggguac

SEQ ID NO: 49026 - RNA, 30 nt, Artificial Sequence
  Protein fem-1 homolog B (29-38)
gagagcgacauccgcuaccugcucggcuac

SEQ ID NO: 49027 - RNA, 33 nt, Artificial Sequence
  ER membrane protein complex subunit 1 (169-179)
gagagcgacuccauccacuaccagaugguguac

SEQ ID NO: 49028 - RNA, 30 nt, Artificial Sequence
  Prolyl endopeptidase FAP (88-97)
gagagcgacuacuccaagcuguggcgcuac

SEQ ID NO: 49029 - RNA, 30 nt, Artificial Sequence
  28S ribosomal protein S18b, mitochondrial (60-69)
gagagcgaggaguaccaggagcgcuacggc

SEQ ID NO: 49030 - RNA, 36 nt, Artificial Sequence
  CD109 antigen (1076-1087)
gagagcgaguucucccgcggcaucagcgacaacuac

SEQ ID NO: 49031 - RNA, 24 nt, Artificial Sequence
  Asparagine synthetase (glutamine-hydrolyzing) (389-396)
gagagcgagcgccugcuccgggag

SEQ ID NO: 49032 - RNA, 30 nt, Artificial Sequence
  Serine/threonine-protein kinase Nek3 (67-76)
gagagcuucgaggccgagggccaccuguac

SEQ ID NO: 49033 - RNA, 27 nt, Artificial Sequence
  Sestrin-3 (9-17)
gagagcuuccugcgcucccaguucuac

SEQ ID NO: 49034 - RNA, 33 nt, Artificial Sequence
  Torsin-1A-interacting protein 2 (368-378)
gagagcuuccccgccggcuccacccugaucuuc

SEQ ID NO: 49035 - RNA, 36 nt, Artificial Sequence
  Torsin-1A-interacting protein 2 (368-379)
gagagcuuccccgccggcuccacccugaucuucuac

SEQ ID NO: 49036 - RNA, 30 nt, Artificial Sequence
  Cell division cycle-associated protein 7 (137-146)
gagagcuuccccggcuccuuccgcgggcgg

SEQ ID NO: 49037 - RNA, 36 nt, Artificial Sequence
  Putative elongation factor 1-alpha-like 3 (413-424)
gagagcuucuccgacuaccccccgcugggccgcuuc

SEQ ID NO: 49038 - RNA, 30 nt, Artificial Sequence
  Dual specificity protein kinase TTK (197-206)
gagagcuucuccggcagccuggggcaccuc

SEQ ID NO: 49039 - RNA, 27 nt, Artificial Sequence
  ER degradation-enhancing alpha-mannosidase-like protein 2 (361-369)
gagagcaucgagaagaucuccaaggug

SEQ ID NO: 49040 - RNA, 33 nt, Artificial Sequence
  E3 ubiquitin-protein ligase HECTD1 (531-541)
gagagcaucgagcgccugccccuccaccuguac

SEQ ID NO: 49041 - RNA, 27 nt, Artificial Sequence
  Zinc-binding alcohol dehydrogenase domain-containing protein 2 (347-355)
gagagcaucuuccgcgccgugaacuac

SEQ ID NO: 49042 - RNA, 30 nt, Artificial Sequence
  GATA zinc finger domain-containing protein 1 (140-149)
gagagcaucuucuacaagggcguguacuac

SEQ ID NO: 49043 - RNA, 27 nt, Artificial Sequence
  Abnormal spindle-like microcephaly-associated protein (62-70)
gagagcauccugaccauccagaaguac

SEQ ID NO: 49044 - RNA, 39 nt, Artificial Sequence
  Ceramide synthase 4 (291-303)
gagagcaucuccaaccgcggccccuucuucggguacuac

SEQ ID NO: 49045 - RNA, 39 nt, Artificial Sequence
  Leucine-rich repeat-containing protein 9 (566-578)
gagagcaucucccagagcaacuaccccauggugaacucc

SEQ ID NO: 49046 - RNA, 30 nt, Artificial Sequence
  Cytochrome b5 domain-containing protein 1 (157-166)
gagagcaucugggagauccugcaccgcuac

SEQ ID NO: 49047 - RNA, 27 nt, Artificial Sequence
  Poly (ADP-ribose) polymerase 9 (164-172)
gagagcaagcaguucguggcccgcuac

SEQ ID NO: 49048 - RNA, 27 nt, Artificial Sequence
  Coiled-coil domain-containing protein 158 (458-466)
gagagccuggagaagguguccagccuc

SEQ ID NO: 49049 - RNA, 33 nt, Artificial Sequence
  Leucine-rich repeat-containing protein 57 (51-61)
gagagccugcccccgcuccugaucggcaaguuc

SEQ ID NO: 49050 - RNA, 30 nt, Artificial Sequence
  N-acetylglucosamine-1-phosphotransferase subunits alpha/beta (1173-1182)
gagagcauguuccccaucccgucccaguuc

SEQ ID NO: 49051 - RNA, 33 nt, Artificial Sequence
  Protein disulfide-isomerase A3 (36-46)
gagagccgcaucuccgacaccggcagcgccggg

SEQ ID NO: 49052 - RNA, 27 nt, Artificial Sequence
  BRCA1-A complex subunit BRE (134-142)
gagagcucccgccugauguucgaguac

SEQ ID NO: 49053 - RNA, 27 nt, Artificial Sequence
  Protein FAM135A (825-833)
gagagcaccuccgccaucagcgagauc

SEQ ID NO: 49054 - RNA, 27 nt, Artificial Sequence
  Transcriptional enhancer factor TEF-1 (240-248)
gagagcguggacauccgccagaucuac

SEQ ID NO: 49055 - RNA, 30 nt, Artificial Sequence
  OTU domain-containing protein 7B (579-588)
gagagcgugggcaacgggggcuccaaguac

SEQ ID NO: 49056 - RNA, 27 nt, Artificial Sequence
  Scm-like with four MBT domains protein 1 (492-500)
gagagcgugaugaucaacggcaaguac

SEQ ID NO: 49057 - RNA, 27 nt, Artificial Sequence
  Tensin-1 (839-847)
gagagcgugcccccgggccgcuccuac

SEQ ID NO: 49058 - RNA, 30 nt, Artificial Sequence
  Zinc transporter ZIP6 (242-251)
gagagcguguccgagccccgcaagggcuuc

SEQ ID NO: 49059 - RNA, 30 nt, Artificial Sequence
  26S proteasome non-ATPase regulatory subunit 6 (309-318)
gagagcuaccgcucccugacccucggcuac

SEQ ID NO: 49060 - RNA, 30 nt, Artificial Sequence
  Exonuclease 1 (584-593)
gagagcuacuccuucgagagcuccaaguuc

SEQ ID NO: 49061 - RNA, 24 nt, Artificial Sequence
  Lactosylceramide alpha-2,3-sialyltransferase (260-267)
gagaccgccuucgacauccugcag

SEQ ID NO: 49062 - RNA, 33 nt, Artificial Sequence
  Transcription factor SOX-10 (359-369)
gagaccgccggcccccaggggccgccccacuac

SEQ ID NO: 49063 - RNA, 27 nt, Artificial Sequence
  DNA-directed RNA polymerases I, II, and III subunit RPABC1 (198-206)
gagaccgccggccgcuacaucaccuac

SEQ ID NO: 49064 - RNA, 36 nt, Artificial Sequence
  HLA class I histocompatibility antigen, A-66 alpha chain (147-158)
gagaccgcccacgaggccgagcaguggcgcgcguac

SEQ ID NO: 49065 - RNA, 30 nt, Artificial Sequence
  Actin-related protein 3 (171-180)
gagaccgccaaggccgugaaggagcgcuac

SEQ ID NO: 49066 - RNA, 33 nt, Artificial Sequence
  Protein S100-A1 (6-16)
gagaccgccauggagacccugaucaacguguuc

SEQ ID NO: 49067 - RNA, 33 nt, Artificial Sequence
  ATP-binding cassette sub-family E member 1 (335-345)
gagaccgccaacgaggaggaggugaagaagaug

SEQ ID NO: 49068 - RNA, 30 nt, Artificial Sequence
  YLP motif-containing protein 1 (228-237)
gagaccgccccccgccacaugaugcggcug

SEQ ID NO: 49069 - RNA, 33 nt, Artificial Sequence
  Ataxin-10 (40-50)
gagaccgccccccgcaccaucuuccagcgggug

SEQ ID NO: 49070 - RNA, 27 nt, Artificial Sequence
  Protein cordon-bleu (683-691)
gagaccgccccccgcgugaccagcuuc

SEQ ID NO: 49071 - RNA, 27 nt, Artificial Sequence
  Alpha-1,3-mannosyl-glycoprotein 2-beta-N-acetylglucosaminyltransferase (147-155)
gagaccgcccaggccaucgcgagcuac

SEQ ID NO: 49072 - RNA, 27 nt, Artificial Sequence
  Exocyst complex component 8 (72-80)
gagaccgcccgcgagaucagcuaccug

SEQ ID NO: 49073 - RNA, 27 nt, Artificial Sequence
  Tudor domain-containing protein 7 (5-13)
gagaccgcccgcaucgcccagcuggug

SEQ ID NO: 49074 - RNA, 30 nt, Artificial Sequence
  Spectrin beta chain, non-erythrocytic 1 (1262-1271)
gagaccgccagcgagcugcucaugcgccug

SEQ ID NO: 49075 - RNA, 30 nt, Artificial Sequence
  E3 ubiquitin-protein ligase RNF213 (3983-3992)
gagaccgccagcaagacccugucccgcuuc

SEQ ID NO: 49076 - RNA, 33 nt, Artificial Sequence
  Kinesin-like protein KIF2C (317-327)
gagaccgccagcaacgagguggucuaccgcuuc

SEQ ID NO: 49077 - RNA, 27 nt, Artificial Sequence
  Protein furry homolog-like (371-379)
gagaccgccagccgcaucgccaaggug

SEQ ID NO: 49078 - RNA, 27 nt, Artificial Sequence
  Endoplasmin (698-706)
gagaccgccacccugcgcagcggcuac

SEQ ID NO: 49079 - RNA, 33 nt, Artificial Sequence
  2'-5'-oligoadenylate synthase 1 (355-365)
gagaccgacgacccccgccgguaccagaaguac

SEQ ID NO: 49080 - RNA, 27 nt, Artificial Sequence
  Putative pre-mRNA-splicing factor ATP-dependent RNA helicase DHX32 (324-332)
gagaccgagaagcgcugccagguguac

SEQ ID NO: 49081 - RNA, 42 nt, Artificial Sequence
  Sorting nexin-17 (7-20)
gagaccgagagccgcuccggcgacagcgggggcuccgccuac

SEQ ID NO: 49082 - RNA, 33 nt, Artificial Sequence
  Caldesmon (164-174)
gagaccgagaccgugacgaagagcuaccagaag

SEQ ID NO: 49083 - RNA, 30 nt, Artificial Sequence
  Deoxyhypusine synthase (353-362)
gagaccuucgcccagaagauggacgccuuc

SEQ ID NO: 49084 - RNA, 30 nt, Artificial Sequence
  Cytoplasmic dynein 1 heavy chain 1 (1934-1943)
gagaccuucgacuuccaggccaugggccgc

SEQ ID NO: 49085 - RNA, 33 nt, Artificial Sequence
  Protein FAM127B (29-39)
gagaccuucgacggcgacaccgaccgccugccc

SEQ ID NO: 49086 - RNA, 39 nt, Artificial Sequence
  Nicastrin (333-345)
gagaccuucgacuacaucggcagcucccgcaugguguac

SEQ ID NO: 49087 - RNA, 27 nt, Artificial Sequence
  CAAX prenyl protease 1 homolog (62-70)
gagaccuucgagaagagccgccuguac

SEQ ID NO: 49088 - RNA, 33 nt, Artificial Sequence
  Ceramide glucosyltransferase (71-81)
gagaccuucuucgagcuggacuaccccaaguac

SEQ ID NO: 49089 - RNA, 30 nt, Artificial Sequence
  Mediator of RNA polymerase II transcription subunit 13-like (1814-1823)
gagaccuucggcgaggccagccagaaguac

SEQ ID NO: 49090 - RNA, 27 nt, Artificial Sequence
  Eukaryotic peptide chain release factor GTP-binding subunit ERF3A (465-473)
gagaccuucaaggacuucccccagaug

SEQ ID NO: 49091 - RNA, 36 nt, Artificial Sequence
  Eukaryotic peptide chain release factor GTP-binding subunit ERF3A (465-476)
gagaccuucaaggacuucccccagaugggccgcuuc

SEQ ID NO: 49092 - RNA, 30 nt, Artificial Sequence
  Kv channel-interacting protein 4 isoform 5 (81-90)
gagaccuucaaggagaucuacagccaguuc

SEQ ID NO: 49093 - RNA, 30 nt, Artificial Sequence
  Dephospho-CoA kinase domain-containing protein (98-107)
gagaccuucaaguacuuccugcgcggcuac

SEQ ID NO: 49094 - RNA, 33 nt, Artificial Sequence
  Proteasome-associated protein ECM29 homolog (349-359)
gagaccuuccccgccaacauccagguggucuac

SEQ ID NO: 49095 - RNA, 30 nt, Artificial Sequence
  Telomeric repeat-binding factor 2 (175-184)
gagaccuuccagcagaagaugcugcgcuuc

SEQ ID NO: 49096 - RNA, 27 nt, Artificial Sequence
  E3 ubiquitin-protein ligase RNF213 (2162-2170)
gagaccuuccagcgccccuaccaguac

SEQ ID NO: 49097 - RNA, 30 nt, Artificial Sequence
  Uncharacterized protein C7orf43 (200-209)
gagaccuuccgcggcgagcagagcgccuuc

SEQ ID NO: 49098 - RNA, 30 nt, Artificial Sequence
  40S ribosomal protein S7 (169-178)
gagaccuucagcggcguguacaagaagcug

SEQ ID NO: 49099 - RNA, 27 nt, Artificial Sequence
  Protein SGT1 homolog (78-86)
gagaccuucaccgagggccagaagcug

SEQ ID NO: 49100 - RNA, 27 nt, Artificial Sequence
  Mitotic spindle assembly checkpoint protein MAD2A (41-49)
gagaccuucacccgcgugcagaaguac

SEQ ID NO: 49101 - RNA, 30 nt, Artificial Sequence
  Src substrate cortactin (75-84)
gagaccggccccaaggccagccacggguac

SEQ ID NO: 49102 - RNA, 33 nt, Artificial Sequence
  Tetratricopeptide repeat protein 17 (861-871)
gagaccggccagaucgagaacgggcaccgcuac

SEQ ID NO: 49103 - RNA, 27 nt, Artificial Sequence
  Inositol 1,4,5-trisphosphate receptor type 2 (1301-1309)
gagacccacggccgccacguggaguac

SEQ ID NO: 49104 - RNA, 27 nt, Artificial Sequence
  L-dopachrome tautomerase (196-204)
gagacccaccugagcuccaagcgcuac

SEQ ID NO: 49105 - RNA, 33 nt, Artificial Sequence
  Nucleoside diphosphate kinase homolog 5 (107-117)
gagacccaccccgacagccugcgcgccaucuac

SEQ ID NO: 49106 - RNA, 30 nt, Artificial Sequence
  Conserved oligomeric Golgi complex subunit 4 (61-70)
gagacccaccagcccaucguggagaccuac

SEQ ID NO: 49107 - RNA, 30 nt, Artificial Sequence
  Nuclear autoantigenic sperm protein (246-255)
gagacccacuaccagcugggccucgccuac

SEQ ID NO: 49108 - RNA, 27 nt, Artificial Sequence
  Glutamine-fructose-6-phosphate aminotransferase (isomerizing) 1 (27-35)
gagaccaucgccaagcuggugaaguac

SEQ ID NO: 49109 - RNA, 36 nt, Artificial Sequence
  Splicing factor 3A subunit 2 (36-47)
gagaccaucgacaucaacaaggaccccuacuucaug

SEQ ID NO: 49110 - RNA, 27 nt, Artificial Sequence
  Alpha-aminoadipic semialdehyde synthase, mitochondrial (614-622)
gagaccaucgacaaggccaaggaggug

SEQ ID NO: 49111 - RNA, 30 nt, Artificial Sequence
  HEAT repeat-containing protein 5B (1515-1524)
gagaccaucgacaccgcccgccugcacuac

SEQ ID NO: 49112 - RNA, 33 nt, Artificial Sequence
  Methylsterol monooxygenase 1 (92-102)
gagaccaucgacgugcacagcggcuacgacauc

SEQ ID NO: 49113 - RNA, 27 nt, Artificial Sequence
  Threonine-tRNA ligase, cytoplasmic (692-700)
gagaccaucgagcgccugcagcagcuc

SEQ ID NO: 49114 - RNA, 27 nt, Artificial Sequence
  TBC1 domain family member 10A (329-337)
gagaccaucgagcgccugcggagccuc

SEQ ID NO: 49115 - RNA, 39 nt, Artificial Sequence
  GRIP and coiled-coil domain-containing protein 1 (19-31)
gagaccaucgagacccagaagaagcagcugcuccaguac

SEQ ID NO: 49116 - RNA, 27 nt, Artificial Sequence
  DNA-directed RNA polymerase III subunit RPC3 (517-525)
gagaccaucuuccugcucgagagcuac

SEQ ID NO: 49117 - RNA, 27 nt, Artificial Sequence
  Dynamin-like 120 kDa protein, mitochondrial (435-443)
gagaccaucuucagcaucuccaaggcc

SEQ ID NO: 49118 - RNA, 33 nt, Artificial Sequence
  Regulatory-associated protein of mTOR (100-110)
gagaccaucggcgccaaccugcagaagcaguac

SEQ ID NO: 49119 - RNA, 27 nt, Artificial Sequence
  Heterogeneous nuclear ribonucleoprotein K (95-103)
gagaccaucggcgagauccugaagaag

SEQ ID NO: 49120 - RNA, 27 nt, Artificial Sequence
  X-ray repair cross-complementing protein 5 (17-25)
gagaccaucggcaagaaguucgagaag

SEQ ID NO: 49121 - RNA, 36 nt, Artificial Sequence
  Superkiller viralicidic activity 2-like 2 (269-280)
gagaccaucauccugcuccccgacaacgugcacuac

SEQ ID NO: 49122 - RNA, 33 nt, Artificial Sequence
  Golgi-specific brefeldin A-resistance guanine nucleotide exchange factor 1 (948-958)
gagaccaucauccagaaggccaucagcggcuuc

SEQ ID NO: 49123 - RNA, 30 nt, Artificial Sequence
  Inositol polyphosphate multikinase (205-214)
gagaccaucaaggacggcgugagccgcuuc

SEQ ID NO: 49124 - RNA, 30 nt, Artificial Sequence
  Cyclin-dependent kinase 4 (41-50)
gagaccaucaaggaccugaugcgccaguuc

SEQ ID NO: 49125 - RNA, 36 nt, Artificial Sequence
  Ral GTPase-activating protein subunit beta (590-601)
gagaccauccugcccgaccgcgagcucagcaaguuc

SEQ ID NO: 49126 - RNA, 30 nt, Artificial Sequence
  Mitochondrial Rho GTPase 1 (129-138)
gagaccauccugcccaucaugaaccaguac

SEQ ID NO: 49127 - RNA, 27 nt, Artificial Sequence
  Sodium-dependent neutral amino acid transporter B(0)AT2 (81-89)
gagaccaucaugaaguuccugaagaug

SEQ ID NO: 49128 - RNA, 27 nt, Artificial Sequence
  Rab GDP dissociation inhibitor beta (124-132)
gagaccaucaaccgcaucaagcuguac

SEQ ID NO: 49129 - RNA, 27 nt, Artificial Sequence
  cAMP-specific 3',5'-cyclic phosphodiesterase 4B (104-112)
gagaccauccagaccuaccgcagcgug

SEQ ID NO: 49130 - RNA, 30 nt, Artificial Sequence
  Platelet-derived growth factor D (54-63)
gagaccauccaggugaagggcaacggguac

SEQ ID NO: 49131 - RNA, 27 nt, Artificial Sequence
  Vacuolar protein-sorting-associated protein 36 (204-212)
gagaccauccgcuucaagagcuaccug

SEQ ID NO: 49132 - RNA, 27 nt, Artificial Sequence
  Transmembrane protein 260 (666-674)
gagaccauccgccacuuccggcuguac

SEQ ID NO: 49133 - RNA, 30 nt, Artificial Sequence
  Probable ATP-dependent RNA helicase DDX41 (307-316)
gagaccauccgccacggcgugcacaugaug

SEQ ID NO: 49134 - RNA, 27 nt, Artificial Sequence
  Lysophospholipid acyltransferase 7 (297-305)
gagaccauccgcaacaucgacugcuac

SEQ ID NO: 49135 - RNA, 27 nt, Artificial Sequence
  HAUS augmin-like complex subunit 2 (20-28)
gagaccauccgcaacaucccccaccug

SEQ ID NO: 49136 - RNA, 30 nt, Artificial Sequence
  Dynamin-2 (654-663)
gagaccauccgcaaccugguggacagcuac

SEQ ID NO: 49137 - RNA, 27 nt, Artificial Sequence
  Basic leucine zipper and W2 domain-containing protein 2 (106-114)
gagaccauccgcaacuacgcccaggug

SEQ ID NO: 49138 - RNA, 27 nt, Artificial Sequence
  T-complex protein 1 subunit alpha (15-23)
gagaccauccgcagccagaacgugaug

SEQ ID NO: 49139 - RNA, 27 nt, Artificial Sequence
  Zinc finger FYVE domain-containing protein 16 (802-810)
gagaccaucagcaaggcccaggccuuc

SEQ ID NO: 49140 - RNA, 27 nt, Artificial Sequence
  dTDP-D-glucose 4,6-dehydratase (30-38)
gagaccaucagcaacaagcagaacuac

SEQ ID NO: 49141 - RNA, 36 nt, Artificial Sequence
  Lysosomal glucocerebrosidase (500-511)
gagaccaucagccccggcuacuccauccacaccuac

SEQ ID NO: 49142 - RNA, 27 nt, Artificial Sequence
  Delta(14)-sterol reductase (327-335)
gagaccaucagcaccgccacgggccgc

SEQ ID NO: 49143 - RNA, 33 nt, Artificial Sequence
  UDP-N-acetylhexosamine pyrophosphorylase (460-470)
gagaccaucaccgccgacgugaaccacaaccug

SEQ ID NO: 49144 - RNA, 27 nt, Artificial Sequence
  THO complex subunit 2 (857-865)
gagaccaucaccaaguuccugcagcuc

SEQ ID NO: 49145 - RNA, 33 nt, Artificial Sequence
  S-phase kinase-associated protein 2 (283-293)
gagaccaucacccagcugaaccucagcggcuac

SEQ ID NO: 49146 - RNA, 33 nt, Artificial Sequence
  Minor histocompatibility antigen H13 (68-78)
gagaccaucaccagccgcgacgccgcccgguuc

SEQ ID NO: 49147 - RNA, 27 nt, Artificial Sequence
  DNA repair protein complementing XP-A cells (180-188)
gagaccaucgugcaccagcacgaguac

SEQ ID NO: 49148 - RNA, 27 nt, Artificial Sequence
  Disco-interacting protein 2 homolog B (143-151)
gagaccaucgugaacguccuggacuuc

SEQ ID NO: 49149 - RNA, 30 nt, Artificial Sequence
  Tumor suppressor candidate 2 (66-75)
gagaccaucgugaccaagaacggccagaag

SEQ ID NO: 49150 - RNA, 30 nt, Artificial Sequence
  RuvB-like 2 (169-178)
gagaccaucuacgaccugggcaccaagaug

SEQ ID NO: 49151 - RNA, 33 nt, Artificial Sequence
  Mediator of RNA polymerase II transcription subunit 23 (553-563)
gagaccaucuacggcaacgggaucaugcgcauc

SEQ ID NO: 49152 - RNA, 27 nt, Artificial Sequence
  Peroxisome biogenesis factor 1 (491-499)
gagaccaaggacggccugaaggaguuc

SEQ ID NO: 49153 - RNA, 27 nt, Artificial Sequence
  F-box only protein 38 (25-33)
gagaccaaggacuacaugaaccagcug

SEQ ID NO: 49154 - RNA, 33 nt, Artificial Sequence
  Destrin (90-100)
gagaccaaggagagccgcaaggaggagcugaug

SEQ ID NO: 49155 - RNA, 27 nt, Artificial Sequence
  Dynein light chain 1, cytoplasmic (69-77)
gagaccaagcacuucaucuacuucuac

SEQ ID NO: 49156 - RNA, 27 nt, Artificial Sequence
  ATP-dependent RNA helicase DDX50 (83-91)
gagaccaagaagaacgugaccgagaug

SEQ ID NO: 49157 - RNA, 27 nt, Artificial Sequence
  Protein LTV1 homolog (235-243)
gagaccaagagccgcuucaccgaguac

SEQ ID NO: 49158 - RNA, 27 nt, Artificial Sequence
  UPF0462 protein C4orf33 (111-119)
gagaccaagugggagggcaaggccuac

SEQ ID NO: 49159 - RNA, 30 nt, Artificial Sequence
  Alpha-centractin (232-241)
gagacccuggagaccgagaaggcccaguac

SEQ ID NO: 49160 - RNA, 33 nt, Artificial Sequence
  Alpha-centractin (232-242)
gagacccuggagaccgagaaggcccaguacuac

SEQ ID NO: 49161 - RNA, 27 nt, Artificial Sequence
  Heterogeneous nuclear ribonucleoprotein L (557-565)
gagacccugggcuuccucaaccacuac

SEQ ID NO: 49162 - RNA, 30 nt, Artificial Sequence
  Truncated extracellular matrix protein 1 (208-217)
gagacccugaacuuccucgagaucggcuac

SEQ ID NO: 49163 - RNA, 33 nt, Artificial Sequence
  HEAT repeat-containing protein 1 (1769-1779)
gagacccugccccacuucaucagcccguaccuc

SEQ ID NO: 49164 - RNA, 27 nt, Artificial Sequence
  Neuron navigator 2 (931-939)
gagacccugcagcgcaacaccagccuc

SEQ ID NO: 49165 - RNA, 30 nt, Artificial Sequence
  LIM domain-binding protein 3 (205-214)
gagacccugcgcgagauggcccagauguac

SEQ ID NO: 49166 - RNA, 30 nt, Artificial Sequence
  Transient receptor potential cation channel subfamily M member 7 (239-248)
gagaccauggccaugaagcugcucaccuac

SEQ ID NO: 49167 - RNA, 39 nt, Artificial Sequence
  Nucleoporin NUP188 homolog (30-42)
gagaccauggaccccuucguggaccgcaucggcuacuuc

SEQ ID NO: 49168 - RNA, 39 nt, Artificial Sequence
  Aldehyde dehydrogenase family 1 member A3 (118-130)
gagaccauggacaccggcaagcccuuccugcacgccuuc

SEQ ID NO: 49169 - RNA, 33 nt, Artificial Sequence
  Myosin-10 (328-338)
gagaccauggaggccaugcacaucaugggcuuc

SEQ ID NO: 49170 - RNA, 30 nt, Artificial Sequence
  Heterogeneous nuclear ribonucleoprotein H (76-85)
gagaccaugggccaccgcuacguggagguc

SEQ ID NO: 49171 - RNA, 27 nt, Artificial Sequence
  ETS-related transcription factor Elf-2 (173-181)
gagaccaugggccgcgcccugcgguac

SEQ ID NO: 49172 - RNA, 27 nt, Artificial Sequence
  Serine/threonine-protein phosphatase 4 regulatory subunit 2 (37-45)
gagaccaugauccaguggagccaguuc

SEQ ID NO: 49173 - RNA, 27 nt, Artificial Sequence
  Apolipoprotein E (84-92)
gagaccaugaaggagcugaaggccuac

SEQ ID NO: 49174 - RNA, 27 nt, Artificial Sequence
  Ribosome-recycling factor, mitochondrial (153-161)
gagaccaugaagcagaucaagcaguac

SEQ ID NO: 49175 - RNA, 30 nt, Artificial Sequence
  Interferon-induced protein with tetratricopeptide repeats 1 (375-384)
gagaccaugcaggacauccacuuccacuac

SEQ ID NO: 49176 - RNA, 33 nt, Artificial Sequence
  Inositol 1,4,5-trisphosphate receptor type 3 (1262-1272)
gagaccaugcagcacaucuuccugaacaacuac

SEQ ID NO: 49177 - RNA, 30 nt, Artificial Sequence
  TRPM8 channel-associated factor 1 (132-141)
gagaccaugaccgagaagcuggugaaguuc

SEQ ID NO: 49178 - RNA, 30 nt, Artificial Sequence
  Carnitine O-acetyltransferase (515-524)
gagaccaacgccgcccgccuggcgcacuac

SEQ ID NO: 49179 - RNA, 27 nt, Artificial Sequence
  Trafficking kinesin-binding protein 2 (258-266)
gagaccaacgcccagaugagccgcaug

SEQ ID NO: 49180 - RNA, 27 nt, Artificial Sequence
  BTB/POZ domain-containing protein 3 (304-312)
gagaccaacgacaucuuccugugguac

SEQ ID NO: 49181 - RNA, 27 nt, Artificial Sequence
  Myotubularin (266-274)
gagaccaacaagcagaucagcaagcug

SEQ ID NO: 49182 - RNA, 36 nt, Artificial Sequence
  Serine-tRNA ligase, mitochondrial (334-345)
gagaccaacaccggccaggagccccgcgggcuguac

SEQ ID NO: 49183 - RNA, 27 nt, Artificial Sequence
  E3 ubiquitin-protein ligase RFWD3 (353-361)
gagaccaacaccgugguccagacguac

SEQ ID NO: 49184 - RNA, 30 nt, Artificial Sequence
  Protein bicaudal D homolog 2 (309-318)
gagacccccaaccgcgugaugcuggacuac

SEQ ID NO: 49185 - RNA, 27 nt, Artificial Sequence
  Splicing factor, proline- and glutamine-rich (475-483)
gagacccccccgcgcuucgcccagcac

SEQ ID NO: 49186 - RNA, 30 nt, Artificial Sequence
  Histone-lysine N-methyltransferase 2C (4271-4280)
gagacccccagcaaggccuuccaccaguac

SEQ ID NO: 49187 - RNA, 33 nt, Artificial Sequence
  Tetratricopeptide repeat protein 4 (310-320)
gagacccccagcugggaccuggagcagaaguac

SEQ ID NO: 49188 - RNA, 27 nt, Artificial Sequence
  T-complex protein 1 subunit eta (146-154)
gagacccagaucggcggggagcgcuac

SEQ ID NO: 49189 - RNA, 27 nt, Artificial Sequence
  Proteasome subunit alpha type-5 (37-45)
gagacccagaaccacugguucaccuac

SEQ ID NO: 49190 - RNA, 30 nt, Artificial Sequence
  Zinc finger MIZ domain-containing protein 1 (308-317)
gagacccagaacaaggacaucaaccaguac

SEQ ID NO: 49191 - RNA, 27 nt, Artificial Sequence
  Histone-lysine N-methyltransferase NSD3 (50-58)
gagacccagaccaaguaccagagcuac

SEQ ID NO: 49192 - RNA, 27 nt, Artificial Sequence
  Elongation factor 1-gamma (326-334)
gagacccagacccuggugcgcgaguac

SEQ ID NO: 49193 - RNA, 30 nt, Artificial Sequence
  Calcipressin-1 (27-36)
gagacccgcgccaaguucgagagccuguuc

SEQ ID NO: 49194 - RNA, 27 nt, Artificial Sequence
  Protein FAM184A (53-61)
gagacccgcgagaagauccugcaguac

SEQ ID NO: 49195 - RNA, 33 nt, Artificial Sequence
  Zinc finger protein 428 (46-56)
gagacccgcgagcccgccgagaccggcggguac

SEQ ID NO: 49196 - RNA, 33 nt, Artificial Sequence
  Rho GTPase-activating protein 26 (401-411)
gagacccgcggcaucaacgagcaggggcuguac

SEQ ID NO: 49197 - RNA, 36 nt, Artificial Sequence
  A-kinase anchor protein 2 (904-915)
gagacccgccccgagggcagcuacuucuccaaguac

SEQ ID NO: 49198 - RNA, 27 nt, Artificial Sequence
  Pre-mRNA-splicing regulator WTAP (228-236)
gagacccgccagcagcuggcccaguac

SEQ ID NO: 49199 - RNA, 27 nt, Artificial Sequence
  F-box/WD repeat-containing protein 11 (431-439)
gagacccgcagccccucccggaccuac

SEQ ID NO: 49200 - RNA, 33 nt, Artificial Sequence
  F-box/WD repeat-containing protein 11 (431-441)
gagacccgcagccccucccggaccuacacguac

SEQ ID NO: 49201 - RNA, 27 nt, Artificial Sequence
  Zinc finger CCCH domain-containing protein 13 (597-605)
gagacccgcagcuccuaccccgagcgg

SEQ ID NO: 49202 - RNA, 36 nt, Artificial Sequence
  Zinc finger CCCH domain-containing protein 13 (597-608)
gagacccgcagcuccuaccccgagcgggaccgcuac

SEQ ID NO: 49203 - RNA, 27 nt, Artificial Sequence
  Serine/threonine-protein kinase TBK1 (301-309)
gagaccagcgacauccugcaccgcaug

SEQ ID NO: 49204 - RNA, 30 nt, Artificial Sequence
  Vimentin (457-466)
gagaccagccagcaccacgacgaccuggag

SEQ ID NO: 49205 - RNA, 27 nt, Artificial Sequence
  Centromere protein F (880-888)
gagaccagccagcgcaucuccaagcug

SEQ ID NO: 49206 - RNA, 33 nt, Artificial Sequence
  Peptidyl-glycine alpha-amidating monooxygenase (904-914)
gagaccagcuccggccgcgugcuggggcgguuc

SEQ ID NO: 49207 - RNA, 33 nt, Artificial Sequence
  Heterogeneous nuclear ribonucleoprotein A1 (24-34)
gagaccaccgacgagagccugcgcucccacuuc

SEQ ID NO: 49208 - RNA, 27 nt, Artificial Sequence
  Exportin-7 (20-28)
gagaccaccgacacgaccacccgccug

SEQ ID NO: 49209 - RNA, 27 nt, Artificial Sequence
  Poly (ADP-ribose) polymerase 4 (422-430)
gagaccaccgaguuccugagcaagcuc

SEQ ID NO: 49210 - RNA, 30 nt, Artificial Sequence
  Flap endonuclease 1 (59-68)
gagaccaccagccaccugaugggcauguuc

SEQ ID NO: 49211 - RNA, 33 nt, Artificial Sequence
  Flap endonuclease 1 (59-69)
gagaccaccagccaccugaugggcauguucuac

SEQ ID NO: 49212 - RNA, 27 nt, Artificial Sequence
  Zinc finger MYM-type protein 3 (161-169)
gagaccaccagcaucgccacggcccgc

SEQ ID NO: 49213 - RNA, 27 nt, Artificial Sequence
  Transcription initiation factor TFIID subunit 4B (139-147)
gagaccaccagcaacaucacgucccgc

SEQ ID NO: 49214 - RNA, 27 nt, Artificial Sequence
  Uncharacterized protein C1orf112 (237-245)
gagaccaccacgcgcaucagccugcuc

SEQ ID NO: 49215 - RNA, 27 nt, Artificial Sequence
  TM2 domain-containing protein 2 isoform b (68-76)
gagaccaccacgugggagcgcaaguac

SEQ ID NO: 49216 - RNA, 27 nt, Artificial Sequence
  Ubiquitin-like protein FUBI (19-27)
gagaccguggcccagaucaaggcccac

SEQ ID NO: 49217 - RNA, 27 nt, Artificial Sequence
  Dynactin subunit 1 (38-46)
gagaccgugggcgaccuggaggccaug

SEQ ID NO: 49218 - RNA, 33 nt, Artificial Sequence
  Interferon-induced GTP-binding protein Mx1 (394-404)
gagaccgugggcgaggaggacauccgccuguuc

SEQ ID NO: 49219 - RNA, 27 nt, Artificial Sequence
  Glycerol-3-phosphate acyltransferase 1, mitochondrial (479-487)
gagaccgugggcaaguucauccaguac

SEQ ID NO: 49220 - RNA, 27 nt, Artificial Sequence
  28S ribosomal protein S23, mitochondrial (7-15)
gagaccgugggcagcaucuucucccgc

SEQ ID NO: 49221 - RNA, 30 nt, Artificial Sequence
  Structural maintenance of chromosomes flexible hinge domain-containing protein 1 (89-98)
gagaccgugaaggacggcgucacccuguac

SEQ ID NO: 49222 - RNA, 27 nt, Artificial Sequence
  Phosphoprotein associated withosphingolipid-enriched microdomains 1 (182-190)
gagaccgugaaggagaucaaggagguc

SEQ ID NO: 49223 - RNA, 30 nt, Artificial Sequence
  Developmentally-regulated GTP-binding protein 1 (203-212)
gagaccgugaagagcauccuggccgaguac

SEQ ID NO: 49224 - RNA, 27 nt, Artificial Sequence
  Ribosomal RNA small subunit methyltransferase NEP1 (48-56)
gagaccgugaaggucggcaagaccuac

SEQ ID NO: 49225 - RNA, 27 nt, Artificial Sequence
  ADP-ribosylation factor GTPase-activating protein 3 (388-396)
gagaccgugcugaagaccacgggcuac

SEQ ID NO: 49226 - RNA, 30 nt, Artificial Sequence
  Zinc finger protein 574 (7-16)
gagaccgugcuguacaucgagcaccgcuac

SEQ ID NO: 49227 - RNA, 33 nt, Artificial Sequence
  Ankyrin repeat and LEM domain-containing protein 2 (291-301)
gagaccgugaacaaggagcgcgccaacagcuac

SEQ ID NO: 49228 - RNA, 30 nt, Artificial Sequence
  Absent in melanoma 1 protein (1522-1531)
gagaccgugaaccugcgcagccucggcuuc

SEQ ID NO: 49229 - RNA, 27 nt, Artificial Sequence
  Rab GDP dissociation inhibitor alpha (74-82)
gagaccgugaaccgcaucaagcuguac

SEQ ID NO: 49230 - RNA, 27 nt, Artificial Sequence
  Tumor susceptibility gene 101 protein (24-32)
gagaccgugaacgucaucacccuguac

SEQ ID NO: 49231 - RNA, 27 nt, Artificial Sequence
  Peroxisome proliferator-activated receptor delta (255-263)
gagaccgugcgcgagcugaccgaguuc

SEQ ID NO: 49232 - RNA, 27 nt, Artificial Sequence
  Trafficking kinesin-binding protein 1 (346-354)
gagaccgugcgcaacaucaaccagguc

SEQ ID NO: 49233 - RNA, 27 nt, Artificial Sequence
  T-complex protein 1 subunit delta (524-532)
gagaccgugcgcagcauccugaagauc

SEQ ID NO: 49234 - RNA, 30 nt, Artificial Sequence
  Golgin subfamily A member 7 (45-54)
gagaccgugcgcacccugaacaaccucuac

SEQ ID NO: 49235 - RNA, 27 nt, Artificial Sequence
  Nuclear receptor 2C2-associated protein (9-17)
gagaccgugagccgcgucuccagcgug

SEQ ID NO: 49236 - RNA, 27 nt, Artificial Sequence
  Transitional endoplasmic reticulum ATPase (94-102)
gagaccguggucgaggugccccaggug

SEQ ID NO: 49237 - RNA, 27 nt, Artificial Sequence
  Exportin-T (504-512)
gagaccgugguccgcuacgagaaguuc

SEQ ID NO: 49238 - RNA, 27 nt, Artificial Sequence
  HLA class II histocompatibility antigen, DP alpha 1 chain (71-79)
gagaccguguggcaccuggaggaguuc

SEQ ID NO: 49239 - RNA, 36 nt, Artificial Sequence
  28S ribosomal protein S33, mitochondrial (47-58)
gagaccuacgacugguaccccaaccaccacaccuac

SEQ ID NO: 49240 - RNA, 30 nt, Artificial Sequence
  Dedicator of cytokinesis protein 1 (40-49)
gagaccuacgagggcugguaccgcggguac

SEQ ID NO: 49241 - RNA, 27 nt, Artificial Sequence
  Pre-mRNA-processing factor 6 (444-452)
gagaccuacgagaacgcccgcaaggug

SEQ ID NO: 49242 - RNA, 27 nt, Artificial Sequence
  Transcription elongation factor SPT6 (938-946)
gagaccuacgagugggcccgcaagaug

SEQ ID NO: 49243 - RNA, 30 nt, Artificial Sequence
  Exocyst complex component 7 (575-584)
gagaccuacggcgccuuccugcagaaguuc

SEQ ID NO: 49244 - RNA, 27 nt, Artificial Sequence
  C-C motif chemokine 28 (119-127)
gagaccuacggccacaagacccccuac

SEQ ID NO: 49245 - RNA, 27 nt, Artificial Sequence
  Myotonin-protein kinase (311-319)
gagaccuacggcaagaucgugcacuac

SEQ ID NO: 49246 - RNA, 27 nt, Artificial Sequence
  Quinone oxidoreductase (51-59)
gagaccuacauccgcagcggcaccuac

SEQ ID NO: 49247 - RNA, 30 nt, Artificial Sequence
  RNA-binding protein 8A (106-115)
gagaccuacaaggaggcccaggccgcgaug

SEQ ID NO: 49248 - RNA, 27 nt, Artificial Sequence
  Aurora kinase A (336-344)
gagaccuacaagcgcaucagccgggug

SEQ ID NO: 49249 - RNA, 27 nt, Artificial Sequence
  60 kDa SS-A/Ro ribonucleoprotein (329-337)
gagaccuacaagaccggccacgggcug

SEQ ID NO: 49250 - RNA, 30 nt, Artificial Sequence
  U6 snRNA-associated Sm-like protein LSm4 (23-32)
gagaccuacaacggccaccuggugagcugc

SEQ ID NO: 49251 - RNA, 30 nt, Artificial Sequence
  Centromere protein J (230-239)
gagaccuaccccagcaacauccugucccac

SEQ ID NO: 49252 - RNA, 30 nt, Artificial Sequence
  Arf-GAP with coiled-coil, ANK repeat and PH domain-containing protein 2 (748-757)
gagaccuaccaggacaucuuccgcgacuuc

SEQ ID NO: 49253 - RNA, 27 nt, Artificial Sequence
  Bifunctional coenzyme A synthase (290-298)
gagaccuaccgcggcgggauggccauc

SEQ ID NO: 49254 - RNA, 36 nt, Artificial Sequence
  Vacuolar protein sorting-associated protein 13B (522-533)
gagaccuacaccgagaucgccggcaugcagcgcuuc

SEQ ID NO: 49255 - RNA, 27 nt, Artificial Sequence
  CD81 antigen (34-42)
gagguggccgccggcaucuggggguuc

SEQ ID NO: 49256 - RNA, 36 nt, Artificial Sequence
  Transforming acidic coiled-coil-containing protein 3 (321-332)
gagguggccgccggccagauggcgagcuccagccgc

SEQ ID NO: 49257 - RNA, 33 nt, Artificial Sequence
  Condensin complex subunit 2 (680-690)
gagguggccgacgagaagaugcugagcggccuc

SEQ ID NO: 49258 - RNA, 30 nt, Artificial Sequence
  Rootletin (1797-1806)
gagguggccgaccuggagcuccagcgcguc

SEQ ID NO: 49259 - RNA, 27 nt, Artificial Sequence
  KN motif and ankyrin repeat domain-containing protein 2 (488-496)
gagguggccgaccccaccgcccaccgc

SEQ ID NO: 49260 - RNA, 27 nt, Artificial Sequence
  Protein phosphatase 1H (361-369)
gagguggccgaggccaucacccaguuc

SEQ ID NO: 49261 - RNA, 27 nt, Artificial Sequence
  Geminin (143-151)
gagguggccgagcacguccaguacaug

SEQ ID NO: 49262 - RNA, 27 nt, Artificial Sequence
  Tankyrase-2 (672-680)
gagguggccgagcugcucgucaagcac

SEQ ID NO: 49263 - RNA, 30 nt, Artificial Sequence
  Abnormal spindle-like microcephaly-associated protein (73-82)
gagguggccgaggucaagaucagccacuuc

SEQ ID NO: 49264 - RNA, 27 nt, Artificial Sequence
  Tankyrase-1 (618-626)
gagguggccgaguaccugcucgagcac

SEQ ID NO: 49265 - RNA, 33 nt, Artificial Sequence
  HRAS-like suppressor 3 (72-82)
gagguggccggcgccggggcggccagcgucaug

SEQ ID NO: 49266 - RNA, 27 nt, Artificial Sequence
  CAD protein (1287-1295)
gagguggccggcuucggggagagccgc

SEQ ID NO: 49267 - RNA, 27 nt, Artificial Sequence
  5'-nucleotidase (100-108)
gagguggcccacuucaugaacgcccug

SEQ ID NO: 49268 - RNA, 33 nt, Artificial Sequence
  5'-nucleotidase (100-110)
gagguggcccacuucaugaacgcccugcgcuac

SEQ ID NO: 49269 - RNA, 27 nt, Artificial Sequence
  Protein disulfide-isomerase A4 (440-448)
gagguggccaaggacuuccccgaguac

SEQ ID NO: 49270 - RNA, 33 nt, Artificial Sequence
  Eukaryotic translation initiation factor 2-alpha kinase 1 (153-163)
gagguggcccuggaggcccagaccagccgcuac

SEQ ID NO: 49271 - RNA, 27 nt, Artificial Sequence
  Amyloid protein-binding protein 2 (469-477)
gagguggcccugagcgucggccaccuc

SEQ ID NO: 49272 - RNA, 33 nt, Artificial Sequence
  Microtubule-associated protein 4 (341-351)
gagguggcccccgccaaggacgucacccugcuc

SEQ ID NO: 49273 - RNA, 27 nt, Artificial Sequence
  Striatin (575-583)
gagguggcccccgcccugagcgucuuc

SEQ ID NO: 49274 - RNA, 33 nt, Artificial Sequence
  cDNA FLJ60317, highly similar to Aminoacylase-1 (EC 3.5.1.14) (143-153)
gagguggcccccggcuacgucgugaccgugcug

SEQ ID NO: 49275 - RNA, 27 nt, Artificial Sequence
  E3 ubiquitin-protein ligase TRIM63 (155-163)
gagguggccccccugcagagcgucuuc

SEQ ID NO: 49276 - RNA, 33 nt, Artificial Sequence
  Kelch-like protein 21 (364-374)
gagguggcccccaugcugaaggcccgcgaguac

SEQ ID NO: 49277 - RNA, 30 nt, Artificial Sequence
  Endophilin-B2 (59-68)
gagguggcccccccggccagcggcacccgc

SEQ ID NO: 49278 - RNA, 33 nt, Artificial Sequence
  Niemann-Pick C1 protein (730-740)
gagguggcccccagcauguuccuguccagcuuc

SEQ ID NO: 49279 - RNA, 27 nt, Artificial Sequence
  E3 ubiquitin-protein ligase Topors (578-586)
gagguggcccagcccagccgcgaguuc

SEQ ID NO: 49280 - RNA, 33 nt, Artificial Sequence
  Zinc finger protein 131 (41-51)
gagguggccagcgccaagcaguccgucaaguac

SEQ ID NO: 49281 - RNA, 27 nt, Artificial Sequence
  Autophagy-related protein 9A (160-168)
gagguggccagcgcccugcgcuccuuc

SEQ ID NO: 49282 - RNA, 27 nt, Artificial Sequence
  Methyltransferase-like protein 13 (163-171)
gagguggccacccagugguucggcuuc

SEQ ID NO: 49283 - RNA, 27 nt, Artificial Sequence
  D-3-phosphoglycerate dehydrogenase (159-167)
gagguggccacccgcaugcagagcuuc

SEQ ID NO: 49284 - RNA, 27 nt, Artificial Sequence
  DNA-dependent protein kinase catalytic subunit (713-721)
gagguggccgucaagaugaagcaguac

SEQ ID NO: 49285 - RNA, 33 nt, Artificial Sequence
  Ribonuclease H2 subunit C (72-82)
gagguggccguccccccgggccuggugggguac

SEQ ID NO: 49286 - RNA, 33 nt, Artificial Sequence
  Endoplasmic reticulum lectin 1 (124-134)
gaggugugccacggcaagcacauccgccaguac

SEQ ID NO: 49287 - RNA, 27 nt, Artificial Sequence
  Serine/threonine-protein phosphatase 4 regulatory subunit 2 (20-28)
gaggugugccccguccuggaccaguuc

SEQ ID NO: 49288 - RNA, 27 nt, Artificial Sequence
  FRAS1-related extracellular matrix protein 1 (1345-1353)
gagguggaccugaaccuccugcgcuac

SEQ ID NO: 49289 - RNA, 33 nt, Artificial Sequence
  Melanoma-associated antigen 3 (168-178)
gagguggaccccaucggccaccuguacaucuuc

SEQ ID NO: 49290 - RNA, 27 nt, Artificial Sequence
  SET domain-containing protein 5 (26-34)
gagguggaggcccccuaccugagccgc

SEQ ID NO: 49291 - RNA, 30 nt, Artificial Sequence
  DENN domain-containing protein 5A (179-188)
gagguguucgccaaccgcuucacccagaug

SEQ ID NO: 49292 - RNA, 30 nt, Artificial Sequence
  Nck-associated protein 1 (479-488)
gagguguucgacuuccgcggcaugcggcug

SEQ ID NO: 49293 - RNA, 30 nt, Artificial Sequence
  Probable ubiquitin carboxyl-terminal hydrolase FAF-X (1928-1937)
gagguguucgaccacaugaugaagcgcaug

SEQ ID NO: 49294 - RNA, 30 nt, Artificial Sequence
  Disheveled-associated activator of morphogenesis 2 (1033-1042)
gagguguucgacaaggaccugugcaagcuc

SEQ ID NO: 49295 - RNA, 30 nt, Artificial Sequence
  Ribosomal RNA processing protein 36 homolog (132-141)
gagguguucgacaagaccuaccaguuccug

SEQ ID NO: 49296 - RNA, 36 nt, Artificial Sequence
  FAST kinase domain-containing protein 5 (107-118)
gagguguucgacagcuucgagaacaugcgcgucuuc

SEQ ID NO: 49297 - RNA, 33 nt, Artificial Sequence
  Melanoma-associated antigen 2 (229-239)
gagguguucgagggccgcgaggacagcgucuuc

SEQ ID NO: 49298 - RNA, 30 nt, Artificial Sequence
  Protein arginine N-methyltransferase 5 (308-317)
gagguguucgagaaggaccccaucaaguac

SEQ ID NO: 49299 - RNA, 30 nt, Artificial Sequence
  Presenilin-2 (337-346)
gagguguucgagcccccgcugaccggcuac

SEQ ID NO: 49300 - RNA, 30 nt, Artificial Sequence
  GMP reductase 1 (254-263)
gagguguucgagcgcaacggccggaagcug

SEQ ID NO: 49301 - RNA, 27 nt, Artificial Sequence
  Lanosterol synthase (479-487)
gagguguucggcgacaucaugaucgac

SEQ ID NO: 49302 - RNA, 30 nt, Artificial Sequence
  Monocarboxylate transporter 7 (340-349)
gagguguucggccgcaucggggccggcuuc

SEQ ID NO: 49303 - RNA, 27 nt, Artificial Sequence
  Zinc finger protein ZIC 2 (187-195)
gagguguucggccgcagcgagcaguac

SEQ ID NO: 49304 - RNA, 27 nt, Artificial Sequence
  Nesprin-2 (6334-6342)
gagguguucggccgcgucagccgguuc

SEQ ID NO: 49305 - RNA, 27 nt, Artificial Sequence
  Trifunctional purine biosynthetic protein adenosine-3 (10-18)
gagguguuccacgccggcaccgcccug

SEQ ID NO: 49306 - RNA, 30 nt, Artificial Sequence
  Ribosomal protein S6 kinase alpha-5 (267-276)
gagguguuccacgaccagcugcacaccuuc

SEQ ID NO: 49307 - RNA, 30 nt, Artificial Sequence
  Non-POU domain-containing octamer-binding protein (13-22)
gagguguucauccacaaggacaagggcuuc

SEQ ID NO: 49308 - RNA, 27 nt, Artificial Sequence
  DNA-directed RNA polymerase II subunit RPB4 (59-67)
gagguguucaugaagacccugaacuac

SEQ ID NO: 49309 - RNA, 30 nt, Artificial Sequence
  Quinone oxidoreductase (196-205)
gagguguucaaccaccgcgaggucaacuac

SEQ ID NO: 49310 - RNA, 30 nt, Artificial Sequence
  FACT complex subunit SPT16 (192-201)
gagguguucaacaaguucuucaaggagcgc

SEQ ID NO: 49311 - RNA, 30 nt, Artificial Sequence
  UDP-N-acetylglucosamine-peptide N-acetylglucosaminyltransferase 110 kDa subunit (229-238)
gagguguuccccgaguucgccgccgcgcac

SEQ ID NO: 49312 - RNA, 30 nt, Artificial Sequence
  Serine/threonine-protein kinase LATS2 (719-728)
gagguguuccccgagcaccuggcccgcuuc

SEQ ID NO: 49313 - RNA, 33 nt, Artificial Sequence
  Serine/threonine-protein phosphatase 6 regulatory ankyrin repeat subunit A (779-789)
gagguguuccagaagaccgagggcaacgccuuc

SEQ ID NO: 49314 - RNA, 33 nt, Artificial Sequence
  Replication protein A 70 kDa DNA-binding subunit (560-570)
gagguguuccagaacgccaacuuccgcagcuuc

SEQ ID NO: 49315 - RNA, 30 nt, Artificial Sequence
  F-box/LRR-repeat protein 5 (115-124)
gagguguuccagcccaugcugauggaguac

SEQ ID NO: 49316 - RNA, 30 nt, Artificial Sequence
  Histone-lysine N-methyltransferase SETD2 (2472-2481)
gagguguuccgcaaggagaugagccaguuc

SEQ ID NO: 49317 - RNA, 30 nt, Artificial Sequence
  Zinc finger and SCAN domain-containing protein 30 (45-54)
gagguguuccgccagaaguuccggcaguuc

SEQ ID NO: 49318 - RNA, 30 nt, Artificial Sequence
  WD repeat and FYVE domain-containing protein 3 (667-676)
gagguguucagcggcgacgggcgcaacuac

SEQ ID NO: 49319 - RNA, 30 nt, Artificial Sequence
  Coiled-coil domain-containing protein 136 (105-114)
gagguguucaccaagcagauccagcagcug

SEQ ID NO: 49320 - RNA, 30 nt, Artificial Sequence
  RCC1 and BTB domain-containing protein 2 (124-133)
gagguguucaccuggggccacaacgccuac

SEQ ID NO: 49321 - RNA, 33 nt, Artificial Sequence
  Pre-mRNA-splicing factor ATP-dependent RNA helicase DHX15 (379-389)
gaggugggcgacaucaagaucaucccccuguac

SEQ ID NO: 49322 - RNA, 27 nt, Artificial Sequence
  Protein AAR2 homolog (40-48)
gaggugggccccaaguuccgcgggguc

SEQ ID NO: 49323 - RNA, 30 nt, Artificial Sequence
  Adipocyte plasma membrane-associated protein (403-412)
gaggugcacgagcacgacggccaccuguac

SEQ ID NO: 49324 - RNA, 33 nt, Artificial Sequence
  Adipocyte plasma membrane-associated protein (403-413)
gaggugcacgagcacgacggccaccuguaccuc

SEQ ID NO: 49325 - RNA, 36 nt, Artificial Sequence
  Phosphatase and actin regulator 1 (636-647)
gaggugcacgagcugagccgccaccucacccgguuc

SEQ ID NO: 49326 - RNA, 30 nt, Artificial Sequence
  GPI transamidase component PIG-T (291-300)
gaggugcaccccccgcccaccaccacguac

SEQ ID NO: 49327 - RNA, 33 nt, Artificial Sequence
  Aryl hydrocarbon receptor nuclear translocator 2 (438-448)
gaggugcaccagcgcgacggccugagcuccuac

SEQ ID NO: 49328 - RNA, 30 nt, Artificial Sequence
  Uncharacterized protein C1orf131 (173-182)
gaggugcaccgcuucggcaucaccggguac

SEQ ID NO: 49329 - RNA, 36 nt, Artificial Sequence
  2-methoxy-6-polyprenyl-1,4-benzoquinol methylase, mitochondrial (272-283)
gaggugaucgccggcgacuggaagagcuaccaguac

SEQ ID NO: 49330 - RNA, 27 nt, Artificial Sequence
  DNA mismatch repair protein Msh2 (914-922)
gaggugaucgccaagaacaacagcuuc

SEQ ID NO: 49331 - RNA, 36 nt, Artificial Sequence
  Protein CutA (104-115)
gaggugaucgcccugcccgucgagcagggcaacuuc

SEQ ID NO: 49332 - RNA, 33 nt, Artificial Sequence
  Drebrin-like protein (403-413)
gaggugaucgacgagggcugguggcgcggguac

SEQ ID NO: 49333 - RNA, 33 nt, Artificial Sequence
  Alpha/beta hydrolase domain-containing protein 17B (236-246)
gaggugaucgacuucagccacggccuggcccuc

SEQ ID NO: 49334 - RNA, 36 nt, Artificial Sequence
  Alpha/beta hydrolase domain-containing protein 17A (256-267)
gaggugaucgacuucagccacggccuggcccucuac

SEQ ID NO: 49335 - RNA, 33 nt, Artificial Sequence
  Alpha/beta hydrolase domain-containing protein 17C (277-287)
gaggugaucgacuucagccacggccuggccaug

SEQ ID NO: 49336 - RNA, 36 nt, Artificial Sequence
  Alpha/beta hydrolase domain-containing protein 17C (277-288)
gaggugaucgacuucagccacggccuggccauguac

SEQ ID NO: 49337 - RNA, 36 nt, Artificial Sequence
  SH3 and PX domain-containing protein 2A (332-343)
gaggugaucgacaagaacagcggcggguggugguac

SEQ ID NO: 49338 - RNA, 27 nt, Artificial Sequence
  XK-related protein 9 (123-131)
gaggugaucgaccgcgucaccgaccug

SEQ ID NO: 49339 - RNA, 30 nt, Artificial Sequence
  Histidine-tRNA ligase, cytoplasmic (90-99)
gaggugaucgacacccccgucuucgagcug

SEQ ID NO: 49340 - RNA, 27 nt, Artificial Sequence
  SNF-related serine/threonine-protein kinase (80-88)
gaggugaucgacacccagaccaagcug

SEQ ID NO: 49341 - RNA, 27 nt, Artificial Sequence
  Mitochondrial ribonuclease P protein 3 (193-201)
gaggugaucgacgucuucgagaucaug

SEQ ID NO: 49342 - RNA, 33 nt, Artificial Sequence
  Mitochondrial ribonuclease P protein 3 (193-203)
gaggugaucgacgucuucgagaucaugaaggcc

SEQ ID NO: 49343 - RNA, 30 nt, Artificial Sequence
  N-terminal Xaa-Pro-Lys N-methyltransferase 1 (4-13)
gaggugaucgaggacgagaagcaguucuac

SEQ ID NO: 49344 - RNA, 27 nt, Artificial Sequence
  T-complex protein 1 subunit theta (127-135)
gaggugaucgagggcuacgagaucgcc

SEQ ID NO: 49345 - RNA, 30 nt, Artificial Sequence
  Phosphatidate phosphatase LPIN1 (766-775)
gaggugaucgagaagaagcccgagaaguuc

SEQ ID NO: 49346 - RNA, 30 nt, Artificial Sequence
  SH3 and PX domain-containing protein 2B (396-405)
gaggugaucgagaagaaccugagcggcugg

SEQ ID NO: 49347 - RNA, 30 nt, Artificial Sequence
  Dynamin-1-like protein (634-643)
gaggugaucgagcgccugaucaagagcuac

SEQ ID NO: 49348 - RNA, 27 nt, Artificial Sequence
  Asparagine synthetase (glutamine-hydrolyzing) (326-334)
gaggugaucuucagccuggagaccuac

SEQ ID NO: 49349 - RNA, 30 nt, Artificial Sequence
  Dynamin-like 120 kDa protein, mitochondrial (156-165)
gaggugaucggcgccagcgaccugcuccug

SEQ ID NO: 49350 - RNA, 33 nt, Artificial Sequence
  Dynamin-like 120 kDa protein, mitochondrial (156-166)
gaggugaucggcgccagcgaccugcuccugcug

SEQ ID NO: 49351 - RNA, 27 nt, Artificial Sequence
  Protein phosphatase 1 regulatory subunit 37 (75-83)
gaggugaucggcgccuacaagcaggcc

SEQ ID NO: 49352 - RNA, 33 nt, Artificial Sequence
  Protein TMEPAI (199-209)
gaggugaucggccacuaccccgggagcuccuuc

SEQ ID NO: 49353 - RNA, 36 nt, Artificial Sequence
  Mitogen-activated protein kinase kinase kinase 11 (121-132)
gaggugaucggcaucgggggcuucgggaaggucuac

SEQ ID NO: 49354 - RNA, 33 nt, Artificial Sequence
  Ropporin-1B (190-200)
gaggugaucggccccgacgggcugaucaccguc

SEQ ID NO: 49355 - RNA, 36 nt, Artificial Sequence
  Hepatocyte growth factor receptor (215-226)
gaggugaucggccgcgggcacuucggcugcgucuac

SEQ ID NO: 49356 - RNA, 33 nt, Artificial Sequence
  Inositol-trisphosphate 3-kinase B (875-885)
gaggugaucggcagcucccugcucuucauccac

SEQ ID NO: 49357 - RNA, 33 nt, Artificial Sequence
  Protein furry homolog-like (141-151)
gaggugaucggcguccuggcccagagcaaguuc

SEQ ID NO: 49358 - RNA, 30 nt, Artificial Sequence
  Transportin-3 (359-368)
gaggugauccacggcaucuucaaggccuac

SEQ ID NO: 49359 - RNA, 27 nt, Artificial Sequence
  ELAV-like protein 1 (101-109)
gaggugaucaaggacgccaaccuguac

SEQ ID NO: 49360 - RNA, 36 nt, Artificial Sequence
  Exocyst complex component 3 (390-401)
gaggugaucaagcugaccgaccccagccuccuguac

SEQ ID NO: 49361 - RNA, 30 nt, Artificial Sequence
  Eukaryotic translation initiation factor 3 subunit L (50-59)
gaggugaucaagaacuucauccaguacuuc

SEQ ID NO: 49362 - RNA, 30 nt, Artificial Sequence
  Ribosome maturation protein SBDS (156-165)
gaggugaucaagcagcugaaggagaagaug

SEQ ID NO: 49363 - RNA, 27 nt, Artificial Sequence
  Myosin-10 (1642-1650)
gaggugaucaagcagcugcgcaagcuc

SEQ ID NO: 49364 - RNA, 27 nt, Artificial Sequence
  Exosome complex component RRP43 (268-276)
gaggugaucaagagcaugaagcccaag

SEQ ID NO: 49365 - RNA, 27 nt, Artificial Sequence
  Cofilin-2 (10-18)
gaggugaucaaggucuucaacgacaug

SEQ ID NO: 49366 - RNA, 27 nt, Artificial Sequence
  T-complex protein 1 subunit beta (512-520)
gaggugauccugcgcgucgacaacauc

SEQ ID NO: 49367 - RNA, 30 nt, Artificial Sequence
  E3 ubiquitin-protein ligase TRIM63 (81-90)
gaggugaucauggaccgccacggcgucuac

SEQ ID NO: 49368 - RNA, 33 nt, Artificial Sequence
  Nucleosome-remodeling factor subunit BPTF (564-574)
gaggugaucaugaagggcaacaucaacaacuac

SEQ ID NO: 49369 - RNA, 27 nt, Artificial Sequence
  Gamma-interferon-inducible protein 16 (15-23)
gaggugaucaacgacuaccacuuccgc

SEQ ID NO: 49370 - RNA, 33 nt, Artificial Sequence
  Rho guanine nucleotide exchange factor 12 (790-800)
gaggugaucaacgagcuguucuacaccgagcgc

SEQ ID NO: 49371 - RNA, 30 nt, Artificial Sequence
  Eukaryotic translation initiation factor 3 subunit G (58-67)
gaggugaucaacggcaacaucaagaccguc

SEQ ID NO: 49372 - RNA, 27 nt, Artificial Sequence
  Isoleucine-tRNA ligase, cytoplasmic (989-997)
gaggugaucaaccgcauccagaagcug

SEQ ID NO: 49373 - RNA, 27 nt, Artificial Sequence
  Trafficking protein particle complex subunit 9 (680-688)
gaggugauccccgcccugccgcgccuc

SEQ ID NO: 49374 - RNA, 30 nt, Artificial Sequence
  Dynactin subunit 6 (135-144)
gaggugauccccgagaacaccgucaucuac

SEQ ID NO: 49375 - RNA, 27 nt, Artificial Sequence
  Transcriptional adapter 1 (289-297)
gaggugauccccacccacaccgucuac

SEQ ID NO: 49376 - RNA, 33 nt, Artificial Sequence
  Heme oxygenase 1 (103-113)
gaggugauccccuacaccccggccaugcagcgc

SEQ ID NO: 49377 - RNA, 36 nt, Artificial Sequence
  Heme oxygenase 1 (103-114)
gaggugauccccuacaccccggccaugcagcgcuac

SEQ ID NO: 49378 - RNA, 39 nt, Artificial Sequence
  MAX gene-associated protein (214-226)
gaggugauccagcugaacggccccgggguccacaccuuc

SEQ ID NO: 49379 - RNA, 36 nt, Artificial Sequence
  Kalirin (827-838)
gaggugauccagcagggccaggaccugcaccaguac

SEQ ID NO: 49380 - RNA, 27 nt, Artificial Sequence
  Cyclin-I (47-55)
gaggugauccaguggcuggccaagcuc

SEQ ID NO: 49381 - RNA, 27 nt, Artificial Sequence
  Protein dopey-2 (236-244)
gaggugauccgcgccuucuacagcuac

SEQ ID NO: 49382 - RNA, 27 nt, Artificial Sequence
  Inositol-tetrakisphosphate 1-kinase (260-268)
gaggugauccgcgagcugagccgggcc

SEQ ID NO: 49383 - RNA, 30 nt, Artificial Sequence
  Serine/threonine-protein kinase ICK (67-76)
gaggugauccgcgagaacgaccaccuguac

SEQ ID NO: 49384 - RNA, 39 nt, Artificial Sequence
  Peptidyl-prolyl cis-trans isomerase FKBP1A (55-67)
gaggugauccgcggcugggaggagggggucgcccagaug

SEQ ID NO: 49385 - RNA, 27 nt, Artificial Sequence
  BCL2/adenovirus E1B 19 kDa protein-interacting protein 2 (170-178)
gaggugauccgcaagggcagcaucacc

SEQ ID NO: 49386 - RNA, 33 nt, Artificial Sequence
  BCL2/adenovirus E1B 19 kDa protein-interacting protein 2 (170-180)
gaggugauccgcaagggcagcaucaccgaguac

SEQ ID NO: 49387 - RNA, 33 nt, Artificial Sequence
  General vesicular transport factor p115 (180-190)
gaggugauccgcaacgacggcguccugcuccug

SEQ ID NO: 49388 - RNA, 36 nt, Artificial Sequence
  Mitogen-activated protein kinase kinase kinase 3 (568-579)
gaggugaucagcggcgagggguacggccgcaaggcc

SEQ ID NO: 49389 - RNA, 30 nt, Artificial Sequence
  Protein FRA10AC1 (165-174)
gaggugaucagcggcaaggggcaguucuuc

SEQ ID NO: 49390 - RNA, 30 nt, Artificial Sequence
  Ectonucleoside triphosphate diphosphohydrolase 4 (216-225)
gaggugaucagcggcaagcaggaggggguc

SEQ ID NO: 49391 - RNA, 33 nt, Artificial Sequence
  Ectonucleoside triphosphate diphosphohydrolase 4 (216-226)
gaggugaucagcggcaagcaggagggggucuac

SEQ ID NO: 49392 - RNA, 36 nt, Artificial Sequence
  Protein CIP2A (34-45)
gaggugaucagcggccagaagcugacccgccucuuc

SEQ ID NO: 49393 - RNA, 27 nt, Artificial Sequence
  Syntaxin-18 (55-63)
gaggugaucagccacaucggcaagcug

SEQ ID NO: 49394 - RNA, 27 nt, Artificial Sequence
  CREB3 regulatory factor (131-139)
gaggugaucagcaagacccccacccug

SEQ ID NO: 49395 - RNA, 27 nt, Artificial Sequence
  Cullin-9 (584-592)
gaggugaucagcaaguacgagaaggcc

SEQ ID NO: 49396 - RNA, 27 nt, Artificial Sequence
  FAS-associated factor 2 (195-203)
gaggugaucagccugaucaacacccgc

SEQ ID NO: 49397 - RNA, 30 nt, Artificial Sequence
  Pseudopodium-enriched atypical kinase 1 (20-29)
gaggugaucagcaacgagggcgggcgcuuc

SEQ ID NO: 49398 - RNA, 30 nt, Artificial Sequence
  Alpha-1,3-mannosyl-glycoprotein 4-beta-N-acetylglucosaminyltransferase B (111-120)
gaggugaucagccccuccccgcacuucuac

SEQ ID NO: 49399 - RNA, 27 nt, Artificial Sequence
  ATP-binding cassette sub-family A member 5 (1411-1419)
gaggugaucagccgcaucacccacgcc

SEQ ID NO: 49400 - RNA, 36 nt, Artificial Sequence
  Importin subunit alpha-5 (120-131)
gaggugaucagcacccccggcgucguggcccgcuuc

SEQ ID NO: 49401 - RNA, 27 nt, Artificial Sequence
  Ankycorbin (933-941)
gaggugaucagcgucuaccgcaugcac

SEQ ID NO: 49402 - RNA, 27 nt, Artificial Sequence
  Ataxin-2 (291-299)
gaggugaucagcuggggcuccgggcgc

SEQ ID NO: 49403 - RNA, 33 nt, Artificial Sequence
  Unconventional myosin-X (308-318)
gaggugaucaccgccauggacgucaugcaguuc

SEQ ID NO: 49404 - RNA, 33 nt, Artificial Sequence
  Ras GTPase-activating protein 3 (134-144)
gaggugaucaccgacaccggcgucgugugccac

SEQ ID NO: 49405 - RNA, 30 nt, Artificial Sequence
  Nuclear export mediator factor NEMF (306-315)
gaggugaucacccacgagcugcaggacuuc

SEQ ID NO: 49406 - RNA, 33 nt, Artificial Sequence
  Phospholipid scramblase 2 (86-96)
gaggugaucacccuggagcgcccccuccggugc

SEQ ID NO: 49407 - RNA, 30 nt, Artificial Sequence
  A-kinase anchor protein 9 (1601-1610)
gaggugaucaccaaccgccccaagggcuuc

SEQ ID NO: 49408 - RNA, 36 nt, Artificial Sequence
  Translation initiation factor eIF-2B subunit gamma (272-283)
gaggugaucgucggcaacgaccagcugauggagauc

SEQ ID NO: 49409 - RNA, 27 nt, Artificial Sequence
  Methylmalonyl-CoA mutase, mitochondrial (484-492)
gaggugaucgucggcgugaacaaguac

SEQ ID NO: 49410 - RNA, 27 nt, Artificial Sequence
  Insulin-like growth factor 2 mRNA-binding protein 2 (555-563)
gaggugaucguccgcaucaucggccac

SEQ ID NO: 49411 - RNA, 27 nt, Artificial Sequence
  Dynactin subunit 4 (424-432)
gaggugaucuggcugacccagcacguc

SEQ ID NO: 49412 - RNA, 33 nt, Artificial Sequence
  Actin-related protein 8 (209-219)
gaggugaucuggagccacgccauccagaaguac

SEQ ID NO: 49413 - RNA, 27 nt, Artificial Sequence
  BTB/POZ domain-containing protein 10 (398-406)
gaggugaucuacaacuacguccagcgc

SEQ ID NO: 49414 - RNA, 27 nt, Artificial Sequence
  Ras GTPase-activating-like protein IQGAP1 (1602-1610)
gaggugaaggccaaguucaugggcguc

SEQ ID NO: 49415 - RNA, 27 nt, Artificial Sequence
  E3 ubiquitin-protein ligase CBL-B (290-298)
gaggugaaggcccgccugcagaaguac

SEQ ID NO: 49416 - RNA, 33 nt, Artificial Sequence
  F-box only protein 22 (380-390)
gaggugaaggacgacgaccuguuccacagcuac

SEQ ID NO: 49417 - RNA, 33 nt, Artificial Sequence
  Cation-independent mannose-6-phosphate receptor (1228-1238)
gaggugaaggacccccgccacggcaaccuguac

SEQ ID NO: 49418 - RNA, 30 nt, Artificial Sequence
  Centromere protein F (1197-1206)
gaggugaaggagaucagccuggacuccuac

SEQ ID NO: 49419 - RNA, 27 nt, Artificial Sequence
  Apolipoprotein E (249-257)
gaggugaaggagcaggucgccgaggug

SEQ ID NO: 49420 - RNA, 27 nt, Artificial Sequence
  Ras association domain-containing protein 8 (290-298)
gaggugaagggcaagaucgggaagguc

SEQ ID NO: 49421 - RNA, 30 nt, Artificial Sequence
  Prolyl endopeptidase-like (114-123)
gaggugaagcacggcggguucgucuacuac

SEQ ID NO: 49422 - RNA, 27 nt, Artificial Sequence
  Ras association domain-containing protein 2 (297-305)
gaggugaagaagcugaugcgcaaguac

SEQ ID NO: 49423 - RNA, 27 nt, Artificial Sequence
  Ethylmalonyl-CoA decarboxylase (36-44)
gaggugaagaagacccugcagcaguuc

SEQ ID NO: 49424 - RNA, 27 nt, Artificial Sequence
  Proteasome activator complex subunit 3 (10-18)
gaggugaagcugaaggucgacagcuuc

SEQ ID NO: 49425 - RNA, 27 nt, Artificial Sequence
  Integrator complex subunit 11 (350-358)
gaggugaagaugcaggucgaguacaug

SEQ ID NO: 49426 - RNA, 27 nt, Artificial Sequence
  Elongator complex protein 1 (50-58)
gaggugaagaacgaggucagccuggug

SEQ ID NO: 49427 - RNA, 45 nt, Artificial Sequence
  Delta-1-pyrroline-5-carboxylate synthase (320-334)
gaggugaagcccgccggcccgaccgucgagcagcagggggagaug

SEQ ID NO: 49428 - RNA, 48 nt, Artificial Sequence
  Delta-1-pyrroline-5-carboxylate synthase (320-335)
gaggugaagcccgccggcccgaccgucgagcagcagggggagauggcc

SEQ ID NO: 49429 - RNA, 27 nt, Artificial Sequence
  Ras-related GTP-binding protein D (60-68)
gaggugaagccccgcauccugcucaug

SEQ ID NO: 49430 - RNA, 27 nt, Artificial Sequence
  Histone deacetylase 9 (142-150)
gaggugaagcagaagcugcaggaguuc

SEQ ID NO: 49431 - RNA, 27 nt, Artificial Sequence
  Periodic tryptophan protein 1 homolog (31-39)
gaggugaagcgccugaucgccgaggcc

SEQ ID NO: 49432 - RNA, 27 nt, Artificial Sequence
  Pachytene checkpoint protein 2 homolog (146-154)
gaggugaagagccaccugcucgacuac

SEQ ID NO: 49433 - RNA, 27 nt, Artificial Sequence
  Apoptosis-inducing factor 1, mitochondrial (276-284)
gaggugaagagccgcaccacccuguuc

SEQ ID NO: 49434 - RNA, 27 nt, Artificial Sequence
  Chloride intracellular channel protein 4 (83-91)
gaggugaagaccgacgucaacaagauc

SEQ ID NO: 49435 - RNA, 27 nt, Artificial Sequence
  Kinetochore-associated protein DSN1 homolog (235-243)
gaggugaaggucgagcccaugaccuac

SEQ ID NO: 49436 - RNA, 27 nt, Artificial Sequence
  Glycerol-3-phosphate dehydrogenase, mitochondrial (410-418)
gaggugaaguacggcaucaaggaguac

SEQ ID NO: 49437 - RNA, 27 nt, Artificial Sequence
  Bifunctional coenzyme A synthase (63-71)
gaggugcuggacuucaucacccaccuc

SEQ ID NO: 49438 - RNA, 30 nt, Artificial Sequence
  Insulin-like growth factor 2 mRNA-binding protein 2 (95-104)
gaggugcuggacggccuccuggcccaguac

SEQ ID NO: 49439 - RNA, 30 nt, Artificial Sequence
  Serine/threonine-protein kinase PRP4 homolog (170-179)
gaggugcuggacaagcgcuacaacgucuac

SEQ ID NO: 49440 - RNA, 33 nt, Artificial Sequence
  Estradiol 17-beta-dehydrogenase 1 (203-213)
gaggugcuggaccgcaccgacauccacaccuuc

SEQ ID NO: 49441 - RNA, 30 nt, Artificial Sequence
  Receptor-type protein tyrosine phosphatase beta (1332-1341)
gaggugcuggacagccacauccacgccuac

SEQ ID NO: 49442 - RNA, 30 nt, Artificial Sequence
  Insulin-like growth factor 2 mRNA-binding protein 3 (95-104)
gaggugcuggacagccuccugguccaguac

SEQ ID NO: 49443 - RNA, 27 nt, Artificial Sequence
  StAR-related lipid transfer protein 7, mitochondrial (136-144)
gaggugcugcacugggucacccacuuc

SEQ ID NO: 49444 - RNA, 30 nt, Artificial Sequence
  Ubiquitin-associated protein 1-like (34-43)
gaggugcugcucggcagcaugcacgacuuc

SEQ ID NO: 49445 - RNA, 30 nt, Artificial Sequence
  Mitofusin-2 (308-317)
gaggugcugaacgcccgcauccagaaggcc

SEQ ID NO: 49446 - RNA, 30 nt, Artificial Sequence
  Exportin-6 (272-281)
gaggugcugaaccgcauccaguuccgguac

SEQ ID NO: 49447 - RNA, 30 nt, Artificial Sequence
  Ancient ubiquitous protein 1 (306-315)
gaggugcugccccacgucccgcucggcgug

SEQ ID NO: 49448 - RNA, 30 nt, Artificial Sequence
  Spectrin alpha chain, non-erythrocytic 1 (185-194)
gaggugcugcagaagaaguucgaggaguuc

SEQ ID NO: 49449 - RNA, 27 nt, Artificial Sequence
  Importin-7 (378-386)
gaggugcugcagaagaccaugggcuuc

SEQ ID NO: 49450 - RNA, 27 nt, Artificial Sequence
  Class E basic helix-loop-helix protein 41 (141-149)
gaggugcugcaguaccucagccgcuuc

SEQ ID NO: 49451 - RNA, 27 nt, Artificial Sequence
  MAGEC3 protein (192-200)
gaggugcugagcgccaucggcgucugc

SEQ ID NO: 49452 - RNA, 33 nt, Artificial Sequence
  Serine/threonine-protein kinase Nek2 (9-19)
gaggugcuguacaccaucggcaccgggagcuac

SEQ ID NO: 49453 - RNA, 33 nt, Artificial Sequence
  Ly6/PLAUR domain-containing protein 1 isoform c (73-83)
gaggugauggagcagagcgccggcaucauguac

SEQ ID NO: 49454 - RNA, 30 nt, Artificial Sequence
  Protein FAM118A (215-224)
gaggugauggagguccugcagaaccucuac

SEQ ID NO: 49455 - RNA, 36 nt, Artificial Sequence
  Proteasome maturation protein (125-136)
gaggugaugggcgagccccaccugauggucgaguac

SEQ ID NO: 49456 - RNA, 30 nt, Artificial Sequence
  Isoprenoid synthase domain-containing protein isoform X7 (103-112)
gaggugaugaagagcaucauccagaaguac

SEQ ID NO: 49457 - RNA, 30 nt, Artificial Sequence
  Alkyldihydroxyacetonephosphate synthase, peroxisomal (89-98)
gaggugaugaaguggaacggcuggggguac

SEQ ID NO: 49458 - RNA, 33 nt, Artificial Sequence
  Protein-L-isoaspartate(D-aspartate) O-methyltransferase (30-40)
gaggugaugcuggccaccgaccgcagccacuac

SEQ ID NO: 49459 - RNA, 30 nt, Artificial Sequence
  Prolyl 3-hydroxylase 1 (335-344)
gaggugaugaaccagaaccuggccuacuac

SEQ ID NO: 49460 - RNA, 27 nt, Artificial Sequence
  tRNA-dihydrouridine(20) synthase (NAD(P)+)-like (227-235)
gaggugaugcagaaguacauccgcuac

SEQ ID NO: 49461 - RNA, 30 nt, Artificial Sequence
  Actin-related protein 2/3 complex subunit 3 (127-136)
gaggugaugcgcgccuaccugcagcagcuc

SEQ ID NO: 49462 - RNA, 27 nt, Artificial Sequence
  Transcription factor SOX-10 (284-292)
gaggugaugagcaacauggagaccuuc

SEQ ID NO: 49463 - RNA, 30 nt, Artificial Sequence
  Mitofusin-2 (23-32)
gaggugaacgccagcccccugaagcacuuc

SEQ ID NO: 49464 - RNA, 33 nt, Artificial Sequence
  Procollagen C-endopeptidase enhancer 2 (220-230)
gaggugaacgacgcccgccggaucggcaaguac

SEQ ID NO: 49465 - RNA, 27 nt, Artificial Sequence
  Ankycorbin (840-848)
gaggugaacgagcugcuccagaaguuc

SEQ ID NO: 49466 - RNA, 27 nt, Artificial Sequence
  mRNA turnover protein 4 homolog (111-119)
gaggugaacgagugguucaccaaguac

SEQ ID NO: 49467 - RNA, 30 nt, Artificial Sequence
  Ethanolamine-phosphate cytidylyltransferase (254-263)
gaggugaaccacuacaagggcaagaacuac

SEQ ID NO: 49468 - RNA, 27 nt, Artificial Sequence
  Long-chain-fatty-acid-CoA ligase 4 (89-97)
gaggugaaccgccgggucaacaacuuc

SEQ ID NO: 49469 - RNA, 27 nt, Artificial Sequence
  Serpin B8 (76-84)
gaggugaaccgcaccggcacccaguac

SEQ ID NO: 49470 - RNA, 27 nt, Artificial Sequence
  T-complex protein 1 subunit zeta (101-109)
gaggugaacagcggcuucuucuacaag

SEQ ID NO: 49471 - RNA, 27 nt, Artificial Sequence
  Sodium/potassium/calcium exchanger 5 (372-380)
gaggugaacagccgcggccugaccuac

SEQ ID NO: 49472 - RNA, 30 nt, Artificial Sequence
  Putative PIP5K1A and PSMD4-like protein (632-641)
gaggugaacaccgagaagcugaccgccuuc

SEQ ID NO: 49473 - RNA, 33 nt, Artificial Sequence
  FAST kinase domain-containing protein 1 (204-214)
gaggugaacgucgccaagagcaucgccaaguuc

SEQ ID NO: 49474 - RNA, 27 nt, Artificial Sequence
  Protein NATD1 (59-67)
gaggugcccgacgccuaccgcggccgg

SEQ ID NO: 49475 - RNA, 27 nt, Artificial Sequence
  Thioredoxin-like protein 4A (65-73)
gaggugcccgacuucaacaagauguac

SEQ ID NO: 49476 - RNA, 36 nt, Artificial Sequence
  Cyclin-A2 (174-185)
gaggugcccgacuaccacgaggacauccacaccuac

SEQ ID NO: 49477 - RNA, 30 nt, Artificial Sequence
  Protein FAM135B (80-89)
gaggugcccaucaacgacgccgucguguuc

SEQ ID NO: 49478 - RNA, 27 nt, Artificial Sequence
  Serine/threonine-protein kinase 36 (1232-1240)
gaggugccccagcgccugcucgagaug

SEQ ID NO: 49479 - RNA, 30 nt, Artificial Sequence
  La-related protein 1 (262-271)
gaggugccccgcgagaagcuggccagccgg

SEQ ID NO: 49480 - RNA, 30 nt, Artificial Sequence
  Meckel syndrome type 1 protein (150-159)
gaggugcccagcuuccuggucgagcgcaug

SEQ ID NO: 49481 - RNA, 30 nt, Artificial Sequence
  Copine-1 (173-182)
gaggugcccacccagcuggucagcuacuuc

SEQ ID NO: 49482 - RNA, 39 nt, Artificial Sequence
  Macrophage-capping protein (97-109)
gaggugcagggcaacgagagcgaccuguucauguccuac

SEQ ID NO: 49483 - RNA, 27 nt, Artificial Sequence
  26S protease regulatory subunit 8 (142-150)
gaggugcagcgcaccaugcuggagcuc

SEQ ID NO: 49484 - RNA, 27 nt, Artificial Sequence
  Coatomer subunit gamma-2 (523-531)
gaggugcgcgaccgggccaccuucuac

SEQ ID NO: 49485 - RNA, 30 nt, Artificial Sequence
  Ubiquitin-protein ligase E3C (567-576)
gaggugcgcgaggaguacaucaccgccuuc

SEQ ID NO: 49486 - RNA, 30 nt, Artificial Sequence
  Lactadherin (36-45)
gaggugcgcggcgacgucuuccccagcuac

SEQ ID NO: 49487 - RNA, 27 nt, Artificial Sequence
  Spindle and kinetochore-associated protein 1 (243-251)
gaggugcgcggcgggggccugacccgg

SEQ ID NO: 49488 - RNA, 30 nt, Artificial Sequence
  Spindle and kinetochore-associated protein 1 (243-252)
gaggugcgcggcgggggccugacccgguac

SEQ ID NO: 49489 - RNA, 30 nt, Artificial Sequence
  GTP-binding protein 1 (445-454)
gaggugcgcggcgggcagaccgccagcuuc

SEQ ID NO: 49490 - RNA, 27 nt, Artificial Sequence
  Glutaredoxin-3 (140-148)
gaggugcgccagggccugaaggccuac

SEQ ID NO: 49491 - RNA, 30 nt, Artificial Sequence
  Fatty acid synthase (674-683)
gaggugcgcaccggcgggauggccuuccac

SEQ ID NO: 49492 - RNA, 27 nt, Artificial Sequence
  Putative butyrophilin subfamily 2 member A3 (62-70)
gaggugcgcugguuccagagccaguuc

SEQ ID NO: 49493 - RNA, 27 nt, Artificial Sequence
  Butyrophilin subfamily 2 member A1 (63-71)
gaggugcgcugguuccggagccaguuc

SEQ ID NO: 49494 - RNA, 30 nt, Artificial Sequence
  Interleukin-1 receptor-associated kinase 4 (159-168)
gaggugagcgacacccgcuuccacuccuuc

SEQ ID NO: 49495 - RNA, 27 nt, Artificial Sequence
  E3 ubiquitin-protein ligase UBR5 (24-32)
gaggugagcgagaagcugaacaaguac

SEQ ID NO: 49496 - RNA, 27 nt, Artificial Sequence
  Protein FAM111B (228-236)
gaggugagcggcaagguccuggagaug

SEQ ID NO: 49497 - RNA, 33 nt, Artificial Sequence
  Cytosolic carboxypeptidase 1 (764-774)
gaggugagcggcaugcgccccggggucgccuac

SEQ ID NO: 49498 - RNA, 27 nt, Artificial Sequence
  Alpha-actinin-1 (574-582)
gaggugagcaagaucguccagaccuac

SEQ ID NO: 49499 - RNA, 27 nt, Artificial Sequence
  cGMP-inhibited 3',5'-cyclic phosphodiesterase B (656-664)
gaggugagccuggaccucauccugguc

SEQ ID NO: 49500 - RNA, 33 nt, Artificial Sequence
  Growth hormone-inducible transmembrane protein (303-313)
gaggugagccccauguacggcguccagaaguac

SEQ ID NO: 49501 - RNA, 27 nt, Artificial Sequence
  NADH-ubiquinone oxidoreductase 75 kDa subunit, mitochondrial (537-545)
gaggugagccccaaccugguccgcuac

SEQ ID NO: 49502 - RNA, 30 nt, Artificial Sequence
  Proton myo-inositol cotransporter (179-188)
gaggugagccccccgaaccugcgcggccgg

SEQ ID NO: 49503 - RNA, 27 nt, Artificial Sequence
  Abnormal spindle-like microcephaly-associated protein (322-330)
gaggugagcccccgcaucccggagugc

SEQ ID NO: 49504 - RNA, 30 nt, Artificial Sequence
  AP-1 complex subunit beta-1 (934-943)
gaggugagccagcacgucuaccaggccuac

SEQ ID NO: 49505 - RNA, 27 nt, Artificial Sequence
  Transcription factor TFIIIB component B'' homolog (1376-1384)
gaggugagcucccacuucagccacuuc

SEQ ID NO: 49506 - RNA, 30 nt, Artificial Sequence
  Retinoblastoma-like protein 1 (130-139)
gaggugagcaccgucaucuucaagaaguac

SEQ ID NO: 49507 - RNA, 33 nt, Artificial Sequence
  Xenotropic and polytropic retrovirus receptor 1 (40-50)
gaggugaccgacgaggacaccgucaagcgcuac

SEQ ID NO: 49508 - RNA, 30 nt, Artificial Sequence
  U3 small nucleolar ribonucleoprotein protein IMP3 (22-31)
gaggugaccgaccacaaccugcacgagcuc

SEQ ID NO: 49509 - RNA, 27 nt, Artificial Sequence
  Ankyrin repeat domain-containing protein 54 (279-287)
gaggugaccgaccugcucgccagcuuc

SEQ ID NO: 49510 - RNA, 36 nt, Artificial Sequence
  Protein SET (111-122)
gaggugaccgaguucgaggacaucaagagcggcuac

SEQ ID NO: 49511 - RNA, 27 nt, Artificial Sequence
  Prostaglandin E synthase 2 (201-209)
gaggugaccgaguucggcaacaaguac

SEQ ID NO: 49512 - RNA, 27 nt, Artificial Sequence
  Zinc finger CCHC domain-containing protein 14 (136-144)
gaggugaccgaguucaucagcaagcug

SEQ ID NO: 49513 - RNA, 27 nt, Artificial Sequence
  Beta-parvin (274-282)
gaggugaccgagcuggagacccaguuc

SEQ ID NO: 49514 - RNA, 27 nt, Artificial Sequence
  Tankyrase-2 (358-366)
gaggugaccgagcugcucgucaagcac

SEQ ID NO: 49515 - RNA, 27 nt, Artificial Sequence
  RNA-binding protein 26 (806-814)
gaggugaccgagcugcgccggaaguac

SEQ ID NO: 49516 - RNA, 27 nt, Artificial Sequence
  Ribonucleoprotein PTB-binding 2 (177-185)
gaggugaccggccacagcaagggguac

SEQ ID NO: 49517 - RNA, 30 nt, Artificial Sequence
  Integrin alpha-X (448-457)
gaggugaccggcacccagaucgggagcuac

SEQ ID NO: 49518 - RNA, 27 nt, Artificial Sequence
  Catalase (10-18)
gaggugacccacgacaucaccaaguac

SEQ ID NO: 49519 - RNA, 27 nt, Artificial Sequence
  Plectin (3906-3914)
gaggugaccaagaaccugcagaaguuc

SEQ ID NO: 49520 - RNA, 27 nt, Artificial Sequence
  EH domain-binding protein 1 (186-194)
gaggugaccaagaacuaccgcggcguc

SEQ ID NO: 49521 - RNA, 27 nt, Artificial Sequence
  Apoptosis-inducing factor 2 (169-177)
gaggugacccugauccacagccagguc

SEQ ID NO: 49522 - RNA, 33 nt, Artificial Sequence
  Ankyrin repeat and KH domain-containing protein 1 (1670-1680)
gaggugacccccaacagccuguccaccagcuac

SEQ ID NO: 49523 - RNA, 30 nt, Artificial Sequence
  Teneurin-4 (87-96)
gaggugacccccccgcacggcacccuguac

SEQ ID NO: 49524 - RNA, 27 nt, Artificial Sequence
  Translocon-associated protein subunit gamma (99-107)
gaggugacccgcaagcugagcgaggcc

SEQ ID NO: 49525 - RNA, 27 nt, Artificial Sequence
  FAD synthase (63-71)
gaggugaccagcuucuccaaccgcuuc

SEQ ID NO: 49526 - RNA, 27 nt, Artificial Sequence
  Probable ATP-dependent RNA helicase DDX5 (30-38)
gaggugaccaccgcccgcagccaguuc

SEQ ID NO: 49527 - RNA, 27 nt, Artificial Sequence
  EH domain-binding protein 1-like protein 1 (1049-1057)
gaggugaccaccggcuaccgcgggguc

SEQ ID NO: 49528 - RNA, 27 nt, Artificial Sequence
  Formin-binding protein 4 (242-250)
gaggugaccugggagcugccccaguac

SEQ ID NO: 49529 - RNA, 27 nt, Artificial Sequence
  NGFI-A-binding protein 1 (307-315)
gaggugaccuacaaguacaccuaccgc

SEQ ID NO: 49530 - RNA, 30 nt, Artificial Sequence
  Serine/threonine-protein kinase TAO2 (52-61)
gagguggucgccaucaagaagaugagcuac

SEQ ID NO: 49531 - RNA, 30 nt, Artificial Sequence
  Phosphatidate phosphatase LPIN1 (844-853)
gagguggucgaccacguguucccccugcuc

SEQ ID NO: 49532 - RNA, 27 nt, Artificial Sequence
  Glutamate decarboxylase 1 (118-126)
gagguggucgacauccugcucaacuac

SEQ ID NO: 49533 - RNA, 30 nt, Artificial Sequence
  Nardilysin (988-997)
gagguggucgacaagaagaucgaggaguuc

SEQ ID NO: 49534 - RNA, 27 nt, Artificial Sequence
  Lethal(3)malignant brain tumor-like protein 3 (457-465)
gagguggucgacaagcgcaaccccaug

SEQ ID NO: 49535 - RNA, 39 nt, Artificial Sequence
  Contactin-associated protein-like 4 (182-194)
gagguggucgaccuggacggcaagagcucccuccuguac

SEQ ID NO: 49536 - RNA, 27 nt, Artificial Sequence
  Translation initiation factor eIF-2B subunit gamma (116-124)
gagguggucgaccuguuccgcgccuac

SEQ ID NO: 49537 - RNA, 33 nt, Artificial Sequence
  Translation initiation factor eIF-2B subunit gamma (116-126)
gagguggucgaccuguuccgcgccuacgacgcc

SEQ ID NO: 49538 - RNA, 27 nt, Artificial Sequence
  Collagen triple helix repeat-containing protein 1 (46-54)
gagguggucgaccuguacaacggcaug

SEQ ID NO: 49539 - RNA, 33 nt, Artificial Sequence
  Unconventional myosin-X (2025-2035)
gagguggucgacguggccaagcugaugaaggcc

SEQ ID NO: 49540 - RNA, 36 nt, Artificial Sequence
  Unconventional myosin-X (2025-2036)
gagguggucgacguggccaagcugaugaaggccuac

SEQ ID NO: 49541 - RNA, 33 nt, Artificial Sequence
  Gephyrin (726-736)
gagguggucgacgugauggugaucggccgccug

SEQ ID NO: 49542 - RNA, 27 nt, Artificial Sequence
  Guanine nucleotide-binding protein-like 3-like protein (181-189)
gagguggucgagaaguggcuggacuac

SEQ ID NO: 49543 - RNA, 27 nt, Artificial Sequence
  Kinetochore protein Nuf2 (271-279)
gagguggucgagaaguacgagaucuac

SEQ ID NO: 49544 - RNA, 27 nt, Artificial Sequence
  TBC1 domain family member 13 (209-217)
gagguggucgagcgcauccuguucauc

SEQ ID NO: 49545 - RNA, 33 nt, Artificial Sequence
  Putative ATP-dependent RNA helicase TDRD9 (906-916)
gagguggucgaggugggccacuucuggggguac

SEQ ID NO: 49546 - RNA, 30 nt, Artificial Sequence
  Cytosolic non-specific dipeptidase (351-360)
gagguggucggcgagcaggugaccagcuac

SEQ ID NO: 49547 - RNA, 27 nt, Artificial Sequence
  Nuclear pore complex protein Nup160 (1025-1033)
gagguggucggcaucaucgagagccgc

SEQ ID NO: 49548 - RNA, 27 nt, Artificial Sequence
  Pseudopodium-enriched atypical kinase 1 (303-311)
gagguggucggcaagauccgcagccug

SEQ ID NO: 49549 - RNA, 33 nt, Artificial Sequence
  DCN1-like protein 5 (65-75)
gagguggucggccccgaggggauggagaaguuc

SEQ ID NO: 49550 - RNA, 30 nt, Artificial Sequence
  3 beta-hydroxysteroid dehydrogenase type 7 (131-140)
gagguggucggccccaacaccaaggggcac

SEQ ID NO: 49551 - RNA, 27 nt, Artificial Sequence
  Tetratricopeptide repeat protein 5 (59-67)
gagguggucggcagcgugcaggggaag

SEQ ID NO: 49552 - RNA, 33 nt, Artificial Sequence
  Diacylglycerol kinase theta (848-858)
gagguggucggcgugaccggggugguccacaug

SEQ ID NO: 49553 - RNA, 27 nt, Artificial Sequence
  WD repeat-containing protein 35 (735-743)
gagguggucggcuacuucgggcgcuuc

SEQ ID NO: 49554 - RNA, 27 nt, Artificial Sequence
  Signal transducer and activator of transcription 1-alpha/beta (212-220)
gaggugguccacaagaucaucgagcug

SEQ ID NO: 49555 - RNA, 27 nt, Artificial Sequence
  Hemicentin-1 (5-13)
gaggugguccacaccguguuccuguuc

SEQ ID NO: 49556 - RNA, 36 nt, Artificial Sequence
  Midasin (1181-1192)
gagguggucaaggcccacccccgcuucaugcuguuc

SEQ ID NO: 49557 - RNA, 27 nt, Artificial Sequence
  Heat shock protein HSP 90-beta (126-134)
gagguggucaagaagcacagccaguuc

SEQ ID NO: 49558 - RNA, 27 nt, Artificial Sequence
  Peroxisomal multifunctional enzyme type 2 (641-649)
gagguggucaagaaggugaacgccgug

SEQ ID NO: 49559 - RNA, 27 nt, Artificial Sequence
  39S ribosomal protein L21, mitochondrial (78-86)
gagguggucaagaaggugaacgagaug

SEQ ID NO: 49560 - RNA, 27 nt, Artificial Sequence
  Non-canonical poly(A) RNA polymerase PAPD7 (53-61)
gagguggucaagcgcaucgagaccgug

SEQ ID NO: 49561 - RNA, 39 nt, Artificial Sequence
  Radial spoke head 10 homolog B2 (158-170)
gagguggucaacggcaugcgcaacggguucggcauguuc

SEQ ID NO: 49562 - RNA, 33 nt, Artificial Sequence
  DNA replication licensing factor MCM7 (92-102)
gagguggucaacaaggacgugcuggacguguac

SEQ ID NO: 49563 - RNA, 27 nt, Artificial Sequence
  Unconventional myosin-Ib (290-298)
gagguggucaacaagaucaaccgcgcc

SEQ ID NO: 49564 - RNA, 42 nt, Artificial Sequence
  Protein ELYS (55-68)
gagguggucaacagcaucaccggcgagcgccuguccgccuac

SEQ ID NO: 49565 - RNA, 27 nt, Artificial Sequence
  Transcription factor SOX-13 (110-118)
gaggugguccccgccaucgagaagcug

SEQ ID NO: 49566 - RNA, 27 nt, Artificial Sequence
  Cathepsin K (85-93)
gaggugguccagaagaugaccggccug

SEQ ID NO: 49567 - RNA, 27 nt, Artificial Sequence
  Protein C12orf4 (366-374)
gaggugguccagcagguggugcuguac

SEQ ID NO: 49568 - RNA, 27 nt, Artificial Sequence
  Peptidylprolyl isomerase domain and WD repeat-containing protein 1 (616-624)
gaggugguccagcgcaucagcaacgug

SEQ ID NO: 49569 - RNA, 45 nt, Artificial Sequence
  Proteasome subunit alpha type-7 (197-211)
gaggugguccagagcggcgggaagaacaucgagcuggccgugaug

SEQ ID NO: 49570 - RNA, 27 nt, Artificial Sequence
  E3 ubiquitin-protein ligase BRE1B (40-48)
gaggugguccgcgagaccggcgaguac

SEQ ID NO: 49571 - RNA, 27 nt, Artificial Sequence
  Melanoma-associated antigen 12 (168-176)
gaggugguccgcaucggccaccuguac

SEQ ID NO: 49572 - RNA, 27 nt, Artificial Sequence
  Unconventional myosin-IXb (955-963)
gaggugguccgcaagauccugcuccug

SEQ ID NO: 49573 - RNA, 30 nt, Artificial Sequence
  Cytoskeleton-associated protein 5 (88-97)
gagguggucagcggcgugguguccaagguc

SEQ ID NO: 49574 - RNA, 27 nt, Artificial Sequence
  Ubiquitin-conjugating enzyme E2 variant 3 (232-240)
gagguggucagccacaccucccaggug

SEQ ID NO: 49575 - RNA, 33 nt, Artificial Sequence
  RNA demethylase ALKBH5 (109-119)
gagguggucagccgcgccgagaagggccuguac

SEQ ID NO: 49576 - RNA, 30 nt, Artificial Sequence
  Integrator complex subunit 1 (1714-1723)
gagguggucagcuccaccgugcgcgccgug

SEQ ID NO: 49577 - RNA, 33 nt, Artificial Sequence
  Cullin-3 (55-65)
gagguggucaccgagcaccugaucaacaaggug

SEQ ID NO: 49578 - RNA, 33 nt, Artificial Sequence
  Ankyrin repeat and zinc finger domain-containing protein 1 (16-26)
gagguggucacccacaagaccuuccaccgcuac

SEQ ID NO: 49579 - RNA, 30 nt, Artificial Sequence
  Cyclin-dependent kinase 2 (224-233)
gagguggucuggcccggcgugaccagcaug

SEQ ID NO: 49580 - RNA, 39 nt, Artificial Sequence
  Contactin-associated protein-like 3B (182-194)
gagguggucuacuucgacggccagagcgcccugcucuac

SEQ ID NO: 49581 - RNA, 27 nt, Artificial Sequence
  DDB1- and CUL4-associated factor 7 (176-184)
gagguguacgacaucgccuucagccgc

SEQ ID NO: 49582 - RNA, 30 nt, Artificial Sequence
  DDB1- and CUL4-associated factor 7 (176-185)
gagguguacgacaucgccuucagccgcgcc

SEQ ID NO: 49583 - RNA, 36 nt, Artificial Sequence
  Melanotransferrin (97-108)
gagguguacgaccaggaggucggcaccagcuacuac

SEQ ID NO: 49584 - RNA, 30 nt, Artificial Sequence
  Nuclear pore complex protein Nup155 (1301-1310)
gagguguacgaccagcuguucaagagccgc

SEQ ID NO: 49585 - RNA, 27 nt, Artificial Sequence
  Protein polybromo-1 (670-678)
gagguguacgaggccgucaagaacuac

SEQ ID NO: 49586 - RNA, 30 nt, Artificial Sequence
  DNA-directed RNA polymerase, mitochondrial (459-468)
gagguguacgagggccgcuucagccuguac

SEQ ID NO: 49587 - RNA, 33 nt, Artificial Sequence
  DNA-directed RNA polymerase, mitochondrial (459-469)
gagguguacgagggccgcuucagccuguacccc

SEQ ID NO: 49588 - RNA, 30 nt, Artificial Sequence
  Tyrosine-protein kinase ABL1 (255-264)
gagguguacgagggcgucuggaagaaguac

SEQ ID NO: 49589 - RNA, 30 nt, Artificial Sequence
  Protein lin-7 homolog C (52-61)
gagguguacgagcacgucuacgagaccgug

SEQ ID NO: 49590 - RNA, 27 nt, Artificial Sequence
  Zinc finger protein 292 (337-345)
gagguguacgagaaggucguggacuac

SEQ ID NO: 49591 - RNA, 33 nt, Artificial Sequence
  Muscular LMNA-interacting protein (350-360)
gagguguacgagcccaacccguucagcaaguac

SEQ ID NO: 49592 - RNA, 27 nt, Artificial Sequence
  rRNA methyltransferase 2, mitochondrial (229-237)
gagguguacuuccuggccacccaguac

SEQ ID NO: 49593 - RNA, 30 nt, Artificial Sequence
  Large neutral amino acids transporter small subunit 1 (122-131)
gagguguacggcagccugcccgccuuccuc

SEQ ID NO: 49594 - RNA, 36 nt, Artificial Sequence
  Procollagen-lysine,2-oxoglutarate 5-dioxygenase 2 (336-347)
gagguguaccacgagaaggacaucaaggucuucuuc

SEQ ID NO: 49595 - RNA, 30 nt, Artificial Sequence
  Nucleoside diphosphate kinase 7 (250-259)
gagguguacaagggcgucgugaccgaguac

SEQ ID NO: 49596 - RNA, 33 nt, Artificial Sequence
  Ras GTPase-activating-like protein IQGAP3 (1166-1176)
gagguguacaaggucgugggcaaccugcucuac

SEQ ID NO: 49597 - RNA, 30 nt, Artificial Sequence
  Kinesin-like protein KIF14 (5-14)
gagguguacaacgagaagauccacgaccug

SEQ ID NO: 49598 - RNA, 30 nt, Artificial Sequence
  Kinesin-like protein KIF18B (166-175)
gagguguacaacgagcagauccacgaccug

SEQ ID NO: 49599 - RNA, 30 nt, Artificial Sequence
  Kinesin-like protein KIF18A (161-170)
gagguguacaacgagcagauccgcgaccug

SEQ ID NO: 49600 - RNA, 27 nt, Artificial Sequence
  F-box only protein 32 (44-52)
gagguguacaacaaggagaaccuguuc

SEQ ID NO: 49601 - RNA, 39 nt, Artificial Sequence
  Tyrosinase (409-421)
gagguguaccccgaggccaacgccccgaucggccacaac

SEQ ID NO: 49602 - RNA, 36 nt, Artificial Sequence
  Ubiquitin carboxyl-terminal hydrolase 11 (150-161)
gagguguaccccgucgagcugcuccuggugcgccac

SEQ ID NO: 49603 - RNA, 27 nt, Artificial Sequence
  E3 ubiquitin-protein ligase UBR2 (37-45)
gagguguaccagcaccuggcccacuac

SEQ ID NO: 49604 - RNA, 30 nt, Artificial Sequence
  Small nuclear ribonucleoprotein Sm D3 (26-35)
gagguguaccgcggcaagcugaucgaggcc

SEQ ID NO: 49605 - RNA, 30 nt, Artificial Sequence
  Transmembrane protein 201 (151-160)
gagguguaccgccaccaccuggagcagaug

SEQ ID NO: 49606 - RNA, 33 nt, Artificial Sequence
  Pre-mRNA-processing-splicing factor 8 (2324-2334)
gagguguacagcgccgaccgcgaggaccuguac

SEQ ID NO: 49607 - RNA, 33 nt, Artificial Sequence
  Semaphorin-7A (114-124)
gagguguacagcaccauccgcaagcaggaguac

SEQ ID NO: 49608 - RNA, 33 nt, Artificial Sequence
  cAMP-dependent protein kinase type I-alpha regulatory subunit (103-113)
gagguguacaccgaggaggacgccgccagcuac

SEQ ID NO: 49609 - RNA, 30 nt, Artificial Sequence
  Arf-GAP with Rho-GAP domain, ANK repeat and PH domain-containing protein 1 (574-583)
gagguguacaccgagggcgagcgccuguac

SEQ ID NO: 49610 - RNA, 30 nt, Artificial Sequence
  DNA repair endonuclease XPF (99-108)
gagguguacacccagggcggggucaucuuc

SEQ ID NO: 49611 - RNA, 30 nt, Artificial Sequence
  Signal transducer and activator of transcription 2 (831-840)
gagguguacgucagccgccccucccacuuc

SEQ ID NO: 49612 - RNA, 33 nt, Artificial Sequence
  Signal transducer and activator of transcription 2 (831-841)
gagguguacgucagccgccccucccacuucuac

SEQ ID NO: 49613 - RNA, 27 nt, Artificial Sequence
  Phospholipase A-2-activating protein (168-176)
gagguguacuacggccacaccaacuac

SEQ ID NO: 49614 - RNA, 33 nt, Artificial Sequence
  Phospholipase A-2-activating protein (168-178)
gagguguacuacggccacaccaacuacaucuac

SEQ ID NO: 49615 - RNA, 27 nt, Artificial Sequence
  Protein virilizer homolog (485-493)
uucgccgaccacgugagcuccagccug

SEQ ID NO: 49616 - RNA, 27 nt, Artificial Sequence
  CLIP-associating protein 1 (877-885)
uucgccgacccccacagcaagcgcgug

SEQ ID NO: 49617 - RNA, 30 nt, Artificial Sequence
  CLIP-associating protein 1 (877-886)
uucgccgacccccacagcaagcgcguguuc

SEQ ID NO: 49618 - RNA, 27 nt, Artificial Sequence
  Calmodulin-regulated spectrin-associated protein 2 (673-681)
uucgccgagcagaaguuccgcaagcug

SEQ ID NO: 49619 - RNA, 30 nt, Artificial Sequence
  Sorting nexin-17 (460-469)
uucgccuucgagggcaucggggacgaggac

SEQ ID NO: 49620 - RNA, 27 nt, Artificial Sequence
  Melanoma-associated antigen C1 (1035-1043)
uucgccuucggcgagccccgcgagcug

SEQ ID NO: 49621 - RNA, 48 nt, Artificial Sequence
  POTE ankyrin domain family member F (721-736)
uucgccggcgacgacgccccccgcgcgguguucccgagcaucgucggg

SEQ ID NO: 49622 - RNA, 33 nt, Artificial Sequence
  Up-regulator of cell proliferation (600-610)
uucgcccacuuccccggccuggccagcgagcuc

SEQ ID NO: 49623 - RNA, 27 nt, Artificial Sequence
  Glycerol-3-phosphate dehydrogenase, mitochondrial (27-35)
uucgcccacuaccgccggaagcagaug

SEQ ID NO: 49624 - RNA, 24 nt, Artificial Sequence
  Alpha-catulin (24-31)
uucgcccuggacagcggccucgag

SEQ ID NO: 49625 - RNA, 33 nt, Artificial Sequence
  Melanocyte protein PMEL (247-257)
uucgcccugcagcuccacgaccccagcggcuac

SEQ ID NO: 49626 - RNA, 30 nt, Artificial Sequence
  Eukaryotic translation initiation factor 3 subunit E (53-62)
uucgccauggacguguacaagaaccuguac

SEQ ID NO: 49627 - RNA, 27 nt, Artificial Sequence
  NHL repeat-containing protein 2 (407-415)
uucgcccagcccagcggccugucccuc

SEQ ID NO: 49628 - RNA, 27 nt, Artificial Sequence
  Dynactin subunit 1 (1206-1214)
uucgccaccuuccccagcuccgccuuc

SEQ ID NO: 49629 - RNA, 24 nt, Artificial Sequence
  Translocon-associated protein subunit gamma (75-82)
uucgccuacaagaacgugaaguuc

SEQ ID NO: 49630 - RNA, 36 nt, Artificial Sequence
  Protein disulfide-isomerase A3 (160-171)
uucgacgacagcuucuccgaggcccacagcgaguuc

SEQ ID NO: 49631 - RNA, 27 nt, Artificial Sequence
  Phosphatidylinositol 3,4,5-trisphosphate 3-phosphatase and dual-specificity protein phosphatase PTEN (90-98)
uucgaggaccacaaccccccgcagcug

SEQ ID NO: 49632 - RNA, 45 nt, Artificial Sequence
  Keratin, type I cytoskeletal 9 (465-479)
uucgagagcuccggcgccgggaagaucggccuggggggccgcggg

SEQ ID NO: 49633 - RNA, 48 nt, Artificial Sequence
  Keratin, type I cytoskeletal 9 (465-480)
uucgagagcuccggcgccgggaagaucggccuggggggccgcgggggc

SEQ ID NO: 49634 - RNA, 36 nt, Artificial Sequence
  Interleukin enhancer-binding factor 3 (693-704)
uucuucaccgacugcuacggcuaccacgacuucggg

SEQ ID NO: 49635 - RNA, 42 nt, Artificial Sequence
  Interleukin enhancer-binding factor 3 (693-706)
uucuucaccgacugcuacggcuaccacgacuucgggagcucc

SEQ ID NO: 49636 - RNA, 30 nt, Artificial Sequence
  Apolipoprotein B-100 (2396-2405)
uucaucgacgacgccgugaagaagcugaac

SEQ ID NO: 49637 - RNA, 27 nt, Artificial Sequence
  Probable tRNA (uracil-O(2)-)-methyltransferase (608-616)
uucaucgaccaggugguccugcaggug

SEQ ID NO: 49638 - RNA, 33 nt, Artificial Sequence
  Plexin-A2 (789-799)
uucaucaucgacaacccccaggaccugaaggug

SEQ ID NO: 49639 - RNA, 39 nt, Artificial Sequence
  Filamin-A (2041-2053)
uucaucaucgacacccgcgacgccggcuacgggggccug

SEQ ID NO: 49640 - RNA, 45 nt, Artificial Sequence
  Filamin-A (2041-2055)
uucaucaucgacacccgcgacgccggcuacgggggccugagccuc

SEQ ID NO: 49641 - RNA, 27 nt, Artificial Sequence
  Uncharacterized protein CXorf57 (552-560)
uucauccuguucuucuacggcagcgac

SEQ ID NO: 49642 - RNA, 33 nt, Artificial Sequence
  Sorting nexin-14 (234-244)
uuccuggccgaccccgacaccgugaaccaccuc

SEQ ID NO: 49643 - RNA, 36 nt, Artificial Sequence
  Protein YIF1B (69-80)
uuccuggccgaccccgugagcaacauggccauggcg

SEQ ID NO: 49644 - RNA, 30 nt, Artificial Sequence
  Class E basic helix-loop-helix protein 41 (366-375)
uuccuggacaagagcggccucgagaaguac

SEQ ID NO: 49645 - RNA, 36 nt, Artificial Sequence
  Class E basic helix-loop-helix protein 41 (366-377)
uuccuggacaagagcggccucgagaaguaccuguac

SEQ ID NO: 49646 - RNA, 30 nt, Artificial Sequence
  Ceramide synthase 1 (207-216)
uuccugcacgacaucagcgacgugcagcuc

SEQ ID NO: 49647 - RNA, 27 nt, Artificial Sequence
  Exostosin-2 (253-261)
uuccugcucagcucccaggugggccug

SEQ ID NO: 49648 - RNA, 33 nt, Artificial Sequence
  Uncharacterized protein C15orf61 (147-157)
uuccugaacaaggaggacgagggcgccauguac

SEQ ID NO: 49649 - RNA, 27 nt, Artificial Sequence
  Spatacsin (617-625)
uuccugaacaaccagaucaaggagcuc

SEQ ID NO: 49650 - RNA, 27 nt, Artificial Sequence
  2',3'-cyclic-nucleotide 3'-phosphodiesterase (12-20)
uuccugcccaagaucuucuuccgcaag

SEQ ID NO: 49651 - RNA, 33 nt, Artificial Sequence
  Polyphosphoinositide phosphatase (404-414)
uuccugcccccggagcacaccaucguguacauc

SEQ ID NO: 49652 - RNA, 30 nt, Artificial Sequence
  Alpha/beta hydrolase domain-containing protein 17C (35-44)
uuccugcccccggagcccaccuacaccgug

SEQ ID NO: 49653 - RNA, 33 nt, Artificial Sequence
  Zinc finger protein with KRAB and SCAN domains 1 (104-114)
uuccugagcauccuccccaaggagcugcaggug

SEQ ID NO: 49654 - RNA, 30 nt, Artificial Sequence
  Presenilin-2 (437-446)
uucauggacacccuggccagccaccagcuc

SEQ ID NO: 49655 - RNA, 33 nt, Artificial Sequence
  Presenilin-2 (437-447)
uucauggacacccuggccagccaccagcucuac

SEQ ID NO: 49656 - RNA, 36 nt, Artificial Sequence
  Presenilin-2 (437-448)
uucauggacacccuggccagccaccagcucuacauc

SEQ ID NO: 49657 - RNA, 33 nt, Artificial Sequence
  Protein tyrosine phosphatase type IVA 1 (23-33)
uucauggaguuccugaagggcagcggggacuac

SEQ ID NO: 49658 - RNA, 27 nt, Artificial Sequence
  SHC-transforming protein 4 (33-41)
uuccgcaacgagagcaucaccucccug

SEQ ID NO: 49659 - RNA, 30 nt, Artificial Sequence
  Caprin-1 (656-665)
uucagcgccccccgcgacuacuccggcuac

SEQ ID NO: 49660 - RNA, 27 nt, Artificial Sequence
  Uncharacterized protein CXorf23 (6-14)
uucagcgacggccgcacccagaaguac

SEQ ID NO: 49661 - RNA, 36 nt, Artificial Sequence
  DNA-directed RNA polymerase I subunit RPA2 (493-504)
uucagcgaccacaaccaguccccccgcaacauguac

SEQ ID NO: 49662 - RNA, 33 nt, Artificial Sequence
  Serine/threonine-protein kinase RIO2 (416-426)
uucagcgaggagaagaaccgcaccgagaacuac

SEQ ID NO: 49663 - RNA, 30 nt, Artificial Sequence
  Tubulin alpha-1C chain (18-27)
uucagcgagaccggcgccgggaagcacgug

SEQ ID NO: 49664 - RNA, 24 nt, Artificial Sequence
  Nucleosome assembly protein 1-like 1 (245-252)
uucagcuucgacggccccgagauc

SEQ ID NO: 49665 - RNA, 30 nt, Artificial Sequence
  RNA-binding protein EWS (285-294)
uucagcggccccggggagaaccgcuccaug

SEQ ID NO: 49666 - RNA, 27 nt, Artificial Sequence
  40S ribosomal protein S27 (111-119)
uucagccacgcccagaccgugguccug

SEQ ID NO: 49667 - RNA, 27 nt, Artificial Sequence
  ADP-ribose pyrophosphatase, mitochondrial (257-265)
uucagccaggaccaccuggugaucuac

SEQ ID NO: 49668 - RNA, 51 nt, Artificial Sequence
  PERQ amino acid-rich with GYF domain-containing protein 2 (1273-1289)
uucagcgugaacgccuccagcgagcgccugaacaugggcgagaucgagacc

SEQ ID NO: 49669 - RNA, 33 nt, Artificial Sequence
  Serine/threonine-protein kinase Sgk1 (516-526)
uucagcuacgcccccccgaccgacuccuuccug

SEQ ID NO: 49670 - RNA, 33 nt, Artificial Sequence
  Transcription factor SOX-10 (425-435)
uucagcuacaugggccccucccagcgcccgcug

SEQ ID NO: 49671 - RNA, 33 nt, Artificial Sequence
  Protein argonaute-3 (775-785)
uucaccgccgacgagcugcagcuccugaccuac

SEQ ID NO: 49672 - RNA, 27 nt, Artificial Sequence
  Protein FAM102B (9-17)
uucaccgccgagagcucccgcgaggug

SEQ ID NO: 49673 - RNA, 27 nt, Artificial Sequence
  Dipeptidyl peptidase 2 (373-381)
uucaccgacgagcugcgccagcgguac

SEQ ID NO: 49674 - RNA, 27 nt, Artificial Sequence
  Membrane-associated transporter protein (338-346)
uucaccgacuucaugggccagaucgug

SEQ ID NO: 49675 - RNA, 30 nt, Artificial Sequence
  Membrane-associated transporter protein (338-347)
uucaccgacuucaugggccagaucguguac

SEQ ID NO: 49676 - RNA, 24 nt, Artificial Sequence
  Probable guanine nucleotide exchange factor MCF2L2 (62-69)
uucaccgacaucggcaucaaguac

SEQ ID NO: 49677 - RNA, 30 nt, Artificial Sequence
  Testis-expressed sequence 10 protein (107-116)
uucaccgacaaggacgccaacgugcgccug

SEQ ID NO: 49678 - RNA, 27 nt, Artificial Sequence
  Semaphorin-5A (1065-1073)
uucaccgaccugaacaacuacgacgag

SEQ ID NO: 49679 - RNA, 30 nt, Artificial Sequence
  Semaphorin-5A (1065-1074)
uucaccgaccugaacaacuacgacgaguac

SEQ ID NO: 49680 - RNA, 27 nt, Artificial Sequence
  Tubulin polyglutamylase complex subunit 1 (17-25)
uucaccgacagcggccgccaguccgug

SEQ ID NO: 49681 - RNA, 33 nt, Artificial Sequence
  Leucine-rich repeat-containing protein 42 (128-138)
uucaccgagcccggcgccgggcugcgcgcccuc

SEQ ID NO: 49682 - RNA, 27 nt, Artificial Sequence
  AF4/FMR2 family member 1 (3-11)
uucaccgagcgcgugaacagcuccggc

SEQ ID NO: 49683 - RNA, 21 nt, Artificial Sequence
  von Willebrand factor A domain-containing protein 9 (129-135)
uucaccaucgacggcccccug

SEQ ID NO: 49684 - RNA, 27 nt, Artificial Sequence
  Elongator complex protein 1 (934-942)
uucaccaucgacaaguaccugaagcgc

SEQ ID NO: 49685 - RNA, 51 nt, Artificial Sequence
  Melanocyte protein PMEL (214-230)
uucaccaucaccgaccaggugcccuucagcgucuccgugagccagcugcgc

SEQ ID NO: 49686 - RNA, 33 nt, Artificial Sequence
  Hypoxia-inducible factor 1-alpha (295-305)
uucaccaagggccaggugaccacggggcaguac

SEQ ID NO: 49687 - RNA, 27 nt, Artificial Sequence
  Ropporin-1B (203-211)
uucacccagaacccccgcguguggcug

SEQ ID NO: 49688 - RNA, 24 nt, Artificial Sequence
  Nephrocystin-4 (1264-1271)
uucaccagccacccccaggagcug

SEQ ID NO: 49689 - RNA, 27 nt, Artificial Sequence
  Very-long-chain enoyl-CoA reductase (119-127)
uucaccagcucccgccacaccgugguc

SEQ ID NO: 49690 - RNA, 27 nt, Artificial Sequence
  Cytoplasmic dynein 2 heavy chain 1 (2484-2492)
uucaccguggacgacuacagccacuac

SEQ ID NO: 49691 - RNA, 45 nt, Artificial Sequence
  Cleft lip and palate transmembrane protein 1-like protein (157-171)
uucguguucgacggcagcucccugcccgccgacguccaccgcuac

SEQ ID NO: 49692 - RNA, 33 nt, Artificial Sequence
  TNF receptor-associated factor 4 (202-212)
uucguguucgacaccauccagagccaccaguac

SEQ ID NO: 49693 - RNA, 27 nt, Artificial Sequence
  NADH dehydrogenase (ubiquinone) 1 beta subcomplex subunit 1 (32-40)
uucgugaucggcugcuaccuggaccgc

SEQ ID NO: 49694 - RNA, 33 nt, Artificial Sequence
  FAD-dependent oxidoreductase domain-containing protein 2 (493-503)
uucgugaucaacauggaguacggccgcaacuuc

SEQ ID NO: 49695 - RNA, 27 nt, Artificial Sequence
  Ran GTPase-activating protein 1 (562-570)
uucgugaccaagcccaacagcgcccug

SEQ ID NO: 49696 - RNA, 27 nt, Artificial Sequence
  Long-chain-fatty-acid-CoA ligase 3 (624-632)
uucgugguccccaaccagaaggagcug

SEQ ID NO: 49697 - RNA, 30 nt, Artificial Sequence
  Mitochondrial folate transporter/carrier (297-306)
uucguggucuacgagaacgugagccacuuc

SEQ ID NO: 49698 - RNA, 30 nt, Artificial Sequence
  F-box only protein 21 (602-611)
uucguguacgagaccguccagaacaucuac

SEQ ID NO: 49699 - RNA, 33 nt, Artificial Sequence
  Transmembrane protein 181 (554-564)
uucguguacagccccuccaagaacgcccuguac

SEQ ID NO: 49700 - RNA, 27 nt, Artificial Sequence
  GDP-fucose protein O-fucosyltransferase 1 (2-10)
ggcgccgccgcgugggcccgcccccug

SEQ ID NO: 49701 - RNA, 27 nt, Artificial Sequence
  Zinc finger and BTB domain-containing protein 7A (137-145)
ggcgccgacgccgggcagcuggaccuc

SEQ ID NO: 49702 - RNA, 30 nt, Artificial Sequence
  3'(2'),5'-bisphosphate nucleotidase 1 (176-185)
ggcgccuucggguuccagcugaaggaggug

SEQ ID NO: 49703 - RNA, 27 nt, Artificial Sequence
  X-ray repair cross-complementing protein 5 (469-477)
ggcgcccacuucagcguguccagccug

SEQ ID NO: 49704 - RNA, 27 nt, Artificial Sequence
  Replication protein A 70 kDa DNA-binding subunit (8-16)
ggcgccaucgccgcgaucaugcagaag

SEQ ID NO: 49705 - RNA, 27 nt, Artificial Sequence
  WD repeat-containing protein 89 (351-359)
ggcgccaucgagaagaccuucaccaag

SEQ ID NO: 49706 - RNA, 33 nt, Artificial Sequence
  Elongation factor 2 (190-200)
ggcgcccugugcgaggagaacaugcgcggggug

SEQ ID NO: 49707 - RNA, 27 nt, Artificial Sequence
  NHP2-like protein 1 (38-46)
ggcgccaacgaggccaccaagacccug

SEQ ID NO: 49708 - RNA, 39 nt, Artificial Sequence
  Nestin (515-527)
ggcgcccccgugcaccuggggcagggccaguuccucaag

SEQ ID NO: 49709 - RNA, 51 nt, Artificial Sequence
  Galectin-1 (66-82)
ggcgccugggggaccgagcagcgcgaggccguguuccccuuccagccgggc

SEQ ID NO: 49710 - RNA, 27 nt, Artificial Sequence
  Calcium-transporting ATPase type 2C member 1 (481-489)
ggcgccuacgagcaggugaucaaguac

SEQ ID NO: 49711 - RNA, 27 nt, Artificial Sequence
  Delta(24)-sterol reductase (349-357)
ggcgccuacggggagccccgcgugaag

SEQ ID NO: 49712 - RNA, 27 nt, Artificial Sequence
  Ribosomal protein S6 kinase alpha-5 (58-66)
ggcgccuacgggaagguguuccugguc

SEQ ID NO: 49713 - RNA, 45 nt, Artificial Sequence
  Heterogeneous nuclear ribonucleoprotein F (26-40)
ggcgccuacagcucccaggugaugcaggggaugggcgucagcgcc

SEQ ID NO: 49714 - RNA, 27 nt, Artificial Sequence
  Complement factor H-related protein 2 (34-42)
ggcgacaucaccagcuuccugcucucc

SEQ ID NO: 49715 - RNA, 27 nt, Artificial Sequence
  Protein SMG8 (168-176)
ggcgaggccgggggcgggcugagccuc

SEQ ID NO: 49716 - RNA, 36 nt, Artificial Sequence
  Cytoplasmic dynein 1 heavy chain 1 (2969-2980)
ggcgaggacuucgacgaggaccugcgcaccgugcuc

SEQ ID NO: 49717 - RNA, 30 nt, Artificial Sequence
  Cytoplasmic dynein 1 light intermediate chain 1 (74-83)
ggcgaggacggggccggcaagaccagccug

SEQ ID NO: 49718 - RNA, 27 nt, Artificial Sequence
  Neural cell adhesion molecule L1 (1050-1058)
ggcgaggagaaggggggcgccagccug

SEQ ID NO: 49719 - RNA, 27 nt, Artificial Sequence
  HEAT repeat-containing protein 5B (1966-1974)
ggcgaggagcagaaccgcgugcagcug

SEQ ID NO: 49720 - RNA, 33 nt, Artificial Sequence
  Rho guanine nucleotide exchange factor 2 (798-808)
ggcgaggagcgcgccaccgaggccgggagccug

SEQ ID NO: 49721 - RNA, 27 nt, Artificial Sequence
  Chondroitin sulfate synthase 2 (169-177)
ggcgaggagcgccccaucgggcaccug

SEQ ID NO: 49722 - RNA, 30 nt, Artificial Sequence
  CD276 antigen (290-299)
ggcgagggggagggcagcaagaccgcccug

SEQ ID NO: 49723 - RNA, 27 nt, Artificial Sequence
  Ras GTPase-activating-like protein IQGAP1 (1300-1308)
ggcgagaucaucaacacccacacccug

SEQ ID NO: 49724 - RNA, 27 nt, Artificial Sequence
  Bifunctional 3'-phosphoadenosine 5'-phosphosulfate synthase 2 (170-178)
ggcgagaucaagggguucaccggcauc

SEQ ID NO: 49725 - RNA, 33 nt, Artificial Sequence
  Serine/threonine-protein kinase TBK1 (496-506)
ggcgagaucagcgacauccacaccaagcugcuc

SEQ ID NO: 49726 - RNA, 30 nt, Artificial Sequence
  Leucine zipper putative tumor suppressor 2 (448-457)
ggcgagaucagccugcucaagcagcagcug

SEQ ID NO: 49727 - RNA, 33 nt, Artificial Sequence
  DNA-directed RNA polymerase III subunit RPC3 (18-28)
ggcgagaucguggagaagaucgggguccaccug

SEQ ID NO: 49728 - RNA, 27 nt, Artificial Sequence
  Coatomer subunit beta' (652-660)
ggcgagcugaagaucgccuaccagcuc

SEQ ID NO: 49729 - RNA, 27 nt, Artificial Sequence
  DNA topoisomerase 3-beta-1 (168-176)
ggcgagcccgaccacaacgaggcccug

SEQ ID NO: 49730 - RNA, 36 nt, Artificial Sequence
  Ras-related protein Rab-5A (27-38)
ggcgagagcgccguggggaaguccagccugguccuc

SEQ ID NO: 49731 - RNA, 27 nt, Artificial Sequence
  Hemicentin-1 (1905-1913)
ggcgagacccagcagcacauccagcug

SEQ ID NO: 49732 - RNA, 27 nt, Artificial Sequence
  NF-kappa-B inhibitor beta (105-113)
ggcgagaccagcaccguggagaagcug

SEQ ID NO: 49733 - RNA, 27 nt, Artificial Sequence
  Probable N-acetyltransferase 16 (116-124)
ggcgagaccgugcuggucgaggggcuc

SEQ ID NO: 49734 - RNA, 39 nt, Artificial Sequence
  5,6-dihydroxyindole-2-carboxylic acid oxidase (209-221)
ggcgagguggacuucagccacgaggggcccgccuuccug

SEQ ID NO: 49735 - RNA, 33 nt, Artificial Sequence
  Unconventional myosin-X (1723-1733)
ggcgagguggucgagaagcugauccgcgggcuc

SEQ ID NO: 49736 - RNA, 30 nt, Artificial Sequence
  Ornithine aminotransferase, mitochondrial (121-130)
ggcgaguacgaggaguacaucaccaagcug

SEQ ID NO: 49737 - RNA, 27 nt, Artificial Sequence
  Carbonic anhydrase-related protein (45-53)
ggcgaguaccagagccccaucaaccug

SEQ ID NO: 49738 - RNA, 51 nt, Artificial Sequence
  Peptidyl-prolyl cis-trans isomerase A (64-80)
ggcggggacuucacccgccacaacggcaccgggggcaagagcaucuacggg

SEQ ID NO: 49739 - RNA, 42 nt, Artificial Sequence
  NEDD8-conjugating enzyme Ubc12 (170-183)
ggcggguacaucggcagcaccuacuucgagcgcugccugaag

SEQ ID NO: 49740 - RNA, 30 nt, Artificial Sequence
  Fibrocystin-L (2531-2540)
ggcaucgagcacgggaacauccugcaguac

SEQ ID NO: 49741 - RNA, 27 nt, Artificial Sequence
  Polypeptide N-acetylgalactosaminyltransferase 16 (295-303)
ggcaucuucgugaucgacaagagcugg

SEQ ID NO: 49742 - RNA, 30 nt, Artificial Sequence
  2'-5'-oligoadenylate synthase-like protein (493-502)
ggcauccaggacagcgacacccugauccuc

SEQ ID NO: 49743 - RNA, 27 nt, Artificial Sequence
  60S ribosomal protein L37a (8-16)
ggcaucguggggaaguacggcacccgc

SEQ ID NO: 49744 - RNA, 27 nt, Artificial Sequence
  Intraflagellar transport protein 172 homolog (129-137)
ggccuggccgaggggaaggugcgccuc

SEQ ID NO: 49745 - RNA, 27 nt, Artificial Sequence
  Pre-B-cell leukemia transcription factor-interacting protein 1 (428-436)
ggccuggccgagcucgggcaccgccug

SEQ ID NO: 49746 - RNA, 27 nt, Artificial Sequence
  NADH dehydrogenase (ubiquinone) 1 alpha subcomplex subunit 1 (20-28)
ggccuggccaccgccuacauccaccgc

SEQ ID NO: 49747 - RNA, 27 nt, Artificial Sequence
  Selenocysteine insertion sequence-binding protein 2-like (751-759)
ggccuggacgaggcccucuacaacgug

SEQ ID NO: 49748 - RNA, 27 nt, Artificial Sequence
  Solute carrier family 25 member 33 (93-101)
ggccuggggcccaaccucgugggcguc

SEQ ID NO: 49749 - RNA, 24 nt, Artificial Sequence
  Lysine-specific demethylase 3A (124-131)
ggccuggggagcaucaccuccgug

SEQ ID NO: 49750 - RNA, 27 nt, Artificial Sequence
  Membrane-associated transporter protein (409-417)
ggccuggggaccggcuucaucgggcuc

SEQ ID NO: 49751 - RNA, 27 nt, Artificial Sequence
  Plectin (546-554)
ggccugcaccagagcaucgaggaguuc

SEQ ID NO: 49752 - RNA, 27 nt, Artificial Sequence
  Filamin-A (1300-1308)
ggccugcacagcguggacgucaccuac

SEQ ID NO: 49753 - RNA, 36 nt, Artificial Sequence
  Ubiquitin-conjugating enzyme E2 G1 (28-39)
ggccugaucgacgacaacgaccucuaccgcugggag

SEQ ID NO: 49754 - RNA, 27 nt, Artificial Sequence
  Dedicator of cytokinesis protein 11 (1172-1180)
ggccugcuccuggagaacauccagcgc

SEQ ID NO: 49755 - RNA, 33 nt, Artificial Sequence
  ATP-dependent RNA helicase DDX1 (121-131)
ggccugaugaaggggaagcacuacuacgaggug

SEQ ID NO: 49756 - RNA, 27 nt, Artificial Sequence
  U7 snRNA-associated Sm-like protein LSm10 (23-31)
ggccugcaggggcgcgugaccaccguc

SEQ ID NO: 49757 - RNA, 27 nt, Artificial Sequence
  Mortality factor 4-like protein 1 (100-108)
ggccugcagcagaagaacguggagguc

SEQ ID NO: 49758 - RNA, 21 nt, Artificial Sequence
  Microtubule-associated protein 1B (225-231)
ggccugagcgaguucaccgag

SEQ ID NO: 49759 - RNA, 27 nt, Artificial Sequence
  Pterin-4-alpha-carbinolamine dehydratase (12-20)
ggccugagcgagcgcgacaucaaccuc

SEQ ID NO: 49760 - RNA, 27 nt, Artificial Sequence
  Protein-methionine sulfoxide oxidase MICAL3 (1054-1062)
ggccugagcgaggugcucguccagauc

SEQ ID NO: 49761 - RNA, 27 nt, Artificial Sequence
  Probable E3 ubiquitin-protein ligase HERC1 (3214-3222)
ggccugaccgacauccgcacccucgug

SEQ ID NO: 49762 - RNA, 33 nt, Artificial Sequence
  Zinc transporter ZIP14 (20-30)
ggccuguggcgcaccacccccgaggcccacgcc

SEQ ID NO: 49763 - RNA, 33 nt, Artificial Sequence
  Prolyl 3-hydroxylase 2 (87-97)
ggccuguacgaggccaucgccgaccacuacaug

SEQ ID NO: 49764 - RNA, 30 nt, Artificial Sequence
  Guanine nucleotide-binding protein-like 3-like protein (377-386)
ggccuguacagccaggagcaggccgccaag

SEQ ID NO: 49765 - RNA, 27 nt, Artificial Sequence
  Tuberin (1302-1310)
ggcauggaccgccggaccgacgccuac

SEQ ID NO: 49766 - RNA, 33 nt, Artificial Sequence
  Unconventional myosin-Va (1628-1638)
ggcaugcuggagcacgagaccauccagggggug

SEQ ID NO: 49767 - RNA, 51 nt, Artificial Sequence
  Spectrin alpha chain, non-erythrocytic 1 (367-383)
ggcaugaugccccgcgacgagaccgacagcaagaccgccuccccguggaag

SEQ ID NO: 49768 - RNA, 27 nt, Artificial Sequence
  Solute carrier family 35 member E1 (21-29)
ggcaugaugaccgccauccugggggug

SEQ ID NO: 49769 - RNA, 27 nt, Artificial Sequence
  Catenin beta-1 (106-114)
ggcaugcagauccccagcacccaguuc

SEQ ID NO: 49770 - RNA, 51 nt, Artificial Sequence
  Autophagy-related protein 2 homolog A (1914-1930)
ggcaugcgcaaccagaucgugcccgacgcccacaaggaccacgcccugaag

SEQ ID NO: 49771 - RNA, 27 nt, Artificial Sequence
  Synaptic vesicle membrane protein VAT-1 homolog (137-145)
ggcauguggcaggaggaggugaccguc

SEQ ID NO: 49772 - RNA, 36 nt, Artificial Sequence
  BMP and activin membrane-bound inhibitor homolog (249-260)
ggcauguacagcgggcacggcaagcuggaguucgug

SEQ ID NO: 49773 - RNA, 30 nt, Artificial Sequence
  Bifunctional lysine-specific demethylase and histidyl-hydroxylase MINA (93-102)
ggcauguacuacgggcgcgacgugaacguc

SEQ ID NO: 49774 - RNA, 51 nt, Artificial Sequence
  Heterogeneous nuclear ribonucleoprotein A1-like 2 (126-142)
ggcaacuucgggggccgcagcuccgggcccuacggcgggggcggccaguac

SEQ ID NO: 49775 - RNA, 27 nt, Artificial Sequence
  Uncharacterized protein KIAA1841 (80-88)
ggcaacgugaucagcauccugaucucc

SEQ ID NO: 49776 - RNA, 48 nt, Artificial Sequence
  Vimentin (17-32)
ggccccgggaccgccagccgcccguccagcucccggagcuacgugacc

SEQ ID NO: 49777 - RNA, 51 nt, Artificial Sequence
  Vimentin (17-33)
ggccccgggaccgccagccgcccguccagcucccggagcuacgugaccacg

SEQ ID NO: 49778 - RNA, 42 nt, Artificial Sequence
  Stromal membrane-associated protein 2 (336-349)
ggccaggccgccaaccagacccugagcccccagauguggaag

SEQ ID NO: 49779 - RNA, 33 nt, Artificial Sequence
  Integrin beta-3 (297-307)
ggccagugccacguggggagcgacaaccacuac

SEQ ID NO: 49780 - RNA, 30 nt, Artificial Sequence
  Anaphase-promoting complex subunit 7 (149-158)
ggccaggagcgccccagcgugaccuccuac

SEQ ID NO: 49781 - RNA, 27 nt, Artificial Sequence
  Protein FAM98A (492-500)
ggccaguucgagcagcacuuccagcac

SEQ ID NO: 49782 - RNA, 30 nt, Artificial Sequence
  UPF0428 protein CXorf56 (123-132)
ggccagggguucggcaagaccaacaucuac

SEQ ID NO: 49783 - RNA, 27 nt, Artificial Sequence
  Melanoma antigen preferentially expressed in tumors (89-97)
ggccagcaccugcaccucgagaccuuc

SEQ ID NO: 49784 - RNA, 27 nt, Artificial Sequence
  Sodium-dependent neutral amino acid transporter B(0)AT2 (281-289)
ggccagaucacccacaacaccagcuuc

SEQ ID NO: 49785 - RNA, 27 nt, Artificial Sequence
  Class E basic helix-loop-helix protein 41 (208-216)
ggccagaagcuggagccccucgccuac

SEQ ID NO: 49786 - RNA, 42 nt, Artificial Sequence
  Heterogeneous nuclear ribonucleoprotein U (692-705)
ggccagaagcccuggagccagcacuaccaccagggguacuac

SEQ ID NO: 49787 - RNA, 27 nt, Artificial Sequence
  CAP-Gly domain-containing linker protein 3 (317-325)
ggccagaagcaggggaucgugcgcuuc

SEQ ID NO: 49788 - RNA, 30 nt, Artificial Sequence
  Protein SCAI (271-280)
ggccagcugagccucgccgacgcccugauc

SEQ ID NO: 49789 - RNA, 33 nt, Artificial Sequence
  Ras GTPase-activating protein-binding protein 2 (102-112)
ggccagcccgagcgcaaguucaugcagaccuuc

SEQ ID NO: 49790 - RNA, 27 nt, Artificial Sequence
  Clathrin heavy chain 1 (26-34)
ggccagccccagccgggguucggcuac

SEQ ID NO: 49791 - RNA, 27 nt, Artificial Sequence
  Kinesin-like protein KIF3C (89-97)
ggccagaccgggaccggcaagacguac

SEQ ID NO: 49792 - RNA, 30 nt, Artificial Sequence
  F-box only protein 7 (137-146)
ggccaggugccccacagccuggagacccuc

SEQ ID NO: 49793 - RNA, 27 nt, Artificial Sequence
  Protein FAM13A (81-89)
ggccgcgacaaggggcugaucaacaag

SEQ ID NO: 49794 - RNA, 57 nt, Artificial Sequence
  Nucleolar and spindle-associated protein 1 (253-271)
ggccgcagcugcgggcccgccucccagagcacccugggccucaaggggucccugaag

SEQ ID NO: 49795 - RNA, 27 nt, Artificial Sequence
  Phosphatidylinositide phosphatase SAC2 (738-746)
ggcagcgaccugcccaucaucgagaag

SEQ ID NO: 49796 - RNA, 33 nt, Artificial Sequence
  Anoctamin-4 (845-855)
ggcagcgaguucuccgggaccccccugaaguac

SEQ ID NO: 49797 - RNA, 42 nt, Artificial Sequence
  Keratin, type II cytoskeletal 1 (603-616)
ggcagcgggggcggguccagcggcggguccaucggcggccgc

SEQ ID NO: 49798 - RNA, 27 nt, Artificial Sequence
  HLA class I histocompatibility antigen, B-50 alpha chain (25-33)
ggcagccacuccaugcgcuacuuccac

SEQ ID NO: 49799 - RNA, 27 nt, Artificial Sequence
  LIM and calponin homology domains-containing protein 1 (610-618)
ggcagcaucgagaucaacaucaagaag

SEQ ID NO: 49800 - RNA, 36 nt, Artificial Sequence
  Poly(rC)-binding protein 1 (26-37)
ggcagcaucaucgggaagaagggcgaguccgugaag

SEQ ID NO: 49801 - RNA, 39 nt, Artificial Sequence
  Poly(rC)-binding protein 2 (26-38)
ggcagcaucaucgggaagaagggcgaguccgugaagaag

SEQ ID NO: 49802 - RNA, 27 nt, Artificial Sequence
  Parkinson disease 7 domain-containing protein 1 (55-63)
ggcagccuggcccgcauccuccagcac

SEQ ID NO: 49803 - RNA, 27 nt, Artificial Sequence
  Integrator complex subunit 4 (30-38)
ggcagccuggagaaguccgugaccaag

SEQ ID NO: 49804 - RNA, 30 nt, Artificial Sequence
  Phytanoyl-CoA dioxygenase, peroxisomal (117-126)
ggcagccugaagccccacgacuacccgaag

SEQ ID NO: 49805 - RNA, 27 nt, Artificial Sequence
  Signal peptidase complex catalytic subunit SEC11A (55-63)
ggcagcauggagcccgccuuccaccgc

SEQ ID NO: 49806 - RNA, 27 nt, Artificial Sequence
  ER membrane protein complex subunit 1 (351-359)
ggcagcaugggguccuucagcgagaag

SEQ ID NO: 49807 - RNA, 33 nt, Artificial Sequence
  SLAIN motif-containing protein 2 (286-296)
ggcagcaugaaggacgacuccuggaaggacggg

SEQ ID NO: 49808 - RNA, 27 nt, Artificial Sequence
  Dynein heavy chain 14, axonemal (154-162)
ggcagcuccaagaucgccauccagaag

SEQ ID NO: 49809 - RNA, 33 nt, Artificial Sequence
  Dyslexia-associated protein KIAA0319-like protein (680-690)
ggcagcgugcccaacgggcagaccccgcugaag

SEQ ID NO: 49810 - RNA, 39 nt, Artificial Sequence
  28S ribosomal protein S16, mitochondrial (52-64)
ggcagcuacgacccccugccgaacucccacggggagaag

SEQ ID NO: 49811 - RNA, 27 nt, Artificial Sequence
  Transcription factor SOX-10 (199-207)
ggcaccgccgccauccaggcgcacuac

SEQ ID NO: 49812 - RNA, 30 nt, Artificial Sequence
  5,6-dihydroxyindole-2-carboxylic acid oxidase (495-504)
ggcaccgccagcuaccugauccgcgcccgg

SEQ ID NO: 49813 - RNA, 24 nt, Artificial Sequence
  FRAS1-related extracellular matrix protein 1 (1422-1429)
ggcaccgacaagcccgaggagcug

SEQ ID NO: 49814 - RNA, 27 nt, Artificial Sequence
  Retinol dehydrogenase 8 (207-215)
ggcaccgaccccgagacccugcacuac

SEQ ID NO: 49815 - RNA, 27 nt, Artificial Sequence
  Receptor-type tyrosine-protein phosphatase gamma isoform X5 (1086-1094)
ggcaccgacuacaucaacgccagcuac

SEQ ID NO: 49816 - RNA, 27 nt, Artificial Sequence
  Fibronectin (331-339)
ggcaccgacuacaagaucuaccuguac

SEQ ID NO: 49817 - RNA, 27 nt, Artificial Sequence
  Myelin proteolipid protein (42-50)
ggcaccgagaagcugaucgagaccuac

SEQ ID NO: 49818 - RNA, 36 nt, Artificial Sequence
  Fructose-bisphosphate aldolase A (48-59)
ggcaccgagaacaccgaggagaaccgccgguucuac

SEQ ID NO: 49819 - RNA, 36 nt, Artificial Sequence
  Activating signal cointegrator 1 complex subunit 3 (1388-1399)
ggcaccgaguacuacgacgggaagacccgccgguac

SEQ ID NO: 49820 - RNA, 30 nt, Artificial Sequence
  39S ribosomal protein L41, mitochondrial (18-27)
ggcaccuucgaccccgacaaccuggagaag

SEQ ID NO: 49821 - RNA, 36 nt, Artificial Sequence
  Fibronectin (567-578)
ggcaccuucuaccagaucggggacagcugggagaag

SEQ ID NO: 49822 - RNA, 27 nt, Artificial Sequence
  NHS-like protein 1 (375-383)
ggcaccgggacccugcuccgccccaag

SEQ ID NO: 49823 - RNA, 30 nt, Artificial Sequence
  Receptor-interacting serine/threonine-protein kinase 4 (183-192)
ggcaccaucgccuaccugcccccggagcgc

SEQ ID NO: 49824 - RNA, 30 nt, Artificial Sequence
  Centromere protein F (3155-3164)
ggcaccauccugcgcgagcccaccacgaag

SEQ ID NO: 49825 - RNA, 27 nt, Artificial Sequence
  SWI/SNF-related matrix-associated actin-dependent regulator of chromatin subfamily E member 1-related (80-88)
ggcacccuggacuucuacauggcccgc

SEQ ID NO: 49826 - RNA, 36 nt, Artificial Sequence
  Translocating chain-associated membrane protein 1 (356-367)
ggcacccugaccagcaacguggccgacuccccccgc

SEQ ID NO: 49827 - RNA, 30 nt, Artificial Sequence
  Anaphase-promoting complex subunit 1 (1218-1227)
ggcaccauggacaugagcaucacccgccug

SEQ ID NO: 49828 - RNA, 33 nt, Artificial Sequence
  F-actin-capping protein subunit beta (211-221)
ggcaccaugaaccuggggggcagccucacccgc

SEQ ID NO: 49829 - RNA, 30 nt, Artificial Sequence
  Mitochondrial intermediate peptidase (222-231)
ggcaccaacuuccccaacaagaucgagaag

SEQ ID NO: 49830 - RNA, 27 nt, Artificial Sequence
  Synaptobrevin homolog YKT6 (178-186)
ggcacccagagcaaggccuucuacaag

SEQ ID NO: 49831 - RNA, 27 nt, Artificial Sequence
  Protein FAM83D (419-427)
ggcacccagaccgccgugaucacgcgc

SEQ ID NO: 49832 - RNA, 27 nt, Artificial Sequence
  Neuron navigator 2 (769-777)
ggcacccaggugacccacagcacgcug

SEQ ID NO: 49833 - RNA, 27 nt, Artificial Sequence
  MpV17 transgene, murine homolog, glomerulosclerosis, isoform CRA_f (79-87)
ggcaccaccaagguggacgcccugaag

SEQ ID NO: 49834 - RNA, 30 nt, Artificial Sequence
  Sorcin (118-127)
ggcaccguggacccccaggagcugcagaag

SEQ ID NO: 49835 - RNA, 36 nt, Artificial Sequence
  Galectin-3 (136-147)
ggcaccgugaagcccaacgccaaccgcaucgcccug

SEQ ID NO: 49836 - RNA, 33 nt, Artificial Sequence
  Putative germ cell-less protein-like 1-like (82-92)
ggcaccuacgggcuggacagcgugaagaagaag

SEQ ID NO: 49837 - RNA, 48 nt, Artificial Sequence
  Chromobox protein homolog 6 (397-412)
ggcguggccggggccgcgggcgggggcgggagcaucggcgccuccaag

SEQ ID NO: 49838 - RNA, 27 nt, Artificial Sequence
  WD repeat-containing protein 1 (324-332)
ggcguggacgggaacguccgccuguac

SEQ ID NO: 49839 - RNA, 27 nt, Artificial Sequence
  Zinc finger protein 106 (750-758)
ggcguguucgaggggcacaccagcaag

SEQ ID NO: 49840 - RNA, 30 nt, Artificial Sequence
  Scavenger receptor class B member 1 (291-300)
ggcguguucgaggggauccccaccuaccgc

SEQ ID NO: 49841 - RNA, 30 nt, Artificial Sequence
  Vacuolar-sorting protein SNF8 (5-14)
ggcgugggggccggcgccaucgcgaagaag

SEQ ID NO: 49842 - RNA, 42 nt, Artificial Sequence
  Dedicator of cytokinesis protein 4 (591-604)
ggcgugaucgacgccgccgucaacgggggcgugagccgcuac

SEQ ID NO: 49843 - RNA, 27 nt, Artificial Sequence
  Ribosomal protein S6 kinase delta-1 (332-340)
ggcgugaucgacaagguccugcucgug

SEQ ID NO: 49844 - RNA, 27 nt, Artificial Sequence
  Disabled homolog 2 (110-118)
ggcgugaucgagcacgagcaccccguc

SEQ ID NO: 49845 - RNA, 33 nt, Artificial Sequence
  Probable ATP-dependent RNA helicase DDX58 (746-756)
ggcgugaucgagaaggagcagaucaacauguac

SEQ ID NO: 49846 - RNA, 33 nt, Artificial Sequence
  Regulator of chromosome condensation (182-192)
ggcgugaucgggcugcucgagcccaugaagaag

SEQ ID NO: 49847 - RNA, 30 nt, Artificial Sequence
  Interleukin enhancer-binding factor 3 (91-100)
ggcgugaugcgcgucgggcugguggccaag

SEQ ID NO: 49848 - RNA, 27 nt, Artificial Sequence
  Chromodomain-helicase-DNA-binding protein 4 (1522-1530)
ggcgugaugagccugauccgcaagaag

SEQ ID NO: 49849 - RNA, 27 nt, Artificial Sequence
  Non-structural maintenance of chromosomes element 1 homolog (3-11)
ggcgugaugaccgacguccaccgccgg

SEQ ID NO: 49850 - RNA, 36 nt, Artificial Sequence
  POTE ankyrin domain family member I (75-86)
ggcgugacccacaccguccccaucuacgagggguac

SEQ ID NO: 49851 - RNA, 30 nt, Artificial Sequence
  Protein-glutamine gamma-glutamyltransferase 6 (232-241)
ggcgugguccaggggcaguggcagggcaag

SEQ ID NO: 49852 - RNA, 36 nt, Artificial Sequence
  Copine-3 (78-89)
ggcguguacgacaucgacaacaagaccaucgagcug

SEQ ID NO: 49853 - RNA, 30 nt, Artificial Sequence
  Hyccin (107-116)
ggcguguacaaccuggagaucgucgacaag

SEQ ID NO: 49854 - RNA, 33 nt, Artificial Sequence
  Alpha-actinin-4 (5-15)
cacgccgccaaccagagcuaccaguacggcccc

SEQ ID NO: 49855 - RNA, 48 nt, Artificial Sequence
  Alpha-actinin-4 (5-20)
cacgccgccaaccagagcuaccaguacggccccuccagcgcggggaac

SEQ ID NO: 49856 - RNA, 27 nt, Artificial Sequence
  Transforming growth factor-beta receptor-associated protein 1 (725-733)
cacgccggccccaccgcccacgagcug

SEQ ID NO: 49857 - RNA, 30 nt, Artificial Sequence
  Leucine-rich repeat-containing protein 1 (515-524)
cacgccaucgaccgcgugaccaccagcguc

SEQ ID NO: 49858 - RNA, 27 nt, Artificial Sequence
  Coatomer subunit beta (447-455)
cacgccaucaagagcgugaagaucuac

SEQ ID NO: 49859 - RNA, 27 nt, Artificial Sequence
  G-protein coupled receptor 143 (190-198)
cacgccaucccccacuacgugaccaug

SEQ ID NO: 49860 - RNA, 27 nt, Artificial Sequence
  ATP-dependent RNA helicase DDX3X (209-217)
cacgccauccccaucaucaaggagaag

SEQ ID NO: 49861 - RNA, 27 nt, Artificial Sequence
  Protein Smaug homolog 2 (682-690)
cacgcccugggcggggagcacuuccuc

SEQ ID NO: 49862 - RNA, 27 nt, Artificial Sequence
  Protein GREB1 (566-574)
cacgccauggacggcgccagccaccug

SEQ ID NO: 49863 - RNA, 27 nt, Artificial Sequence
  Mothers against decapentaplegic homolog 4 (405-413)
cacgccguguucguccagagcuacuac

SEQ ID NO: 49864 - RNA, 27 nt, Artificial Sequence
  U4/U6.U5 tri-snRNP-associated protein 2 (151-159)
cacgccuacauccacagcgugcaguuc

SEQ ID NO: 49865 - RNA, 27 nt, Artificial Sequence
  Helicase SRCAP (102-110)
cacgaggccgagaucgagacccgcauc

SEQ ID NO: 49866 - RNA, 30 nt, Artificial Sequence
  Zinc finger FYVE domain-containing protein 16 (414-423)
cacgaggagauccagaacagcgugguccug

SEQ ID NO: 49867 - RNA, 45 nt, Artificial Sequence
  Phospholipid hydroperoxide glutathione peroxidase, mitochondrial (42-56)
cacgaguucagcgccaaggacaucgacggccacauggugaaccug

SEQ ID NO: 49868 - RNA, 30 nt, Artificial Sequence
  Activin receptor type-1B isoform X3 (285-294)
cacgagcacggcagccuguucgacuaccuc

SEQ ID NO: 49869 - RNA, 27 nt, Artificial Sequence
  Sex comb on midleg-like protein 4 (131-139)
cacgagaucgacggcaacgcccugcuc

SEQ ID NO: 49870 - RNA, 39 nt, Artificial Sequence
  Insulin-like growth factor-binding protein 7 (270-282)
cacgagauccccgugaagaagggcgagggggccgagcug

SEQ ID NO: 49871 - RNA, 27 nt, Artificial Sequence
  Major facilitator superfamily domain-containing protein 12 (161-169)
cacgagaagguggagcugaccgcccuc

SEQ ID NO: 49872 - RNA, 30 nt, Artificial Sequence
  Putative RNA-binding protein Luc7-like 1 (110-119)
cacgagcugaacgaggagaucggcaagcuc

SEQ ID NO: 49873 - RNA, 27 nt, Artificial Sequence
  Alpha-parvin (245-253)
cacgagcgcgacgccuucgacacccug

SEQ ID NO: 49874 - RNA, 24 nt, Artificial Sequence
  Monocarboxylate transporter 5 (168-175)
cacgagaccgaggagagcaccauc

SEQ ID NO: 49875 - RNA, 30 nt, Artificial Sequence
  Cadherin-19 (309-318)
cacgagacccaggagggcaucgugauccug

SEQ ID NO: 49876 - RNA, 30 nt, Artificial Sequence
  Liprin-alpha-1 (69-78)
cacgaggugggccacgagcgcgacagccug

SEQ ID NO: 49877 - RNA, 30 nt, Artificial Sequence
  60S ribosomal protein L36a-like (90-99)
cacuucgagcugggcggggacaagaagcgc

SEQ ID NO: 49878 - RNA, 36 nt, Artificial Sequence
  60S ribosomal protein L36a-like (90-101)
cacuucgagcugggcggggacaagaagcgcaagggc

SEQ ID NO: 49879 - RNA, 39 nt, Artificial Sequence
  60S ribosomal protein L36a-like (90-102)
cacuucgagcugggcggggacaagaagcgcaagggccag

SEQ ID NO: 49880 - RNA, 51 nt, Artificial Sequence
  60S ribosomal protein L36a-like (90-106)
cacuucgagcugggcggggacaagaagcgcaagggccaggugauccaguuc

SEQ ID NO: 49881 - RNA, 39 nt, Artificial Sequence
  Interleukin enhancer-binding factor 3 (666-678)
cacggcggguacaugaacgccggcgccggguacggcagc

SEQ ID NO: 49882 - RNA, 27 nt, Artificial Sequence
  Tubulin beta-2A chain (21-29)
cacggcaucgaccccaccgggagcuac

SEQ ID NO: 49883 - RNA, 39 nt, Artificial Sequence
  Dyslexia-associated protein KIAA0319-like protein (676-688)
cacggccagaacgggagcgugcccaacggccagaccccg

SEQ ID NO: 49884 - RNA, 30 nt, Artificial Sequence
  Putative heat shock protein HSP 90-beta-3 (6-15)
caccacggcgaggaggagguggagaccuuc

SEQ ID NO: 49885 - RNA, 48 nt, Artificial Sequence
  G protein-coupled receptor kinase 5 (575-590)
caccacaucaacagcaaccacguguccagcaacuccaccggcagcucc

SEQ ID NO: 49886 - RNA, 51 nt, Artificial Sequence
  Non-POU domain-containing octamer-binding protein (28-44)
caccaccagcagcagcagcagcagcccccgcccccccccaucccggccaac

SEQ ID NO: 49887 - RNA, 27 nt, Artificial Sequence
  F-box/WD repeat-containing protein 11 (32-40)
cacaucgccgagaacauccugagcuac

SEQ ID NO: 49888 - RNA, 27 nt, Artificial Sequence
  60S ribosomal protein L8 (172-180)
cacaucggcaagcccagcaccauccgc

SEQ ID NO: 49889 - RNA, 27 nt, Artificial Sequence
  Retinol dehydrogenase 14 (257-265)
cacauccacaucccccugcucgugaag

SEQ ID NO: 49890 - RNA, 27 nt, Artificial Sequence
  HMG box-containing protein 1 (138-146)
cacaucaucgccaccagcaagucccug

SEQ ID NO: 49891 - RNA, 30 nt, Artificial Sequence
  NADH-ubiquinone oxidoreductase chain 5 (394-403)
cacaucaucgagaccgccaacaugagcuac

SEQ ID NO: 49892 - RNA, 27 nt, Artificial Sequence
  UBX domain-containing protein 2A (198-206)
cacaucaaggacuucaucgagaaguac

SEQ ID NO: 49893 - RNA, 30 nt, Artificial Sequence
  Tyrosine-protein kinase JAK1 (584-593)
cacaucuacagcggcacccugauggacuac

SEQ ID NO: 49894 - RNA, 30 nt, Artificial Sequence
  Disintegrin and metalloproteinase domain-containing protein 10 (101-110)
cacaucuacaccggccacaucuacgacuac

SEQ ID NO: 49895 - RNA, 27 nt, Artificial Sequence
  Cyclin-L2 (129-137)
caccuggccagcaagaucgaggaggcc

SEQ ID NO: 49896 - RNA, 27 nt, Artificial Sequence
  Nesprin-1 (1108-1116)
caccuggacgaggaccagcaggagcuc

SEQ ID NO: 49897 - RNA, 21 nt, Artificial Sequence
  UDP-N-acetylglucosamine-dolichyl-phosphate N-acetylglucosaminephosphotransferase (55-61)
caccuggaccucggcauccug

SEQ ID NO: 49898 - RNA, 24 nt, Artificial Sequence
  UDP-N-acetylglucosamine-dolichyl-phosphate N-acetylglucosaminephosphotransferase (55-62)
caccuggaccucggcauccuguac

SEQ ID NO: 49899 - RNA, 24 nt, Artificial Sequence
  Histone H3-like centromeric protein A (104-111)
caccuguucgaggacgccuaccuc

SEQ ID NO: 49900 - RNA, 27 nt, Artificial Sequence
  Histone H3-like centromeric protein A (104-112)
caccuguucgaggacgccuaccuccug

SEQ ID NO: 49901 - RNA, 30 nt, Artificial Sequence
  WD repeat-containing protein 43 (142-151)
caccuguucgagcacauccucaacggcuac

SEQ ID NO: 49902 - RNA, 27 nt, Artificial Sequence
  UPF0536 protein C12orf66 (239-247)
caccuguucggcgggcagagccagaag

SEQ ID NO: 49903 - RNA, 30 nt, Artificial Sequence
  Protein Shroom4 (1371-1380)
caccuguucgugggcgaccucgacaagguc

SEQ ID NO: 49904 - RNA, 30 nt, Artificial Sequence
  cDNA FLJ60317, highly similar to Aminoacylase-1 (EC 3.5.1.14) (332-341)
caccugaaggagggcagcgugaccuccguc

SEQ ID NO: 49905 - RNA, 33 nt, Artificial Sequence
  Homeodomain-interacting protein kinase 2 (531-541)
caccugcucgacuucccccacagcacccacgug

SEQ ID NO: 49906 - RNA, 27 nt, Artificial Sequence
  Pre-mRNA-processing-splicing factor 8 (1875-1883)
caccugcucgacuuccccaacaucgug

SEQ ID NO: 49907 - RNA, 33 nt, Artificial Sequence
  Adenylosuccinate lyase (442-452)
caccugcucgaccccagcuccuucaccggccgc

SEQ ID NO: 49908 - RNA, 33 nt, Artificial Sequence
  Mitotic checkpoint serine/threonine-protein kinase BUB1 (791-801)
caccugcucggcgagggggccuucgcccaggug

SEQ ID NO: 49909 - RNA, 27 nt, Artificial Sequence
  Superkiller viralicidic activity 2-like 2 (735-743)
caccugcucagcgccaucuccagcgug

SEQ ID NO: 49910 - RNA, 27 nt, Artificial Sequence
  Glutamine synthetase (8-16)
caccugaacaagggcaucaagcaggug

SEQ ID NO: 49911 - RNA, 27 nt, Artificial Sequence
  Integrator complex subunit 11 (516-524)
caccugcccgacggcagcgugaccguc

SEQ ID NO: 49912 - RNA, 27 nt, Artificial Sequence
  Putative ATP-dependent RNA helicase TDRD12 (984-992)
caccugcccgagcacuuccacacccuc

SEQ ID NO: 49913 - RNA, 27 nt, Artificial Sequence
  Unconventional myosin-Id (220-228)
caccugcagaagagccucuccagcuac

SEQ ID NO: 49914 - RNA, 27 nt, Artificial Sequence
  Testis-expressed sequence 10 protein (95-103)
caccugagcaacauccucuccgaggug

SEQ ID NO: 49915 - RNA, 27 nt, Artificial Sequence
  NADH-ubiquinone oxidoreductase chain 4 (83-91)
caccugagcuccgagccccucagccgc

SEQ ID NO: 49916 - RNA, 27 nt, Artificial Sequence
  RAD50-interacting protein 1 (429-437)
caccugguggacgagguccuccuguuc

SEQ ID NO: 49917 - RNA, 27 nt, Artificial Sequence
  Thiamin pyrophosphokinase 1 (34-42)
caccuguggaacaaggcccuccugcgc

SEQ ID NO: 49918 - RNA, 30 nt, Artificial Sequence
  Proline-rich nuclear receptor coactivator 1 (204-213)
caccuguacgagcagcccaagaucaaccgc

SEQ ID NO: 49919 - RNA, 27 nt, Artificial Sequence
  60S ribosomal protein L19 (99-107)
cacauguaccacagccuguaccucaag

SEQ ID NO: 49920 - RNA, 27 nt, Artificial Sequence
  COP9 signalosome complex subunit 8 (47-55)
cacaacgacaugaacaacgcccgcuac

SEQ ID NO: 49921 - RNA, 36 nt, Artificial Sequence
  Probable ATP-dependent RNA helicase DDX5 (585-596)
cacaacggcaugaaccagcaggccuacgccuacccc

SEQ ID NO: 49922 - RNA, 24 nt, Artificial Sequence
  Ankycorbin (931-938)
caccaggaggugaucagcgucuac

SEQ ID NO: 49923 - RNA, 42 nt, Artificial Sequence
  Protein FAM98A (489-502)
caccagggcgggcaguucgagcagcacuuccagcacggcggg

SEQ ID NO: 49924 - RNA, 24 nt, Artificial Sequence
  WD repeat-containing protein 70 (230-237)
caccagaucaagagccugcaguac

SEQ ID NO: 49925 - RNA, 30 nt, Artificial Sequence
  Sulfotransferase 1C2 (198-207)
caccagauccuguuccucuucuacgaggac

SEQ ID NO: 49926 - RNA, 33 nt, Artificial Sequence
  Melanocyte protein PMEL (562-572)
caccagauccugaagggcgggagcggcaccuac

SEQ ID NO: 49927 - RNA, 24 nt, Artificial Sequence
  Kinesin-1 heavy chain (712-719)
caccagaagcagaucagcucccug

SEQ ID NO: 49928 - RNA, 27 nt, Artificial Sequence
  Zinc finger SWIM domain-containing protein 3 (499-507)
caccagagcggcuccgagcuggccuac

SEQ ID NO: 49929 - RNA, 30 nt, Artificial Sequence
  Catenin delta-2 (274-283)
caccgccccccggccagcgaguacaccaug

SEQ ID NO: 49930 - RNA, 39 nt, Artificial Sequence
  RNMT-activating mini protein (94-106)
caccgccaggagcccuacuacccgcagcaguacggccac

SEQ ID NO: 49931 - RNA, 27 nt, Artificial Sequence
  Biorientation of chromosomes in cell division protein 1-like 1 (75-83)
cacagcgcccugcccaaccagucccuc

SEQ ID NO: 49932 - RNA, 30 nt, Artificial Sequence
  Monoacylglycerol lipase ABHD12 (365-374)
cacagcgaccugggcuaccgccacaaguac

SEQ ID NO: 49933 - RNA, 33 nt, Artificial Sequence
  Transient receptor potential cation channel subfamily A member 1 (758-768)
cacagcgagauccuggacaccaccaacuccuac

SEQ ID NO: 49934 - RNA, 27 nt, Artificial Sequence
  Alstrom syndrome protein 1 (958-966)
cacagcgagaaguccagcguguucuac

SEQ ID NO: 49935 - RNA, 27 nt, Artificial Sequence
  Glycine dehydrogenase (decarboxylating), mitochondrial (529-537)
cacagcgagaccaacaucgugcgcuac

SEQ ID NO: 49936 - RNA, 30 nt, Artificial Sequence
  Dedicator of cytokinesis protein 9 (1147-1156)
cacagcuucgacgaccgcuacgccucccgg

SEQ ID NO: 49937 - RNA, 33 nt, Artificial Sequence
  Tubulin alpha-3C/D chain (138-148)
cacagcuucggcgggggcaccggguccggcuuc

SEQ ID NO: 49938 - RNA, 36 nt, Artificial Sequence
  Tubulin alpha-1C chain (104-115)
cacagcuucggcgggggcaccggguccggcuucacc

SEQ ID NO: 49939 - RNA, 24 nt, Artificial Sequence
  E3 ubiquitin-protein ligase TRIM33 (605-612)
cacagcggcccccaguacuccaug

SEQ ID NO: 49940 - RNA, 42 nt, Artificial Sequence
  Tubulin gamma-1 chain (139-152)
cacagcaucgccggcgggaccggcuccgggcugggcagcuac

SEQ ID NO: 49941 - RNA, 36 nt, Artificial Sequence
  Macrophage migration inhibitory factor (61-72)
cacagcaucggcaagaucgggggcgcccagaaccgc

SEQ ID NO: 49942 - RNA, 33 nt, Artificial Sequence
  Rho-related BTB domain-containing protein 3 (176-186)
cacagccuggacgacuucuacaucggcaaguac

SEQ ID NO: 49943 - RNA, 33 nt, Artificial Sequence
  Copper transport protein ATOX1 (46-56)
cacagcauggacacccugcucgccacccugaag

SEQ ID NO: 49944 - RNA, 24 nt, Artificial Sequence
  40S ribosomal protein S20 (92-99)
cacagccccuccgagaucgugaag

SEQ ID NO: 49945 - RNA, 36 nt, Artificial Sequence
  Transcriptional regulator Kaiso (573-584)
cacagccaggaccccuccggcgacagcaagcuguac

SEQ ID NO: 49946 - RNA, 30 nt, Artificial Sequence
  FERM domain-containing protein 4A (823-832)
cacagccagucccagcccagcucccaguac

SEQ ID NO: 49947 - RNA, 27 nt, Artificial Sequence
  Nipped-B-like protein (134-142)
cacagcucccccgccagcuccaacuac

SEQ ID NO: 49948 - RNA, 30 nt, Artificial Sequence
  Melanocyte protein PMEL (639-648)
cacagcuccagccacuggcugcgccucccc

SEQ ID NO: 49949 - RNA, 27 nt, Artificial Sequence
  Transformation/transcription domain-associated protein (3009-3017)
cacagcuccagcaucgugaccgccuac

SEQ ID NO: 49950 - RNA, 33 nt, Artificial Sequence
  PERQ amino acid-rich with GYF domain-containing protein 2 (1230-1240)
cacagcacccugcacuccguguuccagaccaac

SEQ ID NO: 49951 - RNA, 45 nt, Artificial Sequence
  PERQ amino acid-rich with GYF domain-containing protein 2 (1230-1244)
cacagcacccugcacuccguguuccagaccaaccagagcaacaac

SEQ ID NO: 49952 - RNA, 27 nt, Artificial Sequence
  Ribosome maturation protein SBDS (54-62)
cacagcguguucgucaacguguccaag

SEQ ID NO: 49953 - RNA, 24 nt, Artificial Sequence
  Proteasome assembly chaperone 2 (85-92)
cacagcuaccagcgcaacgaccug

SEQ ID NO: 49954 - RNA, 27 nt, Artificial Sequence
  Adenine DNAosylase (479-487)
cacaccgccgccgugagcaccgcgaug

SEQ ID NO: 49955 - RNA, 27 nt, Artificial Sequence
  Protein archease (38-46)
cacaccgccgacgugcacggccuguac

SEQ ID NO: 49956 - RNA, 30 nt, Artificial Sequence
  Protein archease (38-47)
cacaccgccgacgugcacggccuguacuac

SEQ ID NO: 49957 - RNA, 30 nt, Artificial Sequence
  Protein O-linked-mannose beta-1,2-N-acetylglucosaminyltransferase 1 (410-419)
cacaccgccgaggaccccgcccugcucuac

SEQ ID NO: 49958 - RNA, 27 nt, Artificial Sequence
  Proton myo-inositol cotransporter (546-554)
cacaccgccgaguaccugaccuacuac

SEQ ID NO: 49959 - RNA, 27 nt, Artificial Sequence
  Hydroxyacylglutathione hydrolase-like protein (110-118)
cacaccgccggccacaugagcuacuuc

SEQ ID NO: 49960 - RNA, 27 nt, Artificial Sequence
  Tensin-1 (628-636)
cacaccgcccccaugcgcccgagcuac

SEQ ID NO: 49961 - RNA, 27 nt, Artificial Sequence
  CD63 antigen (131-139)
cacaccgccagcauccuggaccgcaug

SEQ ID NO: 49962 - RNA, 27 nt, Artificial Sequence
  Alanine-tRNA ligase, cytoplasmic (605-613)
cacaccgccacccacauccugaacuuc

SEQ ID NO: 49963 - RNA, 24 nt, Artificial Sequence
  U3 small nucleolar RNA-associated protein 6 homolog (267-274)
cacaccgacgacccccugaccugg

SEQ ID NO: 49964 - RNA, 24 nt, Artificial Sequence
  Mitochondrial enolase superfamily member 1 (29-36)
cacaccgaccccgacuacagcgcc

SEQ ID NO: 49965 - RNA, 30 nt, Artificial Sequence
  Ras GTPase-activating protein 3 (501-510)
cacaccgacccccagaccagccgcacgcug

SEQ ID NO: 49966 - RNA, 30 nt, Artificial Sequence
  Zinc finger protein DZIP1 (221-230)
cacaccgaggagaacagccacuucgaguac

SEQ ID NO: 49967 - RNA, 27 nt, Artificial Sequence
  Protein FAM214A (1013-1021)
cacaccgaggagcgccugcuccgguac

SEQ ID NO: 49968 - RNA, 36 nt, Artificial Sequence
  Melanophilin (469-480)
cacaccuucgccaagcccguggucgcccaccagagc

SEQ ID NO: 49969 - RNA, 33 nt, Artificial Sequence
  Cytochrome c oxidase subunit 1 (503-513)
cacaccuucgaggagcccguguacaugaagagc

SEQ ID NO: 49970 - RNA, 39 nt, Artificial Sequence
  Protein tyrosine phosphatase type IVA 1 (21-33)
cacaccuucauggaguuccugaagggcagcggggacuac

SEQ ID NO: 49971 - RNA, 30 nt, Artificial Sequence
  GRB2-associated-binding protein 2 (554-563)
cacaccuucaacagcuccagcucccaguac

SEQ ID NO: 49972 - RNA, 27 nt, Artificial Sequence
  Discoidin, CUB and LCCL domain-containing protein 1 (613-621)
cacaccuucagcgcccaguccggcuac

SEQ ID NO: 49973 - RNA, 27 nt, Artificial Sequence
  Importin-8 (408-416)
cacaccaucgacaccauccugacggug

SEQ ID NO: 49974 - RNA, 33 nt, Artificial Sequence
  Protein pelota homolog (100-110)
cacaccaucgagcuggagcccaaccgccaguuc

SEQ ID NO: 49975 - RNA, 27 nt, Artificial Sequence
  Tubulin polyglutamylase TTLL5 (968-976)
cacaccaucggccccuucagcuccuuc

SEQ ID NO: 49976 - RNA, 30 nt, Artificial Sequence
  Nuclear pore complex protein Nup107 (862-871)
cacaccauccugcacagcaccggccaguac

SEQ ID NO: 49977 - RNA, 30 nt, Artificial Sequence
  S-methyl-5'-thioadenosine phosphorylase (65-74)
cacaccaucaugcccagcaaggugaacuac

SEQ ID NO: 49978 - RNA, 27 nt, Artificial Sequence
  Serologically defined colon cancer antigen 8 (120-128)
cacaccaucaacgaccagagccaguac

SEQ ID NO: 49979 - RNA, 27 nt, Artificial Sequence
  Minor histocompatibility antigen H13 (119-127)
cacaccaucagccccuucaugaacaag

SEQ ID NO: 49980 - RNA, 42 nt, Artificial Sequence
  Tyrosinase (143-156)
cacaccaucagcuccgacuacgugauccccaucggcaccuac

SEQ ID NO: 49981 - RNA, 27 nt, Artificial Sequence
  Cytoskeleton-associated protein 2 (499-507)
cacaccaucguggacauccugaccaug

SEQ ID NO: 49982 - RNA, 30 nt, Artificial Sequence
  Cytoplasmic protein NCK2 (351-360)
cacaccauggacgagcugguggagcacuac

SEQ ID NO: 49983 - RNA, 36 nt, Artificial Sequence
  U3 small nucleolar RNA-associated protein 18 homolog (362-373)
cacaccauggacuucagcccccgcuccggcuacuuc

SEQ ID NO: 49984 - RNA, 33 nt, Artificial Sequence
  Queuine tRNA-ribosyltransferase subunit QTRTD1 (26-36)
cacaccauggacauccccggcugccugcucuac

SEQ ID NO: 49985 - RNA, 27 nt, Artificial Sequence
  Syntaxin-18 (80-88)
cacaccaugagcgaguacggccgcaug

SEQ ID NO: 49986 - RNA, 30 nt, Artificial Sequence
  Histone-lysine N-methyltransferase setd3 (279-288)
cacaccaacggccugaucaccacgggguac

SEQ ID NO: 49987 - RNA, 33 nt, Artificial Sequence
  Alpha-adducin (241-251)
cacacccccgccggcgccgcggugagcgccaug

SEQ ID NO: 49988 - RNA, 30 nt, Artificial Sequence
  Alpha-1,6-mannosylglycoprotein 6-beta-N-acetylglucosaminyltransferase B (424-433)
cacacccccgacaacagcuucaugggcuuc

SEQ ID NO: 49989 - RNA, 30 nt, Artificial Sequence
  Lanosterol 14-alpha demethylase (489-498)
cacacccccgagaacccggugauccgcuac

SEQ ID NO: 49990 - RNA, 33 nt, Artificial Sequence
  Iroquois-class homeodomain protein IRX-5 (89-99)
cacacccccggcauggccgggagccugggcuac

SEQ ID NO: 49991 - RNA, 27 nt, Artificial Sequence
  Ligand of Numb protein X 2 (443-451)
cacacccccccgcccuacuacagccgc

SEQ ID NO: 49992 - RNA, 33 nt, Artificial Sequence
  Tensin-1 (410-420)
cacacccagggcccccuggacgggagccucuac

SEQ ID NO: 49993 - RNA, 30 nt, Artificial Sequence
  Succinate dehydrogenase (ubiquinone) flavoprotein subunit, mitochondrial (270-279)
cacaccagcaccggcgacgggacggccaug

SEQ ID NO: 49994 - RNA, 27 nt, Artificial Sequence
  Very-long-chain (3R)-3-hydroxyacyl-CoA dehydratase 3 (185-193)
cacaccguggccgacaugauguacuuc

SEQ ID NO: 49995 - RNA, 27 nt, Artificial Sequence
  Tetratricopeptide repeat protein 38 (218-226)
cacaccguggcccacauccacgagaug

SEQ ID NO: 49996 - RNA, 30 nt, Artificial Sequence
  U3 small nucleolar RNA-associated protein 15 homolog (126-135)
cacaccguggacuucaccgccgacaaguac

SEQ ID NO: 49997 - RNA, 33 nt, Artificial Sequence
  Aprataxin (170-180)
cacaccgugggcgagaaggucaucguggacuuc

SEQ ID NO: 49998 - RNA, 30 nt, Artificial Sequence
  Sodium-dependent phosphate transporter 1 (379-388)
cacaccgugcacaaggacagcggccuguac

SEQ ID NO: 49999 - RNA, 30 nt, Artificial Sequence
  Heterogeneous nuclear ribonucleoprotein A1-like 2 (15-24)
cacaccgugaacggccacaacugcgagguc

SEQ ID NO: 50000 - RNA, 36 nt, Artificial Sequence
  Melanocyte protein PMEL (285-296)
cacaccuaccuggagcccggcccggugaccgcccag

SEQ ID NO: 50001 - RNA, 30 nt, Artificial Sequence
  Oxidoreductase-like domain-containing protein 1 (115-124)
cacguggccgacgagaaccugaaggccuuc

SEQ ID NO: 50002 - RNA, 30 nt, Artificial Sequence
  Condensin complex subunit 2 (196-205)
cacguggccgacggcagcgccaccgagaug

SEQ ID NO: 50003 - RNA, 30 nt, Artificial Sequence
  1-phosphatidylinositol 4,5-bisphosphate phosphodiesterase beta-4 (428-437)
cacguggccgaggagcgcaacauccacuac

SEQ ID NO: 50004 - RNA, 30 nt, Artificial Sequence
  Protein FAN (292-301)
cacguggccgagcacaccgccgagagcuac

SEQ ID NO: 50005 - RNA, 27 nt, Artificial Sequence
  GPI-anchor transamidase (62-70)
cacguggccaacacccugagcgucuac

SEQ ID NO: 50006 - RNA, 30 nt, Artificial Sequence
  RNA polymerase-associated protein CTR9 homolog (745-754)
cacguggcccccagcgacaccguccugaug

SEQ ID NO: 50007 - RNA, 33 nt, Artificial Sequence
  RNA polymerase-associated protein CTR9 homolog (745-755)
cacguggcccccagcgacaccguccugauguuc

SEQ ID NO: 50008 - RNA, 27 nt, Artificial Sequence
  40S ribosomal protein S16 (76-84)
cacguggcccagaucuacgccauccgc

SEQ ID NO: 50009 - RNA, 27 nt, Artificial Sequence
  F-box only protein 31 (181-189)
cacguggacgaccccaugcgcuucaag

SEQ ID NO: 50010 - RNA, 27 nt, Artificial Sequence
  tRNA wybutosine-synthesizing protein 2 homolog (192-200)
cacguggacaacggcauccgcuacaag

SEQ ID NO: 50011 - RNA, 24 nt, Artificial Sequence
  P protein (222-229)
cacguggacagcacccugcuccag

SEQ ID NO: 50012 - RNA, 27 nt, Artificial Sequence
  P protein (222-230)
cacguggacagcacccugcuccagguc

SEQ ID NO: 50013 - RNA, 30 nt, Artificial Sequence
  PRELI domain containing protein 3B (8-17)
cacguguucgaccaccccugggagaccguc

SEQ ID NO: 50014 - RNA, 30 nt, Artificial Sequence
  RNA polymerase II subunit A C-terminal domain phosphatase (243-252)
cacguguucaccuucggcagccgccuguac

SEQ ID NO: 50015 - RNA, 27 nt, Artificial Sequence
  Neuropilin-2 (221-229)
cacgugggcccccugaucgggaaguac

SEQ ID NO: 50016 - RNA, 27 nt, Artificial Sequence
  Filamin-A (138-146)
cacgugggcagccgccuguacuccguc

SEQ ID NO: 50017 - RNA, 27 nt, Artificial Sequence
  Endoribonuclease Dicer (1769-1777)
cacgugaucgacgacuucguccaguuc

SEQ ID NO: 50018 - RNA, 33 nt, Artificial Sequence
  TRAF2 and NCK-interacting protein kinase (370-380)
cacgugaucgacgucgacagcggcaacuccuac

SEQ ID NO: 50019 - RNA, 33 nt, Artificial Sequence
  Activity-dependent neuroprotector homeobox protein (210-220)
cacgugaucgaggaccacgagcgcaucggcuac

SEQ ID NO: 50020 - RNA, 27 nt, Artificial Sequence
  Interferon-induced helicase C domain-containing protein 1 (921-929)
cacgugaucgagaagaugcaccacguc

SEQ ID NO: 50021 - RNA, 33 nt, Artificial Sequence
  Cytochrome b-c1 complex subunit 2, mitochondrial (172-182)
cacgugaucgagaaccugcacgccgccgcguac

SEQ ID NO: 50022 - RNA, 27 nt, Artificial Sequence
  Myomegalin (2179-2187)
cacgugaucggccacaucgacgacuac

SEQ ID NO: 50023 - RNA, 33 nt, Artificial Sequence
  Protein bicaudal C homolog 1 (746-756)
cacgugaucggcaaggggggcaacaacaucaag

SEQ ID NO: 50024 - RNA, 30 nt, Artificial Sequence
  116 kDa U5 small nuclear ribonucleoprotein component (627-636)
cacgugauccugggcaccggggagcucuac

SEQ ID NO: 50025 - RNA, 30 nt, Artificial Sequence
  Voltage-gated potassium channel subunit beta-1 (216-225)
cacgugaucaaccagggcauggccauguac

SEQ ID NO: 50026 - RNA, 27 nt, Artificial Sequence
  Regulator of telomere elongation helicase 1 (740-748)
cacgugauccgcgacgucgcccaguuc

SEQ ID NO: 50027 - RNA, 30 nt, Artificial Sequence
  BTB/POZ domain-containing protein KCTD1 (197-206)
cacgugauccgcuucccccugaacggcuac

SEQ ID NO: 50028 - RNA, 36 nt, Artificial Sequence
  DNA-directed RNA polymerase II subunit RPB1 (1384-1395)
cacgugaucagcuucgacggcuccuacgucaacuac

SEQ ID NO: 50029 - RNA, 30 nt, Artificial Sequence
  Disco-interacting protein 2 homolog C (561-570)
cacgugaucagcauccccuacucccugaug

SEQ ID NO: 50030 - RNA, 27 nt, Artificial Sequence
  E3 SUMO-protein ligase RanBP2 (2985-2993)
cacgugaucaccaagaccauggagcug

SEQ ID NO: 50031 - RNA, 30 nt, Artificial Sequence
  40S ribosomal protein S4, Y isoform 1 (208-217)
cacgugaaggacgccaacggcaacagcuuc

SEQ ID NO: 50032 - RNA, 30 nt, Artificial Sequence
  Nodal modulator 3 (252-261)
cacgugcugggcaccaucaccacggacaag

SEQ ID NO: 50033 - RNA, 30 nt, Artificial Sequence
  Pecanex-like protein 1 (113-122)
cacgugauggacgacggcaccaacgaguac

SEQ ID NO: 50034 - RNA, 30 nt, Artificial Sequence
  Pleckstrin homology domain-containing family G member 3 (497-506)
cacgugauggacagccacgucuccgagcgc

SEQ ID NO: 50035 - RNA, 33 nt, Artificial Sequence
  Elongation factor G, mitochondrial (445-455)
cacgugcccgacccggucaucagcaucgccaug

SEQ ID NO: 50036 - RNA, 27 nt, Artificial Sequence
  Probable phospholipid-transporting ATPase IIB (501-509)
cacgugcgcgacagcuacucccagaug

SEQ ID NO: 50037 - RNA, 27 nt, Artificial Sequence
  Sideroflexin-1 (171-179)
cacgugagcccccugaucggccgcuuc

SEQ ID NO: 50038 - RNA, 27 nt, Artificial Sequence
  Long-chain-fatty-acid-CoA ligase 3 (4-12)
cacgugagcuccaagcccagcaccaug

SEQ ID NO: 50039 - RNA, 33 nt, Artificial Sequence
  Zinc finger protein 451 (549-559)
cacgugaccgaguuccacaacggccaccgcuac

SEQ ID NO: 50040 - RNA, 27 nt, Artificial Sequence
  Deoxyribose-phosphate aldolase (322-330)
cacgugaccggccgcuacgccgccuac

SEQ ID NO: 50041 - RNA, 27 nt, Artificial Sequence
  Phosphoribosylformylglycinamidine synthase (342-350)
cacguggucgccggcaccgccggguac

SEQ ID NO: 50042 - RNA, 30 nt, Artificial Sequence
  Jouberin (369-378)
cacguggucgacgagcacaccggccaguac

SEQ ID NO: 50043 - RNA, 27 nt, Artificial Sequence
  Nephrocystin-4 (1128-1136)
cacguggucgaccagguguuccgcuuc

SEQ ID NO: 50044 - RNA, 33 nt, Artificial Sequence
  Tetratricopeptide repeat protein 39B (542-552)
cacguggucgagagcgagaagcugcucaaguac

SEQ ID NO: 50045 - RNA, 30 nt, Artificial Sequence
  Dedicator of cytokinesis protein 10 (121-130)
cacguggucaacuacaaguacgagcaguac

SEQ ID NO: 50046 - RNA, 27 nt, Artificial Sequence
  Large proline-rich protein BAG6 (350-358)
cacgugguccgccccaugagccacuac

SEQ ID NO: 50047 - RNA, 27 nt, Artificial Sequence
  HEAT repeat-containing protein 5A (373-381)
cacguggucagcuccgugagcuccuuc

SEQ ID NO: 50048 - RNA, 36 nt, Artificial Sequence
  WD repeat-containing protein 74 (10-21)
cacgugugggucggcaccgagaccgggauccugaag

SEQ ID NO: 50049 - RNA, 33 nt, Artificial Sequence
  Vesicle-associated membrane protein 7 (159-169)
cacguguacgaggagccccaggcccacuacuac

SEQ ID NO: 50050 - RNA, 30 nt, Artificial Sequence
  Regulator of chromosome condensation (291-300)
cacguguacggcuucgggcugagcaacuac

SEQ ID NO: 50051 - RNA, 27 nt, Artificial Sequence
  Transmembrane protein 209 (513-521)
cacguguacaaccugcccaagggccgc

SEQ ID NO: 50052 - RNA, 30 nt, Artificial Sequence
  Bcl-2 homologous antagonist/killer (141-150)
cacguguaccagcacggccugaccggguuc

SEQ ID NO: 50053 - RNA, 27 nt, Artificial Sequence
  Little elongation complex subunit 1 (1936-1944)
cacguguacgucggcaacaucagcaag

SEQ ID NO: 50054 - RNA, 30 nt, Artificial Sequence
  Neutral amino acid transporter B(0) (523-532)
cacuaccgcggccccgccggggacgccacc

SEQ ID NO: 50055 - RNA, 30 nt, Artificial Sequence
  UPF0568 protein C14orf166 (230-239)
aucgccgaccccaagaccgaccaccgccug

SEQ ID NO: 50056 - RNA, 27 nt, Artificial Sequence
  Endoplasmin (212-220)
aucgccgacccccgcggcaacacccug

SEQ ID NO: 50057 - RNA, 36 nt, Artificial Sequence
  40S ribosomal protein S19 (134-145)
aucgccggccagguggccgcggccaacaagaagcac

SEQ ID NO: 50058 - RNA, 27 nt, Artificial Sequence
  Tensin-1 (1325-1333)
aucgccagccccggcuccccgagccug

SEQ ID NO: 50059 - RNA, 27 nt, Artificial Sequence
  Hemicentin-1 (4090-4098)
aucgccguggacaagcccaucacccug

SEQ ID NO: 50060 - RNA, 27 nt, Artificial Sequence
  Uncharacterized protein KIAA1210 (412-420)
aucgccguggagcgcgucaucagcgug

SEQ ID NO: 50061 - RNA, 27 nt, Artificial Sequence
  Protein SDE2 homolog (286-294)
aucgacaaggagaccaucgaccugcuc

SEQ ID NO: 50062 - RNA, 39 nt, Artificial Sequence
  Syndecan-3 (293-305)
aucgacagcggcuccagcgccgcccagcugccccagaag

SEQ ID NO: 50063 - RNA, 30 nt, Artificial Sequence
  Cullin-3 (721-730)
aucgagggccugaucgagcgcgaguaccuc

SEQ ID NO: 50064 - RNA, 24 nt, Artificial Sequence
  Dolichyl-diphosphooligosaccharide-proteinosyltransferase subunit 1 (381-388)
aucgagaucgacagccccuacgag

SEQ ID NO: 50065 - RNA, 33 nt, Artificial Sequence
  Complex I assembly factor TMEM126B, mitochondrial (24-34)
aucgagaucaucgagaagaacuucgacuaccug

SEQ ID NO: 50066 - RNA, 30 nt, Artificial Sequence
  Copper transport protein ATOX1 (42-51)
aucgagagcgagcacuccauggacacccug

SEQ ID NO: 50067 - RNA, 33 nt, Artificial Sequence
  Copper transport protein ATOX1 (42-52)
aucgagagcgagcacuccauggacacccugcuc

SEQ ID NO: 50068 - RNA, 24 nt, Artificial Sequence
  N-acyl-aromatic-L-amino acid amidohydrolase (carboxylate-forming) (191-198)
aucuucagccgcaugcggacccug

SEQ ID NO: 50069 - RNA, 30 nt, Artificial Sequence
  Cadherin-19 (91-100)
aucaucgacgagcgcaccggcgacaucuac

SEQ ID NO: 50070 - RNA, 27 nt, Artificial Sequence
  40S ribosomal protein S17 (95-103)
aucaucgagguggaccccgacaccaag

SEQ ID NO: 50071 - RNA, 30 nt, Artificial Sequence
  FACT complex subunit SSRP1 (30-39)
aucaucuucaagaacagcaagaccggcaag

SEQ ID NO: 50072 - RNA, 27 nt, Artificial Sequence
  Neuron navigator 2 (2224-2232)
aucauccuggacaaccuccaccacgug

SEQ ID NO: 50073 - RNA, 42 nt, Artificial Sequence
  Putative heat shock 70 kDa protein 7 (30-43)
auccuggccaacgaccagggcaaccgcaccacccccagcuac

SEQ ID NO: 50074 - RNA, 30 nt, Artificial Sequence
  Fer-1-like protein 5 (1201-1210)
auccuggccagcugcgagcucauccugcag

SEQ ID NO: 50075 - RNA, 30 nt, Artificial Sequence
  U6 snRNA-associated Sm-like protein LSm8 (16-25)
auccuggacgagagccacgagcgcguguuc

SEQ ID NO: 50076 - RNA, 30 nt, Artificial Sequence
  Cleft lip and palate transmembrane protein 1 (410-419)
auccuggacaacgagaccaacuucgugguc

SEQ ID NO: 50077 - RNA, 27 nt, Artificial Sequence
  Vesicle transport protein USE1 (249-257)
auccuguucauccgcaucaugcccaag

SEQ ID NO: 50078 - RNA, 30 nt, Artificial Sequence
  TELO2-interacting protein 1 homolog (52-61)
auccuguucccccuccgcuucacccugaag

SEQ ID NO: 50079 - RNA, 51 nt, Artificial Sequence
  Transforming growth factor beta receptor type 3 (374-390)
auccugcucgaccccggcgcccugccggcccugcagaacccccccauccgc

SEQ ID NO: 50080 - RNA, 33 nt, Artificial Sequence
  Serine/threonine-protein kinase Sgk1 (323-333)
auccugcucgacagccagggccacaucgugcug

SEQ ID NO: 50081 - RNA, 33 nt, Artificial Sequence
  Eukaryotic translation initiation factor 3 subunit A (542-552)
auccugcaggagaaggaggagcagcaccagcuc

SEQ ID NO: 50082 - RNA, 27 nt, Artificial Sequence
  Inositol-trisphosphate 3-kinase B (133-141)
auccugcagcgcgagcuccagaacgug

SEQ ID NO: 50083 - RNA, 30 nt, Artificial Sequence
  Myotubularin-related protein 6 isoform X4 (104-113)
auccugaccaaggagcuccugcacagcgug

SEQ ID NO: 50084 - RNA, 39 nt, Artificial Sequence
  Sodium/potassium/calcium exchanger 5 (18-30)
auccugugggccaccgcccaccucccccugagcggcacc

SEQ ID NO: 50085 - RNA, 33 nt, Artificial Sequence
  Chromosome transmission fidelity protein 8 homolog (58-68)
auccuguacggcaagaucauccaccucgagaag

SEQ ID NO: 50086 - RNA, 30 nt, Artificial Sequence
  40S ribosomal protein S3 (188-197)
aucaugcugcccugggacccgaccggcaag

SEQ ID NO: 50087 - RNA, 24 nt, Artificial Sequence
  Vimentin (182-189)
aucaugcgccugcgggagaagcuc

SEQ ID NO: 50088 - RNA, 36 nt, Artificial Sequence
  MAGUK p55 subfamily member 2 (395-406)
aucaugugggaccccgaccgcuacggcaccaccgug

SEQ ID NO: 50089 - RNA, 27 nt, Artificial Sequence
  Bromodomain adjacent to zinc finger domain protein 1A (730-738)
aucaacugcgugacccgcgagccccug

SEQ ID NO: 50090 - RNA, 27 nt, Artificial Sequence
  Sarcospan (117-125)
auccaguucagcaugaagcugcucuac

SEQ ID NO: 50091 - RNA, 30 nt, Artificial Sequence
  Catalase (347-356)
auccaguacagcggcgaggugcgccgguuc

SEQ ID NO: 50092 - RNA, 51 nt, Artificial Sequence
  Calmodulin (126-142)
auccgcgaggccgacaucgacggcgacgggcaggugaacuacgaggaguuc

SEQ ID NO: 50093 - RNA, 27 nt, Artificial Sequence
  60S ribosomal protein L32 (21-29)
auccgccaccagagcgaccgguacgug

SEQ ID NO: 50094 - RNA, 27 nt, Artificial Sequence
  ATP-citrate synthase (6-14)
aucagcgagcagaccggcaaggagcug

SEQ ID NO: 50095 - RNA, 27 nt, Artificial Sequence
  XAGE1D protein (105-113)
aucagccagacccccggcaucaaccug

SEQ ID NO: 50096 - RNA, 24 nt, Artificial Sequence
  Metalloproteinase inhibitor 4 (52-59)
aucagcuccgagaagguggucccc

SEQ ID NO: 50097 - RNA, 36 nt, Artificial Sequence
  Transmembraneoprotein NMB (483-494)
aucagcgugcccgaccgcgacccggccuccccccug

SEQ ID NO: 50098 - RNA, 33 nt, Artificial Sequence
  40S ribosomal protein S18 (30-40)
aucaccgccaucaagggcguggggcgccgguac

SEQ ID NO: 50099 - RNA, 27 nt, Artificial Sequence
  Melanoma-associated antigen D4 (549-557)
aucaccgacgacuucgugaagcagaag

SEQ ID NO: 50100 - RNA, 45 nt, Artificial Sequence
  Melanocyte protein PMEL (216-230)
aucaccgaccaggugcccuucagcgucuccgugagccagcugcgc

SEQ ID NO: 50101 - RNA, 33 nt, Artificial Sequence
  Voltage-dependent L-type calcium channel subunit alpha-1C (1300-1310)
aucaccgagaacgccgaggagaacagccgcauc

SEQ ID NO: 50102 - RNA, 30 nt, Artificial Sequence
  Beta-adrenergic receptor kinase 2 (53-62)
aucaccuucgacaagaucuucaaccagaag

SEQ ID NO: 50103 - RNA, 39 nt, Artificial Sequence
  Galectin-3 (132-144)
aucaccauccugggcaccgugaagcccaacgccaaccgc

SEQ ID NO: 50104 - RNA, 45 nt, Artificial Sequence
  Galectin-3 (132-146)
aucaccauccugggcaccgugaagcccaacgccaaccgcaucgcc

SEQ ID NO: 50105 - RNA, 27 nt, Artificial Sequence
  Catalase (42-50)
aucaccgugggcccccgcgggccgcug

SEQ ID NO: 50106 - RNA, 27 nt, Artificial Sequence
  Dipeptidyl peptidase 4 (185-193)
aucaccuggaccggcaaggaggacauc

SEQ ID NO: 50107 - RNA, 33 nt, Artificial Sequence
  Galectin-8 (91-101)
aucaccuacgacacccccuucaagcgcgagaag

SEQ ID NO: 50108 - RNA, 36 nt, Artificial Sequence
  Proteasome subunit alpha type-7 (133-144)
aucgugggcuucgacuucgacgggaccccccgccug

SEQ ID NO: 50109 - RNA, 27 nt, Artificial Sequence
  F-box only protein 11 (19-27)
aucgugcacaccaacuucgucgagaag

SEQ ID NO: 50110 - RNA, 27 nt, Artificial Sequence
  Protein SMG5 (881-889)
aucgugaucaucccccgcaccgucauc

SEQ ID NO: 50111 - RNA, 39 nt, Artificial Sequence
  Zinc finger CCHC domain-containing protein 10 (33-45)
aucgugauccgcgacagcgucgcccaggccggccugaag

SEQ ID NO: 50112 - RNA, 30 nt, Artificial Sequence
  Teneurin-4 (347-356)
aucgugaucagcgccacccuggucauccuc

SEQ ID NO: 50113 - RNA, 27 nt, Artificial Sequence
  U4/U6 small nuclear ribonucleoprotein Prp31 (462-470)
aucgugaacccccaggccgccgagaag

SEQ ID NO: 50114 - RNA, 27 nt, Artificial Sequence
  P antigen family member 5 (47-55)
aucgugcagcagcccaccgaggagaag

SEQ ID NO: 50115 - RNA, 30 nt, Artificial Sequence
  Carbohydrate sulfotransferase 9 (266-275)
aucuacacccgccugaacaccuacacgaag

SEQ ID NO: 50116 - RNA, 39 nt, Artificial Sequence
  Cap-specific mRNAucleoside-2'-O-)-methyltransferase 1 (72-84)
aaggccgacagccugguggagggcaccuccagccgcuac

SEQ ID NO: 50117 - RNA, 27 nt, Artificial Sequence
  Antigen KI-67 (793-801)
aaggccgacguggaggaggaguuccug

SEQ ID NO: 50118 - RNA, 30 nt, Artificial Sequence
  Coatomer subunit zeta-1 (19-28)
aaggccuucgagaagaacaucuucaacaag

SEQ ID NO: 50119 - RNA, 33 nt, Artificial Sequence
  Zinc finger and SCAN domain-containing protein 21 (278-288)
aaggccuucggccagagcuccgaccugcucaag

SEQ ID NO: 50120 - RNA, 27 nt, Artificial Sequence
  Estradiol 17-beta-dehydrogenase 11 (153-161)
aaggccuuccugcccgccaugaccaag

SEQ ID NO: 50121 - RNA, 30 nt, Artificial Sequence
  Antigen KI-67 (828-837)
aaggccuucaugggcacccccgugcagaag

SEQ ID NO: 50122 - RNA, 27 nt, Artificial Sequence
  Zinc finger protein 7 (98-106)
aaggccuucagccaguccagcucccug

SEQ ID NO: 50123 - RNA, 33 nt, Artificial Sequence
  Zinc finger protein 430 (519-529)
aaggccuucagccaguccagcacccugaccaag

SEQ ID NO: 50124 - RNA, 30 nt, Artificial Sequence
  Xaa-Pro dipeptidase (484-493)
aaggccuucacccccuucagcggcccgaag

SEQ ID NO: 50125 - RNA, 33 nt, Artificial Sequence
  Zinc finger protein 721 (184-194)
aaggccuucaccagcuccaccacgcugaccaag

SEQ ID NO: 50126 - RNA, 27 nt, Artificial Sequence
  Dynactin subunit 1 (141-149)
aaggcccacgccaaggcgaucgagaug

SEQ ID NO: 50127 - RNA, 27 nt, Artificial Sequence
  Histone-binding protein RBBP7 (263-271)
aaggccaucuucaccggccacagcgcc

SEQ ID NO: 50128 - RNA, 27 nt, Artificial Sequence
  Protein ECT2 (595-603)
aaggccaucggcagccugaaggaggug

SEQ ID NO: 50129 - RNA, 27 nt, Artificial Sequence
  Nitrogen permease regulator 3-like protein (253-261)
aaggccauccgccccuaccacgcccug

SEQ ID NO: 50130 - RNA, 27 nt, Artificial Sequence
  Elongation factor 1-gamma (193-201)
aaggccaaggaccccuucgcccaccug

SEQ ID NO: 50131 - RNA, 33 nt, Artificial Sequence
  Dynamin-like 120 kDa protein, mitochondrial (154-164)
aaggcccugcccagcuccgaggaccucgugaag

SEQ ID NO: 50132 - RNA, 30 nt, Artificial Sequence
  Annexin A1 (98-107)
aaggcccugaccggccaccucgaggaggug

SEQ ID NO: 50133 - RNA, 27 nt, Artificial Sequence
  Phosphoinositide 3-kinase regulatory subunit 4 (572-580)
aaggccaacgacgugcugcucagccac

SEQ ID NO: 50134 - RNA, 27 nt, Artificial Sequence
  UDP-glucose:glycoprotein glucosyltransferase 2 (1135-1143)
aaggccaaccccggcgccuggauccug

SEQ ID NO: 50135 - RNA, 27 nt, Artificial Sequence
  Importin subunit alpha-1 (486-494)
aaggccagccugucccucaucgagaag

SEQ ID NO: 50136 - RNA, 27 nt, Artificial Sequence
  Ectonucleoside triphosphate diphosphohydrolase 6 (156-164)
aaggccaccccccuggugcucaaggcc

SEQ ID NO: 50137 - RNA, 27 nt, Artificial Sequence
  Protein FAM161A (564-572)
aaggccuacgacagccaccagucccug

SEQ ID NO: 50138 - RNA, 33 nt, Artificial Sequence
  Gamma-soluble NSF attachment protein (76-86)
aaggccuacgagcaggccggcaugaugcugaag

SEQ ID NO: 50139 - RNA, 27 nt, Artificial Sequence
  Cell division cycle protein 23 homolog (85-93)
aaggccuacuucgacgugaaggaguac

SEQ ID NO: 50140 - RNA, 33 nt, Artificial Sequence
  28S ribosomal protein S29, mitochondrial (321-331)
aaggccuaccugccccaggagcuccugggcaag

SEQ ID NO: 50141 - RNA, 27 nt, Artificial Sequence
  NF-kappa-B inhibitor zeta (545-553)
aaggccuacaacggcaacaccgcccug

SEQ ID NO: 50142 - RNA, 27 nt, Artificial Sequence
  Protein phosphatase Slingshot homolog 1 (418-426)
aaggccuacaacuacgugaagcagaag

SEQ ID NO: 50143 - RNA, 27 nt, Artificial Sequence
  Integrator complex subunit 11 (122-130)
aaggccuacuacgccggccacgugcug

SEQ ID NO: 50144 - RNA, 27 nt, Artificial Sequence
  Switch-associated protein 70 (278-286)
aagugcuucgacaagaccuucgagauc

SEQ ID NO: 50145 - RNA, 30 nt, Artificial Sequence
  Zinc finger protein 860 (39-48)
aagugccuggaccccacccagcgcgcccuc

SEQ ID NO: 50146 - RNA, 30 nt, Artificial Sequence
  Keratin, type II cytoskeletal 1 (289-298)
aaggacguggacggcgccuacaugaccaag

SEQ ID NO: 50147 - RNA, 30 nt, Artificial Sequence
  Little elongation complex subunit 1 (521-530)
aaggaggccgcccccggcaagagcgagcug

SEQ ID NO: 50148 - RNA, 30 nt, Artificial Sequence
  Rho guanine nucleotide exchange factor 40 (405-414)
aaggaggacgccagccaccaggaggcccug

SEQ ID NO: 50149 - RNA, 27 nt, Artificial Sequence
  Ras-related protein Ral-A (118-126)
aaggaggacgagaacgugcccuuccug

SEQ ID NO: 50150 - RNA, 27 nt, Artificial Sequence
  DNA ligase 3 (389-397)
aaggaggacgagcagcagcaggcccug

SEQ ID NO: 50151 - RNA, 27 nt, Artificial Sequence
  Protein SOGA1 (625-633)
aaggaggaccagcagcgcgcccugcuc

SEQ ID NO: 50152 - RNA, 27 nt, Artificial Sequence
  Dolichyl-diphosphooligosaccharide-proteinosyltransferase subunit 2 (229-237)
aaggaggaccaggugauccagcugaug

SEQ ID NO: 50153 - RNA, 30 nt, Artificial Sequence
  DNA replication licensing factor MCM7 (259-268)
aaggaggacgugaacgaggccauccgccug

SEQ ID NO: 50154 - RNA, 30 nt, Artificial Sequence
  Spermine synthase (169-178)
aaggaggacuacaccggcaaggacgugcug

SEQ ID NO: 50155 - RNA, 27 nt, Artificial Sequence
  Integrin alpha-7 (1092-1100)
aaggaggagaagaccggcaccauccug

SEQ ID NO: 50156 - RNA, 27 nt, Artificial Sequence
  Eukaryotic translation initiation factor 3 subunit A (105-113)
aaggaggagagccagcagauggugcug

SEQ ID NO: 50157 - RNA, 39 nt, Artificial Sequence
  Solute carrier family 43 member 3 (268-280)
aaggaggagacccccggcgccgggcagaagcaggagcug

SEQ ID NO: 50158 - RNA, 27 nt, Artificial Sequence
  Ras-related protein Rab-17 (148-156)
aaggaguucgccgacagccagaagcug

SEQ ID NO: 50159 - RNA, 36 nt, Artificial Sequence
  Exportin-1 (1023-1034)
aaggaguucgccggcgaggacaccagcgaccuguuc

SEQ ID NO: 50160 - RNA, 24 nt, Artificial Sequence
  Heat shock protein HSP 90-alpha (656-663)
aaggaguucgagggcaagacccug

SEQ ID NO: 50161 - RNA, 27 nt, Artificial Sequence
  Protein phosphatase Slingshot homolog 1 (292-300)
aaggaguucaucgacaacgagaugcug

SEQ ID NO: 50162 - RNA, 30 nt, Artificial Sequence
  Oxidative stress-induced growth inhibitor 1 (196-205)
aaggagcacgccaucccccacgugguccug

SEQ ID NO: 50163 - RNA, 27 nt, Artificial Sequence
  Trophinin (105-113)
aaggagaucgacaagcagagcucccug

SEQ ID NO: 50164 - RNA, 30 nt, Artificial Sequence
  Heat shock 70 kDa protein 4 (766-775)
aaggagaucgaggccaagaucaaggagcug

SEQ ID NO: 50165 - RNA, 27 nt, Artificial Sequence
  WASH complex subunit 7 (678-686)
aaggagaucgagaaggaccugcgccuc

SEQ ID NO: 50166 - RNA, 30 nt, Artificial Sequence
  THO complex subunit 5 homolog (217-226)
aaggagaucgaggugaagaaggaguaccug

SEQ ID NO: 50167 - RNA, 30 nt, Artificial Sequence
  Calcium/calmodulin-dependent protein kinase type IV (135-144)
aaggagaucuucgagacccccaccgagauc

SEQ ID NO: 50168 - RNA, 33 nt, Artificial Sequence
  Kinesin-like protein KIF2C (653-663)
aaggagaucauccagcagggccccgacuggcug

SEQ ID NO: 50169 - RNA, 30 nt, Artificial Sequence
  Spectrin beta chain, non-erythrocytic 1 (924-933)
aaggagaucaaggcccagcaggacaagcug

SEQ ID NO: 50170 - RNA, 27 nt, Artificial Sequence
  Eukaryotic translation initiation factor 3 subunit E (29-37)
aaggagaucuacaacgagaaggagcug

SEQ ID NO: 50171 - RNA, 27 nt, Artificial Sequence
  Telomere-associated protein RIF1 (519-527)
aaggagaagcccggcagcgaggugcug

SEQ ID NO: 50172 - RNA, 30 nt, Artificial Sequence
  Beclin-1 (185-194)
aaggagcuggcccucgaggaggagcgccug

SEQ ID NO: 50173 - RNA, 27 nt, Artificial Sequence
  Ras and Rab interactor 1 (172-180)
aaggagcuggaggccaucagccaccuc

SEQ ID NO: 50174 - RNA, 27 nt, Artificial Sequence
  Liprin-beta-1 (682-690)
aaggagcugggcaucaagcacagccuc

SEQ ID NO: 50175 - RNA, 33 nt, Artificial Sequence
  Protein S100-A1 (32-42)
aaggagcugaaggagcuccugcagaccgagcug

SEQ ID NO: 50176 - RNA, 27 nt, Artificial Sequence
  L-dopachrome tautomerase (418-426)
aaggagcugcccagccuccacgugcug

SEQ ID NO: 50177 - RNA, 30 nt, Artificial Sequence
  Loss of heterozygosity 12 chromosomal region 1 protein (119-128)
aaggagauggaccugagcguggagacccuc

SEQ ID NO: 50178 - RNA, 27 nt, Artificial Sequence
  Disabled homolog 2 (652-660)
aaggagauguucaaggacuuccagcug

SEQ ID NO: 50179 - RNA, 36 nt, Artificial Sequence
  T-complex protein 1 subunit epsilon (113-124)
aaggagaugaaccccgcccugggcaucgacugccuc

SEQ ID NO: 50180 - RNA, 33 nt, Artificial Sequence
  Ras-related protein Rab-13 (99-109)
aaggagaacgccagcgccggcguggagcgccug

SEQ ID NO: 50181 - RNA, 30 nt, Artificial Sequence
  Ras-related protein Rab-34 (152-161)
aaggagaacgaccccagcuccgugcugcuc

SEQ ID NO: 50182 - RNA, 30 nt, Artificial Sequence
  AN1-type zinc finger protein 5 (200-209)
aaggagaaccccguggucguggccgagaag

SEQ ID NO: 50183 - RNA, 27 nt, Artificial Sequence
  Hypoxia-inducible factor 1-alpha (392-400)
aaggagcccgacgcccugacccuccug

SEQ ID NO: 50184 - RNA, 27 nt, Artificial Sequence
  P protein (539-547)
aaggagcccagcgagaucguggagcug

SEQ ID NO: 50185 - RNA, 33 nt, Artificial Sequence
  Zinc finger protein 36, C3H1 type-like 2 (102-112)
aaggagcccagcggcgggggcgggaccgcccug

SEQ ID NO: 50186 - RNA, 27 nt, Artificial Sequence
  V-type proton ATPase subunit H (86-94)
aaggagcagaccgugcaguacauccug

SEQ ID NO: 50187 - RNA, 33 nt, Artificial Sequence
  Filamin A-interacting protein 1-like (562-572)
aaggagcgcgacgaccugaagaacaagcucaag

SEQ ID NO: 50188 - RNA, 30 nt, Artificial Sequence
  Transcription factor 7-like 2 (348-357)
aaggagagcgccgccaucaaccagauccug

SEQ ID NO: 50189 - RNA, 27 nt, Artificial Sequence
  Dynactin subunit 2 (127-135)
aaggagagcgccaccgaggagaagcug

SEQ ID NO: 50190 - RNA, 27 nt, Artificial Sequence
  Cullin-1 (229-237)
aaggagagcuucgagucccaguuccug

SEQ ID NO: 50191 - RNA, 30 nt, Artificial Sequence
  Lysine-specific histone demethylase 1B (522-531)
aaggagagcggcauccaguucuccgagcug

SEQ ID NO: 50192 - RNA, 27 nt, Artificial Sequence
  Ras-related GTP-binding protein D (313-321)
aaggagagcaccgccaucaucaagcug

SEQ ID NO: 50193 - RNA, 27 nt, Artificial Sequence
  Ras-related protein Rab-7a (48-56)
aaggaggugauggucgacgaccgccug

SEQ ID NO: 50194 - RNA, 27 nt, Artificial Sequence
  Cold shock domain-containing protein E1 (675-683)
aaggaggugcaggacggcaucgagcug

SEQ ID NO: 50195 - RNA, 24 nt, Artificial Sequence
  Band 4.1-like protein 2 (195-202)
aaggaggugcagaccaacgagcug

SEQ ID NO: 50196 - RNA, 27 nt, Artificial Sequence
  Nuclear receptor subfamily 4 group A member 3 (320-328)
aaggaggugguccgcaccgacagccug

SEQ ID NO: 50197 - RNA, 33 nt, Artificial Sequence
  RuvB-like 1 (68-78)
aaggagguguacgagggcgaggucaccgagcug

SEQ ID NO: 50198 - RNA, 27 nt, Artificial Sequence
  F-box only protein 32 (43-51)
aaggagguguacaacaaggagaaccug

SEQ ID NO: 50199 - RNA, 27 nt, Artificial Sequence
  Armadillo repeat-containing X-linked protein 1 (379-387)
aaggagugggaccgcgagauccugcuc

SEQ ID NO: 50200 - RNA, 27 nt, Artificial Sequence
  Sentrin-specific protease 6 (154-162)
aaggaguaccccccgcacgugcagaag

SEQ ID NO: 50201 - RNA, 33 nt, Artificial Sequence
  Iron-responsive element-binding protein 2 (24-34)
aaguucuucgacgugagcaagcugggcaccaag

SEQ ID NO: 50202 - RNA, 27 nt, Artificial Sequence
  Nucleolin (110-118)
aagggcgccacccccgggaaggcccug

SEQ ID NO: 50203 - RNA, 27 nt, Artificial Sequence
  PRELI domain-containing protein 1, mitochondrial (160-168)
aagggcuucgaguacauccuggccaag

SEQ ID NO: 50204 - RNA, 30 nt, Artificial Sequence
  CD302 antigen (84-93)
aagggccccgacgacauccugcucgggaug

SEQ ID NO: 50205 - RNA, 27 nt, Artificial Sequence
  Epithelial discoidin domain-containing receptor 1 (781-789)
aagaucgccgacuucggcaugagccgc

SEQ ID NO: 50206 - RNA, 33 nt, Artificial Sequence
  Merlin (209-219)
aagaucgcccaggaccuggagauguacggcgug

SEQ ID NO: 50207 - RNA, 27 nt, Artificial Sequence
  Afadin (742-750)
aagaucgacgacgugcugcacacccuc

SEQ ID NO: 50208 - RNA, 27 nt, Artificial Sequence
  Leucine-rich repeat-containing protein 9 (112-120)
aagaucgagaaccuggagaagcucauc

SEQ ID NO: 50209 - RNA, 27 nt, Artificial Sequence
  Gamma-interferon-inducible protein 16 (67-75)
aagaucuucgaggacauccccacccug

SEQ ID NO: 50210 - RNA, 30 nt, Artificial Sequence
  Palladin (13-22)
aagaucuucgagggcaugcccgugaccuuc

SEQ ID NO: 50211 - RNA, 30 nt, Artificial Sequence
  Cytochrome c oxidase subunit 2 (217-226)
aagaucuucgagaugggccccguguucacc

SEQ ID NO: 50212 - RNA, 27 nt, Artificial Sequence
  Small subunit processome component 20 homolog (391-399)
aagaucuucgagagccgcuucgagaag

SEQ ID NO: 50213 - RNA, 33 nt, Artificial Sequence
  Zinc finger protein 141 (290-300)
aagaucuucaccagcuccagcaacuucgccaag

SEQ ID NO: 50214 - RNA, 27 nt, Artificial Sequence
  Tudor domain-containing protein 3 (524-532)
aagaucuucuacaacagcggccccaag

SEQ ID NO: 50215 - RNA, 27 nt, Artificial Sequence
  Cytoskeleton-associated protein 5 (868-876)
aagaucggcgacaagaacuggaagauc

SEQ ID NO: 50216 - RNA, 27 nt, Artificial Sequence
  Neuron navigator 2 (2313-2321)
aagaucaucgacuggauccccaaggug

SEQ ID NO: 50217 - RNA, 36 nt, Artificial Sequence
  RanBP2-like and GRIP domain-containing protein 3 (721-732)
aagauccuggacgacagcgacuccaaccucagcgug

SEQ ID NO: 50218 - RNA, 30 nt, Artificial Sequence
  Creatine kinase S-type, mitochondrial (344-353)
aagauccuggagaaccuccgccugcagaag

SEQ ID NO: 50219 - RNA, 27 nt, Artificial Sequence
  Ankyrin repeat and KH domain-containing protein 1 (866-874)
aagauccugaaggagcuccagaaggug

SEQ ID NO: 50220 - RNA, 27 nt, Artificial Sequence
  Protein phosphatase 1 regulatory subunit 21 (355-363)
aagauccugcccuaccagcucaagcgc

SEQ ID NO: 50221 - RNA, 30 nt, Artificial Sequence
  Cytoglobin (125-134)
aagauccugagcggcgugauccucgagguc

SEQ ID NO: 50222 - RNA, 27 nt, Artificial Sequence
  Trimethylguanosine synthase (510-518)
aagauccugagcaagguggagaaguuc

SEQ ID NO: 50223 - RNA, 33 nt, Artificial Sequence
  X-ray repair cross-complementing protein 6 (451-461)
aagaucauggccacccccgagcaggugggcaag

SEQ ID NO: 50224 - RNA, 27 nt, Artificial Sequence
  Syntaxin-binding protein 1 (13-21)
aagaucaugcacgacgugaucaagaag

SEQ ID NO: 50225 - RNA, 27 nt, Artificial Sequence
  Protein S100-A10 (54-62)
aagaucaugaaggaccuggaccagugc

SEQ ID NO: 50226 - RNA, 27 nt, Artificial Sequence
  60S ribosomal protein L26 (28-36)
aagaucaugagcuccccccugagcaag

SEQ ID NO: 50227 - RNA, 27 nt, Artificial Sequence
  Inversin (350-358)
aagaucaaccccaacgugcaggacuac

SEQ ID NO: 50228 - RNA, 33 nt, Artificial Sequence
  E3 SUMO-protein ligase NSE2 (96-106)
aagauccccgaccugaagcuccugguggagaag

SEQ ID NO: 50229 - RNA, 27 nt, Artificial Sequence
  Arrestin domain-containing protein 4 (273-281)
aagauccccccggugacccccagcauc

SEQ ID NO: 50230 - RNA, 27 nt, Artificial Sequence
  Utrophin (2159-2167)
aagaucagcgagucccugcgcaccgug

SEQ ID NO: 50231 - RNA, 30 nt, Artificial Sequence
  Nucleolar protein 58 (40-49)
aagaucgugaagcugaagcacuucgagaag

SEQ ID NO: 50232 - RNA, 36 nt, Artificial Sequence
  ATP synthase subunit g, mitochondrial (55-66)
aagaucgugaacagcgcccagaccggcuccuucaag

SEQ ID NO: 50233 - RNA, 36 nt, Artificial Sequence
  Pre-mRNA-processing factor 19 (375-386)
aagaucugggaccugaaggagcgcaccaacguggcc

SEQ ID NO: 50234 - RNA, 30 nt, Artificial Sequence
  Melanoma-associated antigen 12 (220-229)
aagaucugggaggagcugagcgugcucgag

SEQ ID NO: 50235 - RNA, 27 nt, Artificial Sequence
  60S ribosomal protein L3 (278-286)
aagaucuacaagaucggccagggguac

SEQ ID NO: 50236 - RNA, 33 nt, Artificial Sequence
  SWI/SNF-related matrix-associated actin-dependent regulator of chromatin subfamily A member 5 (411-421)
aagaucuacgugggccugagcaagaugcagcgc

SEQ ID NO: 50237 - RNA, 27 nt, Artificial Sequence
  Dynein heavy chain 5, axonemal (1406-1414)
aagaagcagcugaaccuccugcagaag

SEQ ID NO: 50238 - RNA, 27 nt, Artificial Sequence
  Tubulin alpha-1C chain (89-97)
aagcuggccgaccagugcaccggccuc

SEQ ID NO: 50239 - RNA, 27 nt, Artificial Sequence
  Protein TANC1 (1398-1406)
aagcugugccccaccaaccaggaggug

SEQ ID NO: 50240 - RNA, 30 nt, Artificial Sequence
  Golgi-associated PDZ and coiled-coil motif-containing protein (449-458)
aagcuggacgaccuccacacccuguaccac

SEQ ID NO: 50241 - RNA, 27 nt, Artificial Sequence
  Dystonin (4697-4705)
aagcuggacgacaugcucagcgagcug

SEQ ID NO: 50242 - RNA, 27 nt, Artificial Sequence
  Prefoldin subunit 3 (21-29)
aagcuggacgagcaguaccagaaguac

SEQ ID NO: 50243 - RNA, 30 nt, Artificial Sequence
  DNA topoisomerase 2-alpha (278-287)
aagcuggacgagaccggcaacagccucaag

SEQ ID NO: 50244 - RNA, 30 nt, Artificial Sequence
  Cysteine-tRNA ligase, cytoplasmic (716-725)
aagcuguucgaggcccaggagaagcucuac

SEQ ID NO: 50245 - RNA, 33 nt, Artificial Sequence
  Pleckstrin homology-like domain family B member 1 (803-813)
aagcuguucgaggaccucgaguuccagcagcug

SEQ ID NO: 50246 - RNA, 27 nt, Artificial Sequence
  Protein CASP (544-552)
aagcuguucgagaagaucaaguuccuc

SEQ ID NO: 50247 - RNA, 30 nt, Artificial Sequence
  Integrator complex subunit 11 (251-260)
aagcuguucauccccuggaccaaccagaag

SEQ ID NO: 50248 - RNA, 27 nt, Artificial Sequence
  Lathosterol oxidase (289-297)
aagcuguucaacggcgaguucaccaag

SEQ ID NO: 50249 - RNA, 33 nt, Artificial Sequence
  Cytochrome c oxidase subunit 7A2, mitochondrial (33-43)
aagcuguuccaggaggacgacgagaucccccuc

SEQ ID NO: 50250 - RNA, 30 nt, Artificial Sequence
  Ubiquitin carboxyl-terminal hydrolase 1 (428-437)
aagcuguuccagggccagcucgugcugcgc

SEQ ID NO: 50251 - RNA, 33 nt, Artificial Sequence
  Coatomer subunit gamma-1 (75-85)
aagcuguuccagagcaacgaccccacccuccgc

SEQ ID NO: 50252 - RNA, 24 nt, Artificial Sequence
  Probable U3 small nucleolar RNA-associated protein 11 (142-149)
aagcuguucgugaucgcccagaag

SEQ ID NO: 50253 - RNA, 36 nt, Artificial Sequence
  Thyroid hormone receptor-associated protein 3 (547-558)
aagcugggcgccaagggggacuuccccaccggcaag

SEQ ID NO: 50254 - RNA, 27 nt, Artificial Sequence
  F-box only protein 7 (249-257)
aagcugggcgagaacguggccaacauc

SEQ ID NO: 50255 - RNA, 27 nt, Artificial Sequence
  Vam6/Vps39-like protein (271-279)
aagcugggcaccgaccccacccacgug

SEQ ID NO: 50256 - RNA, 27 nt, Artificial Sequence
  Zinc finger protein 106 (287-295)
aagcugggcaccguggccaccuaccgc

SEQ ID NO: 50257 - RNA, 30 nt, Artificial Sequence
  Large subunit GTPase 1 homolog (102-111)
aagcugcacgaggagaacaagcaguuccuc

SEQ ID NO: 50258 - RNA, 27 nt, Artificial Sequence
  Serine/threonine-protein kinase RIO2 (60-68)
aagcugaucgccugggagcgcaccaag

SEQ ID NO: 50259 - RNA, 36 nt, Artificial Sequence
  Inter-alpha-trypsin inhibitor heavy chain H5 (795-806)
aagcugaucgacggcgaguacaaggacuaccucgcc

SEQ ID NO: 50260 - RNA, 27 nt, Artificial Sequence
  Elongation of very long chain fatty acids protein 5 (120-128)
aagcugaucgaguucauggacaccuuc

SEQ ID NO: 50261 - RNA, 27 nt, Artificial Sequence
  Transcription factor E2F4 (96-104)
aagcugaucgagcucaaggccgagauc

SEQ ID NO: 50262 - RNA, 27 nt, Artificial Sequence
  Dedicator of cytokinesis protein 9 (1738-1746)
aagcugaucauccccaucuacgagaag

SEQ ID NO: 50263 - RNA, 27 nt, Artificial Sequence
  Amyloid-like protein 2 (10-18)
aagcugaaggaccucgccuuccugaag

SEQ ID NO: 50264 - RNA, 27 nt, Artificial Sequence
  Kinesin-like protein KIF20B (1224-1232)
aagcugaaggaggagaucacccagcuc

SEQ ID NO: 50265 - RNA, 27 nt, Artificial Sequence
  Dystonin (2863-2871)
aagcugaaggagagccucgagaaggcc

SEQ ID NO: 50266 - RNA, 27 nt, Artificial Sequence
  Heat shock 70 kDa protein 4 (124-132)
aagcugaaggagaccgccgagagcgug

SEQ ID NO: 50267 - RNA, 27 nt, Artificial Sequence
  Lon protease homolog 2, peroxisomal (304-312)
aagcugaagaagcgcgugcucgaguac

SEQ ID NO: 50268 - RNA, 27 nt, Artificial Sequence
  Cytoplasmic dynein 1 heavy chain 1 (681-689)
aagcugaagcaggacggcgacagcuuc

SEQ ID NO: 50269 - RNA, 33 nt, Artificial Sequence
  E3 ubiquitin-protein ligase UBR3 (1192-1202)
aagcugcucgccgaguucgccagccgccagaag

SEQ ID NO: 50270 - RNA, 30 nt, Artificial Sequence
  Cytoplasmic dynein 1 heavy chain 1 (1715-1724)
aagcugcucgccgagagcgugaccgagguc

SEQ ID NO: 50271 - RNA, 27 nt, Artificial Sequence
  WD repeat and HMG-box DNA-binding protein 1 (77-85)
aagcugcucgccauccccguggagaag

SEQ ID NO: 50272 - RNA, 36 nt, Artificial Sequence
  Tight junction-associated protein 1 (150-161)
aagcugcucgacgccaagaacaccaucaacaagcug

SEQ ID NO: 50273 - RNA, 30 nt, Artificial Sequence
  Protein FAM32A (36-45)
aagcugcucgaggccaugggcaccagcaag

SEQ ID NO: 50274 - RNA, 30 nt, Artificial Sequence
  SEC14 domain and spectrin repeat-containing protein 1 (418-427)
aagcugcucgaggagaagcugaagagcgug

SEQ ID NO: 50275 - RNA, 27 nt, Artificial Sequence
  Probable dimethyladenosine transferase (73-81)
aagcugcucgagaaggccaagaaggug

SEQ ID NO: 50276 - RNA, 27 nt, Artificial Sequence
  Polymerase I and transcript release factor (109-117)
aagcugcucgagaaggugcgcaagguc

SEQ ID NO: 50277 - RNA, 27 nt, Artificial Sequence
  Retinaldehyde-binding protein 1 (261-269)
aagcugcucgagcgcguguucguccac

SEQ ID NO: 50278 - RNA, 27 nt, Artificial Sequence
  Ubiquitin-conjugating enzyme E2 Q1 (46-54)
aagcugcucgagagcaucuuccaccgc

SEQ ID NO: 50279 - RNA, 27 nt, Artificial Sequence
  S-adenosylmethionine decarboxylase proenzyme (12-20)
aagcugcucgaggugugguucagccgc

SEQ ID NO: 50280 - RNA, 30 nt, Artificial Sequence
  General transcription factor 3C polypeptide 1 (82-91)
aagcugcucaaggaguucaagcgcaacgac

SEQ ID NO: 50281 - RNA, 30 nt, Artificial Sequence
  Enhancer of mRNA-decapping protein 4 (1087-1096)
aagcugcucaagagcaagaaccugaccgac

SEQ ID NO: 50282 - RNA, 36 nt, Artificial Sequence
  Growth arrest and DNA damage-inducible protein GADD45 alpha (45-56)
aagcugcucaacguggaccccgacaacgucgugcug

SEQ ID NO: 50283 - RNA, 30 nt, Artificial Sequence
  Box C/D snoRNA protein 1 (321-330)
aagcugcuccccaacggcuucaccaagcgc

SEQ ID NO: 50284 - RNA, 27 nt, Artificial Sequence
  HMG box-containing protein 1 (263-271)
aagcugcucagccacgaggaguccgug

SEQ ID NO: 50285 - RNA, 36 nt, Artificial Sequence
  Ubiquitin-conjugating enzyme E2 E1 (43-54)
aagcugcucagcaccuccgccaagcgcauccagaag

SEQ ID NO: 50286 - RNA, 33 nt, Artificial Sequence
  Junction plakoglobin (325-335)
aagcugcucuggaccaccagccgcgugcugaag

SEQ ID NO: 50287 - RNA, 27 nt, Artificial Sequence
  Mitogen-activated protein kinase 6 (549-557)
aagcugaacgaccucaacagcuccgug

SEQ ID NO: 50288 - RNA, 27 nt, Artificial Sequence
  Platelet-activating factor acetylhydrolase IB subunit alpha (71-79)
aagcugaacgaggccaaggaggaguuc

SEQ ID NO: 50289 - RNA, 27 nt, Artificial Sequence
  Structural maintenance of chromosomes protein 1A (1009-1017)
aagcugaacgagcagcagagcgugcuc

SEQ ID NO: 50290 - RNA, 33 nt, Artificial Sequence
  60S ribosomal protein L4 (327-337)
aagcugaaccccuacgccaagaccaugcgccgg

SEQ ID NO: 50291 - RNA, 27 nt, Artificial Sequence
  Pleckstrin homology domain-containing family A member 5 (187-195)
aagcugaacagccuccccuccgaguac

SEQ ID NO: 50292 - RNA, 27 nt, Artificial Sequence
  RUN and FYVE domain-containing protein 2 (250-258)
aagcugcaggaggagaaccaccagcuc

SEQ ID NO: 50293 - RNA, 27 nt, Artificial Sequence
  Bardet-Biedl syndrome 5 protein (242-250)
aagcugcaggagagcgugaaggagauc

SEQ ID NO: 50294 - RNA, 30 nt, Artificial Sequence
  Calponin-3 (64-73)
aagcugcagcccggcagcgugaagaagguc

SEQ ID NO: 50295 - RNA, 30 nt, Artificial Sequence
  AP-1 complex subunit beta-1 (876-885)
aagcugcagagcuccaacaucuucaccgug

SEQ ID NO: 50296 - RNA, 27 nt, Artificial Sequence
  RuvB-like 1 (214-222)
aagcugcgcggcgagaucaacaaggug

SEQ ID NO: 50297 - RNA, 30 nt, Artificial Sequence
  Integrin beta-1 (331-340)
aagcugagcgagggcgugaccaucuccuac

SEQ ID NO: 50298 - RNA, 33 nt, Artificial Sequence
  3-hydroxy-3-methylglutaryl-coenzyme A reductase (502-512)
aagcugagcgagcccuccagccuccaguaccug

SEQ ID NO: 50299 - RNA, 27 nt, Artificial Sequence
  DNA topoisomerase 1 (248-256)
aagcugagccccaaggccgaggaggug

SEQ ID NO: 50300 - RNA, 30 nt, Artificial Sequence
  Neuron navigator 2 (616-625)
aagcugagcuccggccucccccagcagaag

SEQ ID NO: 50301 - RNA, 33 nt, Artificial Sequence
  Coatomer subunit alpha (619-629)
aagcuggugggccagagcaucaucgccuaccuc

SEQ ID NO: 50302 - RNA, 27 nt, Artificial Sequence
  Proteasome activator complex subunit 3 (201-209)
aagcuggugagcaagaucgccaaguac

SEQ ID NO: 50303 - RNA, 30 nt, Artificial Sequence
  Coatomer subunit beta' (124-133)
aagcugugggacugggacaagaaguggagc

SEQ ID NO: 50304 - RNA, 33 nt, Artificial Sequence
  Treslin (218-228)
aagcugugggagagccccgaccaccucggcuac

SEQ ID NO: 50305 - RNA, 30 nt, Artificial Sequence
  Lambda-crystallin homolog (33-42)
aagcuguacgacaucgagcagcagcagauc

SEQ ID NO: 50306 - RNA, 33 nt, Artificial Sequence
  26S proteasome non-ATPase regulatory subunit 11 (325-335)
aagcuguacgacaaccuccuggagcagaaccug

SEQ ID NO: 50307 - RNA, 27 nt, Artificial Sequence
  Calpain-1 catalytic subunit (654-662)
aagcuguacgagcucaucaucacccgc

SEQ ID NO: 50308 - RNA, 30 nt, Artificial Sequence
  Calpain-1 catalytic subunit (654-663)
aagcuguacgagcucaucaucacccgcuac

SEQ ID NO: 50309 - RNA, 27 nt, Artificial Sequence
  Signal recognition particle 9 kDa protein (16-24)
aagcuguaccucgccgaccccaugaag

SEQ ID NO: 50310 - RNA, 27 nt, Artificial Sequence
  Gap junction alpha-3 protein (313-321)
aagcuguacaacggccaccaccaccuc

SEQ ID NO: 50311 - RNA, 27 nt, Artificial Sequence
  Dedicator of cytokinesis protein 5 (1299-1307)
aagcuguaccaggagaucaucagcuac

SEQ ID NO: 50312 - RNA, 30 nt, Artificial Sequence
  Rab GDP dissociation inhibitor beta (130-139)
aagcuguacagcgagucccucgcccgcuac

SEQ ID NO: 50313 - RNA, 27 nt, Artificial Sequence
  2',3'-cyclic-nucleotide 3'-phosphodiesterase (351-359)
aagcuguacagccucggcaacgggcgc

SEQ ID NO: 50314 - RNA, 27 nt, Artificial Sequence
  Cytochrome b-c1 complex subunit 9 (9-17)
aagcuguacagccuccuguuccgccgg

SEQ ID NO: 50315 - RNA, 30 nt, Artificial Sequence
  Dual specificity tyrosine-phosphorylation-regulated kinase 3 (365-374)
aagcuguacaccuacauccagagccgcuuc

SEQ ID NO: 50316 - RNA, 33 nt, Artificial Sequence
  Something about silencing protein 10 (134-144)
aagcuguacuacgacaccgacuacggcagcaag

SEQ ID NO: 50317 - RNA, 27 nt, Artificial Sequence
  Stathmin (95-103)
aagauggccgaggagaagcugacccac

SEQ ID NO: 50318 - RNA, 33 nt, Artificial Sequence
  Stathmin (95-105)
aagauggccgaggagaagcugacccacaagaug

SEQ ID NO: 50319 - RNA, 33 nt, Artificial Sequence
  Eukaryotic peptide chain release factor GTP-binding subunit ERF3B (350-360)
aagauggacgaccccaccgugaacuggagcauc

SEQ ID NO: 50320 - RNA, 27 nt, Artificial Sequence
  Dihydropyrimidinase-related protein 1 (341-349)
aagauggacgagaaccaguucguggcc

SEQ ID NO: 50321 - RNA, 27 nt, Artificial Sequence
  Interferon regulatory factor 9 (369-377)
aagauggagcaggccuucgcccgcuac

SEQ ID NO: 50322 - RNA, 27 nt, Artificial Sequence
  Guanine nucleotide-binding protein G(i) subunit alpha-1 (197-205)
aagauguucgacgugggcgggcagcgc

SEQ ID NO: 50323 - RNA, 39 nt, Artificial Sequence
  Transketolase (516-528)
aagauguucggcaucgaccgcgacgccaucgcccaggcg

SEQ ID NO: 50324 - RNA, 33 nt, Artificial Sequence
  Zinc finger FYVE domain-containing protein 16 (254-264)
aagauguuccacgccaaggacaagcugcagcac

SEQ ID NO: 50325 - RNA, 24 nt, Artificial Sequence
  Ubiquitin-associated domain-containing protein 2 (83-90)
aagauguuccaggugcaccagguc

SEQ ID NO: 50326 - RNA, 33 nt, Artificial Sequence
  Intraflagellar transport protein 88 homolog (227-237)
aagauguucagcaacgccggcauccugaagaug

SEQ ID NO: 50327 - RNA, 27 nt, Artificial Sequence
  Integrin alpha-7 (1061-1069)
aagaugggcuucuucaagcgcgccaag

SEQ ID NO: 50328 - RNA, 27 nt, Artificial Sequence
  FACT complex subunit SPT16 (120-128)
aagaugaucgaggccaucaaggagagc

SEQ ID NO: 50329 - RNA, 30 nt, Artificial Sequence
  BRISC and BRCA1-A complex member 1 (126-135)
aagaugaucgagauguucgugcgcaccaag

SEQ ID NO: 50330 - RNA, 27 nt, Artificial Sequence
  Spartin (80-88)
aagaugaaggagacccugcagaacgug

SEQ ID NO: 50331 - RNA, 30 nt, Artificial Sequence
  DNA topoisomerase 1 (262-271)
aagaugcuggaccacgaguacaccaccaag

SEQ ID NO: 50332 - RNA, 30 nt, Artificial Sequence
  Tropomodulin-3 (307-316)
aagaugcuggaggagaacaccaacauccuc

SEQ ID NO: 50333 - RNA, 30 nt, Artificial Sequence
  Enhancer of mRNA-decapping protein 3 (373-382)
aagaugcuggagagcaucaccaacgagcuc

SEQ ID NO: 50334 - RNA, 27 nt, Artificial Sequence
  Transient receptor potential cation channel subfamily M member 2 (1336-1344)
aagaugcuggaggugcucgucgugaag

SEQ ID NO: 50335 - RNA, 27 nt, Artificial Sequence
  MICAL-like protein 1 (843-851)
aagaugcugaagcuccugggcaacaag

SEQ ID NO: 50336 - RNA, 30 nt, Artificial Sequence
  Cofilin-1 (73-82)
aagaugcugcccgacaaggacugccgcuac

SEQ ID NO: 50337 - RNA, 33 nt, Artificial Sequence
  Cofilin-1 (73-83)
aagaugcugcccgacaaggacugccgcuacgcc

SEQ ID NO: 50338 - RNA, 27 nt, Artificial Sequence
  Leucine-rich repeat-containing protein 40 (539-547)
aagaugauggagaaccugaccacccuc

SEQ ID NO: 50339 - RNA, 27 nt, Artificial Sequence
  U3 small nucleolar ribonucleoprotein protein MPP10 (357-365)
aagaugaacgagaagaucgccagccug

SEQ ID NO: 50340 - RNA, 27 nt, Artificial Sequence
  Unconventional myosin-X (643-651)
aagaugcccgaccaguucgaccaggcc

SEQ ID NO: 50341 - RNA, 27 nt, Artificial Sequence
  Voltage-dependent calcium channel subunit alpha-2/delta-1 (39-47)
aagaugcaggaggaccuggugacccuc

SEQ ID NO: 50342 - RNA, 36 nt, Artificial Sequence
  Gamma-secretase C-terminal fragment 59 (620-631)
aagaugcagcagaacggcuacgagaaccccaccuac

SEQ ID NO: 50343 - RNA, 33 nt, Artificial Sequence
  U2 small nuclear ribonucleoprotein B'' (47-57)
aagaugcgcggccaggccuucgugaucuucaag

SEQ ID NO: 50344 - RNA, 27 nt, Artificial Sequence
  Aryl hydrocarbon receptor nuclear translocator (104-112)
aagaugaccgccuacaucaccgagcug

SEQ ID NO: 50345 - RNA, 27 nt, Artificial Sequence
  Uncharacterized protein C20orf194 (424-432)
aagaugaccuuccacauccacgccgug

SEQ ID NO: 50346 - RNA, 27 nt, Artificial Sequence
  Aryl hydrocarbon receptor nuclear translocator 2 (67-75)
aagaugacccaguacaucaccgagcug

SEQ ID NO: 50347 - RNA, 27 nt, Artificial Sequence
  Dual specificity mitogen-activated protein kinase kinase 7 (221-229)
aagaugaccguggccaucgucaaggcc

SEQ ID NO: 50348 - RNA, 36 nt, Artificial Sequence
  A-kinase anchor protein 11 (898-909)
aagaugguggacgagcgcaccgacuaccugaccaag

SEQ ID NO: 50349 - RNA, 33 nt, Artificial Sequence
  5-demethoxyubiquinone hydroxylase, mitochondrial (1-11)
aagaugugggaccaggagaaggaccaccugaag

SEQ ID NO: 50350 - RNA, 36 nt, Artificial Sequence
  5-demethoxyubiquinone hydroxylase, mitochondrial (1-12)
aagaugugggaccaggagaaggaccaccugaagaag

SEQ ID NO: 50351 - RNA, 45 nt, Artificial Sequence
  Neuroblast differentiation-associated protein AHNAK (5087-5101)
aagauguacuuccccgacguggaguucgacaucaagagcccgaag

SEQ ID NO: 50352 - RNA, 33 nt, Artificial Sequence
  General transcription factor 3C polypeptide 3 (166-176)
aagauguacggcuacguggacacccugcucacc

SEQ ID NO: 50353 - RNA, 30 nt, Artificial Sequence
  Round spermatid basic protein 1 (272-281)
aagauguacaacaaggaggugcagaccguc

SEQ ID NO: 50354 - RNA, 33 nt, Artificial Sequence
  116 kDa U5 small nuclear ribonucleoprotein component (480-490)
aagauguacagcaccgacgacggcgugcaguuc

SEQ ID NO: 50355 - RNA, 27 nt, Artificial Sequence
  60S ribosomal protein L17 (96-104)
aagaacgccgagagcaacgccgagcug

SEQ ID NO: 50356 - RNA, 27 nt, Artificial Sequence
  Ras GTPase-activating-like protein IQGAP2 (729-737)
aagaacgaccugcucagcgagcugcug

SEQ ID NO: 50357 - RNA, 27 nt, Artificial Sequence
  FACT complex subunit SPT16 (53-61)
aagaacuucgacauggugaucgucuac

SEQ ID NO: 50358 - RNA, 24 nt, Artificial Sequence
  Glutathione S-transferase theta-2B (23-30)
aagaacggcaucccccuggagcuc

SEQ ID NO: 50359 - RNA, 45 nt, Artificial Sequence
  Stromal cell-derived factor 2 (197-211)
aagcccagcgagcugcucaaggccgaggcccaccacgcggagcug

SEQ ID NO: 50360 - RNA, 36 nt, Artificial Sequence
  Spectrin beta chain, non-erythrocytic 1 (1179-1190)
aagcaggccgaggccuuccugaacaaccaggaguac

SEQ ID NO: 50361 - RNA, 27 nt, Artificial Sequence
  Melanocyte protein PMEL (629-637)
aagcaggacuucagcgugccccagcug

SEQ ID NO: 50362 - RNA, 24 nt, Artificial Sequence
  EF-hand calcium-binding domain-containing protein 14 (264-271)
aagcaggacauccuguaccuccac

SEQ ID NO: 50363 - RNA, 27 nt, Artificial Sequence
  Syntaxin-binding protein 6 (78-86)
aagcaguucgagggcagcaccuccuuc

SEQ ID NO: 50364 - RNA, 27 nt, Artificial Sequence
  E3 ubiquitin-protein ligase makorin-1 (320-328)
aagcaguucgagagcaagaucaucaag

SEQ ID NO: 50365 - RNA, 27 nt, Artificial Sequence
  Nucleoside diphosphate-linked moiety X motif 19 (337-345)
aagcaguuccaccgcaucgugaccuac

SEQ ID NO: 50366 - RNA, 30 nt, Artificial Sequence
  ADP-ribosylation factor GTPase-activating protein 2 (453-462)
aagcagggcgugaagagcgucgccgggaag

SEQ ID NO: 50367 - RNA, 27 nt, Artificial Sequence
  Lanosterol 14-alpha demethylase (169-177)
aagcagcacgugagcaucaucgagaag

SEQ ID NO: 50368 - RNA, 30 nt, Artificial Sequence
  60 kDa SS-A/Ro ribonucleoprotein (14-23)
aagcagaucgccaacagccaggacggcuac

SEQ ID NO: 50369 - RNA, 27 nt, Artificial Sequence
  Cytoplasmic dynein 1 heavy chain 1 (3819-3827)
aagcagauccacuuccuguaccaguac

SEQ ID NO: 50370 - RNA, 30 nt, Artificial Sequence
  Catenin alpha-1 (287-296)
aagcagaucaucguggacccccugagcuuc

SEQ ID NO: 50371 - RNA, 30 nt, Artificial Sequence
  Cytoplasmic dynein 1 heavy chain 1 (1464-1473)
aagcagauccgcgagguguggaacaccuac

SEQ ID NO: 50372 - RNA, 33 nt, Artificial Sequence
  Proteasome subunit alpha type-4 (158-168)
aagcagaaggagguggagcagcugaucaagaag

SEQ ID NO: 50373 - RNA, 33 nt, Artificial Sequence
  Tyrosinase (505-515)
aagcagcugcccgaggagaagcagccgcuccug

SEQ ID NO: 50374 - RNA, 30 nt, Artificial Sequence
  Guanine nucleotide-binding protein G(s) subunit alpha isoforms short (28-37)
aagcagcugcagaaggacaagcagguguac

SEQ ID NO: 50375 - RNA, 27 nt, Artificial Sequence
  Small kinetochore-associated protein (228-236)
aagcagauggaggagcugcaggcccuc

SEQ ID NO: 50376 - RNA, 27 nt, Artificial Sequence
  DnaJ homolog subfamily C member 4 (151-159)
aagcagaacaagcaggugcugggcuac

SEQ ID NO: 50377 - RNA, 27 nt, Artificial Sequence
  Cytoplasmic dynein 1 heavy chain 1 (3266-3274)
aagcagcaggaggugaucgccgacaag

SEQ ID NO: 50378 - RNA, 27 nt, Artificial Sequence
  Pyridoxal kinase (29-37)
aagcagcagaacccccgccugguguac

SEQ ID NO: 50379 - RNA, 27 nt, Artificial Sequence
  PRELI domain-containing protein 1, mitochondrial (211-219)
aagcagcagcagcagcagcaguucgug

SEQ ID NO: 50380 - RNA, 27 nt, Artificial Sequence
  Mitochondrial import receptor subunit TOM7 homolog (9-17)
aagcagcgccugcagcagcucuucaag

SEQ ID NO: 50381 - RNA, 27 nt, Artificial Sequence
  Protein Simiate (164-172)
aagcaguacgaggaggugauggucaag

SEQ ID NO: 50382 - RNA, 27 nt, Artificial Sequence
  60S ribosomal protein L35a (45-53)
aagcgcugcgccuacguguacaaggcc

SEQ ID NO: 50383 - RNA, 27 nt, Artificial Sequence
  Fructose-bisphosphate aldolase A (82-90)
aagcgcugccaguacgugaccgagaag

SEQ ID NO: 50384 - RNA, 27 nt, Artificial Sequence
  Trafficking kinesin-binding protein 2 (839-847)
aagcgccugggcaucgcccgggugguc

SEQ ID NO: 50385 - RNA, 27 nt, Artificial Sequence
  Chitinase domain-containing protein 1 (226-234)
aagcgcgugggccugauccacaugcuc

SEQ ID NO: 50386 - RNA, 33 nt, Artificial Sequence
  Myc proto-oncogene protein (324-334)
aagcgcgugaagcuggacagcguccgggugcuc

SEQ ID NO: 50387 - RNA, 27 nt, Artificial Sequence
  Msx2-interacting protein (27-35)
aagcgcuacggccggguggagagcguc

SEQ ID NO: 50388 - RNA, 33 nt, Artificial Sequence
  DmX-like protein 2 (1150-1160)
aagagcgacgcccugcucuccaaggaccgcuac

SEQ ID NO: 50389 - RNA, 33 nt, Artificial Sequence
  Mitochondrial Rho GTPase 1 (528-538)
aagagcgaccugcacgaggugaagcaggaguac

SEQ ID NO: 50390 - RNA, 42 nt, Artificial Sequence
  LON peptidase N-terminal domain and RING finger protein 2 (360-373)
aagagcgacaugcugggcaacaccaacuccagcgugcucuac

SEQ ID NO: 50391 - RNA, 27 nt, Artificial Sequence
  Transmembrane protein 70, mitochondrial (84-92)
aagagcgaggacggccgccugaucuac

SEQ ID NO: 50392 - RNA, 33 nt, Artificial Sequence
  Coiled-coil domain-containing protein 50 (470-480)
aagagcgaguccagccacaagggcuuccacuac

SEQ ID NO: 50393 - RNA, 30 nt, Artificial Sequence
  26S proteasome non-ATPase regulatory subunit 2 (545-554)
aagagcgagaccgagcugaaggacaccuac

SEQ ID NO: 50394 - RNA, 24 nt, Artificial Sequence
  Clathrin heavy chain 1 (706-713)
aagagcuucgagggccuguucuac

SEQ ID NO: 50395 - RNA, 27 nt, Artificial Sequence
  Formin-1 (1326-1334)
aagagcuucgagaccaccgugcgcuac

SEQ ID NO: 50396 - RNA, 27 nt, Artificial Sequence
  Ubiquitin-like modifier-activating enzyme 6 (628-636)
aagagcuuccccgccgccaucgagcac

SEQ ID NO: 50397 - RNA, 30 nt, Artificial Sequence
  Probable cation-transporting ATPase 13A3 (833-842)
aagagcuucuccgugauccuggagcacuuc

SEQ ID NO: 50398 - RNA, 30 nt, Artificial Sequence
  Glutamate-rich WD repeat-containing protein 1 (341-350)
aagagcggcucccccguggccaccuucaag

SEQ ID NO: 50399 - RNA, 33 nt, Artificial Sequence
  Bifunctional UDP-N-acetylglucosamine 2-epimerase/N-acetylmannosamine kinase (375-385)
aagagcaucgaccugcaggagccccuccagaag

SEQ ID NO: 50400 - RNA, 27 nt, Artificial Sequence
  Retinoblastoma-like protein 1 (69-77)
aagagcaucauccccaccgugggcaag

SEQ ID NO: 50401 - RNA, 30 nt, Artificial Sequence
  NAD(P)H dehydrogenase (quinone) 1 (259-268)
aagagcauccccaccgacaaccagaucaag

SEQ ID NO: 50402 - RNA, 27 nt, Artificial Sequence
  Small kinetochore-associated protein (70-78)
aagagccugcuccccgugcgcuccaag

SEQ ID NO: 50403 - RNA, 33 nt, Artificial Sequence
  Leucine-rich repeat-containing protein 40 (210-220)
aagagccugcccgccgagaucaaccgcaugaag

SEQ ID NO: 50404 - RNA, 27 nt, Artificial Sequence
  Putative ATP-dependent RNA helicase DHX57 (635-643)
aagagcuccgccacccgccugcucuac

SEQ ID NO: 50405 - RNA, 27 nt, Artificial Sequence
  Ankycorbin (402-410)
aagagcucccccagcgugcugauccac

SEQ ID NO: 50406 - RNA, 30 nt, Artificial Sequence
  Alternative protein MKKS (31-40)
aagagcucccccguguuccagaucccgaag

SEQ ID NO: 50407 - RNA, 27 nt, Artificial Sequence
  ATP synthase F(0) complex subunit C2, mitochondrial (31-39)
aagagcaccucccagcugcucagccgc

SEQ ID NO: 50408 - RNA, 27 nt, Artificial Sequence
  Clathrin heavy chain 1 (468-476)
aagagcguggaccccacccuggcccuc

SEQ ID NO: 50409 - RNA, 30 nt, Artificial Sequence
  Programmed cell death 6-interacting protein (574-583)
aagagcgugaacuucgacaugaccuccaag

SEQ ID NO: 50410 - RNA, 33 nt, Artificial Sequence
  Sodium/potassium-transporting ATPase subunit beta-3 (33-43)
aagagcuggggcucccaguacguggucgggaag

SEQ ID NO: 50411 - RNA, 27 nt, Artificial Sequence
  Arf-GAP with SH3 domain, ANK repeat and PH domain-containing protein 1 (73-81)
aagaccgccgacaagcugaagcaguac

SEQ ID NO: 50412 - RNA, 30 nt, Artificial Sequence
  DNA-directed RNA polymerase II subunit RPB1 (853-862)
aagaccgccgagaccggcuacauccagcgc

SEQ ID NO: 50413 - RNA, 30 nt, Artificial Sequence
  DNA-directed RNA polymerase III subunit RPC1 (133-142)
aagaccgccgagaccggcuacaugcagcgc

SEQ ID NO: 50414 - RNA, 27 nt, Artificial Sequence
  Chromodomain-helicase-DNA-binding protein 9 (992-1000)
aagaccgacgacagccuggagaaguac

SEQ ID NO: 50415 - RNA, 27 nt, Artificial Sequence
  TBC1 domain family member 15 (379-387)
aagaccgacgaguacuuccgcaugaag

SEQ ID NO: 50416 - RNA, 27 nt, Artificial Sequence
  Elongator complex protein 6 (28-36)
aagaccgacggcagcuuccuggugcac

SEQ ID NO: 50417 - RNA, 27 nt, Artificial Sequence
  PHD finger-like domain-containing protein 5A (95-103)
aagaccgaccuguucuacgagcgcaag

SEQ ID NO: 50418 - RNA, 30 nt, Artificial Sequence
  EF-hand calcium-binding domain-containing protein 7 (222-231)
aagaccgaccccgagaccuuccugaacaag

SEQ ID NO: 50419 - RNA, 33 nt, Artificial Sequence
  A-kinase anchor protein 13 (287-297)
aagaccgacagcaaguccaucaugcgcaugaag

SEQ ID NO: 50420 - RNA, 30 nt, Artificial Sequence
  Tumor necrosis factor receptor superfamily member 14 (17-26)
aagaccgacgugcugcgccucguccuguac

SEQ ID NO: 50421 - RNA, 27 nt, Artificial Sequence
  Poly (ADP-ribose) polymerase 14 (1027-1035)
aagaccgacguggucgugaacagcgug

SEQ ID NO: 50422 - RNA, 30 nt, Artificial Sequence
  Uncharacterized protein C19orf43 (137-146)
aagaccgaggacgaggugcugaccagcaag

SEQ ID NO: 50423 - RNA, 27 nt, Artificial Sequence
  M-phase phosphoprotein 8 (68-76)
aagaccgagggcgggaaggugcuguac

SEQ ID NO: 50424 - RNA, 33 nt, Artificial Sequence
  Protein PRR5-ARHGAP8 (76-86)
aagaccgagcugggcagcuucuucaccgaguac

SEQ ID NO: 50425 - RNA, 33 nt, Artificial Sequence
  Switch-associated protein 70 (282-292)
aagaccuucgagaucagcgccuccgacaagaag

SEQ ID NO: 50426 - RNA, 30 nt, Artificial Sequence
  Cytoplasmic dynein 1 heavy chain 1 (872-881)
aagaccuucagcgagauccugaaccgcgug

SEQ ID NO: 50427 - RNA, 30 nt, Artificial Sequence
  N-acetylglucosamine-6-sulfatase (191-200)
aagaccaucgaccccgagcugcucggcaag

SEQ ID NO: 50428 - RNA, 33 nt, Artificial Sequence
  DNA/RNA-binding protein KIN17 (231-241)
aagaccaucggcagcuccgccagcgugaagcgc

SEQ ID NO: 50429 - RNA, 33 nt, Artificial Sequence
  FH2 domain-containing protein 1 (90-100)
aagaccauccccgaggagcaggugcgcggcaag

SEQ ID NO: 50430 - RNA, 27 nt, Artificial Sequence
  Nck-associated protein 1 (635-643)
aagaccaucagccaggccgugaacaag

SEQ ID NO: 50431 - RNA, 27 nt, Artificial Sequence
  Endoplasmic reticulum-Golgi intermediate compartment protein 3 (4-12)
aagacccuggaggacuuccgcgugaag

SEQ ID NO: 50432 - RNA, 30 nt, Artificial Sequence
  Mitochondrial inner membrane protease ATP23 homolog (100-109)
aagacccuggagaccaaccccuacgugaag

SEQ ID NO: 50433 - RNA, 36 nt, Artificial Sequence
  cAMP-dependent protein kinase type I-alpha regulatory subunit (123-134)
aagaccauggccgcccuggcgaaggccaucgagaag

SEQ ID NO: 50434 - RNA, 30 nt, Artificial Sequence
  Arfaptin-2 (216-225)
aagaccauggaggacacccugaugacggug

SEQ ID NO: 50435 - RNA, 33 nt, Artificial Sequence
  Telomere-associated protein RIF1 (1915-1925)
aagaccauggagcugaacgugggcaacgaggcc

SEQ ID NO: 50436 - RNA, 33 nt, Artificial Sequence
  Protein GREB1 (304-314)
aagaccaugaccagcacggagcagucccuguac

SEQ ID NO: 50437 - RNA, 36 nt, Artificial Sequence
  Protein GREB1 (304-315)
aagaccaugaccagcacggagcagucccuguacuac

SEQ ID NO: 50438 - RNA, 27 nt, Artificial Sequence
  U3 small nucleolar RNA-associated protein 18 homolog (120-128)
aagaccaaccccaagauccagagcauc

SEQ ID NO: 50439 - RNA, 27 nt, Artificial Sequence
  Huntingtin-interacting protein 1-related protein (29-37)
aagacccaggccaucagcaucuccaag

SEQ ID NO: 50440 - RNA, 27 nt, Artificial Sequence
  Proteasome subunit alpha type-1 (121-129)
aagacccagauccccacccagcgcuac

SEQ ID NO: 50441 - RNA, 27 nt, Artificial Sequence
  F-box only protein 32 (74-82)
aagacccaguacuuccaccaggagaag

SEQ ID NO: 50442 - RNA, 33 nt, Artificial Sequence
  Oxysterol-binding protein-related protein 1 (153-163)
aagaccaccgagcugacggcccuccugaaccgc

SEQ ID NO: 50443 - RNA, 33 nt, Artificial Sequence
  G patch domain and KOW motifs-containing protein (49-59)
aagaccguggagggccgcgagcugcagagcguc

SEQ ID NO: 50444 - RNA, 27 nt, Artificial Sequence
  Melanocyte protein PMEL (154-162)
aagaccugggaccaggugcccuucagc

SEQ ID NO: 50445 - RNA, 36 nt, Artificial Sequence
  Melanocyte protein PMEL (154-165)
aagaccugggaccaggugcccuucagcgucuccgug

SEQ ID NO: 50446 - RNA, 24 nt, Artificial Sequence
  Melanocyte protein PMEL (154-161)
aagaccuggggccaguacuggcag

SEQ ID NO: 50447 - RNA, 27 nt, Artificial Sequence
  UDP-glucose 4-epimerase (176-184)
aagaccuggaacgccgugcugcuccgc

SEQ ID NO: 50448 - RNA, 30 nt, Artificial Sequence
  UDP-glucose 4-epimerase (176-185)
aagaccuggaacgccgugcugcuccgcuac

SEQ ID NO: 50449 - RNA, 27 nt, Artificial Sequence
  Transcription factor IIIA (198-206)
aagaccuggaccgagcugcucaagcac

SEQ ID NO: 50450 - RNA, 33 nt, Artificial Sequence
  A-kinase anchor protein 8-like (264-274)
aagaccuggaccacggccgacuuccgcaccaag

SEQ ID NO: 50451 - RNA, 33 nt, Artificial Sequence
  Nuclear pore complex protein Nup107 (574-584)
aagaccuacauccagcugcucauccgcgagaag

SEQ ID NO: 50452 - RNA, 27 nt, Artificial Sequence
  Poly(A)-specific ribonuclease PARN-like domain-containing protein 1 (364-372)
aagguggcccaccugcuccugcagaag

SEQ ID NO: 50453 - RNA, 33 nt, Artificial Sequence
  Mesoderm development candidate 1 (236-246)
aagguggcccccagcgagcuggcccgcucccgg

SEQ ID NO: 50454 - RNA, 33 nt, Artificial Sequence
  Calponin-3 (251-261)
aagguggccagccagaagggcauguccgucuac

SEQ ID NO: 50455 - RNA, 27 nt, Artificial Sequence
  Trafficking protein particle complex subunit 11 (134-142)
aagguggccgucgugcugauccagaag

SEQ ID NO: 50456 - RNA, 27 nt, Artificial Sequence
  Poly(A) polymerase gamma (590-598)
aagguggacagcaccgucaagaccgug

SEQ ID NO: 50457 - RNA, 36 nt, Artificial Sequence
  Actin-related protein 2/3 complex subunit 3 (147-158)
aagguguucgacccccagaacgacaagccgagcaag

SEQ ID NO: 50458 - RNA, 36 nt, Artificial Sequence
  Myosin regulatory light chain 10 (142-153)
aagguguucgacaccgagggcaagggguucgucaag

SEQ ID NO: 50459 - RNA, 27 nt, Artificial Sequence
  AP-2 complex subunit mu (405-413)
aagguguucgagcccaagcugaacuac

SEQ ID NO: 50460 - RNA, 27 nt, Artificial Sequence
  Lysine-specific histone demethylase 1A (228-236)
aagguguuccuguucauccgcaaccgg

SEQ ID NO: 50461 - RNA, 27 nt, Artificial Sequence
  Serine/threonine-protein phosphatase 2A activator (141-149)
aagguguucaaccgcuaccuggagguc

SEQ ID NO: 50462 - RNA, 27 nt, Artificial Sequence
  Long-chain-fatty-acid-CoA ligase 3 (90-98)
aagguguucaccuacgccaagaacaag

SEQ ID NO: 50463 - RNA, 27 nt, Artificial Sequence
  Caspase-2 (77-85)
aaggugggcagcuucucccagaacguc

SEQ ID NO: 50464 - RNA, 27 nt, Artificial Sequence
  Syntaxin-binding protein 1 (125-133)
aaggugaucaagacccugaccgagauc

SEQ ID NO: 50465 - RNA, 33 nt, Artificial Sequence
  Zinc finger protein 721 (244-254)
aaggugaucagcuccagcuccagcuucgccaag

SEQ ID NO: 50466 - RNA, 30 nt, Artificial Sequence
  Protein kinase C delta type (353-362)
aaggugcugggcaaggggagcuucggcaag

SEQ ID NO: 50467 - RNA, 36 nt, Artificial Sequence
  Inositol 1,4,5-trisphosphate receptor type 1 (451-462)
aaggugcugggcagcaucgccgggaagcucgagaag

SEQ ID NO: 50468 - RNA, 33 nt, Artificial Sequence
  Nuclease-sensitive element-binding protein 1 (58-68)
aaggugcugggcaccgucaagugguucaacgug

SEQ ID NO: 50469 - RNA, 27 nt, Artificial Sequence
  SLIT-ROBO Rho GTPase-activating protein 1 (156-164)
aaggugcugaacgagcucuacaccguc

SEQ ID NO: 50470 - RNA, 33 nt, Artificial Sequence
  Trafficking protein particle complex subunit 11 (54-64)
aaggugcugcccggcgaccacgaguacccgaag

SEQ ID NO: 50471 - RNA, 33 nt, Artificial Sequence
  B-cell CLL/lymphoma 7 protein family member B (20-30)
aaggugauggccgccaucgagaagguccgcaag

SEQ ID NO: 50472 - RNA, 27 nt, Artificial Sequence
  Uncharacterized protein C10orf88 (295-303)
aaggugaugccccagaaccacagcuuc

SEQ ID NO: 50473 - RNA, 27 nt, Artificial Sequence
  Max-like protein X (158-166)
aaggugaacuacgagcagaucgucaag

SEQ ID NO: 50474 - RNA, 27 nt, Artificial Sequence
  Mitochondrial antiviral-signaling protein (311-319)
aaggugcccgccaacccggccagcguc

SEQ ID NO: 50475 - RNA, 30 nt, Artificial Sequence
  Guanine nucleotide-binding protein G(s) subunit alpha isoforms short (77-86)
aaggugcaggacaucaagaacaaccugaag

SEQ ID NO: 50476 - RNA, 30 nt, Artificial Sequence
  Kinectin (324-333)
aaggugcaggagcugcagaaccuccugaag

SEQ ID NO: 50477 - RNA, 27 nt, Artificial Sequence
  Centromere protein F (2787-2795)
aaggugcgcgaggagaucgccgaguac

SEQ ID NO: 50478 - RNA, 27 nt, Artificial Sequence
  Transcription elongation factor SPT6 (191-199)
aaggugagcgacggcaucuaccagcac

SEQ ID NO: 50479 - RNA, 27 nt, Artificial Sequence
  Peptidyl-prolyl cis-trans isomerase FKBP3 (80-88)
aaggugagcgagcaggucaagaacgug

SEQ ID NO: 50480 - RNA, 27 nt, Artificial Sequence
  Exocyst complex component 7 (506-514)
aaggugaccgacuacaucgccgagaag

SEQ ID NO: 50481 - RNA, 27 nt, Artificial Sequence
  39S ribosomal protein L51, mitochondrial (1-9)
aagguggucgaccgcuggaacgagaag

SEQ ID NO: 50482 - RNA, 27 nt, Artificial Sequence
  Zinc finger CCHC-type and RNA-binding motif-containing protein 1 (35-43)
aagguggucaaggugaccaucaugaag

SEQ ID NO: 50483 - RNA, 27 nt, Artificial Sequence
  Liprin-beta-1 (756-764)
aagguggucagcgugcugcaccaccuc

SEQ ID NO: 50484 - RNA, 27 nt, Artificial Sequence
  Pre-mRNA-splicing factor SPF27 (136-144)
aagguguacaacgagaaccugguccac

SEQ ID NO: 50485 - RNA, 27 nt, Artificial Sequence
  Extended synaptotagmin-2 (225-233)
aagguguacaccgagaacgucgacaag

SEQ ID NO: 50486 - RNA, 27 nt, Artificial Sequence
  DNA helicase MCM8 (563-571)
aaguacaucggcuacgcccgccaguac

SEQ ID NO: 50487 - RNA, 27 nt, Artificial Sequence
  Ubiquitin-associated protein 2-like (970-978)
aaguaccccccgcccuacaagcacuuc

SEQ ID NO: 50488 - RNA, 27 nt, Artificial Sequence
  Fc receptor-like protein 3 (587-595)
cuggccgccgcggccgcccuccugcac

SEQ ID NO: 50489 - RNA, 30 nt, Artificial Sequence
  Nucleosome assembly protein 1-like 1 (320-329)
cuggccgccgacuucgagaucggccacuuc

SEQ ID NO: 50490 - RNA, 27 nt, Artificial Sequence
  Lanosterol 14-alpha demethylase (46-54)
cuggccgccggccaccucgugcagcug

SEQ ID NO: 50491 - RNA, 24 nt, Artificial Sequence
  KIAA1751 protein (14-21)
cuggccgacgcccuccugcuggag

SEQ ID NO: 50492 - RNA, 27 nt, Artificial Sequence
  Tripartite motif-containing protein 35 (187-195)
cuggccgacgagaagaugaagcagcuc

SEQ ID NO: 50493 - RNA, 27 nt, Artificial Sequence
  Rho GTPase-activating protein 11B (163-171)
cuggccgaccacaccgugcacguccuc

SEQ ID NO: 50494 - RNA, 30 nt, Artificial Sequence
  Annexin A1 (198-207)
cuggccgacagcgacgcccgcgcgcucuac

SEQ ID NO: 50495 - RNA, 33 nt, Artificial Sequence
  Macrophage migration inhibitory factor (82-92)
cuggccgagcgccuccggaucagccccgaccgc

SEQ ID NO: 50496 - RNA, 27 nt, Artificial Sequence
  MICOS complex subunit MIC10 (43-51)
cuggccuucggcagcgggaugggccuc

SEQ ID NO: 50497 - RNA, 27 nt, Artificial Sequence
  Dedicator of cytokinesis protein 11 (1003-1011)
cuggccaucaucccccacgugaccauc

SEQ ID NO: 50498 - RNA, 33 nt, Artificial Sequence
  Thioredoxin domain-containing protein 15 (243-253)
cuggcccucgacgccagccagcacuccagccug

SEQ ID NO: 50499 - RNA, 27 nt, Artificial Sequence
  Ribosomal protein S6 kinase alpha-2 (72-80)
cuggcccucgaccaccugcacagccug

SEQ ID NO: 50500 - RNA, 27 nt, Artificial Sequence
  Breast cancer type 2 susceptibility protein (901-909)
cuggcccucggcaacaccaaggagcug

SEQ ID NO: 50501 - RNA, 27 nt, Artificial Sequence
  Dual specificity protein phosphatase 3 (113-121)
cuggcccagaagaacggccgcgugcuc

SEQ ID NO: 50502 - RNA, 27 nt, Artificial Sequence
  Transmembrane protein 8A (26-34)
cuggcccgccccccgcccgccagcgcg

SEQ ID NO: 50503 - RNA, 36 nt, Artificial Sequence
  Serine protease 56 (350-361)
cuggccugggaccccccgcaggagcuccaggccgac

SEQ ID NO: 50504 - RNA, 30 nt, Artificial Sequence
  Vacuolar protein sorting-associated protein 13B (3150-3159)
cuggacgccagccuccugcagaagcagauc

SEQ ID NO: 50505 - RNA, 39 nt, Artificial Sequence
  Zinc finger protein castor homolog 1 (1616-1628)
cuggacggcagccucucccugggggccgagcccggcagc

SEQ ID NO: 50506 - RNA, 27 nt, Artificial Sequence
  Connector enhancer of kinase suppressor of ras 3 (161-169)
cuggaccucaccaccacggugcagaag

SEQ ID NO: 50507 - RNA, 30 nt, Artificial Sequence
  Coiled-coil domain-containing protein 66 (308-317)
cuggaccagagccgcgagaccgugcuccug

SEQ ID NO: 50508 - RNA, 33 nt, Artificial Sequence
  Protein S100-A9 (66-76)
cuggacaccaacgccgacaagcagcucagcuuc

SEQ ID NO: 50509 - RNA, 27 nt, Artificial Sequence
  Uveal autoantigen with coiled-coil domains and ankyrin repeats (769-777)
cuggacgugacccagaaguacaccgag

SEQ ID NO: 50510 - RNA, 27 nt, Artificial Sequence
  Actin-binding LIM protein 1 (304-312)
cuggacuacaaggaccucgccgccauc

SEQ ID NO: 50511 - RNA, 30 nt, Artificial Sequence
  Uncharacterized protein (163-172)
cuggaggaguacaacaagauccuccuggac

SEQ ID NO: 50512 - RNA, 30 nt, Artificial Sequence
  Tyrosinase (279-288)
cuggaggaguacaacagccaccagucccuc

SEQ ID NO: 50513 - RNA, 30 nt, Artificial Sequence
  Vimentin (404-413)
cuggagggcgaggagagccgcaucucccuc

SEQ ID NO: 50514 - RNA, 51 nt, Artificial Sequence
  Keratin, type I cytoskeletal 10 (257-273)
cuggagggcgaggggagcuccggcgggggcgggcgcggcggcgggagcuuc

SEQ ID NO: 50515 - RNA, 30 nt, Artificial Sequence
  Eukaryotic translation initiation factor 3 subunit M (232-241)
cuggagggcgagcucauccacgaccugcug

SEQ ID NO: 50516 - RNA, 27 nt, Artificial Sequence
  Nestin (589-597)
cuggagaaggagaacaaggagcuccug

SEQ ID NO: 50517 - RNA, 33 nt, Artificial Sequence
  Protein FAM167B (131-141)
cuggagcucgagcccggcgccgggcuggcccug

SEQ ID NO: 50518 - RNA, 27 nt, Artificial Sequence
  Nestin (560-568)
cuggagaaccagagccacgagacccuc

SEQ ID NO: 50519 - RNA, 30 nt, Artificial Sequence
  Alpha-actinin-4 (707-716)
cuggagcagcagcaccagcucauccaggag

SEQ ID NO: 50520 - RNA, 33 nt, Artificial Sequence
  Ribosomal protein S6 kinase delta-1 (1025-1035)
cuggagcgccucggcgccgggguggccggcguc

SEQ ID NO: 50521 - RNA, 27 nt, Artificial Sequence
  Coiled-coil domain-containing protein 77 (409-417)
cuggagcgccggcgcauccucgaggug

SEQ ID NO: 50522 - RNA, 27 nt, Artificial Sequence
  Hydrocephalus-inducing protein homolog (151-159)
cuguucgaccacgugaccgagcgcgag

SEQ ID NO: 50523 - RNA, 21 nt, Artificial Sequence
  Nucleoredoxin (9-15)
cugggcgagaagcucgugacc

SEQ ID NO: 50524 - RNA, 39 nt, Artificial Sequence
  Protein S100-A9 (26-38)
cugggccaccccgacacccucaaccagggggaguucaag

SEQ ID NO: 50525 - RNA, 27 nt, Artificial Sequence
  Serine beta-lactamase-like protein LACTB, mitochondrial (52-60)
cugggcgugaagcucgccgggggccug

SEQ ID NO: 50526 - RNA, 33 nt, Artificial Sequence
  Galectin-1 (43-53)
cugcacuucaacccccgcuucaacgcccacggc

SEQ ID NO: 50527 - RNA, 30 nt, Artificial Sequence
  Translocon-associated protein subunit gamma (176-185)
cugaucgcccuccugagcaccggcuccaag

SEQ ID NO: 50528 - RNA, 30 nt, Artificial Sequence
  Alpha-actinin-4 (718-727)
cugaucuucgacaacaagcacaccaacuac

SEQ ID NO: 50529 - RNA, 30 nt, Artificial Sequence
  Solute carrier family 40 member 1 (135-144)
cugaucaucaccaucgccaacaucgccaac

SEQ ID NO: 50530 - RNA, 33 nt, Artificial Sequence
  Prohibitin (163-173)
cugauccucgacgacgugagccugacccaccug

SEQ ID NO: 50531 - RNA, 30 nt, Artificial Sequence
  Lysosomal-associated transmembrane protein 4B (214-223)
cugaucuaccccaacagcauccaggaguac

SEQ ID NO: 50532 - RNA, 27 nt, Artificial Sequence
  Desmoplakin (486-494)
cugaaggagcaggccaucaagaucacc

SEQ ID NO: 50533 - RNA, 27 nt, Artificial Sequence
  Histone deacetylase complex subunit SAP30L (60-68)
cugaagcucgacaucgacaagagccug

SEQ ID NO: 50534 - RNA, 30 nt, Artificial Sequence
  Lipoxygenase homology domain-containing protein 1 (933-942)
cugaagagcuccaagaccaacagcgacaag

SEQ ID NO: 50535 - RNA, 27 nt, Artificial Sequence
  Alpha-1-antichymotrypsin (12-20)
cugcucgccgccggcuucugccccgcg

SEQ ID NO: 50536 - RNA, 33 nt, Artificial Sequence
  Granulocyte-macrophage colony-stimulating factor receptor subunit alpha (9-19)
cugcucugcgagcugccccacccggccuuccug

SEQ ID NO: 50537 - RNA, 27 nt, Artificial Sequence
  Probable serine carboxypeptidase CPVL (258-266)
cugcucgacgagaagcagaagaaguac

SEQ ID NO: 50538 - RNA, 27 nt, Artificial Sequence
  Teashirt homolog 3 (435-443)
cugcucgacgagaaggugcagagcguc

SEQ ID NO: 50539 - RNA, 27 nt, Artificial Sequence
  Alpha-aminoadipic semialdehyde synthase, mitochondrial (668-676)
cugcucgacggcaagguggucaacgug

SEQ ID NO: 50540 - RNA, 27 nt, Artificial Sequence
  Catenin delta-1 (315-323)
cugcucgaccaccccaagaaggaggug

SEQ ID NO: 50541 - RNA, 27 nt, Artificial Sequence
  Interleukin-13 receptor subunit alpha-2 (164-172)
cugcucgacaccaacuacaaccuguuc

SEQ ID NO: 50542 - RNA, 30 nt, Artificial Sequence
  Interleukin-13 receptor subunit alpha-2 (164-173)
cugcucgacaccaacuacaaccuguucuac

SEQ ID NO: 50543 - RNA, 30 nt, Artificial Sequence
  RAD50-interacting protein 1 (435-444)
cugcucuucgagcgcgagcugcacagcgug

SEQ ID NO: 50544 - RNA, 39 nt, Artificial Sequence
  Sorting nexin-21 (131-143)
cugcucuucgaggugaccagcgccaacgucgugaaggac

SEQ ID NO: 50545 - RNA, 27 nt, Artificial Sequence
  Complement decay-accelerating factor (14-22)
cugcucggcgagcugccccgccugcuc

SEQ ID NO: 50546 - RNA, 27 nt, Artificial Sequence
  Torsin-1A-interacting protein 2, isoform IFRG15 (90-98)
cugcucggccccccgcuggugcgcaag

SEQ ID NO: 50547 - RNA, 33 nt, Artificial Sequence
  Collagen alpha-1(IV) chain (17-27)
cugcuccacgaggagcacagccgcgccgccgcg

SEQ ID NO: 50548 - RNA, 27 nt, Artificial Sequence
  Pescadillo homolog (73-81)
cugcuccacgagcccaucgugaacaag

SEQ ID NO: 50549 - RNA, 24 nt, Artificial Sequence
  DST protein (851-858)
cugcucaaggacaagcuggacgag

SEQ ID NO: 50550 - RNA, 27 nt, Artificial Sequence
  Inverted formin-2 (76-84)
cugcuccuggaggcccuggcccgccuc

SEQ ID NO: 50551 - RNA, 33 nt, Artificial Sequence
  Metastasis suppressor protein 1 (174-184)
cugcuccuggaggagaccgagaagcaggccgug

SEQ ID NO: 50552 - RNA, 33 nt, Artificial Sequence
  Signal transducer and activator of transcription 6 (550-560)
cugcuccugaacgagcccgacggcaccuuccug

SEQ ID NO: 50553 - RNA, 27 nt, Artificial Sequence
  Carboxypeptidase N catalytic chain (379-387)
cugcuccugcccggcaucuacaccgug

SEQ ID NO: 50554 - RNA, 27 nt, Artificial Sequence
  KATNB1-like protein 1 (135-143)
cugcuccgcaacauccagauccugaag

SEQ ID NO: 50555 - RNA, 27 nt, Artificial Sequence
  Zinc finger protein ubi-d4 (122-130)
cugcuccgcaccgacccccuggagaag

SEQ ID NO: 50556 - RNA, 33 nt, Artificial Sequence
  Cytoplasmic dynein 1 heavy chain 1 (2160-2170)
cugcucagcgacguguuccccggcguccaguac

SEQ ID NO: 50557 - RNA, 33 nt, Artificial Sequence
  Aspartate beta-hydroxylase domain-containing protein 1 (342-352)
cugcucguggacgacagcuuccugcacaccguc

SEQ ID NO: 50558 - RNA, 33 nt, Artificial Sequence
  Lon protease homolog 2, peroxisomal (173-183)
cugcucgugcgccagaucgagggccugaagcug

SEQ ID NO: 50559 - RNA, 30 nt, Artificial Sequence
  Growth hormone-inducible transmembrane protein (291-300)
cugcucuacgacacccagaaggugaucaag

SEQ ID NO: 50560 - RNA, 27 nt, Artificial Sequence
  Integrin alpha-7 (875-883)
cugcucuaccccaugcagguggagcug

SEQ ID NO: 50561 - RNA, 33 nt, Artificial Sequence
  Protein FAM69B (179-189)
cugauggccgacuucaacaaggacaaccgcgug

SEQ ID NO: 50562 - RNA, 27 nt, Artificial Sequence
  Pre-mRNA-processing factor 6 (250-258)
cugauggacaugcgccucagccaggug

SEQ ID NO: 50563 - RNA, 27 nt, Artificial Sequence
  L-dopachrome tautomerase (194-202)
cugauggagacccaccucagcuccaag

SEQ ID NO: 50564 - RNA, 27 nt, Artificial Sequence
  Hippocampus abundant transcript-like protein 1 (59-67)
cugaugaacggccucauccagggggug

SEQ ID NO: 50565 - RNA, 36 nt, Artificial Sequence
  Vimentin (413-424)
cugccccucccgaacuucagcucccugaaccugcgc

SEQ ID NO: 50566 - RNA, 30 nt, Artificial Sequence
  Vimentin (431-440)
cugccccucguggacacccacagcaagcgc

SEQ ID NO: 50567 - RNA, 27 nt, Artificial Sequence
  Ectonucleotide pyrophosphatase/phosphodiesterase family member 1 (605-613)
cugcccuacggccgcccgcgggugcuc

SEQ ID NO: 50568 - RNA, 30 nt, Artificial Sequence
  Eukaryotic translation initiation factor 5A-1 (102-111)
cugcaggacagcggcgaggugcgcgaggac

SEQ ID NO: 50569 - RNA, 27 nt, Artificial Sequence
  Coiled-coil domain-containing protein 13 (338-346)
cugcagcgcgagcucgaggagcugaag

SEQ ID NO: 50570 - RNA, 27 nt, Artificial Sequence
  Zinc finger protein 703 (534-542)
cugcgcaacccccacacccucggccug

SEQ ID NO: 50571 - RNA, 30 nt, Artificial Sequence
  ATP-binding cassette sub-family A member 13 (39-48)
cugagcgccauccagggcgugacccucgcc

SEQ ID NO: 50572 - RNA, 33 nt, Artificial Sequence
  GPI-anchor transamidase (151-161)
cugagcgacgaccgcuccaacauccucaucuac

SEQ ID NO: 50573 - RNA, 27 nt, Artificial Sequence
  General transcription factor 3C polypeptide 2 (596-604)
cugagcgacggcucccucaagcuguac

SEQ ID NO: 50574 - RNA, 27 nt, Artificial Sequence
  Myotubularin-related protein 5 (501-509)
cugagcgaccccuucuaccgcacccuc

SEQ ID NO: 50575 - RNA, 27 nt, Artificial Sequence
  Low affinity immunoglobulin gamma Fc region receptor II-b (113-121)
cugagcgaccccgugcaccucaccguc

SEQ ID NO: 50576 - RNA, 27 nt, Artificial Sequence
  Tyrosine-protein kinase JAK1 (30-38)
cugagcgaccgcgagccccuccggcug

SEQ ID NO: 50577 - RNA, 27 nt, Artificial Sequence
  Exportin-5 (689-697)
cugagcgacguggacgccuucaucgcc

SEQ ID NO: 50578 - RNA, 33 nt, Artificial Sequence
  DNA polymerase zeta catalytic subunit (2423-2433)
cugagcgacugguucgacaacaagaccgaccuc

SEQ ID NO: 50579 - RNA, 27 nt, Artificial Sequence
  Little elongation complex subunit 1 (1975-1983)
cugagcgagcucaagauccagaagauc

SEQ ID NO: 50580 - RNA, 33 nt, Artificial Sequence
  Cell surfaceoprotein MUC18 (332-342)
cugagcgagccccaggagcuccuggugaacuac

SEQ ID NO: 50581 - RNA, 27 nt, Artificial Sequence
  Putative stereocilin-like protein (36-44)
cugagcuuccucaagucccugcugagc

SEQ ID NO: 50582 - RNA, 27 nt, Artificial Sequence
  Melanocyte protein PMEL (177-185)
cugagcaucggcaccgggcgcgccaug

SEQ ID NO: 50583 - RNA, 27 nt, Artificial Sequence
  Cytoplasmic dynein 1 heavy chain 1 (746-754)
cugagcaaggaggugcgcaaccucaag

SEQ ID NO: 50584 - RNA, 27 nt, Artificial Sequence
  Exophilin-5 (986-994)
cugagcaagaccgaguccaucagcgug

SEQ ID NO: 50585 - RNA, 30 nt, Artificial Sequence
  EF-hand calcium-binding domain-containing protein 6 (344-353)
cugagccuccccacccaggagcugcgcccg

SEQ ID NO: 50586 - RNA, 27 nt, Artificial Sequence
  Methylcrotonoyl-CoA carboxylase subunit alpha, mitochondrial (108-116)
cugagcauggagaagaucauccaggug

SEQ ID NO: 50587 - RNA, 33 nt, Artificial Sequence
  Zinc finger and BTB domain-containing protein 34 (63-73)
cugagcaccauguccggccucagcaucuccgug

SEQ ID NO: 50588 - RNA, 27 nt, Artificial Sequence
  Vacuolar protein sorting-associated protein 13B (1713-1721)
cugagcguggcccagguccagcuccug

SEQ ID NO: 50589 - RNA, 27 nt, Artificial Sequence
  PERQ amino acid-rich with GYF domain-containing protein 1 (92-100)
cugagcgugaacuccgucgccgugcuc

SEQ ID NO: 50590 - RNA, 33 nt, Artificial Sequence
  Mitogen-activated protein kinase 14 (122-132)
cugaccgacgaccacgugcaguuccucaucuac

SEQ ID NO: 50591 - RNA, 33 nt, Artificial Sequence
  FAST kinase domain-containing protein 5 (625-635)
cugaccgacgaccucaugaacaagcugcugaag

SEQ ID NO: 50592 - RNA, 33 nt, Artificial Sequence
  Vacuolar protein sorting-associated protein VTA1 homolog (134-144)
cugaccgacgagaacgugaagcaccgcaaguac

SEQ ID NO: 50593 - RNA, 30 nt, Artificial Sequence
  Ectonucleoside triphosphate diphosphohydrolase 4 (199-208)
cugaccgacauccccgugcacuucgacuuc

SEQ ID NO: 50594 - RNA, 21 nt, Artificial Sequence
  39S ribosomal protein L52, mitochondrial (43-49)
cugaccgagcuccccgacugg

SEQ ID NO: 50595 - RNA, 30 nt, Artificial Sequence
  Glutathione S-transferase theta-1 (64-73)
cugaccgagagcguggccauccuccuguac

SEQ ID NO: 50596 - RNA, 27 nt, Artificial Sequence
  AFG3-like protein 2 (346-354)
cugaccggccccccggggaccggcaag

SEQ ID NO: 50597 - RNA, 21 nt, Artificial Sequence
  Keratin, type I cytoskeletal 9 (86-92)
cugaccaagacccucaacgac

SEQ ID NO: 50598 - RNA, 33 nt, Artificial Sequence
  Amphoterin-induced protein 1 (187-197)
cugacccuccuggaccugagcuccaacaagcuc

SEQ ID NO: 50599 - RNA, 27 nt, Artificial Sequence
  Delta and Notch-like epidermal growth factor-related receptor (632-640)
cugaccaacaugccccgccacagccuc

SEQ ID NO: 50600 - RNA, 36 nt, Artificial Sequence
  Synaptosomal-associated protein 23 (156-167)
cugacccaggugggcagcauccucgggaaccugaag

SEQ ID NO: 50601 - RNA, 33 nt, Artificial Sequence
  Inactive rhomboid protein 2 (165-175)
cugaccagcuucaccuccgugcgcagcggcuac

SEQ ID NO: 50602 - RNA, 27 nt, Artificial Sequence
  Tubulin beta-4B chain (273-281)
cugaccagccgcggcucccagcaguac

SEQ ID NO: 50603 - RNA, 27 nt, Artificial Sequence
  Tectonic-3 (319-327)
cugaccguggagcccggcgccagccuc

SEQ ID NO: 50604 - RNA, 30 nt, Artificial Sequence
  LON peptidase N-terminal domain and RING finger protein 1 (764-773)
cugaccuacuucagccgcgaccaguccaag

SEQ ID NO: 50605 - RNA, 45 nt, Artificial Sequence
  60S ribosomal protein L34 (5-19)
cugaccuaccgccggcgccucagcuacaacaccgccuccaacaag

SEQ ID NO: 50606 - RNA, 30 nt, Artificial Sequence
  Aspartate beta-hydroxylase domain-containing protein 1 (343-352)
cugguggacgacagcuuccuccacaccguc

SEQ ID NO: 50607 - RNA, 24 nt, Artificial Sequence
  Cytosolic non-specific dipeptidase (250-257)
cugguggacaagcgcggcaacauc

SEQ ID NO: 50608 - RNA, 30 nt, Artificial Sequence
  Thymidine phosphorylase (223-232)
cugguggagggccucagcgcccuggucgug

SEQ ID NO: 50609 - RNA, 27 nt, Artificial Sequence
  Matrin-3 (461-469)
cugguguucggcaagcccguccgcgug

SEQ ID NO: 50610 - RNA, 33 nt, Artificial Sequence
  POTE ankyrin domain family member F (708-718)
cuggugaucgacaacggcagcgggaugugcaag

SEQ ID NO: 50611 - RNA, 33 nt, Artificial Sequence
  Phospholipid hydroperoxide glutathione peroxidase, mitochondrial (187-197)
cuggugaucgagaaggaccucccccacuacuuc

SEQ ID NO: 50612 - RNA, 33 nt, Artificial Sequence
  Roquin-2 (100-110)
cuggugaucgagagcauccccguccucggcacc

SEQ ID NO: 50613 - RNA, 27 nt, Artificial Sequence
  Probable ATP-dependent RNA helicase DDX17 (248-256)
cuggugcucgcccccacccgcgagcug

SEQ ID NO: 50614 - RNA, 27 nt, Artificial Sequence
  Melanocyte protein PMEL (10-18)
cuggugcucaagcgcugccugcugcac

SEQ ID NO: 50615 - RNA, 39 nt, Artificial Sequence
  Beta-actin-like protein 2 (9-21)
cugguggucgacaacggcagcgggaugugcaaggccggc

SEQ ID NO: 50616 - RNA, 27 nt, Artificial Sequence
  DNA mismatch repair protein Msh6 (111-119)
cuguacagccaggccggccuccuggcc

SEQ ID NO: 50617 - RNA, 33 nt, Artificial Sequence
  Olfactory receptor 4M2 (122-132)
cuguacaccgccaucugccgcccccuccacuac

SEQ ID NO: 50618 - RNA, 39 nt, Artificial Sequence
  Heterogeneous nuclear ribonucleoprotein L (35-47)
auggccgccgcgggcgggggcgggggcgggggccgcuac

SEQ ID NO: 50619 - RNA, 30 nt, Artificial Sequence
  Exocyst complex component 4 (1-10)
auggccgccgaggcggccggcgggaaguac

SEQ ID NO: 50620 - RNA, 27 nt, Artificial Sequence
  Liprin-alpha-1 (538-546)
auggccgacggccacaccgacagcuac

SEQ ID NO: 50621 - RNA, 27 nt, Artificial Sequence
  Cystatin-C (1-9)
auggccggcccccugcgcgccccgcuc

SEQ ID NO: 50622 - RNA, 30 nt, Artificial Sequence
  WD repeat-containing protein 7 (1479-1488)
auggcccacgacggcaaggagcaccgcuuc

SEQ ID NO: 50623 - RNA, 33 nt, Artificial Sequence
  WD repeat-containing protein 7 (1479-1489)
auggcccacgacggcaaggagcaccgcuucaug

SEQ ID NO: 50624 - RNA, 27 nt, Artificial Sequence
  Tubulin polyglutamylase complex subunit 2 (33-41)
auggccaucaacagcaucuccaagcug

SEQ ID NO: 50625 - RNA, 33 nt, Artificial Sequence
  Intron-binding protein aquarius (867-877)
auggcccuggacaucgacgagcgccaccuccug

SEQ ID NO: 50626 - RNA, 33 nt, Artificial Sequence
  Ribonuclease pancreatic (1-11)
auggcccuggagaagagccucgugcgccugcug

SEQ ID NO: 50627 - RNA, 36 nt, Artificial Sequence
  Actin, cytoplasmic 2 (18-29)
auggccaccgccgcgagcuccagcucccuggagaag

SEQ ID NO: 50628 - RNA, 27 nt, Artificial Sequence
  STE20-related kinase adapter protein alpha (113-121)
auggccuacggcagcgccaaggaccug

SEQ ID NO: 50629 - RNA, 30 nt, Artificial Sequence
  High mobility group protein 20A (131-140)
auggaguucgaggagcgcaacgccgcccug

SEQ ID NO: 50630 - RNA, 33 nt, Artificial Sequence
  Squalene synthase (112-122)
auggagagcaaggagaaggaccgccaggugcug

SEQ ID NO: 50631 - RNA, 27 nt, Artificial Sequence
  A-kinase anchor protein 11 (545-553)
augaucaaggacagcauccagaaguuc

SEQ ID NO: 50632 - RNA, 27 nt, Artificial Sequence
  Protein mago nashi homolog (45-53)
augauccgcaaggaggagcuggagauc

SEQ ID NO: 50633 - RNA, 30 nt, Artificial Sequence
  Hypoxia-inducible factor 1-alpha (109-118)
augaucuacaucagcgacaacgugaacaag

SEQ ID NO: 50634 - RNA, 33 nt, Artificial Sequence
  Nidogen-1 (1-11)
augcuggccagcuccagccgcauccgggccgcg

SEQ ID NO: 50635 - RNA, 33 nt, Artificial Sequence
  Spectrin beta chain, non-erythrocytic 1 (1424-1434)
augcuggagaaccagauggaggugcgcaagaag

SEQ ID NO: 50636 - RNA, 33 nt, Artificial Sequence
  Prostate tumor-overexpressed gene 1 protein (184-194)
augcuguucccccacaucagcccgugcgaggug

SEQ ID NO: 50637 - RNA, 27 nt, Artificial Sequence
  Melanoma-associated antigen D2 (305-313)
augcugaaggacaucaucaaggaguac

SEQ ID NO: 50638 - RNA, 33 nt, Artificial Sequence
  DNA-directed RNA polymerases I, II, and III subunit RPABC5 (48-58)
augcugcucgcccacguggaccugaucgagaag

SEQ ID NO: 50639 - RNA, 30 nt, Artificial Sequence
  Coatomer subunit gamma-1 (404-413)
augcugcgcgaggagggcggguucgaguac

SEQ ID NO: 50640 - RNA, 27 nt, Artificial Sequence
  G-protein coupled receptor 143 (175-183)
augcuguacuaccccagcgugucccgc

SEQ ID NO: 50641 - RNA, 54 nt, Artificial Sequence
  G-protein coupled receptor 143 (175-192)
augcuguacuaccccagcgugucccgcaagcuccuggaguacaucgaggagauc

SEQ ID NO: 50642 - RNA, 36 nt, Artificial Sequence
  LIM domain and actin-binding protein 1 (101-112)
augauguucgagaagggcgagcccacccagaccaag

SEQ ID NO: 50643 - RNA, 24 nt, Artificial Sequence
  T-complex protein 1 subunit eta (172-179)
augaugcuggacgaccuccugcag

SEQ ID NO: 50644 - RNA, 27 nt, Artificial Sequence
  Neuroblast differentiation-associated protein AHNAK (2771-2779)
augcccaagaucagcaugccgggcuuc

SEQ ID NO: 50645 - RNA, 27 nt, Artificial Sequence
  Neuroblast differentiation-associated protein AHNAK (749-757)
augcccaagaugaagaugccgaaguuc

SEQ ID NO: 50646 - RNA, 27 nt, Artificial Sequence
  Neuroblast differentiation-associated protein AHNAK (1382-1390)
augcccaaggugaagaugccgaaguuc

SEQ ID NO: 50647 - RNA, 24 nt, Artificial Sequence
  ATP-dependent RNA helicase DDX24 (584-591)
augcaguaccccggccgcagccug

SEQ ID NO: 50648 - RNA, 39 nt, Artificial Sequence
  Leucine zipper putative tumor suppressor 1 (179-191)
augagcucccugcccacccacagcaccuccagcuccuac

SEQ ID NO: 50649 - RNA, 27 nt, Artificial Sequence
  Liprin-alpha-1 (1170-1178)
augagcucccccagcaugcagccgaag

SEQ ID NO: 50650 - RNA, 33 nt, Artificial Sequence
  Vimentin (1-11)
augagcacccgcuccgugagcuccagcuccuac

SEQ ID NO: 50651 - RNA, 27 nt, Artificial Sequence
  ADP-ribosylation factor-like protein 5B (133-141)
augaccgccgccgagaucagcaaguac

SEQ ID NO: 50652 - RNA, 39 nt, Artificial Sequence
  CD44 antigen (412-424)
augaccgccgacgagacccgcaaccugcagaacguggac

SEQ ID NO: 50653 - RNA, 27 nt, Artificial Sequence
  RNA-binding protein 14 (266-274)
augaccgcccaggccgcgagcuaccgc

SEQ ID NO: 50654 - RNA, 42 nt, Artificial Sequence
  TBC1 domain family member 7 (1-14)
augaccgaggacagccagcgcaacuuccgguccguguacuac

SEQ ID NO: 50655 - RNA, 21 nt, Artificial Sequence
  E3 ubiquitin-protein ligase UBR5 (2723-2729)
augaccgagcgccaggaccug

SEQ ID NO: 50656 - RNA, 30 nt, Artificial Sequence
  SEC14-like protein 2 (333-342)
augaccgaggugcugcccaaccagcgcuac

SEQ ID NO: 50657 - RNA, 27 nt, Artificial Sequence
  Cleavage and polyadenylation specificity factor subunit 3 (99-107)
augacccacgccaccaaggccaucuac

SEQ ID NO: 50658 - RNA, 30 nt, Artificial Sequence
  Protein phosphatase 1G (151-160)
augaccaucgaggagcugcucacccgcuac

SEQ ID NO: 50659 - RNA, 39 nt, Artificial Sequence
  E3 ubiquitin-protein ligase RNF13 (5-17)
augaccagccuggccugggaccccaccacgcuccgcuac

SEQ ID NO: 50660 - RNA, 27 nt, Artificial Sequence
  L-dopachrome tautomerase (30-38)
augaccguggacagccuggucaacaag

SEQ ID NO: 50661 - RNA, 51 nt, Artificial Sequence
  2-oxoisovalerate dehydrogenase subunit alpha, mitochondrial (262-278)
augaccuaccgcaucggccaccacagcaccuccgacgacagcuccgccuac

SEQ ID NO: 50662 - RNA, 30 nt, Artificial Sequence
  Ubiquitin carboxyl-terminal hydrolase 11 (498-507)
augguggccgacgucuucagccaccgcuuc

SEQ ID NO: 50663 - RNA, 30 nt, Artificial Sequence
  DnaJ homolog subfamily C member 3 (1-10)
augguggcccccggcagcgucaccucccgc

SEQ ID NO: 50664 - RNA, 42 nt, Artificial Sequence
  Proteasome subunit beta type-4 (84-97)
auggugaucgacgaggagcugcucggcgacgggcacagcuac

SEQ ID NO: 50665 - RNA, 24 nt, Artificial Sequence
  Adenylate kinase 9 (1518-1525)
auggugaucuucgagcugagcguc

SEQ ID NO: 50666 - RNA, 33 nt, Artificial Sequence
  Zinc transporter ZIP6 (217-227)
auggugaucaugggcgacgggcugcacaacuuc

SEQ ID NO: 50667 - RNA, 27 nt, Artificial Sequence
  Vigilin (427-435)
auggugaaggaccugaucaaccgcaug

SEQ ID NO: 50668 - RNA, 27 nt, Artificial Sequence
  Helicase with zinc finger domain 2 (1524-1532)
auggugaaggaguacaugauccaguuc

SEQ ID NO: 50669 - RNA, 27 nt, Artificial Sequence
  Major centromere autoantigen B (13-21)
auggugaagcgcuaccugaccagcuuc

SEQ ID NO: 50670 - RNA, 51 nt, Artificial Sequence
  ATP synthase subunit e, mitochondrial (1-17)
auggugcccccgguccaggugagcccccugaucaagcucggccgcuacucc

SEQ ID NO: 50671 - RNA, 30 nt, Artificial Sequence
  UV excision repair protein RAD23 homolog B (172-181)
auggugaccgagaucaugagcaugggcuac

SEQ ID NO: 50672 - RNA, 30 nt, Artificial Sequence
  NGFI-A-binding protein 2 (244-253)
augguggucgagagcguggagcgcaucuuc

SEQ ID NO: 50673 - RNA, 39 nt, Artificial Sequence
  Peptidase inhibitor 15 (91-103)
auggugugggacgagaaccuggccaagagcgccgaggcg

SEQ ID NO: 50674 - RNA, 27 nt, Artificial Sequence
  AT-rich interactive domain-containing protein 2 (84-92)
aacgccgccuucgcgcugaagcaguac

SEQ ID NO: 50675 - RNA, 27 nt, Artificial Sequence
  Sphingomyelin phosphodiesterase 4 (248-256)
aacgccgaccccgccagccacgagauc

SEQ ID NO: 50676 - RNA, 24 nt, Artificial Sequence
  60S ribosomal protein L17 (97-104)
aacgccgagagcaacgccgagcug

SEQ ID NO: 50677 - RNA, 27 nt, Artificial Sequence
  Ethylmalonyl-CoA decarboxylase (70-78)
aacgccuucagcggcgugaugaugcug

SEQ ID NO: 50678 - RNA, 45 nt, Artificial Sequence
  Syndecan-3 (291-305)
aacgccaucgacagcggcuccagcgccgcgcagcugccccagaag

SEQ ID NO: 50679 - RNA, 27 nt, Artificial Sequence
  Importin subunit alpha-5 (231-239)
aacgccgugugggcccugagcaaccuc

SEQ ID NO: 50680 - RNA, 30 nt, Artificial Sequence
  EGF domain-specific O-linked N-acetylglucosamine transferase (20-29)
aacgaggcccccccgaacacccacagcauc

SEQ ID NO: 50681 - RNA, 27 nt, Artificial Sequence
  Coatomer subunit beta (113-121)
aacgaguucauccgcggcagcacccug

SEQ ID NO: 50682 - RNA, 33 nt, Artificial Sequence
  Prefoldin subunit 2 (68-78)
aacgaguuccgcgagaagcacaacauccggcug

SEQ ID NO: 50683 - RNA, 27 nt, Artificial Sequence
  GCN1 general control of amino-acid synthesis 1-like 1 (1511-1519)
aacgaguucgugcgcgacaccgcccug

SEQ ID NO: 50684 - RNA, 30 nt, Artificial Sequence
  Dynamin-like 120 kDa protein, mitochondrial (618-627)
aacgagauccuggacgaggugaucagccuc

SEQ ID NO: 50685 - RNA, 27 nt, Artificial Sequence
  Vimentin (102-110)
aacgagaagguggagcugcaggagcuc

SEQ ID NO: 50686 - RNA, 36 nt, Artificial Sequence
  Keratin, type I cytoskeletal 10 (90-101)
aaccacgaggaggagaugaaggaccugcgcaacgug

SEQ ID NO: 50687 - RNA, 36 nt, Artificial Sequence
  Calponin-3 (250-261)
aacaagguggccagccagaagggcauguccgucuac

SEQ ID NO: 50688 - RNA, 33 nt, Artificial Sequence
  Guanine nucleotide-binding protein-like 3-like protein (343-353)
aaccuggaggagaucagcaacuacuacggcgug

SEQ ID NO: 50689 - RNA, 33 nt, Artificial Sequence
  Peroxisomal acyl-coenzyme A oxidase 1 (631-641)
aaccuguucgagugggccaagaacagcccccuc

SEQ ID NO: 50690 - RNA, 27 nt, Artificial Sequence
  Galectin-1 (33-41)
aaccugggcaaggacagcaacaaccuc

SEQ ID NO: 50691 - RNA, 33 nt, Artificial Sequence
  Glycogenin-2 (64-74)
aaccugaucgacagcgccgacuacauccaccuc

SEQ ID NO: 50692 - RNA, 36 nt, Artificial Sequence
  Putative ATP-dependent RNA helicase DDX11-like protein 8 (397-408)
aaccugaucgacaccaucaccggcaugcacagcgug

SEQ ID NO: 50693 - RNA, 27 nt, Artificial Sequence
  Glutathione S-transferase Mu 2 (180-188)
aaccugaaggacuucaucagccgcuuc

SEQ ID NO: 50694 - RNA, 27 nt, Artificial Sequence
  SAM and SH3 domain-containing protein 1 (646-654)
aaccugaaggagcacaugcccaccuuc

SEQ ID NO: 50695 - RNA, 27 nt, Artificial Sequence
  Abelson tyrosine-protein kinase 2 (353-361)
aaccugcucgacuaccugcgcgagugc

SEQ ID NO: 50696 - RNA, 39 nt, Artificial Sequence
  Multidrug resistance-associated protein 7 (339-351)
aaccugcucggcaccgacagcgagcgccugcugaacuuc

SEQ ID NO: 50697 - RNA, 30 nt, Artificial Sequence
  Catenin alpha-1 (815-824)
aaccugaugaacgccgugguccagaccgug

SEQ ID NO: 50698 - RNA, 33 nt, Artificial Sequence
  Small glutamine-rich tetratricopeptide repeat-containing protein alpha (236-246)
aaccugaugaacaacccccagauccagcagcuc

SEQ ID NO: 50699 - RNA, 24 nt, Artificial Sequence
  Leucine-rich repeat-containing protein 4C (125-132)
aaccugaacacccucgagcuguuc

SEQ ID NO: 50700 - RNA, 27 nt, Artificial Sequence
  N-terminal Xaa-Pro-Lys N-methyltransferase 1 (210-218)
aaccugcccgacgagaucuaccacgug

SEQ ID NO: 50701 - RNA, 30 nt, Artificial Sequence
  N-terminal Xaa-Pro-Lys N-methyltransferase 1 (210-219)
aaccugcccgacgagaucuaccacguguac

SEQ ID NO: 50702 - RNA, 27 nt, Artificial Sequence
  DNA repair protein RAD51 homolog 3 (205-213)
aaccugcgcgaccucgagauccugcug

SEQ ID NO: 50703 - RNA, 27 nt, Artificial Sequence
  MIT domain-containing protein 1 (60-68)
aaccugcgcgagaagaucagcaaguac

SEQ ID NO: 50704 - RNA, 27 nt, Artificial Sequence
  Negative regulator of reactive oxygen species (622-630)
aaccugagcuccaagaucauccgcgug

SEQ ID NO: 50705 - RNA, 33 nt, Artificial Sequence
  Galectin-3-binding protein (51-61)
aaccugugggaccucaccgacgccagcgugguc

SEQ ID NO: 50706 - RNA, 27 nt, Artificial Sequence
  2'-5'-oligoadenylate synthase 3 (990-998)
aacauggccgagggcuuccgcaccgug

SEQ ID NO: 50707 - RNA, 27 nt, Artificial Sequence
  X-ray repair cross-complementing protein 5 (410-418)
aacaugcugaaccccccggccgaggug

SEQ ID NO: 50708 - RNA, 27 nt, Artificial Sequence
  Heterogeneous nuclear ribonucleoprotein H (351-359)
aacaugcagcaccgcuacguggagcug

SEQ ID NO: 50709 - RNA, 27 nt, Artificial Sequence
  Monocarboxylate transporter 7 (86-94)
aaccgcuucggccaccggcuggugguc

SEQ ID NO: 50710 - RNA, 27 nt, Artificial Sequence
  Leucine-rich repeat-containing protein C10orf11 (190-198)
aaccgcuucauccgggacgaccagcug

SEQ ID NO: 50711 - RNA, 24 nt, Artificial Sequence
  Proteasome subunit beta type-4 (230-237)
aaccgcuuccagaucgccaccgug

SEQ ID NO: 50712 - RNA, 27 nt, Artificial Sequence
  Vacuolar protein sorting-associated protein 16 homolog (30-38)
aaccgcggcgacuucuucaugacccug

SEQ ID NO: 50713 - RNA, 27 nt, Artificial Sequence
  Transcription factor MafF (38-46)
aaccgccaccugcggggccucagcgcc

SEQ ID NO: 50714 - RNA, 27 nt, Artificial Sequence
  RNA polymerase-associated protein RTF1 homolog (202-210)
aaccgcaucgagaagcgggaggugcug

SEQ ID NO: 50715 - RNA, 24 nt, Artificial Sequence
  Catenin beta-1 (586-593)
aaccgcaucgugauccggggccug

SEQ ID NO: 50716 - RNA, 27 nt, Artificial Sequence
  Zinc finger and BTB domain-containing protein 38 (384-392)
aaccgccuggaccggcacgagcagauc

SEQ ID NO: 50717 - RNA, 27 nt, Artificial Sequence
  40S ribosomal protein S24 (15-23)
aaccgccugcuccagcggaagcagaug

SEQ ID NO: 50718 - RNA, 24 nt, Artificial Sequence
  Cytoplasmic FMR1-interacting protein 1 (839-846)
aaccgcaugacccacaagcugcuc

SEQ ID NO: 50719 - RNA, 27 nt, Artificial Sequence
  Transcription initiation factor IIA subunit 2 (54-62)
aaccgcgugaacuuccggggcagccug

SEQ ID NO: 50720 - RNA, 27 nt, Artificial Sequence
  Pseudouridine-5'-phosphatase (35-43)
aaccgcuacgacaagaaguacagcugg

SEQ ID NO: 50721 - RNA, 39 nt, Artificial Sequence
  Ribonucleoside-diphosphate reductase large subunit (35-47)
aacagcgccaucaucuacgaccgcgacuucuccuacaac

SEQ ID NO: 50722 - RNA, 27 nt, Artificial Sequence
  Rho-related BTB domain-containing protein 3 (241-249)
aacagcgaccugaacaaccuccuguuc

SEQ ID NO: 50723 - RNA, 36 nt, Artificial Sequence
  SAM and SH3 domain-containing protein 1 (424-435)
aacagcgaccccaugggcaaggagggggacuucgug

SEQ ID NO: 50724 - RNA, 39 nt, Artificial Sequence
  SAM and SH3 domain-containing protein 1 (424-436)
aacagcgaccccaugggcaaggagggggacuucguguac

SEQ ID NO: 50725 - RNA, 30 nt, Artificial Sequence
  Schlafen family member 5 (601-610)
aacagcgaccgcaaggcccaguccguguac

SEQ ID NO: 50726 - RNA, 33 nt, Artificial Sequence
  RELT-like protein 1 (113-123)
aacagcgacaccgugggccagaucguccacuac

SEQ ID NO: 50727 - RNA, 33 nt, Artificial Sequence
  Peptidyl-prolyl cis-trans isomerase FKBP9 (143-153)
aacagcgaggaccaggugcagauccacaccuac

SEQ ID NO: 50728 - RNA, 33 nt, Artificial Sequence
  Zinc finger protein 583 (85-95)
aacagcgaguucuccagcaagcaggagaccuac

SEQ ID NO: 50729 - RNA, 21 nt, Artificial Sequence
  Thymidylate synthase (205-211)
aacagcgagcuguccugccag

SEQ ID NO: 50730 - RNA, 27 nt, Artificial Sequence
  Zinc finger protein 280D (611-619)
aacaccgcccugcgcaaccuccgguac

SEQ ID NO: 50731 - RNA, 27 nt, Artificial Sequence
  DNA-directed RNA polymerase III subunit RPC10 (26-34)
aacaccugccccuacgugcacaacauc

SEQ ID NO: 50732 - RNA, 33 nt, Artificial Sequence
  Heterogeneous nuclear ribonucleoprotein L-like (153-163)
aacaccgacgaccccagcggcgggaacaaggug

SEQ ID NO: 50733 - RNA, 30 nt, Artificial Sequence
  Ubiquitin-like protein 5 (19-28)
aacaccgacgacaccaucggcgaccugaag

SEQ ID NO: 50734 - RNA, 27 nt, Artificial Sequence
  Lysosomal-trafficking regulator (2269-2277)
aacaccgacgacugggagaacuucgcc

SEQ ID NO: 50735 - RNA, 27 nt, Artificial Sequence
  Serine/threonine-protein kinase 4 (95-103)
aacaccgaccuguggaucgugauggag

SEQ ID NO: 50736 - RNA, 54 nt, Artificial Sequence
  Selenoprotein O (185-202)
aacaccgacaacaugagcauccugggccucaccaucgacuacgggcccuucggc

SEQ ID NO: 50737 - RNA, 30 nt, Artificial Sequence
  DNA-binding protein inhibitor ID-4 (141-150)
aacaccgaccccgccggcgccgugaacaag

SEQ ID NO: 50738 - RNA, 30 nt, Artificial Sequence
  ADP-ribosylation factor-binding protein GGA2 (54-63)
aacaccgaccccaacggcccgacccacgcc

SEQ ID NO: 50739 - RNA, 27 nt, Artificial Sequence
  Phenylalanine-tRNA ligase beta subunit (486-494)
aacaccgacgugggcgccaagaacuac

SEQ ID NO: 50740 - RNA, 27 nt, Artificial Sequence
  Fructose-bisphosphate aldolase A (51-59)
aacaccgaggagaaccgccgguucuac

SEQ ID NO: 50741 - RNA, 27 nt, Artificial Sequence
  Fructose-bisphosphate aldolase C (85-93)
aacaccgaggagaaccgccggcuguac

SEQ ID NO: 50742 - RNA, 33 nt, Artificial Sequence
  Dynamin-1 (590-600)
aacaccgagcagcgcaacguguacaaggacuac

SEQ ID NO: 50743 - RNA, 27 nt, Artificial Sequence
  Neuron navigator 2 (838-846)
aacaccgagagcggccgcuacguguac

SEQ ID NO: 50744 - RNA, 27 nt, Artificial Sequence
  WW domain-binding protein 2 (24-32)
aacaccgagagcauccugauguccuac

SEQ ID NO: 50745 - RNA, 33 nt, Artificial Sequence
  Short/branched chain specific acyl-CoA dehydrogenase, mitochondrial (422-432)
aacaccaucgccaagcacaucgacgccgaguac

SEQ ID NO: 50746 - RNA, 36 nt, Artificial Sequence
  Mothers against decapentaplegic homolog 2 (91-102)
aacaccaucgaccagugggacaccacgggccuguac

SEQ ID NO: 50747 - RNA, 36 nt, Artificial Sequence
  CDK5 and ABL1 enzyme substrate 1 (7-18)
aacaccaucgacagcaccuccagcuucucccaguuc

SEQ ID NO: 50748 - RNA, 27 nt, Artificial Sequence
  H(+)/Cl(-) exchange transporter 5 (18-26)
aacaccaucgacugggugcgcgagaag

SEQ ID NO: 50749 - RNA, 27 nt, Artificial Sequence
  Coiled-coil domain-containing protein 93 (523-531)
aacacccuggacgacaagaagguguac

SEQ ID NO: 50750 - RNA, 27 nt, Artificial Sequence
  COP9 signalosome complex subunit 6 (300-308)
aacaccaugaaccaguucgugaacaag

SEQ ID NO: 50751 - RNA, 27 nt, Artificial Sequence
  Protein FAM50A (156-164)
aacaccaugcagcaguuccugcagaag

SEQ ID NO: 50752 - RNA, 27 nt, Artificial Sequence
  26S proteasome non-ATPase regulatory subunit 8 (201-209)
aacacccccaagaagaugaccgacuac

SEQ ID NO: 50753 - RNA, 27 nt, Artificial Sequence
  G-protein coupled receptor 98 (3795-3803)
aacaccaccacgcugcagcuccagauc

SEQ ID NO: 50754 - RNA, 30 nt, Artificial Sequence
  Calsyntenin-1 (464-473)
aacguggaguuccccagcgucacccuguac

SEQ ID NO: 50755 - RNA, 36 nt, Artificial Sequence
  39S ribosomal protein L2, mitochondrial (195-206)
aacguggagagcgagcccggccgcggggcccaguac

SEQ ID NO: 50756 - RNA, 33 nt, Artificial Sequence
  Geranylgeranyl transferase type-2 subunit beta (112-122)
aacgugaucgacgucaacaaggugguggaguac

SEQ ID NO: 50757 - RNA, 33 nt, Artificial Sequence
  Zinc finger protein 638 (207-217)
aacgugaucgacuacggccacgccagcaaguac

SEQ ID NO: 50758 - RNA, 30 nt, Artificial Sequence
  Neuropathy target esterase (1252-1261)
aacgugaucgagaagaugcugaccgaccgc

SEQ ID NO: 50759 - RNA, 30 nt, Artificial Sequence
  Protein MMS22-like (799-808)
aacgugaucgagcaguacaucggccgcuuc

SEQ ID NO: 50760 - RNA, 27 nt, Artificial Sequence
  Syndetin (606-614)
aacgugauccgccuggucggcaaguac

SEQ ID NO: 50761 - RNA, 27 nt, Artificial Sequence
  tRNA (guanine(37)-N1)-methyltransferase (163-171)
aacgugagcccccagaucuccaaguac

SEQ ID NO: 50762 - RNA, 33 nt, Artificial Sequence
  Probable crossover junction endonuclease EME2 (356-366)
cccgaccugagccgccggaucugccucuuccug

SEQ ID NO: 50763 - RNA, 33 nt, Artificial Sequence
  Neuronal acetylcholine receptor subunit alpha-3 (433-443)
cccgagaucaaggaggccauccagagcgugaag

SEQ ID NO: 50764 - RNA, 27 nt, Artificial Sequence
  Ribosomal L1 domain-containing protein 1 (244-252)
cccgagaagugggagagcgugaagcug

SEQ ID NO: 50765 - RNA, 27 nt, Artificial Sequence
  Galectin-3 (191-199)
cccuucgagagcggcaagccguucaag

SEQ ID NO: 50766 - RNA, 33 nt, Artificial Sequence
  40S ribosomal protein S19 (2-12)
cccggcgugaccgucaaggacgugaaccagcag

SEQ ID NO: 50767 - RNA, 24 nt, Artificial Sequence
  Carbohydrate sulfotransferase 5 (259-266)
ccccaccugcgccucauccgggag

SEQ ID NO: 50768 - RNA, 30 nt, Artificial Sequence
  Myosin regulatory light chain 12A (152-161)
cccaucgacaagaagggcaacuucaacuac

SEQ ID NO: 50769 - RNA, 33 nt, Artificial Sequence
  A-kinase anchor protein 11 (107-117)
ccccuggacaucagcuccgacccgcucaaccag

SEQ ID NO: 50770 - RNA, 27 nt, Artificial Sequence
  SYTL2 protein (325-333)
ccccugcgcaugcuccugaucgccaag

SEQ ID NO: 50771 - RNA, 33 nt, Artificial Sequence
  Titin (13404-13414)
cccccgguggaggagcgcgagaucgagaaguac

SEQ ID NO: 50772 - RNA, 27 nt, Artificial Sequence
  Translation initiation factor eIF-2B subunit delta (205-213)
ccccaguacagccgccagaacucccug

SEQ ID NO: 50773 - RNA, 27 nt, Artificial Sequence
  Ubiquitin-associated protein 2-like (957-965)
cccagcggcuacgggucccacggcuac

SEQ ID NO: 50774 - RNA, 36 nt, Artificial Sequence
  Enhancer of filamentation 1 (121-132)
cccaccggccacgggacccaggagcaggagguguac

SEQ ID NO: 50775 - RNA, 36 nt, Artificial Sequence
  Phosphatidylethanolamine-binding protein 1 (2-13)
cccguggaccugagcaagugguccggcccgcucagc

SEQ ID NO: 50776 - RNA, 27 nt, Artificial Sequence
  DNA ligase 3 (547-555)
caggccuuccccggcgggcacagcaug

SEQ ID NO: 50777 - RNA, 27 nt, Artificial Sequence
  E3 ubiquitin-protein ligase BRE1B (135-143)
caggccggccccaucaaccgcgagaug

SEQ ID NO: 50778 - RNA, 27 nt, Artificial Sequence
  Tyrosine-protein phosphatase non-receptor type 20 (25-33)
caggcccugagcccccuccuguccgug

SEQ ID NO: 50779 - RNA, 27 nt, Artificial Sequence
  Importin subunit beta-1 (408-416)
caggccaugcccacccugaucgagcuc

SEQ ID NO: 50780 - RNA, 30 nt, Artificial Sequence
  UBX domain-containing protein 6 (85-94)
caggaggaccccgaggaguucuacgugcug

SEQ ID NO: 50781 - RNA, 24 nt, Artificial Sequence
  Spectrin beta chain, non-erythrocytic 5 (1672-1679)
caggaggagcuggccaucuacugg

SEQ ID NO: 50782 - RNA, 39 nt, Artificial Sequence
  Growth/differentiation factor 15 (4-16)
caggagcugcgcaccgugaacggcagccagaugcuccug

SEQ ID NO: 50783 - RNA, 30 nt, Artificial Sequence
  Ethanolamine kinase 1 (326-335)
caguucaucgacuacgaguacagcggcuac

SEQ ID NO: 50784 - RNA, 30 nt, Artificial Sequence
  Leucine-rich repeat-containing protein 15 (122-131)
cagggccuggacagccucgagucccugcug

SEQ ID NO: 50785 - RNA, 30 nt, Artificial Sequence
  Methyltransferase-like protein 25 (467-476)
cagggccugcccaccgagagccucuucuac

SEQ ID NO: 50786 - RNA, 27 nt, Artificial Sequence
  Nuclear migration protein nudC (20-28)
cagcacgagggcggggugcaggagcug

SEQ ID NO: 50787 - RNA, 27 nt, Artificial Sequence
  Threonine-tRNA ligase, cytoplasmic (535-543)
cagaucaaggacgccaucggccgcuac

SEQ ID NO: 50788 - RNA, 27 nt, Artificial Sequence
  Cytoplasmic dynein 1 heavy chain 1 (2212-2220)
cagaucacccagaucaaccacggccug

SEQ ID NO: 50789 - RNA, 36 nt, Artificial Sequence
  Importin-8 (185-196)
cagaucgugcagcugcuccccgacagcuccuacuac

SEQ ID NO: 50790 - RNA, 30 nt, Artificial Sequence
  Histone-lysine N-methyltransferase SUV39H1 (268-277)
cagaucuacgaccgccagggcgccaccuac

SEQ ID NO: 50791 - RNA, 27 nt, Artificial Sequence
  PH and SEC7 domain-containing protein 3 (214-222)
cagaaggaccugaccgcccuccugacc

SEQ ID NO: 50792 - RNA, 27 nt, Artificial Sequence
  Zinc finger and BTB domain-containing protein 37 (95-103)
cagcuggccgacaucaucagcuaccuc

SEQ ID NO: 50793 - RNA, 27 nt, Artificial Sequence
  Protein FAM98B (139-147)
cagcuggacaagaacagcgagguguac

SEQ ID NO: 50794 - RNA, 30 nt, Artificial Sequence
  Calsyntenin-1 (952-961)
cagcuggagugggacgacagcacccucucc

SEQ ID NO: 50795 - RNA, 27 nt, Artificial Sequence
  Poly (ADP-ribose) polymerase 4 (351-359)
cagcugauccgcgacauggugaacguc

SEQ ID NO: 50796 - RNA, 27 nt, Artificial Sequence
  Rap guanine nucleotide exchange factor 6 (270-278)
cagcugcucgaguucaugcaccagcug

SEQ ID NO: 50797 - RNA, 27 nt, Artificial Sequence
  Probable dimethyladenosine transferase (249-257)
cagcugcucgagaagaacuaccgcauc

SEQ ID NO: 50798 - RNA, 33 nt, Artificial Sequence
  26S proteasome non-ATPase regulatory subunit 6 (306-316)
cagcugcucgagagcuaccgcucccugacccug

SEQ ID NO: 50799 - RNA, 27 nt, Artificial Sequence
  Chromosome-associated kinesin KIF4A (982-990)
cagcugcuccgcgagaacgagaucauc

SEQ ID NO: 50800 - RNA, 33 nt, Artificial Sequence
  Voltage-gated potassium channel subunit beta-2 (329-339)
cagcugauggagaacaucggcgccauccaggug

SEQ ID NO: 50801 - RNA, 27 nt, Artificial Sequence
  Chromatin assembly factor 1 subunit B (113-121)
cagcugaacaaggagaacuggaccgug

SEQ ID NO: 50802 - RNA, 27 nt, Artificial Sequence
  Transcription activator BRG1 (179-187)
cagcugcgcgcccagaucauggccuac

SEQ ID NO: 50803 - RNA, 27 nt, Artificial Sequence
  Nuclear factor erythroid 2-related factor 1 (321-329)
cagcugagcgaggcccagcucucccug

SEQ ID NO: 50804 - RNA, 27 nt, Artificial Sequence
  Protein AHNAK2 (5375-5383)
cagcugugggaggacagcgugcucacc

SEQ ID NO: 50805 - RNA, 27 nt, Artificial Sequence
  Alpha-2-macroglobulin receptor-associated protein (61-69)
cagcugugggagaaggcccagcgccuc

SEQ ID NO: 50806 - RNA, 27 nt, Artificial Sequence
  Lysine-specific histone demethylase 1A (239-247)
cagcuguggcucgacaaccccaagauc

SEQ ID NO: 50807 - RNA, 30 nt, Artificial Sequence
  YrdC domain-containing protein, mitochondrial (184-193)
cagauguucgagggcccccuggcccucacc

SEQ ID NO: 50808 - RNA, 27 nt, Artificial Sequence
  U3 small nucleolar RNA-associated protein 14 homolog A (505-513)
cagaugaucgaccugcagaaccuccug

SEQ ID NO: 50809 - RNA, 27 nt, Artificial Sequence
  Sodium/myo-inositol cotransporter (686-694)
cagaugcuggaggagacccgccaggug

SEQ ID NO: 50810 - RNA, 33 nt, Artificial Sequence
  Neuroblastoma-amplified sequence (2232-2242)
cagaugcugcccgccgagggcgugaaggagcuc

SEQ ID NO: 50811 - RNA, 27 nt, Artificial Sequence
  Vimentin (343-351)
cagaugcgcgagauggaggagaacuuc

SEQ ID NO: 50812 - RNA, 27 nt, Artificial Sequence
  Transmembrane emp24 domain-containing protein 4 (59-67)
cagaugugggacaagcagaaggaggug

SEQ ID NO: 50813 - RNA, 27 nt, Artificial Sequence
  G protein-coupled receptor SNSR1 (285-293)
cagaaccugaagcucgugcugcagaag

SEQ ID NO: 50814 - RNA, 27 nt, Artificial Sequence
  DNA-directed RNA polymerase I subunit RPA2 (30-38)
cagcagaaggccgcccugcaggagcuc

SEQ ID NO: 50815 - RNA, 27 nt, Artificial Sequence
  Histone-lysine N-methyltransferase 2C (1225-1233)
cagcagcagcagcagcagcagcaguuc

SEQ ID NO: 50816 - RNA, 27 nt, Artificial Sequence
  Synaptosomal-associated protein 29 (42-50)
cagcaguaccugcgccaggaggugcuc

SEQ ID NO: 50817 - RNA, 36 nt, Artificial Sequence
  Vimentin (195-206)
cagcgcgaggaggccgagaacacccugcagagcuuc

SEQ ID NO: 50818 - RNA, 27 nt, Artificial Sequence
  Very long-chain specific acyl-CoA dehydrogenase, mitochondrial (600-608)
cagagcgaccccuggcagcaggagcug

SEQ ID NO: 50819 - RNA, 30 nt, Artificial Sequence
  Neuropilin-2 (690-699)
cagagcgacucccagcgcgagggccaguac

SEQ ID NO: 50820 - RNA, 27 nt, Artificial Sequence
  Kelch-like protein 42 (26-34)
cagagcgacuacuuccgcgcccuguac

SEQ ID NO: 50821 - RNA, 33 nt, Artificial Sequence
  HLA class I histocompatibility antigen, B-8 alpha chain (111-121)
cagagcgaggccggcucccacacccugcagagc

SEQ ID NO: 50822 - RNA, 39 nt, Artificial Sequence
  HLA class I histocompatibility antigen, A-66 alpha chain (86-98)
cagagcgaggacggcucccacaccauccagcgcauguac

SEQ ID NO: 50823 - RNA, 42 nt, Artificial Sequence
  Cold-inducible RNA-binding protein (147-160)
cagagcggcggguacuccgaccgcagcuccggcgggagcuac

SEQ ID NO: 50824 - RNA, 39 nt, Artificial Sequence
  Caprin-1 (653-665)
cagagccaguucuccgccccccgcgacuacagcggcuac

SEQ ID NO: 50825 - RNA, 30 nt, Artificial Sequence
  Zinc finger and BTB domain-containing protein 17 (685-694)
cagaccgacgccgacuucuaccagcaguac

SEQ ID NO: 50826 - RNA, 27 nt, Artificial Sequence
  RNA polymerase-associated protein CTR9 homolog (424-432)
cagaccgacauccagggcgcccugagc

SEQ ID NO: 50827 - RNA, 30 nt, Artificial Sequence
  Glia-derived nexin (301-310)
cagaccgaccugaaggagccccucaaggug

SEQ ID NO: 50828 - RNA, 33 nt, Artificial Sequence
  Calreticulin (119-129)
cagaccgacaugcacggcgacagcgaguacaac

SEQ ID NO: 50829 - RNA, 27 nt, Artificial Sequence
  Intraflagellar transport protein 172 homolog (85-93)
cagaccgacaacaucaucuacguguac

SEQ ID NO: 50830 - RNA, 30 nt, Artificial Sequence
  Putative E3 ubiquitin-protein ligase UNKL (18-27)
cagaccgagaagcccacccacuaccgcuac

SEQ ID NO: 50831 - RNA, 30 nt, Artificial Sequence
  Zinc finger protein 217 (667-676)
cagaccgagaccgccgccgacugccgcuac

SEQ ID NO: 50832 - RNA, 27 nt, Artificial Sequence
  Interleukin-13 receptor subunit alpha-1 (268-276)
cagaccgagacccacaacguguucuac

SEQ ID NO: 50833 - RNA, 27 nt, Artificial Sequence
  Centrosomal protein of 295 kDa (745-753)
cagaccgagacccagcagcgcgacuac

SEQ ID NO: 50834 - RNA, 27 nt, Artificial Sequence
  Basic leucine zipper and W2 domain-containing protein 1 (165-173)
cagaccaucggcgcccgcaaggagcug

SEQ ID NO: 50835 - RNA, 27 nt, Artificial Sequence
  Ubiquitin carboxyl-terminal hydrolase 32 (111-119)
cagaccaucaaggagauccacgaguac

SEQ ID NO: 50836 - RNA, 30 nt, Artificial Sequence
  Zinc fingers and homeoboxes protein 3 (607-616)
cagacccccgacuucaccccgacgaaguac

SEQ ID NO: 50837 - RNA, 33 nt, Artificial Sequence
  Glycerol-3-phosphate dehydrogenase 1-like protein (226-236)
cagaccagcgccgagguguaccgcauccugaag

SEQ ID NO: 50838 - RNA, 27 nt, Artificial Sequence
  Probable ATP-dependent RNA helicase DDX47 (228-236)
cagaccguggagaagcugcagcaguac

SEQ ID NO: 50839 - RNA, 30 nt, Artificial Sequence
  WD repeat-containing protein 62 (147-156)
cagguggccgagaugcugggccacaaguac

SEQ ID NO: 50840 - RNA, 30 nt, Artificial Sequence
  Ran GTPase-activating protein 1 (17-26)
cagguggccggcgggcagcugagcuucaag

SEQ ID NO: 50841 - RNA, 27 nt, Artificial Sequence
  Pre-mRNA-processing factor 19 (209-217)
cagguggccagccacgucggccugcac

SEQ ID NO: 50842 - RNA, 33 nt, Artificial Sequence
  Rootletin (1601-1611)
cagguggccacccuggagcgcagccuccaggcc

SEQ ID NO: 50843 - RNA, 36 nt, Artificial Sequence
  Tripartite motif-containing protein 2 (694-705)
cagguguucgacggcagcggguccuuccugagcuac

SEQ ID NO: 50844 - RNA, 30 nt, Artificial Sequence
  Basic leucine zipper and W2 domain-containing protein 2 (113-122)
cagguguucaacaagcugauccgccgguac

SEQ ID NO: 50845 - RNA, 30 nt, Artificial Sequence
  Sec1 family domain-containing protein 2 (210-219)
caggugaucgccgccgaccuggcgaacuac

SEQ ID NO: 50846 - RNA, 33 nt, Artificial Sequence
  Putative Polycomb group protein ASXL1 (36-46)
caggugaucgaggccgagggccugaaggagaug

SEQ ID NO: 50847 - RNA, 33 nt, Artificial Sequence
  SURP and G-patch domain-containing protein 2 (69-79)
caggugaucggccaccgcaagcuggggcacuuc

SEQ ID NO: 50848 - RNA, 27 nt, Artificial Sequence
  Vimentin (453-461)
caggugaucaacgagaccagccagcac

SEQ ID NO: 50849 - RNA, 30 nt, Artificial Sequence
  Vimentin (453-462)
caggugaucaacgagaccagccagcaccac

SEQ ID NO: 50850 - RNA, 36 nt, Artificial Sequence
  Vimentin (453-464)
caggugaucaacgagaccagccagcaccacgacgac

SEQ ID NO: 50851 - RNA, 27 nt, Artificial Sequence
  Splicing factor U2AF 65 kDa subunit (274-282)
caggugaaggagcugcucaccagcuuc

SEQ ID NO: 50852 - RNA, 27 nt, Artificial Sequence
  Glutathione-specific gamma-glutamylcyclotransferase 1 (98-106)
caggugcagggcgagcaggucagcaag

SEQ ID NO: 50853 - RNA, 30 nt, Artificial Sequence
  tRNA-splicing ligase RtcB homolog (232-241)
cagguggucgacgagaucuucaacgaguac

SEQ ID NO: 50854 - RNA, 30 nt, Artificial Sequence
  Xylulose kinase (511-520)
cagguguacgaggcccugcucccccaguac

SEQ ID NO: 50855 - RNA, 30 nt, Artificial Sequence
  2'-5'-oligoadenylate synthase 3 (908-917)
cagguguacgucgaccugauccacagcuac

SEQ ID NO: 50856 - RNA, 27 nt, Artificial Sequence
  FERM domain-containing protein 8 (28-36)
cgcgccgccgacgugcuggucuaccuc

SEQ ID NO: 50857 - RNA, 27 nt, Artificial Sequence
  Non-canonical poly(A) RNA polymerase PAPD7 (152-160)
cgcgccgccgaguucaucaagaacuac

SEQ ID NO: 50858 - RNA, 27 nt, Artificial Sequence
  Nuclear export mediator factor NEMF (136-144)
cgcgccgccgagccccugcucacccug

SEQ ID NO: 50859 - RNA, 39 nt, Artificial Sequence
  Non-POU domain-containing octamer-binding protein (367-379)
cgcgccgcccccggcgcggaguucgccccgaacaagcgg

SEQ ID NO: 50860 - RNA, 33 nt, Artificial Sequence
  Fatty acid synthase (2275-2285)
cgcgccgccccccuggacagcauccacucccuc

SEQ ID NO: 50861 - RNA, 30 nt, Artificial Sequence
  Sodium/potassium-transporting ATPase subunit alpha-3 (42-51)
cgcgccgccgugcccgacgcggucggcaag

SEQ ID NO: 50862 - RNA, 27 nt, Artificial Sequence
  Nuclear pore complex protein Nup205 (413-421)
cgcgccgacgaggacgcccggaugauc

SEQ ID NO: 50863 - RNA, 27 nt, Artificial Sequence
  Uncharacterized protein KIAA0930 (312-320)
cgcgccgacggcaacuuccugcucuac

SEQ ID NO: 50864 - RNA, 27 nt, Artificial Sequence
  Cytochrome b-c1 complex subunit 9 (34-42)
cgcgccuucgaccagggcgccgacgcg

SEQ ID NO: 50865 - RNA, 33 nt, Artificial Sequence
  E3 ubiquitin-protein ligase DTX3L (679-689)
cgcgccuucgaccagaagcugaucuucaccgug

SEQ ID NO: 50866 - RNA, 27 nt, Artificial Sequence
  Protein transport protein Sec16A (1122-1130)
cgcgccuuccccggcccgcuggccaag

SEQ ID NO: 50867 - RNA, 30 nt, Artificial Sequence
  Protein ECT2 (107-116)
cgcgccuucagcuucuccaagacccccaag

SEQ ID NO: 50868 - RNA, 27 nt, Artificial Sequence
  Rho GTPase-activating protein 11B (16-24)
cgcgccuucuacggcaucaaggugaag

SEQ ID NO: 50869 - RNA, 33 nt, Artificial Sequence
  Glutaminyl-peptide cyclotransferase (172-182)
cgcgcccuggacaagaagcuccugagccugaag

SEQ ID NO: 50870 - RNA, 27 nt, Artificial Sequence
  Clathrin heavy chain 1 (625-633)
cgcgcccuggagcacuucaccgaccuc

SEQ ID NO: 50871 - RNA, 27 nt, Artificial Sequence
  Guanine nucleotide exchange factor DBS (926-934)
cgcgcccuggagcagagccagucccuc

SEQ ID NO: 50872 - RNA, 27 nt, Artificial Sequence
  ALX homeobox protein 1 (94-102)
cgcgccauggacaacugcaacagccug

SEQ ID NO: 50873 - RNA, 30 nt, Artificial Sequence
  Inositol hexakisphosphate kinase 2 (6-15)
cgcgccauggacguggagccccgggccaag

SEQ ID NO: 50874 - RNA, 27 nt, Artificial Sequence
  Hsp70-binding protein 1 (283-291)
cgcgccaugcagcagcaggugcagaag

SEQ ID NO: 50875 - RNA, 27 nt, Artificial Sequence
  Ankyrin-2 (388-396)
cgcgccaaccccaacgcccgggcgcug

SEQ ID NO: 50876 - RNA, 39 nt, Artificial Sequence
  N-terminal kinase-like protein (673-685)
cgcgccagccagucccccaccggcgccgcggggaagcug

SEQ ID NO: 50877 - RNA, 27 nt, Artificial Sequence
  Retinoic acid receptor alpha (15-23)
cgcgccaccagcuccacccagagccug

SEQ ID NO: 50878 - RNA, 27 nt, Artificial Sequence
  Coiled-coil domain-containing protein 124 (215-223)
cgcgccgugcccuucaacgccccgaag

SEQ ID NO: 50879 - RNA, 27 nt, Artificial Sequence
  Eukaryotic peptide chain release factor GTP-binding subunit ERF3A (143-151)
cgcgccuacuucgagaccgagaagaag

SEQ ID NO: 50880 - RNA, 30 nt, Artificial Sequence
  CCR4-NOT transcription complex subunit 1 (1694-1703)
cgcgccuacggcagccccuggugcaacaag

SEQ ID NO: 50881 - RNA, 27 nt, Artificial Sequence
  E3 ubiquitin-protein ligase UBR5 (1124-1132)
cgcgccuaccccgccgcgaucaccauc

SEQ ID NO: 50882 - RNA, 30 nt, Artificial Sequence
  SWI/SNF-related matrix-associated actin-dependent regulator of chromatin subfamily E member 1-related (135-144)
cgcgccuaccagcagagcgaggccuacaag

SEQ ID NO: 50883 - RNA, 27 nt, Artificial Sequence
  Hermansky-Pudlak syndrome 3 protein (89-97)
cgcgccuacgugaacuggcggaacaag

SEQ ID NO: 50884 - RNA, 27 nt, Artificial Sequence
  60S ribosomal protein L37 (21-29)
cgcugcggcagcaaggccuaccaccug

SEQ ID NO: 50885 - RNA, 42 nt, Artificial Sequence
  PEST proteolytic signal-containing nuclear protein (112-125)
cgcgacacccccaccagcgccggcccgaacuccuucaacaag

SEQ ID NO: 50886 - RNA, 30 nt, Artificial Sequence
  Nuclear mitotic apparatus protein 1 (76-85)
cgcgaggccgagcagaugggcaacgagcug

SEQ ID NO: 50887 - RNA, 30 nt, Artificial Sequence
  Melanotransferrin (44-53)
cgcgaggccggcauccagcccagccugcuc

SEQ ID NO: 50888 - RNA, 30 nt, Artificial Sequence
  Kinesin-like protein (353-362)
cgcgaggccggcaacaucaaccagagccug

SEQ ID NO: 50889 - RNA, 27 nt, Artificial Sequence
  Vacuolar protein sorting-associated protein 72 homolog (174-182)
cgcgaggccaagaucaccgaggagcug

SEQ ID NO: 50890 - RNA, 27 nt, Artificial Sequence
  Src substrate cortactin (417-425)
cgcgaggccagcucccagcagggccug

SEQ ID NO: 50891 - RNA, 33 nt, Artificial Sequence
  Cullin-4B (258-268)
cgcgaggacagccuggacuccgugcucuuccug

SEQ ID NO: 50892 - RNA, 30 nt, Artificial Sequence
  Beta-citrylglutamate synthase B (18-27)
cgcgaggacuacccccagaaggagauccug

SEQ ID NO: 50893 - RNA, 30 nt, Artificial Sequence
  RE1-silencing transcription factor (872-881)
cgcgaggaggccagcggcgaccagaagcug

SEQ ID NO: 50894 - RNA, 36 nt, Artificial Sequence
  39S ribosomal protein L37, mitochondrial (242-253)
cgcgaggagaucgaggccaccaagaaccacgugcug

SEQ ID NO: 50895 - RNA, 27 nt, Artificial Sequence
  ATP-dependent RNA helicase DHX36 (91-99)
cgcgaggagcagaucgugcagcugcuc

SEQ ID NO: 50896 - RNA, 27 nt, Artificial Sequence
  60S ribosomal protein L3-like (69-77)
cgcgaggagguggaggccgucaccauc

SEQ ID NO: 50897 - RNA, 30 nt, Artificial Sequence
  Colorectal mutant cancer protein (584-593)
cgcgaguucgagguggagaccgagcggcug

SEQ ID NO: 50898 - RNA, 33 nt, Artificial Sequence
  Proteasome subunit alpha type-7 (169-179)
cgcgaguuccuggagaagaacuacaccgacgag

SEQ ID NO: 50899 - RNA, 27 nt, Artificial Sequence
  TBC1 domain family member 16 (242-250)
cgcgaguuccccgaggccgaggcccug

SEQ ID NO: 50900 - RNA, 27 nt, Artificial Sequence
  Leucine-rich repeat and calponin homology domain-containing protein 3 (427-435)
cgcgaguuccagaagaccgaggacaug

SEQ ID NO: 50901 - RNA, 27 nt, Artificial Sequence
  5,6-dihydroxyindole-2-carboxylic acid oxidase (471-479)
cgcgaguucagcgugcccgagaucauc

SEQ ID NO: 50902 - RNA, 27 nt, Artificial Sequence
  Rhophilin-2 (553-561)
cgcgagggcgacuacaucgugagcauc

SEQ ID NO: 50903 - RNA, 33 nt, Artificial Sequence
  Contactin-associated protein-like 3B (224-234)
cgcgagggccagcacgggaaccacaucacccug

SEQ ID NO: 50904 - RNA, 36 nt, Artificial Sequence
  Colorectal mutant cancer protein (255-266)
cgcgagcacgaggacgugcaggagcggaccacccug

SEQ ID NO: 50905 - RNA, 27 nt, Artificial Sequence
  Protein orai-2 (155-163)
cgcgagaucgaggagcugcacaagcuc

SEQ ID NO: 50906 - RNA, 27 nt, Artificial Sequence
  Pyridoxal-dependent decarboxylase domain-containing protein 1 (596-604)
cgcgagaucgaggagaacagccggcug

SEQ ID NO: 50907 - RNA, 27 nt, Artificial Sequence
  Zinc finger FYVE domain-containing protein 16 (199-207)
cgcgagaucggcgggaucaaggagcug

SEQ ID NO: 50908 - RNA, 33 nt, Artificial Sequence
  Cathepsin K (225-235)
cgcgagauccccgagggcaacgagaaggcccug

SEQ ID NO: 50909 - RNA, 27 nt, Artificial Sequence
  Calcineurin-binding protein cabin-1 (253-261)
cgcgagaaggagcccgaccugaagcuc

SEQ ID NO: 50910 - RNA, 27 nt, Artificial Sequence
  B-cell lymphoma 3 protein (77-85)
cgcgagcuggacaucuacaacaaccuc

SEQ ID NO: 50911 - RNA, 27 nt, Artificial Sequence
  Serine/threonine-protein kinase Nek9 (195-203)
cgcgagauggaggagaaggugacccug

SEQ ID NO: 50912 - RNA, 27 nt, Artificial Sequence
  Vimentin (345-353)
cgcgagauggaggagaacuucgccgug

SEQ ID NO: 50913 - RNA, 27 nt, Artificial Sequence
  Mitogen-activated protein kinase kinase kinase 1 (162-170)
cgcgagauggagaacaaggagacccug

SEQ ID NO: 50914 - RNA, 30 nt, Artificial Sequence
  Protein lin-9 homolog (312-321)
cgcgagaugaacaccgaggccgagaagcug

SEQ ID NO: 50915 - RNA, 30 nt, Artificial Sequence
  KN motif and ankyrin repeat domain-containing protein 1 (483-492)
cgcgagaugaccaagcugaagcaggagcuc

SEQ ID NO: 50916 - RNA, 30 nt, Artificial Sequence
  Sorting nexin-29 (92-101)
cgcgagaacgaggugcugaagguccagcuc

SEQ ID NO: 50917 - RNA, 27 nt, Artificial Sequence
  RNA-binding protein 27 (502-510)
cgcgagaacaacgagcagcccacccug

SEQ ID NO: 50918 - RNA, 33 nt, Artificial Sequence
  N-alpha-acetyltransferase 11 (175-185)
cgcgagaaccaggagacccagggcagcacccug

SEQ ID NO: 50919 - RNA, 30 nt, Artificial Sequence
  Heterogeneous nuclear ribonucleoprotein K (171-180)
cgcgagaacacccagaccacgaucaagcug

SEQ ID NO: 50920 - RNA, 33 nt, Artificial Sequence
  Probable ATP-dependent RNA helicase DDX5 (511-521)
cgcgagaacuacgaccggggcuacagcucccug

SEQ ID NO: 50921 - RNA, 36 nt, Artificial Sequence
  Probable ATP-dependent RNA helicase DDX5 (511-522)
cgcgagaacuacgaccggggcuacagcucccugcuc

SEQ ID NO: 50922 - RNA, 30 nt, Artificial Sequence
  Hsp70-binding protein 1 (357-366)
cgcgagcccgagcugggccucgaggagcug

SEQ ID NO: 50923 - RNA, 30 nt, Artificial Sequence
  Tripartite motif-containing protein 65 (51-60)
cgcgagcccuucccggacggcgccgagcug

SEQ ID NO: 50924 - RNA, 30 nt, Artificial Sequence
  Melanoma-associated antigen 2 (155-164)
cgcgagcccgugaccaaggccgagaugcug

SEQ ID NO: 50925 - RNA, 27 nt, Artificial Sequence
  FAS-associated factor 1 (349-357)
cgcgagcaggacgaggccuaccggcug

SEQ ID NO: 50926 - RNA, 27 nt, Artificial Sequence
  Intersectin-2 (475-483)
cgcgagcaggaggagaucgugcggcug

SEQ ID NO: 50927 - RNA, 30 nt, Artificial Sequence
  L-dopachrome tautomerase (138-147)
cgcgagcaguuccugggcgcccucgaccug

SEQ ID NO: 50928 - RNA, 33 nt, Artificial Sequence
  Ras-responsive element-binding protein 1 (361-371)
cgcgagcagcccagcgagggcgccaccgagcug

SEQ ID NO: 50929 - RNA, 27 nt, Artificial Sequence
  Microtubule-actin cross-linking factor 1, isoforms 1/2/3/5 (4309-4317)
cgcgagcagcagcugcagagcacccuc

SEQ ID NO: 50930 - RNA, 27 nt, Artificial Sequence
  V-type proton ATPase subunit D (194-202)
cgcgagcgggaggaguucuaccgccug

SEQ ID NO: 50931 - RNA, 27 nt, Artificial Sequence
  Eukaryotic translation initiation factor 4B (372-380)
cgcgagcgggagguggaggagcgccug

SEQ ID NO: 50932 - RNA, 33 nt, Artificial Sequence
  Proteasome activator complex subunit 3 (19-29)
cgcgagcggaucaccagcgaggccgaggaccug

SEQ ID NO: 50933 - RNA, 27 nt, Artificial Sequence
  Lysosomal-trafficking regulator (1440-1448)
cgcgagagcuucccccaccggcugcuc

SEQ ID NO: 50934 - RNA, 30 nt, Artificial Sequence
  Cytoplasmic dynein 1 intermediate chain 1 (57-66)
cgcgagaccgaggcccugcuccagagcauc

SEQ ID NO: 50935 - RNA, 30 nt, Artificial Sequence
  Annexin A5 (227-236)
cgcgagaccagcggcaaccuggagcagcuc

SEQ ID NO: 50936 - RNA, 33 nt, Artificial Sequence
  Dexamethasone-induced Ras-related protein 1 (153-163)
cgcgagguggaccagcgggagaucgagcagcug

SEQ ID NO: 50937 - RNA, 39 nt, Artificial Sequence
  Dual specificity protein phosphatase 10 (294-306)
cgcgaggugggcgggggcgccagcgccgcguccagccug

SEQ ID NO: 50938 - RNA, 33 nt, Artificial Sequence
  Transmembrane channel-like protein 6 (57-67)
cgcgaggugaccggcagcucccagcagacccug

SEQ ID NO: 50939 - RNA, 30 nt, Artificial Sequence
  Sarcoplasmic/endoplasmic reticulum calcium ATPase 2 (549-558)
cgcgaguggggcagcggguccgacacccug

SEQ ID NO: 50940 - RNA, 30 nt, Artificial Sequence
  GPN-loop GTPase 1 (251-260)
cgcgaguaccggcccgaguacgagcgccug

SEQ ID NO: 50941 - RNA, 27 nt, Artificial Sequence
  Rab-like protein 3 (198-206)
cgcuucuucgacaaggugaucgagaag

SEQ ID NO: 50942 - RNA, 30 nt, Artificial Sequence
  DNA mismatch repair protein Msh3 (26-35)
cgcuucuuccagagcaccggcucccugaag

SEQ ID NO: 50943 - RNA, 54 nt, Artificial Sequence
  Transgelin-2 (182-199)
cgcggcgccagccaggccgggaugaccggcuacgggaugccccggcagauccug

SEQ ID NO: 50944 - RNA, 33 nt, Artificial Sequence
  F-box/LRR-repeat protein 4 (358-368)
cgcggcuucaucagcguggccggguucucccgg

SEQ ID NO: 50945 - RNA, 33 nt, Artificial Sequence
  Isocitrate dehydrogenase (NAD) subunit alpha, mitochondrial (25-35)
cgcggcuucaccgggggcaucaacuucgccaag

SEQ ID NO: 50946 - RNA, 27 nt, Artificial Sequence
  POM121 and ZP3 fusion protein (9-17)
cgcaucgcccccccggaccggcgcuuc

SEQ ID NO: 50947 - RNA, 33 nt, Artificial Sequence
  Histone H2B type 1-A (74-84)
cgcaucgccagcgaggccucccggcuggcgcac

SEQ ID NO: 50948 - RNA, 27 nt, Artificial Sequence
  Cell division cycle 5-like protein (33-41)
cgcaucgccagccugcuccaccggaag

SEQ ID NO: 50949 - RNA, 30 nt, Artificial Sequence
  Transmembrane protein 230 (98-107)
cgcaucgccuacuacgccagcaagggcuac

SEQ ID NO: 50950 - RNA, 27 nt, Artificial Sequence
  Galectin-3-binding protein (216-224)
cgcaucgacaucacccugagcuccgug

SEQ ID NO: 50951 - RNA, 27 nt, Artificial Sequence
  Nuclear pore complex protein Nup88 (356-364)
cgcaucgaccugauccccagccucuac

SEQ ID NO: 50952 - RNA, 33 nt, Artificial Sequence
  Dolichyl-diphosphooligosaccharide-proteinosyltransferase 48 kDa subunit (359-369)
cgcaucgaccccuucgugcggaccuuccugaag

SEQ ID NO: 50953 - RNA, 33 nt, Artificial Sequence
  78 kDa glucose-regulated protein (540-550)
cgcaucgacacccggaacgagcuggagagcuac

SEQ ID NO: 50954 - RNA, 27 nt, Artificial Sequence
  Tuftelin-interacting protein 11 (402-410)
cgcaucuucgagacccugcaggacaag

SEQ ID NO: 50955 - RNA, 27 nt, Artificial Sequence
  DNA-directed RNA polymerase III subunit RPC3 (364-372)
cgcaucuuccggcuggugcuccagaag

SEQ ID NO: 50956 - RNA, 27 nt, Artificial Sequence
  Serine/threonine-protein phosphatase 2A regulatory subunit B'' subunit beta (354-362)
cgcaucuucagcggcgccgugacccgg

SEQ ID NO: 50957 - RNA, 39 nt, Artificial Sequence
  Interleukin enhancer-binding factor 3 (5-17)
cgcaucuucgugaacgacgaccggcacgucauggccaag

SEQ ID NO: 50958 - RNA, 27 nt, Artificial Sequence
  Peroxisome biogenesis factor 10 (83-91)
cgcauccacgugcccagcucccugcgg

SEQ ID NO: 50959 - RNA, 27 nt, Artificial Sequence
  A-kinase anchor protein 13 (58-66)
cgcaucaucgacagcaaguuccugaag

SEQ ID NO: 50960 - RNA, 27 nt, Artificial Sequence
  Oligoribonuclease, mitochondrial (133-141)
cgcaucaucgacgugagcaccgucaag

SEQ ID NO: 50961 - RNA, 27 nt, Artificial Sequence
  Actin filament-associated protein 1-like 1 (363-371)
cgcaucaucggcuucagcaagaagaag

SEQ ID NO: 50962 - RNA, 33 nt, Artificial Sequence
  Choline kinase alpha (244-254)
cgcaucaaguucaccgaggagagccggaucaag

SEQ ID NO: 50963 - RNA, 27 nt, Artificial Sequence
  Endothelin B receptor (208-216)
cgcaucaagggcaucggggugcccaag

SEQ ID NO: 50964 - RNA, 30 nt, Artificial Sequence
  Uncharacterized protein C1orf21 (35-44)
cgcaucaagcccguggaggaggucaaguac

SEQ ID NO: 50965 - RNA, 27 nt, Artificial Sequence
  Chromodomain-helicase-DNA-binding protein 8 (579-587)
cgcauccuggacgagagccacuccauc

SEQ ID NO: 50966 - RNA, 30 nt, Artificial Sequence
  SH3 domain-binding glutamic acid-rich-like protein 3 (159-168)
cgcauccuggacggcaagcggauccaguac

SEQ ID NO: 50967 - RNA, 36 nt, Artificial Sequence
  Ubiquitin conjugation factor E4 B (856-867)
cgcauccuggaccccgccuacccggacaucacccuc

SEQ ID NO: 50968 - RNA, 27 nt, Artificial Sequence
  Shugoshin-like 2 (1098-1106)
cgcauccuggacagcgugcagggcaag

SEQ ID NO: 50969 - RNA, 33 nt, Artificial Sequence
  Serine/threonine-protein phosphatase 6 regulatory subunit 3 (385-395)
cgcauccuggaggccugggagaugaacgagaag

SEQ ID NO: 50970 - RNA, 33 nt, Artificial Sequence
  60S ribosomal protein L19 (117-127)
cgcauccugauggagcacauccacaagcucaag

SEQ ID NO: 50971 - RNA, 33 nt, Artificial Sequence
  Eukaryotic translation initiation factor 3 subunit A (623-633)
cgcauccugcaggagcacgagcagaucaagaag

SEQ ID NO: 50972 - RNA, 30 nt, Artificial Sequence
  Pre-mRNA-splicing factor ATP-dependent RNA helicase DHX15 (666-675)
cgcaucauggaccgguucaaccugccccgc

SEQ ID NO: 50973 - RNA, 33 nt, Artificial Sequence
  Cell differentiation protein RCD1 homolog (169-179)
cgcaucauggagagcggcuccgagcugagcaag

SEQ ID NO: 50974 - RNA, 33 nt, Artificial Sequence
  Elongation factor 2 (428-438)
cgcaucaugggccccaacuacaccccggggaag

SEQ ID NO: 50975 - RNA, 33 nt, Artificial Sequence
  Calcineurin binding protein 1, isoform CRA_c (308-318)
cgcaucaugagcgagaccuacaugcugaucaag

SEQ ID NO: 50976 - RNA, 27 nt, Artificial Sequence
  Synaptonemal complex central element protein 1 (59-67)
cgcaucaacgaggugcagcaggccaag

SEQ ID NO: 50977 - RNA, 30 nt, Artificial Sequence
  Ninein (1240-1249)
cgcauccccgaggccagcccgaaguacaag

SEQ ID NO: 50978 - RNA, 30 nt, Artificial Sequence
  Ribosomal protein 63, mitochondrial (11-20)
cgcauccccggccggcaguggaucgggaag

SEQ ID NO: 50979 - RNA, 33 nt, Artificial Sequence
  Cullin-1 (328-338)
cgcauccaggacggccugggggagcucaagaag

SEQ ID NO: 50980 - RNA, 33 nt, Artificial Sequence
  Malate dehydrogenase, mitochondrial (229-239)
cgcauccaggaggccggcaccgagguggucaag

SEQ ID NO: 50981 - RNA, 27 nt, Artificial Sequence
  Spectrin beta chain, non-erythrocytic 1 (1245-1253)
cgcauccaggagaagguggacagcauc

SEQ ID NO: 50982 - RNA, 30 nt, Artificial Sequence
  Thyroid adenoma-associated protein (692-701)
cgcauccaggagagcucccaggugcuguac

SEQ ID NO: 50983 - RNA, 27 nt, Artificial Sequence
  DNA replication licensing factor MCM6 (207-215)
cgcauccaggagacccaggccgagcug

SEQ ID NO: 50984 - RNA, 27 nt, Artificial Sequence
  Antigen KI-67 (38-46)
cgcauccagcugcccguggucagcaag

SEQ ID NO: 50985 - RNA, 27 nt, Artificial Sequence
  RNA-binding E3 ubiquitin-protein ligase MEX3C (156-164)
cgcauccagcagcagacccacaccuac

SEQ ID NO: 50986 - RNA, 33 nt, Artificial Sequence
  Tubulin beta chain (18-28)
cgcaucagcgagcaguucaccgccauguuccgg

SEQ ID NO: 50987 - RNA, 27 nt, Artificial Sequence
  Zinc finger protein 529 (330-338)
cgcaucagcucccagcugaucgagcac

SEQ ID NO: 50988 - RNA, 27 nt, Artificial Sequence
  Lysine-specific histone demethylase 1B (473-481)
cgcaucaccgaccccaccaucgacaag

SEQ ID NO: 50989 - RNA, 30 nt, Artificial Sequence
  Cleavage stimulation factor subunit 2 (179-188)
cgcaucguggaccccgagaucgcccugaag

SEQ ID NO: 50990 - RNA, 27 nt, Artificial Sequence
  Unconventional myosin-X (239-247)
cgcaucguggacuaccugcucgagaag

SEQ ID NO: 50991 - RNA, 27 nt, Artificial Sequence
  CDP-diacylglycerol-glycerol-3-phosphate 3-phosphatidyltransferase, mitochondrial (76-84)
cgcaucuggagccugcaguucucccgg

SEQ ID NO: 50992 - RNA, 27 nt, Artificial Sequence
  Dynein heavy chain 6, axonemal (191-199)
cgcaucuacgccgccaccuucgagaag

SEQ ID NO: 50993 - RNA, 30 nt, Artificial Sequence
  DNA-directed RNA polymerase II subunit RPB2 (409-418)
cgcaucuacgcccagaaguucaucgaccgg

SEQ ID NO: 50994 - RNA, 27 nt, Artificial Sequence
  U4/U6 small nuclear ribonucleoprotein Prp31 (203-211)
cgcaucuacgaguacguggagagccgg

SEQ ID NO: 50995 - RNA, 27 nt, Artificial Sequence
  Long-chain-fatty-acid-CoA ligase 4 (339-347)
cgcaucuacaagaacgugaugagcaag

SEQ ID NO: 50996 - RNA, 27 nt, Artificial Sequence
  28S ribosomal protein S21, mitochondrial (50-58)
cgcaucuacaacauggagauggcccgg

SEQ ID NO: 50997 - RNA, 27 nt, Artificial Sequence
  Ankyrin repeat and SOCS box protein 4 (318-326)
cgcaucuaccccccgcaguuccacaag

SEQ ID NO: 50998 - RNA, 27 nt, Artificial Sequence
  Transformation/transcription domain-associated protein (296-304)
cgcaucuaccaggagcuggugaccaag

SEQ ID NO: 50999 - RNA, 30 nt, Artificial Sequence
  Semaphorin-5A (736-745)
cgccuggccgaccccaaccuccuggaggug

SEQ ID NO: 51000 - RNA, 27 nt, Artificial Sequence
  Long-chain fatty acid transport protein 3 (117-125)
cgccuggccgagcucgcccagcagcgg

SEQ ID NO: 51001 - RNA, 33 nt, Artificial Sequence
  E3 ubiquitin-protein ligase TRIM56 (291-301)
cgccuggccgagcucgagggccgggagcaggug

SEQ ID NO: 51002 - RNA, 27 nt, Artificial Sequence
  Catenin beta-1 (124-132)
cgccuggccgagcccagccagaugcuc

SEQ ID NO: 51003 - RNA, 27 nt, Artificial Sequence
  14-3-3 protein eta (12-20)
cgccuggccgagcaggccgagcgguac

SEQ ID NO: 51004 - RNA, 27 nt, Artificial Sequence
  Syntaxin-binding protein 1 (171-179)
cgccuggccgagcagaucgccacccuc

SEQ ID NO: 51005 - RNA, 27 nt, Artificial Sequence
  GPALPP motifs-containing protein 1 (89-97)
cgccuggccgagcaggugagcuccuac

SEQ ID NO: 51006 - RNA, 30 nt, Artificial Sequence
  Ubiquitin carboxyl-terminal hydrolase 19 (897-906)
cgccuggccgaggugaucaagaaccgguuc

SEQ ID NO: 51007 - RNA, 33 nt, Artificial Sequence
  Receptor tyrosine-protein kinase erbB-3 (916-926)
cgccuggccgaggugcccgaccuccuggagaag

SEQ ID NO: 51008 - RNA, 33 nt, Artificial Sequence
  Catenin beta-1 (274-284)
cgccuggccggcgggcuccagaagaugguggcc

SEQ ID NO: 51009 - RNA, 27 nt, Artificial Sequence
  Echinoderm microtubule-associated protein-like 3 (815-823)
cgccuggccccccggcucgccggccgc

SEQ ID NO: 51010 - RNA, 27 nt, Artificial Sequence
  Nucleolar protein 56 (212-220)
cgccuggcccaguucaucggcaaccgg

SEQ ID NO: 51011 - RNA, 27 nt, Artificial Sequence
  Sorting nexin-17 (261-269)
cgccuggcccagacccuccggcacuac

SEQ ID NO: 51012 - RNA, 36 nt, Artificial Sequence
  Microtubule-associated protein 4 (922-933)
cgccuggccaccaacaccagcgcccccgaccucaag

SEQ ID NO: 51013 - RNA, 27 nt, Artificial Sequence
  P2X purinoceptor 7 (277-285)
cgccuggacgacaagaccaccaacgug

SEQ ID NO: 51014 - RNA, 33 nt, Artificial Sequence
  Nuclear RNA export factor 1 (219-229)
cgccuggacgacaugagcuccaucgugcagaag

SEQ ID NO: 51015 - RNA, 30 nt, Artificial Sequence
  Potassium voltage-gated channel subfamily G member 3 (115-124)
cgccuggacgaccggaugagcgacaccuac

SEQ ID NO: 51016 - RNA, 30 nt, Artificial Sequence
  FERM domain-containing protein 6 (225-234)
cgccuggacgacguggccguccacuacuac

SEQ ID NO: 51017 - RNA, 27 nt, Artificial Sequence
  Dolichyl-diphosphooligosaccharide-proteinosyltransferase subunit 2 (190-198)
cgccuggacgagcucggcgggguguac

SEQ ID NO: 51018 - RNA, 27 nt, Artificial Sequence
  Activating signal cointegrator 1 (224-232)
cgccuggacgagaccauccaggccauc

SEQ ID NO: 51019 - RNA, 27 nt, Artificial Sequence
  Helicase-like transcription factor (880-888)
cgccuggacggcagcauggcccagaag

SEQ ID NO: 51020 - RNA, 27 nt, Artificial Sequence
  Tubulin alpha-1C chain (355-363)
cgccuggaccacaaguucgaccucaug

SEQ ID NO: 51021 - RNA, 27 nt, Artificial Sequence
  Protein kinase C and casein kinase substrate in neurons protein 2 (427-435)
cgccuggacaacggccagguggggcuc

SEQ ID NO: 51022 - RNA, 27 nt, Artificial Sequence
  Coiled-coil domain-containing protein 138 (306-314)
cgccuggacaaccuccagcggaaguac

SEQ ID NO: 51023 - RNA, 27 nt, Artificial Sequence
  Melanoma antigen preferentially expressed in tumors (312-320)
cgccuggaccagcuccugcggcacgug

SEQ ID NO: 51024 - RNA, 27 nt, Artificial Sequence
  Coiled-coil domain-containing protein 91 (405-413)
cgccuggaccaggugauccggcagcgc

SEQ ID NO: 51025 - RNA, 33 nt, Artificial Sequence
  Nicastrin (281-291)
cgccuggacagccgguccuucuucuggaacgug

SEQ ID NO: 51026 - RNA, 27 nt, Artificial Sequence
  C-Jun-amino-terminal kinase-interacting protein 4 (1097-1105)
cgccuggacagcacccuccggcuguac

SEQ ID NO: 51027 - RNA, 27 nt, Artificial Sequence
  Cyclin-dependent kinase 2 (36-44)
cgccuggacaccgagaccgagggcgug

SEQ ID NO: 51028 - RNA, 27 nt, Artificial Sequence
  Uncharacterized protein C19orf60 (50-58)
cgccuggaggagggccaccggcaguac

SEQ ID NO: 51029 - RNA, 30 nt, Artificial Sequence
  Cap-specific mRNAucleoside-2'-O-)-methyltransferase 1 (708-717)
cgccuggaggagauggagaagaucuucgug

SEQ ID NO: 51030 - RNA, 33 nt, Artificial Sequence
  Pre-mRNA-processing factor 6 (317-327)
cgccuggaggaggugaccggcaagcuccagguc

SEQ ID NO: 51031 - RNA, 30 nt, Artificial Sequence
  Armadillo repeat-containing protein 8 (27-36)
cgccuguucgaccccgacccgcagaaggug

SEQ ID NO: 51032 - RNA, 30 nt, Artificial Sequence
  Receptor-interacting serine/threonine-protein kinase 4 (198-207)
cgccuguucgacaccaagcacgacguguac

SEQ ID NO: 51033 - RNA, 30 nt, Artificial Sequence
  Phosphatidylinositol 4-kinase beta (132-141)
cgccuguucgagagcaagcucuucgacauc

SEQ ID NO: 51034 - RNA, 30 nt, Artificial Sequence
  Cartilage-associated protein (107-116)
cgccuguucggcgggcuccugcggcgcgcc

SEQ ID NO: 51035 - RNA, 30 nt, Artificial Sequence
  Synaptonemal complex protein SC65 (104-113)
cgccuguucggccgggugcucgagcgcgcc

SEQ ID NO: 51036 - RNA, 36 nt, Artificial Sequence
  Diamine acetyltransferase 1 (155-166)
cgccuguucaagaucgacaaggaguaccuccugaag

SEQ ID NO: 51037 - RNA, 33 nt, Artificial Sequence
  Dol-P-Man:Man(5)GlcNAc(2)-PP-Dol alpha-1,3-mannosyltransferase (123-133)
cgccuguucaacgaccccguggccaugguccuc

SEQ ID NO: 51038 - RNA, 27 nt, Artificial Sequence
  Membralin (58-66)
cgccuguuccccccggccuuccggcgc

SEQ ID NO: 51039 - RNA, 27 nt, Artificial Sequence
  DNA primase small subunit (19-27)
cgccuguuccccuacagccaguacuac

SEQ ID NO: 51040 - RNA, 27 nt, Artificial Sequence
  Homeobox protein cut-like 1 (640-648)
cgccuguuccaggaggugcccaagcgg

SEQ ID NO: 51041 - RNA, 33 nt, Artificial Sequence
  Coatomer subunit gamma-2 (75-85)
cgccuguuccagagcaacgaccagacccuccgg

SEQ ID NO: 51042 - RNA, 27 nt, Artificial Sequence
  28S ribosomal protein S2, mitochondrial (251-259)
cgccuguuccagaccgccaucacccgg

SEQ ID NO: 51043 - RNA, 27 nt, Artificial Sequence
  Armadillo repeat-containing protein 2 (134-142)
cgccuguuccgggccgccagccagcgc

SEQ ID NO: 51044 - RNA, 30 nt, Artificial Sequence
  Nicalin (40-49)
cgccuguucagccggcucuacaccuacaag

SEQ ID NO: 51045 - RNA, 36 nt, Artificial Sequence
  C-Jun-amino-terminal kinase-interacting protein 4 (548-559)
cgccuguucagcuccagcuccaacaccaccaagaag

SEQ ID NO: 51046 - RNA, 30 nt, Artificial Sequence
  40S ribosomal protein S17 (23-32)
cgccugggcaacgacuuccacaccaacaag

SEQ ID NO: 51047 - RNA, 30 nt, Artificial Sequence
  Thrombospondin-2 (245-254)
cgccugggcccccacgugaccaccgaguac

SEQ ID NO: 51048 - RNA, 27 nt, Artificial Sequence
  Ankyrin repeat domain-containing protein 54 (100-108)
cgccugggccccaccgggaaggaggug

SEQ ID NO: 51049 - RNA, 30 nt, Artificial Sequence
  Protein fantom (56-65)
cgccugcacgacgagaacauccuccugaag

SEQ ID NO: 51050 - RNA, 39 nt, Artificial Sequence
  40S ribosomal protein S20 (87-99)
cgccugaucgaccuccacagccccuccgagaucgugaag

SEQ ID NO: 51051 - RNA, 33 nt, Artificial Sequence
  28S ribosomal protein S5, mitochondrial (246-256)
cgccugaucggcaucaaggacauguacgccaag

SEQ ID NO: 51052 - RNA, 27 nt, Artificial Sequence
  Abnormal spindle-like microcephaly-associated protein (521-529)
cgccugauccagaccaccuggcggaag

SEQ ID NO: 51053 - RNA, 27 nt, Artificial Sequence
  Calcineurin-binding protein cabin-1 (136-144)
cgccugauccggaucccccucgcccgc

SEQ ID NO: 51054 - RNA, 33 nt, Artificial Sequence
  Chromatin assembly factor 1 subunit A (782-792)
cgccugaucagcgagaacuccguguacgagaag

SEQ ID NO: 51055 - RNA, 27 nt, Artificial Sequence
  Rho guanine nucleotide exchange factor 39 (185-193)
cgccugaucagcgagaccgcccagcgg

SEQ ID NO: 51056 - RNA, 36 nt, Artificial Sequence
  DCN1-like protein 5 (40-51)
cgccugaucagcggcgaggagcacuucuccagcaag

SEQ ID NO: 51057 - RNA, 36 nt, Artificial Sequence
  40S ribosomal protein S4, X isoform (81-92)
cgccugaucuacgacaccaagggccgguucgccgug

SEQ ID NO: 51058 - RNA, 27 nt, Artificial Sequence
  Protein PRRC2A (2074-2082)
cgccugaaggccacccccagcaccuac

SEQ ID NO: 51059 - RNA, 27 nt, Artificial Sequence
  Nuclear migration protein nudC (143-151)
cgccugaagggcaaggacauggugguc

SEQ ID NO: 51060 - RNA, 33 nt, Artificial Sequence
  tRNA-splicing endonuclease subunit Sen34 (58-68)
cgccugcucgccgagaucggcgccgugacccug

SEQ ID NO: 51061 - RNA, 27 nt, Artificial Sequence
  Transcription factor SPT20 homolog (262-270)
cgccugcucgacuuccugcagaagcgg

SEQ ID NO: 51062 - RNA, 27 nt, Artificial Sequence
  Mitogen-activated protein kinase-binding protein 1 (92-100)
cgccugcucgacaaguggguggagcug

SEQ ID NO: 51063 - RNA, 27 nt, Artificial Sequence
  E3 ubiquitin-protein ligase RNF14 (373-381)
cgccugcucgaccagcgguacggcaag

SEQ ID NO: 51064 - RNA, 33 nt, Artificial Sequence
  Lysine-specific histone demethylase 1A (408-418)
cgccugcucgaggccaccagcuaccugucccac

SEQ ID NO: 51065 - RNA, 27 nt, Artificial Sequence
  39S ribosomal protein L37, mitochondrial (112-120)
cgccugcucgagggcgugaagcaggcc

SEQ ID NO: 51066 - RNA, 27 nt, Artificial Sequence
  Transient receptor potential cation channel subfamily M member 1 (158-166)
cgccugcucgagaagcacaucagccug

SEQ ID NO: 51067 - RNA, 27 nt, Artificial Sequence
  DNA-directed RNA polymerase III subunit RPC3 (458-466)
cgccugcucgagaagagccagcgggug

SEQ ID NO: 51068 - RNA, 27 nt, Artificial Sequence
  citron Rho-interacting kinase isoform X13 (384-392)
cgccugcucgagcuggagacccggcug

SEQ ID NO: 51069 - RNA, 27 nt, Artificial Sequence
  Clathrin heavy chain 1 (583-591)
cgccugcucgagaugaaccugaugcac

SEQ ID NO: 51070 - RNA, 33 nt, Artificial Sequence
  Unconventional myosin-Va (137-147)
cgccugcucgagagccagcugcagucccagaag

SEQ ID NO: 51071 - RNA, 33 nt, Artificial Sequence
  Glycogen synthase kinase-3 beta (319-329)
cgccugcucgaguacacccccaccgcccggcug

SEQ ID NO: 51072 - RNA, 51 nt, Artificial Sequence
  Oxidation resistance protein 1 (21-37)
cgccugcucggcuucgggggcgggggcgaggcccggcagacccuggccaag

SEQ ID NO: 51073 - RNA, 24 nt, Artificial Sequence
  Membrane-associated transporter protein (209-216)
cgccugcucggcaccgaguuccag

SEQ ID NO: 51074 - RNA, 27 nt, Artificial Sequence
  Microsomal glutathione S-transferase 1 (147-155)
cgccugcucaagagcaagcuguaccug

SEQ ID NO: 51075 - RNA, 27 nt, Artificial Sequence
  Actin-binding protein anillin (762-770)
cgccugcuccugaucgccaccggcaag

SEQ ID NO: 51076 - RNA, 30 nt, Artificial Sequence
  DNA replication licensing factor MCM6 (11-20)
cgccugcucaacaagagcaucauccgggug

SEQ ID NO: 51077 - RNA, 33 nt, Artificial Sequence
  Activating signal cointegrator 1 complex subunit 3 (832-842)
cgccugcucaaccugagcaaggugaucgacaag

SEQ ID NO: 51078 - RNA, 33 nt, Artificial Sequence
  Glioma tumor suppressor candidate region gene 2 protein (165-175)
cgccugcucaaccccagcgccacccgggccaag

SEQ ID NO: 51079 - RNA, 30 nt, Artificial Sequence
  Ectonucleoside triphosphate diphosphohydrolase 6 (169-178)
cgccugcuccccggcgagaaggcccagaag

SEQ ID NO: 51080 - RNA, 33 nt, Artificial Sequence
  Myomegalin (2291-2301)
cgccugcuccagagcaccaccgagcaccugaag

SEQ ID NO: 51081 - RNA, 27 nt, Artificial Sequence
  Carbohydrate sulfotransferase 14 (180-188)
cgccugcucagcgccuaccggaacaag

SEQ ID NO: 51082 - RNA, 36 nt, Artificial Sequence
  GPI-anchor transamidase (149-160)
cgccugcucagcgacgaccgguccaacauccugauc

SEQ ID NO: 51083 - RNA, 30 nt, Artificial Sequence
  Spermatogenesis-associated protein 20 (128-137)
cgccugcucagcgaggacuucguguccguc

SEQ ID NO: 51084 - RNA, 33 nt, Artificial Sequence
  Attractin (51-61)
cgccugcucagccccccgcugcggccccgccug

SEQ ID NO: 51085 - RNA, 36 nt, Artificial Sequence
  Attractin (51-62)
cgccugcucagccccccgcugcggccccgccugcuc

SEQ ID NO: 51086 - RNA, 27 nt, Artificial Sequence
  Actin-binding protein anillin (910-918)
cgccugcucaccagcaucaccacgaag

SEQ ID NO: 51087 - RNA, 33 nt, Artificial Sequence
  Serine/threonine-protein kinase mTOR (2429-2439)
cgccugauggacaccaacaccaagggcaacaag

SEQ ID NO: 51088 - RNA, 33 nt, Artificial Sequence
  Dehydrodolichyl diphosphate syntase complex subunit DHDDS (103-113)
cgccugauggaggagaaggagaagcuccagaag

SEQ ID NO: 51089 - RNA, 27 nt, Artificial Sequence
  Dedicator of cytokinesis protein 4 (213-221)
cgccugauggagcggcuccuggacuac

SEQ ID NO: 51090 - RNA, 27 nt, Artificial Sequence
  Nuclear receptor-interacting protein 3 (4-12)
cgccugauggagaccaaccucagcaag

SEQ ID NO: 51091 - RNA, 36 nt, Artificial Sequence
  Heterogeneous nuclear ribonucleoprotein Q (192-203)
cgccugaugauggacccccucaccggccugaaccgg

SEQ ID NO: 51092 - RNA, 33 nt, Artificial Sequence
  Heat shock protein 105 kDa (169-179)
cgccugaugaacgacaugaccgccguggcccuc

SEQ ID NO: 51093 - RNA, 27 nt, Artificial Sequence
  RILP-like protein 1 (52-60)
cgccugaugcccaaggugguccgggug

SEQ ID NO: 51094 - RNA, 27 nt, Artificial Sequence
  U5 small nuclear ribonucleoprotein 200 kDa helicase (841-849)
cgccugaugcgggccaucuucgagauc

SEQ ID NO: 51095 - RNA, 27 nt, Artificial Sequence
  FYVE, RhoGEF and PH domain-containing protein 4 (32-40)
cgccugaugagcaagaacuucaccaag

SEQ ID NO: 51096 - RNA, 27 nt, Artificial Sequence
  Hyaluronan mediated motility receptor (119-127)
cgccugaacgccgcccuccgggagaag

SEQ ID NO: 51097 - RNA, 27 nt, Artificial Sequence
  Cytochrome c oxidase subunit 5A, mitochondrial (98-106)
cgccugaacgacuucgccagcaccgug

SEQ ID NO: 51098 - RNA, 27 nt, Artificial Sequence
  Spectrin beta chain, non-erythrocytic 1 (2278-2286)
cgccugaacgacggcaacgaguaccuc

SEQ ID NO: 51099 - RNA, 30 nt, Artificial Sequence
  V-type proton ATPase subunit H (382-391)
cgccugaacgagaagaacuacgagcuccug

SEQ ID NO: 51100 - RNA, 33 nt, Artificial Sequence
  Pyruvate kinase PKM (73-83)
cgccugaacuucagccacggcacccacgaguac

SEQ ID NO: 51101 - RNA, 36 nt, Artificial Sequence
  60S acidic ribosomal protein P2 (38-49)
cgccugaacaaggugaucagcgagcucaacggcaag

SEQ ID NO: 51102 - RNA, 27 nt, Artificial Sequence
  Midasin (2183-2191)
cgccugaacaacaagaucaacagcuac

SEQ ID NO: 51103 - RNA, 33 nt, Artificial Sequence
  RalBP1-associated Eps domain-containing protein 1 (712-722)
cgccugaacagcgagcuccagcagcagcugaag

SEQ ID NO: 51104 - RNA, 30 nt, Artificial Sequence
  Testis-expressed sequence 10 protein (473-482)
cgccugaacagcaagcagcucaaccggcug

SEQ ID NO: 51105 - RNA, 30 nt, Artificial Sequence
  Integrator complex subunit 8 (649-658)
cgccugcccgacaucccgcuccggcaggug

SEQ ID NO: 51106 - RNA, 33 nt, Artificial Sequence
  Protrudin (48-58)
cgccugcccgacagcgagcucaugcggcgcaag

SEQ ID NO: 51107 - RNA, 33 nt, Artificial Sequence
  Beta-1,3-N-acetylglucosaminyltransferase radical fringe (267-277)
cgccugcccccggacacccuccugcagcaggug

SEQ ID NO: 51108 - RNA, 27 nt, Artificial Sequence
  F-actin-capping protein subunit beta (41-49)
cgccugcccccgcagcagaucgagaag

SEQ ID NO: 51109 - RNA, 39 nt, Artificial Sequence
  Transmembrane protein 51 (123-135)
cgccugccccagggcaccauguucccggccacccggaag

SEQ ID NO: 51110 - RNA, 27 nt, Artificial Sequence
  Inactive tyrosine-protein kinase 7 (362-370)
cgccugcccacccacggccggguguac

SEQ ID NO: 51111 - RNA, 27 nt, Artificial Sequence
  Bridging integrator 3 (137-145)
cgccugcaggccaagguggagaaguac

SEQ ID NO: 51112 - RNA, 30 nt, Artificial Sequence
  Nck-associated protein 1 (492-501)
cgccugcaggccuacaccagcguguccaag

SEQ ID NO: 51113 - RNA, 27 nt, Artificial Sequence
  Scavenger receptor class A member 5 (244-252)
cgccugcaggaccuccgggugcugguc

SEQ ID NO: 51114 - RNA, 39 nt, Artificial Sequence
  Protein FAM167A (131-143)
cgccugcaggaccagcagcucgcccggcagcugaugcgc

SEQ ID NO: 51115 - RNA, 30 nt, Artificial Sequence
  KH domain-containing, RNA-binding, signal transduction-associated protein 1 (186-195)
cgccugcaggaggagaccggcgccaagauc

SEQ ID NO: 51116 - RNA, 27 nt, Artificial Sequence
  26S proteasome non-ATPase regulatory subunit 12 (39-47)
cgccugcaggaggugaucgagacccuc

SEQ ID NO: 51117 - RNA, 33 nt, Artificial Sequence
  Sentrin-specific protease 6 (172-182)
cgccugcagggcguggagcggaucaugaagaag

SEQ ID NO: 51118 - RNA, 36 nt, Artificial Sequence
  60S ribosomal protein L10 (109-120)
cgccugcagaccggcaugcggggggccuucggcaag

SEQ ID NO: 51119 - RNA, 30 nt, Artificial Sequence
  Integrin beta-3 (117-126)
cgccugcggcccgacgacagcaagaacuuc

SEQ ID NO: 51120 - RNA, 30 nt, Artificial Sequence
  Protogenin (10-19)
cgccugcggcccccgggcaugcuccugcgc

SEQ ID NO: 51121 - RNA, 33 nt, Artificial Sequence
  DNA replication licensing factor MCM5 (573-583)
cgccugagcgccgaggccgcggagaagcucaag

SEQ ID NO: 51122 - RNA, 36 nt, Artificial Sequence
  EF-hand domain-containing protein D2 (176-187)
cgccugagcgagaucgacguguccagcgagggcguc

SEQ ID NO: 51123 - RNA, 27 nt, Artificial Sequence
  MICOS complex subunit MIC25 (29-37)
cgccugagcgagaacguggucaaccgg

SEQ ID NO: 51124 - RNA, 27 nt, Artificial Sequence
  Neuron navigator 2 (2169-2177)
cgccugagcgaguacaucgugcuccgg

SEQ ID NO: 51125 - RNA, 33 nt, Artificial Sequence
  Serine palmitoyltransferase 2 (212-222)
cgccugagcggcgccaccauccggaucuucaag

SEQ ID NO: 51126 - RNA, 27 nt, Artificial Sequence
  T-complex protein 1 subunit delta (435-443)
cgccugaccgaguacagccggacccuc

SEQ ID NO: 51127 - RNA, 27 nt, Artificial Sequence
  60S ribosomal protein L36 (32-40)
cgccugaccaagcacaccaaguucgug

SEQ ID NO: 51128 - RNA, 27 nt, Artificial Sequence
  Centromere protein F (420-428)
cgccugacccaggagcuccagcaggcc

SEQ ID NO: 51129 - RNA, 30 nt, Artificial Sequence
  Spectrin beta chain, non-erythrocytic 1 (2078-2087)
cgccugaccacccucgagcugcuggaggug

SEQ ID NO: 51130 - RNA, 39 nt, Artificial Sequence
  Disintegrin and metalloproteinase domain-containing protein 10 (389-401)
cgccugguggacgccgacggcccccucgcccggcugaag

SEQ ID NO: 51131 - RNA, 33 nt, Artificial Sequence
  DNA mismatch repair protein Mlh1 (265-275)
cgccugguggagagcaccucccuccggaaggcc

SEQ ID NO: 51132 - RNA, 27 nt, Artificial Sequence
  Coiled-coil domain-containing protein 144A (749-757)
cgccuggugaaggagcuccggaccguc

SEQ ID NO: 51133 - RNA, 39 nt, Artificial Sequence
  Sialidase-3 (111-123)
cgccuggugagcaacuccuggacccaggccauccucaag

SEQ ID NO: 51134 - RNA, 27 nt, Artificial Sequence
  Uridine phosphorylase 1 (90-98)
cgccuggugagcuacuucaucaagaag

SEQ ID NO: 51135 - RNA, 27 nt, Artificial Sequence
  Cryptochrome-2 (155-163)
cgccugugggaccucuacaagaaggug

SEQ ID NO: 51136 - RNA, 45 nt, Artificial Sequence
  Ribosome biogenesis protein WDR12 (322-336)
cgccugugggacccccggaccaaggacggcagccucgugucccug

SEQ ID NO: 51137 - RNA, 30 nt, Artificial Sequence
  Protein polybromo-1 (982-991)
cgccugugggaggacagcgccggcgagaag

SEQ ID NO: 51138 - RNA, 27 nt, Artificial Sequence
  ATP-dependent RNA helicase DDX24 (447-455)
cgccugugggagcucaucaaggagaag

SEQ ID NO: 51139 - RNA, 30 nt, Artificial Sequence
  DnaJ homolog subfamily C member 4 (11-20)
cgccuguggccccggaacccgcccagccgc

SEQ ID NO: 51140 - RNA, 36 nt, Artificial Sequence
  Multifunctional protein ADE2 (215-226)
cgccuguggcccagcggcgaccggucccagcagaag

SEQ ID NO: 51141 - RNA, 33 nt, Artificial Sequence
  39S ribosomal protein L37, mitochondrial (162-172)
cgccuguggcagaccaccgaggagauccccaag

SEQ ID NO: 51142 - RNA, 30 nt, Artificial Sequence
  Protein phosphatase Slingshot homolog 1 (144-153)
cgccuguggagcgacaccaagauccaccuc

SEQ ID NO: 51143 - RNA, 30 nt, Artificial Sequence
  Inositol 1,4,5-trisphosphate receptor type 1 (806-815)
cgccuguggagcgagauccccuccgagauc

SEQ ID NO: 51144 - RNA, 30 nt, Artificial Sequence
  E3 ubiquitin-protein ligase Mdm2 (71-80)
cgccuguacgacgagaagcagcagcacauc

SEQ ID NO: 51145 - RNA, 36 nt, Artificial Sequence
  E3 ubiquitin-protein ligase Mdm2 (65-76)
cgccuguacgacgagaagcagcagcacaucguguac

SEQ ID NO: 51146 - RNA, 33 nt, Artificial Sequence
  ATP-binding cassette sub-family B member 10, mitochondrial (542-552)
cgccuguacgaccccgccagcggcaccaucucc

SEQ ID NO: 51147 - RNA, 30 nt, Artificial Sequence
  MICOS complex subunit MIC26 (165-174)
cgccuguacgacuggggccuccggggguac

SEQ ID NO: 51148 - RNA, 27 nt, Artificial Sequence
  ADP-ribosylation factor-like protein 4D (182-190)
cgccuguacgagaugauccucaagcgg

SEQ ID NO: 51149 - RNA, 39 nt, Artificial Sequence
  Probable fibrosin-1 (306-318)
cgccuguacggccucgagcccgcccacccgcugcuguac

SEQ ID NO: 51150 - RNA, 30 nt, Artificial Sequence
  Tubulin-specific chaperone C (217-226)
cgccuguacggcaaccccaacacccuccgg

SEQ ID NO: 51151 - RNA, 27 nt, Artificial Sequence
  Tubulin polyglutamylase TTLL7 (399-407)
cgccuguacggccagaacagcaucaag

SEQ ID NO: 51152 - RNA, 27 nt, Artificial Sequence
  Condensin-2 complex subunit G2 (329-337)
cgccuguacaagcccauccucuggcgg

SEQ ID NO: 51153 - RNA, 27 nt, Artificial Sequence
  Partitioning defective 6 homolog beta (159-167)
cgccuguacaaguacggcaccgagaag

SEQ ID NO: 51154 - RNA, 30 nt, Artificial Sequence
  HCG2002594, isoform CRA_c (311-320)
cgccuguaccccuggggcaucguggagguc

SEQ ID NO: 51155 - RNA, 24 nt, Artificial Sequence
  Conserved oligomeric Golgi complex subunit 4 (121-128)
cgccuguaccaggccauccagcgg

SEQ ID NO: 51156 - RNA, 33 nt, Artificial Sequence
  Proteasome subunit alpha type-7 (143-153)
cgccuguaccagaccgaccccagcggcaccuac

SEQ ID NO: 51157 - RNA, 27 nt, Artificial Sequence
  Coiled-coil domain-containing protein 77 (127-135)
cgccuguacagcgagaacgaccggcuc

SEQ ID NO: 51158 - RNA, 30 nt, Artificial Sequence
  39S ribosomal protein L17, mitochondrial (74-83)
cgcauggccgacuucuggcugaccgagaag

SEQ ID NO: 51159 - RNA, 39 nt, Artificial Sequence
  Coiled-coil-helix-coiled-coil-helix domain-containing protein 2 (11-23)
cgcauggcccccccggccagccgggcgccccagaugcgc

SEQ ID NO: 51160 - RNA, 27 nt, Artificial Sequence
  Exportin-1 (44-52)
cgcauggcccaggaggugcugacccac

SEQ ID NO: 51161 - RNA, 30 nt, Artificial Sequence
  Lon protease homolog 2, peroxisomal (632-641)
cgcauggacggcgaggggcagcugacccuc

SEQ ID NO: 51162 - RNA, 27 nt, Artificial Sequence
  DNA mismatch repair protein Msh3 (448-456)
cgcauggacaacaucuacuucgaguac

SEQ ID NO: 51163 - RNA, 36 nt, Artificial Sequence
  39S ribosomal protein L51, mitochondrial (101-112)
cgcauguucgccgacgaccugcacaaccucaacaag

SEQ ID NO: 51164 - RNA, 33 nt, Artificial Sequence
  60S ribosomal protein L4 (100-110)
cgcauguucgcccccaccaagaccuggcggcgc

SEQ ID NO: 51165 - RNA, 27 nt, Artificial Sequence
  Zinc finger BED domain-containing protein 5 (228-236)
cgcauguucgacgagcaguacagcaag

SEQ ID NO: 51166 - RNA, 33 nt, Artificial Sequence
  HLA class II histocompatibility antigen, DP alpha 1 chain (6-16)
cgcauguuccacauccgggccgugauccugcgc

SEQ ID NO: 51167 - RNA, 30 nt, Artificial Sequence
  Protein Shroom2 (323-332)
cgcauguucaucggcgaccuggacaaggug

SEQ ID NO: 51168 - RNA, 30 nt, Artificial Sequence
  Cullin-1 (506-515)
cgcauguuccaggacaucggcgugagcaag

SEQ ID NO: 51169 - RNA, 36 nt, Artificial Sequence
  EPM2A-interacting protein 1 (249-260)
cgcaugaucggcgagaacagcgggcugguguccuac

SEQ ID NO: 51170 - RNA, 30 nt, Artificial Sequence
  Leucine-rich repeat and WD repeat-containing protein 1 (193-202)
cgcaugaucagcgaggagcugguggccgcc

SEQ ID NO: 51171 - RNA, 30 nt, Artificial Sequence
  Endoplasmin (509-518)
cgcaugaaggagaagcaggacaagaucuac

SEQ ID NO: 51172 - RNA, 33 nt, Artificial Sequence
  Heat shock protein HSP 90-alpha (605-615)
cgcaugaaggagaaccagaagcacaucuacuac

SEQ ID NO: 51173 - RNA, 30 nt, Artificial Sequence
  Heat shock protein HSP 90-beta (401-410)
cgcaugaaggagacccagaagagcaucuac

SEQ ID NO: 51174 - RNA, 33 nt, Artificial Sequence
  Heat shock protein HSP 90-beta (401-411)
cgcaugaaggagacccagaagagcaucuacuac

SEQ ID NO: 51175 - RNA, 30 nt, Artificial Sequence
  60S ribosomal protein L39 (28-37)
cgcaugaagaccggcaacaagauccgguac

SEQ ID NO: 51176 - RNA, 27 nt, Artificial Sequence
  Liprin-alpha-4 (339-347)
cgcaugcuggaccaccucaccaagaag

SEQ ID NO: 51177 - RNA, 30 nt, Artificial Sequence
  Eukaryotic translation initiation factor 3 subunit A (752-761)
cgcaugcuggaggaccgggaccucuucgug

SEQ ID NO: 51178 - RNA, 27 nt, Artificial Sequence
  Proteasome subunit beta type-7 (103-111)
cgcaugcugaagcagaugcucuuccgg

SEQ ID NO: 51179 - RNA, 33 nt, Artificial Sequence
  cDNA FLJ78342 (112-122)
cgcaugcugcagaucagcgaguccagcuuccuc

SEQ ID NO: 51180 - RNA, 33 nt, Artificial Sequence
  rRNA-processing protein FCF1 homolog (15-25)
cgcaugcugagccuccgggaccagcgccugaag

SEQ ID NO: 51181 - RNA, 30 nt, Artificial Sequence
  Meiotic nuclear division protein 1 homolog (15-24)
cgcaugauggagaucuucagcgagaccaag

SEQ ID NO: 51182 - RNA, 33 nt, Artificial Sequence
  Zinc finger FYVE domain-containing protein 16 (812-822)
cgcaugaugagccccaccggcuccaaccugaag

SEQ ID NO: 51183 - RNA, 27 nt, Artificial Sequence
  DNA replication ATP-dependent helicase/nuclease DNA2 (828-836)
cgcaugaacagcaagaucaugucccug

SEQ ID NO: 51184 - RNA, 33 nt, Artificial Sequence
  WAS protein family homolog 1 (5-15)
cgcaugcagcacagccuggccggccagaccuac

SEQ ID NO: 51185 - RNA, 27 nt, Artificial Sequence
  Neuron navigator 2 (1941-1949)
cgcaugcagagcgagaucgagaagcug

SEQ ID NO: 51186 - RNA, 27 nt, Artificial Sequence
  28 kDa heat- and acid-stable phosphoprotein (173-181)
cgcaugcagagccugucccucaacaag

SEQ ID NO: 51187 - RNA, 39 nt, Artificial Sequence
  cDNA FLJ57726, highly similar to Heterogeneous nuclear ribonucleoprotein H3 (32-44)
cgcaugcgggacggccgcgggaugggcgggcacggcuac

SEQ ID NO: 51188 - RNA, 27 nt, Artificial Sequence
  Histone-lysine N-methyltransferase EHMT2 (42-50)
cgcaugagcgacgacgugcacucccug

SEQ ID NO: 51189 - RNA, 27 nt, Artificial Sequence
  La-related protein 4 (502-510)
cgcaugagcgacguggucaagggcgug

SEQ ID NO: 51190 - RNA, 48 nt, Artificial Sequence
  Casein kinase I isoform delta (394-409)
cgcaugagcaccucccagaacagcauccccuucgagcaccacggcaag

SEQ ID NO: 51191 - RNA, 27 nt, Artificial Sequence
  Nucleophosmin (277-285)
cgcaugaccgaccaggaggccauccag

SEQ ID NO: 51192 - RNA, 30 nt, Artificial Sequence
  DNA mismatch repair protein Msh6 (302-311)
cgcauggugaccggcaacgggagccugaag

SEQ ID NO: 51193 - RNA, 33 nt, Artificial Sequence
  Mesencephalic astrocyte-derived neurotrophic factor (3-13)
cgcaugugggccacccagggccuggccguggcg

SEQ ID NO: 51194 - RNA, 27 nt, Artificial Sequence
  Arginine/serine-rich coiled-coil protein 2 (170-178)
cgcaaccuggacgcccaguacgagaug

SEQ ID NO: 51195 - RNA, 51 nt, Artificial Sequence
  Melanocyte protein PMEL (241-257)
cgcaaccagccccugaccuucgcccuccagcugcacgacccgagcggcuac

SEQ ID NO: 51196 - RNA, 27 nt, Artificial Sequence
  Keratin, type I cytoskeletal 10 (99-107)
cgcaacgugagcaccggcgacgucaac

SEQ ID NO: 51197 - RNA, 27 nt, Artificial Sequence
  Dystonin (4836-4844)
cgccaggccgaggaguuccacagcgug

SEQ ID NO: 51198 - RNA, 27 nt, Artificial Sequence
  Stathmin-3 (130-138)
cgccaggccgaggagaagcugaacuac

SEQ ID NO: 51199 - RNA, 27 nt, Artificial Sequence
  Elongation factor 1-gamma (99-107)
cgccaggccuuccccaacaccaaccgg

SEQ ID NO: 51200 - RNA, 27 nt, Artificial Sequence
  A-kinase anchor protein 10, mitochondrial (481-489)
cgccaggccuggaccaccauggagaag

SEQ ID NO: 51201 - RNA, 27 nt, Artificial Sequence
  Vimentin (207-215)
cgccaggacguggacaacgccagccug

SEQ ID NO: 51202 - RNA, 27 nt, Artificial Sequence
  Acidic fibroblast growth factor intracellular-binding protein (136-144)
cgccaguucgacaacuucaagcgggug

SEQ ID NO: 51203 - RNA, 24 nt, Artificial Sequence
  Lysine-specific demethylase 5B (878-885)
cgccaguucgugacccagcuguac

SEQ ID NO: 51204 - RNA, 27 nt, Artificial Sequence
  Fibronectin type III domain-containing protein 3B (198-206)
cgccagaucgaccggcagaaccgccug

SEQ ID NO: 51205 - RNA, 30 nt, Artificial Sequence
  Cytochrome P450 2U1 (288-297)
cgccagaucgagaaggacaucaccagcuuc

SEQ ID NO: 51206 - RNA, 24 nt, Artificial Sequence
  Interferon alpha-inducible protein 6 (2-9)
cgccagaaggccgugagccuguuc

SEQ ID NO: 51207 - RNA, 27 nt, Artificial Sequence
  THAP domain-containing protein 1 (175-183)
cgccagcuggagaagcucaaggaggug

SEQ ID NO: 51208 - RNA, 33 nt, Artificial Sequence
  3-hydroxy-3-methylglutaryl-coenzyme A reductase (84-94)
cgccagcugggcagcaaguacauccucgggauc

SEQ ID NO: 51209 - RNA, 27 nt, Artificial Sequence
  Protein FAM32A (72-80)
cgccagauggagcggauccugaagaag

SEQ ID NO: 51210 - RNA, 27 nt, Artificial Sequence
  Splicing factor 3A subunit 1 (72-80)
cgccagaacgagaucaacaaccccaag

SEQ ID NO: 51211 - RNA, 27 nt, Artificial Sequence
  Spectrin beta chain, non-erythrocytic 1 (1161-1169)
cgccagaaccugcucagccagucccac

SEQ ID NO: 51212 - RNA, 27 nt, Artificial Sequence
  Unconventional myosin-X (252-260)
cgccagaaccccggcgagcggaacuac

SEQ ID NO: 51213 - RNA, 30 nt, Artificial Sequence
  Phosphatidylinositol-binding clathrin assembly protein (139-148)
cgccagguggccuucgacuucaccaagguc

SEQ ID NO: 51214 - RNA, 27 nt, Artificial Sequence
  Hom s 2 (98-106)
cgccaggugaccggcgucacccgggug

SEQ ID NO: 51215 - RNA, 30 nt, Artificial Sequence
  Alpha-actinin-1 (672-681)
cgccaguacgagaagagcaucgugaacuac

SEQ ID NO: 51216 - RNA, 27 nt, Artificial Sequence
  Protein CREG2 (251-259)
cgccaguacgagugguucuucaugaag

SEQ ID NO: 51217 - RNA, 27 nt, Artificial Sequence
  Transmembrane emp24 domain-containing protein 4 (92-100)
cgccaguacggcagcgaggggcgguuc

SEQ ID NO: 51218 - RNA, 27 nt, Artificial Sequence
  Bromodomain adjacent to zinc finger domain protein 2B (487-495)
cgccaguaccccgaggugaucaaguac

SEQ ID NO: 51219 - RNA, 27 nt, Artificial Sequence
  Myb-binding protein 1A (59-67)
cgccgggacuuccagauccgcgugcug

SEQ ID NO: 51220 - RNA, 27 nt, Artificial Sequence
  FLYWCH-type zinc finger-containing protein 1 (137-145)
cgccggggccccgggccgcugacccuc

SEQ ID NO: 51221 - RNA, 27 nt, Artificial Sequence
  NEDD8 ultimate buster 1 (431-439)
cgccggcuggagaacauccgcuuccuc

SEQ ID NO: 51222 - RNA, 27 nt, Artificial Sequence
  Tribbles homolog 2 (31-39)
cgcagcgccgagcccucccagagcuuc

SEQ ID NO: 51223 - RNA, 27 nt, Artificial Sequence
  Adenylate kinase 2, mitochondrial (175-183)
cgcagcgacgacaacgagaaggcccug

SEQ ID NO: 51224 - RNA, 33 nt, Artificial Sequence
  Rhomboid-like protein (64-74)
cgcagcgaccccggcaccuccggggaggccuac

SEQ ID NO: 51225 - RNA, 33 nt, Artificial Sequence
  THO complex subunit 5 homolog (27-37)
cgcagcgacaccgagcaggagggcaaguacuac

SEQ ID NO: 51226 - RNA, 27 nt, Artificial Sequence
  Serine/threonine-protein kinase VRK2 (112-120)
cgcagcgacguggagauccugggcuac

SEQ ID NO: 51227 - RNA, 39 nt, Artificial Sequence
  Eukaryotic translation initiation factor 3 subunit E (431-443)
cgcagcgaggcccccaacugggccacccaggacuccggc

SEQ ID NO: 51228 - RNA, 39 nt, Artificial Sequence
  Annexin A1 (303-315)
cgcagcgagaucgacaugaacgacaucaaggccuucuac

SEQ ID NO: 51229 - RNA, 30 nt, Artificial Sequence
  Protein LAP2 (1012-1021)
cgcagcgaguccaccgagaaccagagcuac

SEQ ID NO: 51230 - RNA, 27 nt, Artificial Sequence
  Zinc finger and BTB domain-containing protein 17 (362-370)
cgcagcuucuccgaccccaccagcaag

SEQ ID NO: 51231 - RNA, 33 nt, Artificial Sequence
  Acyl-coenzyme A thioesterase THEM4 (34-44)
cgcagcuucuccagcgaggaggugauccugaag

SEQ ID NO: 51232 - RNA, 27 nt, Artificial Sequence
  Hypoxia-inducible factor 1-alpha (30-38)
cgcagcaaggaguccgagguguucuac

SEQ ID NO: 51233 - RNA, 27 nt, Artificial Sequence
  Tubulin-tyrosine ligase-like protein 12 (425-433)
cgcagccuggacacccacgugaccaag

SEQ ID NO: 51234 - RNA, 33 nt, Artificial Sequence
  UHRF1-binding protein 1 (558-568)
cgcagccuggagcaguucaaggccaucuacaag

SEQ ID NO: 51235 - RNA, 27 nt, Artificial Sequence
  EWS RNA-binding protein variant 6 (391-399)
cgcagccugcgguacuacuacgagaag

SEQ ID NO: 51236 - RNA, 33 nt, Artificial Sequence
  Transmembrane protein 131 (709-719)
cgcagccuguccgaggacgugcgguucuacuac

SEQ ID NO: 51237 - RNA, 27 nt, Artificial Sequence
  Solute carrier family 25 member 35 (270-278)
cgcagccuguacuacaccgacaccaag

SEQ ID NO: 51238 - RNA, 27 nt, Artificial Sequence
  Phospholipid hydroperoxide glutathione peroxidase, mitochondrial (39-47)
cgcagcaugcacgaguucuccgccaag

SEQ ID NO: 51239 - RNA, 27 nt, Artificial Sequence
  Ubiquitin-like protein 7 (210-218)
cgcagcaugcccuccagcuccuaccgg

SEQ ID NO: 51240 - RNA, 27 nt, Artificial Sequence
  Baculoviral IAP repeat-containing protein 6 (3123-3131)
cgcagcaugguguccaccaucaugaag

SEQ ID NO: 51241 - RNA, 27 nt, Artificial Sequence
  Testis-specific Y-encoded protein 1 (206-214)
cgcagcaaccccuacuuccagaacaag

SEQ ID NO: 51242 - RNA, 27 nt, Artificial Sequence
  Eukaryotic translation initiation factor 2 subunit 2 (285-293)
cgcagccccgacaccauccugcagaag

SEQ ID NO: 51243 - RNA, 36 nt, Artificial Sequence
  Myb-binding protein 1A (545-556)
cgcagccccucccugcuccagagcggcgccaagaag

SEQ ID NO: 51244 - RNA, 30 nt, Artificial Sequence
  Histone acetyltransferase KAT2A (279-288)
cgcagccaggccgaggacguggccaccuac

SEQ ID NO: 51245 - RNA, 27 nt, Artificial Sequence
  Sorting nexin-17 (193-201)
cgcagccaggaguacaagaucgugcug

SEQ ID NO: 51246 - RNA, 48 nt, Artificial Sequence
  Cold-inducible RNA-binding protein (145-160)
cgcagccaguccggcggguacagcgaccgguccagcggcggguccuac

SEQ ID NO: 51247 - RNA, 39 nt, Artificial Sequence
  Heterogeneous nuclear ribonucleoprotein A1-like 2 (131-143)
cgcagcuccggccccuacgggggcgggggccaguacuuc

SEQ ID NO: 51248 - RNA, 27 nt, Artificial Sequence
  Solute carrier family 22 member 18 (22-30)
cgcagcuccgugauccugcucaccuac

SEQ ID NO: 51249 - RNA, 30 nt, Artificial Sequence
  Lysine-specific histone demethylase 1A (632-641)
cgcagcaccucccagaccuucaucuacaag

SEQ ID NO: 51250 - RNA, 27 nt, Artificial Sequence
  Butyrophilin subfamily 2 member A2 (135-143)
cgcagcuacgacgaggccauccugcgg

SEQ ID NO: 51251 - RNA, 30 nt, Artificial Sequence
  Butyrophilin subfamily 2 member A2 (135-144)
cgcagcuacgacgaggccauccugcggcuc

SEQ ID NO: 51252 - RNA, 27 nt, Artificial Sequence
  Vacuolar protein sorting-associated protein 52 homolog (301-309)
cgcagcuaccugggccggcucaugaag

SEQ ID NO: 51253 - RNA, 33 nt, Artificial Sequence
  CDKN2AIP N-terminal-like protein (28-38)
cgcagcuacuccgagagcgagaagcaguggaag

SEQ ID NO: 51254 - RNA, 36 nt, Artificial Sequence
  Vimentin (28-39)
cgcagcuacgugaccaccuccacgcggaccuacagc

SEQ ID NO: 51255 - RNA, 33 nt, Artificial Sequence
  Ribosome biogenesis protein BOP1 (9-19)
cgcaccgccgcccccagcgugcggccggagaag

SEQ ID NO: 51256 - RNA, 33 nt, Artificial Sequence
  Myelin basic protein (92-102)
cgcaccgcccacuacggcagccugccccagaag

SEQ ID NO: 51257 - RNA, 51 nt, Artificial Sequence
  HIRA-interacting protein 3 (190-206)
cgcaccgccuggaacccccugggcgaggccgcgccgcccggggagcucuac

SEQ ID NO: 51258 - RNA, 27 nt, Artificial Sequence
  WD repeat-containing protein 91 (7-15)
cgcaccgacgagcuggugcgggaguac

SEQ ID NO: 51259 - RNA, 27 nt, Artificial Sequence
  Protein FAM199X (55-63)
cgcaccgacccccugcaccgguuccac

SEQ ID NO: 51260 - RNA, 39 nt, Artificial Sequence
  Sodium/potassium/calcium exchanger 5 (203-215)
cgcaccgacagcggcaucuucuacgaggacuccggguac

SEQ ID NO: 51261 - RNA, 36 nt, Artificial Sequence
  Multivesicular body subunit 12B (107-118)
cgcaccgacuacgaguaccagcacagcaaccuguac

SEQ ID NO: 51262 - RNA, 30 nt, Artificial Sequence
  Upstream stimulatory factor 1 (52-61)
cgcaccgagaacggcgggcaggugauguac

SEQ ID NO: 51263 - RNA, 33 nt, Artificial Sequence
  Upstream stimulatory factor 2 (69-79)
cgcaccgagaccaacggcgggcaggugacguac

SEQ ID NO: 51264 - RNA, 36 nt, Artificial Sequence
  Plexin-C1 (1024-1035)
cgcaccuucuuccccgagagcggcggguucacccac

SEQ ID NO: 51265 - RNA, 30 nt, Artificial Sequence
  Spatacsin (651-660)
cgcaccuucaugaucaaguuccccuggaag

SEQ ID NO: 51266 - RNA, 30 nt, Artificial Sequence
  Cytoplasmic dynein 1 heavy chain 1 (4159-4168)
cgcaccuucagcuccauccccgugagccgg

SEQ ID NO: 51267 - RNA, 27 nt, Artificial Sequence
  Abhydrolase domain-containing protein 2 (144-152)
cgcaccuucguggacuacgcccagaag

SEQ ID NO: 51268 - RNA, 27 nt, Artificial Sequence
  Probable ATP-dependent RNA helicase DDX5 (559-567)
cgcaccggcaaccccaccgggacguac

SEQ ID NO: 51269 - RNA, 33 nt, Artificial Sequence
  Ras-related protein Rab-1B (48-58)
cgcaccaucgagcuggacggcaagaccaucaag

SEQ ID NO: 51270 - RNA, 42 nt, Artificial Sequence
  NADH dehydrogenase (ubiquinone) 1 beta subcomplex subunit 4 (72-85)
cgcaccaucaacguguaccccaacuuccggccgacccccaag

SEQ ID NO: 51271 - RNA, 39 nt, Artificial Sequence
  S-adenosylmethionine decarboxylase proenzyme (33-45)
cgcaccaucccccggagcgagugggacauccugcucaag

SEQ ID NO: 51272 - RNA, 27 nt, Artificial Sequence
  Midasin (1582-1590)
cgcacccuguucaaguucaugaagaag

SEQ ID NO: 51273 - RNA, 27 nt, Artificial Sequence
  DNA dC-dU-editing enzyme APOBEC-3B (183-191)
cgcacccugaaggagauccuccgguac

SEQ ID NO: 51274 - RNA, 33 nt, Artificial Sequence
  Disintegrin and metalloproteinase domain-containing protein 10 (147-157)
cgcacccugcccuuccacagcgugaucuaccac

SEQ ID NO: 51275 - RNA, 33 nt, Artificial Sequence
  BTB/POZ domain-containing adapter for CUL3-mediated RhoA degradation protein 1 (57-67)
cgcacccugaccggccaggacacgaugcucaag

SEQ ID NO: 51276 - RNA, 42 nt, Artificial Sequence
  Heat shock protein HSP 90-beta (32-45)
cgcacccugacccucguggacacgggcaucgggaugaccaag

SEQ ID NO: 51277 - RNA, 36 nt, Artificial Sequence
  UDP-N-acetylhexosamine pyrophosphorylase (169-180)
cgcaccauggagagcaccaaggaguucuucacgaag

SEQ ID NO: 51278 - RNA, 33 nt, Artificial Sequence
  Hypoxia-inducible factor 1-alpha (180-190)
cgcaccaugaacaucaagagcgccaccuggaag

SEQ ID NO: 51279 - RNA, 27 nt, Artificial Sequence
  Spindle and centriole-associated protein 1 (657-665)
cgcaccaacgagagccugauccagcgg

SEQ ID NO: 51280 - RNA, 30 nt, Artificial Sequence
  COBW domain-containing protein 2 (353-362)
cgcaccaaccggcuggugcuccugggccgc

SEQ ID NO: 51281 - RNA, 30 nt, Artificial Sequence
  Alpha-adducin (193-202)
cgcacccccagcuuccugaagaaguccaag

SEQ ID NO: 51282 - RNA, 27 nt, Artificial Sequence
  Programmed cell death 6-interacting protein (478-486)
cgcacccccagcaacgagcuguacaag

SEQ ID NO: 51283 - RNA, 36 nt, Artificial Sequence
  Leucine zipper putative tumor suppressor 1 (432-443)
cgcacccaggaccuggagggcgcccuccggaccaag

SEQ ID NO: 51284 - RNA, 27 nt, Artificial Sequence
  Protein disulfide-isomerase A4 (155-163)
cgcacccaggaggagaucguggccaag

SEQ ID NO: 51285 - RNA, 33 nt, Artificial Sequence
  Glycerol kinase (118-128)
cgcacccagagcaccguggagucccugagcaag

SEQ ID NO: 51286 - RNA, 30 nt, Artificial Sequence
  E3 ubiquitin-protein ligase DZIP3 (287-296)
cgcacccaguacaacgagcagaucaacaag

SEQ ID NO: 51287 - RNA, 27 nt, Artificial Sequence
  SHC SH2 domain-binding protein 1 (434-442)
cgcaccagcgccgaguuccugaugaag

SEQ ID NO: 51288 - RNA, 30 nt, Artificial Sequence
  Microtubule-associated protein 1B (1897-1906)
cgcaccagcgacgugggcggguacuacuac

SEQ ID NO: 51289 - RNA, 27 nt, Artificial Sequence
  Phosphatidylinositol 3-kinase regulatory subunit beta (469-477)
cgcaccagccaggagcugcagaugaag

SEQ ID NO: 51290 - RNA, 33 nt, Artificial Sequence
  Plakophilin-4 (455-465)
cgcaccagcucccagcggagcacccugacguac

SEQ ID NO: 51291 - RNA, 27 nt, Artificial Sequence
  (E3-independent) E2 ubiquitin-conjugating enzyme (103-111)
cgcaccaccgacaucgugauccggauc

SEQ ID NO: 51292 - RNA, 33 nt, Artificial Sequence
  Uncharacterized protein KIAA1211 (15-25)
cgcaccaccagcugggccaaguccaagcuguuc

SEQ ID NO: 51293 - RNA, 27 nt, Artificial Sequence
  Eukaryotic translation initiation factor 3 subunit E (74-82)
cgcaccaccguggucgcccagcugaag

SEQ ID NO: 51294 - RNA, 33 nt, Artificial Sequence
  Dolichyl-diphosphooligosaccharide-proteinosyltransferase subunit 1 (38-48)
cgcaccguggaccugagcucccaccucgccaag

SEQ ID NO: 51295 - RNA, 30 nt, Artificial Sequence
  28S ribosomal protein S24, mitochondrial (77-86)
cgcaccguggaggacgucuuccugcggaag

SEQ ID NO: 51296 - RNA, 33 nt, Artificial Sequence
  Serpin B6 (125-135)
cgcaccguggagaaggagcugaccuacgagaag

SEQ ID NO: 51297 - RNA, 30 nt, Artificial Sequence
  Ribosome biogenesis protein BOP1 (389-398)
cgcaccgugcccgucggcgggguggugaag

SEQ ID NO: 51298 - RNA, 27 nt, Artificial Sequence
  Histone-lysine N-methyltransferase SETMAR (106-114)
cgcaccgugcaguggugguucaagaag

SEQ ID NO: 51299 - RNA, 30 nt, Artificial Sequence
  Kinesin-like protein KIF22 (23-32)
cgcaccgugaccggcgccaagccccugaag

SEQ ID NO: 51300 - RNA, 27 nt, Artificial Sequence
  Ubiquitin-like-conjugating enzyme ATG3 (198-206)
cgcaccuacgaccuguacaucaccuac

SEQ ID NO: 51301 - RNA, 27 nt, Artificial Sequence
  Phosphatidylinositol 4-kinase alpha (889-897)
cgcaccuacgacaugauccaguacuac

SEQ ID NO: 51302 - RNA, 33 nt, Artificial Sequence
  Serine-protein kinase ATM (2034-2044)
cgcaccuacgagcacgaggccauguggggcaag

SEQ ID NO: 51303 - RNA, 30 nt, Artificial Sequence
  Vimentin (36-45)
cgcaccuacagccugggcuccgcccuccgg

SEQ ID NO: 51304 - RNA, 33 nt, Artificial Sequence
  Protein-methionine sulfoxide oxidase MICAL3 (192-202)
cgcaccuacaccgaggaggagcugaacgccaag

SEQ ID NO: 51305 - RNA, 30 nt, Artificial Sequence
  Nucleolar and coiled-body phosphoprotein 1 (638-647)
cgcguggccgacaacagcuucgacgccaag

SEQ ID NO: 51306 - RNA, 27 nt, Artificial Sequence
  Arginine vasopressin-induced protein 1 (66-74)
cgcguggccgaggcccugaagcggcuc

SEQ ID NO: 51307 - RNA, 27 nt, Artificial Sequence
  Chondroitin sulfate synthase 3 (30-38)
cgcguggccgagcugagcgagcggaag

SEQ ID NO: 51308 - RNA, 27 nt, Artificial Sequence
  Caspase-9 (236-244)
cgcguggccaacgccgucagcgugaag

SEQ ID NO: 51309 - RNA, 39 nt, Artificial Sequence
  Caspase-9 (236-248)
cgcguggccaacgccgucagcgugaagggcaucuacaag

SEQ ID NO: 51310 - RNA, 33 nt, Artificial Sequence
  7-dehydrocholesterol reductase (339-349)
cgcguggccaaccaccagaaggaccuguuccgg

SEQ ID NO: 51311 - RNA, 33 nt, Artificial Sequence
  SHC-transforming protein 3 (55-65)
cgcgugugcgaggccguccccggcgccaagggg

SEQ ID NO: 51312 - RNA, 30 nt, Artificial Sequence
  Transmembrane protein 98 (138-147)
cgcguggacgacgucgugaagagcauguac

SEQ ID NO: 51313 - RNA, 30 nt, Artificial Sequence
  Protein OS-9 (16-25)
cgcguggacgagccccugagcugcuccuac

SEQ ID NO: 51314 - RNA, 27 nt, Artificial Sequence
  Eukaryotic peptide chain release factor subunit 1 (402-410)
cgcguggacuuccagggcauggaguac

SEQ ID NO: 51315 - RNA, 33 nt, Artificial Sequence
  Nuclear fragile X mental retardation-interacting protein 2 (272-282)
cgcguggacggcagcaagcccaucuggaaguac

SEQ ID NO: 51316 - RNA, 30 nt, Artificial Sequence
  COP9 signalosome complex subunit 1 (484-493)
cgcguggacagccacuccaagauccuguac

SEQ ID NO: 51317 - RNA, 30 nt, Artificial Sequence
  Brefeldin A-inhibited guanine nucleotide-exchange protein 1 (1662-1671)
cgcguggacacccaggaccagggcauguac

SEQ ID NO: 51318 - RNA, 27 nt, Artificial Sequence
  Coiled-coil domain-containing protein 127 (252-260)
cgcguggaggaggccauccuggagaag

SEQ ID NO: 51319 - RNA, 33 nt, Artificial Sequence
  Copine-1 (267-277)
cgcguggagaccgaguacagcuuccuggacuac

SEQ ID NO: 51320 - RNA, 30 nt, Artificial Sequence
  Tumor protein D53 (48-57)
cgcguggagaccaccgucacgagccugaag

SEQ ID NO: 51321 - RNA, 30 nt, Artificial Sequence
  Chromobox protein homolog 6 (9-18)
cgcguguucgccgccgagagcaucaucaag

SEQ ID NO: 51322 - RNA, 27 nt, Artificial Sequence
  Eukaryotic initiation factor 4A-III (166-174)
cgcguguucgacaugauccggcgccgg

SEQ ID NO: 51323 - RNA, 30 nt, Artificial Sequence
  DNA topoisomerase 3-beta-1 (263-272)
cgcguguucgaccgggagaucgcccagaug

SEQ ID NO: 51324 - RNA, 27 nt, Artificial Sequence
  Annexin A1 (235-243)
cgcguguuccagaaguacaccaaguac

SEQ ID NO: 51325 - RNA, 30 nt, Artificial Sequence
  Hermansky-Pudlak syndrome 5 protein (137-146)
cgcguguucgucggcgaccacgccgggaag

SEQ ID NO: 51326 - RNA, 36 nt, Artificial Sequence
  Non-specific lipid-transfer protein (13-24)
cgcguguucgucgugggcguggggaugaccaaguuc

SEQ ID NO: 51327 - RNA, 27 nt, Artificial Sequence
  Receptor activity-modifying protein 2 (18-26)
cgcgugggccggcccgccgcccugcgc

SEQ ID NO: 51328 - RNA, 36 nt, Artificial Sequence
  ATP-dependent RNA helicase DDX3X (407-418)
cgcgugggcagcaccuccgagaacaucacccagaag

SEQ ID NO: 51329 - RNA, 27 nt, Artificial Sequence
  Dol-P-Man:Man(5)GlcNAc(2)-PP-Dol alpha-1,3-mannosyltransferase (115-123)
cgcgugcacagcaucuucguccugcgg

SEQ ID NO: 51330 - RNA, 30 nt, Artificial Sequence
  Lon protease homolog 2, peroxisomal (197-206)
cgcgugaucgccauccggcccauccgccgg

SEQ ID NO: 51331 - RNA, 27 nt, Artificial Sequence
  B-cell lymphoma 3 protein (267-275)
cgcgugaucgacauccugcggggcaag

SEQ ID NO: 51332 - RNA, 36 nt, Artificial Sequence
  Serine/threonine-protein kinase TBK1 (143-154)
cgcgugaucggcgaggacgggcagagcgucuacaag

SEQ ID NO: 51333 - RNA, 39 nt, Artificial Sequence
  Stress-70 protein, mitochondrial (218-230)
cgcgugaucaacgagcccaccgccgccgcgcuggccuac

SEQ ID NO: 51334 - RNA, 33 nt, Artificial Sequence
  Synembryn-A (493-503)
cgcgugauccagcccaugggcaugagcccgcgg

SEQ ID NO: 51335 - RNA, 33 nt, Artificial Sequence
  GDP-fucose protein O-fucosyltransferase 1 (101-111)
cgcgugaucagccuggaggacuucauggagaag

SEQ ID NO: 51336 - RNA, 36 nt, Artificial Sequence
  Creatine kinase M-type (236-247)
cgcgugaucagcauggagaagggcgggaacaugaag

SEQ ID NO: 51337 - RNA, 36 nt, Artificial Sequence
  COX assembly mitochondrial protein 2 homolog (63-74)
cgcgugaucgucacccacggcagccugaagcucaag

SEQ ID NO: 51338 - RNA, 27 nt, Artificial Sequence
  ENTH domain-containing protein 1 (376-384)
cgcgugaaggagaucgucaucaacaag

SEQ ID NO: 51339 - RNA, 36 nt, Artificial Sequence
  Epidermal growth factor receptor substrate 15 (33-44)
cgcgugcuggccagcgacgccgcggccuuccucaag

SEQ ID NO: 51340 - RNA, 30 nt, Artificial Sequence
  Transient receptor potential cation channel subfamily M member 1 (871-880)
cgcgugcuggacaucuucggcgucaacaag

SEQ ID NO: 51341 - RNA, 33 nt, Artificial Sequence
  Anaphase-promoting complex subunit 2 (163-173)
cgcgugcuggaccccagcauggucauccucgag

SEQ ID NO: 51342 - RNA, 36 nt, Artificial Sequence
  Monofunctional C1-tetrahydrofolate synthase, mitochondrial (497-508)
cgcgugcuggacaccaacgaccgguuccuccgcaag

SEQ ID NO: 51343 - RNA, 30 nt, Artificial Sequence
  Uncharacterized protein C19orf52 (162-171)
cgcgugcuggacgucggcuucguggggcgg

SEQ ID NO: 51344 - RNA, 27 nt, Artificial Sequence
  Paired amphipathic helix protein Sin3b (506-514)
cgcgugcuggagagcguccagaagaag

SEQ ID NO: 51345 - RNA, 33 nt, Artificial Sequence
  Nipped-B-like protein (1779-1789)
cgcgugcugggcgagaacgccaucgccguccgg

SEQ ID NO: 51346 - RNA, 27 nt, Artificial Sequence
  Interferon-stimulated gene 20 kDa protein (131-139)
cgcgugcugagcgagcggcuccugcac

SEQ ID NO: 51347 - RNA, 30 nt, Artificial Sequence
  Interferon-stimulated gene 20 kDa protein (131-140)
cgcgugcugagcgagcggcuccugcacaag

SEQ ID NO: 51348 - RNA, 27 nt, Artificial Sequence
  14-3-3 protein sigma (60-68)
cgcgugcugagcuccaucgagcagaag

SEQ ID NO: 51349 - RNA, 33 nt, Artificial Sequence
  Guanine nucleotide-binding protein G(s) subunit alpha isoforms short (187-197)
cgcgugcugaccagcggcaucuucgagaccaag

SEQ ID NO: 51350 - RNA, 27 nt, Artificial Sequence
  T lymphocyte c-maf long form (21-29)
cgcgugcugaccagcgucuucaccaag

SEQ ID NO: 51351 - RNA, 27 nt, Artificial Sequence
  Beta-parvin (351-359)
cgcgugcuguacaaccucuucaccaag

SEQ ID NO: 51352 - RNA, 33 nt, Artificial Sequence
  B-cell CLL/lymphoma 7 protein family member A (20-30)
cgcgugauggccgccaucgagaagguccggaag

SEQ ID NO: 51353 - RNA, 33 nt, Artificial Sequence
  Nuclear transcription factor Y subunit gamma (25-35)
cgcgugauggaggagauccggaaccugaccguc

SEQ ID NO: 51354 - RNA, 33 nt, Artificial Sequence
  Poly (ADP-ribose) polymerase 4 (419-429)
cgcgugaacgagaccaccgaguuccugagcaag

SEQ ID NO: 51355 - RNA, 30 nt, Artificial Sequence
  Ceramide synthase 5 (379-388)
cgcgugaacggccacauggggggcagcuac

SEQ ID NO: 51356 - RNA, 27 nt, Artificial Sequence
  Cytoplasmic dynein 1 heavy chain 1 (759-767)
cgcgugccccuggccaucgucaacaag

SEQ ID NO: 51357 - RNA, 30 nt, Artificial Sequence
  Protein scribble homolog (161-170)
cgcgugccccaggccgagggcccgcccaag

SEQ ID NO: 51358 - RNA, 33 nt, Artificial Sequence
  Phosphatidylinositol 3-kinase regulatory subunit gamma (209-219)
cgcgugcaggccgaggaccugcucuacggcaag

SEQ ID NO: 51359 - RNA, 30 nt, Artificial Sequence
  Large neutral amino acids transporter small subunit 1 (195-204)
cgcgugcaggacgccuucgccgcggccaag

SEQ ID NO: 51360 - RNA, 36 nt, Artificial Sequence
  ATPase family AAA domain-containing protein 3A (605-616)
cgcgugcaggacgccguccagcagcaccagcagaag

SEQ ID NO: 51361 - RNA, 33 nt, Artificial Sequence
  Fibronectin type III domain-containing protein 3B (271-281)
cgcgugcaggacauccugagcggcaucgagaag

SEQ ID NO: 51362 - RNA, 27 nt, Artificial Sequence
  6-phosphofructo-2-kinase/fructose-2,6-bisphosphatase 2 (228-236)
cgcgugcaggacuacauccagagcaag

SEQ ID NO: 51363 - RNA, 33 nt, Artificial Sequence
  Probable ATP-dependent RNA helicase DHX37 (767-777)
cgcgugcagagcgaggagaugcuggaggacaag

SEQ ID NO: 51364 - RNA, 30 nt, Artificial Sequence
  Charged multivesicular body protein 1b (75-84)
cgcgugcagaccgccgucaccaugggcaag

SEQ ID NO: 51365 - RNA, 42 nt, Artificial Sequence
  28S ribosomal protein S29, mitochondrial (232-245)
cgcgugcggaacgccaccgacgccgucggcaucgugcugaag

SEQ ID NO: 51366 - RNA, 27 nt, Artificial Sequence
  F-box only protein 21 (77-85)
cgcgugcgguggcccagccugaugaag

SEQ ID NO: 51367 - RNA, 30 nt, Artificial Sequence
  Platelet-activating factor acetylhydrolase 2, cytoplasmic (188-197)
cgcgugagcgagugccugcggguccucaag

SEQ ID NO: 51368 - RNA, 27 nt, Artificial Sequence
  ADP-ribosylation factor GTPase-activating protein 1 (148-156)
cgcgugagcggccagccccaguccguc

SEQ ID NO: 51369 - RNA, 27 nt, Artificial Sequence
  DNA polymerase delta catalytic subunit (537-545)
cgcgugaccggcgucccccugagcuac

SEQ ID NO: 51370 - RNA, 30 nt, Artificial Sequence
  E3 ubiquitin-protein ligase MIB2 (258-267)
cgcguggucgacauccggggcugggacgug

SEQ ID NO: 51371 - RNA, 27 nt, Artificial Sequence
  NADH dehydrogenase (ubiquinone) 1 alpha subcomplex subunit 6 (77-85)
cgcguggucgaccugcucgugaucaag

SEQ ID NO: 51372 - RNA, 33 nt, Artificial Sequence
  Lysine-specific histone demethylase 1B (420-430)
cgcgugugggacgacaagagcuucaagggcguc

SEQ ID NO: 51373 - RNA, 33 nt, Artificial Sequence
  Coatomer subunit alpha (160-170)
cgcgugugggacaucagcggccugcggaagaag

SEQ ID NO: 51374 - RNA, 39 nt, Artificial Sequence
  ATP-binding cassette sub-family B member 8, mitochondrial (669-681)
cgcgugugggaggccggcacccacgaggagcugcucaag

SEQ ID NO: 51375 - RNA, 30 nt, Artificial Sequence
  Methyltransferase-like protein 8 (334-343)
cgcguguggauccagggcaaguuccagaag

SEQ ID NO: 51376 - RNA, 30 nt, Artificial Sequence
  Charged multivesicular body protein 1a (46-55)
cgcguguacgccgagaacgccauccggaag

SEQ ID NO: 51377 - RNA, 27 nt, Artificial Sequence
  Neuferricin (62-70)
cgcguguacgacgucagcuccggccgg

SEQ ID NO: 51378 - RNA, 27 nt, Artificial Sequence
  Formin-binding protein 1-like (96-104)
cgcguguacggcgagcugaugcgguac

SEQ ID NO: 51379 - RNA, 30 nt, Artificial Sequence
  Actin filament-associated protein 1-like 2 (535-544)
cgcguguaccuggaccucacccccgucaag

SEQ ID NO: 51380 - RNA, 33 nt, Artificial Sequence
  Transcription termination factor 2 (414-424)
cgcguguaccugaccacccagcucaagcagaag

SEQ ID NO: 51381 - RNA, 27 nt, Artificial Sequence
  Follistatin-related protein 5 (344-352)
cgcguguaccccgagagccaggcccgg

SEQ ID NO: 51382 - RNA, 33 nt, Artificial Sequence
  Serine/threonine-protein kinase pim-1 (296-306)
cgcguguacagccccccggaguggauccgguac

SEQ ID NO: 51383 - RNA, 30 nt, Artificial Sequence
  Epidermal growth factor receptor kinase substrate 8 (772-781)
cgcguguacagccagaucaccguccagaag

SEQ ID NO: 51384 - RNA, 33 nt, Artificial Sequence
  Bifunctional 3'-phosphoadenosine 5'-phosphosulfate synthase 1 (386-396)
cgcguguacuggaacgacggccuggaccaguac

SEQ ID NO: 51385 - RNA, 27 nt, Artificial Sequence
  ATP-binding cassette sub-family B member 6, mitochondrial (144-152)
cgcuaccgggaggccaucaucaaguac

SEQ ID NO: 51386 - RNA, 27 nt, Artificial Sequence
  Melanoma inhibitory activity protein 3 (1397-1405)
agcgccgccgaggaggugaagaccuac

SEQ ID NO: 51387 - RNA, 27 nt, Artificial Sequence
  Transketolase (43-51)
agcgccgccgagaucauggcggugcug

SEQ ID NO: 51388 - RNA, 27 nt, Artificial Sequence
  Kinesin-like protein KIFC3 (471-479)
agcgccgccgagaucuacaacgaggug

SEQ ID NO: 51389 - RNA, 27 nt, Artificial Sequence
  Protein fem-1 homolog C (91-99)
agcgccgccggccaccugaaggugguc

SEQ ID NO: 51390 - RNA, 27 nt, Artificial Sequence
  E3 ubiquitin-protein ligase AMFR (606-614)
agcgccgacgagcgccagcggaugcug

SEQ ID NO: 51391 - RNA, 33 nt, Artificial Sequence
  Laminin subunit beta-3 (706-716)
agcgccgaccccuccggcgccuuccgcaugcug

SEQ ID NO: 51392 - RNA, 27 nt, Artificial Sequence
  GRIP and coiled-coil domain-containing protein 2 (1284-1292)
agcgccgagcagcaccagcgcacccug

SEQ ID NO: 51393 - RNA, 27 nt, Artificial Sequence
  Mortality factor 4-like protein 2 (280-288)
agcgccgaguaccaccgcaaggcccug

SEQ ID NO: 51394 - RNA, 33 nt, Artificial Sequence
  Coiled-coil domain-containing protein 77 (190-200)
agcgccuucaaggccgaccccaagaucuccaag

SEQ ID NO: 51395 - RNA, 33 nt, Artificial Sequence
  Versican core protein (1221-1231)
agcgccuucaagcccuccagcgccaucaccaag

SEQ ID NO: 51396 - RNA, 30 nt, Artificial Sequence
  Zinc finger protein 703 (400-409)
agcgcccacgaccccgccggcccgucccug

SEQ ID NO: 51397 - RNA, 27 nt, Artificial Sequence
  Transcription factor 20 (608-616)
agcgcccacgagcccggcgggucccug

SEQ ID NO: 51398 - RNA, 36 nt, Artificial Sequence
  Probable cation-transporting ATPase 13A3 (802-813)
agcgccaucgaccccgaggccaucccggugaagcug

SEQ ID NO: 51399 - RNA, 27 nt, Artificial Sequence
  Protein AATF (141-149)
agcgccaagacccccggcuucuccgug

SEQ ID NO: 51400 - RNA, 30 nt, Artificial Sequence
  Ras-specific guanine nucleotide-releasing factor 1 (254-263)
agcgcccuggagaucgccgagcagcucacc

SEQ ID NO: 51401 - RNA, 36 nt, Artificial Sequence
  Fc receptor-like A (117-128)
agcgcccugggccccccggggcccaaccgcgaguuc

SEQ ID NO: 51402 - RNA, 33 nt, Artificial Sequence
  Vimentin (42-52)
agcgcccugcgccccuccaccagccggucccuc

SEQ ID NO: 51403 - RNA, 39 nt, Artificial Sequence
  Vimentin (42-54)
agcgcccugcgccccuccaccagccggucccucuacgcc

SEQ ID NO: 51404 - RNA, 33 nt, Artificial Sequence
  Actin-related protein 2/3 complex subunit 1A (298-308)
agcgccauggagcgcuuccggaacauggacaag

SEQ ID NO: 51405 - RNA, 27 nt, Artificial Sequence
  Fatty acid synthase (2039-2047)
agcgccauggagcgcaucugcgagaag

SEQ ID NO: 51406 - RNA, 30 nt, Artificial Sequence
  Cytoplasmic dynein 1 heavy chain 1 (1505-1514)
agcgccaugaagcugucccccuacuacaag

SEQ ID NO: 51407 - RNA, 30 nt, Artificial Sequence
  Syntenin-1 (23-32)
agcgccaaccccgccaacccggcgauccug

SEQ ID NO: 51408 - RNA, 30 nt, Artificial Sequence
  Vacuole membrane protein 1 isoform 8 (83-92)
agcgcccaggacuucgccucccgcgcgaag

SEQ ID NO: 51409 - RNA, 30 nt, Artificial Sequence
  HLA class I histocompatibility antigen, alpha chain E (339-348)
agcgcccagggcuccgagagccacucccug

SEQ ID NO: 51410 - RNA, 27 nt, Artificial Sequence
  ATP-dependent RNA helicase DDX54 (145-153)
agcgcccagaccggcgcccgcgcgcug

SEQ ID NO: 51411 - RNA, 27 nt, Artificial Sequence
  Poly(rC)-binding protein 2 (254-262)
agcgcccagaccaccucccacgagcug

SEQ ID NO: 51412 - RNA, 27 nt, Artificial Sequence
  ADP-dependent glucokinase (213-221)
agcgccuccggcccccacagcucccug

SEQ ID NO: 51413 - RNA, 30 nt, Artificial Sequence
  Nodal modulator 3 (166-175)
agcgccguggaguuccgccagaccggcuac

SEQ ID NO: 51414 - RNA, 30 nt, Artificial Sequence
  Histone acetyltransferase type B catalytic subunit (16-25)
agcgccguggagaagaagcuggccgaguac

SEQ ID NO: 51415 - RNA, 27 nt, Artificial Sequence
  ADP-ribosylation factor-binding protein GGA1 (288-296)
agcgccgugcccaaggucaugaaggug

SEQ ID NO: 51416 - RNA, 27 nt, Artificial Sequence
  Ankyrin repeat domain-containing protein 20B (272-280)
agcgccguguccaucuuccacgagcug

SEQ ID NO: 51417 - RNA, 27 nt, Artificial Sequence
  Long-chain-fatty-acid-CoA ligase 3 (66-74)
agcgccuaccgcuccgugaacagccug

SEQ ID NO: 51418 - RNA, 33 nt, Artificial Sequence
  Ribulose-phosphate 3-epimerase (186-196)
agcgaggacccccgcuccgugaucaaccugcuc

SEQ ID NO: 51419 - RNA, 30 nt, Artificial Sequence
  WD repeat and FYVE domain-containing protein 1 (43-52)
agcgaggaccgcaccauccggguguggcug

SEQ ID NO: 51420 - RNA, 30 nt, Artificial Sequence
  Clathrin heavy chain 1 (825-834)
agcgaggacgugaucaagaaccugauccuc

SEQ ID NO: 51421 - RNA, 30 nt, Artificial Sequence
  Microtubule-associated protein 4 (230-239)
agcgaggagcgccccccggcccaggcccug

SEQ ID NO: 51422 - RNA, 30 nt, Artificial Sequence
  Cortactin-binding protein 2 (232-241)
agcgaguucgacaccgagcgcgagcagcug

SEQ ID NO: 51423 - RNA, 27 nt, Artificial Sequence
  Ubiquitin carboxyl-terminal hydrolase 48 (254-262)
agcgaguuccugaaggaggagaagcuc

SEQ ID NO: 51424 - RNA, 39 nt, Artificial Sequence
  55 kDa erythrocyte membrane protein (6-18)
agcgagggcgaguccgggggcagcaugcacaccgcccug

SEQ ID NO: 51425 - RNA, 27 nt, Artificial Sequence
  Copper transport protein ATOX1 (44-52)
agcgagcacuccauggacacccugcuc

SEQ ID NO: 51426 - RNA, 39 nt, Artificial Sequence
  Ventricular zone-expressed PH domain-containing protein homolog 1 (106-118)
agcgagaucgacccccugggccaggggaacgacaagcuc

SEQ ID NO: 51427 - RNA, 27 nt, Artificial Sequence
  Prolyl 3-hydroxylase OGFOD1 (290-298)
agcgagauccugcucaaggaguuccug

SEQ ID NO: 51428 - RNA, 27 nt, Artificial Sequence
  Nucleolar protein 10 (225-233)
agcgagaucaacucccugcccaccauc

SEQ ID NO: 51429 - RNA, 33 nt, Artificial Sequence
  Leucine-rich repeat LGI family member 3 (77-87)
agcgagauccaggacggcgccuucucccaccug

SEQ ID NO: 51430 - RNA, 27 nt, Artificial Sequence
  Serine-protein kinase ATM (707-715)
agcgagaucaccaacuccgagacccug

SEQ ID NO: 51431 - RNA, 30 nt, Artificial Sequence
  Nuclear pore complex protein Nup50 (255-264)
agcgagaagaagaccgaccccuccagccug

SEQ ID NO: 51432 - RNA, 24 nt, Artificial Sequence
  Talin-1 (1958-1965)
agcgagaaggugucccacguccug

SEQ ID NO: 51433 - RNA, 30 nt, Artificial Sequence
  Protein strawberry notch homolog 1 (911-920)
agcgagcuggacgugcccgucgagauccuc

SEQ ID NO: 51434 - RNA, 33 nt, Artificial Sequence
  Protein S100-B (31-41)
agcgagcugaaggagcucaucaacaacgagcug

SEQ ID NO: 51435 - RNA, 33 nt, Artificial Sequence
  U2 snRNP-associated SURP motif-containing protein (401-411)
agcgagauguccgaggagaagcgcgccaagcug

SEQ ID NO: 51436 - RNA, 27 nt, Artificial Sequence
  Protein piccolo (3378-3386)
agcgagaacucccagcaccuggagcuc

SEQ ID NO: 51437 - RNA, 30 nt, Artificial Sequence
  Mitotic checkpoint serine/threonine-protein kinase BUB1 (159-168)
agcgagccccugcacaacgugcagguccuc

SEQ ID NO: 51438 - RNA, 33 nt, Artificial Sequence
  Gap junction beta-1 protein (253-263)
agcgagcaggacggcucccugaaggacauccuc

SEQ ID NO: 51439 - RNA, 36 nt, Artificial Sequence
  Transformation/transcription domain-associated protein (434-445)
agcgagcaggaguccggcaacgggcgcgacgugcug

SEQ ID NO: 51440 - RNA, 27 nt, Artificial Sequence
  Multidrug resistance-associated protein 4 (13-21)
agcgagacccccacccugcagggccuc

SEQ ID NO: 51441 - RNA, 36 nt, Artificial Sequence
  Vitamin K epoxide reductase complex subunit 1 (44-55)
agcuuccgcaaggugcaggagccccagggcaaggcc

SEQ ID NO: 51442 - RNA, 27 nt, Artificial Sequence
  POTE ankyrin domain family member F (855-863)
agcggcgacggggugacccacaccguc

SEQ ID NO: 51443 - RNA, 27 nt, Artificial Sequence
  Disabled homolog 2 (538-546)
agcggcuucucccagcccgugaucuuc

SEQ ID NO: 51444 - RNA, 42 nt, Artificial Sequence
  Heterogeneous nuclear ribonucleoprotein U-like protein 1 (662-675)
agcggcgggggcggguacucccagaaccgcuggggcaacaac

SEQ ID NO: 51445 - RNA, 45 nt, Artificial Sequence
  Prelamin-A/C (483-497)
agcggcgggggcuccuucggggacaaccuggugacccgcagcuac

SEQ ID NO: 51446 - RNA, 42 nt, Artificial Sequence
  Keratin, type II cytoskeletal 1 (604-617)
agcggcgggggcuccagcgggggcuccaucgggggccgcggc

SEQ ID NO: 51447 - RNA, 39 nt, Artificial Sequence
  Cold-inducible RNA-binding protein (148-160)
agcggcggguacuccgaccgcagcuccggcgggagcuac

SEQ ID NO: 51448 - RNA, 45 nt, Artificial Sequence
  Serine/threonine-protein phosphatase PP1-beta catalytic subunit (311-325)
agcggccgccccgugaccccgccccggaccgccaacccccccaag

SEQ ID NO: 51449 - RNA, 30 nt, Artificial Sequence
  Frataxin, mitochondrial (81-90)
agcggcacccuggggcaccccggcucccuc

SEQ ID NO: 51450 - RNA, 39 nt, Artificial Sequence
  Caprin-1 (663-675)
agcggcuaccagcgcgacggguaccagcagaacuucaag

SEQ ID NO: 51451 - RNA, 27 nt, Artificial Sequence
  Protein kinase C delta-binding protein (70-78)
agccacgacaccaccuccaacacgcug

SEQ ID NO: 51452 - RNA, 30 nt, Artificial Sequence
  E3 ubiquitin-protein ligase TRIM32 (566-575)
agccacuucuucuccgagaacgaggacuuc

SEQ ID NO: 51453 - RNA, 30 nt, Artificial Sequence
  ATP-dependent RNA helicase DDX42 (307-316)
agccacgugcgccccgaccggcagacccug

SEQ ID NO: 51454 - RNA, 27 nt, Artificial Sequence
  Transmembrane protein 147 (87-95)
agcaucgacuccaacaucagccuggug

SEQ ID NO: 51455 - RNA, 27 nt, Artificial Sequence
  Neuron navigator 2 (1236-1244)
agcaucgacuccaacaucagcuccaag

SEQ ID NO: 51456 - RNA, 36 nt, Artificial Sequence
  Fructose-bisphosphate aldolase A (46-57)
agcaucggcaccgagaacaccgaggagaaccgccgg

SEQ ID NO: 51457 - RNA, 27 nt, Artificial Sequence
  Septin-9 (321-329)
agcauccacuucgaggccuaccgcgug

SEQ ID NO: 51458 - RNA, 30 nt, Artificial Sequence
  Lanosterol 14-alpha demethylase (173-182)
agcaucaucgagaaggagaccaaggaguac

SEQ ID NO: 51459 - RNA, 27 nt, Artificial Sequence
  Heterogeneous nuclear ribonucleoprotein K (401-409)
agcaucaucggcaaggggggccagcgc

SEQ ID NO: 51460 - RNA, 33 nt, Artificial Sequence
  Interleukin-1 receptor accessory protein (317-327)
agcaucaagaaggugaccuccgaggaccugaag

SEQ ID NO: 51461 - RNA, 33 nt, Artificial Sequence
  Ubiquitin carboxyl-terminal hydrolase 11 (519-529)
agcauccuggaccgcgacgacaucuucguguac

SEQ ID NO: 51462 - RNA, 33 nt, Artificial Sequence
  Mortality factor 4-like protein 1 (192-202)
agcauccuggaggacuacgccaacuacaagaag

SEQ ID NO: 51463 - RNA, 39 nt, Artificial Sequence
  Protein transport protein Sec31A (332-344)
agcaucaugggcggguccaccgacggccugcgccagaag

SEQ ID NO: 51464 - RNA, 27 nt, Artificial Sequence
  Casein kinase I isoform delta (401-409)
agcauccccuucgagcaccacggcaag

SEQ ID NO: 51465 - RNA, 30 nt, Artificial Sequence
  Protein maestro (14-23)
agcauccccaccucccagccgaagcagaag

SEQ ID NO: 51466 - RNA, 30 nt, Artificial Sequence
  Inosine-5'-monophosphate dehydrogenase 1 (531-540)
agcauccaggacaagggcuccauccagaag

SEQ ID NO: 51467 - RNA, 30 nt, Artificial Sequence
  NHP2-like protein 1 (118-127)
agcauccagcaguccaucgagcgccugcuc

SEQ ID NO: 51468 - RNA, 39 nt, Artificial Sequence
  ATP synthase F(0) complex subunit B1, mitochondrial (226-238)
agcaucuccacccagcaggagaaggagaccaucgccaag

SEQ ID NO: 51469 - RNA, 36 nt, Artificial Sequence
  StAR-related lipid transfer protein 13 (339-350)
agcaucuacgacaacgugcccggcucccaccuguac

SEQ ID NO: 51470 - RNA, 36 nt, Artificial Sequence
  Carboxypeptidase Q (211-222)
agcaucuacuccccccacaccggcauccaggaguac

SEQ ID NO: 51471 - RNA, 39 nt, Artificial Sequence
  Keratin, type I cytoskeletal 10 (148-160)
agcaaggagcugaccaccgagaucgacaacaacaucgag

SEQ ID NO: 51472 - RNA, 27 nt, Artificial Sequence
  Receptor-interacting serine/threonine-protein kinase 1 (376-384)
agcaagcugcaggacgaggccaacuac

SEQ ID NO: 51473 - RNA, 39 nt, Artificial Sequence
  CDK5 regulatory subunit-associated protein 2 (133-145)
agccuggccgaggccggcggguccgagauccagcgcgug

SEQ ID NO: 51474 - RNA, 27 nt, Artificial Sequence
  MICAL-like protein 2 (22-30)
agccuggccgaguucucccuccugaag

SEQ ID NO: 51475 - RNA, 33 nt, Artificial Sequence
  Wiskott-Aldrich syndrome protein family member 2 (67-77)
agccuggccgagcgcguggaccggcuccagguc

SEQ ID NO: 51476 - RNA, 24 nt, Artificial Sequence
  Nucleolar protein 11 (286-293)
agccugugccccgaccucauggag

SEQ ID NO: 51477 - RNA, 27 nt, Artificial Sequence
  Insulin-degrading enzyme (224-232)
agccuggacgaccucaccaaccuggug

SEQ ID NO: 51478 - RNA, 27 nt, Artificial Sequence
  Signal peptidase complex subunit 2 (59-67)
agccuggacgacuccgccaagaaggug

SEQ ID NO: 51479 - RNA, 33 nt, Artificial Sequence
  Signal peptidase complex subunit 2 (59-69)
agccuggacgacuccgccaagaaggugcuccug

SEQ ID NO: 51480 - RNA, 27 nt, Artificial Sequence
  Sodium/potassium-transporting ATPase subunit alpha-1 (47-55)
agccuggacgagcuccaccgcaaguac

SEQ ID NO: 51481 - RNA, 27 nt, Artificial Sequence
  Transmembrane protein 132B (241-249)
agccuggacgagaugguggucuccgug

SEQ ID NO: 51482 - RNA, 27 nt, Artificial Sequence
  GREB1-like protein (74-82)
agccuggacuucuccaacaaccucacc

SEQ ID NO: 51483 - RNA, 27 nt, Artificial Sequence
  2'-5'-oligoadenylate synthase 2 (123-131)
agccuggacggcuucaccauccaggug

SEQ ID NO: 51484 - RNA, 27 nt, Artificial Sequence
  Angio-associated migratory cell protein (93-101)
agccuggaccccaagaccaacacccuc

SEQ ID NO: 51485 - RNA, 21 nt, Artificial Sequence
  Eukaryotic translation initiation factor 3 subunit C-like protein (835-841)
agccuggaccagcccacccag

SEQ ID NO: 51486 - RNA, 27 nt, Artificial Sequence
  Regulator of nonsense transcripts 2 (992-1000)
agccuggaggaguccauccgccaggug

SEQ ID NO: 51487 - RNA, 36 nt, Artificial Sequence
  Heterogeneous nuclear ribonucleoprotein M (536-547)
agccuggagcgcaugggccucgagcggaugggggcc

SEQ ID NO: 51488 - RNA, 39 nt, Artificial Sequence
  Heterogeneous nuclear ribonucleoprotein M (536-548)
agccuggagcgcaugggccucgagcggaugggggccaac

SEQ ID NO: 51489 - RNA, 27 nt, Artificial Sequence
  ATP-sensitive inward rectifier potassium channel 10 (186-194)
agccuguucgaccagguggucaaggug

SEQ ID NO: 51490 - RNA, 36 nt, Artificial Sequence
  Inositol 1,4,5-trisphosphate receptor type 3 (365-376)
agccuguucgagcucgaccccaccacccugcagaag

SEQ ID NO: 51491 - RNA, 30 nt, Artificial Sequence
  Utrophin (249-258)
agccuguucgaggugcucccccagcagguc

SEQ ID NO: 51492 - RNA, 27 nt, Artificial Sequence
  Microtubule-associated tumor suppressor 1 (694-702)
agccuguuccucggcuccgccagcaag

SEQ ID NO: 51493 - RNA, 27 nt, Artificial Sequence
  V-type proton ATPase 116 kDa subunit a isoform 1 (555-563)
agccuguucaaccacaucuacuucaag

SEQ ID NO: 51494 - RNA, 27 nt, Artificial Sequence
  Ventricular zone-expressed PH domain-containing protein homolog 1 (252-260)
agccuguuccccgagccgcucuccauc

SEQ ID NO: 51495 - RNA, 30 nt, Artificial Sequence
  Eukaryotic translation initiation factor 3 subunit E (218-227)
agccuguucguguucuucaaccaccccaag

SEQ ID NO: 51496 - RNA, 27 nt, Artificial Sequence
  Metalloproteinase inhibitor 3 (15-23)
agccugggcgacuggggggccgaggcc

SEQ ID NO: 51497 - RNA, 27 nt, Artificial Sequence
  Ran GTPase-activating protein 1 (102-110)
agccugggcgaggggcucaucaccgcc

SEQ ID NO: 51498 - RNA, 30 nt, Artificial Sequence
  Homeobox protein SEBOX (201-210)
agccugggcucccucagcgaccugaucuac

SEQ ID NO: 51499 - RNA, 27 nt, Artificial Sequence
  Nuclear receptor subfamily 4 group A member 1 (492-500)
agccugcacucccuccugguggacguc

SEQ ID NO: 51500 - RNA, 27 nt, Artificial Sequence
  Carboxypeptidase M (303-311)
agccugaucgaguacaucaagcaggug

SEQ ID NO: 51501 - RNA, 30 nt, Artificial Sequence
  Zinc finger FYVE domain-containing protein 16 (160-169)
agccugaucggccucgaccuguccagcgug

SEQ ID NO: 51502 - RNA, 27 nt, Artificial Sequence
  Src kinase-associated phosphoprotein 2 (47-55)
agccugaucaagaagaucaaggacgug

SEQ ID NO: 51503 - RNA, 27 nt, Artificial Sequence
  Small glutamine-rich tetratricopeptide repeat-containing protein beta (33-41)
agccugaucaacaaccccgccuucauc

SEQ ID NO: 51504 - RNA, 27 nt, Artificial Sequence
  Anoctamin-4 (154-162)
agccugaucaacuccgacaucaucuuc

SEQ ID NO: 51505 - RNA, 30 nt, Artificial Sequence
  Anoctamin-4 (154-163)
agccugaucaacuccgacaucaucuucgug

SEQ ID NO: 51506 - RNA, 33 nt, Artificial Sequence
  Serine/threonine-protein kinase Sgk1 (451-461)
agccugaucaacugggacgaccucaucaacaag

SEQ ID NO: 51507 - RNA, 33 nt, Artificial Sequence
  Probable global transcription activator SNF2L1 (137-147)
agccugaucuccgccggcgacuaccgccaccgg

SEQ ID NO: 51508 - RNA, 27 nt, Artificial Sequence
  Lambda-crystallin homolog (73-81)
agccugaucuccggcugccccaacauc

SEQ ID NO: 51509 - RNA, 30 nt, Artificial Sequence
  Alpha-aminoadipic semialdehyde dehydrogenase (196-205)
agccugaucuccguggccgucaccaagauc

SEQ ID NO: 51510 - RNA, 30 nt, Artificial Sequence
  Endonuclease G, mitochondrial (288-297)
agccugaaggccaucaccgccggcuccaag

SEQ ID NO: 51511 - RNA, 27 nt, Artificial Sequence
  Cysteine protease ATG4C (177-185)
agccugaaggagaccaucggcaaguac

SEQ ID NO: 51512 - RNA, 27 nt, Artificial Sequence
  DNA-directed RNA polymerase II subunit RPB11-a (99-107)
agccugcucgaggagcgcuuccgggug

SEQ ID NO: 51513 - RNA, 27 nt, Artificial Sequence
  Nuclear receptor subfamily 4 group A member 3 (230-238)
agccugcucggcgagucccccagccug

SEQ ID NO: 51514 - RNA, 27 nt, Artificial Sequence
  Protein naked cuticle homolog 1 (158-166)
agccugcuccacaccaucuacgaggug

SEQ ID NO: 51515 - RNA, 30 nt, Artificial Sequence
  IL6ST nirs variant 1 (26-35)
agccugcucaucgccaagcagaacgugacc

SEQ ID NO: 51516 - RNA, 27 nt, Artificial Sequence
  Protein transport protein Sec23A (156-164)
agccugcuccccccgaccgcccuggug

SEQ ID NO: 51517 - RNA, 30 nt, Artificial Sequence
  E3 ubiquitin-protein ligase UBR1 (683-692)
agccugauggaccccaacaaguuccuccug

SEQ ID NO: 51518 - RNA, 36 nt, Artificial Sequence
  Abhydrolase domain-containing protein 2 (299-310)
agccugaugcagaucgacgacaacgugaugcgcaag

SEQ ID NO: 51519 - RNA, 27 nt, Artificial Sequence
  Fatty acid synthase (1570-1578)
agccugaacuuccgcgacaucaugcuc

SEQ ID NO: 51520 - RNA, 27 nt, Artificial Sequence
  Putative segment polarity protein dishevelled homolog DVL1P1 (246-254)
agccugaacaucaucaccgugacccuc

SEQ ID NO: 51521 - RNA, 45 nt, Artificial Sequence
  Integrin alpha-6 (599-613)
agccugcccgaggugcucccgauccugaacuccgacgagcccaag

SEQ ID NO: 51522 - RNA, 36 nt, Artificial Sequence
  60S ribosomal protein L38 (59-70)
agccugcccccgggccucgccgugaaggagcugaag

SEQ ID NO: 51523 - RNA, 27 nt, Artificial Sequence
  Transcription cofactor HES-6 (44-52)
agccugcaggagcuccgccugcugcuc

SEQ ID NO: 51524 - RNA, 30 nt, Artificial Sequence
  Anaphase-promoting complex subunit 1 (60-69)
agccugcaggaggugaccauccacgagaag

SEQ ID NO: 51525 - RNA, 27 nt, Artificial Sequence
  Nestin (24-32)
agccugcagaaggagaaccaggagcuc

SEQ ID NO: 51526 - RNA, 33 nt, Artificial Sequence
  Uncharacterized protein C17orf98 (105-115)
agccugcagcaggugaccggccacgaccacuac

SEQ ID NO: 51527 - RNA, 27 nt, Artificial Sequence
  RING finger protein 10 (254-262)
agccuguccgagaagaccuggagcaag

SEQ ID NO: 51528 - RNA, 27 nt, Artificial Sequence
  Putative ATP-dependent RNA helicase TDRD12 (1100-1108)
agccugucccagacccccccgcgcgug

SEQ ID NO: 51529 - RNA, 30 nt, Artificial Sequence
  Alpha-crystallin B chain (129-138)
agccuguccagcgacggcgugcucaccguc

SEQ ID NO: 51530 - RNA, 27 nt, Artificial Sequence
  PWWP domain-containing protein MUM1 (280-288)
agccugaccgcccccccggcccccgag

SEQ ID NO: 51531 - RNA, 30 nt, Artificial Sequence
  Probable ATP-dependent RNA helicase DHX40 (351-360)
agccugaccaucgacggcauccgcuacgug

SEQ ID NO: 51532 - RNA, 33 nt, Artificial Sequence
  Integrator complex subunit 7 (196-206)
agccugguggacacccccaagcagauccagcuc

SEQ ID NO: 51533 - RNA, 30 nt, Artificial Sequence
  Transcobalamin-1 (223-232)
agccugguggagaagauccucuccgagaag

SEQ ID NO: 51534 - RNA, 33 nt, Artificial Sequence
  Vacuolar protein sorting-associated protein 41 homolog (618-628)
agccuguacgccgaguacgaccgccccaaccuc

SEQ ID NO: 51535 - RNA, 33 nt, Artificial Sequence
  Spermine synthase (309-319)
agccuguacgaggagcagcucggccgccuguac

SEQ ID NO: 51536 - RNA, 33 nt, Artificial Sequence
  General transcription factor 3C polypeptide 3 (259-269)
agccuguacgagcagaugggcgaccacaagaug

SEQ ID NO: 51537 - RNA, 27 nt, Artificial Sequence
  COP9 signalosome complex subunit 3 (281-289)
agccuguacaagaagaacauccagcgc

SEQ ID NO: 51538 - RNA, 30 nt, Artificial Sequence
  P2X purinoceptor 7 (286-295)
agccuguaccccggcuacaacuuccgcuac

SEQ ID NO: 51539 - RNA, 27 nt, Artificial Sequence
  Death-inducer obliterator 1 (1135-1143)
agccuguacuccuacuucagcucccgc

SEQ ID NO: 51540 - RNA, 30 nt, Artificial Sequence
  Protein prune homolog 2 (269-278)
agccuguacaccgaggacaugacccagaag

SEQ ID NO: 51541 - RNA, 27 nt, Artificial Sequence
  Protein argonaute-2 (566-574)
agcauggacgcccaccccaaccgcuac

SEQ ID NO: 51542 - RNA, 27 nt, Artificial Sequence
  Protein argonaute-1 (615-623)
agcauggacgcccaccccucccgcuac

SEQ ID NO: 51543 - RNA, 27 nt, Artificial Sequence
  5,6-dihydroxyindole-2-carboxylic acid oxidase (506-514)
agcauggacgaggccaaccagccccug

SEQ ID NO: 51544 - RNA, 30 nt, Artificial Sequence
  Kinesin-like protein KIF13A (63-72)
agcauggacgaguccaacaccaccaaguac

SEQ ID NO: 51545 - RNA, 27 nt, Artificial Sequence
  Protein argonaute-4 (609-617)
agcauggacggccaccccucccgcuac

SEQ ID NO: 51546 - RNA, 27 nt, Artificial Sequence
  Serine-protein kinase ATM (2549-2557)
agcauggaccacccccaccacacccug

SEQ ID NO: 51547 - RNA, 27 nt, Artificial Sequence
  V-type proton ATPase 116 kDa subunit a isoform 3 (340-348)
agcauggaggagggcguguccgccguc

SEQ ID NO: 51548 - RNA, 36 nt, Artificial Sequence
  RNA-binding protein EWS (350-361)
agcauguucggcucccccgggggccugcgcgaggcc

SEQ ID NO: 51549 - RNA, 33 nt, Artificial Sequence
  Ribosome-binding protein 1 (32-42)
agcaugaaggagaccuccuacgaggaggcccug

SEQ ID NO: 51550 - RNA, 30 nt, Artificial Sequence
  Caprin-1 (376-385)
agcaugcuggacuucgagaaccagacccuc

SEQ ID NO: 51551 - RNA, 27 nt, Artificial Sequence
  Protein GREB1 (500-508)
agcaugcugggcgaggagauccagcuc

SEQ ID NO: 51552 - RNA, 27 nt, Artificial Sequence
  Cystine/glutamate transporter (330-338)
agcaugaacggcgggguguucgccguc

SEQ ID NO: 51553 - RNA, 30 nt, Artificial Sequence
  Myosin-10 (371-380)
agcaugcccgagaacaccguggcccagaag

SEQ ID NO: 51554 - RNA, 27 nt, Artificial Sequence
  T-complex protein 1 subunit alpha (155-163)
agcauguccagcaagaucaucggcauc

SEQ ID NO: 51555 - RNA, 30 nt, Artificial Sequence
  Liprin-alpha-1 (1169-1178)
agcauguccagccccuccaugcagccgaag

SEQ ID NO: 51556 - RNA, 27 nt, Artificial Sequence
  Protein PAT1 homolog 1 (499-507)
agcauguacgacaaccugcgcggcaag

SEQ ID NO: 51557 - RNA, 45 nt, Artificial Sequence
  Heterogeneous nuclear ribonucleoprotein A1-like 2 (99-113)
agcaacuucggcgggggcggguccuacaacgacuucggcaacuac

SEQ ID NO: 51558 - RNA, 27 nt, Artificial Sequence
  Catenin beta-1 (605-613)
agccccaucgagaacauccagcgcgug

SEQ ID NO: 51559 - RNA, 27 nt, Artificial Sequence
  Pleckstrin homology-like domain family A member 2 (42-50)
agcccccgcgcccggccgaaggagcug

SEQ ID NO: 51560 - RNA, 30 nt, Artificial Sequence
  Clathrin heavy chain 1 (1427-1436)
agcccccgccuggaccacacccgggccgug

SEQ ID NO: 51561 - RNA, 39 nt, Artificial Sequence
  Arginine/serine-rich protein 1 (18-30)
agccccuccaccagccgcuccggcgggagcucccggcug

SEQ ID NO: 51562 - RNA, 27 nt, Artificial Sequence
  Disabled homolog 2 (471-479)
agccccaccggccagccgaccgcccug

SEQ ID NO: 51563 - RNA, 45 nt, Artificial Sequence
  Transgelin-2 (185-199)
agccaggccggcaugaccggguacggcaugccccgccagauccug

SEQ ID NO: 51564 - RNA, 27 nt, Artificial Sequence
  Transmembrane protein 8A (50-58)
agccaggccccccagcgccuguccuuc

SEQ ID NO: 51565 - RNA, 27 nt, Artificial Sequence
  Serine/threonine-protein phosphatase 4 regulatory subunit 2 (5-13)
agccaguucaagggcuacuucaucuuc

SEQ ID NO: 51566 - RNA, 36 nt, Artificial Sequence
  Copine-8 (260-271)
agccaguucaacguguacgaggucgugaaccccaag

SEQ ID NO: 51567 - RNA, 30 nt, Artificial Sequence
  Transmembrane protein 131 (402-411)
agccaguucuccggcaagaucaccgugaag

SEQ ID NO: 51568 - RNA, 27 nt, Artificial Sequence
  Ragulator complex protein LAMTOR1 (73-81)
agccagggcauggagcagcacgaguac

SEQ ID NO: 51569 - RNA, 39 nt, Artificial Sequence
  Catenin alpha-1 (268-280)
agccagcaccagggcgggggcgggggcgagcuggccuac

SEQ ID NO: 51570 - RNA, 27 nt, Artificial Sequence
  Protein NPAT (417-425)
agccagaucuccaccagcauccagaag

SEQ ID NO: 51571 - RNA, 27 nt, Artificial Sequence
  A-kinase anchor protein 9 (687-695)
agccagaagaucgagaccaugcaguuc

SEQ ID NO: 51572 - RNA, 33 nt, Artificial Sequence
  TSC22 domain family protein 1 (1018-1028)
agccagcuggagcaggagaacaaccuccugaag

SEQ ID NO: 51573 - RNA, 27 nt, Artificial Sequence
  Tubulin-specific chaperone E (124-132)
agccagcuguccaagcuccaggaggug

SEQ ID NO: 51574 - RNA, 30 nt, Artificial Sequence
  Phosphatidylinositol-binding clathrin assembly protein (520-529)
agccagaaccagaaccugcccguggccaag

SEQ ID NO: 51575 - RNA, 30 nt, Artificial Sequence
  Heat shock protein HSP 90-alpha (575-584)
agccagaaccgcaagaagcuguccgagcuc

SEQ ID NO: 51576 - RNA, 27 nt, Artificial Sequence
  Clathrin interactor 1 (459-467)
agccagaacaccgacauggugcagaag

SEQ ID NO: 51577 - RNA, 27 nt, Artificial Sequence
  Rotatin (918-926)
agccagcaguccagccugcucaccgug

SEQ ID NO: 51578 - RNA, 45 nt, Artificial Sequence
  Cold-inducible RNA-binding protein (146-160)
agccaguccggcggguacagcgaccgcuccagcggcggguccuac

SEQ ID NO: 51579 - RNA, 24 nt, Artificial Sequence
  Neuron navigator 2 (999-1006)
agccagguggagcgcaacucccug

SEQ ID NO: 51580 - RNA, 30 nt, Artificial Sequence
  Microtubule-actin cross-linking factor 1 (2589-2598)
agccaggugcagaaggagcugcaguccauc

SEQ ID NO: 51581 - RNA, 30 nt, Artificial Sequence
  Rho GTPase-activating protein 5 (922-931)
agccaguaccaccgccagaccgagguguuc

SEQ ID NO: 51582 - RNA, 30 nt, Artificial Sequence
  Histone-lysine N-methyltransferase setd3 (208-217)
agccaguacaagaacaccgcccgccaguac

SEQ ID NO: 51583 - RNA, 27 nt, Artificial Sequence
  Protein unc-45 homolog A (578-586)
agccgccuggaggagcgguccgugcuc

SEQ ID NO: 51584 - RNA, 51 nt, Artificial Sequence
  ELL-associated factor 1 (232-248)
agccgccccgccguggccaacggcaccucccggccgcaggggagcaaccag

SEQ ID NO: 51585 - RNA, 51 nt, Artificial Sequence
  Cold-inducible RNA-binding protein (144-160)
agccgcucccagagcggcggguacuccgaccggagcuccggcgggagcuac

SEQ ID NO: 51586 - RNA, 27 nt, Artificial Sequence
  Phosphatase and actin regulator (216-224)
agcuccgccaagcccggcccggcccug

SEQ ID NO: 51587 - RNA, 30 nt, Artificial Sequence
  LIM domain-binding protein 3 (265-274)
agcuccgcccccgccacccacaccagcuac

SEQ ID NO: 51588 - RNA, 27 nt, Artificial Sequence
  Serine incorporator 5 (337-345)
agcuccgacgcccugcagggccgcuac

SEQ ID NO: 51589 - RNA, 30 nt, Artificial Sequence
  F-box-like/WD repeat-containing protein TBL1XR1 (4-13)
agcuccgacgaggugaacuuccuggucuac

SEQ ID NO: 51590 - RNA, 30 nt, Artificial Sequence
  Poly (ADP-ribose) polymerase 1 (4-13)
agcuccgacaagcuguaccgcguggaguac

SEQ ID NO: 51591 - RNA, 27 nt, Artificial Sequence
  ATP-dependent RNA helicase DDX18 (602-610)
agcuccgacagccgccaguucucccac

SEQ ID NO: 51592 - RNA, 27 nt, Artificial Sequence
  Heterogeneous nuclear ribonucleoprotein H2 (441-449)
agcuccgacuaccagagcaaccuggcc

SEQ ID NO: 51593 - RNA, 33 nt, Artificial Sequence
  Tyrosinase (146-156)
agcuccgacuacgugauccccaucggcaccuac

SEQ ID NO: 51594 - RNA, 27 nt, Artificial Sequence
  Nesprin-2 (2105-2113)
agcuccgaggccccccuggugcagaag

SEQ ID NO: 51595 - RNA, 33 nt, Artificial Sequence
  Osteopontin (26-36)
agcuccgaggagaagcagcuguacaacaaguac

SEQ ID NO: 51596 - RNA, 27 nt, Artificial Sequence
  Carbohydrate sulfotransferase 11 (323-331)
agcuccgagcaccagacccagcuguac

SEQ ID NO: 51597 - RNA, 30 nt, Artificial Sequence
  Serine/threonine-protein kinase PLK2 (666-675)
agcuccgagcugaagaaccgcauggaguac

SEQ ID NO: 51598 - RNA, 27 nt, Artificial Sequence
  Neuron navigator 2 (1837-1845)
agcuccuucaagcaggccuucggcaag

SEQ ID NO: 51599 - RNA, 27 nt, Artificial Sequence
  Protein GREB1 (296-304)
agcuccuuccgcccccugcucagcaag

SEQ ID NO: 51600 - RNA, 42 nt, Artificial Sequence
  Keratin, type I cytoskeletal 10 (370-383)
agcuccggcagcgugggggaguccagcuccaagggcccccgc

SEQ ID NO: 51601 - RNA, 24 nt, Artificial Sequence
  Olfactory receptor 52E1 (66-73)
agcuccaucgaccccggccugagc

SEQ ID NO: 51602 - RNA, 27 nt, Artificial Sequence
  E3 ubiquitin-protein ligase HUWE1 (114-122)
agcuccaucgagcaccugaccacccuc

SEQ ID NO: 51603 - RNA, 27 nt, Artificial Sequence
  Zinc finger FYVE domain-containing protein 16 (841-849)
agcuccauccccagcccggccacccug

SEQ ID NO: 51604 - RNA, 36 nt, Artificial Sequence
  HBS1-like protein (521-532)
agcuccaagcugggcaagaacagcaacuucgccaag

SEQ ID NO: 51605 - RNA, 33 nt, Artificial Sequence
  Zinc finger protein 43 (404-414)
agcuccaagcugaccgagcacaagcucacccac

SEQ ID NO: 51606 - RNA, 33 nt, Artificial Sequence
  RalBP1-associated Eps domain-containing protein 1 (509-519)
agcucccuggacaugaaccgcaccuucaccgug

SEQ ID NO: 51607 - RNA, 33 nt, Artificial Sequence
  Chromodomain-helicase-DNA-binding protein 9 (261-271)
agcucccuggaggagaaccuccugcaccaggug

SEQ ID NO: 51608 - RNA, 33 nt, Artificial Sequence
  Spectrin beta chain, non-erythrocytic 1 (1556-1566)
agcucccugagcgccgaggccauccgccagcgg

SEQ ID NO: 51609 - RNA, 33 nt, Artificial Sequence
  Eukaryotic translation initiation factor 3 subunit C-like protein (15-25)
agcucccugagcggcgaggagcucgugaccaag

SEQ ID NO: 51610 - RNA, 30 nt, Artificial Sequence
  COMM domain-containing protein 10 (123-132)
agcuccaugggccaggagaccguggagaag

SEQ ID NO: 51611 - RNA, 33 nt, Artificial Sequence
  Liprin-alpha-1 (1168-1178)
agcuccaugagcucccccagcaugcagccgaag

SEQ ID NO: 51612 - RNA, 27 nt, Artificial Sequence
  Exostosin-2 (52-60)
agcuccaacgacuggaacguggagaag

SEQ ID NO: 51613 - RNA, 42 nt, Artificial Sequence
  Membrane magnesium transporter 1 (109-122)
agcuccaaccaggacgcccugagcuccaacaccagccucaag

SEQ ID NO: 51614 - RNA, 51 nt, Artificial Sequence
  Vimentin (55-71)
agcucccccggcgggguguacgccacccgcagcuccgccguccggcugcgc

SEQ ID NO: 51615 - RNA, 27 nt, Artificial Sequence
  Coatomer subunit gamma-1 (297-305)
agcucccccaaggccgcccugcgcuac

SEQ ID NO: 51616 - RNA, 27 nt, Artificial Sequence
  RING finger protein 10 (486-494)
agcucccagcaggagcccaucaccaag

SEQ ID NO: 51617 - RNA, 27 nt, Artificial Sequence
  FERM domain-containing protein 4A (829-837)
agcucccaguaccgcaucaaggaguac

SEQ ID NO: 51618 - RNA, 39 nt, Artificial Sequence
  Chondroitin sulfate proteoglycan 4 (1608-1620)
agcuccagcgccggcaccgacccccagcugcuccuguac

SEQ ID NO: 51619 - RNA, 27 nt, Artificial Sequence
  Ankyrin-2 (960-968)
agcuccagccccauccacuccggcuuc

SEQ ID NO: 51620 - RNA, 36 nt, Artificial Sequence
  Reticulon-4 (429-440)
agcuccagcccccuggaggccuccagcgugaacuac

SEQ ID NO: 51621 - RNA, 27 nt, Artificial Sequence
  Histone acetyltransferase KAT6A (999-1007)
agcuccagccccccgauccugaccaag

SEQ ID NO: 51622 - RNA, 27 nt, Artificial Sequence
  Heterogeneous nuclear ribonucleoprotein U-like protein 1 (97-105)
agcuccagccgccccaucgugcagaag

SEQ ID NO: 51623 - RNA, 42 nt, Artificial Sequence
  Retinoic acid-induced protein 1 (223-236)
agcuccagcgugcagggcgggggccagggggcccacuccuac

SEQ ID NO: 51624 - RNA, 36 nt, Artificial Sequence
  Helicase-like transcription factor (446-457)
agcuccgugcccaccaccaagaagaagaugcugaag

SEQ ID NO: 51625 - RNA, 27 nt, Artificial Sequence
  Loss of heterozygosity 12 chromosomal region 1 protein (18-26)
agcuccgugacccccagcccggccaag

SEQ ID NO: 51626 - RNA, 27 nt, Artificial Sequence
  Ral GTPase-activating protein subunit beta (647-655)
agcuccuacgacaagcccaucaccuuc

SEQ ID NO: 51627 - RNA, 27 nt, Artificial Sequence
  Protein kinase C and casein kinase substrate in neurons protein 2 (345-353)
agcuccuacgagaagacccagagcuac

SEQ ID NO: 51628 - RNA, 27 nt, Artificial Sequence
  CD99 antigen-like protein 2 (60-68)
agcuccuacaucagcuaccagcagaag

SEQ ID NO: 51629 - RNA, 27 nt, Artificial Sequence
  U4/U6 small nuclear ribonucleoprotein Prp31 (226-234)
agcaccgccgccaagaucaugggcgug

SEQ ID NO: 51630 - RNA, 42 nt, Artificial Sequence
  Heterogeneous nuclear ribonucleoprotein H (363-376)
agcaccgccggcgccuccgggggcgcguacgagcaccgcuac

SEQ ID NO: 51631 - RNA, 39 nt, Artificial Sequence
  Heterogeneous nuclear ribonucleoprotein H (363-375)
agcaccgccggcgccuccgggggcgcguacgggagccag

SEQ ID NO: 51632 - RNA, 27 nt, Artificial Sequence
  Complement component 1 Q subcomponent-binding protein, mitochondrial (175-183)
agcaccgcccuggagcaccaggaguac

SEQ ID NO: 51633 - RNA, 30 nt, Artificial Sequence
  JmjC domain-containing protein 8 (89-98)
agcaccgccaacaccuacuccuaccacaag

SEQ ID NO: 51634 - RNA, 36 nt, Artificial Sequence
  Transcription initiation factor TFIID subunit 6 (584-595)
agcaccgcccccuccggcccggggagcgugcagaag

SEQ ID NO: 51635 - RNA, 30 nt, Artificial Sequence
  IQ motif and SEC7 domain-containing protein 2 (10-19)
agcaccgccucccacacccugcaccaguac

SEQ ID NO: 51636 - RNA, 27 nt, Artificial Sequence
  116 kDa U5 small nuclear ribonucleoprotein component (483-491)
agcaccgacgacggcgugcaguuccac

SEQ ID NO: 51637 - RNA, 24 nt, Artificial Sequence
  Neuropilin-2 (829-836)
agcaccgacaaggagaaguccugg

SEQ ID NO: 51638 - RNA, 30 nt, Artificial Sequence
  Immunoglobulin superfamily member 3 (124-133)
agcaccgacaagcaguacuucggcuccuac

SEQ ID NO: 51639 - RNA, 30 nt, Artificial Sequence
  Transcription initiation factor TFIID subunit 7-like (113-122)
agcaccgaccccaacaucgugcgcaagaag

SEQ ID NO: 51640 - RNA, 33 nt, Artificial Sequence
  Transcription factor HES-1 (101-111)
agcaccgaccccuccgugcugggcaaguaccgc

SEQ ID NO: 51641 - RNA, 39 nt, Artificial Sequence
  RNA-binding protein FUS (44-56)
agcaccgacaccuccggcuacgggcagagcuccuacagc

SEQ ID NO: 51642 - RNA, 30 nt, Artificial Sequence
  Latent-transforming growth factor beta-binding protein 2 (1572-1581)
agcaccgaggaccugcccgaccacgacauc

SEQ ID NO: 51643 - RNA, 33 nt, Artificial Sequence
  Baculoviral IAP repeat-containing protein 6 (2019-2029)
agcaccgagcagcugcgcaccaucauccgguac

SEQ ID NO: 51644 - RNA, 27 nt, Artificial Sequence
  Cathepsin L1 (287-295)
agcaccgaguccgacaacaacaaguac

SEQ ID NO: 51645 - RNA, 42 nt, Artificial Sequence
  DNA-dependent protein kinase catalytic subunit (1861-1874)
agcaccuucgacacccagaucacgaagaagaugggcuacuac

SEQ ID NO: 51646 - RNA, 33 nt, Artificial Sequence
  Zinc finger protein 280B (174-184)
agcaccuucgaggugaacuccaucaaccccaag

SEQ ID NO: 51647 - RNA, 27 nt, Artificial Sequence
  Brain-specific angiogenesis inhibitor 1-associated protein 2-like protein 1 (460-468)
agcaccuucaaggcccccgccuccaag

SEQ ID NO: 51648 - RNA, 30 nt, Artificial Sequence
  Sex comb on midleg-like protein 4 (11-20)
agcaccuucaaccaccgcggcucccugcac

SEQ ID NO: 51649 - RNA, 27 nt, Artificial Sequence
  Transmembrane emp24 domain-containing protein 3 (107-115)
agcaccuucucccacaagaccguguac

SEQ ID NO: 51650 - RNA, 27 nt, Artificial Sequence
  Alstrom syndrome protein 1 (1095-1103)
agcaccuucuacucccagcgcgagaag

SEQ ID NO: 51651 - RNA, 30 nt, Artificial Sequence
  Protein FAM91A1 (429-438)
agcaccggcgagggggaggcccagcgcuac

SEQ ID NO: 51652 - RNA, 27 nt, Artificial Sequence
  N-acetylglucosamine-1-phosphodiester alpha-N-acetylglucosaminidase (4-12)
agcaccggccgcuggcugcuccugcgg

SEQ ID NO: 51653 - RNA, 27 nt, Artificial Sequence
  Vacuolar protein sorting-associated protein 16 homolog (322-330)
agcacccacgaguuccugcacgaggug

SEQ ID NO: 51654 - RNA, 27 nt, Artificial Sequence
  Bifunctional lysine-specific demethylase and histidyl-hydroxylase MINA (251-259)
agcacccacgugaccaucuccacguac

SEQ ID NO: 51655 - RNA, 30 nt, Artificial Sequence
  Clathrin interactor 1 (210-219)
agcaccaucgacgacaccaucuccaaguuc

SEQ ID NO: 51656 - RNA, 27 nt, Artificial Sequence
  Prolyl 4-hydroxylase subunit alpha-1 (200-208)
agcaccaucgacaagguguccguccug

SEQ ID NO: 51657 - RNA, 30 nt, Artificial Sequence
  EPB41 protein (372-381)
agcaccaucggcuucaagcugcccuccuac

SEQ ID NO: 51658 - RNA, 27 nt, Artificial Sequence
  Calcium-independent phospholipase A2-gamma (310-318)
agcaccaagcaguccaucgccaacuuc

SEQ ID NO: 51659 - RNA, 27 nt, Artificial Sequence
  Kanadaptin (547-555)
agcacccuggacggcgugucccgcaag

SEQ ID NO: 51660 - RNA, 30 nt, Artificial Sequence
  Serologically defined colon cancer antigen 8 (8-17)
agcacccuggaggagauccucggccaguac

SEQ ID NO: 51661 - RNA, 27 nt, Artificial Sequence
  Serine-protein kinase ATM (934-942)
agcacccuggagcccaccaagucccuc

SEQ ID NO: 51662 - RNA, 33 nt, Artificial Sequence
  DNA-directed RNA polymerase I subunit RPA1 (376-386)
agcacccugcccggccagucccucaucgacaag

SEQ ID NO: 51663 - RNA, 27 nt, Artificial Sequence
  Myb-related protein B (600-608)
agcacccugcccaagucccucagccug

SEQ ID NO: 51664 - RNA, 30 nt, Artificial Sequence
  Zinc finger protein 212 (21-30)
agcacccugcccucccaggccaccgagaag

SEQ ID NO: 51665 - RNA, 39 nt, Artificial Sequence
  Myelin basic protein (20-32)
agcaccauggaccacgcccgccacggcuuccugccccgg

SEQ ID NO: 51666 - RNA, 27 nt, Artificial Sequence
  Coatomer subunit gamma-1 (134-142)
agcaccaugcugcaggccaucgagcgc

SEQ ID NO: 51667 - RNA, 27 nt, Artificial Sequence
  SHC SH2 domain-binding protein 1 (299-307)
agcaccaugauggccggccugcuccgc

SEQ ID NO: 51668 - RNA, 27 nt, Artificial Sequence
  Forkhead box protein O1 (544-552)
agcaccaugccccacaccuccggcaug

SEQ ID NO: 51669 - RNA, 27 nt, Artificial Sequence
  Transmembrane protein 248 (87-95)
agcaccaugaccuccggccaggcccgc

SEQ ID NO: 51670 - RNA, 27 nt, Artificial Sequence
  Calcium uptake protein 1, mitochondrial (122-130)
agcacccccgacaagaucuuccgcuac

SEQ ID NO: 51671 - RNA, 30 nt, Artificial Sequence
  C-Jun-amino-terminal kinase-interacting protein 4 (350-359)
agcacccccaccaagggcaucgagaacaag

SEQ ID NO: 51672 - RNA, 27 nt, Artificial Sequence
  Transcription elongation factor A protein 1 (135-143)
agcaccuccgacagcgugcgccugaag

SEQ ID NO: 51673 - RNA, 30 nt, Artificial Sequence
  LisH domain-containing protein ARMC9 (382-391)
agcaccuccgacgugguccgccaguacaug

SEQ ID NO: 51674 - RNA, 33 nt, Artificial Sequence
  Endoplasmin (187-197)
agcaccuccgagcugaucggccaguucggggug

SEQ ID NO: 51675 - RNA, 27 nt, Artificial Sequence
  Enhancer of mRNA-decapping protein 4 (165-173)
agcaccuccgagcgcacccugcucaag

SEQ ID NO: 51676 - RNA, 27 nt, Artificial Sequence
  Versican core protein (1942-1950)
agcaccgugucccaccccaucgccaag

SEQ ID NO: 51677 - RNA, 27 nt, Artificial Sequence
  E3 ubiquitin-protein ligase ZNRF1 (95-103)
agcaccuacgcccacggcaacggguac

SEQ ID NO: 51678 - RNA, 39 nt, Artificial Sequence
  Epithelial discoidin domain-containing receptor 1 (213-225)
agcaccuacgacggccacaccguggggggccugcaguac

SEQ ID NO: 51679 - RNA, 30 nt, Artificial Sequence
  Regulator of microtubule dynamics protein 1 (239-248)
agcaccuacgagaaggcccugggcuacuuc

SEQ ID NO: 51680 - RNA, 27 nt, Artificial Sequence
  Zinc finger protein 627 (490-498)
agcaccuacuuccgcgugcacgagaag

SEQ ID NO: 51681 - RNA, 33 nt, Artificial Sequence
  Heat shock protein HSP 90-alpha (724-734)
agcaccuacggcuggaccgccaacauggagcgc

SEQ ID NO: 51682 - RNA, 27 nt, Artificial Sequence
  Phosphomevalonate kinase (66-74)
agcaccuacaaggaggccuuccgcaag

SEQ ID NO: 51683 - RNA, 33 nt, Artificial Sequence
  Acid ceramidase (33-43)
agcaccuaccccccguccggccccaccuaccgc

SEQ ID NO: 51684 - RNA, 33 nt, Artificial Sequence
  Mitochondrial basic amino acids transporter (140-150)
agcaccuaccccguggacgucgugaagucccgc

SEQ ID NO: 51685 - RNA, 30 nt, Artificial Sequence
  Protein tweety homolog 2 (519-528)
agcguggccgacgagcaccugcgccacuac

SEQ ID NO: 51686 - RNA, 33 nt, Artificial Sequence
  BMP-2-inducible protein kinase (599-609)
agcguggccgacaaggaggccaucgcgaacuuc

SEQ ID NO: 51687 - RNA, 27 nt, Artificial Sequence
  Adenomatous polyposis coli protein 2 (774-782)
agcguggccuccaaggcccugcagaag

SEQ ID NO: 51688 - RNA, 33 nt, Artificial Sequence
  Dolichyl-diphosphooligosaccharide-proteinosyltransferase subunit 2 (312-322)
agcguggccucccgcgccaccguccugcagaag

SEQ ID NO: 51689 - RNA, 30 nt, Artificial Sequence
  DNA-directed RNA polymerase III subunit RPC5 (347-356)
agcguggccguccugcgcggcauccagaag

SEQ ID NO: 51690 - RNA, 27 nt, Artificial Sequence
  Epididymal secretory protein E1 (29-37)
agcguggacggcgucaucaaggaggug

SEQ ID NO: 51691 - RNA, 33 nt, Artificial Sequence
  Chromodomain-helicase-DNA-binding protein 4 (628-638)
agcguggacaagaagggccacguccacuaccug

SEQ ID NO: 51692 - RNA, 30 nt, Artificial Sequence
  U3 small nucleolar ribonucleoprotein protein MPP10 (594-603)
agcguggaccaggccggcaaguacuccaag

SEQ ID NO: 51693 - RNA, 30 nt, Artificial Sequence
  Nucleolar protein 11 (28-37)
agcguggaccgcaaguucaucucccugaug

SEQ ID NO: 51694 - RNA, 30 nt, Artificial Sequence
  Peroxisomal multifunctional enzyme type 2 (75-84)
agcguggaggagggcgagaaggucgugaag

SEQ ID NO: 51695 - RNA, 33 nt, Artificial Sequence
  Cytochrome c oxidase subunit 7C, mitochondrial (30-40)
agcguggagaacaaguggucccugcucgccaag

SEQ ID NO: 51696 - RNA, 33 nt, Artificial Sequence
  Histone acetyltransferase KAT7 (249-259)
agcguguucgaggucgacggcaagaagaacaag

SEQ ID NO: 51697 - RNA, 36 nt, Artificial Sequence
  Receptor-type tyrosine-protein phosphatase zeta (1032-1043)
agcguguucggcgacgacaacaaggcccuguccaag

SEQ ID NO: 51698 - RNA, 39 nt, Artificial Sequence
  Calcium-binding mitochondrial carrier protein SCaMC-2 (37-49)
agcguguucauccccucccaggaguucagcaccuaccgc

SEQ ID NO: 51699 - RNA, 30 nt, Artificial Sequence
  LIX1-like protein (121-130)
agcguguucaacgagcaccccucccgccgg

SEQ ID NO: 51700 - RNA, 27 nt, Artificial Sequence
  Ras-associated and pleckstrin homology domains-containing protein 1 (627-635)
agcguguucuccgaggccuggaagcgc

SEQ ID NO: 51701 - RNA, 36 nt, Artificial Sequence
  Formin-1 (1148-1159)
agcguguucuccgagggcaucaccagccugcaccgc

SEQ ID NO: 51702 - RNA, 27 nt, Artificial Sequence
  Transcription activator BRG1 (1587-1595)
agcguguucaccuccguccgccagaag

SEQ ID NO: 51703 - RNA, 33 nt, Artificial Sequence
  Ras-related protein Rab-6B (23-33)
agcgugggcaagaccucccugaucacccgcuuc

SEQ ID NO: 51704 - RNA, 27 nt, Artificial Sequence
  Rho guanine nucleotide exchange factor 17 (885-893)
agcgugaucgacaccgccuccaaguac

SEQ ID NO: 51705 - RNA, 27 nt, Artificial Sequence
  Transmembrane emp24 domain-containing protein 7 (151-159)
agcgugaucgacuaccagacccacuuc

SEQ ID NO: 51706 - RNA, 30 nt, Artificial Sequence
  BTB/POZ domain-containing protein 9 (367-376)
agcgugaucgagggcgucucccgcagccgg

SEQ ID NO: 51707 - RNA, 30 nt, Artificial Sequence
  Protein dopey-2 (19-28)
agcgugaucgagaaggcccugcgcaacuuc

SEQ ID NO: 51708 - RNA, 27 nt, Artificial Sequence
  Inactive phospholipase C-like protein 1 (372-380)
agcgugaucgaggucaucaacaaguuc

SEQ ID NO: 51709 - RNA, 27 nt, Artificial Sequence
  Carbohydrate sulfotransferase 10 (278-286)
agcgugaucggccaccacgagacccug

SEQ ID NO: 51710 - RNA, 27 nt, Artificial Sequence
  E3 ubiquitin-protein ligase RBBP6 (1347-1355)
agcgugaucaagaacgucuccaccaag

SEQ ID NO: 51711 - RNA, 30 nt, Artificial Sequence
  FERM domain-containing protein 6 (60-69)
agcgugauccagaacaacgagcacgucuac

SEQ ID NO: 51712 - RNA, 30 nt, Artificial Sequence
  Vacuolar protein sorting-associated protein 11 homolog (769-778)
agcgugauccgcgacuaccugguccagaag

SEQ ID NO: 51713 - RNA, 30 nt, Artificial Sequence
  Choline kinase alpha (114-123)
agcgugauccgcggcgggcuguccaacaug

SEQ ID NO: 51714 - RNA, 33 nt, Artificial Sequence
  Lipid phosphate phosphatase-related protein type 3 (109-119)
agcgugaucuccgacaccaccaagcugcucaag

SEQ ID NO: 51715 - RNA, 30 nt, Artificial Sequence
  E3 ubiquitin-protein ligase MYCBP2 (613-622)
agcgugaucuccaaggacggcgagcuguac

SEQ ID NO: 51716 - RNA, 33 nt, Artificial Sequence
  ATPase family AAA domain-containing protein 2 (1033-1043)
agcgugaucuccaagaucgaccugcacaaguac

SEQ ID NO: 51717 - RNA, 27 nt, Artificial Sequence
  Pro-interleukin-16 (212-220)
agcgugaucuccaacaucguccugaug

SEQ ID NO: 51718 - RNA, 30 nt, Artificial Sequence
  Dolichyl-diphosphooligosaccharide-proteinosyltransferase subunit DAD1 (7-16)
agcgugaucucccgcuuccuggaggaguac

SEQ ID NO: 51719 - RNA, 30 nt, Artificial Sequence
  Fanconi anemia group A protein (283-292)
agcgugaucuccaccgacccccugaagcgc

SEQ ID NO: 51720 - RNA, 27 nt, Artificial Sequence
  Vacuolar protein sorting-associated protein 13C (3201-3209)
agcgugaucacccgcuucaacgaguac

SEQ ID NO: 51721 - RNA, 27 nt, Artificial Sequence
  Acyl-CoA dehydrogenase family member 9, mitochondrial (237-245)
agcgugaaggacaagaucaccgccuuc

SEQ ID NO: 51722 - RNA, 42 nt, Artificial Sequence
  Ran-specific GTPase-activating protein (187-200)
agcgugaaggaggagaccaaggaggacgccgaggagaagcag

SEQ ID NO: 51723 - RNA, 42 nt, Artificial Sequence
  39S ribosomal protein L48, mitochondrial (94-107)
agcgugaaggagcacaccgaggaggacuucaagggccgcuuc

SEQ ID NO: 51724 - RNA, 27 nt, Artificial Sequence
  CTP synthase 1 (225-233)
agcgugaaggagaagaucuccauguuc

SEQ ID NO: 51725 - RNA, 27 nt, Artificial Sequence
  Amyloid protein-binding protein 2 (95-103)
agcgugcuggccuacuccuucagccgc

SEQ ID NO: 51726 - RNA, 33 nt, Artificial Sequence
  Cytoplasmic dynein 1 heavy chain 1 (2317-2327)
agcgugcuggacgacaacaagcuccugacccug

SEQ ID NO: 51727 - RNA, 27 nt, Artificial Sequence
  Interferon-induced GTP-binding protein Mx1 (85-93)
agcgugcuggaggcccucuccggcguc

SEQ ID NO: 51728 - RNA, 36 nt, Artificial Sequence
  Protein fem-1 homolog B (414-425)
agcgugcuggagaucgagcaguccaugaaccgcguc

SEQ ID NO: 51729 - RNA, 27 nt, Artificial Sequence
  Zinc finger MYM-type protein 6 (648-656)
agcgugcugaagggcgccgucaccaag

SEQ ID NO: 51730 - RNA, 27 nt, Artificial Sequence
  Pre-rRNA-processing protein TSR1 homolog (547-555)
agcgugcugaacauggucgugcgccgg

SEQ ID NO: 51731 - RNA, 30 nt, Artificial Sequence
  Protein tweety homolog 3 (286-295)
agcgugcuguccggcgacauccuccaguac

SEQ ID NO: 51732 - RNA, 27 nt, Artificial Sequence
  Interleukin-1 receptor-associated kinase 1 (94-102)
agcgugcuguggcccuggaucaaccgc

SEQ ID NO: 51733 - RNA, 36 nt, Artificial Sequence
  Heat shock 70 kDa protein 14 (206-217)
agcgugauggaggucaacuccggcaucuaccgcgug

SEQ ID NO: 51734 - RNA, 33 nt, Artificial Sequence
  Synaptonemal complex protein SC65 (327-337)
agcgugaugcagcagaaccuggucuacuaccgc

SEQ ID NO: 51735 - RNA, 27 nt, Artificial Sequence
  DNA replication licensing factor MCM5 (417-425)
agcgugaugcgcgaccccuccagccgg

SEQ ID NO: 51736 - RNA, 30 nt, Artificial Sequence
  V-type proton ATPase 16 kDa proteolipid subunit (45-54)
agcgugaugcgccccgagcagaucaugaag

SEQ ID NO: 51737 - RNA, 27 nt, Artificial Sequence
  Propionyl-CoA carboxylase beta chain, mitochondrial (34-42)
agcgugaacgagcgcaucgagaacaag

SEQ ID NO: 51738 - RNA, 36 nt, Artificial Sequence
  A-kinase-interacting protein 1 (106-117)
agcgugcccgaggagggcggggccacccacgucuac

SEQ ID NO: 51739 - RNA, 36 nt, Artificial Sequence
  Melanocyte protein PMEL (633-644)
agcgugccccagcugccgcacuccagcucccacugg

SEQ ID NO: 51740 - RNA, 30 nt, Artificial Sequence
  Nuclear distribution protein nudE homolog 1 (211-220)
agcgugcccuccaccccgaucgcccaccgc

SEQ ID NO: 51741 - RNA, 30 nt, Artificial Sequence
  Krueppel-like factor 5 (213-222)
agcgugcccacccagcagggccaccuguac

SEQ ID NO: 51742 - RNA, 36 nt, Artificial Sequence
  Retinoic acid-induced protein 1 (225-236)
agcgugcagggcgggggccagggggcccacuccuac

SEQ ID NO: 51743 - RNA, 33 nt, Artificial Sequence
  Bcl-2-related protein A1 (43-53)
agcgugcagaaggaggucgagaagaaccugaag

SEQ ID NO: 51744 - RNA, 27 nt, Artificial Sequence
  UDP-glucose 4-epimerase (97-105)
agcgugcagaagccccuggacuacuac

SEQ ID NO: 51745 - RNA, 27 nt, Artificial Sequence
  40S ribosomal protein S16 (9-17)
agcgugcaggucuucggccgcaagaag

SEQ ID NO: 51746 - RNA, 27 nt, Artificial Sequence
  Serine/threonine-protein kinase 4 (109-117)
agcguguccgacaucauccgccugcgg

SEQ ID NO: 51747 - RNA, 27 nt, Artificial Sequence
  Zinc transporter ZIP6 (243-251)
agcguguccgagccccgcaagggcuuc

SEQ ID NO: 51748 - RNA, 30 nt, Artificial Sequence
  MICOS complex subunit MIC60 (113-122)
agcguguccgaggucaugaaggagagcaag

SEQ ID NO: 51749 - RNA, 36 nt, Artificial Sequence
  CDC42 small effector protein 2 (51-62)
agcguguccagcauccagaaccagaugcaguccaag

SEQ ID NO: 51750 - RNA, 27 nt, Artificial Sequence
  Vimentin (5-13)
agcguguccagcuccagcuaccgccgg

SEQ ID NO: 51751 - RNA, 27 nt, Artificial Sequence
  Shootin-1 (9-17)
agcgugaccaagaccgcccugaacaag

SEQ ID NO: 51752 - RNA, 33 nt, Artificial Sequence
  LON peptidase N-terminal domain and RING finger protein 2 (607-617)
agcguggucgacgccaucggcaucucccgcuuc

SEQ ID NO: 51753 - RNA, 27 nt, Artificial Sequence
  Phosphatidylinositol 3-kinase regulatory subunit beta (397-405)
agcguggucgaccugaucaaccacuac

SEQ ID NO: 51754 - RNA, 27 nt, Artificial Sequence
  GRAM domain-containing protein 1A (439-447)
agcguggucgagacccagacccuguuc

SEQ ID NO: 51755 - RNA, 30 nt, Artificial Sequence
  Unconventional myosin-VI (74-83)
agcguggucggcggguucgugucccacuac

SEQ ID NO: 51756 - RNA, 33 nt, Artificial Sequence
  Elongator complex protein 1 (1171-1181)
agcguggucuccggcagcgagauguccgggaag

SEQ ID NO: 51757 - RNA, 33 nt, Artificial Sequence
  DNA dC-dU-editing enzyme APOBEC-3C (46-56)
agcguggucuccuggaagaccggcguguuccgc

SEQ ID NO: 51758 - RNA, 27 nt, Artificial Sequence
  Centrosomal protein of 131 kDa (47-55)
agcguggucaccggcuccgagcagaag

SEQ ID NO: 51759 - RNA, 27 nt, Artificial Sequence
  Discoidin domain-containing receptor 2 (215-223)
agcguguacgacggcgccgucggguac

SEQ ID NO: 51760 - RNA, 30 nt, Artificial Sequence
  Exocyst complex component 6B (39-48)
agcguguacgacggcgaggagcacgggcgc

SEQ ID NO: 51761 - RNA, 39 nt, Artificial Sequence
  Serum paraoxonase/arylesterase 2 (334-346)
agcguguacgacggcaagcugcucaucgggacccuguac

SEQ ID NO: 51762 - RNA, 30 nt, Artificial Sequence
  DNA-binding protein RFX7 (1307-1316)
agcguguacgaguuccagacccccuccuac

SEQ ID NO: 51763 - RNA, 30 nt, Artificial Sequence
  Far upstream element-binding protein 3 (77-86)
agcguguacggcuacgggguccagaagcgc

SEQ ID NO: 51764 - RNA, 33 nt, Artificial Sequence
  Nuclear cap-binding protein subunit 1 (280-290)
agcguguaccccaugccgcgcgucaucuuccgg

SEQ ID NO: 51765 - RNA, 33 nt, Artificial Sequence
  Inositol hexakisphosphate and diphosphoinositol-pentakisphosphate kinase 2 (220-230)
agcguguacucccccgagagcaacguccgcaag

SEQ ID NO: 51766 - RNA, 30 nt, Artificial Sequence
  Golgi resident protein GCP60 (519-528)
agcguguacuaccgcgucuacuacacccgg

SEQ ID NO: 51767 - RNA, 27 nt, Artificial Sequence
  T-box transcription factor TBX2 (536-544)
accgccgcccccuucccguuccaccug

SEQ ID NO: 51768 - RNA, 33 nt, Artificial Sequence
  Transducin beta-like protein 3 (197-207)
accgccgaccacaaccugcuccuguacgaggcc

SEQ ID NO: 51769 - RNA, 27 nt, Artificial Sequence
  Protein bicaudal D homolog 2 (465-473)
accgccgagguggcccuggcgaaccuc

SEQ ID NO: 51770 - RNA, 27 nt, Artificial Sequence
  Unconventional myosin-X (353-361)
accgcccugggccgcagcgccgagcuc

SEQ ID NO: 51771 - RNA, 27 nt, Artificial Sequence
  Homeodomain-interacting protein kinase 3 (308-316)
accgcccugaagaagcucaagagccug

SEQ ID NO: 51772 - RNA, 27 nt, Artificial Sequence
  Protein S100-A1 (7-15)
accgccauggagacccugaucaacgug

SEQ ID NO: 51773 - RNA, 33 nt, Artificial Sequence
  Ankycorbin (72-82)
accgcccaggacaccacgggccacagcgcccug

SEQ ID NO: 51774 - RNA, 48 nt, Artificial Sequence
  Presequence protease, mitochondrial (707-722)
accgcccaggagcuggccaacggcauccccgacagcgggcaccucuac

SEQ ID NO: 51775 - RNA, 21 nt, Artificial Sequence
  Nuclear pore complex-interacting protein (238-244)
accgacaacagccugucccuc

SEQ ID NO: 51776 - RNA, 30 nt, Artificial Sequence
  Interleukin-1 receptor accessory protein (307-316)
accgaggacgagacccgcacgcagauccug

SEQ ID NO: 51777 - RNA, 30 nt, Artificial Sequence
  Uncharacterized membrane protein C19orf24 (108-117)
accgaggaccccaccgagauggccagccug

SEQ ID NO: 51778 - RNA, 27 nt, Artificial Sequence
  Quinone oxidoreductase (182-190)
accgaggagggccagaagaucgugcug

SEQ ID NO: 51779 - RNA, 30 nt, Artificial Sequence
  Proteasome activator complex subunit 3 (220-229)
accgagaucgacgagaaggaguacaucagc

SEQ ID NO: 51780 - RNA, 27 nt, Artificial Sequence
  Ventricular zone-expressed PH domain-containing protein homolog 1 (7-15)
accgagaucgaguuccccgagaagcug

SEQ ID NO: 51781 - RNA, 27 nt, Artificial Sequence
  RNA-binding protein 12 (77-85)
accgagaugcagaacaugaucgagcug

SEQ ID NO: 51782 - RNA, 27 nt, Artificial Sequence
  Pre-mRNA-processing-splicing factor 8 (945-953)
accgagcccccgccccugcucguguac

SEQ ID NO: 51783 - RNA, 27 nt, Artificial Sequence
  Probable N-acetyltransferase 16 (59-67)
accgagcgcgaguucgaggaggugcug

SEQ ID NO: 51784 - RNA, 27 nt, Artificial Sequence
  Major facilitator superfamily domain-containing protein 1 (327-335)
accggcaagaacaucaucugggugcug

SEQ ID NO: 51785 - RNA, 27 nt, Artificial Sequence
  DNA topoisomerase 2-alpha (1397-1405)
acccacuuccccgacgagaccgagauc

SEQ ID NO: 51786 - RNA, 30 nt, Artificial Sequence
  Mothers against decapentaplegic homolog 2 (197-206)
acccacagcauccccgagaacaccaacuuc

SEQ ID NO: 51787 - RNA, 30 nt, Artificial Sequence
  Sorting nexin-18 (279-288)
accaucgacgaccccaccaagcagacgaag

SEQ ID NO: 51788 - RNA, 33 nt, Artificial Sequence
  Plastin-2 (117-127)
accaucgacgagcgcaccaucaacaagaagaag

SEQ ID NO: 51789 - RNA, 27 nt, Artificial Sequence
  MAM and LDL-receptor class A domain-containing protein 1 (1829-1837)
accaucgaggagagcggccugaacauc

SEQ ID NO: 51790 - RNA, 30 nt, Artificial Sequence
  NADH-ubiquinone oxidoreductase chain 2 (12-21)
accaucuucgccggcacccugaucacggcc

SEQ ID NO: 51791 - RNA, 27 nt, Artificial Sequence
  DBH-like monooxygenase protein 1 (50-58)
accaucaucgaguucacccgcgagcug

SEQ ID NO: 51792 - RNA, 27 nt, Artificial Sequence
  Cytoskeleton-associated protein 5 (365-373)
accauccuggagaaguucaaggagaag

SEQ ID NO: 51793 - RNA, 48 nt, Artificial Sequence
  Melanocyte protein PMEL (215-230)
accaucaccgaccaggugcccuucagcgucuccgugagccagcugcgc

SEQ ID NO: 51794 - RNA, 39 nt, Artificial Sequence
  Ornithine aminotransferase, mitochondrial (30-42)
accaagaagaccgugcagggccccccgacgagcgacgac

SEQ ID NO: 51795 - RNA, 39 nt, Artificial Sequence
  Catenin delta-1 (790-802)
accaagagccuggacaacaacuacuccacccccaacgag

SEQ ID NO: 51796 - RNA, 30 nt, Artificial Sequence
  Low-density lipoprotein receptor-related protein 1B (701-710)
acccuggacuuccacaccaacacgcucuac

SEQ ID NO: 51797 - RNA, 33 nt, Artificial Sequence
  KN motif and ankyrin repeat domain-containing protein 1 (702-712)
acccuggacaagcagaccagcacgcagaccgug

SEQ ID NO: 51798 - RNA, 24 nt, Artificial Sequence
  PH and SEC7 domain-containing protein 3 (117-124)
acccuggaccagagccuccgcuac

SEQ ID NO: 51799 - RNA, 27 nt, Artificial Sequence
  Kinesin-like protein KIF20B (1134-1142)
acccuggacgugcagauccagcacguc

SEQ ID NO: 51800 - RNA, 33 nt, Artificial Sequence
  UPF0505 protein C16orf62 (625-635)
acccuggaggacgagaagcgcaugcucagcuac

SEQ ID NO: 51801 - RNA, 33 nt, Artificial Sequence
  Syndecan-3 (348-358)
acccuggaggagcccaagcaggccagcgugacc

SEQ ID NO: 51802 - RNA, 30 nt, Artificial Sequence
  Biliverdin reductase A (71-80)
acccuggaggagcgcaaggaggaccaguac

SEQ ID NO: 51803 - RNA, 27 nt, Artificial Sequence
  Rap guanine nucleotide exchange factor 6 (4-12)
acccuguuccagaagcucuucagcaag

SEQ ID NO: 51804 - RNA, 30 nt, Artificial Sequence
  ATP-dependent RNA helicase DHX36 (503-512)
acccugcacgaccuccugaugagccaggug

SEQ ID NO: 51805 - RNA, 30 nt, Artificial Sequence
  F-box/WD repeat-containing protein 11 (217-226)
acccugauccaccacaacgaggccgugcuc

SEQ ID NO: 51806 - RNA, 30 nt, Artificial Sequence
  Plexin-C1 (370-379)
acccugauccacagcgaccucaccuccgug

SEQ ID NO: 51807 - RNA, 33 nt, Artificial Sequence
  Tetraspanin-14 (239-249)
acccugaucagcgacaucgaggccgugaaggcc

SEQ ID NO: 51808 - RNA, 27 nt, Artificial Sequence
  Midasin (462-470)
acccugcucgacaaguacuggaccaag

SEQ ID NO: 51809 - RNA, 33 nt, Artificial Sequence
  Inositol-tetrakisphosphate 1-kinase (102-112)
acccugcucgaccgcagcaaguccuacgagcug

SEQ ID NO: 51810 - RNA, 27 nt, Artificial Sequence
  Midasin (3030-3038)
acccugcucgaggugggccagaucgcc

SEQ ID NO: 51811 - RNA, 36 nt, Artificial Sequence
  NADH-ubiquinone oxidoreductase chain 4L (39-50)
acccugaugacccucaacacgcacagccugcuggcc

SEQ ID NO: 51812 - RNA, 30 nt, Artificial Sequence
  Serine/threonine-protein phosphatase 1 regulatory subunit 10 (169-178)
acccugcccgagcgcccgcucaccgaggug

SEQ ID NO: 51813 - RNA, 27 nt, Artificial Sequence
  Sorting nexin-9 (218-226)
acccugcaggacaagcagaacauggug

SEQ ID NO: 51814 - RNA, 30 nt, Artificial Sequence
  Olfactory receptor (79-88)
acccuggugggcaacuucaccaucaucauc

SEQ ID NO: 51815 - RNA, 27 nt, Artificial Sequence
  tRNA-dihydrouridine(20) synthase (NAD(P)+)-like (378-386)
acccugugggacaagagcaagaagcuc

SEQ ID NO: 51816 - RNA, 33 nt, Artificial Sequence
  Spatacsin (451-461)
acccugugggaccucgagacccagggcaugcag

SEQ ID NO: 51817 - RNA, 27 nt, Artificial Sequence
  E3 SUMO-protein ligase PIAS1 (360-368)
acccuguacauccagaugaacgagaag

SEQ ID NO: 51818 - RNA, 42 nt, Artificial Sequence
  Eukaryotic translation initiation factor 3 subunit D (56-69)
accaacaaguacagcucccaguucggcgggggcagccaguac

SEQ ID NO: 51819 - RNA, 33 nt, Artificial Sequence
  ATP-dependent RNA helicase DDX42 (106-116)
accaaccugaccccccagcagcucaucgaccug

SEQ ID NO: 51820 - RNA, 27 nt, Artificial Sequence
  Calcium permeable stress-gated cation channel 1 (426-434)
acccccgccaucaucaugaacaccauc

SEQ ID NO: 51821 - RNA, 27 nt, Artificial Sequence
  Neuron navigator 2 (981-989)
acccccgccagcucccgcaagaaccug

SEQ ID NO: 51822 - RNA, 48 nt, Artificial Sequence
  Nucleolin (121-136)
acccccggcaagaagggggccgccaucccggcgaagggcgccaagaac

SEQ ID NO: 51823 - RNA, 57 nt, Artificial Sequence
  Nucleolin (121-139)
acccccggcaagaagggggccgccaucccggcgaagggcgccaagaacgggaagaac

SEQ ID NO: 51824 - RNA, 36 nt, Artificial Sequence
  Chondroitin sulfate proteoglycan 4 (2310-2321)
acccccaacccggcccugaagaacggccaguacugg

SEQ ID NO: 51825 - RNA, 42 nt, Artificial Sequence
  Alpha-adducin (194-207)
acccccagcuuccugaagaaguccaagaagaagagcgacucc

SEQ ID NO: 51826 - RNA, 27 nt, Artificial Sequence
  GPI ethanolamine phosphate transferase 3 (274-282)
acccaggaccugcaggccaaggagcuc

SEQ ID NO: 51827 - RNA, 30 nt, Artificial Sequence
  Homer protein homolog 3 (100-109)
acccaguucgccgagaaguuccaggaggug

SEQ ID NO: 51828 - RNA, 33 nt, Artificial Sequence
  Hypoxia-inducible factor 1-alpha (123-133)
acccaguucgagcugaccggccacagcguguuc

SEQ ID NO: 51829 - RNA, 33 nt, Artificial Sequence
  Serine-protein kinase ATM (2268-2278)
acccagcugcccgagcgcgccaucuuccagauc

SEQ ID NO: 51830 - RNA, 36 nt, Artificial Sequence
  Proteasome subunit beta type-4 (15-26)
acccagaaccccauggugaccggcacgagcguccug

SEQ ID NO: 51831 - RNA, 33 nt, Artificial Sequence
  von Willebrand factor A domain-containing protein 9 (75-85)
acccagaaccagcgcagcgaguccaaccgguuc

SEQ ID NO: 51832 - RNA, 39 nt, Artificial Sequence
  Macrophage migration inhibitory factor (22-34)
acccagcagcuggcccaggccaccggcaagcccccgcag

SEQ ID NO: 51833 - RNA, 27 nt, Artificial Sequence
  Gamma-interferon-inducible protein 16 (235-243)
acccagacccaguucuuccacgugaag

SEQ ID NO: 51834 - RNA, 27 nt, Artificial Sequence
  60S ribosomal protein L14 (89-97)
acccgcugggccaagaagaucgaggcc

SEQ ID NO: 51835 - RNA, 27 nt, Artificial Sequence
  Cadherin-19 (219-227)
accagcgccgagauccgcucccuguac

SEQ ID NO: 51836 - RNA, 30 nt, Artificial Sequence
  WW domain-containing adapter protein with coiled-coil (338-347)
accagcgacgccuccagcccccgcuccuac

SEQ ID NO: 51837 - RNA, 27 nt, Artificial Sequence
  FAST kinase domain-containing protein 2 (547-555)
accagcgacgacaugaagaacgccuac

SEQ ID NO: 51838 - RNA, 30 nt, Artificial Sequence
  Latent-transforming growth factor beta-binding protein 2 (1043-1052)
accagcgacgagaagggcugccaggacgug

SEQ ID NO: 51839 - RNA, 33 nt, Artificial Sequence
  Trimethyllysine dioxygenase, mitochondrial (224-234)
accagcgacuucucccgcggcgacaccgccuac

SEQ ID NO: 51840 - RNA, 33 nt, Artificial Sequence
  Cyclic AMP-dependent transcription factor ATF-6 alpha (429-439)
accagcgacggcaucauccagaagaacuccuac

SEQ ID NO: 51841 - RNA, 27 nt, Artificial Sequence
  L-dopachrome tautomerase (136-144)
accagcgaccagcugggcuacuccuac

SEQ ID NO: 51842 - RNA, 27 nt, Artificial Sequence
  Poly (ADP-ribose) polymerase 11 (22-30)
accagcgacacccaguggggcugguuc

SEQ ID NO: 51843 - RNA, 33 nt, Artificial Sequence
  Endoplasmin (188-198)
accagcgagcugaucggccaguucggggugggc

SEQ ID NO: 51844 - RNA, 36 nt, Artificial Sequence
  Probable ATP-dependent RNA helicase DDX5 (556-567)
accagcuuccgcaccggcaaccccacggggaccuac

SEQ ID NO: 51845 - RNA, 30 nt, Artificial Sequence
  YTH domain-containing family protein 2 (706-715)
accagcaucuucgacgacuucucccacuac

SEQ ID NO: 51846 - RNA, 27 nt, Artificial Sequence
  KN motif and ankyrin repeat domain-containing protein 4 (11-19)
accagccugaaguccaucaugaagaag

SEQ ID NO: 51847 - RNA, 33 nt, Artificial Sequence
  E3 ubiquitin-protein ligase RNF213 (1201-1211)
accagcuccaacagccagcgcgccacccacuac

SEQ ID NO: 51848 - RNA, 51 nt, Artificial Sequence
  Nestin (511-527)
accagcugggccggcgcccccgugcaccuggggcagggccaguuccucaag

SEQ ID NO: 51849 - RNA, 27 nt, Artificial Sequence
  Probable ATP-dependent RNA helicase YTHDC2 (1212-1220)
accaccgccgagcgcgugcugaugaag

SEQ ID NO: 51850 - RNA, 24 nt, Artificial Sequence
  Junction plakoglobin (287-294)
accaccgacugccugcagcuccug

SEQ ID NO: 51851 - RNA, 27 nt, Artificial Sequence
  Junction plakoglobin (287-295)
accaccgacugccugcagcuccuggcc

SEQ ID NO: 51852 - RNA, 33 nt, Artificial Sequence
  Flavin reductaseADPH) (190-200)
accaccgacgaguacgacggccacagcacguac

SEQ ID NO: 51853 - RNA, 27 nt, Artificial Sequence
  ATP-dependent 6-phosphofructokinase, platelet type (379-387)
accaccgacuucaucuaccagcuguac

SEQ ID NO: 51854 - RNA, 24 nt, Artificial Sequence
  Probable ATP-dependent RNA helicase DDX60-like (990-997)
accaccgacaucaucgagaaguac

SEQ ID NO: 51855 - RNA, 33 nt, Artificial Sequence
  Methyl-CpG-binding domain protein 6 (678-688)
accaccgaccccggcgccagcucccuggggaag

SEQ ID NO: 51856 - RNA, 30 nt, Artificial Sequence
  IQ domain-containing protein G (71-80)
accaccgaccagcugagcauccucaacuac

SEQ ID NO: 51857 - RNA, 27 nt, Artificial Sequence
  Glutamate receptor ionotropic, kainate 5 (78-86)
accaccgacacgaugugccagauccug

SEQ ID NO: 51858 - RNA, 27 nt, Artificial Sequence
  Heterogeneous nuclear ribonucleoproteins A2/B1 (20-28)
accaccgaggagagccugcgcaacuac

SEQ ID NO: 51859 - RNA, 27 nt, Artificial Sequence
  Apoptosis-stimulating of p53 protein 1 (687-695)
accaccgagcagauccccagcccggug

SEQ ID NO: 51860 - RNA, 39 nt, Artificial Sequence
  Transformer-2 protein homolog beta (29-41)
accaccgagcgcgaccugcgggagguguucagcaaguac

SEQ ID NO: 51861 - RNA, 27 nt, Artificial Sequence
  Pre-mRNA-processing-splicing factor 8 (1254-1262)
accaccuucacgaagaucgugaacaag

SEQ ID NO: 51862 - RNA, 33 nt, Artificial Sequence
  Suppressor of tumorigenicity 7 protein (228-238)
accaccaucgccgaggccgagaagcuguucaag

SEQ ID NO: 51863 - RNA, 27 nt, Artificial Sequence
  Lysine-specific demethylase 6B (1272-1280)
accaccaucgccaaguacgcccaguac

SEQ ID NO: 51864 - RNA, 36 nt, Artificial Sequence
  TOX high mobility group box family member 4 (142-153)
accaccaucgaccagagcgagcuguccagccagcuc

SEQ ID NO: 51865 - RNA, 33 nt, Artificial Sequence
  Nucleolar protein 10 (56-66)
accaccaucaaggugagcaaggacggccaguac

SEQ ID NO: 51866 - RNA, 39 nt, Artificial Sequence
  V-type proton ATPase subunit F (43-55)
accaccaucaacgagaucgaggacacguuccgccaguuc

SEQ ID NO: 51867 - RNA, 30 nt, Artificial Sequence
  Large neutral amino acids transporter small subunit 1 (108-117)
accaccaucagcaaguccggcggggacuac

SEQ ID NO: 51868 - RNA, 27 nt, Artificial Sequence
  WD repeat-containing protein 3 (883-891)
accaccaucagcaaggugucccagguc

SEQ ID NO: 51869 - RNA, 27 nt, Artificial Sequence
  Succinyl-CoA ligase (ADP/GDP-forming) subunit alpha, mitochondrial (321-329)
accaccaucuacaaggaguucgagaag

SEQ ID NO: 51870 - RNA, 27 nt, Artificial Sequence
  Neurofilament light polypeptide (267-275)
accaccaagagcgagauggcccgcuac

SEQ ID NO: 51871 - RNA, 30 nt, Artificial Sequence
  Melanoma-associated antigen D1 (152-161)
accaccaaggugggccccaacgccacguac

SEQ ID NO: 51872 - RNA, 33 nt, Artificial Sequence
  Glycosylphosphatidylinositol anchor attachment 1 protein (526-536)
accaccauggugcccacggccgcccuggcgaag

SEQ ID NO: 51873 - RNA, 27 nt, Artificial Sequence
  Urocortin-2 (100-108)
accaccaacgcccgcauccuggcccgg

SEQ ID NO: 51874 - RNA, 27 nt, Artificial Sequence
  Reticulon-1 (204-212)
accacccccgugaagaucacgcugacc

SEQ ID NO: 51875 - RNA, 33 nt, Artificial Sequence
  Probable E3 ubiquitin-protein ligase HERC1 (3302-3312)
accaccguggacgacagcauccagcgcaaguuc

SEQ ID NO: 51876 - RNA, 36 nt, Artificial Sequence
  Ubiquitin carboxyl-terminal hydrolase 19 (1362-1373)
accaccguggacgagagccaggucgugacgcgcuac

SEQ ID NO: 51877 - RNA, 30 nt, Artificial Sequence
  40S ribosomal protein S6 (125-134)
accaccgugccccgccggcugggcccgaag

SEQ ID NO: 51878 - RNA, 27 nt, Artificial Sequence
  Aminoacyl tRNA synthase complex-interacting multifunctional protein 2 (206-214)
accguggccgacgucgugcuguggagc

SEQ ID NO: 51879 - RNA, 30 nt, Artificial Sequence
  Aminoacyl tRNA synthase complex-interacting multifunctional protein 2 (206-215)
accguggccgacgucgugcuguggagcgug

SEQ ID NO: 51880 - RNA, 30 nt, Artificial Sequence
  Protein FAM73B (18-27)
accguggccgagauccccgucuuccuguac

SEQ ID NO: 51881 - RNA, 30 nt, Artificial Sequence
  Carboxypeptidase Q (271-280)
accguggccgagaucaccggcagcaaguac

SEQ ID NO: 51882 - RNA, 27 nt, Artificial Sequence
  Dynein heavy chain 14, axonemal (3163-3171)
accguggccgagaagcagcugcucgcc

SEQ ID NO: 51883 - RNA, 27 nt, Artificial Sequence
  Protein phosphatase 1K, mitochondrial (191-199)
accguggcccugcuccgcgacggcauc

SEQ ID NO: 51884 - RNA, 27 nt, Artificial Sequence
  Abl interactor 2 (96-104)
accguggacauccacaaggagaagguc

SEQ ID NO: 51885 - RNA, 27 nt, Artificial Sequence
  Volume-regulated anion channel subunit LRRC8B (622-630)
accguggaggagaucaucagcuuccag

SEQ ID NO: 51886 - RNA, 33 nt, Artificial Sequence
  Vimentin (446-456)
accguggagacccgcgacggccaggucaucaac

SEQ ID NO: 51887 - RNA, 27 nt, Artificial Sequence
  Olfactory receptor 51G2 (211-219)
accgugggcaucgacagccugcucauc

SEQ ID NO: 51888 - RNA, 36 nt, Artificial Sequence
  Exocyst complex component 7 (401-412)
accgugcacgagcugaccagcaacgccauccucuuc

SEQ ID NO: 51889 - RNA, 27 nt, Artificial Sequence
  WD repeat-containing protein 70 (364-372)
accgugcaccccaaguuccacuacaag

SEQ ID NO: 51890 - RNA, 27 nt, Artificial Sequence
  Eukaryotic translation initiation factor 3 subunit C-like protein (818-826)
accgugcacagcaucaucuccaagaug

SEQ ID NO: 51891 - RNA, 30 nt, Artificial Sequence
  Transmembrane emp24 domain-containing protein 3 (153-162)
accgugaucgacagccagacccacuaccgc

SEQ ID NO: 51892 - RNA, 30 nt, Artificial Sequence
  60S ribosomal protein L7-like 1 (171-180)
accgugaucgaggagcaccugggcaaguuc

SEQ ID NO: 51893 - RNA, 27 nt, Artificial Sequence
  Ubiquitin carboxyl-terminal hydrolase 24 (488-496)
accgugaucgagaacauccacaccauc

SEQ ID NO: 51894 - RNA, 27 nt, Artificial Sequence
  Integrin alpha-2 (988-996)
accgugaucauccacaucccccaguac

SEQ ID NO: 51895 - RNA, 33 nt, Artificial Sequence
  Actin filament-associated protein 1-like 1 (208-218)
accgugauccgcgaggaccagcugcucugcuac

SEQ ID NO: 51896 - RNA, 33 nt, Artificial Sequence
  Angiomotin (709-719)
accgugaucagccacucccccaacaccagcuac

SEQ ID NO: 51897 - RNA, 39 nt, Artificial Sequence
  Interferon-induced protein 44 (52-64)
accgugaucuacagcgaggaccacaucaucggcgccuac

SEQ ID NO: 51898 - RNA, 27 nt, Artificial Sequence
  Structural maintenance of chromosomes flexible hinge domain-containing protein 1 (90-98)
accgugaaggacggcgucacccuguac

SEQ ID NO: 51899 - RNA, 27 nt, Artificial Sequence
  Microtubule-actin cross-linking factor 1 isoform X31 (4329-4337)
accgugaaggaccagcugaacgagaug

SEQ ID NO: 51900 - RNA, 27 nt, Artificial Sequence
  DnaJ homolog subfamily B member 1 (332-340)
accgugcuggagcagguccuccccauc

SEQ ID NO: 51901 - RNA, 27 nt, Artificial Sequence
  Prostaglandin E2 receptor EP4 subtype (335-343)
accgugcugagcaaggccaucgagaag

SEQ ID NO: 51902 - RNA, 30 nt, Artificial Sequence
  Carboxypeptidase Q (441-450)
accgugauggaccccaagcagaugaacguc

SEQ ID NO: 51903 - RNA, 27 nt, Artificial Sequence
  Embryonic stem cell-specific 5-hydroxymethylcytosine-binding protein (101-109)
accgugauggagaagcgcagcuucaag

SEQ ID NO: 51904 - RNA, 36 nt, Artificial Sequence
  MICOS complex subunit MIC13 (90-101)
accgugaugagcgcccuguccgucgcccccagcaag

SEQ ID NO: 51905 - RNA, 27 nt, Artificial Sequence
  Zinc finger protein 3 (182-190)
accgugaacagcaaccugaucucccac

SEQ ID NO: 51906 - RNA, 27 nt, Artificial Sequence
  mucin-3A isoform (865-873)
accgugcagaacaccgagaucagcauc

SEQ ID NO: 51907 - RNA, 33 nt, Artificial Sequence
  Zinc finger BED domain-containing protein 4 (806-816)
accgugaccgacaacgccagcaucggcaagacg

SEQ ID NO: 51908 - RNA, 36 nt, Artificial Sequence
  Transmembrane protein 186 (82-93)
accguggucgcccugcccccgggcuacuaccucuac

SEQ ID NO: 51909 - RNA, 27 nt, Artificial Sequence
  RNA-binding protein Musashi homolog 2 (17-25)
accguggucgaggacgugaagcaguac

SEQ ID NO: 51910 - RNA, 36 nt, Artificial Sequence
  Serine/threonine-protein kinase A-Raf (31-42)
accguggucaccgugcgcgacggcaugagcguguac

SEQ ID NO: 51911 - RNA, 27 nt, Artificial Sequence
  Putative oxidoreductase GLYR1 (235-243)
accguguggaaccgcaccgccgagaag

SEQ ID NO: 51912 - RNA, 39 nt, Artificial Sequence
  RNA-binding protein 26 (673-685)
accguguacaaccccgccgcccugaaggcggcccagaag

SEQ ID NO: 51913 - RNA, 33 nt, Artificial Sequence
  Junction plakoglobin (21-31)
accuacgacagcggcauccacuccggggccaac

SEQ ID NO: 51914 - RNA, 48 nt, Artificial Sequence
  Caprin-1 (572-587)
accuaccacggcagccccgaccagucccaccaggugaccgggaaccac

SEQ ID NO: 51915 - RNA, 27 nt, Artificial Sequence
  Spartin (153-161)
guggccgcccccgcgagccugucccuc

SEQ ID NO: 51916 - RNA, 30 nt, Artificial Sequence
  Phosphatidylinositol 3,4,5-trisphosphate 5-phosphatase 2 (908-917)
guggccgcccccccgcccaagaacagcuuc

SEQ ID NO: 51917 - RNA, 30 nt, Artificial Sequence
  Dolichyl-diphosphooligosaccharide-proteinosyltransferase subunit 2 (450-459)
guggccgagcccgacaacaagaacgucuac

SEQ ID NO: 51918 - RNA, 33 nt, Artificial Sequence
  Sodium/iodide cotransporter (484-494)
guggcccugagcgucaacgccuccggccuccug

SEQ ID NO: 51919 - RNA, 27 nt, Artificial Sequence
  Transcription elongation factor SPT5 (216-224)
guggcccccgagcacgucaagggcuac

SEQ ID NO: 51920 - RNA, 30 nt, Artificial Sequence
  DNA-dependent protein kinase catalytic subunit (2797-2806)
guggcccagcgcgaccccaucaucgccaag

SEQ ID NO: 51921 - RNA, 27 nt, Artificial Sequence
  Tetratricopeptide repeat protein 21B (25-33)
guggccagcgagggcaucaagcgcuac

SEQ ID NO: 51922 - RNA, 27 nt, Artificial Sequence
  Probable E3 ubiquitin-protein ligase HERC1 (1139-1147)
guggaccuggagcgcaccaucgcccuc

SEQ ID NO: 51923 - RNA, 27 nt, Artificial Sequence
  Cytoplasmic dynein 1 heavy chain 1 (795-803)
guggaggagcgcaacaccaucagccug

SEQ ID NO: 51924 - RNA, 33 nt, Artificial Sequence
  L-dopachrome tautomerase (152-162)
guggaggagacccccggcuggccgaccacgcug

SEQ ID NO: 51925 - RNA, 27 nt, Artificial Sequence
  Glycogen phosphorylase, brain form (505-513)
guggagaagaucggcgaggaguuccug

SEQ ID NO: 51926 - RNA, 33 nt, Artificial Sequence
  Receptor-type tyrosine-protein phosphatase delta (635-645)
guggagaagcagaacggcaucaucaccgaguac

SEQ ID NO: 51927 - RNA, 24 nt, Artificial Sequence
  Phosphatidylinositol 3,4,5-trisphosphate-dependent Rac exchanger 1 protein (160-167)
guggagcugaacaagauccccacc

SEQ ID NO: 51928 - RNA, 27 nt, Artificial Sequence
  Prosaposin (299-307)
guggagcccaucaagaagcacgagguc

SEQ ID NO: 51929 - RNA, 30 nt, Artificial Sequence
  Coiled-coil domain-containing protein 13 (514-523)
guggagagcgcccugacccgccccucccuc

SEQ ID NO: 51930 - RNA, 36 nt, Artificial Sequence
  Protein ZGRF1 (799-810)
guggaggucgagaccgcccgcgagggcaagcaguac

SEQ ID NO: 51931 - RNA, 33 nt, Artificial Sequence
  Proteasome subunit alpha type-1 (104-114)
guguucgaccgcccccugccggucagccggcuc

SEQ ID NO: 51932 - RNA, 33 nt, Artificial Sequence
  ATP-dependent RNA helicase DDX3X (408-418)
gugggcagcaccuccgagaacaucacccagaag

SEQ ID NO: 51933 - RNA, 27 nt, Artificial Sequence
  Protocadherin-18 (261-269)
gugggcacccugcuccuggaccugaac

SEQ ID NO: 51934 - RNA, 30 nt, Artificial Sequence
  THO complex subunit 4 (113-122)
gugcacuacgaccgcagcggccggucccug

SEQ ID NO: 51935 - RNA, 36 nt, Artificial Sequence
  Butyrophilin subfamily 3 member A3 secreted isoform (174-185)
gugauccuggaccccgacaccgccaacgccauccuc

SEQ ID NO: 51936 - RNA, 21 nt, Artificial Sequence
  Trafficking protein particle complex subunit 8 (106-112)
gugaucaccgccggcgacuac

SEQ ID NO: 51937 - RNA, 30 nt, Artificial Sequence
  P antigen family member 5 (46-55)
gugaucguccagcagcccaccgaggagaag

SEQ ID NO: 51938 - RNA, 42 nt, Artificial Sequence
  Myosin-10 (20-33)
gugaucuacaaccccgccacccaggccgacuggaccgcgaag

SEQ ID NO: 51939 - RNA, 33 nt, Artificial Sequence
  Protein-methionine sulfoxide oxidase MICAL1 (432-442)
gugcuggccgagcgcgagagccucuaccagcug

SEQ ID NO: 51940 - RNA, 30 nt, Artificial Sequence
  Protocadherin alpha-1 (636-645)
gugcuggacgaggccgaccucagccgcuac

SEQ ID NO: 51941 - RNA, 27 nt, Artificial Sequence
  NF-kappa-B inhibitor epsilon (286-294)
gugcuggacauccagaacaaccucuac

SEQ ID NO: 51942 - RNA, 33 nt, Artificial Sequence
  Peroxisomal trans-2-enoyl-CoA reductase (146-156)
gugcuggagaccaaccucaccggcacguucuac

SEQ ID NO: 51943 - RNA, 33 nt, Artificial Sequence
  Translocon-associated protein subunit alpha (19-29)
gugcuguuccgcggcgggccccggggccuccug

SEQ ID NO: 51944 - RNA, 27 nt, Artificial Sequence
  ETS translocation variant 5 (79-87)
gugcugcacgcccccccgcccaccaag

SEQ ID NO: 51945 - RNA, 27 nt, Artificial Sequence
  Sorting nexin-14 (176-184)
gugcugauccgccggauccacaagguc

SEQ ID NO: 51946 - RNA, 36 nt, Artificial Sequence
  Transcription initiation factor IIE subunit beta (280-291)
gugcugaaggacuacagcgacaucaccuccagcaag

SEQ ID NO: 51947 - RNA, 33 nt, Artificial Sequence
  Adenosylhomocysteinase 2 (123-133)
gugcugcucgccgagggccgccugcugaaccuc

SEQ ID NO: 51948 - RNA, 33 nt, Artificial Sequence
  Splicing factor 3B subunit 2 (163-173)
gugcugcucgagcaggagcgccagcaggagauc

SEQ ID NO: 51949 - RNA, 39 nt, Artificial Sequence
  Sodium-dependent phosphate transporter 1 (75-87)
gugcugcucggcgccaaggucagcgagaccauccgcaag

SEQ ID NO: 51950 - RNA, 30 nt, Artificial Sequence
  HCG2043033, isoform CRA_b (11-20)
gugcugaugggccucccccuggcccaggcc

SEQ ID NO: 51951 - RNA, 30 nt, Artificial Sequence
  Armadillo repeat-containing X-linked protein 1 (210-219)
gugcugaacauccucgagcgcaccaacgac

SEQ ID NO: 51952 - RNA, 27 nt, Artificial Sequence
  Protein GPR108 (359-367)
gugcugagcgacaaggagaagaagguc

SEQ ID NO: 51953 - RNA, 30 nt, Artificial Sequence
  Leucine-rich repeat-containing protein 1 (295-304)
gugcugaccgagaaccagcuccugacccug

SEQ ID NO: 51954 - RNA, 33 nt, Artificial Sequence
  2',3'-cyclic-nucleotide 3'-phosphodiesterase (126-136)
gugcuggucgagcccaagaccgccuggcgccuc

SEQ ID NO: 51955 - RNA, 33 nt, Artificial Sequence
  Zinc finger CCHC domain-containing protein 14 (120-130)
gugcuguggagcgacuccagcaucaccuccguc

SEQ ID NO: 51956 - RNA, 30 nt, Artificial Sequence
  ADP/ATP translocase 1 (288-297)
gugcuguacgacgagaucaagaaguacguc

SEQ ID NO: 51957 - RNA, 36 nt, Artificial Sequence
  Sodium/potassium/calcium exchanger 5 (423-434)
gugcuguacgagcucggcaucaucgggaacaacaag

SEQ ID NO: 51958 - RNA, 33 nt, Artificial Sequence
  Cytoplasmic dynein 1 heavy chain 1 (3839-3849)
gugcuguacgagaaccccaaccucaagggcguc

SEQ ID NO: 51959 - RNA, 45 nt, Artificial Sequence
  Dolichyl-diphosphooligosaccharide-proteinosyltransferase subunit 4 (23-37)
gugcuguaccacuacgucgccgugaacaaccccaagaagcaggag

SEQ ID NO: 51960 - RNA, 39 nt, Artificial Sequence
  Ras-related protein Rab-27A (25-37)
gugcuguaccaguacaccgacggcaaguucaacagcaag

SEQ ID NO: 51961 - RNA, 24 nt, Artificial Sequence
  HLA class I histocompatibility antigen, A-29 alpha chain (3-10)
gugauggccccccgcacccugcuc

SEQ ID NO: 51962 - RNA, 27 nt, Artificial Sequence
  Embryonic stem cell-specific 5-hydroxymethylcytosine-binding protein (102-110)
gugauggagaagcgcagcuucaagguc

SEQ ID NO: 51963 - RNA, 33 nt, Artificial Sequence
  Ribosomal protein S6 kinase alpha-2 (56-66)
gugauguucaccgaggaggacgucaaguucuac

SEQ ID NO: 51964 - RNA, 27 nt, Artificial Sequence
  Antigen KI-67 (115-123)
gugaugcacacccccccgguccugaag

SEQ ID NO: 51965 - RNA, 39 nt, Artificial Sequence
  Transient receptor potential cation channel subfamily V member 2 (253-265)
gugaugaucagcgacaacuccgccgagaacaucgcccug

SEQ ID NO: 51966 - RNA, 27 nt, Artificial Sequence
  Signal transducer and activator of transcription 1-alpha/beta (134-142)
gugaugcuggacaagcagaaggagcuc

SEQ ID NO: 51967 - RNA, 30 nt, Artificial Sequence
  Poly(U)-binding-splicing factor PUF60 (175-184)
gugaugcugggcgggcgcaacaucaagguc

SEQ ID NO: 51968 - RNA, 27 nt, Artificial Sequence
  Transcriptional coactivator YAP1 (72-80)
gugaugaaccccaagaccgccaacguc

SEQ ID NO: 51969 - RNA, 27 nt, Artificial Sequence
  CD63 antigen (111-119)
gugaugagcgaguucaacaacaacuuc

SEQ ID NO: 51970 - RNA, 30 nt, Artificial Sequence
  Ras-related C3 botulinum toxin substrate 1 (44-53)
gugauggucgacggcaagcccgugaaccug

SEQ ID NO: 51971 - RNA, 33 nt, Artificial Sequence
  Uncharacterized protein C4orf36 (5-15)
gugccccgcaagaacaccgucaagaccauccug

SEQ ID NO: 51972 - RNA, 27 nt, Artificial Sequence
  Zinc finger protein ZFAT (1182-1190)
gugcagcaggccagcgucgagcuggcc

SEQ ID NO: 51973 - RNA, 27 nt, Artificial Sequence
  tRNA wybutosine-synthesizing protein 4 (287-295)
gugcagugggacggccgccuguaccac

SEQ ID NO: 51974 - RNA, 27 nt, Artificial Sequence
  Pre-mRNA-processing-splicing factor 8 (1168-1176)
gugcagugggagaacagcuucgucucc

SEQ ID NO: 51975 - RNA, 33 nt, Artificial Sequence
  Unconventional myosin-X (553-563)
gugcaguacgacguccgcggcauccuggagaag

SEQ ID NO: 51976 - RNA, 54 nt, Artificial Sequence
  Probable ATP-dependent RNA helicase DDX5 (550-567)
gugagcgccggcauccagaccuccuuccgcaccgggaaccccacgggcaccuac

SEQ ID NO: 51977 - RNA, 27 nt, Artificial Sequence
  60S ribosomal protein L24 (148-156)
gugagcgccccccgcgucggcgggaag

SEQ ID NO: 51978 - RNA, 27 nt, Artificial Sequence
  NADH dehydrogenase (ubiquinone) iron-sulfur protein 2, mitochondrial (8-16)
gugagcgacggcuccagccgccccuac

SEQ ID NO: 51979 - RNA, 27 nt, Artificial Sequence
  Single Ig IL-1-related receptor (387-395)
gugagcgaccugggcucccgcaacuac

SEQ ID NO: 51980 - RNA, 27 nt, Artificial Sequence
  MAM domain-containingosylphosphatidylinositol anchor protein 1 (140-148)
gugagcgacguccgcggcaacuucuac

SEQ ID NO: 51981 - RNA, 33 nt, Artificial Sequence
  Protein eva-1 homolog A (27-37)
gugagcgagaaccccgagcgcgccgcccuguac

SEQ ID NO: 51982 - RNA, 27 nt, Artificial Sequence
  Clustered mitochondria protein homolog (512-520)
gugagccacccccgcuaccuggagcuc

SEQ ID NO: 51983 - RNA, 27 nt, Artificial Sequence
  ER degradation-enhancing alpha-mannosidase-like protein 2 (270-278)
gugagcaugcccgucuuccagucccug

SEQ ID NO: 51984 - RNA, 33 nt, Artificial Sequence
  Transmembrane protein 50A (73-83)
gugagcaacggccagguccgcggggacuccuac

SEQ ID NO: 51985 - RNA, 36 nt, Artificial Sequence
  Natriuretic peptides A (87-98)
gugagccccgcccagcgcgacggcggggcccugggc

SEQ ID NO: 51986 - RNA, 27 nt, Artificial Sequence
  Pre-mRNA-processing-splicing factor 8 (2131-2139)
gugagccccccggacaacccccagguc

SEQ ID NO: 51987 - RNA, 33 nt, Artificial Sequence
  PRO2822 (92-102)
gugagccaggacggccugaaccuccugacccug

SEQ ID NO: 51988 - RNA, 30 nt, Artificial Sequence
  PAB-dependent poly(A)-specific ribonuclease subunit PAN3 (183-192)
gugagccagacccccuccagcggccagguc

SEQ ID NO: 51989 - RNA, 30 nt, Artificial Sequence
  Heat shock cognate 71 kDa protein (536-545)
gugagcuccaagaacagccuggaguccuac

SEQ ID NO: 51990 - RNA, 27 nt, Artificial Sequence
  Zinc finger protein with KRAB and SCAN domains 2 (134-142)
gugagcucccccguccaccgcgagaag

SEQ ID NO: 51991 - RNA, 33 nt, Artificial Sequence
  Complex I assembly factor TMEM126B, mitochondrial (46-56)
gugaccgacaagcuguucgucaucgacgcccuc

SEQ ID NO: 51992 - RNA, 27 nt, Artificial Sequence
  Uncharacterized protein C11orf63 (295-303)
gugaccgacaagaccagcauccagaac

SEQ ID NO: 51993 - RNA, 27 nt, Artificial Sequence
  Receptor-type tyrosine-protein phosphatase zeta (705-713)
gugaccgaccuggagaugccccacuac

SEQ ID NO: 51994 - RNA, 24 nt, Artificial Sequence
  F-box/LRR-repeat protein 7 (316-323)
gugaccgacgucggcauccgcuac

SEQ ID NO: 51995 - RNA, 33 nt, Artificial Sequence
  Heterogeneous nuclear ribonucleoprotein Q (266-276)
gugaccgagggccugaccgacgucauccucuac

SEQ ID NO: 51996 - RNA, 24 nt, Artificial Sequence
  Filamin-A (2353-2360)
gugaccgagaucgaccaggacaag

SEQ ID NO: 51997 - RNA, 30 nt, Artificial Sequence
  1-acyl-sn-glycerol-3-phosphate acyltransferase gamma (296-305)
gugaccgagaucgagaagggcagcuccuac

SEQ ID NO: 51998 - RNA, 30 nt, Artificial Sequence
  Carbonic anhydrase-related protein (181-190)
gugaccgagauccugcaggacauccaguac

SEQ ID NO: 51999 - RNA, 30 nt, Artificial Sequence
  Short-chain-specific acyl-CoA dehydrogenase, mitochondrial (369-378)
gugaccgagaugcccgccgagcgccacuac

SEQ ID NO: 52000 - RNA, 27 nt, Artificial Sequence
  Tyrosine-protein kinase TXK (10-18)
gugaccgagaacaagaucaccaaccug

SEQ ID NO: 52001 - RNA, 21 nt, Artificial Sequence
  Integrin beta-3 (336-342)
gugaccgagaacgucgugaac

SEQ ID NO: 52002 - RNA, 27 nt, Artificial Sequence
  Integrin beta-3 (336-344)
gugaccgagaacgucgugaaccuguac

SEQ ID NO: 52003 - RNA, 36 nt, Artificial Sequence
  Integrin beta-3 (336-347)
gugaccgagaacgucgugaaccuguaccagaacuac

SEQ ID NO: 52004 - RNA, 30 nt, Artificial Sequence
  Myosin phosphatase Rho-interacting protein (65-74)
gugaccgaguaccccguccagcgcaacuac

SEQ ID NO: 52005 - RNA, 27 nt, Artificial Sequence
  Lymphocyte antigen 6E (61-69)
gugaccuucggccacagccuguccaag

SEQ ID NO: 52006 - RNA, 27 nt, Artificial Sequence
  OX-2 membraneoprotein (76-84)
gugaccuucagcgagaaccacggcguc

SEQ ID NO: 52007 - RNA, 30 nt, Artificial Sequence
  Annexin A9 (3-12)
gugaccggcgggaagauggcccccagccug

SEQ ID NO: 52008 - RNA, 30 nt, Artificial Sequence
  Zinc finger FYVE domain-containing protein 16 (97-106)
gugaccggccuggaccuccugagcuccguc

SEQ ID NO: 52009 - RNA, 33 nt, Artificial Sequence
  Kinesin-like protein KIF6 (24-34)
gugaccaucgacgacaacaagcagauccugaag

SEQ ID NO: 52010 - RNA, 27 nt, Artificial Sequence
  RNA pseudouridylate synthase domain-containing protein 1 (112-120)
gugaccaucagccacgccaucggccgc

SEQ ID NO: 52011 - RNA, 27 nt, Artificial Sequence
  Endoribonuclease Dicer (827-835)
gugaccaucagcaucgagcugaagaag

SEQ ID NO: 52012 - RNA, 33 nt, Artificial Sequence
  FACT complex subunit SPT16 (3-13)
gugacccuggacaaggacgccuacuaccgccgg

SEQ ID NO: 52013 - RNA, 27 nt, Artificial Sequence
  Pappalysin-1 (689-697)
gugacccuggagugguuccccccgauc

SEQ ID NO: 52014 - RNA, 30 nt, Artificial Sequence
  Autophagy-related protein 9A (411-420)
gugacccugcucggcgucaccgugacggug

SEQ ID NO: 52015 - RNA, 30 nt, Artificial Sequence
  WD repeat-containing protein 70 (23-32)
gugaccaugggcuucaccggguucggcaag

SEQ ID NO: 52016 - RNA, 33 nt, Artificial Sequence
  Small subunit processome component 20 homolog (830-840)
gugaccaaccccgacaucgccgccaagaagaag

SEQ ID NO: 52017 - RNA, 27 nt, Artificial Sequence
  DNA (cytosine-5)-methyltransferase 1 (1422-1430)
gugaccaaccccgagccgaugggcaag

SEQ ID NO: 52018 - RNA, 27 nt, Artificial Sequence
  Beta-parvin (138-146)
gugacccagagcgagaucggccagaag

SEQ ID NO: 52019 - RNA, 27 nt, Artificial Sequence
  Polymerase delta-interacting protein 3 (410-418)
gugaccacccagcccacggaguucaag

SEQ ID NO: 52020 - RNA, 30 nt, Artificial Sequence
  Polycystin-1 (1443-1452)
gugaccgucaccgccagcaacaacaucucc

SEQ ID NO: 52021 - RNA, 27 nt, Artificial Sequence
  LisH domain-containing protein ARMC9 (225-233)
gugaccuaccugaagcgcuacaacaag

SEQ ID NO: 52022 - RNA, 33 nt, Artificial Sequence
  Trafficking protein particle complex subunit 2-like protein (8-18)
guggucgacgagaagaucagcgccaugggcaag

SEQ ID NO: 52023 - RNA, 30 nt, Artificial Sequence
  Beta-actin-like protein 2 (10-19)
guggucgacaacggcagcgggaugugcaag

SEQ ID NO: 52024 - RNA, 36 nt, Artificial Sequence
  Beta-actin-like protein 2 (10-21)
guggucgacaacggcagcgggaugugcaaggccggc

SEQ ID NO: 52025 - RNA, 27 nt, Artificial Sequence
  Cytosolic acyl coenzyme A thioester hydrolase (273-281)
guggucgacagcucccagaagcgcuac

SEQ ID NO: 52026 - RNA, 30 nt, Artificial Sequence
  Catalase (55-64)
guggucuucaccgacgagauggcccacuuc

SEQ ID NO: 52027 - RNA, 33 nt, Artificial Sequence
  RAB6A-GEF complex partner protein 2 (239-249)
guggucggcacccugaaccucggggagggcacc

SEQ ID NO: 52028 - RNA, 33 nt, Artificial Sequence
  Retroviral-like aspartic protease 1 (242-252)
guggucaagguggccaacggcgccgagaugaag

SEQ ID NO: 52029 - RNA, 33 nt, Artificial Sequence
  Thiosulfate sulfurtransferase (97-107)
guggucuacgacggcgagcaccuggggagcuuc

SEQ ID NO: 52030 - RNA, 27 nt, Artificial Sequence
  Keratinocyte-associated transmembrane protein 2 (212-220)
guggucuacaucaccuaccacaacaag

SEQ ID NO: 52031 - RNA, 39 nt, Artificial Sequence
  HLA class I histocompatibility antigen, B-40 alpha chain (243-255)
ugggccgccguggucgugcccagcggcgaggagcagcgc

SEQ ID NO: 52032 - RNA, 27 nt, Artificial Sequence
  Glycerol kinase (156-164)
uggcugcucgacaacgugcgcaagguc

SEQ ID NO: 52033 - RNA, 33 nt, Artificial Sequence
  Protein transport protein Sec61 subunit alpha isoform 1 (324-334)
uggagcgacaccuccagcggcgggcccgcccgc

SEQ ID NO: 52034 - RNA, 30 nt, Artificial Sequence
  Ubiquitin carboxyl-terminal hydrolase 48 (533-542)
uacgccgccgacaucuucuacagccgcuac

SEQ ID NO: 52035 - RNA, 27 nt, Artificial Sequence
  RNA-binding protein 14 (528-536)
uacgccgcccagcagcacccccaggcg

SEQ ID NO: 52036 - RNA, 33 nt, Artificial Sequence
  Unconventional myosin-Va (62-72)
uacgccgacgaccccaagaaguaccagagcuac

SEQ ID NO: 52037 - RNA, 30 nt, Artificial Sequence
  V-type proton ATPase subunit B, kidney isoform (384-393)
uacgccaucggcaaggacgugcaggccaug

SEQ ID NO: 52038 - RNA, 27 nt, Artificial Sequence
  Junction plakoglobin (245-253)
uacgccaucaccacccugcacaaccuc

SEQ ID NO: 52039 - RNA, 27 nt, Artificial Sequence
  Threonine-tRNA ligase, mitochondrial (546-554)
uacgccaaggaggcccagcagagccug

SEQ ID NO: 52040 - RNA, 27 nt, Artificial Sequence
  G2/mitotic-specific cyclin-B2 (368-376)
uacgccagcuccaagcugcucaagauc

SEQ ID NO: 52041 - RNA, 27 nt, Artificial Sequence
  Heterogeneous nuclear ribonucleoprotein L (430-438)
uacgccguggaccgcgccaucacccac

SEQ ID NO: 52042 - RNA, 33 nt, Artificial Sequence
  Protein-methionine sulfoxide oxidase MICAL3 (803-813)
uacgccuacgacaucgaggacggcaaguucuac

SEQ ID NO: 52043 - RNA, 27 nt, Artificial Sequence
  Hypoxia-inducible factor 1-alpha (254-262)
uacugcgacgagcgcaucaccgagcug

SEQ ID NO: 52044 - RNA, 27 nt, Artificial Sequence
  Zinc finger protein 362 (287-295)
uacugcgacaagagcuuccgccagcug

SEQ ID NO: 52045 - RNA, 39 nt, Artificial Sequence
  Cofilin-1 (85-97)
uacgacgccaccuacgagaccaaggagagcaagaaggag

SEQ ID NO: 52046 - RNA, 30 nt, Artificial Sequence
  Melanoma antigen preferentially expressed in tumors (448-457)
uacgaggacauccacggcacccugcaccuc

SEQ ID NO: 52047 - RNA, 27 nt, Artificial Sequence
  Transmembrane protein 9B (93-101)
uacgaggagcgcagcuccgugaccauc

SEQ ID NO: 52048 - RNA, 33 nt, Artificial Sequence
  Ubiquitin-like protein 5 (60-70)
uacgagauccacgacggcaugaaccuggagcuc

SEQ ID NO: 52049 - RNA, 36 nt, Artificial Sequence
  HLA class I histocompatibility antigen, alpha chain E (124-135)
uacgagcaguucgccuacgacggcaaggacuaccug

SEQ ID NO: 52050 - RNA, 27 nt, Artificial Sequence
  Carbohydrate sulfotransferase 14 (199-207)
uacggcgccgagaucgugcgccgguac

SEQ ID NO: 52051 - RNA, 27 nt, Artificial Sequence
  RNA-binding protein 14 (474-482)
uacggcgcccaggccagcauggggcug

SEQ ID NO: 52052 - RNA, 33 nt, Artificial Sequence
  Transcription factor SOX-10 (412-422)
uacggccacagcgggcaggccuccggccuguac

SEQ ID NO: 52053 - RNA, 36 nt, Artificial Sequence
  Heterogeneous nuclear ribonucleoproteins A2/B1 (243-254)
uacggcagcgggaacuacaacgacuucggcaacuac

SEQ ID NO: 52054 - RNA, 30 nt, Artificial Sequence
  RNMT-activating mini protein (107-116)
uacggcuacaaccagcgccccccguacggg

SEQ ID NO: 52055 - RNA, 30 nt, Artificial Sequence
  Histone deacetylase complex subunit SAP130 (880-889)
uacaucgacgaggagggcgugcgcuacguc

SEQ ID NO: 52056 - RNA, 33 nt, Artificial Sequence
  Cleft lip and palate transmembrane protein 1 (409-419)
uacauccuggacaacgagaccaacuucgugguc

SEQ ID NO: 52057 - RNA, 33 nt, Artificial Sequence
  Negative elongation factor C/D (47-57)
uacaucauggagcccagcaucuucaacacccug

SEQ ID NO: 52058 - RNA, 27 nt, Artificial Sequence
  Filamin-B (1580-1588)
uacauccccgacaagaccggccgcuac

SEQ ID NO: 52059 - RNA, 27 nt, Artificial Sequence
  Beta-catenin-interacting protein 1 (15-23)
uacauccagcagaaggugcgcguccug

SEQ ID NO: 52060 - RNA, 30 nt, Artificial Sequence
  Signal recognition particle 9 kDa protein (18-27)
uaccuggccgaccccaugaaggcccgcgug

SEQ ID NO: 52061 - RNA, 27 nt, Artificial Sequence
  S-phase kinase-associated protein 1 (33-41)
uaccuggacaucaagggccuccuggac

SEQ ID NO: 52062 - RNA, 30 nt, Artificial Sequence
  Procollagen-lysine,2-oxoglutarate 5-dioxygenase 3 (199-208)
uaccuggaccccggccuccgcgagaagcug

SEQ ID NO: 52063 - RNA, 30 nt, Artificial Sequence
  Protein dpy-30 homolog (56-65)
uaccuggaccagaccgugguccccauccuc

SEQ ID NO: 52064 - RNA, 33 nt, Artificial Sequence
  Lysyl oxidase homolog 4 (547-557)
uaccuggaggaccgcccccucagccagcuguac

SEQ ID NO: 52065 - RNA, 36 nt, Artificial Sequence
  Ectonucleotide pyrophosphatase/phosphodiesterase family member 1 (319-330)
uaccuggaggagcccgacagcuccggccacagcuac

SEQ ID NO: 52066 - RNA, 27 nt, Artificial Sequence
  HLA class I histocompatibility antigen, Cw-8 alpha chain (170-178)
uaccuggagaacggcaagaagacccuc

SEQ ID NO: 52067 - RNA, 33 nt, Artificial Sequence
  Prolyl endopeptidase (353-363)
uaccugcacgacgugaagaacauccuccagcug

SEQ ID NO: 52068 - RNA, 33 nt, Artificial Sequence
  Unconventional myosin-Vb (79-89)
uaccugcacgagcccgccgugcuccacaaccug

SEQ ID NO: 52069 - RNA, 33 nt, Artificial Sequence
  Dystonin (981-991)
uaccugaucaacgagaucgaccgcauccgggcc

SEQ ID NO: 52070 - RNA, 33 nt, Artificial Sequence
  Tubulin polyglutamylase TTLL5 (191-201)
uaccugaucaacaaccccaaccagaucagccuc

SEQ ID NO: 52071 - RNA, 36 nt, Artificial Sequence
  Vacuolar protein sorting-associated protein 13C (2639-2650)
uaccugcucgagggcaccgccgagacccacgagcug

SEQ ID NO: 52072 - RNA, 27 nt, Artificial Sequence
  Unconventional myosin-XIX (218-226)
uaccugcucgagaagacccgcguggcc

SEQ ID NO: 52073 - RNA, 30 nt, Artificial Sequence
  Transforming growth factor-beta receptor-associated protein 1 (431-440)
uaccugaacgaggugcgcagcaccgagguc

SEQ ID NO: 52074 - RNA, 33 nt, Artificial Sequence
  CD302 antigen (163-173)
uaccugagcgacaaccacauccucaucuccgcc

SEQ ID NO: 52075 - RNA, 33 nt, Artificial Sequence
  GPI inositol-deacylase (41-51)
uacauguucgaguaccccgaguaccagaagauc

SEQ ID NO: 52076 - RNA, 33 nt, Artificial Sequence
  Methyl-CpG-binding domain protein 4 (530-540)
uaccccaucgagcugcacggcaucgggaaguac

SEQ ID NO: 52077 - RNA, 27 nt, Artificial Sequence
  TRIO and F-actin-binding protein (394-402)
uaccaggaggagcugagccgcgagcuc

SEQ ID NO: 52078 - RNA, 27 nt, Artificial Sequence
  ATP synthase-coupling factor 6, mitochondrial (75-83)
uaccagcaggagcuggagcgcgagcuc

SEQ ID NO: 52079 - RNA, 33 nt, Artificial Sequence
  Caprin-1 (665-675)
uaccagcgcgacggcuaccagcagaacuucaag

SEQ ID NO: 52080 - RNA, 30 nt, Artificial Sequence
  Melanocyte protein PMEL (485-494)
uaccgcuacggcagcuucuccgugacccug

SEQ ID NO: 52081 - RNA, 30 nt, Artificial Sequence
  PDZ and LIM domain protein 2 (315-324)
uacagcgcccccgccacccuguccagccgc

SEQ ID NO: 52082 - RNA, 45 nt, Artificial Sequence
  Interleukin enhancer-binding factor 3 (690-704)
uacagcgacuucuucaccgacugcuacggcuaccacgacuucggg

SEQ ID NO: 52083 - RNA, 27 nt, Artificial Sequence
  Sphingosine-1-phosphate lyase 1 (366-374)
uacagcgacaagaaguaccgcaacuac

SEQ ID NO: 52084 - RNA, 51 nt, Artificial Sequence
  Cold-inducible RNA-binding protein (151-167)
uacagcgaccgcuccagcggcggguccuaccgggacagcuacgacuccuac

SEQ ID NO: 52085 - RNA, 30 nt, Artificial Sequence
  AF4/FMR2 family member 2 (1092-1101)
uacagcgagaccguggagcugcuccgcuac

SEQ ID NO: 52086 - RNA, 45 nt, Artificial Sequence
  Ribonucleoprotein PTB-binding 1 (601-615)
uacagcuucgacuaccccuccgacaugggcccgcgccggcuguuc

SEQ ID NO: 52087 - RNA, 45 nt, Artificial Sequence
  Heterogeneous nuclear ribonucleoprotein A1 (260-274)
uacagcggcgggucccgcggcuacgggagcggcgggcagggcuac

SEQ ID NO: 52088 - RNA, 39 nt, Artificial Sequence
  Interleukin enhancer-binding factor 3 (624-636)
uacagcggcuccgggggccgcagcgggggcaacuccuac

SEQ ID NO: 52089 - RNA, 39 nt, Artificial Sequence
  Heterogeneous nuclear ribonucleoprotein D-like (222-234)
uacagcggcuacgggggcuacgacuacaccggguacaac

SEQ ID NO: 52090 - RNA, 42 nt, Artificial Sequence
  Heterogeneous nuclear ribonucleoprotein D-like (222-235)
uacagcggcuacgggggcuacgacuacaccggguacaacuac

SEQ ID NO: 52091 - RNA, 42 nt, Artificial Sequence
  Caprin-1 (662-675)
uacagcggcuaccagcgcgacggguaccagcagaacuucaag

SEQ ID NO: 52092 - RNA, 24 nt, Artificial Sequence
  Transmembrane protein 214 (171-178)
uacagccuggugucccgcgagcuc

SEQ ID NO: 52093 - RNA, 57 nt, Artificial Sequence
  Cold-inducible RNA-binding protein (142-160)
uacagcucccgcagccaguccggcggguacagcgaccgguccagcggcggguccuac

SEQ ID NO: 52094 - RNA, 27 nt, Artificial Sequence
  Condensin complex subunit 2 (428-436)
uacagcuacuucuccccccgcaccaug

SEQ ID NO: 52095 - RNA, 24 nt, Artificial Sequence
  CBP80/20-dependent translation initiation factor (506-513)
uacaccugccugcgcgagcuccug

SEQ ID NO: 52096 - RNA, 36 nt, Artificial Sequence
  Transcription factor SOX-10 (369-380)
uacaccgaccagcccagcaccucccagaucgccuac

SEQ ID NO: 52097 - RNA, 42 nt, Artificial Sequence
  Sialidase-1 (400-413)
uacaccgagagcaucuccguggccaagaucagcgucuacggc

SEQ ID NO: 52098 - RNA, 27 nt, Artificial Sequence
  Metalloproteinase inhibitor 3 (48-56)
uacaccaucaagcagaugaagauguac

SEQ ID NO: 52099 - RNA, 27 nt, Artificial Sequence
  Nodal modulator 2 (59-67)
uacaccaagcacggcacccugaaguac

SEQ ID NO: 52100 - RNA, 36 nt, Artificial Sequence
  Cyclin-dependent kinase 1 (4-15)
uacaccaagaucgagaagaucggcgaggggaccuac

SEQ ID NO: 52101 - RNA, 33 nt, Artificial Sequence
  Syndecan-3 (347-357)
uacacccuggaggagcccaagcaggccagcgug

SEQ ID NO: 52102 - RNA, 27 nt, Artificial Sequence
  Nuclear receptor ROR-beta (229-237)
uacaccauggaggagcugcaccagcuc

SEQ ID NO: 52103 - RNA, 45 nt, Artificial Sequence
  Caprin-1 (651-665)
uacacccagagccaguucuccgccccccgcgacuacagcggcuac

SEQ ID NO: 52104 - RNA, 27 nt, Artificial Sequence
  ATP-binding cassette sub-family B member 8, mitochondrial (162-170)
uacacccgcgaccacgugggcagcuuc

SEQ ID NO: 52105 - RNA, 27 nt, Artificial Sequence
  ATP-dependent 6-phosphofructokinase, platelet type (378-386)
uacaccaccgacuucaucuaccagcug

SEQ ID NO: 52106 - RNA, 33 nt, Artificial Sequence
  Sulfhydryl oxidase 2 (323-333)
uacaccguggaccuggagagcggccuccacuac

SEQ ID NO: 52107 - RNA, 27 nt, Artificial Sequence
  ER degradation-enhancing alpha-mannosidase-like protein 2 (322-330)
uacaccguggagaagcgcgagggcuac

SEQ ID NO: 52108 - RNA, 33 nt, Artificial Sequence
  Membrane-associated transporter protein (439-449)
uacaccgugcccuucaaccugaucaccgaguac

SEQ ID NO: 52109 - RNA, 27 nt, Artificial Sequence
  Dolichyl-diphosphooligosaccharide-proteinosyltransferase 48 kDa subunit (325-333)
uacaccgugaccgaccuggucgaguac

SEQ ID NO: 52110 - RNA, 36 nt, Artificial Sequence
  Sulfhydryl oxidase 1 (728-739)
uacaccuacuuccaggccaagauccgcgcccugaag

SEQ ID NO: 52111 - RNA, 30 nt, Artificial Sequence
  Eukaryotic translation initiation factor 3 subunit E (286-295)
uacaccuacaaggaccccaucaccgaguuc

SEQ ID NO: 52112 - RNA, 33 nt, Artificial Sequence
  ATP-binding cassette sub-family A member 7 (1610-1620)
uacguggcccccgccaaccugccggcgcuccug

SEQ ID NO: 52113 - RNA, 33 nt, Artificial Sequence
  General transcription factor 3C polypeptide 1 (627-637)
uacguggacgacgccagcuggaugcgcuacauc

SEQ ID NO: 52114 - RNA, 27 nt, Artificial Sequence
  Spectrin alpha chain, non-erythrocytic 1 (2453-2461)
uacguggacggcaaggggcgcgagcug

SEQ ID NO: 52115 - RNA, 33 nt, Artificial Sequence
  Tribbles homolog 1 (157-167)
uacguguucuucgagaaggacuucggcgacaug

SEQ ID NO: 52116 - RNA, 27 nt, Artificial Sequence
  Kelch domain-containing protein 10 (220-228)
uacguguucggcgggaccaccggcuac

SEQ ID NO: 52117 - RNA, 30 nt, Artificial Sequence
  Actin, aortic smooth muscle (55-64)
uacgugggcgacgaggcccagagcaagcgc

SEQ ID NO: 52118 - RNA, 33 nt, Artificial Sequence
  Actin, aortic smooth muscle (55-65)
uacgugggcgacgaggcccagagcaagcgcggg

SEQ ID NO: 52119 - RNA, 33 nt, Artificial Sequence
  E3 ubiquitin-protein ligase HUWE1 (1115-1125)
uacgugggcaucgccacccugaucgccaacuac

SEQ ID NO: 52120 - RNA, 30 nt, Artificial Sequence
  Ankyrin repeat and SAM domain-containing protein 1A (113-122)
uacgugcacagcuuccuguccagcggcuac

SEQ ID NO: 52121 - RNA, 36 nt, Artificial Sequence
  Cytospin-A (477-488)
uacgugaucgacgaggacgucaagagcggccgcuac

SEQ ID NO: 52122 - RNA, 39 nt, Artificial Sequence
  Cytospin-A (477-489)
uacgugaucgacgaggacgucaagagcggccgcuacaug

SEQ ID NO: 52123 - RNA, 27 nt, Artificial Sequence
  Kelch-like protein 42 (328-336)
uacgugaucggcggguacaccacccgc

SEQ ID NO: 52124 - RNA, 27 nt, Artificial Sequence
  Lysosome-associated membraneoprotein 2 (396-404)
uacgugaucggccgccggaagagcuac

SEQ ID NO: 52125 - RNA, 36 nt, Artificial Sequence
  Lysosome-associated membraneoprotein 2 (396-407)
uacgugaucggccgccggaagagcuacgccggguac

SEQ ID NO: 52126 - RNA, 33 nt, Artificial Sequence
  Tyrosinase (149-159)
uacgugauccccaucggcaccuacgggcagaug

SEQ ID NO: 52127 - RNA, 30 nt, Artificial Sequence
  Partner of Y14 and mago (5-14)
uacgugaccgacgagaccggcgggaaguac

SEQ ID NO: 52128 - RNA, 36 nt, Artificial Sequence
  Solute carrier family 25 member 33 (176-187)
uacguguaccagaccgagggcauccgcggguucuac

SEQ ID NO: 52129 - RNA, 30 nt, Artificial Sequence
  Plexin-A1 (224-233)
uacguguacagcuuccgcuccgagcaguuc

SEQ ID NO: 52130 - RNA, 27 nt, Artificial Sequence
  L-dopachrome tautomerase (190-198)
uacuacagcgugcgcgacacccugcuc

SEQ ID NO: 52131 - RNA, 30 nt, Artificial Sequence
  GTPase Kras (52-61) mod
cugcucgacauccuggacaccgccggccug

SEQ ID NO: 52132 - RNA, 27 nt, Artificial Sequence
  GTPase Kras (5-13) mod
aagcugguggucgugggcgccggggug

SEQ ID NO: 52133 - RNA, 30 nt, Artificial Sequence
  GTPase Kras (5-14) mod
aagcugguggucgugggcgccgccggggug

SEQ ID NO: 52134 - RNA, 33 nt, Artificial Sequence
  GTPase Kras (51-61) mod
ugccugcucgacauccuggacaccgccggccug

SEQ ID NO: 52135 - RNA, 27 nt, Artificial Sequence
  GTPase Kras (51-59)
ugccugcucgacauccuggacaccgcc

SEQ ID NO: 52136 - RNA, 27 nt, Artificial Sequence
  GTPase Kras (5-13) mod
aagcugguggucgugggcgccugcgug

SEQ ID NO: 52137 - RNA, 30 nt, Artificial Sequence
  GTPase Kras (5-14)
aagcugguggucgugggcgccgggggcgug

SEQ ID NO: 52138 - RNA, 30 nt, Artificial Sequence
  GTPase Kras (5-14) mod
aagcugguggucgugggcgccagcggggug

SEQ ID NO: 52139 - RNA, 30 nt, Artificial Sequence
  GTPase Kras (5-14) mod
aagcugguggucgugggcgccgacggggug

SEQ ID NO: 52140 - RNA, 30 nt, Artificial Sequence
  GTPase Kras (5-14) mod
aagcugguggucgugggcgccugcggggug

SEQ ID NO: 52141 - RNA, 27 nt, Artificial Sequence
  GTPase Kras (1-9)
augaccgaguacaagcugguggucgug

SEQ ID NO: 52142 - RNA, 30 nt, Artificial Sequence
  GTPase Kras (5-14) mod
aagcugguggucgugggcgccguggggguc

SEQ ID NO: 52143 - RNA, 96 nt, Artificial Sequence
  GTPase Kras (1-33) mod
augaccgaguacaagcugguggucgugggcgccgccggggugggcaagagcgcgcucaccauccagcugauccagaaccacuucgucgacgaguac

SEQ ID NO: 52144 - RNA, 96 nt, Artificial Sequence
  GTPase Kras (1-33) mod
augaccgaguacaagcugguggucgugggcgccagcggggugggcaaguccgcccucaccauccagcugauccagaaccacuucgucgacgaguac

SEQ ID NO: 52145 - RNA, 96 nt, Artificial Sequence
  GTPase Kras (1-33) mod
augaccgaguacaagcugguggucgugggcgccggggacgugggcaagagcgcccucaccauccagcugauccagaaccacuucgucgacgaguac

SEQ ID NO: 52146 - RNA, 75 nt, Artificial Sequence
  GTPase Kras (1-26) mod
augaccgaguacaaccugguggucgugggcgccgggggcguggggaagagcgcccucaccauccagcugauccag

SEQ ID NO: 52147 - RNA, 123 nt, Artificial Sequence
  GTPase Kras mod (3-43)
agcuaccgcaagcagguggucaucgacggcgagaccugccugcucgacauccuggacaccacggggcaggaggaguacuccgccaugcgggaccaguacaugcgcaccggcgagggguuccug

SEQ ID NO: 52148 - RNA, 27 nt, Artificial Sequence
  BRAF (597-605) V600E
cuggccaccgagaagagccgcuggucc

SEQ ID NO: 52149 - RNA, 30 nt, Artificial Sequence
  BRAF (597-606) V600E
cuggccaccgagaagagccgcugguccggc

SEQ ID NO: 52150 - RNA, 30 nt, Artificial Sequence
  BRAF(597-606) V600M
cuggccaccaugaagagccgcugguccggc

SEQ ID NO: 52151 - RNA, 27 nt, Artificial Sequence
  p53 wt (65-73)
cgcaugcccgaggccgccccgcccgug

SEQ ID NO: 52152 - RNA, 27 nt, Artificial Sequence
  p53 wt (149-157)
agcacccccccgcccggcacccgcgug

SEQ ID NO: 52153 - RNA, 33 nt, Artificial Sequence; identical to SEQ ID NO: 28006
  p53 wt (187-197)

SEQ ID NO: 52154 - RNA, 27 nt, Artificial Sequence
  p53 wt (217-225)
gugguccccuacgagccgcccgaggug

SEQ ID NO: 52155 - RNA, 27 nt, Artificial Sequence
  p53 wt (264-272)
cugcucggccgcaacagcuucgaggug

SEQ ID NO: 52156 - RNA, 27 nt, Artificial Sequence
  p53 wt (125134)
accuaccccgcccugaacaagauguuc

SEQ ID NO: 52157 - RNA, 27 nt, Artificial Sequence
  p53 wt (161169)
gccaucuacaagcagagccagcacaug

SEQ ID NO: 52158 - RNA, 27 nt, Artificial Sequence
  p53 wt (204212)
gaguaccuggacgaccgcaacaccuuc

SEQ ID NO: 52159 - RNA, 42 nt, Artificial Sequence
  p53 wt (108-122)
ggcuuccgccugggguuccuccacagcggcaccgccuccgug

SEQ ID NO: 52160 - RNA, 42 nt, Artificial Sequence
  p53 wt (110-124)
cgccugggcuuccuccacagcgggaccgccuccgugaccugc

SEQ ID NO: 52161 - RNA, 39 nt, Artificial Sequence
  p53 wt (25-35)
cuguggaagcuccugcccgagaacaacgugcugagcccg

SEQ ID NO: 52162 - RNA, 45 nt, Artificial Sequence
  p53 wt (108-122)
ggcuuccgccugggguuccuccacagcggcaccgccaaguccgug

SEQ ID NO: 52163 - RNA, 42 nt, Artificial Sequence
  p53 wt (153-166)
cccggcacccgcgugcgggccauggccaucuacaagcagagc

SEQ ID NO: 52164 - RNA, 123 nt, Artificial Sequence
  BRAF (442-482)
ggccgccgggacagcuccgacgacugggagauccccgacgggcagaucaccgugggccagaucaucgggagcggcuccuucgggaccgucuacaagggcaaguggcacggcgacguggccgug

SEQ ID NO: 52165 - RNA, 123 nt, Artificial Sequence
  BRAF (443-483)
cgccgggacagcuccgacgacugggagauccccgacggccagaucaccguggggcagcgcagcggcuccgggagcuucggcaccgucuacaaggggaaguggcacggcgacguggccgugaag

SEQ ID NO: 52166 - RNA, 123 nt, Artificial Sequence
  BRAF (444-484)
cgcgacagcuccgacgacugggagauccccgacggccagaucaccguggggcagcggaucgagagcggcuccuucgggaccgucuacaagggcaaguggcacggggacguggccgugaagaug

SEQ ID NO: 52167 - RNA, 123 nt, Artificial Sequence
  BRAF (581-621)
aacaucuuccugcacgaggaccucaccgugaagaucggcgacuucgggcuggccaccgucgagagccgcugguccggcagccaccaguucgagcagcuguccgggagcauccucuggauggcc

SEQ ID NO: 52168 - RNA, 123 nt, Artificial Sequence
  BRAF (446-486)
agcuccgacgacugggagauccccgacggccagaucaccguggggcagcgcaucggcagcgucuccuucgggaccguguacaagggcaaguggcacggggacguggccgucaagaugcugaac

SEQ ID NO: 52169 - RNA, 123 nt, Artificial Sequence
  BRAF (577-617)
cugaagagcaacaacaucuuccuccacgaggaccugaccgugaagaucggcgacuucgggcgcgccaccgucaagucccgguggagcggcucccaccaguucgagcagcugagcggguccauc

SEQ ID NO: 52170 - RNA, 123 nt, Artificial Sequence
  BRAF (449-489)
gacugggagauccccgacggccagaucaccguggggcagcgcaucggcagcggguccuucgccaccgucuacaagggcaaguggcacggggacguggccgugaagaugcugaacgucacggcg

SEQ ID NO: 52171 - RNA, 123 nt, Artificial Sequence
  BRAF (449-489)
gacugggagauccccgacggccagaucaccguggggcagcgcaucggcagcggguccuuccggaccgucuacaagggcaaguggcacggggacguggccgugaagaugcugaacgucacggcc

SEQ ID NO: 52172 - RNA, 123 nt, Artificial Sequence
  BRAF (574-614)
caccgcgaccugaagagcaacaacaucuuccuccacgaggaccugaccgugaagaucggcggguucggccuggccaccgucaagucccgguggagcgggucccaccaguucgagcagcucagc

SEQ ID NO: 52173 - RNA, 27 nt, Artificial Sequence
  Melanoma antigen recognized by T-cells 1 (27-35)
gccgcuggcaucgggauucugaccgug

SEQ ID NO: 52174 - RNA, 27 nt, Artificial Sequence
  Eukaryotic translation initiation factor 4 gamma 1 (1073-1081)
gccgcuagacccgcaaccagcacacug

SEQ ID NO: 52175 - RNA, 33 nt, Artificial Sequence
  Histone H1.2 (49-59)
gccgcuagcaaggagagauccggcgugucucug

SEQ ID NO: 52176 - RNA, 30 nt, Artificial Sequence
  Cyclin-dependent kinase 4 (23-32)
gccugcgacccccacagcggccauuucgug

SEQ ID NO: 52177 - RNA, 30 nt, Artificial Sequence
  40S ribosomal protein S21 (37-46)
gccgagguggacaaggucaccggcagauuc

SEQ ID NO: 52178 - RNA, 27 nt, Artificial Sequence
  DNA replication licensing factor MCM4 (694-702)
gcccacagcaccaucaugcccagacug

SEQ ID NO: 52179 - RNA, 27 nt, Artificial Sequence
  Actin, gamma-enteric smooth muscle (277-285)
gcccuggcucccagcaccaugaagauc

SEQ ID NO: 52180 - RNA, 30 nt, Artificial Sequence; identical to SEQ ID NO: 27953
  Melanocyte protein PMEL (231-240)

SEQ ID NO: 52181 - RNA, 27 nt, Artificial Sequence
  Phospholipid transfer protein (2-10)
gcccuguucggcgcucucuuucuugca

SEQ ID NO: 52182 - RNA, 27 nt, Artificial Sequence
  Vimentin (332-340)
gcccugaagggcaccaacgagagccuc

SEQ ID NO: 52183 - RNA, 27 nt, Artificial Sequence
  Eukaryotic translation initiation factor 3 subunit D (439-447)
gcccugcucgcuggcagcgaguaccuu

SEQ ID NO: 52184 - RNA, 27 nt, Artificial Sequence
  Melanocyte protein PMEL (24-32)
gcccugcucgcugugggcgcaaccaag

SEQ ID NO: 52185 - RNA, 27 nt, Artificial Sequence
  Melanoma antigen recognized by T-cells 1 (56-64)
gcccugauggacaagagccuccacgug

SEQ ID NO: 52186 - RNA, 27 nt, Artificial Sequence
  Melanocyte protein PMEL (94-102)
gcccugaacuuccccggcagccagaag

SEQ ID NO: 52187 - RNA, 27 nt, Artificial Sequence
  Melanoma-associated antigen 1 (301-309)
gcccugagagaggaagaggaaggcgug

SEQ ID NO: 52188 - RNA, 27 nt, Artificial Sequence
  Fructose-bisphosphate aldolase A (98-106)
gcccugagcgaccaccauaucuaccuc

SEQ ID NO: 52189 - RNA, 36 nt, Artificial Sequence
  Guanine nucleotide-binding protein G(I)/G(S)/G(T) subunit beta-2 (167-178)
gcccugugggacaucgagaccggccagcaaacagug

SEQ ID NO: 52190 - RNA, 27 nt, Artificial Sequence
  ER membrane protein complex subunit 7 (4-12)
gcccuguggggcuucuuucccgugcuc

SEQ ID NO: 52191 - RNA, 30 nt, Artificial Sequence
  Melanocyte protein PMEL (184-193)
gccaugcugggcacccacacaauggaggug

SEQ ID NO: 52192 - RNA, 27 nt, Artificial Sequence
  Actin, cytoplasmic 1 (14-22)
gcccccgaggaacacccugugcugcuc

SEQ ID NO: 52193 - RNA, 27 nt, Artificial Sequence
  High mobility group protein B1 (94-102)
gcccccaagagaccuccaagcgcuuuc

SEQ ID NO: 52194 - RNA, 27 nt, Artificial Sequence
  Coiled-coil-helix-coiled-coil-helix domain-containing protein 2 (49-57)
gcccccagacagccuggccugauggcu

SEQ ID NO: 52195 - RNA, 27 nt, Artificial Sequence
  HLA class II histocompatibility antigen, DP beta 1 chain (9-17)
gcccccagaaccguggcucugacagca

SEQ ID NO: 52196 - RNA, 27 nt, Artificial Sequence
  60S ribosomal protein L13 (189-197)
gccagacuguucggcaucagggcuaag

SEQ ID NO: 52197 - RNA, 27 nt, Artificial Sequence
  Thymosin beta-10 (16-24)
gccagcuucgacaaggcuaaacugaag

SEQ ID NO: 52198 - RNA, 27 nt, Artificial Sequence
  Guanine nucleotide-binding protein G(s) subunit alpha isoforms short (239-247)
gccagcuccucuuacaacauggugauc

SEQ ID NO: 52199 - RNA, 24 nt, Artificial Sequence
  Guanine nucleotide-binding protein subunit beta-2-like 1 (251-258)
gccaccggccccagcaucaagauu

SEQ ID NO: 52200 - RNA, 27 nt, Artificial Sequence
  Bax inhibitor 1 (91-99)
gccuacgugcacauggucacccauuuc

SEQ ID NO: 52201 - RNA, 27 nt, Artificial Sequence
  Wilms tumor protein (235-243)
ugcaugaccuggaaccagaugaaucug

SEQ ID NO: 52202 - RNA, 27 nt, Artificial Sequence
  Melanocyte protein PMEL (647-655)
ugccccaucggcgagaacagcccucug

SEQ ID NO: 52203 - RNA, 48 nt, Artificial Sequence
  Gamma-secretase C-terminal fragment 59 (562-577)
gacgccgaguucagacacgauagcggcuacgaagugcaucaccagaag

SEQ ID NO: 52204 - RNA, 51 nt, Artificial Sequence
  Gamma-secretase C-terminal fragment 59 (562-578)
gacgccgaguucagacacgauagcggcuacgaagugcaucaccagaagcug

SEQ ID NO: 52205 - RNA, 27 nt, Artificial Sequence
  Thymidylate synthase (254-262)
gacgcccacaucuaccugaaccauauu

SEQ ID NO: 52206 - RNA, 27 nt, Artificial Sequence
  60S ribosomal protein L10 (28-36)
gacgccaagaucagaauuuucgaucug

SEQ ID NO: 52207 - RNA, 27 nt, Artificial Sequence
  Lys-63-specific deubiquitinase BRCC36 (221-229)
gacgccuacagaaggauccacagccug

SEQ ID NO: 52208 - RNA, 27 nt, Artificial Sequence
  Myelin basic protein (109-117)
gacgagaaccccgugguccacuucuuu

SEQ ID NO: 52209 - RNA, 27 nt, Artificial Sequence
  Vimentin (219-227)
gaccuggagagaaagguggaaagccuc

SEQ ID NO: 52210 - RNA, 45 nt, Artificial Sequence
  HLA class I histocompatibility antigen, A-2 alpha chain (29-43)
gacacccaguucgugagauuugauagcgacgccgcuucccaaagg

SEQ ID NO: 52211 - RNA, 54 nt, Artificial Sequence
  HLA class I histocompatibility antigen, A-2 alpha chain (29-46)
gacacccaguucgugagauuugauagcgacgccgcuucccaaaggauggagccc

SEQ ID NO: 52212 - RNA, 30 nt, Artificial Sequence
  Melanoma antigen recognized by T-cells 1 (26-35)
gaggccgcuggcaucgggauucugaccgug

SEQ ID NO: 52213 - RNA, 27 nt, Artificial Sequence
  Melanoma-associated antigen 1 (161-169)
gaggccgaccccaccggccacagcuac

SEQ ID NO: 52214 - RNA, 27 nt, Artificial Sequence
  Ragulator complex protein LAMTOR5 (40-48)
gagcacgccggcgugaucagcguccug

SEQ ID NO: 52215 - RNA, 30 nt, Artificial Sequence
  Mart-1 (26-35)
gagcuggccggcaucgggauucucaccgug

SEQ ID NO: 52216 - RNA, 27 nt, Artificial Sequence
  40S ribosomal protein S25 (75-83)
gagagacugaagaucaggggcagccuc

SEQ ID NO: 52217 - RNA, 27 nt, Artificial Sequence
  Actin, cytoplasmic 1 (364-372)
gagagcggccccuccaucgugcacaga

SEQ ID NO: 52218 - RNA, 27 nt, Artificial Sequence
  POTE ankyrin domain family member F (825-833)
gagaccuucaacacacccgccauguac

SEQ ID NO: 52219 - RNA, 30 nt, Artificial Sequence
  Mortality factor 4-like protein 1 (312-321)
gagguggcccccccugaauaccacagaaag

SEQ ID NO: 52220 - RNA, 27 nt, Artificial Sequence
  Melanoma-associated antigen 3 (168-176)
gagguggaccccaucggccaccuguac

SEQ ID NO: 52221 - RNA, 27 nt, Artificial Sequence
  Heme oxygenase 1 (103-111)
gaggugauccccuacaccccugccaug

SEQ ID NO: 52222 - RNA, 27 nt, Artificial Sequence
  G2/mitotic-specific cyclin-B1 (18-26)
uucgccuuugugaccgacaacacauac

SEQ ID NO: 52223 - RNA, 27 nt, Artificial Sequence
  Proteasome subunit alpha type-5 (154-162)
uuccacauggaccccagcggcaccuuu

SEQ ID NO: 52224 - RNA, 27 nt, Artificial Sequence
  Protein THEMIS2 (597-605)
uucaucaaggacggcagcuccaccuac

SEQ ID NO: 52225 - RNA, 30 nt, Artificial Sequence
  Vimentin (123-132)
uuccuggagcagcaaaacaagauccuccuu

SEQ ID NO: 52226 - RNA, 30 nt, Artificial Sequence
  Fatty acid synthase (2335-2344)
uuccuguuugacggcagccccaccuacgug

SEQ ID NO: 52227 - RNA, 33 nt, Artificial Sequence
  Fatty acid synthase (2335-2345)
uuccuguuugacggcagccccaccuacgugcuc

SEQ ID NO: 52228 - RNA, 27 nt, Artificial Sequence
  Mammaglobin-A (66-74)
uuccugaaccagaccgacgagacacuc

SEQ ID NO: 52229 - RNA, 27 nt, Artificial Sequence
  Melanoma-associated antigen 3 (271-279)
uuccuguggggccccagagcccucgug

SEQ ID NO: 52230 - RNA, 27 nt, Artificial Sequence
  Actin-related protein 2 (27-35)
uuccccgagcacaucuuuccugcccug

SEQ ID NO: 52231 - RNA, 27 nt, Artificial Sequence
  60S ribosomal protein L28 (38-46)
uucagauacaacggccugauccacagg

SEQ ID NO: 52232 - RNA, 27 nt, Artificial Sequence
  60S acidic ribosomal protein P0 (67-75)
ggccaccuggagaacaaucccgcccuc

SEQ ID NO: 52233 - RNA, 33 nt, Artificial Sequence
  Cellular tumor antigen p53 (62-72)
ggccuggcccccccucagcaccucaucagagug

SEQ ID NO: 52234 - RNA, 27 nt, Artificial Sequence
  Proteasome subunit beta type-3 (55-63)
ggccuggccaccgacgugcagacaguc

SEQ ID NO: 52235 - RNA, 27 nt, Artificial Sequence
  DNA (cytosine-5)-methyltransferase 1 (425-433)
ggccugaucgagaagaacauugaacuc

SEQ ID NO: 52236 - RNA, 27 nt, Artificial Sequence
  Catenin beta-1 (400-408)
ggccugcucgggacccuugugcagcug

SEQ ID NO: 52237 - RNA, 27 nt, Artificial Sequence
  Myosin-9 (338-346)
ggccugcucagagugaucagcgggguc

SEQ ID NO: 52238 - RNA, 30 nt, Artificial Sequence
  Reticulocalbin-2 (4-13)
ggccccagaaccgccgcucuggggcuccuu

SEQ ID NO: 52239 - RNA, 30 nt, Artificial Sequence
  Heterogeneous nuclear ribonucleoprotein A1 (339-348)
ggccccuacgggggagguggccaguauuuc

SEQ ID NO: 52240 - RNA, 27 nt, Artificial Sequence
  60S ribosomal protein L8 (127-135)
ggcagaaucgacaagcccauucugaaa

SEQ ID NO: 52241 - RNA, 27 nt, Artificial Sequence
  Cellular tumor antigen p53 (5-13)
ggcagaaacagcuucgaggugaggguc

SEQ ID NO: 52242 - RNA, 30 nt, Artificial Sequence
  Ribonucleoside-diphosphate reductase subunit M2 (238-247)
ggcagcuucgccuccaucuuuuggcugaag

SEQ ID NO: 52243 - RNA, 27 nt, Artificial Sequence
  Melanocyte protein PMEL (467-475)
ggcaccgccacacugagacucgugaag

SEQ ID NO: 52244 - RNA, 30 nt, Artificial Sequence
  Melanoma-associated antigen B2 (231-240)
ggcguguacgacggggaggaacacagcguc

SEQ ID NO: 52245 - RNA, 27 nt, Artificial Sequence
  Protein SSX2 (17-25)
ggcuacgaccagaucaugcccaagaaa

SEQ ID NO: 52246 - RNA, 27 nt, Artificial Sequence
  Proliferating cell nuclear antigen (241-249)
aucgccgacaugggccaccugaaguac

SEQ ID NO: 52247 - RNA, 27 nt, Artificial Sequence
  Receptor tyrosine-protein kinase erbB-2 (654-662)
aucauuagcgccguggucggcauacug

SEQ ID NO: 52248 - RNA, 27 nt, Artificial Sequence
  Heat shock protein HSP 90-beta (496-504)
auccuggacaagaaaguggagaagguc

SEQ ID NO: 52249 - RNA, 27 nt, Artificial Sequence
  Ornithine decarboxylase (23-31)
auccuggaccagaagauuaacgaggug

SEQ ID NO: 52250 - RNA, 27 nt, Artificial Sequence
  Ubiquitin-conjugating enzyme E2 E3 (97-105)
auccugggccccccugggagcguguac

SEQ ID NO: 52251 - RNA, 27 nt, Artificial Sequence
  Vimentin (130-138)
auccugcucgccgagcuugaacagcug

SEQ ID NO: 52252 - RNA, 27 nt, Artificial Sequence
  60S ribosomal protein L19 (137-145)
auccugauggagcacauucauaagcuc

SEQ ID NO: 52253 - RNA, 27 nt, Artificial Sequence
  Small nuclear ribonucleoprotein-associated proteins B and B' (13-21)
auccugcaggacggcagaauuuucaua

SEQ ID NO: 52254 - RNA, 27 nt, Artificial Sequence
  Elongation factor 2 (161-169)
auccugaccgacauuacaaagggcgug

SEQ ID NO: 52255 - RNA, 27 nt, Artificial Sequence
  Melanoma antigen recognized by T-cells 1 (32-40)
auccugaccgugauucucggcguccuu

SEQ ID NO: 52256 - RNA, 27 nt, Artificial Sequence
  Putative small nuclear ribonucleoprotein G-like protein 15 (68-76)
aucaugcuggaggcccucgaaagagug

SEQ ID NO: 52257 - RNA, 27 nt, Artificial Sequence
  Serine-tRNA ligase, cytoplasmic (357-365)
auccccuaccacauugugaacauaguc

SEQ ID NO: 52258 - RNA, 48 nt, Artificial Sequence
  Beta-2-microglobulin (21-36)
auccagagaacccccaagauucaaguguacagcaggcacccugccgag

SEQ ID NO: 52259 - RNA, 27 nt, Artificial Sequence
  ADP/ATP translocase 2 (79-87)
aucagauacuuccccacccaggcccug

SEQ ID NO: 52260 - RNA, 27 nt, Artificial Sequence
  Acyl-CoA desaturase (20-28)
aucaccgcccccccuagcagagugcug

SEQ ID NO: 52261 - RNA, 27 nt, Artificial Sequence
  Melanocyte protein PMEL (216-224)
aucaccgaccaggugcccuucagcguc

SEQ ID NO: 52262 - RNA, 27 nt, Artificial Sequence
  Ubiquitin-60S ribosomal protein L40 (68-76)
aaggagagcacccugcaccucgugcuu

SEQ ID NO: 52263 - RNA, 54 nt, Artificial Sequence
  Receptor tyrosine-protein kinase erbB-2 (369-386)
aagaucuucggcagccuggccuuucuccccgaguccuucgacggggauccugcu

SEQ ID NO: 52264 - RNA, 45 nt, Artificial Sequence
  Protein SSX2 (45-59)
aagaucuucuacguguauaugaaaagaaaguacgaggccaugacc

SEQ ID NO: 52265 - RNA, 30 nt, Artificial Sequence
  Vimentin (236-245)
aagcugcacgaggaagagauccaggaacuc

SEQ ID NO: 52266 - RNA, 27 nt, Artificial Sequence
  Myosin-9 (1843-1851)
aagcugaaagacgugcuccuucagguc

SEQ ID NO: 52267 - RNA, 30 nt, Artificial Sequence
  Prelamin-A/C (297-306)
aagcugcucgagggcgaagaggaaagacuu

SEQ ID NO: 52268 - RNA, 27 nt, Artificial Sequence
  Mammaglobin-A (2-10)
aagcugcucauggugcuuaugcuggcc

SEQ ID NO: 52269 - RNA, 27 nt, Artificial Sequence
  Heat shock cognate 71 kDa protein (126-134)
aagaugaaagagaucgccgaagcuuac

SEQ ID NO: 52270 - RNA, 27 nt, Artificial Sequence
  Melanoma-associated antigen 2 (140-148)
aagaugguggagcugguccacuuccuc

SEQ ID NO: 52271 - RNA, 27 nt, Artificial Sequence
  Beta-adrenergic receptor kinase 1 (667-675)
aagcccagaagcccuguggucgagcug

SEQ ID NO: 52272 - RNA, 27 nt, Artificial Sequence
  Farnesyl pyrophosphate synthase (184-192)
aagagauacaaaagcaucgugaaguau

SEQ ID NO: 52273 - RNA, 27 nt, Artificial Sequence
  Cellular tumor antigen p53 (139-147)
aagaccugccccgugcagcuguggguc

SEQ ID NO: 52274 - RNA, 27 nt, Artificial Sequence
  40S ribosomal protein S8 (75-83)
aagaccagaaucauugacguggucuac

SEQ ID NO: 52275 - RNA, 27 nt, Artificial Sequence
  Melanocyte protein PMEL (161-169)
aagaccuggggccaguacuggcaagug

SEQ ID NO: 52276 - RNA, 27 nt, Artificial Sequence
  Melanoma-associated antigen 1 (278-286)
aaggugcuggaguacgucaucaaaguu

SEQ ID NO: 52277 - RNA, 27 nt, Artificial Sequence
  Glutamate carboxypeptidase 2 (298-306)
aaguacgccgacaaaaucuauagcauu

SEQ ID NO: 52278 - RNA, 27 nt, Artificial Sequence
  Serine/threonine-protein phosphatase PP1-beta catalytic subunit (112-120)
aaguaccccgagaacuucuuucugcuc

SEQ ID NO: 52279 - RNA, 30 nt, Artificial Sequence
  Mammaglobin-A (83-92)
cugaucuacgacagcucccucugcgaucuu

SEQ ID NO: 52280 - RNA, 27 nt, Artificial Sequence
  ATP-binding cassette sub-family F member 2 (251-259)
cugcucgacgagcccaccaaccaccuu

SEQ ID NO: 52281 - RNA, 27 nt, Artificial Sequence
  Gamma-interferon-inducible lysosomal thiol reductase (24-32)
cugcucgacgugcccaccgccgcuguc

SEQ ID NO: 52282 - RNA, 27 nt, Artificial Sequence
  Cellular tumor antigen p53 (264-272)
cugcucggcagaaacagcuucgaggug

SEQ ID NO: 52283 - RNA, 30 nt, Artificial Sequence
  Gamma-interferon-inducible lysosomal thiol reductase (23-32)
cugcuccuugacgugcccaccgccgcuguc

SEQ ID NO: 52284 - RNA, 36 nt, Artificial Sequence
  Gamma-interferon-inducible lysosomal thiol reductase (15-26)
cugcuccuugacgugcccaccgccgcuguccaggca

SEQ ID NO: 52285 - RNA, 30 nt, Artificial Sequence
  Stress-70 protein, mitochondrial (436-445)
cugcuccuugacgugaccccccugagcuug

SEQ ID NO: 52286 - RNA, 27 nt, Artificial Sequence
  Mucin-1 (12-20)
cugcuccuucugaccguguugacaguc

SEQ ID NO: 52287 - RNA, 27 nt, Artificial Sequence
  Mammaglobin-A (4-12)
cugauggugcucaugcuugccgcucug

SEQ ID NO: 52288 - RNA, 27 nt, Artificial Sequence
  Melanocyte protein PMEL (527-535)
cugcccaaggaggccugcauggaaauc

SEQ ID NO: 52289 - RNA, 27 nt, Artificial Sequence
  Rac GTPase-activating protein 1 (403-411)
cugccccaggccaacagagacacccuc

SEQ ID NO: 52290 - RNA, 27 nt, Artificial Sequence
  Catenin beta-1 (370-378)
cugaccgaccccagccagagacucgug

SEQ ID NO: 52291 - RNA, 27 nt, Artificial Sequence
  HLA class I histocompatibility antigen, B-39 alpha chain (2-10)
cuggugauggcccccagaaccguccuc

SEQ ID NO: 52292 - RNA, 27 nt, Artificial Sequence
  40S ribosomal protein S16 (40-48)
augaucgagcccagaacccugcaguac

SEQ ID NO: 52293 - RNA, 27 nt, Artificial Sequence
  Melanocyte protein PMEL (185-193)
augcugggcacccacacaauggaggug

SEQ ID NO: 52294 - RNA, 27 nt, Artificial Sequence
  Tyrosinase (1-9)
augcugcucgccgugcuuuacugccug

SEQ ID NO: 52295 - RNA, 27 nt, Artificial Sequence
  HLA class I histocompatibility antigen, alpha chain E (1-9)
augguggacggcacccugcuccuucug

SEQ ID NO: 52296 - RNA, 27 nt, Artificial Sequence
  Vimentin (177-185)
aaccuggccgaggacaucaugagacuc

SEQ ID NO: 52297 - RNA, 27 nt, Artificial Sequence
  Bifunctional purine biosynthesis protein PURH (101-109)
aaccuguaccccuucgugaagaccguc

SEQ ID NO: 52298 - RNA, 48 nt, Artificial Sequence
  Transferrin receptor protein 1 (215-230)
aaccccggcggguacguggccuauagcaaggcugcaaccgucacagga

SEQ ID NO: 52299 - RNA, 54 nt, Artificial Sequence
  Transferrin receptor protein 1 (215-232)
aaccccggcggguacguggccuauagcaaggcugcaaccgucacaggaaaacug

SEQ ID NO: 52300 - RNA, 30 nt, Artificial Sequence
  ELAV-like protein 1 (186-195)
aaccccaaucagaacaagaauguggcccug

SEQ ID NO: 52301 - RNA, 27 nt, Artificial Sequence
  U1 small nuclear ribonucleoprotein A (229-237)
aaccaguuccccggcuuuaaggaggug

SEQ ID NO: 52302 - RNA, 45 nt, Artificial Sequence
  Heat shock 70 kDa protein 1-like (170-184)
aacgugcugagaaucauuaaugagcccaccgccgcugcaauagcc

SEQ ID NO: 52303 - RNA, 45 nt, Artificial Sequence
  HLA class II histocompatibility antigen, DR alpha chain (52-66)
cagggcgcccuggcuaacaucgcaguggacaaggccaaucucgag

SEQ ID NO: 52304 - RNA, 27 nt, Artificial Sequence
  Myosin-9 (478-486)
cagcuguucaaccacaccauguuuauc

SEQ ID NO: 52305 - RNA, 27 nt, Artificial Sequence
  Myosin-9 (163-171)
cagcugauggccgagaagcuccaacuu

SEQ ID NO: 52306 - RNA, 27 nt, Artificial Sequence
  T-complex protein 1 subunit alpha (187-195)
cagcccagauacccugugaacagcguc

SEQ ID NO: 52307 - RNA, 30 nt, Artificial Sequence
  Carcinoembryonic antigen-related cell adhesion molecule 5 (268-277)
caguacagcugguucgugaacggcaccuuu

SEQ ID NO: 52308 - RNA, 27 nt, Artificial Sequence
  Histone H2AX (78-86)
agaaucauucccaggcaccugcagcuc

SEQ ID NO: 52309 - RNA, 27 nt, Artificial Sequence
  Lamin-B1 (42-50)
agacuggccguguacaucgacaagguc

SEQ ID NO: 52310 - RNA, 27 nt, Artificial Sequence
  Prelamin-A/C (41-49)
agacuggccguguacaucgacaggguc

SEQ ID NO: 52311 - RNA, 27 nt, Artificial Sequence
  Melanocyte protein PMEL (626-634)
agacugaugaagcaggacuucagcgug

SEQ ID NO: 52312 - RNA, 27 nt, Artificial Sequence
  60S acidic ribosomal protein P2 (38-46)
agacugaacaaggugaucagcgagcuc

SEQ ID NO: 52313 - RNA, 27 nt, Artificial Sequence
  Vimentin (69-77)
agacugaggagcuccgugcccggcguc

SEQ ID NO: 52314 - RNA, 27 nt, Artificial Sequence
  Wilms tumor protein (126-134)
agaauguuccccaacgccccuuaccug

SEQ ID NO: 52315 - RNA, 27 nt, Artificial Sequence
  Histone deacetylase 2 variant (122-130)
agaaugcugccccacgccccuggcgug

SEQ ID NO: 52316 - RNA, 27 nt, Artificial Sequence
  Cellular tumor antigen p53 (65-73)
agaaugcccgaggccgcuccuccagug

SEQ ID NO: 52317 - RNA, 27 nt, Artificial Sequence
  Actin, cytoplasmic 2 (103-111)
agaaugcagaaggagaucaccgcccug

SEQ ID NO: 52318 - RNA, 69 nt, Artificial Sequence
  Melanoma antigen recognized by T-cells 1 (51-73)
agaaacggcuacagggcccugauggacaagagccuccacguggggacccagugcgcucuuacacggcgc

SEQ ID NO: 52319 - RNA, 27 nt, Artificial Sequence
  B-lymphocyte antigen CD20 (222-230)
agacccaagagcaacaucgugcugcuc

SEQ ID NO: 52320 - RNA, 27 nt, Artificial Sequence
  Actin, aortic smooth muscle (39-47)
agacccaggcaccagggcgugaugguc

SEQ ID NO: 52321 - RNA, 27 nt, Artificial Sequence
  Probable global transcription activator SNF2L2 (261-269)
agacccagcggcccugggccagagcug

SEQ ID NO: 52322 - RNA, 27 nt, Artificial Sequence
  Myotubularin-related protein 5 (644-652)
agacccuacagcaacguguccaaucug

SEQ ID NO: 52323 - RNA, 27 nt, Artificial Sequence
  Proteasome subunit beta type-1 (127-135)
agaagguucuuucccuacuauguguac

SEQ ID NO: 52324 - RNA, 27 nt, Artificial Sequence
  60S ribosomal protein L7a (110-118)
agaaggcacuggggcgggaacgugcug

SEQ ID NO: 52325 - RNA, 27 nt, Artificial Sequence
  Histone H3.3 (53-61)
agaagguaccagaagagcaccgagcug

SEQ ID NO: 52326 - RNA, 27 nt, Artificial Sequence
  60S ribosomal protein L24 (23-31)
agaaccgacggcaagguguuccaguuu

SEQ ID NO: 52327 - RNA, 27 nt, Artificial Sequence
  40S ribosomal protein S3 (54-62)
agaacccagaacgugcugggcgagaag

SEQ ID NO: 52328 - RNA, 27 nt, Artificial Sequence
  HLA class I histocompatibility antigen, Cw-7 alpha chain (2-10)
agagugauggcccccagggcucugcuc

SEQ ID NO: 52329 - RNA, 30 nt, Artificial Sequence
  HLA class I histocompatibility antigen, B-15 alpha chain (194-203)
agauaccuggagaacggcaaggaaacccuc

SEQ ID NO: 52330 - RNA, 27 nt, Artificial Sequence
  Serine/threonine-protein kinase Sgk1 (208-216)
agcgcccugggcuaccuccacucccuu

SEQ ID NO: 52331 - RNA, 27 nt, Artificial Sequence
  Tyrosinase (192-200)
agcgagaucuggagagacauugauuuc

SEQ ID NO: 52332 - RNA, 27 nt, Artificial Sequence
  Serine/threonine-protein phosphatase PP1-alpha catalytic subunit (10-18)
agcaucauuggcagacugcucgaggug

SEQ ID NO: 52333 - RNA, 30 nt, Artificial Sequence
  Melanocyte protein PMEL (577-586)
agccuggccgacaccaacucccucgcugug

SEQ ID NO: 52334 - RNA, 27 nt, Artificial Sequence
  Heterogeneous nuclear ribonucleoprotein K (154-162)
agccuggccggcgggaucauuggagug

SEQ ID NO: 52335 - RNA, 27 nt, Artificial Sequence
  L-dopachrome tautomerase (288-296)
agccuggacgauuacaaccaccucgug

SEQ ID NO: 52336 - RNA, 27 nt, Artificial Sequence
  Protein flightless-1 homolog (1009-1017)
agccuguuccccggcaagcucgaggug

SEQ ID NO: 52337 - RNA, 27 nt, Artificial Sequence
  Dual specificity protein phosphatase 5 (337-345)
agccugaucggccaccuccagacccuu

SEQ ID NO: 52338 - RNA, 30 nt, Artificial Sequence
  TSC22 domain family protein 3 (27-36)
agccugcucggcggggacguggucuccguu

SEQ ID NO: 52339 - RNA, 27 nt, Artificial Sequence
  Cancer/testis antigen 1 (157-165)
agccugcucauguggaucacccagugc

SEQ ID NO: 52340 - RNA, 27 nt, Artificial Sequence
  Serine/threonine-protein phosphatase 2A 65 kDa regulatory subunit A alpha isoform (403-411)
agccugcuccccgccaucguggagcuu

SEQ ID NO: 52341 - RNA, 33 nt, Artificial Sequence
  Protein transport protein Sec23B (138-148)
agccugcuccccccugacgcccuugugggccug

SEQ ID NO: 52342 - RNA, 33 nt, Artificial Sequence
  Protein transport protein Sec23A (156-166)
agccugcuccccccuaccgcccuugugggccug

SEQ ID NO: 52343 - RNA, 27 nt, Artificial Sequence
  Vimentin (226-234)
agccugcaggaggaaaucgccuuccuc

SEQ ID NO: 52344 - RNA, 27 nt, Artificial Sequence
  CD59oprotein (106-114)
agccuguccgagaagaccgugcuccuu

SEQ ID NO: 52345 - RNA, 27 nt, Artificial Sequence
  Collagen alpha-5(IV) chain (18-26)
agccuguggggccagcccgccgaggcu

SEQ ID NO: 52346 - RNA, 27 nt, Artificial Sequence
  AT-rich interactive domain-containing protein 3A (372-380)
agccccaagcugccuguguccucucuc

SEQ ID NO: 52347 - RNA, 33 nt, Artificial Sequence
  Polypyrimidine tract-binding protein 1 (141-151)
agccccaaccaggccagagcucaagcagcccug

SEQ ID NO: 52348 - RNA, 27 nt, Artificial Sequence
  Spermine synthase (128-136)
agccccuaccagaacaucaagauucug

SEQ ID NO: 52349 - RNA, 27 nt, Artificial Sequence
  Eukaryotic translation initiation factor 3 subunit D (61-69)
agccaguucggcgggggaucccaauac

SEQ ID NO: 52350 - RNA, 27 nt, Artificial Sequence
  Ornithine decarboxylase (180-188)
agcuccgagcagaccuucauguacuau

SEQ ID NO: 52351 - RNA, 27 nt, Artificial Sequence
  Glutamine-fructose-6-phosphate aminotransferase (isomerizing) 1 (95-103)
agcaccgaccacauccccauucuguac

SEQ ID NO: 52352 - RNA, 30 nt, Artificial Sequence
  Cellular tumor antigen p53 (149-157)
agcacccccccuccaggcgccacaagagug

SEQ ID NO: 52353 - RNA, 27 nt, Artificial Sequence
  Eukaryotic translation initiation factor 3 subunit L (226-234)
agcgugcugaacguccuccacucccuu

SEQ ID NO: 52354 - RNA, 27 nt, Artificial Sequence
  L-dopachrome tautomerase (180-188)
agcguguacgacuucuuugucuggcug

SEQ ID NO: 52355 - RNA, 27 nt, Artificial Sequence
  Mammaglobin-A (32-40)
accaucaacccccaggugagcaagaca

SEQ ID NO: 52356 - RNA, 27 nt, Artificial Sequence
  L-dopachrome tautomerase (360-368)
acccuggacagccaggugaugucccuc

SEQ ID NO: 52357 - RNA, 27 nt, Artificial Sequence
  Protein BTG2 (101-109)
acccuguggguggaccccuacgagguc

SEQ ID NO: 52358 - RNA, 27 nt, Artificial Sequence
  DNA-directed RNA polymerase II subunit RPB1 (527-535)
accccccagagcaacagaccugugaug

SEQ ID NO: 52359 - RNA, 33 nt, Artificial Sequence
  Heat shock cognate 71 kDa protein (22-32)
accguguucgacgccaagagacugaucggcagg

SEQ ID NO: 52360 - RNA, 27 nt, Artificial Sequence
  Carcinoembryonic antigen-related cell adhesion molecule 5 (652-660)
accuacgccugcuucgugagcaaccug

SEQ ID NO: 52361 - RNA, 27 nt, Artificial Sequence
  Receptor tyrosine-protein kinase erbB-2 (63-71)
accuaccugcccacaaacgccagccuc

SEQ ID NO: 52362 - RNA, 24 nt, Artificial Sequence
  Serine/threonine-protein phosphatase 2A 65 kDa regulatory subunit A alpha isoform (263-270)
guggccgacaaguucaccgagcug

SEQ ID NO: 52363 - RNA, 27 nt, Artificial Sequence
  Actin, cytoplasmic 2 (76-84)
guggcccuggacuucgagcaggaaaug

SEQ ID NO: 52364 - RNA, 51 nt, Artificial Sequence
  HLA class I histocompatibility antigen, A-2 alpha chain (27-43)
guggacgauacccaguucgucagauuugacagcgaugccgcuucccaaagg

SEQ ID NO: 52365 - RNA, 57 nt, Artificial Sequence
  HLA class I histocompatibility antigen, A-2 alpha chain (27-45)
guggacgauacccaguucgucagauuugacagcgaugccgcuucccaaaggauggag

SEQ ID NO: 52366 - RNA, 60 nt, Artificial Sequence
  HLA class I histocompatibility antigen, A-2 alpha chain (27-46)
guggacgauacccaguucgucagauuugacagcgaugccgcuucccaaaggauggagccc

SEQ ID NO: 52367 - RNA, 63 nt, Artificial Sequence
  HLA class I histocompatibility antigen, A-2 alpha chain (27-47)
guggacgauacccaguucgucagauuugacagcgaugccgcuucccaaaggauggagccccgg

SEQ ID NO: 52368 - RNA, 27 nt, Artificial Sequence
  Myeloblastin (169-177)
gugcugcaggagcucaacgucaccguu

SEQ ID NO: 52369 - RNA, 30 nt, Artificial Sequence
  Melanocyte protein PMEL (483-492)
gugcuguacagauauggcagcuucuccguc

SEQ ID NO: 52370 - RNA, 27 nt, Artificial Sequence
  HLA class I histocompatibility antigen, Cw-3 alpha chain (3-11)
gugauggcccccagaacccugauccuc

SEQ ID NO: 52371 - RNA, 27 nt, Artificial Sequence
  HLA class I histocompatibility antigen, A-2 alpha chain (3-11)
gugauggcccccagaacccugguccuc

SEQ ID NO: 52372 - RNA, 27 nt, Artificial Sequence
  Importin subunit alpha-5 (434-442)
gugauggacagcaagaucguccagguu

SEQ ID NO: 52373 - RNA, 27 nt, Artificial Sequence
  60S acidic ribosomal protein P2 (65-73)
gugcccgccggcggggcugucgcaguu

SEQ ID NO: 52374 - RNA, 36 nt, Artificial Sequence
  rRNA 2'-O-methyltransferase fibrillarin (174-185)
gugagcgacaucgucggccccgaugggcugguuuac

SEQ ID NO: 52375 - RNA, 45 nt, Artificial Sequence
  Beta-2-microglobulin (84-98)
gugacccugagccagcccaagaucgucaaaugggacagagauaug

SEQ ID NO: 52376 - RNA, 27 nt, Artificial Sequence
  L-dopachrome tautomerase (82-90)
guggucaugggcacccugguugcccuc

SEQ ID NO: 52377 - RNA, 60 nt, Artificial Sequence
  Cancer/testis antigen 1 (161-180)
uggaucacccagugcuuccugcccguguuucucgcccaaccuccaagcggccagagaagg

SEQ ID NO: 52378 - RNA, 48 nt, Artificial Sequence
  Melanocyte protein PMEL (44-59)
uggaacagacagcuguaccccgaguggaccgaagcccaaaggcucgac

SEQ ID NO: 52379 - RNA, 27 nt, Artificial Sequence
  Elongation factor 2 (265-273)
uacuucgaccccgccaacggcaaguuu

SEQ ID NO: 52380 - RNA, 27 nt, Artificial Sequence
  Cyclin-A2 (178-186)
uaccacgaggacauccauaccuaucug

SEQ ID NO: 52381 - RNA, 27 nt, Artificial Sequence
  DNA (cytosine-5)-methyltransferase 1 (254-262)
uaccuggacgaucccgaccucaaguau

SEQ ID NO: 52382 - RNA, 27 nt, Artificial Sequence
  Melanocyte protein PMEL (280-288)
uaccuggagcccggcccugugaccgcc

SEQ ID NO: 52383 - RNA, 27 nt, Artificial Sequence
  Myosin-9 (260-268)
uaccugcucgagaagagcagagccauc

SEQ ID NO: 52384 - RNA, 27 nt, Artificial Sequence
  Probable ATP-dependent RNA helicase DDX5 (148-156)
uaccugcuccccgccaucgugcacauu

SEQ ID NO: 52385 - RNA, 27 nt, Artificial Sequence
  Carcinoembryonic antigen-related cell adhesion molecule 5 (605-613)
uaccugagcggcgccaaccucaaucuu

SEQ ID NO: 52386 - RNA, 27 nt, Artificial Sequence
  Myosin-9 (9-17)
uaccuguauguggacaagaacuucauc

SEQ ID NO: 52387 - RNA, 27 nt, Artificial Sequence
  Tyrosinase (369-377
uacauggacggcaccaugagccaggug

SEQ ID NO: 52388 - RNA, 27 nt, Artificial Sequence
  Tyrosinase (369-377)
uacaugaacggcaccaugagccaggug

SEQ ID NO: 52389 - RNA, 27 nt, Artificial Sequence
  Cellular tumor antigen p53 (103-111)
uaccagggcagcuauggguucagacug

SEQ ID NO: 52390 - RNA, 36 nt, Artificial Sequence
  Cytochrome c oxidase subunit 2 (110-121)
uacaccgacuauggcgggcugaucuucaacagcuac

SEQ ID NO: 52391 - RNA, 27 nt, Artificial Sequence
  HLA class I histocompatibility antigen, Cw-7 alpha chain (12-20)
uucgccuacgacggcaaggauuauauc

SEQ ID NO: 52392 - RNA, 27 nt, Artificial Sequence
  HLA class I histocompatibility antigen, alpha chain E (137-145)
uucgccuacgacggcaaggauuaucug

SEQ ID NO: 52393 - RNA, 27 nt, Artificial Sequence
  IST1 homolog (326-334)
uucgugcugcccgagcucccuagcguc

SEQ ID NO: 52394 - RNA, 30 nt, Artificial Sequence
  60S ribosomal protein L35 (19-28)
aagcagcuggacgaucucaaaguggagcuu

SEQ ID NO: 52395 - RNA, 45 nt, Artificial Sequence
  Triosephosphate isomerase (23-37)
ggcgagcugaucgggacccucaacgccgcuaaggugcccgcagac

SEQ ID NO: 52396 - RNA, 42 nt, Artificial Sequence
  HLA class II histocompatibility antigen, DR alpha chain (40-53)
cuggaggaauucggcagauuugccagcuucgaggcucagggg

SEQ ID NO: 52397 - RNA, 27 nt, Artificial Sequence
  Sorting nexin-5 (257-265)
gaggaacccaccgugaucaagaaauac

SEQ ID NO: 52398 - RNA, 30 nt, Artificial Sequence
  Melanoma-associated antigen 4 (230-239)
ggcguguacgacgggagagagcacaccguc

SEQ ID NO: 52399 - RNA, 27 nt, Artificial Sequence
  HLA class I histocompatibility antigen, B-39 alpha chain (3-11)
gugauggcccccagaaccguccugcuc

SEQ ID NO: 52400 - RNA, 27 nt, Artificial Sequence
  Ubiquilin-4 (442-450)
aaccccagagccaugcaggcucugcuc

SEQ ID NO: 52401 - RNA, 27 nt, Artificial Sequence
  HLA class I histocompatibility antigen, Cw-7 alpha chain (3-11)
gugauggcccccagagcucugcuccuu

SEQ ID NO: 52402 - RNA, 45 nt, Artificial Sequence
  Gamma-secretase C-terminal fragment 59 (562-576)
gacgccgaguucagacacgauagcggcuacgaagugcaucaccag

SEQ ID NO: 52403 - RNA, 30 nt, Artificial Sequence
  Gamma-secretase C-terminal fragment 59 (565-574)
uucagacacgacagcggcuacgaggugcau

SEQ ID NO: 52404 - RNA, 27 nt, Artificial Sequence
  HLA class I histocompatibility antigen, Cw-2 alpha chain (3-11)
gugauggcccccagaacccugcuccuu

SEQ ID NO: 52405 - RNA, 39 nt, Artificial Sequence
  Gamma-secretase C-terminal fragment 59 (562-574)
gacgccgaguucagacacgauagcggcuacgaagugcau

SEQ ID NO: 52406 - RNA, 24 nt, Artificial Sequence
  Beta-2-microglobulin (91-98)
aucgugaagugggacagagauaug

SEQ ID NO: 52407 - RNA, 42 nt, Artificial Sequence
  HLA class II histocompatibility antigen, DR alpha chain (50-63)
gaggcccagggcgcucuggcaaacaucgccguggacaaggcg

SEQ ID NO: 52408 - RNA, 45 nt, Artificial Sequence
  Interferon-induced transmembrane protein 1 (69-83)
gugggcgacgucaccggggcccaggcuuacgcaagcacagccaag

SEQ ID NO: 52409 - RNA, 45 nt, Artificial Sequence
  Gamma-secretase C-terminal fragment 59 (560-574)
uucgccgaggacgugggcagcaacaagggggcuaucauuggacug

SEQ ID NO: 52410 - RNA, 33 nt, Artificial Sequence
  Amyloid beta A4 protein (20-30)
uucgccgaggacgugggcagcaacaagggggcu

SEQ ID NO: 52411 - RNA, 27 nt, Artificial Sequence
  Heat shock 70 kDa protein 1-like (395-403)
cugcucgacguggccccccuuagccug

SEQ ID NO: 52412 - RNA, 27 nt, Artificial Sequence
  Heat shock 70 kDa protein 1B (391-399)
cugcuccuucuggacguggcccccuug

SEQ ID NO: 52413 - RNA, 48 nt, Artificial Sequence
  HLA class I histocompatibility antigen, B-15 alpha chain (53-68)
gacgauacccaguucgugagauuugacagcgaugccgcuucccccagg

SEQ ID NO: 52414 - RNA, 48 nt, Artificial Sequence
  HLA class I histocompatibility antigen, Cw-7 alpha chain (153-168)
gaccugagaagcuggaccgccgcugauacagcagcccagaucacucaa

SEQ ID NO: 52415 - RNA, 45 nt, Artificial Sequence
  HLA class I histocompatibility antigen, B-15 alpha chain (54-68)
gacacccaguucgugagauuugauagcgacgccgcuucccccagg

SEQ ID NO: 52416 - RNA, 51 nt, Artificial Sequence
  HLA class I histocompatibility antigen, A-2 alpha chain (29-45)
gacacccaguucgugagauuugauagcgacgccgcuucccaaaggauggag

SEQ ID NO: 52417 - RNA, 36 nt, Artificial Sequence
  HLA class I histocompatibility antigen, B-15 alpha chain (57-68)
uucgugagauuugacagcgaugccgcuucccccagg

SEQ ID NO: 52418 - RNA, 33 nt, Artificial Sequence
  HLA class I histocompatibility antigen, A-1 alpha chain (32-42)
uucgugagauuugacagcgaugccgcuucccag

SEQ ID NO: 52419 - RNA, 45 nt, Artificial Sequence
  HLA class I histocompatibility antigen, B-15 alpha chain (154-168)
cugagcuccuggaccgccgcugacacagcagcccagaucacucaa

SEQ ID NO: 52420 - RNA, 51 nt, Artificial Sequence
  HLA class I histocompatibility antigen, B-15 alpha chain (52-68)
guggacgauacccaguucgucagauuugacagcgaugccgcuucccccagg

SEQ ID NO: 52421 - RNA, 27 nt, Artificial Sequence
  Vimentin (116-124)
aacuacaucgacaaggugagauuccug

SEQ ID NO: 52422 - RNA, 27 nt, Artificial Sequence
  G antigen 12H (9-17)
uacuauuggcccagaccuaggcgguac

SEQ ID NO: 52423 - RNA, 27 nt, Artificial Sequence
  Transaldolase (168-176)
cugcucuucagcuuugcccaggcugug

SEQ ID NO: 52424 - RNA, 51 nt, Artificial Sequence
  T cell receptor beta chain (42-57)
ugcaagcccaucagcggccacaacucccuguuccagugguacagacaaacc

SEQ ID NO: 52425 - RNA, 27 nt, Artificial Sequence
  Putative pre-mRNA-splicing factor ATP-dependent RNA helicase DHX16 (410-418)
gccgcuaucgcaaaccaccaggugcug

SEQ ID NO: 52426 - RNA, 27 nt, Artificial Sequence
  14-3-3 protein gamma (25-33)
gccgcuaugaagaacgugaccgagcug

SEQ ID NO: 52427 - RNA, 27 nt, Artificial Sequence
  Serine/threonine-protein kinase SMG1 (111-119)
gcccugaacaaucuccuucacagccug

SEQ ID NO: 52428 - RNA, 27 nt, Artificial Sequence
  Cyclin-L1 (148-156)
gacgugaucaacgucuuccaccaucug

SEQ ID NO: 52429 - RNA, 27 nt, Artificial Sequence
  Fructose-bisphosphate aldolase A (15-23)
gagcugagcgacaucgcccacagaauu

SEQ ID NO: 52430 - RNA, 27 nt, Artificial Sequence
  Glyceraldehyde-3-phosphate dehydrogenase (173-181)
ggccugaugaccacagugcacgccauc

SEQ ID NO: 52431 - RNA, 27 nt, Artificial Sequence
  Elongation of very long chain fatty acids protein 1 (135-143)
ggccaggugaccuuccugcacgucuuu

SEQ ID NO: 52432 - RNA, 27 nt, Artificial Sequence
  Microtubule-associated protein RP/EB family member 2 (234-242)
cagcugaacgagcaagugcacagccuc

SEQ ID NO: 52433 - RNA, 27 nt, Artificial Sequence
  T-complex protein 1 subunit epsilon (79-87)
agcaugauggacguggaucaccagauc

SEQ ID NO: 52434 - RNA, 27 nt, Artificial Sequence
  Sphingolipid delta(4)-desaturase DES1 (83-91)
agcaugacccuggccauccacgagauu

SEQ ID NO: 52435 - RNA, 27 nt, Artificial Sequence
  Elongation of very long chain fatty acids protein 5 (171-179)
acccugaacagcuucauccacgugcuc

SEQ ID NO: 52436 - RNA, 27 nt, Artificial Sequence
  ORM1-like protein 2 (50-58)
acccugacaaacgugauccacaaucuc

SEQ ID NO: 52437 - RNA, 30 nt, Artificial Sequence
  Baculoviral IAP repeat-containing protein 7 (280-289)
cagcugugccccaucuguagagccccugug

SEQ ID NO: 52438 - RNA, 30 nt, Artificial Sequence
  E3 ubiquitin-protein ligase TRIM68 (55-64)
uacaccugcccccuguguagagccccugug

SEQ ID NO: 52439 - RNA, 33 nt, Artificial Sequence
  Putative HTLV-1-related endogenous sequence (14-24)
cccaccagagccccuagcggcccaaggccgccc

SEQ ID NO: 52440 - RNA, 33 nt, Artificial Sequence
  Putative HTLV-1-related endogenous sequence (117-127)
agaaggcgggagggccccgaccgcagcccucga

SEQ ID NO: 52441 - RNA, 27 nt, Artificial Sequence
  Myelin basic protein (175-183)
ggcacccugagcaagaucuucaaacuc

SEQ ID NO: 52442 - RNA, 27 nt, Artificial Sequence
  Myelin proteolipid protein (45-53)
aagcugaucgagaccuacuucagcaaa

SEQ ID NO: 52443 - RNA, 27 nt, Artificial Sequence
  Gamma-secretase C-terminal fragment 59 (563-571)
gccgaguucagacacgacagcggcuac

SEQ ID NO: 52444 - RNA, 27 nt, Artificial Sequence
  SAM and SH3 domain-containing protein 1 (305-313)
gcccuguacagcggcgugcacaagaaa

SEQ ID NO: 52445 - RNA, 30 nt, Artificial Sequence
  E3 ubiquitin-protein ligase SIAH1 (6-15)
gccaccgcucugcccacaggcacuagcaag

SEQ ID NO: 52446 - RNA, 27 nt, Artificial Sequence
  Muscleblind-like protein 2 (359-367)
gccaccgcuaaccagaucauucugaag

SEQ ID NO: 52447 - RNA, 27 nt, Artificial Sequence
  Annexin A1 (63-71)
gccaccaucauugacauacugacaaag

SEQ ID NO: 52448 - RNA, 27 nt, Artificial Sequence
  Nuclear ubiquitous casein and cyclin-dependent kinase substrate 1 (176-184)
gccaccgugacacccagcccugucaag

SEQ ID NO: 52449 - RNA, 27 nt, Artificial Sequence
  Pleiotropic regulator 1 (118-126)
gccguggcucugccccuccagaccaag

SEQ ID NO: 52450 - RNA, 36 nt, Artificial Sequence
  NADH dehydrogenase (ubiquinone) 1 alpha subcomplex subunit 3 (29-40)
gccgugauccugcccccucucagcccauacuucaag

SEQ ID NO: 52451 - RNA, 27 nt, Artificial Sequence
  CD99 antigen (177-185)
gccgugcagagaacccugcucgagaag

SEQ ID NO: 52452 - RNA, 27 nt, Artificial Sequence
  Guanine nucleotide-binding protein G(o) subunit alpha (93-101)
gccgugaccgacgucaucauugcuaag

SEQ ID NO: 52453 - RNA, 42 nt, Artificial Sequence
  Calsyntenin-1 (56-69)
gaccccccucugaucgcccucgauaaggacgcuccacuuaga

SEQ ID NO: 52454 - RNA, 27 nt, Artificial Sequence
  GPI transamidase component PIG-T (161-169)
gacaccgaucacuacuuccugagauau

SEQ ID NO: 52455 - RNA, 42 nt, Artificial Sequence
  Perilipin-3 (222-235)
gacguggccagcguccagcaacagagacaggagcaguccuac

SEQ ID NO: 52456 - RNA, 27 nt, Artificial Sequence
  WD40 repeat-containing protein SMU1 (9-17)
gacgugaucagacugauuaugcaguac

SEQ ID NO: 52457 - RNA, 30 nt, Artificial Sequence
  Protein S100-B (35-44)
gagcugaucaacaaugaacucagccacuuc

SEQ ID NO: 52458 - RNA, 33 nt, Artificial Sequence
  Annexin A11 (430-440)
gagaccgaccugcucgauaucagaagcgaauac

SEQ ID NO: 52459 - RNA, 27 nt, Artificial Sequence
  Histone H2B type 2-F (66-74)
uucgugaacgacaucuuugagagaauu

SEQ ID NO: 52460 - RNA, 24 nt, Artificial Sequence
  Calmodulin (145-152)
uucgugcagaugaugaccgccaag

SEQ ID NO: 52461 - RNA, 42 nt, Artificial Sequence
  Phosphoinositide-3-kinase-interacting protein 1 (30-43)
ggccaccuguacagagaggaccagaccagccccgccccuggg

SEQ ID NO: 52462 - RNA, 27 nt, Artificial Sequence
  THO complex subunit 4 (147-155)
ggcaccgccgacgugcacuucgagaga

SEQ ID NO: 52463 - RNA, 27 nt, Artificial Sequence
  Neuroblast differentiation-associated protein AHNAK (1210-1218)
ggcaccuucgggggacuggguagcaag

SEQ ID NO: 52464 - RNA, 27 nt, Artificial Sequence
  Phosphoserine aminotransferase (119-127)
ggcaccaucaacauugugcaccccaag

SEQ ID NO: 52465 - RNA, 27 nt, Artificial Sequence
  Histone deacetylase 7 (159-167)
cacagcgagagacaugugcugcucuac

SEQ ID NO: 52466 - RNA, 27 nt, Artificial Sequence
  Gelsolin (48-56)
aucauuuacaagggcgggaccagcaga

SEQ ID NO: 52467 - RNA, 30 nt, Artificial Sequence
  Tight junction protein ZO-1 (562-571)
auccccaacaagaauagagccgagcagcug

SEQ ID NO: 52468 - RNA, 39 nt, Artificial Sequence
  Calmodulin (126-138)
aucagagaggccgacauugauggcgacgggcaggugaac

SEQ ID NO: 52469 - RNA, 51 nt, Artificial Sequence
  POTE ankyrin domain family member F (1057-1073)
aucagcaagcaggaguacgacgaauccggccccucuauugugcacagaaaa

SEQ ID NO: 52470 - RNA, 27 nt, Artificial Sequence
  NADH dehydrogenase (ubiquinone) iron-sulfur protein 7, mitochondrial (66-74)
aucguggccggcacccugacaaacaag

SEQ ID NO: 52471 - RNA, 27 nt, Artificial Sequence
  LIM domain transcription factor LMO4 (29-37)
aagaucgccgacagauuccugcucuac

SEQ ID NO: 52472 - RNA, 30 nt, Artificial Sequence
  Spectrin beta chain, non-erythrocytic 1 (1939-1948)
aagcccagagacgugagcuccgucgagcug

SEQ ID NO: 52473 - RNA, 27 nt, Artificial Sequence
  NADH dehydrogenase (ubiquinone) 1 subunit C2 (106-114)
aagaccuacggcgagaucuucgaaaaa

SEQ ID NO: 52474 - RNA, 45 nt, Artificial Sequence
  Testican-2 (317-331)
cuggagagaauccagauucaagaagccgcuaagaaaaagcccggc

SEQ ID NO: 52475 - RNA, 27 nt, Artificial Sequence
  Alpha-adducin (37-45)
cugaccgacagagagcucgaagaguac

SEQ ID NO: 52476 - RNA, 30 nt, Artificial Sequence
  V-type proton ATPase subunit F (46-55)
aacgagaucgaagacaccuucagacaguuu

SEQ ID NO: 52477 - RNA, 24 nt, Artificial Sequence
  40S ribosomal protein SA (149-156)
aacaccgacagcccccugagauac

SEQ ID NO: 52478 - RNA, 27 nt, Artificial Sequence
  Bcl-2-associated transcription factor 1 (428-436)
aacaccgaggaagagggccugaaguac

SEQ ID NO: 52479 - RNA, 33 nt, Artificial Sequence
  ATP synthase-coupling factor 6, mitochondrial (98-108)
cccaaguucgaggugaucgaaaaaccucaggcc

SEQ ID NO: 52480 - RNA, 39 nt, Artificial Sequence
  Phosphatidylethanolamine-binding protein 1 (2-14)
cccguggaccugagcaagugguccggcccucucucucuu

SEQ ID NO: 52481 - RNA, 27 nt, Artificial Sequence
  40S ribosomal protein S29 (5-13)
cagcuguacuggagccaccccagaaag

SEQ ID NO: 52482 - RNA, 30 nt, Artificial Sequence
  Septin-2 (291-300)
agacuguaccccuggggcguggucgagguu

SEQ ID NO: 52483 - RNA, 27 nt, Artificial Sequence
  Methyl-CpG-binding domain protein 3 (74-82)
agcaucuucaagcagcccgugaccaaa

SEQ ID NO: 52484 - RNA, 27 nt, Artificial Sequence
  Transformation/transcription domain-associated protein (1806-1814)
agcaucaccuccguguucauuacaaag

SEQ ID NO: 52485 - RNA, 30 nt, Artificial Sequence; identical to SEQ ID NO: 28258
  Transcription factor HES-1 (101-110)

SEQ ID NO: 52486 - RNA, 27 nt, Artificial Sequence
  Protein transport protein Sec23B (115-123)
agcaccaucgaguacgugauucagaga

SEQ ID NO: 52487 - RNA, 33 nt, Artificial Sequence; identical to SEQ ID NO: 28260
  Paralemmin-2 (155-165)

SEQ ID NO: 52488 - RNA, 30 nt, Artificial Sequence
  Sodium/potassium-transporting ATPase subunit alpha-3 (946-955)
agcguguuccagcaaggcaugaagaacaaa

SEQ ID NO: 52489 - RNA, 33 nt, Artificial Sequence
  Stathmin (31-41)
agcgugcccgaguucccucuguccccaccgaag

SEQ ID NO: 52490 - RNA, 27 nt, Artificial Sequence
  Heterogeneous nuclear ribonucleoprotein L-like (68-76)
agcgugucccccgucguucacgugaga

SEQ ID NO: 52491 - RNA, 24 nt, Artificial Sequence
  Nodal modulator 3 (247-254)
accgccaucagacaccaugugcug

SEQ ID NO: 52492 - RNA, 33 nt, Artificial Sequence
  Interferon-induced GTP-binding protein Mx2 (194-204)
accaucauugaccugcccggcauaacaagagug

SEQ ID NO: 52493 - RNA, 27 nt, Artificial Sequence
  Neuronal membraneoprotein M6-b (264-272)
accacauacaacuaugccgugcugaag

SEQ ID NO: 52494 - RNA, 27 nt, Artificial Sequence
  Contactin-1 (759-767)
gugaccaaccccgacacaggcagauac

SEQ ID NO: 52495 - RNA, 24 nt, Artificial Sequence
  Cytosolic non-specific dipeptidase (468-475)
uacgaggugagccagcugaaggac

SEQ ID NO: 52496 - RNA, 27 nt, Artificial Sequence
  Septin-2 (121-129)
uacaucgacgagcaguucgaaagauau

SEQ ID NO: 52497 - RNA, 30 nt, Artificial Sequence
  Noelin-2 (405-414)
uacaccgacgugcccuuccacaaccaguau

SEQ ID NO: 52498 - RNA, 33 nt, Artificial Sequence
  Serine/threonine-protein kinase DCLK1 (176-186)
uacaccgagagagacgccagcggcaugcuguau

SEQ ID NO: 52499 - RNA, 24 nt, Artificial Sequence
  U2 small nuclear ribonucleoprotein B'' (205-212)
gacgcccugcagggcuucaagauc

SEQ ID NO: 52500 - RNA, 45 nt, Artificial Sequence
  Melanocyte protein PMEL (45-59)
aacagacagcuguaccccgaguggaccgaagcccaaaggcucgac

SEQ ID NO: 52501 - RNA, 27 nt, Artificial Sequence
  Nuclear autoantigenic sperm protein (281-289)
gugcugaacgagcaggucaaggaagcc

SEQ ID NO: 52502 - RNA, 27 nt, Artificial Sequence
  60S ribosomal protein L5 (218-226)
gccuacaagaaacaguucagccaauau

SEQ ID NO: 52503 - RNA, 27 nt, Artificial Sequence
  Endoplasmic reticulum-Golgi intermediate compartment protein 1 (258-266)
gccaucauuggcgggaccuucacagug

SEQ ID NO: 52504 - RNA, 27 nt, Artificial Sequence
  Programmed cell death protein 4 (283-291)
gcccuggacaaggcuaccgugcuccuu

SEQ ID NO: 52505 - RNA, 27 nt, Artificial Sequence
  Endoplasmin (381-389)
gcccugaaggacaaaaucgagaaggcu

SEQ ID NO: 52506 - RNA, 27 nt, Artificial Sequence
  Glyceraldehyde-3-phosphate dehydrogenase (302-310)
gcccugaacgaccacuucgugaagcuc

SEQ ID NO: 52507 - RNA, 27 nt, Artificial Sequence
  Eukaryotic translation initiation factor 3 subunit F (349-357)
gcccugaacgagaagcucgugaaucuu

SEQ ID NO: 52508 - RNA, 27 nt, Artificial Sequence
  Cofilin-1 (6-14)
gccgugagcgacggcgucaucaagguu

SEQ ID NO: 52509 - RNA, 27 nt, Artificial Sequence
  Actin, cytoplasmic 2 (21-29)
uucgccggcgacgaugcucccagagca

SEQ ID NO: 52510 - RNA, 30 nt, Artificial Sequence
  Pyruvate kinase PKM (12-21)
uucauccagacccaacagcugcacgccgcu

SEQ ID NO: 52511 - RNA, 30 nt, Artificial Sequence
  Dolichyl-diphosphooligosaccharide-proteinosyltransferase subunit STT3A (59-68)
uuccuggccgaggaaggcuuuuacaaguuc

SEQ ID NO: 52512 - RNA, 30 nt, Artificial Sequence
  5'(3')-deoxyribonucleotidase, cytosolic type (71-80)
uuccuggaccucgagcccaucccuggcgcc

SEQ ID NO: 52513 - RNA, 24 nt, Artificial Sequence
  CKLF-like MARVEL transmembrane domain-containing protein 6 (79-86)
uuccugcucagccuucugaucuug

SEQ ID NO: 52514 - RNA, 27 nt, Artificial Sequence
  Cleavage and polyadenylation specificity factor subunit 1 (185-193)
uuccugcccagcuacaucauugacgug

SEQ ID NO: 52515 - RNA, 24 nt, Artificial Sequence
  Neutral amino acid transporter B(0) (89-96)
uucguguuucccggcgagcugcuc

SEQ ID NO: 52516 - RNA, 30 nt, Artificial Sequence
  Glyceraldehyde-3-phosphate dehydrogenase (169-178)
ggcaucguggaggggcugaugaccacaguc

SEQ ID NO: 52517 - RNA, 27 nt, Artificial Sequence
  Protein PRRC1 (212-220)
ggcaucuggggguucauuaagggagug

SEQ ID NO: 52518 - RNA, 27 nt, Artificial Sequence
  Probable ATP-dependent RNA helicase DDX49 (311-319)
ggccuggacauccccaccgugcagguc

SEQ ID NO: 52519 - RNA, 24 nt, Artificial Sequence
  Nuclear pore complex protein Nup160 (1223-1230)
ggccuguucgacaccgccaucagc

SEQ ID NO: 52520 - RNA, 39 nt, Artificial Sequence
  ATP synthase subunit beta, mitochondrial (203-215)
ggccuguucgggggagccggugugggcaagaccguccuc

SEQ ID NO: 52521 - RNA, 27 nt, Artificial Sequence
  Signal peptidase complex subunit 2 (79-87)
ggccugaucgacgggagacucaccauu

SEQ ID NO: 52522 - RNA, 33 nt, Artificial Sequence
  Pyruvate kinase PKM (122-132)
ggccugaucaaggggagcggaaccgccgaggug

SEQ ID NO: 52523 - RNA, 30 nt, Artificial Sequence
  Protein kinase C iota type (241-250)
ggccugcaggacuucgaucuccuuagagug

SEQ ID NO: 52524 - RNA, 27 nt, Artificial Sequence
  Histone acetyltransferase p300 (2240-2248)
ggccagaucgggcaacugccccaggcc

SEQ ID NO: 52525 - RNA, 27 nt, Artificial Sequence
  Histone H2A type 1-A (107-115)
ggcgugcugcccaacauccaggccguc

SEQ ID NO: 52526 - RNA, 30 nt, Artificial Sequence
  Small nuclear ribonucleoprotein G (67-76)
aucauuaugcuggaggcccucgaaagagug

SEQ ID NO: 52527 - RNA, 27 nt, Artificial Sequence
  Heat shock 70 kDa protein 1-like (174-182)
aucauuaacgagcccaccgccgcugca

SEQ ID NO: 52528 - RNA, 27 nt, Artificial Sequence
  Glyceraldehyde-3-phosphate dehydrogenase (206-214)
aucauucccgccagcaccggcgcugca

SEQ ID NO: 52529 - RNA, 36 nt, Artificial Sequence
  Nucleosome assembly protein 1-like 1 (319-330)
auccuggccgcugacuucgagauuggccacuuucuc

SEQ ID NO: 52530 - RNA, 27 nt, Artificial Sequence
  Glyceraldehyde-3-phosphate dehydrogenase (273-281)
auccugggcuacaccgagcaccaggug

SEQ ID NO: 52531 - RNA, 27 nt, Artificial Sequence
  40S ribosomal protein S11 (72-80)
auccugagcggcguggucaccaagaug

SEQ ID NO: 52532 - RNA, 27 nt, Artificial Sequence
  Structural maintenance of chromosomes protein 3 (436-444)
aagcuggaccaggaucucaacgaggug

SEQ ID NO: 52533 - RNA, 39 nt, Artificial Sequence
  Centrin-2 (111-123)
aagcuguucgacgaugacgagaccggcaaaaucagcuuu

SEQ ID NO: 52534 - RNA, 33 nt, Artificial Sequence; identical to SEQ ID NO: 28307
  GTP-binding nuclear protein Ran (167-177)

SEQ ID NO: 52535 - RNA, 33 nt, Artificial Sequence
  40S ribosomal protein S3a (227-237)
aagcugauggagcuccacggcgaagggagcucc

SEQ ID NO: 52536 - RNA, 30 nt, Artificial Sequence
  ATP-dependent RNA helicase A (696-705)
aagguguucgaccccgucccuguuggcgug

SEQ ID NO: 52537 - RNA, 24 nt, Artificial Sequence
  Gamma-interferon-inducible lysosomal thiol reductase (27-34)
cugcucgacgugcccaccgccgcu

SEQ ID NO: 52538 - RNA, 27 nt, Artificial Sequence
  Heat shock cognate 71 kDa protein (393-401)
cugcucgacgugaccccccuuagccug

SEQ ID NO: 52539 - RNA, 24 nt, Artificial Sequence
  T-complex protein 1 subunit eta (68-75)
cugcucgacgugguccaccccgcc

SEQ ID NO: 52540 - RNA, 27 nt, Artificial Sequence
  T-complex protein 1 subunit eta (68-76)
cugcucgacgugguccaccccgccgcu

SEQ ID NO: 52541 - RNA, 27 nt, Artificial Sequence
  Transmembrane emp24 domain-containing protein 10 (23-31)
cugcucggccccagacuugugcuggcc

SEQ ID NO: 52542 - RNA, 33 nt, Artificial Sequence
  Glyceraldehyde-3-phosphate dehydrogenase (174-184)
cugaugaccacagugcacgccaucacugcuacg

SEQ ID NO: 52543 - RNA, 27 nt, Artificial Sequence
  Proteasome-associated protein ECM29 homolog (162-170)
aaccuggccgagaagcccaaaaccgug

SEQ ID NO: 52544 - RNA, 27 nt, Artificial Sequence
  GPN-loop GTPase 1 (42-50)
aaccuggaccccgccgugcacgagguc

SEQ ID NO: 52545 - RNA, 27 nt, Artificial Sequence
  60S ribosomal protein L10a (143-151)
aacaugguggccaaggucgacgagguu

SEQ ID NO: 52546 - RNA, 27 nt, Artificial Sequence
  Heterogeneous nuclear ribonucleoproteins C1/C2 (142-150)
agagugcccccuccaccgcccaucgcc

SEQ ID NO: 52547 - RNA, 24 nt, Artificial Sequence
  Hydroxymethylglutaryl-CoA synthase, cytoplasmic (447-454)
agccuguucgagggcaccugguac

SEQ ID NO: 52548 - RNA, 27 nt, Artificial Sequence
  Hydroxymethylglutaryl-CoA synthase, cytoplasmic (482-490)
agccuguucgagggcaccugguaccuc

SEQ ID NO: 52549 - RNA, 21 nt, Artificial Sequence
  Sterol O-acyltransferase 1 (127-133)
agccugcucgacgagcuucug

SEQ ID NO: 52550 - RNA, 27 nt, Artificial Sequence
  Tuberin (526-534)
agccugcucgacaucauugagaaggug

SEQ ID NO: 52551 - RNA, 27 nt, Artificial Sequence
  Eukaryotic translation elongation factor 1 epsilon-1 (8-16)
agccugcucgagaagucccuuggccug

SEQ ID NO: 52552 - RNA, 27 nt, Artificial Sequence
  Neuroblast differentiation-associated protein AHNAK (2580-2588)
agcaugcccgacuucgaucugcaccuc

SEQ ID NO: 52553 - RNA, 27 nt, Artificial Sequence
  Phosphoinositide 3-kinase regulatory subunit 4 (906-914)
agccaggugcccgaggucaccacaguu

SEQ ID NO: 52554 - RNA, 36 nt, Artificial Sequence
  Annexin A2 (184-195)
agcgugaucgacuacgagcugauugaucaggacgcc

SEQ ID NO: 52555 - RNA, 33 nt, Artificial Sequence
  U2 small nuclear ribonucleoprotein A' (213-223)
acccuggccgagguggaaagacucaagggccuu

SEQ ID NO: 52556 - RNA, 27 nt, Artificial Sequence
  Serine/threonine-protein kinase SIK1 (473-481)
acccuggccgaggugagcacaagacuc

SEQ ID NO: 52557 - RNA, 27 nt, Artificial Sequence
  G2/mitotic-specific cyclin-B1 (321-329)
acccuggccaaguaccucauggagcuu

SEQ ID NO: 52558 - RNA, 33 nt, Artificial Sequence
  Nucleolin (501-511)
acccugcaggagguguucgaaaaggccacauuu

SEQ ID NO: 52559 - RNA, 30 nt, Artificial Sequence
  L-lactate dehydrogenase B chain (323-332)
acccugugggacauccagaaggaucucaaa

SEQ ID NO: 52560 - RNA, 27 nt, Artificial Sequence
  L-lactate dehydrogenase A chain (322-330)
acccuguggggcauccagaaggagcuc

SEQ ID NO: 52561 - RNA, 27 nt, Artificial Sequence
  Aladin (17-25)
acccuguacgagcacaacaaugaacuc

SEQ ID NO: 52562 - RNA, 33 nt, Artificial Sequence
  Microtubule-associated protein 4 (335-345)
gugcugcccaccgagacagaagucgccccugcu

SEQ ID NO: 52563 - RNA, 27 nt, Artificial Sequence
  Peroxiredoxin-5, mitochondrial (184-192)
gugguccaggacggcaucguuaaggcc

SEQ ID NO: 52564 - RNA, 30 nt, Artificial Sequence
  HLA class I histocompatibility antigen, B-7 alpha chain (140-149)
uacgccuaugacggcaaggauuacaucgcu

SEQ ID NO: 52565 - RNA, 21 nt, Artificial Sequence
  Carbamoyl-phosphate synthase (ammonia), mitochondrial (389-395)
uaccuguucgacagcuuuuuc

SEQ ID NO: 52566 - RNA, 24 nt, Artificial Sequence
  Bax inhibitor 1 (140-147)
uaccuguuccucggcgggauccuu

SEQ ID NO: 52567 - RNA, 30 nt, Artificial Sequence
  Coiled-coil domain-containing protein 12 (62-71)
uacgugcccgaggacgaagaucugaagaaa

SEQ ID NO: 52568 - RNA, 24 nt, Artificial Sequence
  Small nuclear ribonucleoprotein-associated proteins B and B' (18-25)
agaaucuucauuggcaccuuuaag

SEQ ID NO: 52569 - RNA, 54 nt, Artificial Sequence
  ATP synthase-coupling factor 6, mitochondrial (91-108)
cccaccuucaaguuugaggacccuaaauucgaagugaucgagaagccacaggcc

SEQ ID NO: 52570 - RNA, 27 nt, Artificial Sequence
  Kinectin (794-802)
agccugguggaggaacucaagaaaguc

SEQ ID NO: 52571 - RNA, 27 nt, Artificial Sequence
  Kinectin (600-608)
gugcuggccgaggaacuccacaagguc

SEQ ID NO: 52572 - RNA, 33 nt, Artificial Sequence
  HLA class I histocompatibility antigen, B-15 alpha chain (193-203)
agaagguaccuggagaacggcaaggaaacccuc

SEQ ID NO: 52573 - RNA, 27 nt, Artificial Sequence
  Keratin, type I cytoskeletal 18 (307-315)
gcccugcucaacaucaaggugaaacuu

SEQ ID NO: 52574 - RNA, 30 nt, Artificial Sequence
  Heat shock protein HSP 90-beta (346-355)
gccgaggacaaggaaaacuacaaaaaguuc

SEQ ID NO: 52575 - RNA, 27 nt, Artificial Sequence
  40S ribosomal protein S5 (12-20)
gccgagacccccgacaucaagcuguuc

SEQ ID NO: 52576 - RNA, 36 nt, Artificial Sequence
  Ribonucleoside-diphosphate reductase subunit M2 (165-176)
gaggaaguggaccugagcaaggauauccagcacugg

SEQ ID NO: 52577 - RNA, 30 nt, Artificial Sequence
  Nucleosome assembly protein 1-like 4 (86-95)
gaggaagugcacgaccuggagagaaaguac

SEQ ID NO: 52578 - RNA, 27 nt, Artificial Sequence
  U4/U6 small nuclear ribonucleoprotein Prp31 (105-113)
aacgagcugaauaucauucacaaguuc

SEQ ID NO: 52579 - RNA, 36 nt, Artificial Sequence
  ELAV-like protein 3 (161-172)
uucaucagauuugacaagaggauugaggccgaagag

SEQ ID NO: 52580 - RNA, 30 nt, Artificial Sequence
  ELAV-like protein 3 (29-38)
aagaccaaccugaucgugaauuaccucccc

SEQ ID NO: 52581 - RNA, 27 nt, Artificial Sequence
  Minor histocompatibility protein HA-1 (137-145)
gugcugcacgacgaucuccuugaggcc

SEQ ID NO: 52582 - RNA, 42 nt, Artificial Sequence
  Glyceraldehyde-3-phosphate dehydrogenase (26-39)
ggcaagguggacaucgucgccauuaacgaucccuucauagac

SEQ ID NO: 52583 - RNA, 42 nt, Artificial Sequence
  Low affinity immunoglobulin epsilon Fc receptor (10-23)
aucagccaggagcuggaagagcucagagccgaacaacagagg

SEQ ID NO: 52584 - RNA, 27 nt, Artificial Sequence
  26S proteasome non-ATPase regulatory subunit 2 (299-307)
ggcagacacgggguguuccuggagcuc

SEQ ID NO: 52585 - RNA, 27 nt, Artificial Sequence
  ATP-dependent RNA helicase DDX3X (234-242)
uuccugcuccccauccuuagccagauu

SEQ ID NO: 52586 - RNA, 27 nt, Artificial Sequence
  Putative homeodomain transcription factor 2 (652-660)
gcccagcugcuccacgugcaugagauc

SEQ ID NO: 52587 - RNA, 27 nt, Artificial Sequence
  Transcription factor BTF3 (47-55)
gagaccaucaugaaccaggaaaagcug

SEQ ID NO: 52588 - RNA, 27 nt, Artificial Sequence
  Ribosome biogenesis protein BRX1 homolog (141-149)
uuccuggugcagaacauccacacccuc

SEQ ID NO: 52589 - RNA, 27 nt, Artificial Sequence
  Microtubule-actin cross-linking factor 1, isoforms 1/2/3/5 (2558-2566)
caggccaucaagaacggccaagcucug

SEQ ID NO: 52590 - RNA, 39 nt, Artificial Sequence
  HLA class I histocompatibility antigen, B-8 alpha chain (111-123)
cagagcgaggccggcucccacacccugcaaucuauguac

SEQ ID NO: 52591 - RNA, 27 nt, Artificial Sequence
  Dynamin-2 (390-398)
uacgccaucaagaacauucacggcgug

SEQ ID NO: 52592 - RNA, 27 nt, Artificial Sequence
  ELAV-like protein 4 (96-104)
gaccccaaggaugccgagaaagcuauc

SEQ ID NO: 52593 - RNA, 27 nt, Artificial Sequence
  ELAV-like protein 4 (318-326)
ggccccuucggggccgugaacaauguc

SEQ ID NO: 52594 - RNA, 27 nt, Artificial Sequence
  ELAV-like protein 4 (197-205)
aagcccagcggcgccaccgagccuauc

SEQ ID NO: 52595 - RNA, 27 nt, Artificial Sequence
  ELAV-like protein 4 (265-273)
cccccuagcgccugcuccccaagauuc

SEQ ID NO: 52596 - RNA, 27 nt, Artificial Sequence
  ELAV-like protein 4 (270-278)
agccccagauucuccccuaucaccauu

SEQ ID NO: 52597 - RNA, 36 nt, Artificial Sequence
  ATP-dependent RNA helicase DDX3Y (176-187)
cacaucgagaacuucagcgacauugauaugggcgaa

SEQ ID NO: 52598 - RNA, 27 nt, Artificial Sequence
  Histone demethylase UTY (719-727)
cugcucaucgccgacaacccccagcuu

SEQ ID NO: 52599 - RNA, 27 nt, Artificial Sequence
  Pumilio homolog 3 (149-157)
agaacccuggacaaggugcucgagguc

SEQ ID NO: 52600 - RNA, 27 nt, Artificial Sequence
  Histone H4 (83-91)
accgccauggacguggucuacgcucug

SEQ ID NO: 52601 - RNA, 27 nt, Artificial Sequence
  Histone H3.2 (119-127)
accaucaugcccaaggacauucagcug

SEQ ID NO: 52602 - RNA, 39 nt, Artificial Sequence
  Protein S100-A9 (67-79)
gacaccaacgccgauaagcagcugagcuucgaggaauuu

SEQ ID NO: 52603 - RNA, 48 nt, Artificial Sequence
  Annexin A2 (209-224)
gacgugcccaaguggaucagcauuaugaccgagagauccgucccucac

SEQ ID NO: 52604 - RNA, 39 nt, Artificial Sequence
  Glyceraldehyde-3-phosphate dehydrogenase (269-281)
aucagcugguacgacaacgaguucggcuauuccaauaga

SEQ ID NO: 52605 - RNA, 54 nt, Artificial Sequence
  Macrophage migration inhibitory factor (3-20)
aucgugaacaccaauguccccagagccagcguuccugacggcuuccuguccgag

SEQ ID NO: 52606 - RNA, 27 nt, Artificial Sequence
  Hemoglobin subunit alpha (41-49)
cugagaguggaccccgucaacuucaag

SEQ ID NO: 52607 - RNA, 54 nt, Artificial Sequence
  40S ribosomal protein S17 (118-135)
caggugacccaacccacagucggcaugaacuucaagacuccuagagggccaguu

SEQ ID NO: 52608 - RNA, 48 nt, Artificial Sequence
  Collagen alpha-1(I) chain (857-872)
agacugcccaucauugacguggccccucucgaugucggcgcuccagac

SEQ ID NO: 52609 - RNA, 48 nt, Artificial Sequence
  Collagen alpha-2(I) chain (949-964)
agacccaaggacuacgagguggaugccacccugaaaagccucaacaau

SEQ ID NO: 52610 - RNA, 33 nt, Artificial Sequence
  T-complex protein 1 subunit theta (369-379)
gccgaggcuuucgaagcaauccccagagcccug

SEQ ID NO: 52611 - RNA, 27 nt, Artificial Sequence
  Cullin-1 (484-492)
gccgaggcuagcaugaucuccaagcug

SEQ ID NO: 52612 - RNA, 27 nt, Artificial Sequence
  DNA replication licensing factor MCM7 (328-336)
gccgaggaagacuucuacgagaagcug

SEQ ID NO: 52613 - RNA, 30 nt, Artificial Sequence
  BolA-like protein 2 (61-70)
gccgaggaacugccccacauccaugcuuuc

SEQ ID NO: 52614 - RNA, 27 nt, Artificial Sequence
  DNA topoisomerase 2-beta (526-534)
gccgagaucaacaauauuauaaagauc

SEQ ID NO: 52615 - RNA, 30 nt, Artificial Sequence
  Cofilin-1 (150-159)
gccgagaagcugggcgggagcgcugugauc

SEQ ID NO: 52616 - RNA, 27 nt, Artificial Sequence
  Proteasome subunit alpha type-4 (137-145)
gccgagaagguggaaaucgcuacccug

SEQ ID NO: 52617 - RNA, 27 nt, Artificial Sequence
  Bifunctional glutamate/proline-tRNA ligase (1393-1401)
gccgagaacgaagcugagaccaagcug

SEQ ID NO: 52618 - RNA, 30 nt, Artificial Sequence; identical to SEQ ID NO: 28391
  Sodium/potassium-transporting ATPase subunit alpha-1 (677-686)

SEQ ID NO: 52619 - RNA, 30 nt, Artificial Sequence
  Eukaryotic translation initiation factor 4 gamma 1 (1531-1540)
gccgagcagcaaggcaaggggguggcucug

SEQ ID NO: 52620 - RNA, 36 nt, Artificial Sequence
  T-complex protein 1 subunit eta (76-87)
gccgaggugggcgacgggaccacaagcgucacucug

SEQ ID NO: 52621 - RNA, 27 nt, Artificial Sequence
  MICOS complex subunit MIC60 (166-174)
ggcgaggggaagcccaccccugcccug

SEQ ID NO: 52622 - RNA, 33 nt, Artificial Sequence
  Peptidyl-prolyl cis-trans isomerase A (80-90)
ggcgagaaguucgaagacgagaacuuuauccug

SEQ ID NO: 52623 - RNA, 27 nt, Artificial Sequence
  NADH dehydrogenase (ubiquinone) 1 beta subcomplex subunit 7 (127-135)
ggcgagguggaccccaaggucgcccug

SEQ ID NO: 52624 - RNA, 30 nt, Artificial Sequence
  G2/mitotic-specific cyclin-B1 (62-71)
ggcgagguggacgucgaacagcacacccug

SEQ ID NO: 52625 - RNA, 42 nt, Artificial Sequence
  Zinc finger MYM-type protein 2 (207-220)
ggcgaguaccugcccagcaagggggccggaaacaaugugcuc

SEQ ID NO: 52626 - RNA, 30 nt, Artificial Sequence
  Transforming protein RhoA (46-55)
aucgagguggacggcaagcaggucgaacug

SEQ ID NO: 52627 - RNA, 33 nt, Artificial Sequence
  40S ribosomal protein S17 (96-106)
aucgagguggaccccgauaccaaggaaaugcug

SEQ ID NO: 52628 - RNA, 30 nt, Artificial Sequence
  Putative endoplasmin-like protein (341-350)
aaggaggacgaagaugacaaaaccgugcug

SEQ ID NO: 52629 - RNA, 30 nt, Artificial Sequence
  Plasminogen activator inhibitor 1 RNA-binding protein (182-191)
aaggaggaaggccccaaagagaugacccug

SEQ ID NO: 52630 - RNA, 27 nt, Artificial Sequence
  Uncharacterized protein C20orf24 (7-15)
aaggaggaacccccucagccacaacug

SEQ ID NO: 52631 - RNA, 30 nt, Artificial Sequence
  Importin subunit beta-1 (183-192)
aaggaggaacccagcaacaaugugaaacug

SEQ ID NO: 52632 - RNA, 33 nt, Artificial Sequence
  Heat shock protein HSP 90-beta (452-462)
aaggaguucgacggcaaaagccugguguccguc

SEQ ID NO: 52633 - RNA, 27 nt, Artificial Sequence
  Melanoma-associated antigen D2 (337-345)
aaggagaucgacaaaaacgaucaccug

SEQ ID NO: 52634 - RNA, 30 nt, Artificial Sequence
  Protein Spindly (380-389)
aaggagaucgaaagcaccaaaggcgagcug

SEQ ID NO: 52635 - RNA, 30 nt, Artificial Sequence
  Coatomer subunit epsilon (241-250)
aaggagaacgacuucgauagacuggugcuc

SEQ ID NO: 52636 - RNA, 27 nt, Artificial Sequence
  Targeting protein for Xklp2 (238-246)
aaggaggugaacuucaccagcgaacug

SEQ ID NO: 52637 - RNA, 27 nt, Artificial Sequence
  H/ACA ribonucleoprotein complex subunit 4 (151-159)
aaggaguacgugggcaucgucagacug

SEQ ID NO: 52638 - RNA, 30 nt, Artificial Sequence
  H/ACA ribonucleoprotein complex subunit 3 (8-17)
aacgagcagggcgacagaguguacacccug

SEQ ID NO: 52639 - RNA, 30 nt, Artificial Sequence
  Cerebellar degeneration-related protein 2 (148-157)
agagagcuggaagagaccaaccagaagcuc

SEQ ID NO: 52640 - RNA, 27 nt, Artificial Sequence
  Exocyst complex component 2 (640-648)
agacuguucgagaacuacaucgaacuc

SEQ ID NO: 52641 - RNA, 27 nt, Artificial Sequence
  1-phosphatidylinositol 3-phosphate 5-kinase (1841-1849)
agcgaggaagacuucaucagaucccug

SEQ ID NO: 52642 - RNA, 30 nt, Artificial Sequence; identical to SEQ ID NO: 28415
  Hydroxymethylglutaryl-CoA synthase, cytoplasmic (246-255)

SEQ ID NO: 52643 - RNA, 33 nt, Artificial Sequence
  Proteasome activator complex subunit 3 (220-230)
accgagaucgacgaaaaggaguacauuagccug

SEQ ID NO: 52644 - RNA, 45 nt, Artificial Sequence
  HLA class I histocompatibility antigen, B-15 alpha chain (240-254)
accuggcagagagacggcgaggaucaaacacaggacacugaacug

SEQ ID NO: 52645 - RNA, 30 nt, Artificial Sequence
  Nuclear pore complex protein Nup205 (350-359)
guggaggacgauagaacccugcagagccuc

SEQ ID NO: 52646 - RNA, 30 nt, Artificial Sequence
  Septin-2 (86-95)
guggagaucgaagagagaggcgucaagcug

SEQ ID NO: 52647 - RNA, 27 nt, Artificial Sequence
  Hemoglobin subunit alpha (25-33)
uacggcgccgaggcucuggaaagaaug

SEQ ID NO: 52648 - RNA, 42 nt, Artificial Sequence
  HLA class I histocompatibility antigen, A-1 alpha chain (29-42)
gacacccaguucgugagauuugauagcgacgccgcuucccaa

SEQ ID NO: 52649 - RNA, 27 nt, Artificial Sequence
  Neutral amino acid transporter B(0) (533-541)
guggccagcgagaaggaauccgucaug

SEQ ID NO: 52650 - RNA, 27 nt, Artificial Sequence
  Lysosomal protective protein (20-28)
aucagagccgcucccccuccacuguuc

SEQ ID NO: 52651 - RNA, 27 nt, Artificial Sequence
  Serine/threonine-protein kinase 38-like (444-452)
aagagauucgagggccugacccagagg

SEQ ID NO: 52652 - RNA, 48 nt, Artificial Sequence
  Alpha-1B-glycoprotein (173-188)
gcccccguggagcugauccucagcgacgaaacccuuccugcuccagag

SEQ ID NO: 52653 - RNA, 39 nt, Artificial Sequence
  Neuropilin-2 (696-708)
gagggccaguacgccagacugaucagccccccugugcac

SEQ ID NO: 52654 - RNA, 45 nt, Artificial Sequence
  Calreticulin (106-120)
ggcgggggauacgugaagcuguuccccaacagccucgaccagacc

SEQ ID NO: 52655 - RNA, 57 nt, Artificial Sequence
  Annexin A2 (50-68)
ggcguggacgaggucaccaucguuaacauucugacaaauagaagcaacgcccagagg

SEQ ID NO: 52656 - RNA, 45 nt, Artificial Sequence
  Filamin-A (2114-2128)
aaccccgccgaguucguggucaauaccagcaacgcuggcgcaggg

SEQ ID NO: 52657 - RNA, 51 nt, Artificial Sequence
  Syntenin-1 (25-41)
aaccccgccaauccugcuauccugagcgaggcauccgccccaauuccgcac

SEQ ID NO: 52658 - RNA, 42 nt, Artificial Sequence
  Transferrin receptor protein 1 (680-693)
agaguggaguaccacuuccugagccccuaugucuccccuaag

SEQ ID NO: 52659 - RNA, 39 nt, Artificial Sequence
  Cathepsin D (230-242)
agcuucuaccuguccagagaccccgaugcccagccuggc

SEQ ID NO: 52660 - RNA, 63 nt, Artificial Sequence
  HLA class I histocompatibility antigen, B-51 alpha chain (27-47)
guggacgauacccaguucgucagauuugacagcgaugccgcuucccccaggacagagccucgg

SEQ ID NO: 52661 - RNA, 51 nt, Artificial Sequence
  Profilin-1 (35-51)
gugcccggcaagaccuucgucaacaucacaccugccgagguuggggugcug

SEQ ID NO: 52662 - RNA, 27 nt, Artificial Sequence
  Lymphocyte-specific protein 1 (197-205)
aagcugaucgacagaaccgagagccuc

SEQ ID NO: 52663 - RNA, 27 nt, Artificial Sequence
  Synemin (426-434)
agaaccuucagccccacauacggccug

SEQ ID NO: 52664 - RNA, 27 nt, Artificial Sequence
  Insulin receptor substrate 2 (1097-1105)
agaguggccagccccaccuccggcguc

SEQ ID NO: 52665 - RNA, 27 nt, Artificial Sequence
  ETS translocation variant 5 (45-53)
gagcuguuccaggaccucagccaacuu

SEQ ID NO: 52666 - RNA, 27 nt, Artificial Sequence
  E3 ubiquitin-protein ligase Mdm2 (53-61)
gugcuguucuaccucggccaguauauc

SEQ ID NO: 52667 - RNA, 27 nt, Artificial Sequence
  U1 small nuclear ribonucleoprotein 70 kDa (423-431)
uaccuggcccccgagaacggcuaucuc

SEQ ID NO: 52668 - RNA, 27 nt, Artificial Sequence
  Coatomer subunit gamma-1 (147-155)
gccaucguggacaagguccccagcguu

SEQ ID NO: 52669 - RNA, 27 nt, Artificial Sequence
  T-complex protein 1 subunit gamma (129-137)
gcccuggacgauaugaucagcacccuc

SEQ ID NO: 52670 - RNA, 27 nt, Artificial Sequence
  DCN1-like protein 1 (94-102)
gcccuggaccccgcuagcaucuccgug

SEQ ID NO: 52671 - RNA, 27 nt, Artificial Sequence
  U3 small nucleolar ribonucleoprotein protein IMP3 (78-86)
gcccugcucgacaagcuuuacgcucug

SEQ ID NO: 52672 - RNA, 27 nt, Artificial Sequence
  Nuclear pore complex protein Nup205 (318-326)
gcccugcucgacagaaucgugagcguc

SEQ ID NO: 52673 - RNA, 27 nt, Artificial Sequence
  Phosphoglycerate kinase 1 (354-362)
gcccugauggacgagguggucaaggcu

SEQ ID NO: 52674 - RNA, 27 nt, Artificial Sequence
  Diphthamide biosynthesis protein 1 (138-146)
gcccaggacuucagagugcuguacguc

SEQ ID NO: 52675 - RNA, 27 nt, Artificial Sequence
  Methionine aminopeptidase 2 (433-441)
gcccaguucgagcacaccauccugcuc

SEQ ID NO: 52676 - RNA, 27 nt, Artificial Sequence
  GTP-binding nuclear protein Ran (215-223)
gcccaguacgagcacgaccuggaagug

SEQ ID NO: 52677 - RNA, 33 nt, Artificial Sequence
  60S acidic ribosomal protein P0 (108-118)
uuccuggccgaccccagcgcuuuuguggcagcc

SEQ ID NO: 52678 - RNA, 33 nt, Artificial Sequence
  60S ribosomal protein L10a (110-120)
uuccuggccagcgagucccucaucaagcagauu

SEQ ID NO: 52679 - RNA, 27 nt, Artificial Sequence
  Dipeptidyl peptidase 9 (806-814)
uuccuggacgagaacgugcacuuuuuc

SEQ ID NO: 52680 - RNA, 27 nt, Artificial Sequence
  ATP-binding cassette sub-family F member 2 (539-547)
uuccuggacgagcccaccaaccaccuc

SEQ ID NO: 52681 - RNA, 27 nt, Artificial Sequence
  Chloride intracellular channel protein 4 (178-186)
uuccuggacggcaacgagaugacccuc

SEQ ID NO: 52682 - RNA, 27 nt, Artificial Sequence
  3-hydroxy-3-methylglutaryl-coenzyme A reductase (113-121)
uuccuggacaaggagcucaccggccuu

SEQ ID NO: 52683 - RNA, 27 nt, Artificial Sequence
  Acyl-protein thioesterase 2 (218-226)
uuccuggagaagcuccuucccccugug

SEQ ID NO: 52684 - RNA, 27 nt, Artificial Sequence
  Macrophage migration inhibitory factor (17-25)
uuccugagcgagcucacccagcaacuu

SEQ ID NO: 52685 - RNA, 27 nt, Artificial Sequence
  26S proteasome non-ATPase regulatory subunit 14 (61-69)
uucguggacgauuacaccgucagaguu

SEQ ID NO: 52686 - RNA, 30 nt, Artificial Sequence; identical to SEQ ID NO: 28459
  Golgi-specific brefeldin A-resistance guanine nucleotide exchange factor 1 (1053-1062)

SEQ ID NO: 52687 - RNA, 27 nt, Artificial Sequence
  E3 ubiquitin-protein ligase BRE1A (401-409)
caccuggacgaggccagaacccuccuu

SEQ ID NO: 52688 - RNA, 27 nt, Artificial Sequence
  Abl interactor 2 (89-97)
auccuggacgauauuggccacggggug

SEQ ID NO: 52689 - RNA, 27 nt, Artificial Sequence
  Nuclear pore complex protein Nup88 (183-191)
auccuggacccccacgugguccuccuu

SEQ ID NO: 52690 - RNA, 27 nt, Artificial Sequence
  Thioredoxin-like protein 4A (40-48)
aagauggacgaggugcuguacagcauc

SEQ ID NO: 52691 - RNA, 27 nt, Artificial Sequence
  Protein BTG2 (73-81)
aagauggaccccaucauuagcagagug

SEQ ID NO: 52692 - RNA, 27 nt, Artificial Sequence
  Elongation factor 2 (159-167)
aagauggacagagcccugcucgagcuu

SEQ ID NO: 52693 - RNA, 24 nt, Artificial Sequence
  Transmembrane emp24 domain-containing protein 2 (42-49)
aagaugggccugaucuucgaggug

SEQ ID NO: 52694 - RNA, 24 nt, Artificial Sequence
  60S ribosomal protein L19 (119-126)
cugauggagcacauccauaagcuc

SEQ ID NO: 52695 - RNA, 27 nt, Artificial Sequence
  Glycogen phosphorylase, muscle form (271-279)
aaccuggccgagaauaucagcagagug

SEQ ID NO: 52696 - RNA, 27 nt, Artificial Sequence
  Junction plakoglobin (5-13)
aaccugauggagcagcccaucaaggug

SEQ ID NO: 52697 - RNA, 30 nt, Artificial Sequence
  Dolichyl-diphosphooligosaccharide-proteinosyltransferase subunit 2 (51-60)
agacuggacgagcucggcgggguguaccuu

SEQ ID NO: 52698 - RNA, 27 nt, Artificial Sequence
  Putative eukaryotic translation initiation factor 2 subunit 3-like protein (17-25)
agacaggaccugaccacacucgaugug

SEQ ID NO: 52699 - RNA, 27 nt, Artificial Sequence
  Serine/threonine-protein kinase/endoribonuclease IRE1 (37-45)
acccuggacggcagccuccacgccgug

SEQ ID NO: 52700 - RNA, 33 nt, Artificial Sequence
  Interferon-induced GTP-binding protein Mx1 (175-185)
acccugaucgaccuccccggcauuacaagagug

SEQ ID NO: 52701 - RNA, 27 nt, Artificial Sequence
  Mitotic spindle-associated MMXD complex subunit MIP18 (97-105)
acccugaucggccucagcauuaaggug

SEQ ID NO: 52702 - RNA, 27 nt, Artificial Sequence
  Sulfiredoxin-1 (114-122)
acccugagcgaccucagaguguaccuu

SEQ ID NO: 52703 - RNA, 30 nt, Artificial Sequence
  Nucleolar GTP-binding protein 1 (322-331)
acccugacagaggaaggcgugaucaagguc

SEQ ID NO: 52704 - RNA, 27 nt, Artificial Sequence
  10 kDa heat shock protein, mitochondrial (81-89)
gugcuggacgauaaggacuacuuccuc

SEQ ID NO: 52705 - RNA, 27 nt, Artificial Sequence
  Anoctamin-6 (137-145)
gugcuggacgauaagcucgucuucguu

SEQ ID NO: 52706 - RNA, 27 nt, Artificial Sequence
  Nucleolar pre-ribosomal-associated protein 1 (1314-1322)
gugcuggaccagaagauccuccuucug

SEQ ID NO: 52707 - RNA, 33 nt, Artificial Sequence; identical to SEQ ID NO: 28480
  RNA-binding protein 34 (333-343)

SEQ ID NO: 52708 - RNA, 27 nt, Artificial Sequence
  Eukaryotic translation initiation factor 4 gamma 1 (680-688)
gugcugaugaccgaggacaucaagcuc

SEQ ID NO: 52709 - RNA, 33 nt, Artificial Sequence; identical to SEQ ID NO: 28482
  Phosphoglycerate kinase 1 (407-417)

SEQ ID NO: 52710 - RNA, 30 nt, Artificial Sequence
  S-adenosylmethionine synthase isoform type-2 (235-244)
uaccuggacgaggauaccaucuaucaccuc

SEQ ID NO: 52711 - RNA, 27 nt, Artificial Sequence
  Transmembrane protein 209 (409-417)
uaccuguucgagagaaucaaggaacuc

SEQ ID NO: 52712 - RNA, 30 nt, Artificial Sequence
  HLA class I histocompatibility antigen, B-13 alpha chain (26-35)
uacguggacgauacccaguucgucagauuu

SEQ ID NO: 52713 - RNA, 36 nt, Artificial Sequence
  Melanoma antigen recognized by T-cells 1 (100-111)
gcccccccugcuuacgagaagcugagcgcagaacag

SEQ ID NO: 52714 - RNA, 45 nt, Artificial Sequence
  Melanoma antigen recognized by T-cells 1 (100-114)
gcccccccugcuuacgagaagcugagcgcagaacaguccccaccg

SEQ ID NO: 52715 - RNA, 48 nt, Artificial Sequence
  Melanoma antigen recognized by T-cells 1 (100-115)
gcccccccugcuuacgagaagcugagcgcagaacaguccccaccgccc

SEQ ID NO: 52716 - RNA, 51 nt, Artificial Sequence
  Melanoma antigen recognized by T-cells 1 (100-116)
gcccccccugcuuacgagaagcugagcgcagaacaguccccaccgcccuau

SEQ ID NO: 52717 - RNA, 36 nt, Artificial Sequence
  Melanoma antigen recognized by T-cells 1 (99-110)
aacgcccccccugcuuacgagaagcugagcgcagaa

SEQ ID NO: 52718 - RNA, 60 nt, Artificial Sequence
  Melanoma antigen recognized by T-cells 1 (97-116)
gugcccaacgccccuccagcuuacgagaagcugagcgcagaacaguccccgcccccuuau

SEQ ID NO: 52719 - RNA, 48 nt, Artificial Sequence
  Gamma-secretase C-terminal fragment 59 (581-596)
uucgccgaggacgugggcagcaacaagggggcuaucauuggacugaug

SEQ ID NO: 52720 - RNA, 27 nt, Artificial Sequence
  Ubiquitin carboxyl-terminal hydrolase 11 (583-591)
uucaccugggagggccuguacaacgug

SEQ ID NO: 52721 - RNA, 30 nt, Artificial Sequence
  Ataxin-10 (324-333)
cagguguuccccggccugcucgagagaguc

SEQ ID NO: 52722 - RNA, 27 nt, Artificial Sequence
  Vacuolar protein sorting-associated protein 13B (29-37)
agccuguggggcggggacgugguccuc

SEQ ID NO: 52723 - RNA, 30 nt, Artificial Sequence
  Farnesyl pyrophosphate synthase (238-247)
uaccuggaccucuucggcgaucccagcgug

SEQ ID NO: 52724 - RNA, 27 nt, Artificial Sequence
  Suppressor of SWI4 1 homolog (26-34)
gccgcuaacccccacagcuucguguuu

SEQ ID NO: 52725 - RNA, 33 nt, Artificial Sequence
  Golgin subfamily A member 7 (65-75)
gccgaggcugaaaagcugggcgggcagagcuac

SEQ ID NO: 52726 - RNA, 27 nt, Artificial Sequence
  DNA replication licensing factor MCM4 (741-749)
gccgaggcucacgcaaaggugagacug

SEQ ID NO: 52727 - RNA, 27 nt, Artificial Sequence
  Stomatin-like protein 2, mitochondrial (255-263)
gccgaggcuaucagaauucuggcagcc

SEQ ID NO: 52728 - RNA, 27 nt, Artificial Sequence
  Nuclear pore complex protein Nup107 (415-423)
gccgaggacgaacuguucaacagauac

SEQ ID NO: 52729 - RNA, 33 nt, Artificial Sequence
  N-alpha-acetyltransferase 10 (45-55)
gccgaggacgaaaacggcaagaucgugggguac

SEQ ID NO: 52730 - RNA, 33 nt, Artificial Sequence
  Cytochrome c oxidase subunit 6B1 (2-12)
gccgaggacauggaaaccaagaucaaaaacuac

SEQ ID NO: 52731 - RNA, 27 nt, Artificial Sequence
  General transcription factor II-I repeat domain-containing protein 2B (397-405)
gccgaguucaucaaguuuaccgugauu

SEQ ID NO: 52732 - RNA, 27 nt, Artificial Sequence
  Heterogeneous nuclear ribonucleoprotein A0 (110-118)
gccgagggcgaccugaucgaacacuuc

SEQ ID NO: 52733 - RNA, 33 nt, Artificial Sequence; identical to SEQ ID NO: 28506
  60S ribosomal protein L8 (33-43)

SEQ ID NO: 52734 - RNA, 27 nt, Artificial Sequence
  Condensin complex subunit 3 (712-720)
gccgagggccuggcuaagcucauguuc

SEQ ID NO: 52735 - RNA, 27 nt, Artificial Sequence
  T-complex protein 1 subunit gamma (109-117)
gccgagcacuuccuggaacagcaaaug

SEQ ID NO: 52736 - RNA, 30 nt, Artificial Sequence
  Spectrin beta chain, non-erythrocytic 1 (1958-1967)
gccgagaucgacgcuagaaacgauagcuuc

SEQ ID NO: 52737 - RNA, 27 nt, Artificial Sequence
  Regulation of nuclear pre-mRNA domain-containing protein 1A (232-240)
gccgagaucgacgauagaaagcagcug

SEQ ID NO: 52738 - RNA, 30 nt, Artificial Sequence
  40S ribosomal protein SA (218-227)
gccgagaaggcugugaccaaagaagaguuc

SEQ ID NO: 52739 - RNA, 27 nt, Artificial Sequence
  Helicase SRCAP (394-402)
gccgagagccugcagcccaagggcuac

SEQ ID NO: 52740 - RNA, 27 nt, Artificial Sequence
  Spartin (569-577)
gccgagaccgugcagacagucagauac

SEQ ID NO: 52741 - RNA, 27 nt, Artificial Sequence
  Uncharacterized protein ZMYM6NB (44-52)
gccgagguguucccccugaaggucuuu

SEQ ID NO: 52742 - RNA, 30 nt, Artificial Sequence
  CLIP-associating protein 1 (357-366)
gccgaguacgacaacuucuuucagcaccug

SEQ ID NO: 52743 - RNA, 27 nt, Artificial Sequence
  Alpha-actinin-4 (306-314)
gccaucgaccagcugcaccucgaguac

SEQ ID NO: 52744 - RNA, 27 nt, Artificial Sequence
  Nucleolar protein 58 (12-20)
gccaucuucaaggugcugaacgagaaa

SEQ ID NO: 52745 - RNA, 30 nt, Artificial Sequence
  Serine/threonine-protein kinase Kist (151-160)
gccaucauugaccacauauucgcuagcaag

SEQ ID NO: 52746 - RNA, 30 nt, Artificial Sequence
  Transcription factor Sp2 (106-115)
gccauccagaaccccaccaugauuaauaag

SEQ ID NO: 52747 - RNA, 27 nt, Artificial Sequence
  Apolipoprotein L1 (142-150)
gcccuggcugacggcgugcagaagguc

SEQ ID NO: 52748 - RNA, 27 nt, Artificial Sequence
  Tankyrase-2 (1234-1242)
gcccuggcugaguacgugaucuauaga

SEQ ID NO: 52749 - RNA, 27 nt, Artificial Sequence
  Uncharacterized protein C19orf43 (126-134)
gcccugaagaccggcaucguggcuaaa

SEQ ID NO: 52750 - RNA, 30 nt, Artificial Sequence
  Heat shock protein HSP 90-alpha (740-749)
gcccugagagacaacagcaccaugggcuac

SEQ ID NO: 52751 - RNA, 27 nt, Artificial Sequence
  X-ray repair cross-complementing protein 5 (376-384)
gcccugagcucccucauccacgcucuu

SEQ ID NO: 52752 - RNA, 30 nt, Artificial Sequence
  Nucleolar protein 7 (190-199)
gcccaggcuuucauccacaacagccuguac

SEQ ID NO: 52753 - RNA, 27 nt, Artificial Sequence
  U5 small nuclear ribonucleoprotein 200 kDa helicase (1246-1254)
gcccaggacgagcaccugaucaccuuc

SEQ ID NO: 52754 - RNA, 27 nt, Artificial Sequence
  15 kDa selenoprotein (78-86)
gcccaguucgagaccaagaaacuguac

SEQ ID NO: 52755 - RNA, 30 nt, Artificial Sequence
  Prelamin-A/C (169-178)
gcccagcacgaggaccaaguggaacaguac

SEQ ID NO: 52756 - RNA, 27 nt, Artificial Sequence
  Ribosomal RNA processing protein 1 homolog B (90-98)
gcccagcaccuguucauccaaaccuuu

SEQ ID NO: 52757 - RNA, 27 nt, Artificial Sequence
  116 kDa U5 small nuclear ribonucleoprotein component (574-582)
gcccagaucuucagaccccugaaguuu

SEQ ID NO: 52758 - RNA, 27 nt, Artificial Sequence
  Paraneoplastic antigen Ma1 (246-254)
gcccagaucaaguuccugaacaccuac

SEQ ID NO: 52759 - RNA, 30 nt, Artificial Sequence
  Retinoic acid-induced protein 1 (1522-1531)
gcccagaagcaacccggccacaccaacuac

SEQ ID NO: 52760 - RNA, 27 nt, Artificial Sequence
  ADP-ribosylation factor GTPase-activating protein 2 (233-241)
gcccagaaggugagcucccaaucuuuc

SEQ ID NO: 52761 - RNA, 27 nt, Artificial Sequence
  Nucleolar protein 56 (144-152)
gcccagcugggccucgggcacagcuac

SEQ ID NO: 52762 - RNA, 27 nt, Artificial Sequence
  Catenin beta-1 (481-489)
gcccagaacgcugugagacugcacuac

SEQ ID NO: 52763 - RNA, 33 nt, Artificial Sequence
  nuclear pore complex protein Nup98 isoform 2 proprotein (110-120)
gcccagaacaagcccaccggcuucgggaauuuu

SEQ ID NO: 52764 - RNA, 33 nt, Artificial Sequence
  RNA-binding protein 14 (530-540)
gcccagcaacacccccaggcugcagccagcuac

SEQ ID NO: 52765 - RNA, 27 nt, Artificial Sequence
  Eukaryotic initiation factor 4A-I (113-121)
gcccagcaaauccagaagguggucaug

SEQ ID NO: 52766 - RNA, 27 nt, Artificial Sequence
  Septin-7 (21-29)
gcccagcaaaagaaccuggagggcuac

SEQ ID NO: 52767 - RNA, 27 nt, Artificial Sequence
  Protein polybromo-1 (234-242)
gcccagagaauccaaaacggcagcuac

SEQ ID NO: 52768 - RNA, 30 nt, Artificial Sequence
  Annexin A2 (66-75)
gcccagagacaagacaucgcuuucgcauac

SEQ ID NO: 52769 - RNA, 30 nt, Artificial Sequence
  Annexin A4 (49-58)
gcccagagacaagagaucaggaccgcuuac

SEQ ID NO: 52770 - RNA, 30 nt, Artificial Sequence
  Centromere protein F (348-357)
gcccaguacgaccaagcuagcaccaaguau

SEQ ID NO: 52771 - RNA, 33 nt, Artificial Sequence
  60S ribosomal protein L22-like 1 (118-128)
gccagcgacaaggagaccuacgaacugagauau

SEQ ID NO: 52772 - RNA, 30 nt, Artificial Sequence
  Histone H2B type 1-A (76-85)
gccagcgaggcuuccagacuggcacacuac

SEQ ID NO: 52773 - RNA, 30 nt, Artificial Sequence
  ADP-dependent glucokinase (24-33)
gccagcgaguuccccggcgcucagcacuac

SEQ ID NO: 52774 - RNA, 27 nt, Artificial Sequence
  Heterogeneous nuclear ribonucleoprotein U (205-213)
gccagcuacggcguguccaaggggaaa

SEQ ID NO: 52775 - RNA, 30 nt, Artificial Sequence
  High affinity cAMP-specific 3',5'-cyclic phosphodiesterase 7A (294-303)
gccaccgacaucagcagacagaacgaguac

SEQ ID NO: 52776 - RNA, 27 nt, Artificial Sequence
  E3 ubiquitin-protein ligase UBR2 (31-39)
gccaccgaccugacaagagagguguac

SEQ ID NO: 52777 - RNA, 27 nt, Artificial Sequence
  m7GpppX diphosphatase (135-143)
gccaccgagaagcaccugcagaaauac

SEQ ID NO: 52778 - RNA, 33 nt, Artificial Sequence
  Microtubule-actin cross-linking factor 1, isoforms 1/2/3/5 (326-336)
gccaccgagguggacagcagauggcaggaauac

SEQ ID NO: 52779 - RNA, 27 nt, Artificial Sequence
  YTH domain-containing protein 1 (92-100)
gccaccgaguacaagaacgaagaguau

SEQ ID NO: 52780 - RNA, 27 nt, Artificial Sequence
  Eukaryotic translation initiation factor 5A-1 (146-154)
gccguggcuaucaaggcaauggccaaa

SEQ ID NO: 52781 - RNA, 30 nt, Artificial Sequence
  Activating transcription factor 7-interacting protein 1 (621-630)
gccguguucgacaagacccuggcugagcuc

SEQ ID NO: 52782 - RNA, 27 nt, Artificial Sequence
  Transmembrane protein 258 (16-24)
gccguguucccccaccugaccgucguu

SEQ ID NO: 52783 - RNA, 33 nt, Artificial Sequence
  U3 small nucleolar RNA-associated protein 6 homolog (467-477)
gccgugaucggcgcugacagcgucacccugaag

SEQ ID NO: 52784 - RNA, 27 nt, Artificial Sequence
  Nucleolar RNA helicase 2 (357-365)
gccgugaucggcgacgucauuagaguu

SEQ ID NO: 52785 - RNA, 30 nt, Artificial Sequence; identical to SEQ ID NO: 28558
  Nucleosome assembly protein 1-like 1 (107-116)

SEQ ID NO: 52786 - RNA, 30 nt, Artificial Sequence
  MICOS complex subunit MIC60 (247-256)
gccgugaacgcucacagcaauauccugaag

SEQ ID NO: 52787 - RNA, 27 nt, Artificial Sequence
  Elongation of very long chain fatty acids protein 5 (276-284)
gccgugaacggccacaccaauagcuuc

SEQ ID NO: 52788 - RNA, 27 nt, Artificial Sequence
  DNA-directed RNA polymerase II subunit RPB7 (87-95)
gccguggucacccagguuaacaaggug

SEQ ID NO: 52789 - RNA, 27 nt, Artificial Sequence
  RRP12-like protein (704-712)
gacgaggccgcuaucagcaagcuguac

SEQ ID NO: 52790 - RNA, 33 nt, Artificial Sequence
  26S protease regulatory subunit 6B (265-275)
gacgagaucgaugccauugcuaccaagagauuc

SEQ ID NO: 52791 - RNA, 33 nt, Artificial Sequence
  26S protease regulatory subunit 7 (275-285)
gacgagaucgaugccauuggcggggcuagauuc

SEQ ID NO: 52792 - RNA, 33 nt, Artificial Sequence
  26S protease regulatory subunit 4 (285-295)
gacgagaucgaugccauuggcaccaagagauac

SEQ ID NO: 52793 - RNA, 27 nt, Artificial Sequence
  Nucleolar protein 11 (17-25)
gacgagaacagcgugaucaaguccuuc

SEQ ID NO: 52794 - RNA, 27 nt, Artificial Sequence
  Prothymosin alpha (16-24)
gaccugaaggagaaaaaggaagugguc

SEQ ID NO: 52795 - RNA, 30 nt, Artificial Sequence
  Vezatin (553-562)
gacagcgauuucagaaaggacgauuuuuac

SEQ ID NO: 52796 - RNA, 27 nt, Artificial Sequence
  Protein AF-10 (379-387)
gacagcgaucugagaaacgacuccuac

SEQ ID NO: 52797 - RNA, 27 nt, Artificial Sequence
  Negative elongation factor C/D (348-356)
gacaccgauaucagccugauuagauac

SEQ ID NO: 52798 - RNA, 27 nt, Artificial Sequence
  Transcription factor E2F1 (237-245)
gacaccgauagccagagacuggccuac

SEQ ID NO: 52799 - RNA, 27 nt, Artificial Sequence
  RNA-binding protein 6 (398-406)
gacaccgauuacagaagcauggaguau

SEQ ID NO: 52800 - RNA, 30 nt, Artificial Sequence
  Eukaryotic translation initiation factor 4 gamma 3 (1509-1518)
gacaccgagaaggaacugcaggcccucuac

SEQ ID NO: 52801 - RNA, 33 nt, Artificial Sequence
  Next to BRCA1 gene 1 protein (720-730)
gacaccagcagaccccugggcgauuccauguac

SEQ ID NO: 52802 - RNA, 27 nt, Artificial Sequence
  Mitochondrial import receptor subunit TOM7 homolog (7-15)
gaggccaagcagagacugcaacagcuc

SEQ ID NO: 52803 - RNA, 30 nt, Artificial Sequence
  Heterogeneous nuclear ribonucleoprotein U-like protein 1 (585-594)
gaggaagccgacaagcuggugagacaguac

SEQ ID NO: 52804 - RNA, 27 nt, Artificial Sequence
  Poly (ADP-ribose) polymerase 1 (809-817)
gaggaagccgagaucauuagaaaguac

SEQ ID NO: 52805 - RNA, 30 nt, Artificial Sequence
  RB1 protein (1-10)
gaggaagagagacugagcauccagaacuuc

SEQ ID NO: 52806 - RNA, 30 nt, Artificial Sequence
  Eukaryotic translation initiation factor 3 subunit C (81-90)
gaggaauucgagcugcucggcaaggccuac

SEQ ID NO: 52807 - RNA, 27 nt, Artificial Sequence
  Condensin-2 complex subunit G2 (490-498)
gaggaaggcgccguggacaagagcuac

SEQ ID NO: 52808 - RNA, 30 nt, Artificial Sequence
  Prelamin-A/C (53-62)
gaggaacuggacuuccagaagaacaucuac

SEQ ID NO: 52809 - RNA, 27 nt, Artificial Sequence
  Signal transducer and activator of transcription 1-alpha/beta (281-289)
gaggaacuggagcagaaguacaccuau

SEQ ID NO: 52810 - RNA, 27 nt, Artificial Sequence
  Poly (ADP-ribose) polymerase 1 (168-176)
gaggaacugggcuucagacccgaguac

SEQ ID NO: 52811 - RNA, 27 nt, Artificial Sequence
  BolA-like protein 2 (62-70)
gaggaacugccccacauccaugccuuc

SEQ ID NO: 52812 - RNA, 27 nt, Artificial Sequence
  Signal transducer and activator of transcription 3 (285-293)
gaggaacugcagcaaaaggugagcuac

SEQ ID NO: 52813 - RNA, 30 nt, Artificial Sequence
  Ataxin-2-like protein (284-293)
gaggaaaacuacggcgugaagaccacauau

SEQ ID NO: 52814 - RNA, 27 nt, Artificial Sequence
  G patch domain-containing protein 4 (16-24)
gaggaacagcugcucaagcacggcugg

SEQ ID NO: 52815 - RNA, 30 nt, Artificial Sequence
  Golgi resident protein GCP60 (489-498)
gaggaaguguacgccggcagccaccaguau

SEQ ID NO: 52816 - RNA, 27 nt, Artificial Sequence
  AP-1 complex subunit sigma-3 (146-154)
gaggaauacaugaacaagcccaccuuc

SEQ ID NO: 52817 - RNA, 27 nt, Artificial Sequence
  Transferrin receptor protein 1 (575-583)
gagcugaucgaaagaauucccgagcuc

SEQ ID NO: 52818 - RNA, 27 nt, Artificial Sequence
  Cleavage stimulation factor subunit 3 (52-60)
gagaccgcccugcucguggacagauac

SEQ ID NO: 52819 - RNA, 33 nt, Artificial Sequence
  ATP-dependent RNA helicase DDX24 (571-581)
gagaccgacgaaaaggauuucuaccuguauuac

SEQ ID NO: 52820 - RNA, 30 nt, Artificial Sequence
  Mediator of RNA polymerase II transcription subunit 23 (175-184)
gagaccgaccacaucaaccagauuggcuac

SEQ ID NO: 52821 - RNA, 30 nt, Artificial Sequence
  Sorting and assembly machinery component 50 homolog (206-215)
gagaccgacagaggcaugagcgccgaauac

SEQ ID NO: 52822 - RNA, 33 nt, Artificial Sequence
  Protein polybromo-1 (1182-1192)
gagaccgaacacgagcccacaaagauguucuac

SEQ ID NO: 52823 - RNA, 33 nt, Artificial Sequence
  Protein LAP2 (803-813)
gagaccgaacaccuggagaacggcaauaaguac

SEQ ID NO: 52824 - RNA, 27 nt, Artificial Sequence
  Spectrin beta chain, erythrocytic (299-307)
gagaccgaaaagaugaucgagaaauac

SEQ ID NO: 52825 - RNA, 30 nt, Artificial Sequence
  E3 ubiquitin-protein ligase RBBP6 (790-799)
gagaccgaaagagaguacuucaacagguau

SEQ ID NO: 52826 - RNA, 27 nt, Artificial Sequence
  Putative eukaryotic translation initiation factor 2 subunit 3-like protein (322-330)
uucgccgagcacaacgaccugcaguac

SEQ ID NO: 52827 - RNA, 27 nt, Artificial Sequence
  40S ribosomal protein S18 (28-36)
uucgccaucaccgcuauuaagggcgug

SEQ ID NO: 52828 - RNA, 27 nt, Artificial Sequence
  Keratinocyte-associated protein 2 (110-118)
uucgccagcggccugauccacagagug

SEQ ID NO: 52829 - RNA, 27 nt, Artificial Sequence
  Dolichyl-diphosphooligosaccharide-proteinosyltransferase subunit DAD1 (99-107)
uucgccagcaccauccugcaccucgug

SEQ ID NO: 52830 - RNA, 27 nt, Artificial Sequence
  Minor histocompatibility antigen H13 (236-244)
uucgaggcccccaucaagcugguguuu

SEQ ID NO: 52831 - RNA, 27 nt, Artificial Sequence
  Catenin alpha-2 (609-617)
uucaucgacgccagcagacugguguac

SEQ ID NO: 52832 - RNA, 33 nt, Artificial Sequence
  TBC1 domain family member 31 (560-570)
uucaucgaccacgauauuaccagccagcuguac

SEQ ID NO: 52833 - RNA, 27 nt, Artificial Sequence
  Poly (ADP-ribose) polymerase 4 (797-805)
uucaucuuuagcgacacccacgagcug

SEQ ID NO: 52834 - RNA, 33 nt, Artificial Sequence
  Basic leucine zipper and W2 domain-containing protein 1 (53-63)
uuccuggacgccagcggcgcuaagcucgauuac

SEQ ID NO: 52835 - RNA, 30 nt, Artificial Sequence
  Neutral alpha-glucosidase AB (604-613)
uuccuggacgauggccacaccuuuaacuac

SEQ ID NO: 52836 - RNA, 30 nt, Artificial Sequence
  RuvB-like 2 (433-442)
uuccuggacgagagcagauccacccaguac

SEQ ID NO: 52837 - RNA, 27 nt, Artificial Sequence
  Signal transducer and activator of transcription 1-alpha/beta (14-22)
uuccuggagcaggugcaccaacucuac

SEQ ID NO: 52838 - RNA, 27 nt, Artificial Sequence
  Protein MCM10 homolog (333-341)
uuccuguuuggcgaggugcacaaggcc

SEQ ID NO: 52839 - RNA, 30 nt, Artificial Sequence
  Hemoglobin subunit alpha (5-14)
uuccugagcuuucccaccacaaagacuuac

SEQ ID NO: 52840 - RNA, 27 nt, Artificial Sequence
  Plexin-C1 (1065-1073)
uuccuggugaccgucauccacacacuc

SEQ ID NO: 52841 - RNA, 27 nt, Artificial Sequence
  DNA repair protein XRCC1 (161-169)
uuccagaaccccuuuagaagcgagcug

SEQ ID NO: 52842 - RNA, 27 nt, Artificial Sequence
  Protein AATF (298-306)
uuccaguaccccgacaccagauaucug

SEQ ID NO: 52843 - RNA, 27 nt, Artificial Sequence
  Short transient receptor potential channel 4-associated protein (457-465)
uucagcgaccaccaugagaacaaguac

SEQ ID NO: 52844 - RNA, 27 nt, Artificial Sequence
  Cell cycle progression protein 1 (186-194)
uucagcgacuaccugcacccccaguau

SEQ ID NO: 52845 - RNA, 27 nt, Artificial Sequence
  Dihydrofolate reductase, mitochondrial (149-157)
uucagcgagaucgaccuggaaaaguac

SEQ ID NO: 52846 - RNA, 30 nt, Artificial Sequence
  Splicing factor 3A subunit 3 (130-139)
uucaccgacgaggaaggcuacgggagauau

SEQ ID NO: 52847 - RNA, 30 nt, Artificial Sequence
  Bifunctional glutamate/proline-tRNA ligase (48-57)
uucaccgacgugaacagcauccugagauac

SEQ ID NO: 52848 - RNA, 33 nt, Artificial Sequence
  RNMT-activating mini protein (19-29)
uucaccgagaacgacaaggaauaccaggaguau

SEQ ID NO: 52849 - RNA, 27 nt, Artificial Sequence
  ATP-dependent RNA helicase DDX24 (801-809)
uucaccgagagccagaagacaaaauac

SEQ ID NO: 52850 - RNA, 27 nt, Artificial Sequence
  Eukaryotic translation initiation factor 4 gamma 1 (1377-1385)
uucguggccgagcagaaggucgaauac

SEQ ID NO: 52851 - RNA, 27 nt, Artificial Sequence
  Coatomer subunit delta (9-17)
uucguggagaccgaaagcgucagauac

SEQ ID NO: 52852 - RNA, 27 nt, Artificial Sequence
  Coatomer subunit alpha (641-649)
uucgugaaggacgagaaaaccagauuu

SEQ ID NO: 52853 - RNA, 27 nt, Artificial Sequence
  Mothers against decapentaplegic homolog 9 (418-426)
uucgugaagggcuggggggccgaguac

SEQ ID NO: 52854 - RNA, 30 nt, Artificial Sequence
  Ubiquitin-like protein FUBI (4-13)
uucgugagagcccaggagcugcacaccuuu

SEQ ID NO: 52855 - RNA, 27 nt, Artificial Sequence
  Lysine-tRNA ligase (119-127)
ggcgaggaccccuacccucacaaguuc

SEQ ID NO: 52856 - RNA, 27 nt, Artificial Sequence
  Cytochrome c oxidase subunit 6A1, mitochondrial (7-15)
ggcgaggaagggagcgccagaaugugg

SEQ ID NO: 52857 - RNA, 27 nt, Artificial Sequence
  Polycomb protein SUZ12 (549-557)
ggcgagguggaacagcaaagaaccuac

SEQ ID NO: 52858 - RNA, 30 nt, Artificial Sequence
  SNARE-associated protein Snapin (127-136)
ggcaucuaccccccugggagcccaggaaag

SEQ ID NO: 52859 - RNA, 33 nt, Artificial Sequence
  Ataxin-10 (379-389)
ggccuggccgacgcuagccuccuuaagaaagug

SEQ ID NO: 52860 - RNA, 27 nt, Artificial Sequence
  Signal recognition particle 54 kDa protein (302-310)
ggccugaucgacaaggugaacgagcuc

SEQ ID NO: 52861 - RNA, 27 nt, Artificial Sequence
  Probable JmjC domain-containing histone demethylation protein 2C (846-854)
ggccaggcccaccccagcgcuuccuac

SEQ ID NO: 52862 - RNA, 27 nt, Artificial Sequence
  Putative ATP-dependent RNA helicase DDX11-like protein 8 (825-833)
ggccaggcccccccugggaaggcucug

SEQ ID NO: 52863 - RNA, 27 nt, Artificial Sequence
  General transcription factor 3C polypeptide 1 (604-612)
ggccaggacaagccccacgagaccuac

SEQ ID NO: 52864 - RNA, 30 nt, Artificial Sequence
  Tonsoku-like protein (670-679)
ggccaggacccccacagcucccaagccuuc

SEQ ID NO: 52865 - RNA, 27 nt, Artificial Sequence
  Nuclear pore complex protein Nup214 (1208-1216)
ggccaguucagcaagcccuuuuccuuc

SEQ ID NO: 52866 - RNA, 33 nt, Artificial Sequence
  ATP-dependent 6-phosphofructokinase, platelet type (125-135)
ggccagaucgacaaggaggccgugcaaaaauac

SEQ ID NO: 52867 - RNA, 27 nt, Artificial Sequence
  Alpha-endosulfine (45-53)
ggccagaagcccgggggaagcgacuuc

SEQ ID NO: 52868 - RNA, 27 nt, Artificial Sequence
  Heterogeneous nuclear ribonucleoprotein U (812-820)
ggccagaagcccuggagccaacacuac

SEQ ID NO: 52869 - RNA, 33 nt, Artificial Sequence
  60S ribosomal protein L26 (64-74)
ggccagcaaaucgggaaggugguccagguuuac

SEQ ID NO: 52870 - RNA, 30 nt, Artificial Sequence
  60S ribosomal protein L8 (3-12)
ggccagagaaagggggccggaagcguguuc

SEQ ID NO: 52871 - RNA, 27 nt, Artificial Sequence
  60S ribosomal protein L28 (69-77)
ggccagagaaagcccgccaccagcuac

SEQ ID NO: 52872 - RNA, 27 nt, Artificial Sequence
  DNA mismatch repair protein Msh2 (157-165)
ggccagagacaagugggggucggauac

SEQ ID NO: 52873 - RNA, 27 nt, Artificial Sequence
  Chromodomain-helicase-DNA-binding protein 8 (210-218)
ggccagagcaaggccgugaaagucuac

SEQ ID NO: 52874 - RNA, 27 nt, Artificial Sequence
  Cell division cycle protein 27 homolog (325-333)
ggccagaccgggacaaagagcguguuc

SEQ ID NO: 52875 - RNA, 27 nt, Artificial Sequence
  Transmembrane protein 43 (137-145)
ggccaggugaagaaagagaccagauac

SEQ ID NO: 52876 - RNA, 27 nt, Artificial Sequence
  Clathrin heavy chain 1 (496-504)
ggccaggugcaaaagaucguccuguac

SEQ ID NO: 52877 - RNA, 30 nt, Artificial Sequence
  Disintegrin and metalloproteinase domain-containing protein 10 (19-28)
ggccaguacgggaacccccugaauaaguau

SEQ ID NO: 52878 - RNA, 33 nt, Artificial Sequence; identical to SEQ ID NO: 28651
  Protein transport protein Sec23B (560-570)

SEQ ID NO: 52879 - RNA, 27 nt, Artificial Sequence
  Protein CASP (561-569)
ggcagcgacgauaccgagcugagauac

SEQ ID NO: 52880 - RNA, 30 nt, Artificial Sequence
  Gem-associated protein 5 (444-453)
ggcaccgacgaugggaaggugggacuguac

SEQ ID NO: 52881 - RNA, 27 nt, Artificial Sequence
  Ribosomal biogenesis protein LAS1L (107-115)
ggcaccgacgagcugagacuccuuuac

SEQ ID NO: 52882 - RNA, 27 nt, Artificial Sequence
  WD repeat-containing protein 34 (398-406)
ggcaccgacgggcacgugcaucuguac

SEQ ID NO: 52883 - RNA, 33 nt, Artificial Sequence
  DnaJ homolog subfamily B member 4 (38-48)
ggcaccgacgggcagggagguacauucagauac

SEQ ID NO: 52884 - RNA, 27 nt, Artificial Sequence
  Tyrosine-protein kinase Fyn (31-39)
ggcaccgaccccacaccucagcacuac

SEQ ID NO: 52885 - RNA, 27 nt, Artificial Sequence
  Activating signal cointegrator 1 (235-243)
ggcacccugaaccagccccucacaaag

SEQ ID NO: 52886 - RNA, 27 nt, Artificial Sequence
  Putative mitochondrial import inner membrane translocase subunit Tim23B (113-121)
ggcaccaugacagggaugcuguacaag

SEQ ID NO: 52887 - RNA, 30 nt, Artificial Sequence
  Peroxisomal acyl-coenzyme A oxidase 1 (263-272)
ggcaccuacgugaagccccugagcaacaaa

SEQ ID NO: 52888 - RNA, 27 nt, Artificial Sequence
  HLA class II histocompatibility antigen, DO alpha chain (37-45)
ggcaccuacgugagcuccguccccaga

SEQ ID NO: 52889 - RNA, 27 nt, Artificial Sequence
  Poly (ADP-ribose) polymerase 14 (924-932)
ggcguguucggguuuccccugggaaga

SEQ ID NO: 52890 - RNA, 30 nt, Artificial Sequence
  Cytosolic non-specific dipeptidase (106-115)
ggcguguacgggggaagcguccacgaggcc

SEQ ID NO: 52891 - RNA, 30 nt, Artificial Sequence
  Mediator of RNA polymerase II transcription subunit 18 (127-136)
cacgaguucguggccaagggccaucuguuu

SEQ ID NO: 52892 - RNA, 30 nt, Artificial Sequence
  60S ribosomal protein L7 (192-201)
cacgagaucuacaccgugggcaagagauuc

SEQ ID NO: 52893 - RNA, 27 nt, Artificial Sequence
  Coatomer subunit alpha (103-111)
cacgaguaccccuggauccugagcgcc

SEQ ID NO: 52894 - RNA, 30 nt, Artificial Sequence
  Zinc finger protein 548 (24-33)
caccuggacgaggcccagagacuccuuuac

SEQ ID NO: 52895 - RNA, 27 nt, Artificial Sequence
  Protein FAM32A (95-103)
caccuggacacccucacagagcauuac

SEQ ID NO: 52896 - RNA, 27 nt, Artificial Sequence
  Heat shock protein HSP 90-alpha A2 (189-197)
caccugaaggaggaccagaccgaauac

SEQ ID NO: 52897 - RNA, 27 nt, Artificial Sequence
  Myc-associated zinc finger protein (411-419)
caccugaacagccaugugagacagguc

SEQ ID NO: 52898 - RNA, 27 nt, Artificial Sequence
  Heterogeneous nuclear ribonucleoproteins A2/B1 (127-135)
caccugagagacuacuucgaggaauau

SEQ ID NO: 52899 - RNA, 27 nt, Artificial Sequence
  V-type proton ATPase 116 kDa subunit a isoform 4 (722-730)
caccaggccauccauaccauugaguac

SEQ ID NO: 52900 - RNA, 27 nt, Artificial Sequence
  Elongation of very long chain fatty acids protein 5 (137-145)
caccagaucaccgugcugcaugucuac

SEQ ID NO: 52901 - RNA, 27 nt, Artificial Sequence
  Zinc finger protein 770 (99-107)
caccagcaacugcauaacgagaccuac

SEQ ID NO: 52902 - RNA, 27 nt, Artificial Sequence
  Protein SSXT (207-215)
caccagcaacccccuagccagcaguac

SEQ ID NO: 52903 - RNA, 27 nt, Artificial Sequence
  Zinc finger and BTB domain-containing protein 43 (140-148)
caccagagccccuccucuucaaguuac

SEQ ID NO: 52904 - RNA, 27 nt, Artificial Sequence
  Signal transducing adapter molecule 2 (410-418)
caccaggugaccgucgcccaaagcuac

SEQ ID NO: 52905 - RNA, 27 nt, Artificial Sequence
  Cirhin (556-564)
cacagcgaccagcaaguguucgaguac

SEQ ID NO: 52906 - RNA, 30 nt, Artificial Sequence
  Catenin beta-1 (645-654)
cacagcagaaacgagggcguggccaccuac

SEQ ID NO: 52907 - RNA, 30 nt, Artificial Sequence
  U3 small nucleolar RNA-associated protein 6 homolog (267-276)
cacaccgacgauccccugacaugggacuac

SEQ ID NO: 52908 - RNA, 27 nt, Artificial Sequence
  DTW domain-containing protein 1 (175-183)
cacaccgacauccugaaggagaaauac

SEQ ID NO: 52909 - RNA, 30 nt, Artificial Sequence
  Bone morphogenetic protein receptor type-2 (316-325)
cacaccgagcugcccagaggcgaccauuac

SEQ ID NO: 52910 - RNA, 27 nt, Artificial Sequence
  Dedicator of cytokinesis protein 7 (913-921)
aucgccagcgacauuguguccagauuc

SEQ ID NO: 52911 - RNA, 27 nt, Artificial Sequence
  Filamin-A (898-906)
aucauugaccaccaugauaacaccuac

SEQ ID NO: 52912 - RNA, 27 nt, Artificial Sequence
  SUMO-activating enzyme subunit 1 (309-317)
auccuggcccaggagauugugaaggcu

SEQ ID NO: 52913 - RNA, 30 nt, Artificial Sequence
  Superkiller viralicidic activity 2-like 2 (470-479)
auccuguucagcgagggccucauuaaggcc

SEQ ID NO: 52914 - RNA, 27 nt, Artificial Sequence
  60S ribosomal protein L15 (133-141)
auccugauugaccccuuccacaaggcc

SEQ ID NO: 52915 - RNA, 27 nt, Artificial Sequence
  Transcription elongation factor SPT6 (1267-1275)
aucaugaagauugacauagagaaauuc

SEQ ID NO: 52916 - RNA, 27 nt, Artificial Sequence
  X-ray repair cross-complementing protein 5 (528-536)
aucccccugagcaagauuaaaacccuc

SEQ ID NO: 52917 - RNA, 27 nt, Artificial Sequence
  Eukaryotic translation initiation factor 3 subunit C (783-791)
auccaggaggaaagccugagaaccuac

SEQ ID NO: 52918 - RNA, 27 nt, Artificial Sequence
  60S ribosomal protein L18a (95-103)
auccagauuaugaagguggaggaaaua

SEQ ID NO: 52919 - RNA, 27 nt, Artificial Sequence
  Catalase (398-406)
auccagaagaaagccgugaagaacuuc

SEQ ID NO: 52920 - RNA, 27 nt, Artificial Sequence
  Tuftelin-interacting protein 11 (336-344)
auccagaacgacagacaacugcaguac

SEQ ID NO: 52921 - RNA, 27 nt, Artificial Sequence
  Hepatoma-derived growth factor-related protein 2 (84-92)
auccagaacaauccccacgccagcuac

SEQ ID NO: 52922 - RNA, 27 nt, Artificial Sequence
  Putative annexin A2-like protein (319-327)
auccagcaagacaccaagggcgauuac

SEQ ID NO: 52923 - RNA, 27 nt, Artificial Sequence
  Interferon-induced GTP-binding protein Mx1 (206-214)
auccagagacaagagaccauuagccug

SEQ ID NO: 52924 - RNA, 27 nt, Artificial Sequence
  Protein transport protein Sec16A (1602-1610)
auccagagaaccgaggccuacgaauau

SEQ ID NO: 52925 - RNA, 27 nt, Artificial Sequence
  Transcription elongation factor SPT5 (984-992)
auccaggugaaggucagagacaccuac

SEQ ID NO: 52926 - RNA, 33 nt, Artificial Sequence
  Splicing factor 3B subunit 4 (6-16)
aucagcgagagaaaccaggacgccaccguguac

SEQ ID NO: 52927 - RNA, 27 nt, Artificial Sequence
  40S ribosomal protein S16 (87-95)
aucagcaaggcccugguggcuuacuau

SEQ ID NO: 52928 - RNA, 27 nt, Artificial Sequence
  Serine/threonine-protein kinase 17B (51-59)
aucagcaaguccaccggccaggaguac

SEQ ID NO: 52929 - RNA, 27 nt, Artificial Sequence
  Pre-mRNA-splicing factor CWC22 homolog (146-154)
aucaccgacaagaacagccuggccuac

SEQ ID NO: 52930 - RNA, 30 nt, Artificial Sequence
  Serine/threonine-protein kinase mTOR (664-673)
aucaccgaccccgauccugacauuagauac

SEQ ID NO: 52931 - RNA, 30 nt, Artificial Sequence
  AAC42003.1 (85-94)
aucaccgacagcgccggccacauucuguac

SEQ ID NO: 52932 - RNA, 27 nt, Artificial Sequence
  E3 ubiquitin-protein ligase RNF213 (4163-4171)
aucaccgaggacaagacagaacuguac

SEQ ID NO: 52933 - RNA, 27 nt, Artificial Sequence
  RNA polymerase I-specific transcription initiation factor RRN3 (516-524)
aucaccaacaaguaccagcugguguuc

SEQ ID NO: 52934 - RNA, 27 nt, Artificial Sequence
  Nuclear receptor corepressor 2 (1441-1449)
aucacccagggcacaccccugaaguac

SEQ ID NO: 52935 - RNA, 33 nt, Artificial Sequence
  HLA class II histocompatibility antigen, DQ alpha 1 chain (3-13)
aucguggccgaccacgucgcuagcuacggcguu

SEQ ID NO: 52936 - RNA, 27 nt, Artificial Sequence
  Putative eukaryotic translation initiation factor 2 subunit 3-like protein (59-67)
aaggccaucagcggcgugcacaccguc

SEQ ID NO: 52937 - RNA, 27 nt, Artificial Sequence
  Nuclear pore membraneoprotein 210 (219-227)
aaggccagaauccaggaggcuguguac

SEQ ID NO: 52938 - RNA, 27 nt, Artificial Sequence
  Heat shock protein HSP 90-beta (452-460)
aaggaguucgacggcaaaagccuggug

SEQ ID NO: 52939 - RNA, 27 nt, Artificial Sequence
  NADH dehydrogenase (ubiquinone) 1 beta subcomplex subunit 10 (121-129)
aaggagguggaacaguucacccaaguc

SEQ ID NO: 52940 - RNA, 27 nt, Artificial Sequence
  Lysine-specific histone demethylase 1A (454-462)
aagaucaaagagcugcaccagcaauac

SEQ ID NO: 52941 - RNA, 27 nt, Artificial Sequence
  Thioredoxin-interacting protein (6-14)
aagaucaaaagcuucgagguggucuuu

SEQ ID NO: 52942 - RNA, 27 nt, Artificial Sequence
  60S ribosomal protein L27 (67-75)
aagaucaaaagcuucgugaaggucuac

SEQ ID NO: 52943 - RNA, 27 nt, Artificial Sequence
  60S ribosomal protein L5 (117-125)
aagaucuacgagggccagguggaaguc

SEQ ID NO: 52944 - RNA, 30 nt, Artificial Sequence
  Putative elongation factor 1-alpha-like 3 (386-395)
aagcuggaggacggccccaaauuccucaag

SEQ ID NO: 52945 - RNA, 30 nt, Artificial Sequence
  Long-chain-fatty-acid-CoA ligase 4 (40-49)
aagcuguucgaccacgccgugagcaaauuu

SEQ ID NO: 52946 - RNA, 27 nt, Artificial Sequence
  Signal recognition particle receptor subunit alpha (81-89)
aagcugaucgacgaugugcacagacuc

SEQ ID NO: 52947 - RNA, 33 nt, Artificial Sequence
  Embryonic stem cell-specific 5-hydroxymethylcytosine-binding protein (239-249)
aagcugauccaccccaccgagaacauuacauuc

SEQ ID NO: 52948 - RNA, 27 nt, Artificial Sequence
  Dolichyl-diphosphooligosaccharide-proteinosyltransferase subunit DAD1 (25-33)
aagcugcucgacgccuaccuucuguau

SEQ ID NO: 52949 - RNA, 30 nt, Artificial Sequence
  DNA-directed RNA polymerases I, II, and III subunit RPABC5 (58-67)
aagcugcucaacuacgccccccuugagaaa

SEQ ID NO: 52950 - RNA, 27 nt, Artificial Sequence
  Dystonin (4751-4759)
aagcugagcgaccucgauaacaaacuu

SEQ ID NO: 52951 - RNA, 30 nt, Artificial Sequence
  60S ribosomal protein L23a (115-124)
aagcuguacgacaucgauguggccaaaguc

SEQ ID NO: 52952 - RNA, 30 nt, Artificial Sequence
  ATP-citrate synthase (650-659)
aagcuguacagacccggcagcguggccuau

SEQ ID NO: 52953 - RNA, 27 nt, Artificial Sequence
  Protein quaking (81-89)
aagcuguacgugcccgucaaagaguau

SEQ ID NO: 52954 - RNA, 27 nt, Artificial Sequence
  Homocysteine-responsive endoplasmic reticulum-resident ubiquitin-like domain member 1 protein (92-100)
aagaugcccgagaucaacgccaaagug

SEQ ID NO: 52955 - RNA, 27 nt, Artificial Sequence
  Transducin-like enhancer protein 2 (76-84)
aagcaggccgagaucgugaaaagacug

SEQ ID NO: 52956 - RNA, 27 nt, Artificial Sequence
  Gamma-interferon-inducible protein 16 (309-317)
aagcaggccagcggcaacaucguguac

SEQ ID NO: 52957 - RNA, 30 nt, Artificial Sequence
  Cytoplasmic dynein 1 heavy chain 1 (1181-1190)
aagcaguucgagaaacaaguggaacuguac

SEQ ID NO: 52958 - RNA, 30 nt, Artificial Sequence
  Staphylococcal nuclease domain-containing protein 1 (869-878)
aagcaguuccaaaaagugaucaccgaguac

SEQ ID NO: 52959 - RNA, 30 nt, Artificial Sequence
  Cytoplasmic dynein 1 heavy chain 1 (652-661)
aagcagaucgacagacaacugaccgccuac

SEQ ID NO: 52960 - RNA, 27 nt, Artificial Sequence
  Thioredoxin (3-11)
aagcagaucgagagcaaaaccgccuuc

SEQ ID NO: 52961 - RNA, 27 nt, Artificial Sequence
  Ribonucleoside-diphosphate reductase large subunit (529-537)
aagcagaucuucgagaccauuuacuau

SEQ ID NO: 52962 - RNA, 27 nt, Artificial Sequence
  ADP/ATP translocase 2 (43-51)
aagcagaucaccgccgacaaacaauac

SEQ ID NO: 52963 - RNA, 30 nt, Artificial Sequence
  Lamin-B receptor (234-243)
aagcagaaagaccccagccugcucaacuuc

SEQ ID NO: 52964 - RNA, 30 nt, Artificial Sequence
  Asparagine synthetase (glutamine-hydrolyzing) (272-281)
aagcagcugaaagaggcccaagugcaguac

SEQ ID NO: 52965 - RNA, 33 nt, Artificial Sequence
  Heterogeneous nuclear ribonucleoprotein L (455-465)
aagcagcccgccaucaugccuggccaaagcuac

SEQ ID NO: 52966 - RNA, 30 nt, Artificial Sequence
  Caprin-1 (536-545)
aagcagcaaaaccaguaccaggccagcuau

SEQ ID NO: 52967 - RNA, 27 nt, Artificial Sequence
  DNA-dependent protein kinase catalytic subunit (2970-2978)
aagcaguacgacgaggcccugaacaaa

SEQ ID NO: 52968 - RNA, 30 nt, Artificial Sequence
  Alpha-actinin-4 (691-700)
aagcaguacgagagaagcaucguggacuau

SEQ ID NO: 52969 - RNA, 27 nt, Artificial Sequence
  RAC-beta serine/threonine-protein kinase (30-38)
aagagcgacggcuccuucaucggguac

SEQ ID NO: 52970 - RNA, 27 nt, Artificial Sequence
  Replication factor C subunit 1 (870-878)
aagagcgaccuguucuuucacgauuac

SEQ ID NO: 52971 - RNA, 30 nt, Artificial Sequence
  Pre-mRNA-processing factor 40 homolog A (164-173)
aagagcgacuccggcaaacccuacuauuac

SEQ ID NO: 52972 - RNA, 27 nt, Artificial Sequence
  Helicase-like transcription factor (499-507)
aagagcgacgugcaccugaacuucuac

SEQ ID NO: 52973 - RNA, 27 nt, Artificial Sequence
  Pre-mRNA-splicing factor RBM22 (109-117)
aagagcgacgugaacaaagaguacuau

SEQ ID NO: 52974 - RNA, 27 nt, Artificial Sequence
  Kinesin-like protein KIF18A (241-249)
aagaccgccagcaucaaccagaaugug

SEQ ID NO: 52975 - RNA, 30 nt, Artificial Sequence
  Vacuolar protein sorting-associated protein 13A (1399-1408)
aagaccgacgaucugacaauggugcucuac

SEQ ID NO: 52976 - RNA, 27 nt, Artificial Sequence
  Chromodomain-helicase-DNA-binding protein 8 (165-173)
aagaccgacgagagccugacaaaauac

SEQ ID NO: 52977 - RNA, 27 nt, Artificial Sequence
  Raftlin (114-122)
aagaccgaccugcacaacgagggcuac

SEQ ID NO: 52978 - RNA, 27 nt, Artificial Sequence
  Coiled-coil domain-containing protein 94 (90-98)
aagaccgaccccgagaacacagauuac

SEQ ID NO: 52979 - RNA, 33 nt, Artificial Sequence
  Signal-induced proliferation-associated 1-like protein 2 (436-446)
aagaccgacagcacaggcacucacucccuguac

SEQ ID NO: 52980 - RNA, 33 nt, Artificial Sequence
  Pre-mRNA-processing-splicing factor 8 (341-351)
aagaccgaggaccccgaucugccugccuucuac

SEQ ID NO: 52981 - RNA, 33 nt, Artificial Sequence
  Serine/arginine-rich splicing factor 3 (23-33)
aagaccgagcuggaaagagccuucggcuacuau

SEQ ID NO: 52982 - RNA, 30 nt, Artificial Sequence
  T-complex protein 1 subunit zeta-2 (196-205)
aagaccgaggugaacagcggcuucuuuuac

SEQ ID NO: 52983 - RNA, 27 nt, Artificial Sequence
  Periphilin-1 (297-305)
aagaccaaagagaucgaacagguguac

SEQ ID NO: 52984 - RNA, 30 nt, Artificial Sequence
  Metastasis-associated protein MTA2 (311-320)
aagaccacagacagauacauccagcaaaaa

SEQ ID NO: 52985 - RNA, 27 nt, Artificial Sequence
  Spatacsin (1273-1281)
aagguggccaacaucauucugagcuac

SEQ ID NO: 52986 - RNA, 27 nt, Artificial Sequence
  Heterogeneous nuclear ribonucleoprotein A/B (227-235)
aagguggcccagcccaaagaggucuac

SEQ ID NO: 52987 - RNA, 27 nt, Artificial Sequence
  Protein RRP5 homolog (1680-1688)
aagguguucgagagagccguccaguac

SEQ ID NO: 52988 - RNA, 27 nt, Artificial Sequence
  60 kDa heat shock protein, mitochondrial (344-352)
aaggugggcgaggucaucguuaccaaa

SEQ ID NO: 52989 - RNA, 27 nt, Artificial Sequence
  Protein transport protein Sec61 subunit beta (67-75)
aaggugggccccgucccuguucuggug

SEQ ID NO: 52990 - RNA, 27 nt, Artificial Sequence
  40S ribosomal protein S19 (29-37)
aaggugcccgagugggucgacaccguu

SEQ ID NO: 52991 - RNA, 27 nt, Artificial Sequence
  Protein DEK (315-323)
aagguguacgagaacuaucccaccuac

SEQ ID NO: 52992 - RNA, 27 nt, Artificial Sequence
  Cyclin-dependent kinases regulatory subunit 2 (11-19)
aaguacuucgacgagcacuaugaauac

SEQ ID NO: 52993 - RNA, 27 nt, Artificial Sequence
  Protein disulfide-isomerase A3 (16-24)
cuggccgcugcaagacucgccgcggcu

SEQ ID NO: 52994 - RNA, 27 nt, Artificial Sequence
  Heterogeneous nuclear ribonucleoprotein R (193-201)
cuggaguacgaagaccacaagagcgcc

SEQ ID NO: 52995 - RNA, 27 nt, Artificial Sequence
  Lamina-associated polypeptide 2, isoform alpha (313-321)
cugaucaaggagaccacaacuggcuac

SEQ ID NO: 52996 - RNA, 27 nt, Artificial Sequence
  60S ribosomal protein L28 (17-25)
cugaucaagagaaacaaacagaccuac

SEQ ID NO: 52997 - RNA, 27 nt, Artificial Sequence
  ATP synthase F(0) complex subunit C1, mitochondrial (21-29)
cugaucagacccgugagcgccuccuuc

SEQ ID NO: 52998 - RNA, 27 nt, Artificial Sequence
  Cytospin-A (469-477)
cugcucgacgagcaccauaucagcuac

SEQ ID NO: 52999 - RNA, 30 nt, Artificial Sequence
  Zinc finger protein 557 (59-68)
cugcucgaccccgcccagagaacccuuuac

SEQ ID NO: 53000 - RNA, 30 nt, Artificial Sequence
  Clathrin heavy chain 1 (421-430)
cugcucgaccagggccaacuuaacaaguac

SEQ ID NO: 53001 - RNA, 30 nt, Artificial Sequence
  Zinc finger protein 669 (106-115)
cugcucgacagcucccagaagaaccuuuac

SEQ ID NO: 53002 - RNA, 30 nt, Artificial Sequence; identical to SEQ ID NO: 28775
  WD repeat-containing protein 6 (358-367)

SEQ ID NO: 53003 - RNA, 27 nt, Artificial Sequence
  Signal transducer and activator of transcription 6 (56-64)
cugcucagcgacaccgugcagcaccuu

SEQ ID NO: 53004 - RNA, 27 nt, Artificial Sequence
  Antigen peptide transporter 1 (684-692)
cugcucuacgagagccccgaaagauau

SEQ ID NO: 53005 - RNA, 27 nt, Artificial Sequence
  Retinoic acid receptor RXR-gamma (423-431)
cugcccgcccucagaagcaucggccuu

SEQ ID NO: 53006 - RNA, 27 nt, Artificial Sequence
  Eukaryotic translation initiation factor 2-alpha kinase 1 (221-229)
cugcagcaccccaacaucgugggcuac

SEQ ID NO: 53007 - RNA, 27 nt, Artificial Sequence
  CDK5 regulatory subunit-associated protein 2 (355-363)
cugcagaaggcccaaacccaggaguuc

SEQ ID NO: 53008 - RNA, 27 nt, Artificial Sequence
  Trifunctional purine biosynthetic protein adenosine-3 (429-437)
cugcagcaacccagaagccucaccuac

SEQ ID NO: 53009 - RNA, 27 nt, Artificial Sequence
  Farnesyl pyrophosphate synthase (341-349)
cugcagagagccacccccgagcaauac

SEQ ID NO: 53010 - RNA, 27 nt, Artificial Sequence
  R3H domain-containing protein 4 (70-78)
cugcagagacucgagaacacccaauac

SEQ ID NO: 53011 - RNA, 27 nt, Artificial Sequence
  WD repeat-containing protein 27 (15-23)
cugagcgacaucgugauugagaaguac

SEQ ID NO: 53012 - RNA, 27 nt, Artificial Sequence
  UAP56-interacting factor (99-107)
cugagcgacaagaacaucgagcaguac

SEQ ID NO: 53013 - RNA, 27 nt, Artificial Sequence
  Histone acetyltransferase KAT8 (325-333)
cugagcgaccucggcaagcuuuccuac

SEQ ID NO: 53014 - RNA, 30 nt, Artificial Sequence
  Probable tRNA N6-adenosine threonylcarbamoyltransferase (315-324)
cugagcgacuccggcgugacccagagauac

SEQ ID NO: 53015 - RNA, 30 nt, Artificial Sequence
  Deoxynucleotidyltransferase terminal-interacting protein 2 (252-261)
cugagcgagaucaacaagcccaauuucuac

SEQ ID NO: 53016 - RNA, 33 nt, Artificial Sequence
  Serpin B8 (74-84)
cugagcgaggugaacagaaccggcacacaguac

SEQ ID NO: 53017 - RNA, 27 nt, Artificial Sequence
  ATP synthase subunit alpha, mitochondrial (160-168)
cugaccgacgccgaugcuaugaaguac

SEQ ID NO: 53018 - RNA, 27 nt, Artificial Sequence
  1,4-alpha-glucan-branching enzyme (569-577)
cugaccgacgaugaccuccuuagauac

SEQ ID NO: 53019 - RNA, 30 nt, Artificial Sequence
  26S proteasome non-ATPase regulatory subunit 2 (391-400)
cugaccgacgauggcaacaaguggcucuac

SEQ ID NO: 53020 - RNA, 27 nt, Artificial Sequence
  Phosphatidylinositol 4,5-bisphosphate 3-kinase catalytic subunit alpha isoform (623-631)
cugaccgacgauaagcucagccaguac

SEQ ID NO: 53021 - RNA, 27 nt, Artificial Sequence
  Probable threonine-tRNA ligase 2, cytoplasmic (435-443)
cugaccgacuucaucagagaggaauac

SEQ ID NO: 53022 - RNA, 30 nt, Artificial Sequence
  Coiled-coil domain-containing protein 127 (209-218)
cugaccgacaucuuccagcacgauacauac

SEQ ID NO: 53023 - RNA, 30 nt, Artificial Sequence
  Elongation factor 2 (162-171)
cugaccgacaucacaaagggcgugcaguac

SEQ ID NO: 53024 - RNA, 30 nt, Artificial Sequence
  Tuberin (146-155)
cugaccgacaacggcagacacaucacauac

SEQ ID NO: 53025 - RNA, 27 nt, Artificial Sequence
  Glucosylceramidase (252-260)
cugaccgaccccgaggccgcuaaguac

SEQ ID NO: 53026 - RNA, 30 nt, Artificial Sequence
  ATPase family AAA domain-containing protein 5 (1663-1672)
cugaccgacgugagagagcagaacaaguac

SEQ ID NO: 53027 - RNA, 27 nt, Artificial Sequence
  Casein kinase II subunit alpha (128-136)
cugaccgacuacgauaucagauucuau

SEQ ID NO: 53028 - RNA, 30 nt, Artificial Sequence
  Gamma-tubulin complex component 2 (88-97)
cugaccgaggacaaggaaacacuccaguac

SEQ ID NO: 53029 - RNA, 27 nt, Artificial Sequence
  Integrator complex subunit 11 (242-250)
cugaccgagaaggccaaccacuacuau

SEQ ID NO: 53030 - RNA, 27 nt, Artificial Sequence
  Pogo transposable element with KRAB domain (64-72)
cugaccgagcagcaaaaggcccucuac

SEQ ID NO: 53031 - RNA, 30 nt, Artificial Sequence
  Nuclear factor erythroid 2-related factor 2 (197-206)
cugaccgagguggacaacuaccacuucuau

SEQ ID NO: 53032 - RNA, 33 nt, Artificial Sequence
  Serpin B9 (74-84)
cugaccgaggugaacaaggccggcacacaguac

SEQ ID NO: 53033 - RNA, 27 nt, Artificial Sequence
  Folliculin-interacting protein 2 (997-1005)
cugguggccgaccucguccacaccguu

SEQ ID NO: 53034 - RNA, 27 nt, Artificial Sequence
  Pogo transposable element with KRAB domain (261-269)
cugguggaccagagagucgccgaguac

SEQ ID NO: 53035 - RNA, 30 nt, Artificial Sequence
  Exportin-5 (20-29)
augauggaccccaacagcacccagagauac

SEQ ID NO: 53036 - RNA, 30 nt, Artificial Sequence
  Protein transport protein Sec61 subunit gamma (5-14)
augcaguucguggagcccagcagacaauuu

SEQ ID NO: 53037 - RNA, 27 nt, Artificial Sequence
  Catenin beta-1 (662-670)
augagcgaggacaagccccaggauuac

SEQ ID NO: 53038 - RNA, 27 nt, Artificial Sequence
  Brefeldin A-inhibited guanine nucleotide-exchange protein 1 (574-582)
aacgccgcuaauaucuucgagagacug

SEQ ID NO: 53039 - RNA, 33 nt, Artificial Sequence
  Charged multivesicular body protein 5 (63-73)
aacgagauccaggaagcccugagcagauccuac

SEQ ID NO: 53040 - RNA, 27 nt, Artificial Sequence
  Clathrin heavy chain 1 (935-943)
aacgagaauagccuguucaagucccuc

SEQ ID NO: 53041 - RNA, 27 nt, Artificial Sequence
  Calpain small subunit 1 (93-101)
aacgagagcgaagaggugagacaguuc

SEQ ID NO: 53042 - RNA, 27 nt, Artificial Sequence
  PR domain zinc finger protein 15 (791-799)
aacgagguggacggcgaauacagauau

SEQ ID NO: 53043 - RNA, 33 nt, Artificial Sequence
  Nucleolar pre-ribosomal-associated protein 1 (127-137)
aacgagguggaccccggcgauuggcagaaguuc

SEQ ID NO: 53044 - RNA, 27 nt, Artificial Sequence
  DnaJ homolog subfamily C member 11 (261-269)
aaccuggacaagaauaccgugggcuac

SEQ ID NO: 53045 - RNA, 27 nt, Artificial Sequence
  Ubiquitin-conjugating enzyme E2 variant 3 (190-198)
aaccuggacagccagagacuccaauac

SEQ ID NO: 53046 - RNA, 27 nt, Artificial Sequence
  Clathrin heavy chain 1 (74-82)
aaccccgccagcaaggugaucgcucug

SEQ ID NO: 53047 - RNA, 27 nt, Artificial Sequence
  Spermatid perinuclear RNA-binding protein (397-405)
aaccagaucagacccggccugcaauac

SEQ ID NO: 53048 - RNA, 27 nt, Artificial Sequence
  Dystonin (3331-3339)
aaccagaagcccccuagcgccgaguuc

SEQ ID NO: 53049 - RNA, 27 nt, Artificial Sequence
  Microtubule-actin cross-linking factor 1, isoforms 1/2/3/5 (5369-5377)
aaccagaagcccccuagcgccgaguac

SEQ ID NO: 53050 - RNA, 27 nt, Artificial Sequence
  Cytosolic carboxypeptidase 1 (749-757)
aacagcgacaucaauuccaaccacuac

SEQ ID NO: 53051 - RNA, 30 nt, Artificial Sequence
  DNA repair protein RAD51 homolog 1 (99-108)
aacaccgaccaccagacacaacugcucuac

SEQ ID NO: 53052 - RNA, 27 nt, Artificial Sequence
  Eukaryotic translation initiation factor 3 subunit C-like protein (462-470)
aacaccgacccccacagccaggaguac

SEQ ID NO: 53053 - RNA, 30 nt, Artificial Sequence
  Methionine aminopeptidase 1 (74-83)
aacaccgaccccugggccggcuacagauau

SEQ ID NO: 53054 - RNA, 27 nt, Artificial Sequence
  Tyrosine-protein phosphatase non-receptor type 11 (414-422)
aacaccgagagaacaguguggcaguac

SEQ ID NO: 53055 - RNA, 27 nt, Artificial Sequence
  Protein UXT (66-74)
aacgugaucgagagacugcaggaagcc

SEQ ID NO: 53056 - RNA, 27 nt, Artificial Sequence
  Nardilysin (107-115)
cccagcgacccuaagcaguacagauau

SEQ ID NO: 53057 - RNA, 33 nt, Artificial Sequence
  Mediator of RNA polymerase II transcription subunit 13 (1456-1466)
cccaccgacggcgauagccacgccgugacauac

SEQ ID NO: 53058 - RNA, 27 nt, Artificial Sequence
  Absent in melanoma 1 protein (1215-1223)
cccaccgacccuaagguggucguuuac

SEQ ID NO: 53059 - RNA, 33 nt, Artificial Sequence
  Ubiquitin carboxyl-terminal hydrolase 22 (453-463)
cccaccgacagccugaacaaugauaacaaguac

SEQ ID NO: 53060 - RNA, 33 nt, Artificial Sequence
  ADP-sugar pyrophosphatase (6-16)
cccaccgagagcucccagaacggcaagcaauac

SEQ ID NO: 53061 - RNA, 27 nt, Artificial Sequence
  Vimentin (311-319)
caggccaagcaagagagcaccgaauac

SEQ ID NO: 53062 - RNA, 33 nt, Artificial Sequence
  Nuclear autoantigenic sperm protein (67-77)
caggaggccgcuagccugcucggcaagaaauac

SEQ ID NO: 53063 - RNA, 27 nt, Artificial Sequence
  Ras GTPase-activating protein-binding protein 1 (243-251)
caggaggaccugagaaccuucagcugg

SEQ ID NO: 53064 - RNA, 30 nt, Artificial Sequence
  Nuclear pore complex protein Nup155 (718-727)
caggaguuccuggacagaaacagccaauuu

SEQ ID NO: 53065 - RNA, 27 nt, Artificial Sequence
  Cytosolic non-specific dipeptidase (28-36)
caggagauccccgugaacgucagauuc

SEQ ID NO: 53066 - RNA, 27 nt, Artificial Sequence
  Putative ATP-dependent RNA helicase DDX11-like protein 8 (240-248)
cagcuggcccaauucgugcacgagguc

SEQ ID NO: 53067 - RNA, 30 nt, Artificial Sequence
  Zinc finger protein 550 (19-28)
cagcuggaccucgcccaaagaacccuuuac

SEQ ID NO: 53068 - RNA, 30 nt, Artificial Sequence
  Zinc finger protein 674 (24-33)
cagcuggacagcgcccaaaagaaccucuac

SEQ ID NO: 53069 - RNA, 27 nt, Artificial Sequence
  Proteasome activator complex subunit 3 (33-41)
cagcugguggacaucauugagaagguc

SEQ ID NO: 53070 - RNA, 27 nt, Artificial Sequence
  Nucleoporin NUP188 homolog (1544-1552)
cagcaagcccugcacaccgugcaguac

SEQ ID NO: 53071 - RNA, 27 nt, Artificial Sequence
  Homocysteine-responsive endoplasmic reticulum-resident ubiquitin-like domain member 1 protein (174-182)
cagcaaaucuacgccagacaguauuac

SEQ ID NO: 53072 - RNA, 27 nt, Artificial Sequence
  Signal recognition particle subunit SRP72 (107-115)
cagaccgacaagcugaaagagcucuac

SEQ ID NO: 53073 - RNA, 27 nt, Artificial Sequence
  Oxysterol-binding protein-related protein 8 (674-682)
cagaccgaggccacacaagaaaaguac

SEQ ID NO: 53074 - RNA, 27 nt, Artificial Sequence
  Probable cation-transporting ATPase 13A3 (131-139)
cagaccgagagccaacagaucagauac

SEQ ID NO: 53075 - RNA, 27 nt, Artificial Sequence
  Band 4.1-like protein 2 (42-50)
cagaccgagacaaagacuaucacguac

SEQ ID NO: 53076 - RNA, 27 nt, Artificial Sequence
  26S proteasome non-ATPase regulatory subunit 13 (164-172)
cagaccaucggcaaccacgccagcuac

SEQ ID NO: 53077 - RNA, 33 nt, Artificial Sequence
  60S ribosomal protein L28 (23-33)
cagaccuacagcacagagcccaacaaucugaag

SEQ ID NO: 53078 - RNA, 33 nt, Artificial Sequence
  Cytochrome b-c1 complex subunit 9 (34-44)
agagccuucgaccagggcgcugaugcaaucuac

SEQ ID NO: 53079 - RNA, 27 nt, Artificial Sequence
  Mitotic checkpoint protein BUB3 (186-194)
agagccuuccccaacaagcagggcuac

SEQ ID NO: 53080 - RNA, 30 nt, Artificial Sequence
  X-ray repair cross-complementing protein 5 (296-305)
agagccaacccccaggugggcgucgcuuuc

SEQ ID NO: 53081 - RNA, 33 nt, Artificial Sequence
  Exocyst complex component 4 (551-561)
agagaggccgaccuggauuucgcuaggcaguac

SEQ ID NO: 53082 - RNA, 30 nt, Artificial Sequence
  Signal peptidase complex subunit 2 (185-194)
agagaggccgaauucaccaagagcaucgcu

SEQ ID NO: 53083 - RNA, 27 nt, Artificial Sequence
  Patatin-like phospholipase domain-containing protein 2 (30-38)
agagagcacgcccccuuccugguggcu

SEQ ID NO: 53084 - RNA, 24 nt, Artificial Sequence
  Tubulin beta-4A chain (2-9)
agagagaucgugcaccugcaggcc

SEQ ID NO: 53085 - RNA, 27 nt, Artificial Sequence
  ATP-binding cassette sub-family F member 3 (425-433)
agagaguacgaagcccagcaacaguau

SEQ ID NO: 53086 - RNA, 27 nt, Artificial Sequence
  Pre-mRNA-splicing factor ATP-dependent RNA helicase DHX15 (399-407)
agaaucuucgagcccccuccaccgaag

SEQ ID NO: 53087 - RNA, 30 nt, Artificial Sequence
  Actin-related protein 2/3 complex subunit 2 (9-18)
agaaucauugaggaaacccuggcccucaag

SEQ ID NO: 53088 - RNA, 27 nt, Artificial Sequence
  Protein FAM60A (102-110)
agaaucaagagcaaccagauuuccaaa

SEQ ID NO: 53089 - RNA, 30 nt, Artificial Sequence
  Chromobox protein homolog 6 (91-100)
agaaucagcgacgugcacuucuccgucaag

SEQ ID NO: 53090 - RNA, 30 nt, Artificial Sequence
  Splicing factor 3B subunit 1 (276-285)
agaaucuacaacgacgauaagaauaccuau

SEQ ID NO: 53091 - RNA, 27 nt, Artificial Sequence
  FAS-associated factor 2 (75-83)
agaaucuacagcuauguggucuccagg

SEQ ID NO: 53092 - RNA, 27 nt, Artificial Sequence
  26S proteasome non-ATPase regulatory subunit 3 (107-115)
agacugaaccacuacgugcucuauaag

SEQ ID NO: 53093 - RNA, 33 nt, Artificial Sequence
  Cell division cycle protein 27 homolog (214-224)
agacugaaccucgagagcuccaauucuaaguac

SEQ ID NO: 53094 - RNA, 30 nt, Artificial Sequence
  Histone deacetylase 9 (670-679)
agacugcaggagaccggccuccuuaacaag

SEQ ID NO: 53095 - RNA, 33 nt, Artificial Sequence
  F-box only protein 5 (140-150)
agacuguacgaggacagcggcuauuccucuuuc

SEQ ID NO: 53096 - RNA, 30 nt, Artificial Sequence
  ATP-binding cassette sub-family D member 1 (172-181)
agacuguacuucagccagcaaaccuauuac

SEQ ID NO: 53097 - RNA, 30 nt, Artificial Sequence
  V-type proton ATPase subunit d 1 (169-178)
agacuguaccccgagggccucgcccagcuu

SEQ ID NO: 53098 - RNA, 27 nt, Artificial Sequence
  Vimentin (13-21)
agaauguucggcgggcccggaaccgcc

SEQ ID NO: 53099 - RNA, 33 nt, Artificial Sequence
  Enhancer of rudimentary homolog (42-52)
agaaugaaccccaauagcccuuccaucaccuac

SEQ ID NO: 53100 - RNA, 30 nt, Artificial Sequence
  ATP synthase subunit epsilon-like protein, mitochondrial (6-15)
agacaggccggccugagcuacaucagguau

SEQ ID NO: 53101 - RNA, 27 nt, Artificial Sequence
  Polyadenylate-binding protein 1 (374-382)
agacaggcccaccugaccaaccaauac

SEQ ID NO: 53102 - RNA, 30 nt, Artificial Sequence
  Vimentin (310-319)
agacaggccaagcaagagagcaccgaauac

SEQ ID NO: 53103 - RNA, 27 nt, Artificial Sequence
  Caprin-1 (297-305)
agacaguucauggccgagacccaauuu

SEQ ID NO: 53104 - RNA, 30 nt, Artificial Sequence
  Splicing factor 3B subunit 1 (517-526)
agacagaucaccgacaaggccagggaguuc

SEQ ID NO: 53105 - RNA, 27 nt, Artificial Sequence
  Protein OS-9 (639-647)
agacagaaggagcuggaaagcaacuac

SEQ ID NO: 53106 - RNA, 30 nt, Artificial Sequence
  Interferon-induced, double-stranded RNA-activated protein kinase (18-27)
agacagaagcaaggcgugguccugaaauac

SEQ ID NO: 53107 - RNA, 30 nt, Artificial Sequence
  Alpha-taxilin (77-86)
agacagcuggaggacauccucagcaccuac

SEQ ID NO: 53108 - RNA, 33 nt, Artificial Sequence
  Prelamin-A/C (390-400)
agacagaacggcgacgauccccugcucaccuac

SEQ ID NO: 53109 - RNA, 33 nt, Artificial Sequence
  Spectrin beta chain, non-erythrocytic 1 (1161-1171)
agacagaaccugcucagccaaucccacgccuac

SEQ ID NO: 53110 - RNA, 30 nt, Artificial Sequence
  Tetratricopeptide repeat protein 9C (19-28)
agacagcccgacaacgccaaggcucuguac

SEQ ID NO: 53111 - RNA, 27 nt, Artificial Sequence
  Eukaryotic translation initiation factor 3 subunit C (905-913)
agacagcaacagagccagaccgccuac

SEQ ID NO: 53112 - RNA, 33 nt, Artificial Sequence
  ATP-dependent RNA helicase DDX3X (603-613)
agacagagcuccggcgccucuucaaguagcuuc

SEQ ID NO: 53113 - RNA, 27 nt, Artificial Sequence
  40S ribosomal protein S29 (44-52)
agacaguacgccaaggacaucggcuuc

SEQ ID NO: 53114 - RNA, 33 nt, Artificial Sequence
  Transmembrane emp24 domain-containing protein 4 (33-43)
agacaguacggcagcgaggggagguucaccuuu

SEQ ID NO: 53115 - RNA, 27 nt, Artificial Sequence
  Non-receptor tyrosine-protein kinase TYK2 (521-529)
agaagcuuccccuccgugagggagcug

SEQ ID NO: 53116 - RNA, 27 nt, Artificial Sequence
  E3 ubiquitin-protein ligase AMFR (229-237)
agaaccgcccacgugauccugagguac

SEQ ID NO: 53117 - RNA, 27 nt, Artificial Sequence
  Proteasome subunit alpha type-2 (113-121)
agaguggccagcgucaugcaggaguac

SEQ ID NO: 53118 - RNA, 30 nt, Artificial Sequence
  Calmodulin (91-100)
agaguguucgacaaggauggcaacggguac

SEQ ID NO: 53119 - RNA, 30 nt, Artificial Sequence
  Nucleolysin TIA-1 isoform p40 (244-253)
agaguguuccccgacaagggcuacagcuuu

SEQ ID NO: 53120 - RNA, 30 nt, Artificial Sequence
  Nucleolysin TIAR (213-222)
agaguguuccccgagaagggcuacagcuuu

SEQ ID NO: 53121 - RNA, 30 nt, Artificial Sequence
  Kinesin-like protein KIF20A (466-475)
agaguguuccagggcuuuuucaccgggagg

SEQ ID NO: 53122 - RNA, 33 nt, Artificial Sequence
  Fatty acid synthase (1694-1704)
agaguguucaccacagucggcagcgccgagaag

SEQ ID NO: 53123 - RNA, 33 nt, Artificial Sequence
  Non-specific lipid-transfer protein (13-23)
agaguguucgucguuggcguggggaugaccaag

SEQ ID NO: 53124 - RNA, 33 nt, Artificial Sequence
  26S protease regulatory subunit 7 (239-249)
agagugaucggcagcgagcugguccagaaguac

SEQ ID NO: 53125 - RNA, 30 nt, Artificial Sequence
  Ectonucleoside triphosphate diphosphohydrolase 1 (97-106)
agagugaagggccccgggaucagcaaauuc

SEQ ID NO: 53126 - RNA, 27 nt, Artificial Sequence
  FACT complex subunit SSRP1 (316-324)
agagugaugaaggcccuggucaacagg

SEQ ID NO: 53127 - RNA, 27 nt, Artificial Sequence
  DNA replication licensing factor MCM4 (387-395)
agagugaacgucaccggcaucuacagg

SEQ ID NO: 53128 - RNA, 27 nt, Artificial Sequence
  Double-stranded RNA-binding protein Staufen homolog 1 (457-465)
agagugcagggcuuccaagucgaguac

SEQ ID NO: 53129 - RNA, 27 nt, Artificial Sequence
  Serine/threonine-protein phosphatase 6 regulatory subunit 3 (45-53)
agagugagcgacaucaacuucacccug

SEQ ID NO: 53130 - RNA, 30 nt, Artificial Sequence
  SUMO-specific isopeptidase USPL1 (717-726)
agagugaccagccaggucuccaaccugaag

SEQ ID NO: 53131 - RNA, 27 nt, Artificial Sequence
  5'-nucleotidase domain-containing protein 1 (141-149)
agaguggucgacuaccugaccaagcuc

SEQ ID NO: 53132 - RNA, 27 nt, Artificial Sequence
  Serine/arginine-rich splicing factor 6 (3-11)
agaguguacaucggcaggcugagcuau

SEQ ID NO: 53133 - RNA, 27 nt, Artificial Sequence
  Serine/threonine-protein kinase SMG1 (36-44)
agcgccgaccccgauaaccugaaguac

SEQ ID NO: 53134 - RNA, 27 nt, Artificial Sequence
  Serine/threonine-protein kinase 17A (293-301)
agcgccguggacuucaucagaacccug

SEQ ID NO: 53135 - RNA, 30 nt, Artificial Sequence
  A-kinase anchor protein 2 (685-694)
agcgaggccgcugaacugagauccaccgca

SEQ ID NO: 53136 - RNA, 27 nt, Artificial Sequence
  Zinc finger protein Rlf (1399-1407)
agcgaggccggcuccgcugcaagauuc

SEQ ID NO: 53137 - RNA, 27 nt, Artificial Sequence
  Histone-lysine N-methyltransferase SETD2 (461-469)
agcgaggaagaguacaagaaaaccuau

SEQ ID NO: 53138 - RNA, 27 nt, Artificial Sequence
  U5 small nuclear ribonucleoprotein 200 kDa helicase (1010-1018)
agcgagaucgaacuguucagaguguuu

SEQ ID NO: 53139 - RNA, 30 nt, Artificial Sequence
  Nesprin-2 (320-329)
agcgagaacgacaccuacuucaagaaauau

SEQ ID NO: 53140 - RNA, 30 nt, Artificial Sequence
  Uncharacterized protein C14orf119 (121-130)
agcgagcccgacuucguggccaaguuuuac

SEQ ID NO: 53141 - RNA, 33 nt, Artificial Sequence
  Fructose-bisphosphate aldolase A (408-418)
agcgagucccuguucgugucuaaccacgccuac

SEQ ID NO: 53142 - RNA, 27 nt, Artificial Sequence
  Cyclin-G-associated kinase (305-313)
agcaucgccgaggugguccaccagcug

SEQ ID NO: 53143 - RNA, 27 nt, Artificial Sequence
  26S proteasome non-ATPase regulatory subunit 3 (418-426)
agccuggccgacaucgcucagaagcuc

SEQ ID NO: 53144 - RNA, 30 nt, Artificial Sequence
  Peroxisomal membrane protein 2 (66-75)
agccuggacgugggcgggccccucagauac

SEQ ID NO: 53145 - RNA, 27 nt, Artificial Sequence
  Nucleoporin GLE1 (288-296)
agccugaucuccggcauuauaagagcc

SEQ ID NO: 53146 - RNA, 27 nt, Artificial Sequence
  Nucleolar protein 7 (197-205)
agccuguacggccccgggaccaacaga

SEQ ID NO: 53147 - RNA, 27 nt, Artificial Sequence
  Nuclear pore complex protein Nup93 (787-795)
agccaggccagaacccugaucacauuc

SEQ ID NO: 53148 - RNA, 27 nt, Artificial Sequence
  60S ribosomal export protein NMD3 (228-236)
agccaggacauccacuccaacaccuac

SEQ ID NO: 53149 - RNA, 27 nt, Artificial Sequence
  14 kDa phosphohistidine phosphatase (83-91)
agccaggacaagaaaauccacguguac

SEQ ID NO: 53150 - RNA, 27 nt, Artificial Sequence
  MKI67 FHA domain-interacting nucleolar phosphoprotein (66-74)
agccaguucggcaccgugacaagauuu

SEQ ID NO: 53151 - RNA, 30 nt, Artificial Sequence
  Kinesin-associated protein 3 (208-217)
agccaguuccacggccugaucacccauuac

SEQ ID NO: 53152 - RNA, 27 nt, Artificial Sequence
  Heterogeneous nuclear ribonucleoprotein U (697-705)
agccagcacuaccaucaaggcuauuac

SEQ ID NO: 53153 - RNA, 33 nt, Artificial Sequence
  U4/U6 small nuclear ribonucleoprotein Prp4 (224-234)
agccagaucggcgacgauagacccauuuccuac

SEQ ID NO: 53154 - RNA, 27 nt, Artificial Sequence
  DCN1-like protein 1 (7-15)
agccagaaggacaaagugagacaauuc

SEQ ID NO: 53155 - RNA, 27 nt, Artificial Sequence
  General transcription factor 3C polypeptide 1 (1442-1450)
agccagaugaaguccuaccaaucuuuc

SEQ ID NO: 53156 - RNA, 27 nt, Artificial Sequence
  Transmembrane emp24 domain-containing protein 3 (196-204)
agccaggugcugcuccuuaaguccuuc

SEQ ID NO: 53157 - RNA, 27 nt, Artificial Sequence
  E3 ubiquitin-protein ligase MARCH7 (122-130)
agccaggugcccagauccucuucaaug

SEQ ID NO: 53158 - RNA, 27 nt, Artificial Sequence
  Midasin (130-138)
agcuccgacgccaaccccgugagauac

SEQ ID NO: 53159 - RNA, 27 nt, Artificial Sequence
  Arf-GAP with coiled-coil, ANK repeat and PH domain-containing protein 2 (251-259)
agcuccgacgauucuaagcuggaguac

SEQ ID NO: 53160 - RNA, 30 nt, Artificial Sequence
  Zinc finger protein 330 (258-267)
agcuccgacaaguacggcgauaccucuuau

SEQ ID NO: 53161 - RNA, 30 nt, Artificial Sequence
  Protein FAM208B (1580-1589)
agcuccgacaacgccacccugacacacuac

SEQ ID NO: 53162 - RNA, 27 nt, Artificial Sequence
  Heat shock 70 kDa protein 14 (75-83)
agcuccgacccccaggcccaaaaguac

SEQ ID NO: 53163 - RNA, 27 nt, Artificial Sequence
  Spectrin beta chain, non-erythrocytic 1 (769-777)
agcuccgacgugggccacgaugaguac

SEQ ID NO: 53164 - RNA, 27 nt, Artificial Sequence
  Signal transducer and activator of transcription 3 (613-621)
agcuccaaggagggcggggugaccuuc

SEQ ID NO: 53165 - RNA, 30 nt, Artificial Sequence
  COP9 signalosome complex subunit 6 (241-250)
agcaccgacaaguucaaaacagauuuuuac

SEQ ID NO: 53166 - RNA, 27 nt, Artificial Sequence
  Axin-1 (71-79)
agcaccgaccccagaccugccuccuac

SEQ ID NO: 53167 - RNA, 33 nt, Artificial Sequence
  Proteasome subunit beta type-8 (261-271)
agcaccgacguguccgaucugcuccaccaguac

SEQ ID NO: 53168 - RNA, 27 nt, Artificial Sequence
  Dedicator of cytokinesis protein 11 (109-117)
agcaccgacuggcacguggucaacuac

SEQ ID NO: 53169 - RNA, 27 nt, Artificial Sequence
  Mitochondrial Rho GTPase 2 (298-306)
agcaccgagcugaaccaccucggcuac

SEQ ID NO: 53170 - RNA, 27 nt, Artificial Sequence
  Cirhin (419-427)
agcaccguguccagauucuuucuguac

SEQ ID NO: 53171 - RNA, 27 nt, Artificial Sequence
  Cysteine-rich PDZ-binding protein (64-72)
agcgugcaccagcccggcucccauuac

SEQ ID NO: 53172 - RNA, 33 nt, Artificial Sequence
  Exosome complex exonuclease RRP44 (580-590)
agcgugaucaacuccaaggccucucugaccuac

SEQ ID NO: 53173 - RNA, 27 nt, Artificial Sequence
  Collagen type IV alpha-3-binding protein (484-492)
agcgugaucagaaagauucccgcccug

SEQ ID NO: 53174 - RNA, 27 nt, Artificial Sequence
  Vigilin (74-82)
agcgugaucacccaggucuuccacguu

SEQ ID NO: 53175 - RNA, 27 nt, Artificial Sequence
  WD repeat-containing protein 1 (458-466)
agcgugaaggaguggaccaucacauac

SEQ ID NO: 53176 - RNA, 27 nt, Artificial Sequence
  Cytoplasmic FMR1-interacting protein 1 (214-222)
agcgugaagaacgaccacuccgccuac

SEQ ID NO: 53177 - RNA, 27 nt, Artificial Sequence
  Ribosomal biogenesis protein LAS1L (538-546)
agcgugaagcccgccuccucuucauuc

SEQ ID NO: 53178 - RNA, 30 nt, Artificial Sequence
  Eukaryotic translation initiation factor 3 subunit I (39-48)
agcgugaacggcgagagacuggggaccuac

SEQ ID NO: 53179 - RNA, 33 nt, Artificial Sequence
  Bone morphogenetic protein receptor type-2 (815-825)
agcgugaacucccacgccgcuaccacacaguac

SEQ ID NO: 53180 - RNA, 27 nt, Artificial Sequence
  Epidermal growth factor receptor substrate 15 (746-754)
agcguguccaacgucguuaucaccaag

SEQ ID NO: 53181 - RNA, 33 nt, Artificial Sequence
  E3 ubiquitin-protein ligase Topors (191-201)
agcguguacucccccucuggcccugucaacaga

SEQ ID NO: 53182 - RNA, 33 nt, Artificial Sequence
  Tubulin beta chain (48-58)
agcguguacuauaacgaggccaccggcgggaag

SEQ ID NO: 53183 - RNA, 27 nt, Artificial Sequence
  Cohesin subunit SA-2 (881-889)
accgccgcugacaucuucaagcaguac

SEQ ID NO: 53184 - RNA, 27 nt, Artificial Sequence
  Phosphatidylinositol 3,4,5-trisphosphate-dependent Rac exchanger 1 protein (345-353)
accgccgacuaccacagcaacggcuau

SEQ ID NO: 53185 - RNA, 27 nt, Artificial Sequence
  Phospholipid-transporting ATPase IG (35-43)
accgaggccuacaucgcucagagauuc

SEQ ID NO: 53186 - RNA, 30 nt, Artificial Sequence
  RNMT-activating mini protein (20-29)
accgagaacgacaaggaauaccaggaguau

SEQ ID NO: 53187 - RNA, 27 nt, Artificial Sequence
  Vacuolar protein sorting-associated protein 26A (225-233)
accgagacagaaacuaucgccaaguac

SEQ ID NO: 53188 - RNA, 27 nt, Artificial Sequence
  Ribosomal RNA processing protein 1 homolog B (77-85)
accaucgcccagcuggugcacgcuguc

SEQ ID NO: 53189 - RNA, 27 nt, Artificial Sequence
  Heterogeneous nuclear ribonucleoproteins A2/B1 (164-172)
accaucaacggccacaaugccgaggug

SEQ ID NO: 53190 - RNA, 27 nt, Artificial Sequence
  Transformation/transcription domain-associated protein (378-386)
acccuggccgaccucgugcaccauguc

SEQ ID NO: 53191 - RNA, 30 nt, Artificial Sequence
  Syntaxin-binding protein 3 (187-196)
acccuggacgagaaccccggcgugagauac

SEQ ID NO: 53192 - RNA, 27 nt, Artificial Sequence
  Centrosomal protein CEP57L1 (127-135)
acccugcucgagaagcagcuugaauac

SEQ ID NO: 53193 - RNA, 33 nt, Artificial Sequence
  Pleckstrin homology domain-containing family B member 2 (103-113)
acccugcaggacagcagaacaaacacugccuac

SEQ ID NO: 53194 - RNA, 27 nt, Artificial Sequence
  Zinc finger protein 706 (46-54)
acccagaugcccgacccuaagacauuc

SEQ ID NO: 53195 - RNA, 27 nt, Artificial Sequence
  SWI/SNF-related matrix-associated actin-dependent regulator of chromatin subfamily D member 2 (452-460)
acccagagagacuucaugcugagcuuu

SEQ ID NO: 53196 - RNA, 27 nt, Artificial Sequence
  V-type proton ATPase subunit E 2 (48-56)
acccagagacugaagaucauggaguac

SEQ ID NO: 53197 - RNA, 27 nt, Artificial Sequence
  DNA replication licensing factor MCM7 (654-662)
acccagagacccgccgacgugaucuuc

SEQ ID NO: 53198 - RNA, 30 nt, Artificial Sequence
  40S ribosomal protein S13 (18-27)
accagcgacgaugugaaggagcagaucuac

SEQ ID NO: 53199 - RNA, 27 nt, Artificial Sequence
  Cation-independent mannose-6-phosphate receptor (877-885)
accagcgacggcagacagacaacuuac

SEQ ID NO: 53200 - RNA, 33 nt, Artificial Sequence
  Bifunctional glutamate/proline-tRNA ligase (269-279)
accagcgaccacuucgagacaaucaugaaguac

SEQ ID NO: 53201 - RNA, 30 nt, Artificial Sequence
  Nucleoporin Nup37 (108-117)
accagcgaccugcaggauaagaacgaguac

SEQ ID NO: 53202 - RNA, 33 nt, Artificial Sequence
  RNA polymerase II elongation factor ELL (458-468)
accagcgagacacccgacuaccugcucaaguau

SEQ ID NO: 53203 - RNA, 33 nt, Artificial Sequence
  Heterogeneous nuclear ribonucleoprotein F (256-266)
accacagaccuguucggcagagaucucagcuac

SEQ ID NO: 53204 - RNA, 27 nt, Artificial Sequence
  Tetratricopeptide repeat protein 13 (710-718)
accacagaggaaagaacucagcuguac

SEQ ID NO: 53205 - RNA, 30 nt, Artificial Sequence
  Heterogeneous nuclear ribonucleoproteins A2/B1 (20-29)
accacagaggaaagccugagaaacuacuau

SEQ ID NO: 53206 - RNA, 27 nt, Artificial Sequence
  Tapasin (372-380)
accacagagcagcacggcgccagauac

SEQ ID NO: 53207 - RNA, 30 nt, Artificial Sequence
  Condensin-2 complex subunit D3 (675-684)
accacagagagccaggaacuguccagauac

SEQ ID NO: 53208 - RNA, 27 nt, Artificial Sequence
  Endoplasmic reticulum-Golgi intermediate compartment protein 3 (40-48)
accacagaggugcaccccgaacuguac

SEQ ID NO: 53209 - RNA, 27 nt, Artificial Sequence
  Coatomer subunit gamma-1 (759-767)
accguggccgaccacauccagaagguc

SEQ ID NO: 53210 - RNA, 27 nt, Artificial Sequence
  Threonine-tRNA ligase, cytoplasmic (150-158)
accgugaucgccaaggucaacaauguu

SEQ ID NO: 53211 - RNA, 27 nt, Artificial Sequence
  Transmembrane emp24 domain-containing protein 3 (153-161)
accgugaucgacagccagacacacuac

SEQ ID NO: 53212 - RNA, 30 nt, Artificial Sequence
  Importin subunit alpha-5 (433-442)
accgugauggacagcaagaucguccagguu

SEQ ID NO: 53213 - RNA, 27 nt, Artificial Sequence
  Sodium/potassium-transporting ATPase subunit alpha-3 (268-276)
accgugaugggcagaaucgccacacug

SEQ ID NO: 53214 - RNA, 27 nt, Artificial Sequence
  Band 4.1-like protein 2 (777-785)
guggaggaagagcccagaccugccgcu

SEQ ID NO: 53215 - RNA, 27 nt, Artificial Sequence
  26S protease regulatory subunit 4 (176-184)
guggagaaggccccccaggaaaccuac

SEQ ID NO: 53216 - RNA, 27 nt, Artificial Sequence
  Choline/ethanolaminephosphotransferase 1 (268-276)
gugaucuucaccggcggggucggaaag

SEQ ID NO: 53217 - RNA, 27 nt, Artificial Sequence
  28S ribosomal protein S17, mitochondrial (34-42)
gugcuggaccccuaccuccuuaaguau

SEQ ID NO: 53218 - RNA, 30 nt, Artificial Sequence
  Protein Niban (367-376)
gugcuguucgagaaggaagucaacgagguu

SEQ ID NO: 53219 - RNA, 27 nt, Artificial Sequence
  Caprin-1 (232-240)
gugcugaaggagaucgucgaaagaguu

SEQ ID NO: 53220 - RNA, 27 nt, Artificial Sequence
  Ribonucleoside-diphosphate reductase large subunit (245-253)
gugcugaaggagaaaaucgccaaguac

SEQ ID NO: 53221 - RNA, 33 nt, Artificial Sequence
  Histone H4 (22-32)
gugcugagagacaacauccagggcauuaccaag

SEQ ID NO: 53222 - RNA, 27 nt, Artificial Sequence
  Cytoplasmic dynein 1 heavy chain 1 (3839-3847)
gugcuguacgagaaccccaaucucaag

SEQ ID NO: 53223 - RNA, 27 nt, Artificial Sequence
  Ubiquitin carboxyl-terminal hydrolase 7 (195-203)
gugcaggccgacgcuccccacggcguc

SEQ ID NO: 53224 - RNA, 30 nt, Artificial Sequence
  E3 ubiquitin-protein ligase RNF19A (143-152)
gugcaggccgacguccaaaaggagagauac

SEQ ID NO: 53225 - RNA, 27 nt, Artificial Sequence
  Interleukin enhancer-binding factor 2 (97-105)
gugcagaucgaggaagucagacaaguu

SEQ ID NO: 53226 - RNA, 33 nt, Artificial Sequence
  Proteasome subunit alpha type-2 (102-112)
gugcagagagucgccagcguuaugcaagaguac

SEQ ID NO: 53227 - RNA, 27 nt, Artificial Sequence
  Transitional endoplasmic reticulum ATPase (747-755)
gugagcgacaacgauaucagaaaguac

SEQ ID NO: 53228 - RNA, 27 nt, Artificial Sequence
  Nuclear factor NF-kappa-B p100 subunit (317-325)
gugagcgacuccaagcaguucaccuac

SEQ ID NO: 53229 - RNA, 30 nt, Artificial Sequence
  Nuclear factor NF-kappa-B p100 subunit (317-326)
gugagcgacuccaagcaguucaccuacuau

SEQ ID NO: 53230 - RNA, 33 nt, Artificial Sequence
  Phospholipase D2 (65-75)
gugaccgcccaggucguuggcacagagagauac

SEQ ID NO: 53231 - RNA, 27 nt, Artificial Sequence
  Acidic fibroblast growth factor intracellular-binding protein (29-37)
gugaccgacgccgucgcucugagaguu

SEQ ID NO: 53232 - RNA, 30 nt, Artificial Sequence
  Alanine-tRNA ligase, cytoplasmic (480-489)
gugaccgacgauagccccaaguacaacuau

SEQ ID NO: 53233 - RNA, 33 nt, Artificial Sequence; identical to SEQ ID NO: 29006
  Histone-lysine N-methyltransferase 2C (1500-1510)

SEQ ID NO: 53234 - RNA, 30 nt, Artificial Sequence
  Attractin (145-154)
gugaccgacggccccgggaacuacaaguau

SEQ ID NO: 53235 - RNA, 30 nt, Artificial Sequence
  Proteasome-associated protein ECM29 homolog (1150-1159)
gugaccgacaagagcauggucgauaaauac

SEQ ID NO: 53236 - RNA, 30 nt, Artificial Sequence
  Histone-lysine N-methyltransferase, H3 lysine-79 specific (77-86)
gugaccgaccccgagaagcugaacaauuac

SEQ ID NO: 53237 - RNA, 27 nt, Artificial Sequence
  Dynamin-1-like protein (55-63)
gugaccgacagcaucagagaugaguac

SEQ ID NO: 53238 - RNA, 30 nt, Artificial Sequence; identical to SEQ ID NO: 29011
  Pyridine nucleotide-disulfide oxidoreductase domain-containing protein 1 (98-107)

SEQ ID NO: 53239 - RNA, 27 nt, Artificial Sequence
  Filamin-A (2353-2361)
gugaccgagaucgaccaggauaaguac

SEQ ID NO: 53240 - RNA, 33 nt, Artificial Sequence
  Staphylococcal nuclease domain-containing protein 1 (687-697)
gugaccgagaucacagacgaucugcacuucuac

SEQ ID NO: 53241 - RNA, 27 nt, Artificial Sequence
  E3 ubiquitin-protein ligase RNF213 (4915-4923)
gugaccgagcugcacgucaucagcuac

SEQ ID NO: 53242 - RNA, 27 nt, Artificial Sequence
  Eukaryotic translation initiation factor 3 subunit C-like protein (23-31)
gugaccaagcccgucggcgggaacuac

SEQ ID NO: 53243 - RNA, 30 nt, Artificial Sequence
  Heterogeneous nuclear ribonucleoprotein U (696-705)
uggagccagcacuaccaucaaggcuauuac

SEQ ID NO: 53244 - RNA, 30 nt, Artificial Sequence
  Chromodomain-helicase-DNA-binding protein 7 (859-868)
uggaccgacauccugagccacggcagauac

SEQ ID NO: 53245 - RNA, 27 nt, Artificial Sequence
  Polypyrimidine tract-binding protein 3 (269-277)
uacgccgaccccgugaacgcucacuau

SEQ ID NO: 53246 - RNA, 27 nt, Artificial Sequence
  HLA class I histocompatibility antigen, B-15 alpha chain (140-148)
uacgccuaugacggcaaggauuacauc

SEQ ID NO: 53247 - RNA, 33 nt, Artificial Sequence
  HLA class I histocompatibility antigen, B-52 alpha chain (140-150)
uacgccuaugacggcaaggauuacaucgcucug

SEQ ID NO: 53248 - RNA, 27 nt, Artificial Sequence
  Cell division cycle-associated 7-like protein (433-441)
uacggcuaugacaacgugaaggaguac

SEQ ID NO: 53249 - RNA, 33 nt, Artificial Sequence
  Mediator of RNA polymerase II transcription subunit 10 (70-80)
uacaucgaccagggcagaaacccccaacuguau

SEQ ID NO: 53250 - RNA, 27 nt, Artificial Sequence
  Septin-7 (132-140)
uacaucgacagcaaguucgaggauuau

SEQ ID NO: 53251 - RNA, 27 nt, Artificial Sequence
  Hypoxia-inducible factor 1-alpha (111-119)
uacaucagcgacaacgugaauaaguau

SEQ ID NO: 53252 - RNA, 30 nt, Artificial Sequence
  Ubiquitin carboxyl-terminal hydrolase 22 (118-127)
uacaucuaugacaaggauauggagauuaua

SEQ ID NO: 53253 - RNA, 30 nt, Artificial Sequence
  Metastasis-associated protein MTA3 (123-132)
uaccuggacaaggaggauaccuucuuuuau

SEQ ID NO: 53254 - RNA, 27 nt, Artificial Sequence
  Oxysterol-binding protein-related protein 3 (75-83)
uaccuggacaagggcauccucaaauau

SEQ ID NO: 53255 - RNA, 30 nt, Artificial Sequence
  tRNA (adenine(58)-N(1))-methyltransferase non-catalytic subunit TRM6 (53-62)
uaccuggacaacgugaucggccacagcuau

SEQ ID NO: 53256 - RNA, 27 nt, Artificial Sequence
  Nucleolar complex protein 4 homolog (174-182)
uaccuggacuaugaugacaccagauac

SEQ ID NO: 53257 - RNA, 27 nt, Artificial Sequence
  Signal transducer and activator of transcription 3 (14-22)
uaccuggagcagcuccaccaacuuuau

SEQ ID NO: 53258 - RNA, 27 nt, Artificial Sequence
  Dystonin (981-989)
uaccugaucaacgagauugacagaaua

SEQ ID NO: 53259 - RNA, 27 nt, Artificial Sequence
  Geminin (150-158)
uacauggccgagcugaucgaaagacuc

SEQ ID NO: 53260 - RNA, 27 nt, Artificial Sequence
  Thymidylate synthase (235-243)
uacaugaucgcccacauuaccggccug

SEQ ID NO: 53261 - RNA, 33 nt, Artificial Sequence
  Chromodomain-helicase-DNA-binding protein 1-like (712-722)
uaccaggaccccgaugccaccagccugaaguau

SEQ ID NO: 53262 - RNA, 27 nt, Artificial Sequence
  Up-regulated during skeletal muscle growth protein 5 (10-18)
uaccaguucaccggcaucaagaaauau

SEQ ID NO: 53263 - RNA, 27 nt, Artificial Sequence
  Integrator complex subunit 3 (156-164)
uaccagaagcaacccaaaaucggcuau

SEQ ID NO: 53264 - RNA, 27 nt, Artificial Sequence
  Pre-mRNA-processing-splicing factor 8 (2326-2334)
uacagcgccgacagagaggaucuguau

SEQ ID NO: 53265 - RNA, 27 nt, Artificial Sequence
  Mitogen-activated protein kinase 6 (427-435)
uacagcgaccaccaugagaacaaguau

SEQ ID NO: 53266 - RNA, 30 nt, Artificial Sequence
  RNA binding motif protein, X-linked-like-1 (272-281)
uacagcgaccaccccuccggcgggucuuau

SEQ ID NO: 53267 - RNA, 30 nt, Artificial Sequence
  Cyclin-dependent kinases regulatory subunit 2 (8-17)
uacagcgacaaguauuucgaugagcacuac

SEQ ID NO: 53268 - RNA, 27 nt, Artificial Sequence
  Serine/threonine-protein kinase PLK1 (417-425)
uacagcgacaaguauggccugggguac

SEQ ID NO: 53269 - RNA, 27 nt, Artificial Sequence
  Glycoprotein endo-alpha-1,2-mannosidase-like protein (102-110)
uacagcgaccugcacgccuucuauuac

SEQ ID NO: 53270 - RNA, 30 nt, Artificial Sequence
  Cold-inducible RNA-binding protein (151-160)
uacagcgacagauccucuggcgggucauau

SEQ ID NO: 53271 - RNA, 30 nt, Artificial Sequence
  DNA mismatch repair protein Msh6 (469-478)
uacagcgacucccuggugcagaagggcuau

SEQ ID NO: 53272 - RNA, 30 nt, Artificial Sequence
  Serine hydroxymethyltransferase, cytosolic (73-82)
uacagcgagggcuaucccgggcagagauac

SEQ ID NO: 53273 - RNA, 33 nt, Artificial Sequence
  Store-operated calcium entry-associated regulatory factor (204-214)
uacagcgaguaucccccuuucucccacagauac

SEQ ID NO: 53274 - RNA, 33 nt, Artificial Sequence
  FACT complex subunit SPT16 (18-28)
uacagcaacuggagaaagggcgaggacgaauau

SEQ ID NO: 53275 - RNA, 27 nt, Artificial Sequence
  Histone-lysine N-methyltransferase EZH1 (729-737)
uacagccaggccgacgcucugaaguau

SEQ ID NO: 53276 - RNA, 27 nt, Artificial Sequence
  RNA binding motif protein, X-linked-like-1 (327-335)
uacagcuccucuagaucagaccuguau

SEQ ID NO: 53277 - RNA, 33 nt, Artificial Sequence
  Eukaryotic translation initiation factor 3 subunit I (38-48)
uacagcgugaacggcgagagacuggggaccuau

SEQ ID NO: 53278 - RNA, 33 nt, Artificial Sequence
  Trafficking protein particle complex subunit 4 (75-85)
uacaccgccgacggcaaggaggugcuggaauau

SEQ ID NO: 53279 - RNA, 24 nt, Artificial Sequence
  DnaJ homolog subfamily C member 3 (284-291)
uacaccgacgccacaagcaaguau

SEQ ID NO: 53280 - RNA, 27 nt, Artificial Sequence
  Meckelin (401-409)
uacaccgacgagaaccagcaccaauau

SEQ ID NO: 53281 - RNA, 30 nt, Artificial Sequence
  Serine/threonine-protein kinase pim-2 (194-203)
uacaccgacuucgauggcacaagaguguau

SEQ ID NO: 53282 - RNA, 30 nt, Artificial Sequence
  RNA-binding protein 7 (219-228)
uacaccgaccacggcagcgaucaucacuau

SEQ ID NO: 53283 - RNA, 33 nt, Artificial Sequence
  Glutathione S-transferase Mu 2 (23-33)
uacaccgacagcuccuaugaggaaaagaaauac

SEQ ID NO: 53284 - RNA, 30 nt, Artificial Sequence
  Protein patched homolog 1 (564-573)
uacaccgacacacacgauaacacuagauau

SEQ ID NO: 53285 - RNA, 33 nt, Artificial Sequence
  ARF GTPase-activating protein GIT2 (492-502)
uacaccgacacaagcaaccacuccucucugaag

SEQ ID NO: 53286 - RNA, 24 nt, Artificial Sequence
  Thioredoxin-related transmembrane protein 2 (199-206)
uacaccgacgugagcacaagauau

SEQ ID NO: 53287 - RNA, 30 nt, Artificial Sequence
  Zinc finger CCCH domain-containing protein 18 (65-74)
uacaccgagacagaacccuaucacaacuac

SEQ ID NO: 53288 - RNA, 27 nt, Artificial Sequence
  Probable ATP-dependent RNA helicase DDX47 (236-244)
uacuauaucuucauucccagcaaguuu

SEQ ID NO: 53289 - RNA, 27 nt, Artificial Sequence
  ORM1-like protein 2 (59-67)
gccaccuacguguuccugcacacaguc

SEQ ID NO: 53290 - RNA, 27 nt, Artificial Sequence
  Eukaryotic translation initiation factor 2 subunit 3 (202-210)
gagcaguacgaacaaauccuggccuuc

SEQ ID NO: 53291 - RNA, 27 nt, Artificial Sequence
  Tapasin (354-362)
caccauagcgacggcuccgugucucug

SEQ ID NO: 53292 - RNA, 27 nt, Artificial Sequence
  Cyclin-dependent kinases regulatory subunit 2 (59-67)
auccacgagcccgaaccucauauucug

SEQ ID NO: 53293 - RNA, 27 nt, Artificial Sequence
  Prelamin-A/C (341-349)
aaggccggccagguggucaccaucugg

SEQ ID NO: 53294 - RNA, 27 nt, Artificial Sequence
  AP-1 complex subunit beta-1 (249-257)
agccacgccaacuccgcugugguccug

SEQ ID NO: 53295 - RNA, 27 nt, Artificial Sequence
  Proliferating cell nuclear antigen (152-160)
agccacaucggcgacgccguggucauu

SEQ ID NO: 53296 - RNA, 27 nt, Artificial Sequence
  Ubiquitin-60S ribosomal protein L40 (70-78)
agcacccugcaccucgugcuuagacug

SEQ ID NO: 53297 - RNA, 30 nt, Artificial Sequence
  HLA class I histocompatibility antigen, B-15 alpha chain (162-171)
accgccgcucagaucacacaaagaaagugg

SEQ ID NO: 53298 - RNA, 27 nt, Artificial Sequence
  Septin-6 (73-81)
acccacacacagcccggcgugcaacug

SEQ ID NO: 53299 - RNA, 27 nt, Artificial Sequence
  DNA topoisomerase 2-alpha (684-692)
uaccuguauggccagaccacaacuuac

SEQ ID NO: 53300 - RNA, 30 nt, Artificial Sequence; identical to SEQ ID NO: 29073
  Coilin (257-266)

SEQ ID NO: 53301 - RNA, 27 nt, Artificial Sequence
  Cancer/testis antigen 1 (155-163)
cagcugagccuccuuauguggaucacc

SEQ ID NO: 53302 - RNA, 27 nt, Artificial Sequence
  ATPase family AAA domain-containing protein 2 (1274-1282)
gccagcuccucucagaucauucacaua

SEQ ID NO: 53303 - RNA, 27 nt, Artificial Sequence
  Guanine nucleotide-binding protein G(I)/G(S)/G(T) subunit beta-2 (91-99)
cacgccaucccccugagaagcuccugg

SEQ ID NO: 53304 - RNA, 27 nt, Artificial Sequence
  Acyl-CoA desaturase (115-123)
aucaccgccggcgcucacagacugugg

SEQ ID NO: 53305 - RNA, 27 nt, Artificial Sequence
  Choline-phosphate cytidylyltransferase A (201-209)
agcaccuccgacaucauuacaagaaua

SEQ ID NO: 53306 - RNA, 27 nt, Artificial Sequence
  Serine/threonine-protein kinase pim-1 (191-199)
gcccugcucaaggacaccguguacaca

SEQ ID NO: 53307 - RNA, 27 nt, Artificial Sequence
  Death-associated protein kinase 2 (1-9)
augcugcucgacaagaacauccccauu

SEQ ID NO: 53308 - RNA, 27 nt, Artificial Sequence
  HLA class I histocompatibility antigen, B-15 alpha chain (163-171)
gccgcucagaucacccaaagaaagugg

SEQ ID NO: 53309 - RNA, 27 nt, Artificial Sequence
  Transcription termination factor 2 (113-121)
gagaccuuccaccauagcuccaacugg

SEQ ID NO: 53310 - RNA, 27 nt, Artificial Sequence
  Filamin-A (352-360)
ggcacccacaaggugacaguccuguuc

SEQ ID NO: 53311 - RNA, 27 nt, Artificial Sequence
  Filamin-A (452-460)
ggcgugcacaccguccauguuacauuc

SEQ ID NO: 53312 - RNA, 57 nt, Artificial Sequence
  C-1-tetrahydrofolate synthase, cytoplasmic (72-90)
cacggcaacagcuccaucauugccgaccagauagcucugaagcucguggggcccgag

SEQ ID NO: 53313 - RNA, 57 nt, Artificial Sequence
  Major histocompatibility complex class I-related gene protein (3-21)
cacagccugagauacuucaggcucggcguguccgaccccauccggggggucccugag

SEQ ID NO: 53314 - RNA, 30 nt, Artificial Sequence
  Delta(24)-sterol reductase (310-319)
cacaccuuccagaacgacauccauguguac

SEQ ID NO: 53315 - RNA, 24 nt, Artificial Sequence
  Protein SET (64-71)
aucgccaagauucccaacuucugg

SEQ ID NO: 53316 - RNA, 27 nt, Artificial Sequence
  Eukaryotic translation initiation factor 3 subunit C-like protein (385-393)
aucagcaagcaguuccaccaucaacug

SEQ ID NO: 53317 - RNA, 27 nt, Artificial Sequence
  Constitutive coactivator of PPAR-gamma-like protein 1 (982-990)
aucagcacccccgugauuagaacauuc

SEQ ID NO: 53318 - RNA, 27 nt, Artificial Sequence
  T-complex protein 1 subunit gamma (160-168)
aucaccacaaaggccauuagcagaugg

SEQ ID NO: 53319 - RNA, 27 nt, Artificial Sequence
  DNA replication complex GINS protein PSF1 (5-13)
aaggccauggagcugaucagagaacuc

SEQ ID NO: 53320 - RNA, 27 nt, Artificial Sequence
  60S ribosomal protein L18a (2-10)
aaggccagcggcacccugagagaguac

SEQ ID NO: 53321 - RNA, 27 nt, Artificial Sequence
  14-3-3 protein gamma (152-160)
aaggccuacagcgaggcucacgaaauc

SEQ ID NO: 53322 - RNA, 27 nt, Artificial Sequence
  AP-1 complex subunit mu-2 (348-356)
aagagcuuccccggcgggaaagaguac

SEQ ID NO: 53323 - RNA, 30 nt, Artificial Sequence
  Dolichol-phosphate mannosyltransferase subunit 1 (42-51)
aagagcuucuccgagucuggcaucaacuac

SEQ ID NO: 53324 - RNA, 30 nt, Artificial Sequence
  Heterogeneous nuclear ribonucleoprotein M (203-212)
aagagcagaggcaucgggaccgugacauuc

SEQ ID NO: 53325 - RNA, 27 nt, Artificial Sequence
  Plastin-3 (40-48)
aagagcuccgacaucgccaaaaccuuc

SEQ ID NO: 53326 - RNA, 27 nt, Artificial Sequence
  THO complex subunit 2 (398-406)
aagaccuuccccuaccagcacagauau

SEQ ID NO: 53327 - RNA, 27 nt, Artificial Sequence
  Guanine nucleotide-binding protein subunit beta-2-like 1 (127-135)
aagaccaucaaacuguggaacacacuc

SEQ ID NO: 53328 - RNA, 27 nt, Artificial Sequence
  60S ribosomal protein L4 (163-171)
aagaccaaagaggccgugcugcuccuu

SEQ ID NO: 53329 - RNA, 27 nt, Artificial Sequence
  Ribonucleoside-diphosphate reductase large subunit (52-60)
aagacccuggagagaagcuaccuccuu

SEQ ID NO: 53330 - RNA, 30 nt, Artificial Sequence
  Hexokinase-2 (777-786)
aagaccagaggcaucuucgagacaaaauuu

SEQ ID NO: 53331 - RNA, 27 nt, Artificial Sequence
  Ribosome-binding protein 1 (145-153)
aagguggccaaagucgagcccgcuguu

SEQ ID NO: 53332 - RNA, 27 nt, Artificial Sequence
  Proteasome subunit beta type-5 (92-100)
aaggugaucgagauuaaccccuaccug

SEQ ID NO: 53333 - RNA, 27 nt, Artificial Sequence
  Anaphase-promoting complex subunit 2 (557-565)
aaggugagagaccagcaacuggucuac

SEQ ID NO: 53334 - RNA, 57 nt, Artificial Sequence
  Protein-tyrosine kinase 2-beta (528-546)
caggaggaaaagagccuggaccccaugguguacaugaacgauaccuccccucucaca

SEQ ID NO: 53335 - RNA, 27 nt, Artificial Sequence
  Vigilin (54-62)
agagccaagcccgaguaccacaaauuc

SEQ ID NO: 53336 - RNA, 24 nt, Artificial Sequence
  NEDD8 ultimate buster 1 (113-120)
agaagcaagaucgccgagaccuuc

SEQ ID NO: 53337 - RNA, 27 nt, Artificial Sequence
  Pleiotropic regulator 1 (309-317)
agaaccaaggccagcgugcacacacug

SEQ ID NO: 53338 - RNA, 27 nt, Artificial Sequence
  Baculoviral IAP repeat-containing protein 6 (597-605)
agaacccugcccgugcuccuucuguac

SEQ ID NO: 53339 - RNA, 27 nt, Artificial Sequence
  E3 ubiquitin-protein ligase CBL-B (66-74)
agaaccguggagaagacauggaaacug

SEQ ID NO: 53340 - RNA, 30 nt, Artificial Sequence
  Basigin (137-146)
agagugaggagccaccuggccgcucucugg

SEQ ID NO: 53341 - RNA, 36 nt, Artificial Sequence
  Phosphatidylinositol 4-kinase type 2-beta (74-85)
agcagauccucuucagccgagcuggacaggagucgg

SEQ ID NO: 53342 - RNA, 27 nt, Artificial Sequence
  Histone-binding protein RBBP7 (376-384)
accgccaagaucagcgacuucuccugg

SEQ ID NO: 53343 - RNA, 27 nt, Artificial Sequence
  Junction plakoglobin (207-215)
accacaagcagagugcugaagguccuc

SEQ ID NO: 53344 - RNA, 27 nt, Artificial Sequence
  High mobility group protein B3 (123-131)
guggccaagaaacugggcgagaugugg

SEQ ID NO: 53345 - RNA, 33 nt, Artificial Sequence
  Heterogeneous nuclear ribonucleoprotein U-like protein 1 (427-437)
gugggccugcccgccgcugggaagaccacaugg

SEQ ID NO: 53346 - RNA, 27 nt, Artificial Sequence
  Phosphoglycerate kinase 1 (328-336)
gugaccagagccaagcagaucgucugg

SEQ ID NO: 53347 - RNA, 27 nt, Artificial Sequence
  Transcription elongation factor SPT5 (976-984)
gugaccacagacauccaggucaagguu

SEQ ID NO: 53348 - RNA, 57 nt, Artificial Sequence
  Lymphocyte antigen 75 (1307-1325)
uacauggccagcugggugaugcugggcaucaccuauagaaacaagucccucaugugg

SEQ ID NO: 53349 - RNA, 27 nt, Artificial Sequence
  Guanine nucleotide-binding protein subunit beta-2-like 1 (302-310)
uacaccgacaaccuggugagagucugg

SEQ ID NO: 53350 - RNA, 27 nt, Artificial Sequence
  40S ribosomal protein S21 (75-83)
gccgacggcaucgugagcaagaacuuc

SEQ ID NO: 53351 - RNA, 30 nt, Artificial Sequence
  Pleiotropic regulator 1 (471-480)
gccgaggcugacaagaccaucaaaguguac

SEQ ID NO: 53352 - RNA, 27 nt, Artificial Sequence
  Putative RRN3-like protein RRN3P1 (4-12)
gccgaggcuuuccuggaacaccucugg

SEQ ID NO: 53353 - RNA, 33 nt, Artificial Sequence
  Chloride intracellular channel protein 1 (157-167)
gccgaggacgaaggcgugagccagagaaaguuc

SEQ ID NO: 53354 - RNA, 33 nt, Artificial Sequence
  Heat shock protein HSP 90-beta (346-356)
gccgaggacaaggaaaacuacaaaaaguucuau

SEQ ID NO: 53355 - RNA, 33 nt, Artificial Sequence
  Transmembrane emp24 domain-containing protein 3 (50-60)
gccgaggaccugaacagcagaguguccuacugg

SEQ ID NO: 53356 - RNA, 33 nt, Artificial Sequence
  Transmembrane emp24 domain-containing protein 7 (170-180)
gccgaggaccugaacaccagaguggcuuacugg

SEQ ID NO: 53357 - RNA, 30 nt, Artificial Sequence
  Plasminogen activator inhibitor 1 RNA-binding protein (236-245)
gccgaggacagcgugauggaucaccauuuc

SEQ ID NO: 53358 - RNA, 30 nt, Artificial Sequence
  Eukaryotic translation elongation factor 1 epsilon-1 (65-74)
gccgaggaaaaggcuaucgugcagcaaugg

SEQ ID NO: 53359 - RNA, 27 nt, Artificial Sequence
  Transcription elongation factor SPT6 (985-993)
gccgaggaacuggagagacagggcuac

SEQ ID NO: 53360 - RNA, 30 nt, Artificial Sequence
  G patch domain-containing protein 4 (15-24)
gccgaggaacagcugcucaagcacggcugg

SEQ ID NO: 53361 - RNA, 30 nt, Artificial Sequence
  General transcription factor 3C polypeptide 1 (182-191)
gccgaggaaagcgaccuguccagacaguac

SEQ ID NO: 53362 - RNA, 30 nt, Artificial Sequence
  Myosin light polypeptide 6 (10-19)
gccgaguucaaggaagcuuuucagcuguuc

SEQ ID NO: 53363 - RNA, 30 nt, Artificial Sequence
  Signal peptidase complex subunit 2 (187-196)
gccgaguucaccaagagcaucgcuaaauuu

SEQ ID NO: 53364 - RNA, 27 nt, Artificial Sequence
  60S ribosomal protein L8 (33-41)
gccgagggcauccacaccgggcaguuc

SEQ ID NO: 53365 - RNA, 33 nt, Artificial Sequence
  Proteasome inhibitor PI31 subunit (114-124)
gccgagcaccugggcgacuuccauagaaccuac

SEQ ID NO: 53366 - RNA, 27 nt, Artificial Sequence
  Kinesin-like protein KIF20B (872-880)
gccgagaucgaagacauuagagugcug

SEQ ID NO: 53367 - RNA, 30 nt, Artificial Sequence
  rRNA-processing protein FCF1 homolog (108-117)
gccgagaucgaaaagcugggccagaaauac

SEQ ID NO: 53368 - RNA, 36 nt, Artificial Sequence
  Cyclin-dependent kinase 6 (17-28)
gccgagaucggcgaaggggcuuacggaaagguguuc

SEQ ID NO: 53369 - RNA, 33 nt, Artificial Sequence
  Delta(24)-sterol reductase (227-237)
gccgagaucagaauuauacccgcuaagaaauac

SEQ ID NO: 53370 - RNA, 33 nt, Artificial Sequence
  Filamin A (105-115)
gccgagaucguggaaggcgagaaccacaccuac

SEQ ID NO: 53371 - RNA, 30 nt, Artificial Sequence
  Replication protein A 32 kDa subunit (83-92)
gccgagaaggcucccaccaacaucguguac

SEQ ID NO: 53372 - RNA, 30 nt, Artificial Sequence
  ATP-dependent RNA helicase DHX8 (57-66)
gccgagaagaacaccacauucgacacuuuu

SEQ ID NO: 53373 - RNA, 33 nt, Artificial Sequence
  Cysteine andine-rich protein 1 (129-139)
gccgagaaggugaucggcgcugggaaaagcugg

SEQ ID NO: 53374 - RNA, 30 nt, Artificial Sequence
  ER membrane protein complex subunit 2 (162-171)
gccgagcuguacaucaacgaacacgacuau

SEQ ID NO: 53375 - RNA, 30 nt, Artificial Sequence
  Catenin beta-1 (478-487)
gccgagauggcucagaacgcagugagacug

SEQ ID NO: 53376 - RNA, 27 nt, Artificial Sequence
  Cleavage stimulation factor subunit 1 (217-225)
gccgagaugcugagaagcaucuccuuc

SEQ ID NO: 53377 - RNA, 27 nt, Artificial Sequence
  DNA-dependent protein kinase catalytic subunit (193-201)
gccgagaaccuguucagagcuuuucuc

SEQ ID NO: 53378 - RNA, 33 nt, Artificial Sequence
  Proteasome subunit beta type-1 (211-221)
gccgagagagacguguacaccggcgaugcucug

SEQ ID NO: 53379 - RNA, 27 nt, Artificial Sequence
  Exportin-2 (513-521)
gccgagagcaucgugguccacaccuac

SEQ ID NO: 53380 - RNA, 27 nt, Artificial Sequence
  Full=Zinc finger CCCH domain-containing protein 16 (227-235)
gccgagguggcugcagaaaagagcuuc

SEQ ID NO: 53381 - RNA, 33 nt, Artificial Sequence
  Targeting protein for Xklp2 (638-648)
gccgagguggaagcucagaaggcacaacagcug

SEQ ID NO: 53382 - RNA, 27 nt, Artificial Sequence
  Transmembrane emp24 domain-containing protein 3 (92-100)
gccgaggugaagggcgucuaccaguuc

SEQ ID NO: 53383 - RNA, 30 nt, Artificial Sequence
  DNA-dependent protein kinase catalytic subunit (2320-2329)
gccgaggugcugggccucauccuuagauac

SEQ ID NO: 53384 - RNA, 30 nt, Artificial Sequence
  Spectrin beta chain, non-erythrocytic 1 (1304-1313)
gacgaggccagaaaccugcacagcaagugg

SEQ ID NO: 53385 - RNA, 27 nt, Artificial Sequence
  Protein KIAA0100 (696-704)
gacgaggccgugggcguccagaagugg

SEQ ID NO: 53386 - RNA, 30 nt, Artificial Sequence
  Transcription elongation factor SPT6 (573-582)
gacgaguucagccaccaggugcaagaaugg

SEQ ID NO: 53387 - RNA, 27 nt, Artificial Sequence
  Heat shock protein HSP 90-alpha (288-296)
gacgagauggugagccugaaggauuac

SEQ ID NO: 53388 - RNA, 30 nt, Artificial Sequence
  Cyclin-dependent kinase inhibitor 3 (22-31)
gacgagcagacccccauccacauuagcugg

SEQ ID NO: 53389 - RNA, 27 nt, Artificial Sequence
  Spectrin beta chain, non-erythrocytic 1 (741-749)
gaggaagccagccugcuccaccaguuc

SEQ ID NO: 53390 - RNA, 33 nt, Artificial Sequence
  Eukaryotic translation initiation factor 3 subunit M (11-21)
gaggaagaccaggccgcugagcugagagcauac

SEQ ID NO: 53391 - RNA, 27 nt, Artificial Sequence
  Protein transport protein Sec23B (521-529)
gaggaaggccccgacgugcugagaugg

SEQ ID NO: 53392 - RNA, 33 nt, Artificial Sequence
  40S ribosomal protein S17 (36-46)
gaggaaaucgccauuauacccagcaagaaacug

SEQ ID NO: 53393 - RNA, 30 nt, Artificial Sequence
  Sigma non-opioid intracellular receptor 1 (40-49)
gaggaaaucgcccagcuggcuagacaauac

SEQ ID NO: 53394 - RNA, 33 nt, Artificial Sequence
  DNA repair protein RAD50 (1002-1012)
gaggaaaucaacaagauuauaagagaccugugg

SEQ ID NO: 53395 - RNA, 27 nt, Artificial Sequence
  Targeting protein for Xklp2 (351-359)
gaggaacuggagaagcuccagcaauac

SEQ ID NO: 53396 - RNA, 27 nt, Artificial Sequence
  26S proteasome non-ATPase regulatory subunit 13 (26-34)
gaggaacuguacaccaagaaacucugg

SEQ ID NO: 53397 - RNA, 36 nt, Artificial Sequence
  Nuclear pore complex protein Nup153 (1104-1115)
gaggaaaugcccgccaccaagggcggguucagcuuu

SEQ ID NO: 53398 - RNA, 33 nt, Artificial Sequence
  Eukaryotic initiation factor 4A-I (396-406)
gaggaaaugccccugaacguggccgaccucauc

SEQ ID NO: 53399 - RNA, 27 nt, Artificial Sequence
  General transcription factor 3C polypeptide 1 (183-191)
gaggaaagcgaccuguccagacaguac

SEQ ID NO: 53400 - RNA, 30 nt, Artificial Sequence
  Protein SCO1 homolog, mitochondrial (121-130)
gaggaaguggaccaggucgccagagcuuac

SEQ ID NO: 53401 - RNA, 30 nt, Artificial Sequence
  F-box/LRR-repeat protein 3 (394-403)
gaggaagugcugauccccgaccagaaguac

SEQ ID NO: 53402 - RNA, 27 nt, Artificial Sequence
  von Willebrand factor (1339-1347)
gagcugagaaggaucgccagccaggug

SEQ ID NO: 53403 - RNA, 15 nt, Artificial Sequence
  DNA nucleotidylexotransferase (64-68)
uucagaaggggcaag

SEQ ID NO: 53404 - RNA, 27 nt, Artificial Sequence
  Spectrin beta chain, non-erythrocytic 1 (1059-1067)
ggcgaggccagcaagcugcagcaauuc

SEQ ID NO: 53405 - RNA, 30 nt, Artificial Sequence
  Endothelial differentiation-related factor 1 (35-44)
ggcgaggacguggaaaccagcaagaaaugg

SEQ ID NO: 53406 - RNA, 27 nt, Artificial Sequence
  Serine/arginine-rich splicing factor 9 (175-183)
ggcgagaccagcuacaucagaguguau

SEQ ID NO: 53407 - RNA, 33 nt, Artificial Sequence
  Peroxiredoxin-5, mitochondrial (36-46)
ggcgagugggccagcgggggagugagauccuuc

SEQ ID NO: 53408 - RNA, 27 nt, Artificial Sequence
  Probable E3 ubiquitin-protein ligase makorin-2 (170-178)
cacgagauggaaaaggccuucgcuuuu

SEQ ID NO: 53409 - RNA, 30 nt, Artificial Sequence
  Antigen KI-67 (54-63)
cacgagcaggaagccauccugcauaacuuc

SEQ ID NO: 53410 - RNA, 30 nt, Artificial Sequence
  Mediator of RNA polymerase II transcription subunit 17 (187-196)
aucgaggacccccagauucaagcccacugg

SEQ ID NO: 53411 - RNA, 27 nt, Artificial Sequence
  Actin, aortic smooth muscle (73-81)
aucgagcacggcauuauaaccaacugg

SEQ ID NO: 53412 - RNA, 33 nt, Artificial Sequence
  DNA topoisomerase 2-alpha (921-931)
aucgagauuagcgaacugcccgugagaaccugg

SEQ ID NO: 53413 - RNA, 27 nt, Artificial Sequence
  Non-canonical poly(A) RNA polymerase PAPD5 (227-235)
aucgagagcgugauuaaggaacugugg

SEQ ID NO: 53414 - RNA, 45 nt, Artificial Sequence
  Interleukin-9 receptor (168-182)
aucagccccgcccuggagccuaugaccacacuccuuuccuacgaa

SEQ ID NO: 53415 - RNA, 30 nt, Artificial Sequence
  T-complex protein 1 subunit gamma (6-15)
cuggagaucaagaaaauuggcgacgaauac

SEQ ID NO: 53416 - RNA, 33 nt, Artificial Sequence
  Trafficking protein particle complex subunit 5 (105-115)
cuggagcaggccaacgacgaugcuagaaccuuc

SEQ ID NO: 53417 - RNA, 30 nt, Artificial Sequence
  Eukaryotic translation initiation factor 3 subunit D (314-323)
auggaggccaccuacaucaaccacaauuuc

SEQ ID NO: 53418 - RNA, 30 nt, Artificial Sequence
  Magnesium transporter protein 1 (242-251)
auggaguuccuguuuaacaagaccggcugg

SEQ ID NO: 53419 - RNA, 27 nt, Artificial Sequence
  Transforming acidic coiled-coil-containing protein 3 (718-726)
auggagaagagcuucuccgaccuguuu

SEQ ID NO: 53420 - RNA, 30 nt, Artificial Sequence
  Membrane-associated tyrosine- and threonine-specific cdc2-inhibitory kinase (234-243)
auggagcugccccacggcggggaaggaugg

SEQ ID NO: 53421 - RNA, 27 nt, Artificial Sequence
  AAC83183.1 (92-100)
auggagagccugaccaagcaccucuuc

SEQ ID NO: 53422 - RNA, 30 nt, Artificial Sequence
  60S ribosomal protein L4 (212-221)
aacgaggacaauggcaucauuaaggccuuc

SEQ ID NO: 53423 - RNA, 33 nt, Artificial Sequence
  Protein transport protein Sec23B (420-430)
aacgagcugggcguggggggaaccagccagugg

SEQ ID NO: 53424 - RNA, 30 nt, Artificial Sequence
  Long-chain-fatty-acid-CoA ligase 4 (65-74)
aacgagaugcagcccaauggcaagguguuc

SEQ ID NO: 53425 - RNA, 30 nt, Artificial Sequence
  Mortality factor 4-like protein 1 (215-224)
aacgagguggucgccggcaucaaggaauac

SEQ ID NO: 53426 - RNA, 24 nt, Artificial Sequence
  Ig kappa chain C region (1-8)
aacaucgugaugacccagagcccc

SEQ ID NO: 53427 - RNA, 27 nt, Artificial Sequence
  Multifunctional protein ADE2 (69-77)
caggaggccggcaucaagaccgcuuuc

SEQ ID NO: 53428 - RNA, 33 nt, Artificial Sequence; identical to SEQ ID NO: 29201
  Guanine nucleotide-binding protein G(s) subunit alpha isoforms short (257-267)

SEQ ID NO: 53429 - RNA, 33 nt, Artificial Sequence
  Spectrin beta chain, non-erythrocytic 1 (1864-1874)
caggaggacgccgcuagacugcaagcagccuac

SEQ ID NO: 53430 - RNA, 30 nt, Artificial Sequence
  Annexin A2 (138-147)
caggagcugcaagaaaucaacagaguguac

SEQ ID NO: 53431 - RNA, 30 nt, Artificial Sequence
  TPT1-like protein (84-93)
caggagaccagcuucacaaaggaagccuac

SEQ ID NO: 53432 - RNA, 33 nt, Artificial Sequence
  AP-5 complex subunit zeta-1 (14-24)
agagagauccaggacgaagagcugaagaaauuc

SEQ ID NO: 53433 - RNA, 33 nt, Artificial Sequence
  Eukaryotic translation initiation factor 3 subunit C-like protein (201-211)
agcgaggcccccuccggcgaaucuagaaaguuc

SEQ ID NO: 53434 - RNA, 27 nt, Artificial Sequence
  Histone H2B type 1-A (77-85)
agcgaggccuccagacuggcucacuac

SEQ ID NO: 53435 - RNA, 36 nt, Artificial Sequence
  Protein transport protein Sec31A (233-244)
agcgaggacgauagacugcccgugauccagaugugg

SEQ ID NO: 53436 - RNA, 27 nt, Artificial Sequence
  DnaJ homolog subfamily C member 7 (393-401)
agcgaggacgaaaucaagaaagccuac

SEQ ID NO: 53437 - RNA, 27 nt, Artificial Sequence
  WD repeat-containing protein 82 (86-94)
agcgaggacggcaagauccacgugugg

SEQ ID NO: 53438 - RNA, 30 nt, Artificial Sequence
  Poly (ADP-ribose) polymerase 1 (808-817)
agcgaggaagccgagaucauuagaaaguac

SEQ ID NO: 53439 - RNA, 27 nt, Artificial Sequence
  Polypyrimidine tract-binding protein 1 (485-493)
agcgaggaagaccugaaggugcucuuc

SEQ ID NO: 53440 - RNA, 36 nt, Artificial Sequence
  Eukaryotic translation initiation factor 3 subunit M (10-21)
agcgaggaagaccaggccgcugagcugagagcauac

SEQ ID NO: 53441 - RNA, 27 nt, Artificial Sequence
  General transcription factor 3C polypeptide 1 (415-423)
agcgaggaaggccugcucagacuuuac

SEQ ID NO: 53442 - RNA, 30 nt, Artificial Sequence; identical to SEQ ID NO: 29215
  Disco-interacting protein 2 homolog A (29-38)

SEQ ID NO: 53443 - RNA, 27 nt, Artificial Sequence
  DNA replication licensing factor MCM5 (690-698)
agcgagcacuccaucauuaaggacuuc

SEQ ID NO: 53444 - RNA, 27 nt, Artificial Sequence
  Disks large homolog 1 (143-151)
agcgagaucgaaaacgugcacggcuuc

SEQ ID NO: 53445 - RNA, 33 nt, Artificial Sequence
  Protein SET (61-71)
agcgagcugaucgccaagauucccaacuucugg

SEQ ID NO: 53446 - RNA, 27 nt, Artificial Sequence
  Uncharacterized protein C14orf119 (121-129)
agcgagcccgacuucguggccaaguuu

SEQ ID NO: 53447 - RNA, 27 nt, Artificial Sequence
  Ubiquitin-conjugating enzyme E2 J1 (204-212)
agcgaguccgaccugaaccacucuuuc

SEQ ID NO: 53448 - RNA, 27 nt, Artificial Sequence
  Nucleolar transcription factor 1 (275-283)
agcgaguccgaacugaccagacuccuu

SEQ ID NO: 53449 - RNA, 27 nt, Artificial Sequence
  Citrate synthase, mitochondrial (120-128)
agcgaguccaacuucgccagagcuuac

SEQ ID NO: 53450 - RNA, 27 nt, Artificial Sequence
  GMP reductase 2 (46-54)
agcgagguggaccugaccagauccuuc

SEQ ID NO: 53451 - RNA, 39 nt, Artificial Sequence
  Single Ig IL-1-related receptor (383-395)
agcgagguggacgucuccgaucugggcucuagaaacuac

SEQ ID NO: 53452 - RNA, 27 nt, Artificial Sequence
  Sulfhydryl oxidase 1 (223-231)
accgaggccaacguggucagaaaguuc

SEQ ID NO: 53453 - RNA, 30 nt, Artificial Sequence
  Cyclin-D1-binding protein 1 (44-53)
accgaggaauucaacagagagauguuuugg

SEQ ID NO: 53454 - RNA, 30 nt, Artificial Sequence
  Staphylococcal nuclease domain-containing protein 1 (663-672)
accgagaucacagacgaucugcacuucuac

SEQ ID NO: 53455 - RNA, 27 nt, Artificial Sequence
  Eukaryotic translation initiation factor 3 subunit M (142-150)
accgagcuggaccaggugagaaagugg

SEQ ID NO: 53456 - RNA, 30 nt, Artificial Sequence
  Serine/arginine-rich splicing factor 3 (24-33)
accgagcuggaaagagccuucggcuacuau

SEQ ID NO: 53457 - RNA, 33 nt, Artificial Sequence
  HLA class II histocompatibility antigen, DRB1-15 beta chain (46-56)
accgagcugggcagacccgacgccgaauacugg

SEQ ID NO: 53458 - RNA, 27 nt, Artificial Sequence
  Pre-mRNA-splicing factor ISY1 homolog (37-45)
accgagcugcccaaggccgaaaaaugg

SEQ ID NO: 53459 - RNA, 33 nt, Artificial Sequence
  Coatomer subunit delta (46-56)
accgagauggacagccacgaagagaagguguuc

SEQ ID NO: 53460 - RNA, 27 nt, Artificial Sequence
  CUGBP Elav-like family member 1 (120-128)
accgagaacgacaucagagugauguuc

SEQ ID NO: 53461 - RNA, 27 nt, Artificial Sequence
  Gamma-secretase subunit PEN-2 (48-56)
accgagcagagccaaaucaagggcuac

SEQ ID NO: 53462 - RNA, 33 nt, Artificial Sequence
  Gamma-secretase subunit PEN-2 (48-58)
accgagcagagccaaaucaagggcuacgugugg

SEQ ID NO: 53463 - RNA, 27 nt, Artificial Sequence
  Tyrosine-protein kinase BAZ1B (274-282)
guggaggacgaacuggucaagaaauac

SEQ ID NO: 53464 - RNA, 27 nt, Artificial Sequence
  Vigilin (405-413)
guggagaucaacauugaccacaaguuc

SEQ ID NO: 53465 - RNA, 33 nt, Artificial Sequence
  Influenza virus NS1A-binding protein (576-586)
guggagauguacgaccccaccagaaacgaaugg

SEQ ID NO: 53466 - RNA, 30 nt, Artificial Sequence
  Target of rapamycin complex subunit LST8 (298-307)
guggagaccggcgaaaucaagagagaguac

SEQ ID NO: 53467 - RNA, 30 nt, Artificial Sequence
  Methionine aminopeptidase 2 (311-320)
uacgagguggaaaucgacggcaagaccuau

SEQ ID NO: 53468 - RNA, 42 nt, Artificial Sequence
  Gamma-secretase C-terminal fragment 59 (565-578)
uucagacacgacagcggcuacgaggugcaucaccagaagcug

SEQ ID NO: 53469 - RNA, 27 nt, Artificial Sequence
  Disintegrin and metalloproteinase domain-containing protein 10 (19-27)
ggccaguacgggaacccccugaauaag

SEQ ID NO: 53470 - RNA, 24 nt, Artificial Sequence
  Beta-2-microglobulin (21-28)
auccagagaacccccaagauucaa

SEQ ID NO: 53471 - RNA, 30 nt, Artificial Sequence
  Beta-2-microglobulin (21-30)
auccagagaacccccaagauucaaguguac

SEQ ID NO: 53472 - RNA, 27 nt, Artificial Sequence
  Splicing factor 3B subunit 2 (36-44)
agacagaccggcaucgugcugaacagg

SEQ ID NO: 53473 - RNA, 27 nt, Artificial Sequence
  Importin subunit alpha-1 (377-385)
ggccuggugcccuuccucgucagcguu

SEQ ID NO: 53474 - RNA, 27 nt, Artificial Sequence
  Neutral alpha-glucosidase AB (3-11)
gccguggcugcagucgccgcgagaagg

SEQ ID NO: 53475 - RNA, 30 nt, Artificial Sequence
  60S ribosomal protein L15 (131-140)
gaggugauccugauugaccccuuccacaag

SEQ ID NO: 53476 - RNA, 30 nt, Artificial Sequence
  Cullin-4A (5-14)
gcccccagaaagggcagcuucuccgcucug

SEQ ID NO: 53477 - RNA, 30 nt, Artificial Sequence
  Fatty acid synthase (1169-1178)
auccccagagacccuagccagcaagagcug

SEQ ID NO: 53478 - RNA, 30 nt, Artificial Sequence
  Carbonic anhydrase 9 (397-406)
agccccagagccgcugagccugugcagcug

SEQ ID NO: 53479 - RNA, 27 nt, Artificial Sequence
  BTB/POZ domain-containing adapter for CUL3-mediated RhoA degradation protein 3 (28-36)
agccccuccucuaaguacgugaaacug

SEQ ID NO: 53480 - RNA, 27 nt, Artificial Sequence
  Melanoma-associated antigen 10 (254-262)
ggccuguacgacgggauggagcaccuc

SEQ ID NO: 53481 - RNA, 27 nt, Artificial Sequence
  26S proteasome non-ATPase regulatory subunit 6 (103-111)
gccaugauggcuaaggcagaguaccug

SEQ ID NO: 53482 - RNA, 27 nt, Artificial Sequence
  40S ribosomal protein S26 (107-115)
gcccccagaccuccaccgaagcccaug

SEQ ID NO: 53483 - RNA, 27 nt, Artificial Sequence
  Elongation factor 2 (286-294)
gccuaccugcccgugaacgagagcuuc

SEQ ID NO: 53484 - RNA, 27 nt, Artificial Sequence
  Long-chain-fatty-acid-CoA ligase 3 (326-334)
ggcuaccugccccucgcccacgugcuu

SEQ ID NO: 53485 - RNA, 27 nt, Artificial Sequence
  m7GpppX diphosphatase (268-276)
cacuaccugcccagcuauuaccaucuc

SEQ ID NO: 53486 - RNA, 27 nt, Artificial Sequence
  N6-adenosine-methyltransferase subunit METTL14 (99-107)
aucuacaaggacagcuccaccuuccug

SEQ ID NO: 53487 - RNA, 27 nt, Artificial Sequence
  Ubiquitin-conjugating enzyme E2 H (17-25)
aagcugaucgagagcaaacacgaagug

SEQ ID NO: 53488 - RNA, 27 nt, Artificial Sequence
  Adenylosuccinate synthetase isozyme 2 (347-355)
aaguacgcccacaugaucaacggcuuc

SEQ ID NO: 53489 - RNA, 27 nt, Artificial Sequence
  Serine/threonine-protein phosphatase 2A 56 kDa regulatory subunit epsilon isoform (174-182)
aaguacaucgaccagaaauucgugcug

SEQ ID NO: 53490 - RNA, 27 nt, Artificial Sequence
  Actin-binding protein IPP (238-246)
aaguacaucgagggcgugagcgacuuc

SEQ ID NO: 53491 - RNA, 27 nt, Artificial Sequence
  Mitogen-activated protein kinase 4 (138-146)
aaguacauccacagcgccaacgugcug

SEQ ID NO: 53492 - RNA, 27 nt, Artificial Sequence
  Tyrosine-protein phosphatase non-receptor type 23 (70-78)
aaguaccugggccagcuccacuaucuu

SEQ ID NO: 53493 - RNA, 30 nt, Artificial Sequence
  Mitochondrial carrier homolog 1 (280-289)
aaguaccugagcgugcagggccaacucuuc

SEQ ID NO: 53494 - RNA, 27 nt, Artificial Sequence
  Caprin-1 (98-106)
aaguaccaggaggugaccaacaaucug

SEQ ID NO: 53495 - RNA, 27 nt, Artificial Sequence
  Mitochondrial carrier homolog 1 (168-176)
aaguacagcggcgugcuguccucuauc

SEQ ID NO: 53496 - RNA, 27 nt, Artificial Sequence
  Microspherule protein 1 (251-259)
cuguacgaccccgugaucagcaagcuc

SEQ ID NO: 53497 - RNA, 27 nt, Artificial Sequence
  Splicing factor 3B subunit 3 (988-996)
aacuacaucagcggcauucagaccaua

SEQ ID NO: 53498 - RNA, 27 nt, Artificial Sequence
  Vimentin (357-365)
aacuaccaggacaccaucggcagacug

SEQ ID NO: 53499 - RNA, 27 nt, Artificial Sequence
  Stomatin-like protein 2, mitochondrial (236-244)
caguacgugagcgccuucuccaagcug

SEQ ID NO: 53500 - RNA, 30 nt, Artificial Sequence
  Actin, cytoplasmic 2 (85-94)
agaguggcccccgaggaacacccuguccug

SEQ ID NO: 53501 - RNA, 27 nt, Artificial Sequence
  Casein kinase I isoform delta (178-186)
agauacgccagcaucaacacccaccug

SEQ ID NO: 53502 - RNA, 27 nt, Artificial Sequence
  Dolichyl-diphosphooligosaccharide-proteinosyltransferase subunit 2 (218-226)
agauacaucgccaacaccguggagcug

SEQ ID NO: 53503 - RNA, 27 nt, Artificial Sequence
  Signal transducer and activator of transcription 3 (13-21)
agauaccuggagcagcuccaccaacuu

SEQ ID NO: 53504 - RNA, 27 nt, Artificial Sequence
  Protein kish-A (2-10)
agcgccaucuucaacuuucagucccug

SEQ ID NO: 53505 - RNA, 27 nt, Artificial Sequence
  Seipin (55-63)
agcuacaugcccaccgugucccaccug

SEQ ID NO: 53506 - RNA, 27 nt, Artificial Sequence
  CMP-N-acetylneuraminate-beta-galactosamide-alpha-2,3-sialyltransf erase 2 (239-247)
accuacgcccccgugaagagcuuccug

SEQ ID NO: 53507 - RNA, 27 nt, Artificial Sequence
  Cleft lip and palate transmembrane protein 1 (545-553)
accuacaaggcccugaacacauucauc

SEQ ID NO: 53508 - RNA, 27 nt, Artificial Sequence
  Proteasome subunit beta type-6 (94-102)
accuaccagcugggcuuccacagcauc

SEQ ID NO: 53509 - RNA, 27 nt, Artificial Sequence
  RNA-binding protein 42 (91-99)
accuaccagcaagugcagcagacacug

SEQ ID NO: 53510 - RNA, 27 nt, Artificial Sequence
  DNA replication licensing factor MCM7 (231-239)
accuacacaagcgccagaacucugcuc

SEQ ID NO: 53511 - RNA, 27 nt, Artificial Sequence
  Alpha-enolase (18-26)
guguaccacaaccugaagaaugucauc

SEQ ID NO: 53512 - RNA, 27 nt, Artificial Sequence
  Unconventional myosin-Ic (350-358)
guguacagcagaaccuucacauggcug

SEQ ID NO: 53513 - RNA, 33 nt, Artificial Sequence; identical to SEQ ID NO: 29286
  THO complex subunit 5 homolog (420-430)

SEQ ID NO: 53514 - RNA, 27 nt, Artificial Sequence
  Splicing factor 3B subunit 3 (1166-1174)
uacuauuuccccgugaagaacgucauc

SEQ ID NO: 53515 - RNA, 27 nt, Artificial Sequence
  Solute carrier family 35 member B1 (27-35)
uacuauggcauccugcaggagaagauu

SEQ ID NO: 53516 - RNA, 24 nt, Artificial Sequence
  Transformation/transcription domain-associated protein (1974-1981)
uacuaucccgugagacaccaucug

SEQ ID NO: 53517 - RNA, 48 nt, Artificial Sequence
  Gamma-secretase C-terminal fragment 59 (563-578)
gccgaguucagacacgacagcggcuacgaagugcaucaccagaagcug

SEQ ID NO: 53518 - RNA, 30 nt, Artificial Sequence
  Ribosome-binding protein 1 (168-177)
gccauccuggagaccgcucccaaggaagug

SEQ ID NO: 53519 - RNA, 27 nt, Artificial Sequence
  Sarcoplasmic/endoplasmic reticulum calcium ATPase 1 (206-214)
gccaucgugagaagccugcccuccguc

SEQ ID NO: 53520 - RNA, 27 nt, Artificial Sequence
  ATP-dependent RNA helicase DDX50 (247-255)
gcccuggcugcagcccucgcgcacauc

SEQ ID NO: 53521 - RNA, 30 nt, Artificial Sequence
  Splicing factor, proline- and glutamine-rich (343-352)
gcccuggcugagaucgcaaaggccgaacuc

SEQ ID NO: 53522 - RNA, 36 nt, Artificial Sequence
  DDB1- and CUL4-associated factor 11 (187-198)
gcccuggcuggccaccaggacgggaucaccuucauu

SEQ ID NO: 53523 - RNA, 27 nt, Artificial Sequence
  EH domain-containing protein 1 (502-510)
gcccuggcuaaccaccucaucaaggug

SEQ ID NO: 53524 - RNA, 27 nt, Artificial Sequence
  COP9 signalosome complex subunit 7a (30-38)
gcccuggcuacccucauccaccaggug

SEQ ID NO: 53525 - RNA, 27 nt, Artificial Sequence
  Cullin-2 (304-312)
gcccuggacaaggcucucaccagcgug

SEQ ID NO: 53526 - RNA, 27 nt, Artificial Sequence
  Glutathione S-transferase A4 (73-81)
gcccuggaggaaaagauccccaacauu

SEQ ID NO: 53527 - RNA, 27 nt, Artificial Sequence
  WD repeat-containing protein 19 (108-116)
gcccuguucgagggcaaggugcagcuc

SEQ ID NO: 53528 - RNA, 27 nt, Artificial Sequence
  H/ACA ribonucleoprotein complex subunit 4 (179-187)
gcccuguuccagagacccccucucauc

SEQ ID NO: 53529 - RNA, 27 nt, Artificial Sequence
  Serine palmitoyltransferase 2 (292-300)
gcccugggccccaccgggagaggagug

SEQ ID NO: 53530 - RNA, 33 nt, Artificial Sequence
  Syntaxin-binding protein 3 (373-383)
gcccugggcaccgacgcugaggggcagaaggug

SEQ ID NO: 53531 - RNA, 27 nt, Artificial Sequence
  Apoptosis-associated speck-like protein containing a CARD (118-126)
gcccugaucgcuagagugaccaacguc

SEQ ID NO: 53532 - RNA, 27 nt, Artificial Sequence
  DNA damage-inducible transcript 3 protein (158-166)
gcccugaucgacagaauggugaaccuc

SEQ ID NO: 53533 - RNA, 33 nt, Artificial Sequence
  Erlin-2 (214-224)
gcccugaucgaggcugaaaagguggcacagguc

SEQ ID NO: 53534 - RNA, 27 nt, Artificial Sequence
  DNA polymerase alpha subunit B (22-30)
gcccugaucgagaagcucguggaacuu

SEQ ID NO: 53535 - RNA, 27 nt, Artificial Sequence
  Thyroid adenoma-associated protein (142-150)
gcccugaucaccagaauuuucggcgug

SEQ ID NO: 53536 - RNA, 27 nt, Artificial Sequence
  Proliferating cell nuclear antigen (18-26)
gcccugaaggaccucaucaacgaggcu

SEQ ID NO: 53537 - RNA, 33 nt, Artificial Sequence
  Eukaryotic translation initiation factor 3 subunit D (439-449)
gcccugcucgcuggcagcgaguaccuuaagcug

SEQ ID NO: 53538 - RNA, 27 nt, Artificial Sequence
  AP-3 complex subunit delta-1 (461-469)
gcccugcucgacagcgcucaccuucug

SEQ ID NO: 53539 - RNA, 36 nt, Artificial Sequence
  Extended synaptotagmin-2 (137-148)
gcccugcucgaggacgaagagagaguggucaggcuu

SEQ ID NO: 53540 - RNA, 27 nt, Artificial Sequence
  Transportin-1 (689-697)
gcccugcucggcgaccuuaccaaggcu

SEQ ID NO: 53541 - RNA, 27 nt, Artificial Sequence
  NudC domain-containing protein 3 (12-20)
gcccugcucggcauccuucagcacgug

SEQ ID NO: 53542 - RNA, 27 nt, Artificial Sequence
  ATP synthase subunit beta, mitochondrial (320-328)
gcccugcucggcagaauccccagcgcu

SEQ ID NO: 53543 - RNA, 27 nt, Artificial Sequence
  Ubiquitin carboxyl-terminal hydrolase 35 (288-296)
gcccugcucaagggccuugcugcagug

SEQ ID NO: 53544 - RNA, 27 nt, Artificial Sequence
  Proline and serine-rich protein 1 (900-908)
gcccugcuccagcaagugcacagcgcu

SEQ ID NO: 53545 - RNA, 27 nt, Artificial Sequence
  Lysine-specific histone demethylase 1A (418-426)
gcccugcucagcggccuuagagaggcu

SEQ ID NO: 53546 - RNA, 33 nt, Artificial Sequence
  Hsp90 co-chaperone Cdc37 (204-214)
gcccugauggagcagguggcucaccaaaccauc

SEQ ID NO: 53547 - RNA, 33 nt, Artificial Sequence
  Ubiquitin-conjugating enzyme E2 S (128-138)
gcccugaacgaggaagcuggcagacuccuucug

SEQ ID NO: 53548 - RNA, 27 nt, Artificial Sequence
  Talin-1 (777-785)
gcccugaacgagcuccuucagcacgug

SEQ ID NO: 53549 - RNA, 27 nt, Artificial Sequence
  Kinetochore protein NDC80 homolog (274-282)
gcccugaacgagcagaucgcuagacuc

SEQ ID NO: 53550 - RNA, 27 nt, Artificial Sequence
  Influenza virus NS1A-binding protein (460-468)
gcccugaacggcaagcucuacaucgug

SEQ ID NO: 53551 - RNA, 27 nt, Artificial Sequence
  Integrator complex subunit 4 (235-243)
gcccugcaggagaagcucuggaacgug

SEQ ID NO: 53552 - RNA, 27 nt, Artificial Sequence
  BRISC complex subunit Abro1 (215-223)
gcccugcaggagaaggugcaagcuguc

SEQ ID NO: 53553 - RNA, 27 nt, Artificial Sequence
  Enhancer of filamentation 1 (806-814)
gcccugcaggagauggugcaccaaguc

SEQ ID NO: 53554 - RNA, 27 nt, Artificial Sequence
  Alpha-taxilin (67-75)
gcccugagagacgugagcgaggaacuc

SEQ ID NO: 53555 - RNA, 27 nt, Artificial Sequence
  SET and MYND domain-containing protein 4 (220-228)
gcccugagagaggaaaacgagcagcuc

SEQ ID NO: 53556 - RNA, 27 nt, Artificial Sequence
  Leucine-rich PPR motif-containing protein, mitochondrial (676-684)
gcccugagaggcgagaucgaaaccgug

SEQ ID NO: 53557 - RNA, 27 nt, Artificial Sequence
  HAUS augmin-like complex subunit 1 (219-227)
gcccugagcgagaagcucgcuagacuu

SEQ ID NO: 53558 - RNA, 30 nt, Artificial Sequence
  T-complex protein 1 subunit zeta (162-171)
gcccugagcaaggagggcaucguggcucuc

SEQ ID NO: 53559 - RNA, 27 nt, Artificial Sequence
  Coatomer subunit gamma-1 (159-167)
gcccuggugagcucccuccaccuucug

SEQ ID NO: 53560 - RNA, 30 nt, Artificial Sequence
  Guanine nucleotide-binding protein G(s) subunit alpha isoforms short (142-151)
gcccugugggaggacgaaggcgugagagcu

SEQ ID NO: 53561 - RNA, 27 nt, Artificial Sequence
  FERM, RhoGEF and pleckstrin domain-containing protein 2 (602-610)
gcccugugggagggccccagcaaggcu

SEQ ID NO: 53562 - RNA, 27 nt, Artificial Sequence
  Mannose-1-phosphate guanyltransferase alpha (254-262)
gcccuguacgcuagcagacucuaucuu

SEQ ID NO: 53563 - RNA, 27 nt, Artificial Sequence
  Structural maintenance of chromosomes flexible hinge domain-containing protein 1 (656-664)
gcccuguacgacgaggugagaaccguc

SEQ ID NO: 53564 - RNA, 27 nt, Artificial Sequence
  Asparagine synthetase (glutamine-hydrolyzing) (131-139)
gcccuguacgacaacguggagaagcuc

SEQ ID NO: 53565 - RNA, 27 nt, Artificial Sequence
  A-kinase anchor protein 11 (579-587)
gcccuguaccaccucgcuaucaagcuu

SEQ ID NO: 53566 - RNA, 30 nt, Artificial Sequence; identical to SEQ ID NO: 29339
  tRNA-splicing ligase RtcB homolog (146-155)

SEQ ID NO: 53567 - RNA, 27 nt, Artificial Sequence
  Sister chromatid cohesion protein PDS5 homolog A (534-542)
gccauguucggcaagcugaugaccauc

SEQ ID NO: 53568 - RNA, 27 nt, Artificial Sequence
  Autophagy-related protein 101 (20-28)
gccaugcuggcugugcuccacaccguc

SEQ ID NO: 53569 - RNA, 33 nt, Artificial Sequence
  ATP-binding cassette sub-family F member 1 (296-306)
gccaugcuggagaacgcuagcgacaucaagcuc

SEQ ID NO: 53570 - RNA, 27 nt, Artificial Sequence
  Ankyrin repeat and KH domain-containing protein 1 (1231-1239)
gccaugaacggccacgugcccgcuguc

SEQ ID NO: 53571 - RNA, 27 nt, Artificial Sequence
  Phosphopantothenoylcysteine decarboxylase (65-73)
gccaugugggagcaccccaucaccgcu

SEQ ID NO: 53572 - RNA, 30 nt, Artificial Sequence
  Bifunctional methylenetetrahydrofolate dehydrogenase/cyclohydrolase, mitochondrial (270-279)
gccgugaucgacgucggcauuaacagaguu

SEQ ID NO: 53573 - RNA, 27 nt, Artificial Sequence
  Leucine-rich repeat flightless-interacting protein 2 (349-357)
gaccugaaggaucagauccaagacgug

SEQ ID NO: 53574 - RNA, 27 nt, Artificial Sequence
  ADP-ribosylation factor GTPase-activating protein 3 (152-160)
uucgccagccacgugucccccgagguc

SEQ ID NO: 53575 - RNA, 30 nt, Artificial Sequence
  Plexin-B2 (141-150)
uucaucuuugacgugcacguccaugagguu

SEQ ID NO: 53576 - RNA, 30 nt, Artificial Sequence
  Ankyrin repeat and LEM domain-containing protein 2 (100-109)
uucaucuuugagaagaaacuggcccaggcu

SEQ ID NO: 53577 - RNA, 30 nt, Artificial Sequence
  Signal transducer and activator of transcription 5B (332-341)
uucaucauugagaagcagcccccucaagug

SEQ ID NO: 53578 - RNA, 27 nt, Artificial Sequence
  DNA-directed RNA polymerase I subunit RPA2 (31-39)
uucaucauuaacggcauagagaaggug

SEQ ID NO: 53579 - RNA, 30 nt, Artificial Sequence
  Son of sevenless homolog 1 (444-453)
uucaucauggagggcacccugacaagagug

SEQ ID NO: 53580 - RNA, 27 nt, Artificial Sequence
  Formin-like protein 1 (47-55)
uucaucaacauugugguccacagcguu

SEQ ID NO: 53581 - RNA, 27 nt, Artificial Sequence
  Exocyst complex component 4 (169-177)
uucauccaggagauugaacacgcccug

SEQ ID NO: 53582 - RNA, 27 nt, Artificial Sequence
  26S proteasome non-ATPase regulatory subunit 13 (63-71)
uucaucagcgaguuugaacacagagug

SEQ ID NO: 53583 - RNA, 27 nt, Artificial Sequence
  Dystonin (4051-4059)
uucaucugggagaacauucacacccug

SEQ ID NO: 53584 - RNA, 30 nt, Artificial Sequence
  Cytoskeleton-associated protein 5 (478-487)
uuccuggccgacguggauaagcucaaacuu

SEQ ID NO: 53585 - RNA, 30 nt, Artificial Sequence; identical to SEQ ID NO: 29358
  DNA dC-dU-editing enzyme APOBEC-3F (106-115)

SEQ ID NO: 53586 - RNA, 33 nt, Artificial Sequence
  General transcription factor 3C polypeptide 2 (609-619)
uuccuggcccacgaccaggcugugagaacccuc

SEQ ID NO: 53587 - RNA, 27 nt, Artificial Sequence
  DCC-interacting protein 13-alpha (225-233)
uuccuggccaacaucggcaccagcgug

SEQ ID NO: 53588 - RNA, 27 nt, Artificial Sequence
  Nucleoside diphosphate kinase 3 (25-33)
uuccuggccgugaagcccgacggcguc

SEQ ID NO: 53589 - RNA, 27 nt, Artificial Sequence
  Basic leucine zipper and W2 domain-containing protein 1 (57-65)
uuccuggacgccagcggcgcuaagcuc

SEQ ID NO: 53590 - RNA, 27 nt, Artificial Sequence
  Probable JmjC domain-containing histone demethylation protein 2C (60-68)
uuccuggacgaugugguccacagccuc

SEQ ID NO: 53591 - RNA, 27 nt, Artificial Sequence
  Dipeptidyl peptidase 8 (72-80)
uuccuggacgagaacgugcacuuugcc

SEQ ID NO: 53592 - RNA, 27 nt, Artificial Sequence
  Myotubularin (308-316)
uuccuggacauccacaacauucaugug

SEQ ID NO: 53593 - RNA, 27 nt, Artificial Sequence
  Ubiquitin fusion degradation protein 1 homolog (168-176)
uuccuggacaucaccaaccccaaggcc

SEQ ID NO: 53594 - RNA, 27 nt, Artificial Sequence
  RHO/RAC effector protein (1023-1031)
uuccuggacaagaacgaucacagccuc

SEQ ID NO: 53595 - RNA, 27 nt, Artificial Sequence
  Epidermal growth factor receptor substrate 15-like 1 (67-75)
uuccuggacaagcagggcuuuuacgug

SEQ ID NO: 53596 - RNA, 27 nt, Artificial Sequence
  Serine/threonine-protein kinase N1 (458-466)
uuccuggacaacgagagacacgaagug

SEQ ID NO: 53597 - RNA, 33 nt, Artificial Sequence
  Sphingomyelin phosphodiesterase 4 (86-96)
uuccuggaccccggcgggccuaugaugaagcuc

SEQ ID NO: 53598 - RNA, 30 nt, Artificial Sequence
  Probable dolichyl pyrophosphate Glc1Man9GlcNAc2 alpha-1,3-glucosyltransferase (305-314)
uuccuggaccccaacaauaucccuaaggcc

SEQ ID NO: 53599 - RNA, 27 nt, Artificial Sequence
  trabeculin-alpha (1734-1742)
uuccuggaccagcacggccauaaccuc

SEQ ID NO: 53600 - RNA, 27 nt, Artificial Sequence
  Gamma-tubulin complex component 5 (53-61)
uuccuggacgugaacagccacaagauc

SEQ ID NO: 53601 - RNA, 27 nt, Artificial Sequence
  Bromodomain adjacent to zinc finger domain protein 2A (750-758)
uuccuggagcccgugaacccuagacuc

SEQ ID NO: 53602 - RNA, 27 nt, Artificial Sequence
  Serine/threonine-protein phosphatase 4 regulatory subunit 3A (581-589)
uuccuguuugagcccguggucaaggcc

SEQ ID NO: 53603 - RNA, 27 nt, Artificial Sequence
  Protein yippee-like 5 (43-51)
uuccuguuuaacaagguggucaaucuc

SEQ ID NO: 53604 - RNA, 27 nt, Artificial Sequence
  Protein TASOR (98-106)
uuccuguuucaggagcccagaagcauc

SEQ ID NO: 53605 - RNA, 27 nt, Artificial Sequence
  Protein FAM177A1 (116-124)
uuccugggcgagaagaucgccagcgug

SEQ ID NO: 53606 - RNA, 27 nt, Artificial Sequence
  Meckelin (880-888)
uuccugggcagcuuuaucgaccacgug

SEQ ID NO: 53607 - RNA, 30 nt, Artificial Sequence
  60S ribosomal protein L34 (95-104)
uuccugaucgaggaacagaagauugugguc

SEQ ID NO: 53608 - RNA, 30 nt, Artificial Sequence
  TBCC domain-containing protein 1 (214-223)
uuccugaucgagggcaccauuagcagagcc

SEQ ID NO: 53609 - RNA, 27 nt, Artificial Sequence
  T-complex protein 1 subunit beta (218-226)
uuccugcucgacaagaaaaucggcgug

SEQ ID NO: 53610 - RNA, 33 nt, Artificial Sequence
  Plectin (3718-3728)
uuccugcucgaccccgugaagggcgagagacuu

SEQ ID NO: 53611 - RNA, 27 nt, Artificial Sequence
  GDP-mannose 4,6 dehydratase (9-17)
uuccugcucgagaagggcuacgaagug

SEQ ID NO: 53612 - RNA, 27 nt, Artificial Sequence
  Protein arginine N-methyltransferase 3 (423-431)
uuccugcucgagaagcccuuuagcgug

SEQ ID NO: 53613 - RNA, 27 nt, Artificial Sequence
  Unconventional myosin-If (148-156)
uuccugcucgagaagagcagagugguc

SEQ ID NO: 53614 - RNA, 27 nt, Artificial Sequence
  TBC1 domain family member 9B (187-195)
uuccugcucggcaaggaggugagccuu

SEQ ID NO: 53615 - RNA, 33 nt, Artificial Sequence
  Poly (ADP-ribose) polymerase 10 (535-545)
uuccugcucggccccgaggggcagcaccuucug

SEQ ID NO: 53616 - RNA, 30 nt, Artificial Sequence
  Transport and Golgi organization protein 6 homolog (990-999)
uuccugcucggcagcgugguccacgagguu

SEQ ID NO: 53617 - RNA, 27 nt, Artificial Sequence
  Protein transport protein Sec24A (394-402)
uuccugcuccacauccagcaacaggug

SEQ ID NO: 53618 - RNA, 30 nt, Artificial Sequence; identical to SEQ ID NO: 29391
  GMP synthase (glutamine-hydrolyzing) (510-519)

SEQ ID NO: 53619 - RNA, 27 nt, Artificial Sequence
  Nuclear pore complex protein Nup133 (610-618)
uuccugauggacuuuauccaccaggug

SEQ ID NO: 53620 - RNA, 33 nt, Artificial Sequence; identical to SEQ ID NO: 29393
  SHC SH2 domain-binding protein 1 (439-449)

SEQ ID NO: 53621 - RNA, 27 nt, Artificial Sequence
  3-hydroxyacyl-CoA dehydrogenase type-2 (245-253)
uuccugaacggcgaggugaucagacuc

SEQ ID NO: 53622 - RNA, 27 nt, Artificial Sequence
  Translation initiation factor eIF-2B subunit delta (300-308)
uuccugaacaaggagaucaccagcgug

SEQ ID NO: 53623 - RNA, 27 nt, Artificial Sequence
  Ubiquitin-associated protein 2-like (434-442)
uuccugcaggagaagagccccgccgug

SEQ ID NO: 53624 - RNA, 30 nt, Artificial Sequence
  DNA dC-dU-editing enzyme APOBEC-3B (104-113)
uuccugcaggagaacacccacgugagacuc

SEQ ID NO: 53625 - RNA, 27 nt, Artificial Sequence
  Glutathione S-transferase A4 (87-95)
uuccugcaggaguacaccgugaagcuc

SEQ ID NO: 53626 - RNA, 27 nt, Artificial Sequence
  Proteasome activator complex subunit 4 (673-681)
uuccugcagcccgagcucgugaagcuu

SEQ ID NO: 53627 - RNA, 27 nt, Artificial Sequence
  cAMP-dependent protein kinase type I-alpha regulatory subunit (49-57)
uuccugagagaguacuuugaaaggcuc

SEQ ID NO: 53628 - RNA, 33 nt, Artificial Sequence
  6-phosphofructo-2-kinase/fructose-2,6-bisphosphatase 4 (83-93)
uuccugagcgaggaaggcgggcacguggccguc

SEQ ID NO: 53629 - RNA, 30 nt, Artificial Sequence; identical to SEQ ID NO: 29402
  DNA dC-dU-editing enzyme APOBEC-3B (107-116)

SEQ ID NO: 53630 - RNA, 33 nt, Artificial Sequence
  Lysine-tRNA ligase (585-595)
uuccugaccgacagcaacaauaucaaggaggug

SEQ ID NO: 53631 - RNA, 27 nt, Artificial Sequence
  Calcium and integrin-binding protein 1 (21-29)
uuccugaccaagcaggagauccuccuu

SEQ ID NO: 53632 - RNA, 27 nt, Artificial Sequence
  Zinc transporter ZIP6 (435-443)
uuccugguggagcacguccucacccuu

SEQ ID NO: 53633 - RNA, 27 nt, Artificial Sequence
  DDB1- and CUL4-associated factor 15 (73-81)
uuccuguacgccggccacaucuuucuc

SEQ ID NO: 53634 - RNA, 27 nt, Artificial Sequence
  DNA topoisomerase 2-beta (701-709)
uuccuguacgacgauaaccagagagug

SEQ ID NO: 53635 - RNA, 30 nt, Artificial Sequence
  Alpha-ketoglutarate-dependent dioxygenase FTO (206-215)
uucauggacccccagaagaugccuuaccug

SEQ ID NO: 53636 - RNA, 30 nt, Artificial Sequence
  Serine/threonine-protein phosphatase 6 catalytic subunit (244-253)
uucauguuugacgagaagcuggugaccguc

SEQ ID NO: 53637 - RNA, 27 nt, Artificial Sequence
  U4/U6 small nuclear ribonucleoprotein Prp3 (195-203)
uucaugaacgacgccaucgagaaggcu

SEQ ID NO: 53638 - RNA, 27 nt, Artificial Sequence
  Putative helicase MOV-10 (35-43)
uucguggacggccugaccuuuaagguc

SEQ ID NO: 53639 - RNA, 30 nt, Artificial Sequence
  Ubiquitin carboxyl-terminal hydrolase 10 (604-613)
ggcaucuucgggggacacauuagaagcgug

SEQ ID NO: 53640 - RNA, 33 nt, Artificial Sequence
  D13S824E locus (103-113)
ggcauccugaccaaggagcuccuucacagcgug

SEQ ID NO: 53641 - RNA, 27 nt, Artificial Sequence
  CAD protein (445-453)
ggccuggccgacaagguguacuuccuc

SEQ ID NO: 53642 - RNA, 33 nt, Artificial Sequence
  Threonine-tRNA ligase, cytoplasmic (145-155)
ggccuggccgacaacaccgugaucgcuaagguc

SEQ ID NO: 53643 - RNA, 27 nt, Artificial Sequence
  Importin-4 (306-314)
ggccuggccccccaccucgagcagauc

SEQ ID NO: 53644 - RNA, 27 nt, Artificial Sequence
  Filamin-B (1451-1459)
ggccuggccccccucgaggugagaguc

SEQ ID NO: 53645 - RNA, 30 nt, Artificial Sequence
  Putative helicase MOV-10 (451-460)
ggccuggacgauaucaaggaccucaaagug

SEQ ID NO: 53646 - RNA, 27 nt, Artificial Sequence
  Probable helicase with zinc finger domain (341-349)
ggccuggaccacuacguguauaagguc

SEQ ID NO: 53647 - RNA, 30 nt, Artificial Sequence
  Rho GTPase-activating protein 12 (126-135)
ggccuggacaucgaugggauuuacagagug

SEQ ID NO: 53648 - RNA, 30 nt, Artificial Sequence
  Proline-rich protein 12 (188-197)
ggccuggaccccaacaagccuccagagcuc

SEQ ID NO: 53649 - RNA, 30 nt, Artificial Sequence
  WD repeat-containing protein 70 (189-198)
ggccuggaccccagcggggccagacucgug

SEQ ID NO: 53650 - RNA, 27 nt, Artificial Sequence
  Hexokinase-1 (818-826)
ggccuggacagacucaacgugaccguc

SEQ ID NO: 53651 - RNA, 27 nt, Artificial Sequence
  Cleavage stimulation factor subunit 3 (220-228)
ggccuggacagaaacgcccccagcgug

SEQ ID NO: 53652 - RNA, 27 nt, Artificial Sequence
  Nischarin (1238-1246)
ggccuguucgaccagcacuuuagacuc

SEQ ID NO: 53653 - RNA, 27 nt, Artificial Sequence
  Targeting protein for Xklp2 (12-20)
ggccuguuccaggggaagaccccccuc

SEQ ID NO: 53654 - RNA, 27 nt, Artificial Sequence
  Protein SPT2 homolog (93-101)
ggccuggggcccccuggaagaagcgug

SEQ ID NO: 53655 - RNA, 24 nt, Artificial Sequence
  Bardet-Biedl syndrome 1 protein (382-389)
ggccuggggcccaccuucaagcuc

SEQ ID NO: 53656 - RNA, 27 nt, Artificial Sequence
  Microtubule-actin cross-linking factor 1, isoforms 1/2/3/5 (195-203)
ggccugaucgacagacaggugaccguc

SEQ ID NO: 53657 - RNA, 30 nt, Artificial Sequence; identical to SEQ ID NO: 29430
  Ubiquitin-like domain-containing CTD phosphatase 1 (225-234)

SEQ ID NO: 53658 - RNA, 27 nt, Artificial Sequence
  Programmed cell death protein 5 (91-99)
ggccugaucgagauucucaagaaagug

SEQ ID NO: 53659 - RNA, 33 nt, Artificial Sequence
  Na(+)/H(+) exchange regulatory cofactor NHE-RF1 (122-132)
ggccugcucgccggggacagacuuguggagguc

SEQ ID NO: 53660 - RNA, 27 nt, Artificial Sequence
  Trifunctional purine biosynthetic protein adenosine-3 (685-693)
ggccugcucgagaacauccccagagug

SEQ ID NO: 53661 - RNA, 30 nt, Artificial Sequence
  Hom s 1 (11-20)
ggccugcucgagaccacagugcagaagguc

SEQ ID NO: 53662 - RNA, 27 nt, Artificial Sequence
  Tumor necrosis factor receptor superfamily member 10B (362-370)
ggccugauggacaacgagaucaaggug

SEQ ID NO: 53663 - RNA, 27 nt, Artificial Sequence
  Glucocorticoid modulatory element-binding protein 1 (312-320)
ggccugauggacaccgugaagaaaguc

SEQ ID NO: 53664 - RNA, 30 nt, Artificial Sequence
  Hydroxyacyl-coenzyme A dehydrogenase, mitochondrial (36-45)
ggccugaugggggccggaaucgcucaggug

SEQ ID NO: 53665 - RNA, 27 nt, Artificial Sequence
  Myocyte-specific enhancer factor 2A (27-35)
ggccugaugaagaaagccuacgagcuc

SEQ ID NO: 53666 - RNA, 27 nt, Artificial Sequence
  Kinetochore protein NDC80 homolog (330-338)
ggccugaacgaggaaaucgccagagug

SEQ ID NO: 53667 - RNA, 30 nt, Artificial Sequence
  Zinc finger protein 106 (808-817)
ggccugcccagauucgggaucgagauggug

SEQ ID NO: 53668 - RNA, 27 nt, Artificial Sequence
  Signal recognition particle subunit SRP72 (170-178)
ggccugcaggaggggacccacgaacuc

SEQ ID NO: 53669 - RNA, 30 nt, Artificial Sequence
  Rho GTPase-activating protein 35 (1277-1286)
ggccugagcaccgaggggaucuacagagug

SEQ ID NO: 53670 - RNA, 30 nt, Artificial Sequence
  Probable RNA-binding protein 23 (209-218)
ggccugaccgggcagagacuccuuggagug

SEQ ID NO: 53671 - RNA, 27 nt, Artificial Sequence
  Anamorsin (27-35)
ggccugguggacaagcuccaggcccuu

SEQ ID NO: 53672 - RNA, 27 nt, Artificial Sequence
  Anaphase-promoting complex subunit 1 (56-64)
ggccugguggggagccuccaggagguc

SEQ ID NO: 53673 - RNA, 27 nt, Artificial Sequence
  Intraflagellar transport protein 172 homolog (410-418)
ggccugugggaggaagccuacagagug

SEQ ID NO: 53674 - RNA, 33 nt, Artificial Sequence
  Protein PRRC2B (1324-1334)
ggccugugggggcccgaggaagagccucaccuc

SEQ ID NO: 53675 - RNA, 27 nt, Artificial Sequence
  TRPM8 channel-associated factor 1 (327-335)
ggccugugggggcccgugcacgagcuc

SEQ ID NO: 53676 - RNA, 30 nt, Artificial Sequence; identical to SEQ ID NO: 29449
  tRNA (adenine(58)-N(1))-methyltransferase non-catalytic subunit TRM6 (83-92)

SEQ ID NO: 53677 - RNA, 27 nt, Artificial Sequence
  Long-chain-fatty-acid-CoA ligase 3 (310-318)
ggcauggccgagagaauccccgaacug

SEQ ID NO: 53678 - RNA, 33 nt, Artificial Sequence; identical to SEQ ID NO: 29451
  DNA damage-binding protein 1 (56-66)

SEQ ID NO: 53679 - RNA, 27 nt, Artificial Sequence
  ORM1-like protein 3 (59-67)
ggcauguacaucuuccugcacaccgug

SEQ ID NO: 53680 - RNA, 33 nt, Artificial Sequence
  WD repeat-containing protein 18 (99-109)
ggcguggccgagagcauccaccugugggaaguc

SEQ ID NO: 53681 - RNA, 33 nt, Artificial Sequence
  Putative eukaryotic translation initiation factor 2 subunit 3-like protein (277-287)
ggcguggccgggggaagcauccugaaggguguc

SEQ ID NO: 53682 - RNA, 27 nt, Artificial Sequence
  Chitinase domain-containing protein 1 (236-244)
caccuggccgaggcucuccaucaggca

SEQ ID NO: 53683 - RNA, 27 nt, Artificial Sequence
  E3 ubiquitin-protein ligase BRE1A (291-299)
caccuggccgaggugcucgaaagaguc

SEQ ID NO: 53684 - RNA, 27 nt, Artificial Sequence
  Protein VPRBP (425-433)
caccuggccaucaagcucgagcaggug

SEQ ID NO: 53685 - RNA, 27 nt, Artificial Sequence
  E3 ubiquitin-protein ligase TRIM22 (73-81)
caccuggccaacaucguggagagaguc

SEQ ID NO: 53686 - RNA, 27 nt, Artificial Sequence
  Tetratricopeptide repeat protein 17 (671-679)
caccuggacgccaccaagcuccuucug

SEQ ID NO: 53687 - RNA, 27 nt, Artificial Sequence
  Ninein (404-412)
caccugcucgagagaguggaccagguc

SEQ ID NO: 53688 - RNA, 27 nt, Artificial Sequence
  Golgin subfamily A member 4 (1695-1703)
caccugagcgagcucaacaccaagcuu

SEQ ID NO: 53689 - RNA, 27 nt, Artificial Sequence
  Lysine-tRNA ligase (148-156)
caccugaccgacaucacacucaaggug

SEQ ID NO: 53690 - RNA, 27 nt, Artificial Sequence
  Multiple C2 and transmembrane domain-containing protein 1 (245-253)
caccuguggagaggcaucgugagcauu

SEQ ID NO: 53691 - RNA, 27 nt, Artificial Sequence
  Nucleoside diphosphate-linked moiety X motif 19 (348-356)
caccuguacgacauccaugugaccguc

SEQ ID NO: 53692 - RNA, 27 nt, Artificial Sequence
  Probable helicase senataxin (435-443)
caccuguacagcgaggugaaggaaguc

SEQ ID NO: 53693 - RNA, 30 nt, Artificial Sequence
  Folliculin-interacting protein 1 (827-836)
aucauugccgacauggauaaguggaccgug

SEQ ID NO: 53694 - RNA, 33 nt, Artificial Sequence
  Cofilin-1 (47-57)
aucauucuggaggaaggcaaggagauacucgug

SEQ ID NO: 53695 - RNA, 27 nt, Artificial Sequence
  Ras GTPase-activating-like protein IQGAP1 (1071-1079)
auccuggcccccguggucaaggagauu

SEQ ID NO: 53696 - RNA, 27 nt, Artificial Sequence
  26S proteasome non-ATPase regulatory subunit 1 (736-744)
auccuggacgccggcgggcacaacgug

SEQ ID NO: 53697 - RNA, 33 nt, Artificial Sequence
  26S proteasome non-ATPase regulatory subunit 1 (736-746)
auccuggacgccggcgggcacaacgugaccauu

SEQ ID NO: 53698 - RNA, 27 nt, Artificial Sequence
  F-box only protein 8 (162-170)
auccuggacgauagccccaaggagauu

SEQ ID NO: 53699 - RNA, 33 nt, Artificial Sequence
  Melanoma inhibitory activity protein 3 (156-166)
auccuggacgauaccgccaagaaccucagagug

SEQ ID NO: 53700 - RNA, 27 nt, Artificial Sequence
  IQ domain-containing protein D (55-63)
auccuggacgaggccauuuacaaggug

SEQ ID NO: 53701 - RNA, 27 nt, Artificial Sequence
  Axin-1 (508-516)
auccuggacgagcacgugcagagaguc

SEQ ID NO: 53702 - RNA, 33 nt, Artificial Sequence
  Dihydroxyacetone phosphate acyltransferase (106-116)
auccuggacgagaugagccacaagcucagacuu

SEQ ID NO: 53703 - RNA, 27 nt, Artificial Sequence
  Protein DBF4 homolog A (461-469)
auccuggacauuagcgagcacacccuc

SEQ ID NO: 53704 - RNA, 27 nt, Artificial Sequence
  F-box only protein 25 (65-73)
auccuggacaagauugugcagaaaguc

SEQ ID NO: 53705 - RNA, 27 nt, Artificial Sequence
  Hermansky-Pudlak syndrome 5 protein (446-454)
auccuggacagcggcauuuacagaaua

SEQ ID NO: 53706 - RNA, 30 nt, Artificial Sequence
  Cofilin-1 (48-57)
auccuggaggaaggcaaggagauucucgug

SEQ ID NO: 53707 - RNA, 27 nt, Artificial Sequence
  Heat shock protein HSP 90-alpha (394-402)
auccuggagaagaaaguggaaaagguc

SEQ ID NO: 53708 - RNA, 27 nt, Artificial Sequence
  Guanine nucleotide-binding protein subunit beta-5 (320-328)
auccuguucggccacgagaacagagug

SEQ ID NO: 53709 - RNA, 27 nt, Artificial Sequence
  Cytosolic phospholipase A2 (399-407)
auccuguucaacagagugcucggcguc

SEQ ID NO: 53710 - RNA, 27 nt, Artificial Sequence
  60S acidic ribosomal protein P1 (15-23)
auccugcacgacgaugaggugaccguc

SEQ ID NO: 53711 - RNA, 27 nt, Artificial Sequence
  ATP-binding cassette sub-family B member 7, mitochondrial (22-30)
auccugauuagaccccucgugagcguc

SEQ ID NO: 53712 - RNA, 33 nt, Artificial Sequence
  Dual specificity mitogen-activated protein kinase kinase 7 (249-259)
auccugcucgacgagagaggccagauuaagcuu

SEQ ID NO: 53713 - RNA, 30 nt, Artificial Sequence
  Lon protease homolog 2, peroxisomal (293-302)
auccugcucgacaacgaucacuacgccaug

SEQ ID NO: 53714 - RNA, 27 nt, Artificial Sequence
  Protein virilizer homolog (532-540)
auccugcucgaccagaccgugagaguc

SEQ ID NO: 53715 - RNA, 27 nt, Artificial Sequence
  Histone-lysine N-methyltransferase SETD1A (58-66)
auccugcucgagcacaacuacgcccuu

SEQ ID NO: 53716 - RNA, 33 nt, Artificial Sequence
  Beta-adrenergic receptor kinase 1 (32-42)
auccugcuccccgagccuagcauuagauccgug

SEQ ID NO: 53717 - RNA, 27 nt, Artificial Sequence
  Endosomal/lysomomal potassium channel TMEM175 (218-226)
auccugcuccccuacgugagcaagguc

SEQ ID NO: 53718 - RNA, 33 nt, Artificial Sequence
  Serine/threonine-protein kinase TAO2 (157-167)
auccugcucagcgagcccggccuugugaagcug

SEQ ID NO: 53719 - RNA, 33 nt, Artificial Sequence
  60S ribosomal protein L19 (118-128)
auccugauggagcacauucauaagcucaaagcc

SEQ ID NO: 53720 - RNA, 27 nt, Artificial Sequence
  Pre-mRNA-splicing factor ATP-dependent RNA helicase DHX15 (271-279)
auccugaugggcgugcucaaggagguc

SEQ ID NO: 53721 - RNA, 27 nt, Artificial Sequence
  Cohesin subunit SA-2 (794-802)
auccugaugauuuucagccaccagaua

SEQ ID NO: 53722 - RNA, 27 nt, Artificial Sequence
  Epidermal growth factor receptor substrate 15 (67-75)
auccugaacaagcaggaguucuuugug

SEQ ID NO: 53723 - RNA, 27 nt, Artificial Sequence
  Cell division control protein 6 homolog (354-362)
auccugcaggacagacucaaccaagug

SEQ ID NO: 53724 - RNA, 27 nt, Artificial Sequence
  AT-rich interactive domain-containing protein 4B (796-804)
auccugcaggagaagcuccaagaaauu

SEQ ID NO: 53725 - RNA, 27 nt, Artificial Sequence
  Transcription activator BRG1 (366-374)
auccugcaggagagagaauacaggcuc

SEQ ID NO: 53726 - RNA, 27 nt, Artificial Sequence
  Putative eukaryotic translation initiation factor 2 subunit 3-like protein (187-195)
auccugcagaacaagauugaccucgug

SEQ ID NO: 53727 - RNA, 27 nt, Artificial Sequence
  Ankyrin repeat and SOCS box protein 3 (486-494)
auccugcagcaacacauugccaccgug

SEQ ID NO: 53728 - RNA, 27 nt, Artificial Sequence
  Poly (ADP-ribose) polymerase 1 (712-720)
auccugagcgaggugcagcaagccguc

SEQ ID NO: 53729 - RNA, 27 nt, Artificial Sequence
  Ribonucleases P/MRP protein subunit POP1 (442-450)
auccugaccgaggccauuaaggcugca

SEQ ID NO: 53730 - RNA, 27 nt, Artificial Sequence
  Translin-associated protein X (86-94)
auccugaccgagagcgaaauuaagcuc

SEQ ID NO: 53731 - RNA, 27 nt, Artificial Sequence
  Phosphotriesterase-related protein (316-324)
auccugaccaacgugguccccaagaug

SEQ ID NO: 53732 - RNA, 27 nt, Artificial Sequence
  T-complex protein 1 subunit eta (186-194)
auccuguacgacaagcucgagaaaauu

SEQ ID NO: 53733 - RNA, 27 nt, Artificial Sequence
  Methionine adenosyltransferase 2 subunit beta (184-192)
auccuguacggcgagguggaaaagcuc

SEQ ID NO: 53734 - RNA, 27 nt, Artificial Sequence
  Chromosome transmission fidelity protein 8 homolog (58-66)
auccuguacggcaagauuauacaccuc

SEQ ID NO: 53735 - RNA, 33 nt, Artificial Sequence
  Catenin alpha-1 (549-559)
aucauggcccagcugccccaagagcagaaggcu

SEQ ID NO: 53736 - RNA, 27 nt, Artificial Sequence
  Ras GTPase-activating-like protein IQGAP1 (1079-1087)
aucauggacgauaagagccugaacauu

SEQ ID NO: 53737 - RNA, 27 nt, Artificial Sequence
  Staphylococcal nuclease domain-containing protein 1 (665-673)
aucaccgacgaucugcacuucuacgug

SEQ ID NO: 53738 - RNA, 27 nt, Artificial Sequence
  Splicing factor 3A subunit 1 (52-60)
aucguggacaagaccgccagcuucguc

SEQ ID NO: 53739 - RNA, 33 nt, Artificial Sequence
  Probable JmjC domain-containing histone demethylation protein 2C (2276-2286)
aucgugcugcccgccggcgcucuccaccagguc

SEQ ID NO: 53740 - RNA, 27 nt, Artificial Sequence
  Aurora kinase B (242-250)
aagaucgccgacuucggcuggagcgug

SEQ ID NO: 53741 - RNA, 30 nt, Artificial Sequence
  DNA topoisomerase 2-alpha (83-92)
aagaucuucgacgagauucuggugaacgcc

SEQ ID NO: 53742 - RNA, 30 nt, Artificial Sequence
  Vam6/Vps39-like protein (471-480)
aagaucuucaccgaggaccugcccgaagug

SEQ ID NO: 53743 - RNA, 30 nt, Artificial Sequence; identical to SEQ ID NO: 29516
  B-Raf serine/threonine-protein (638-647)

SEQ ID NO: 53744 - RNA, 27 nt, Artificial Sequence
  Kelch-like protein 13 (131-139)
aagaucauugacuucauauacaccgcc

SEQ ID NO: 53745 - RNA, 27 nt, Artificial Sequence
  Interleukin-6 receptor subunit beta (362-370)
aagauccuggacuacgaggugacccuc

SEQ ID NO: 53746 - RNA, 27 nt, Artificial Sequence
  Ankyrin repeat domain-containing protein 17 (748-756)
aagauccuggaggaacuccagaaagug

SEQ ID NO: 53747 - RNA, 27 nt, Artificial Sequence
  Protein IWS1 homolog (639-647)
aagauccugcaggagcuccccagcgug

SEQ ID NO: 53748 - RNA, 27 nt, Artificial Sequence
  G2/M phase-specific E3 ubiquitin-protein ligase (105-113)
aagauccugagcgagcucuucaccgug

SEQ ID NO: 53749 - RNA, 27 nt, Artificial Sequence
  Adenomatous polyposis coli protein (1645-1653)
aagaucauggaccaggugcaacaggcc

SEQ ID NO: 53750 - RNA, 33 nt, Artificial Sequence
  Flotillin-2 (57-67)
aagaucaugaccgagaaagaacugcucgccgug

SEQ ID NO: 53751 - RNA, 27 nt, Artificial Sequence
  Calpastatin (416-424)
aagcuggccgcugcaaucagcgaggug

SEQ ID NO: 53752 - RNA, 33 nt, Artificial Sequence
  Transitional endoplasmic reticulum ATPase (17-27)
aagcuggccgacgauguggaccucgagcagguc

SEQ ID NO: 53753 - RNA, 30 nt, Artificial Sequence
  Cyclin-dependent kinase 9 (164-173)
aagcuggccgacuucggccucgcuagagca

SEQ ID NO: 53754 - RNA, 30 nt, Artificial Sequence
  E3 ubiquitin-protein ligase listerin (404-413)
aagcuggccgacaucagcauuaacuacgug

SEQ ID NO: 53755 - RNA, 27 nt, Artificial Sequence
  Guanosine-3',5'-bis(diphosphate) 3'-pyrophosphohydrolase MESH1 (119-127)
aagcuggccgacaaacucuacaaccuu

SEQ ID NO: 53756 - RNA, 27 nt, Artificial Sequence
  Protein PRR14L (1063-1071)
aagcuggccgagggcgugcucgacguc

SEQ ID NO: 53757 - RNA, 27 nt, Artificial Sequence
  MAP kinase-activated protein kinase 5 (452-460)
aagcuggccgagaucgugaaacagguc

SEQ ID NO: 53758 - RNA, 27 nt, Artificial Sequence
  Nck-associated protein 1 (12-20)
aagcuggccgagaaacucaccauccuu

SEQ ID NO: 53759 - RNA, 30 nt, Artificial Sequence
  Nuclear poreoprotein p62 (435-444)
aagcuggccgagaacaucgacgcucagcuc

SEQ ID NO: 53760 - RNA, 27 nt, Artificial Sequence
  FACT complex subunit SPT16 (216-224)
aagcuggccgagagcguggaaaaagcu

SEQ ID NO: 53761 - RNA, 27 nt, Artificial Sequence
  Transcription factor BTF3 (54-62)
aagcuggccaaacuccaggcucaagug

SEQ ID NO: 53762 - RNA, 27 nt, Artificial Sequence
  DNA excision repair protein ERCC-6-like (655-663)
aagcuggacgagcacaucgccuaccuc

SEQ ID NO: 53763 - RNA, 33 nt, Artificial Sequence
  DNA topoisomerase 2-alpha (278-288)
aagcuggacgagaccggcaacagccucaaagug

SEQ ID NO: 53764 - RNA, 33 nt, Artificial Sequence
  Kelch repeat and BTB domain-containing protein 4 (508-518)
aagcuggaccccgccaccagcgcugugacaguc

SEQ ID NO: 53765 - RNA, 27 nt, Artificial Sequence
  N-acetylneuraminate lyase (77-85)
aagcuggaccaggugaucauucacguc

SEQ ID NO: 53766 - RNA, 27 nt, Artificial Sequence
  DENN domain-containing protein 4C (705-713)
aagcuguucgacagaccccaggagcuc

SEQ ID NO: 53767 - RNA, 33 nt, Artificial Sequence
  DENN domain-containing protein 4C (705-715)
aagcuguucgacagaccccaggagcucaaacuu

SEQ ID NO: 53768 - RNA, 27 nt, Artificial Sequence
  Fatty acyl-CoA reductase 2 (63-71)
aagcuguucgagaaagugaaggaaguc

SEQ ID NO: 53769 - RNA, 27 nt, Artificial Sequence
  Putative homeodomain transcription factor 2 (586-594)
aagcuguucggccaccucaccagcgcc

SEQ ID NO: 53770 - RNA, 27 nt, Artificial Sequence
  28S ribosomal protein S33, mitochondrial (35-43)
aagcuguucagcgagcucccccuugcc

SEQ ID NO: 53771 - RNA, 27 nt, Artificial Sequence
  Hom s 1 (129-137)
aagcugggccucaaaccccuugaggug

SEQ ID NO: 53772 - RNA, 27 nt, Artificial Sequence
  AP-1 complex subunit beta-1 (147-155)
aagcugcacgacaucaacgcccagcuc

SEQ ID NO: 53773 - RNA, 30 nt, Artificial Sequence
  Guanine nucleotide-binding protein subunit beta-5 (32-41)
aagcugcacgacguggagcuccaucagguc

SEQ ID NO: 53774 - RNA, 27 nt, Artificial Sequence
  RNA-binding protein 4B (59-67)
aagcugcacggcgugaacaucaauguc

SEQ ID NO: 53775 - RNA, 30 nt, Artificial Sequence
  Zinc finger protein 143 (59-68)
aagcugaucgacggccaggugauucaacuc

SEQ ID NO: 53776 - RNA, 27 nt, Artificial Sequence
  cAMP-responsive element modulator (103-111)
aagcugaucgaggaacucgagacccuu

SEQ ID NO: 53777 - RNA, 30 nt, Artificial Sequence
  Elongation factor 2 (314-323)
aagcugaucgagaaacucgacauuaagcuu

SEQ ID NO: 53778 - RNA, 27 nt, Artificial Sequence
  WD repeat-containing protein 43 (416-424)
aagcugauccuccuuauuacccaggug

SEQ ID NO: 53779 - RNA, 27 nt, Artificial Sequence
  CTD small phosphatase-like protein 2 (434-442)
aagcugauccccuuccucgagaaacuu

SEQ ID NO: 53780 - RNA, 27 nt, Artificial Sequence
  Ras-related GTP-binding protein C (235-243)
aagcugaucccccagcucccuacccuu

SEQ ID NO: 53781 - RNA, 27 nt, Artificial Sequence
  DNA repair and recombination protein RAD54B (649-657)
aagcugcucgccgugauccacgagcuu

SEQ ID NO: 53782 - RNA, 39 nt, Artificial Sequence
  HIV Tat-specific factor 1 (199-211)
aagcugcucgacgaggaugaaaucagaggcuacaaacuu

SEQ ID NO: 53783 - RNA, 33 nt, Artificial Sequence
  Negative elongation factor A (255-265)
aagcugcucgacaucagcgagcuugauauggug

SEQ ID NO: 53784 - RNA, 27 nt, Artificial Sequence
  Integrator complex subunit 4 (341-349)
aagcugcucgaccuuaugcccagacug

SEQ ID NO: 53785 - RNA, 33 nt, Artificial Sequence
  Rho-associated protein kinase 1 (1093-1103)
aagcugcucgaccuuagcgauuccaccucugug

SEQ ID NO: 53786 - RNA, 27 nt, Artificial Sequence
  E3 ISG15-protein ligase HERC5 (795-803)
aagcugcucgaccagaugcccagccuu

SEQ ID NO: 53787 - RNA, 27 nt, Artificial Sequence
  T-complex protein 1 subunit eta (55-63)
aagcugcucgacgugguccaccccgcc

SEQ ID NO: 53788 - RNA, 27 nt, Artificial Sequence
  Renal cancer differentiation gene 1 protein (69-77)
aagcugcucgaggccaccagcgcugug

SEQ ID NO: 53789 - RNA, 30 nt, Artificial Sequence
  E3 ubiquitin-protein ligase UBR4 (335-344)
aagcugcucgaggaacagggcaucuuccuu

SEQ ID NO: 53790 - RNA, 36 nt, Artificial Sequence
  Prolyl 4-hydroxylase subunit alpha-1 (230-241)
aagcugcucgagcuugaccccgaacaccagagagcc

SEQ ID NO: 53791 - RNA, 30 nt, Artificial Sequence
  Archaemetzincin-2 (125-134)
aagcugcucgagcccgugccugucagcguu

SEQ ID NO: 53792 - RNA, 27 nt, Artificial Sequence
  EH domain-binding protein 1 (684-692)
aagcugcucgaggugcagccccaaguc

SEQ ID NO: 53793 - RNA, 27 nt, Artificial Sequence
  Hyaluronan mediated motility receptor (233-241)
aagcugcucgaguacaucgaagagauu

SEQ ID NO: 53794 - RNA, 27 nt, Artificial Sequence
  Conserved oligomeric Golgi complex subunit 5 (336-344)
aagcugauggaccacaucuacgccgug

SEQ ID NO: 53795 - RNA, 30 nt, Artificial Sequence
  Proliferating cell nuclear antigen (117-126)
aagcugauggaccucgauguggagcagcuu

SEQ ID NO: 53796 - RNA, 27 nt, Artificial Sequence
  Dolichyl-diphosphooligosaccharide-proteinosyltransferase subunit STT3A (289-297)
aagcugaacccccagcaauucgaggug

SEQ ID NO: 53797 - RNA, 27 nt, Artificial Sequence
  Ribosomal L1 domain-containing protein 1 (242-250)
aagcugcccgagaaaugggaaagcgug

SEQ ID NO: 53798 - RNA, 27 nt, Artificial Sequence
  Regulator of G-protein signaling 10 (129-137)
aagcugcaggaccaaaucuucaaccuc

SEQ ID NO: 53799 - RNA, 27 nt, Artificial Sequence
  Nesprin-2 (2292-2300)
aagcugcaggagcucgaaaacagacuu

SEQ ID NO: 53800 - RNA, 27 nt, Artificial Sequence
  Signal transducer and activator of transcription 1-alpha/beta (350-358)
aagcugcaggagcucaacuacaaucuu

SEQ ID NO: 53801 - RNA, 27 nt, Artificial Sequence
  Protein Jade-2 (282-290)
aagcugcaggagcaaaucuuccaccuc

SEQ ID NO: 53802 - RNA, 27 nt, Artificial Sequence
  DNA-directed RNA polymerase II subunit RPB3 (255-263)
aagcugagcgaccuccagacccaacuu

SEQ ID NO: 53803 - RNA, 27 nt, Artificial Sequence
  Probable tRNA N6-adenosine threonylcarbamoyltransferase (189-197)
aagcugguggagcuccccuacaccguc

SEQ ID NO: 53804 - RNA, 27 nt, Artificial Sequence
  Electron transfer flavoprotein subunit beta (147-155)
aagcuggugaaagaggucaucgccguu

SEQ ID NO: 53805 - RNA, 27 nt, Artificial Sequence
  Protein Mis18-alpha (218-226)
aagcugugggaggccgaaagcaaacuc

SEQ ID NO: 53806 - RNA, 27 nt, Artificial Sequence
  Phosphatidylinositol 4-kinase beta (788-796)
aagcuguacgacggcuuccaguaucuc

SEQ ID NO: 53807 - RNA, 27 nt, Artificial Sequence
  Cytochrome P450 20A1 (274-282)
aagcuguacgaggaaaucaaccaggug

SEQ ID NO: 53808 - RNA, 27 nt, Artificial Sequence
  Delta(24)-sterol reductase (287-295)
aagcuguacgagcagcaccaugugguc

SEQ ID NO: 53809 - RNA, 30 nt, Artificial Sequence
  Ectopic P granules protein 5 homolog (225-234)
aagcuguacccccagcucccugccgagauc

SEQ ID NO: 53810 - RNA, 27 nt, Artificial Sequence
  CCAAT/enhancer-binding protein zeta (211-219)
aagcuguaccagcacgagaucaaccuc

SEQ ID NO: 53811 - RNA, 39 nt, Artificial Sequence
  Stathmin (95-107)
aagauggccgaggaaaaacugacccacaagauggaggcu

SEQ ID NO: 53812 - RNA, 27 nt, Artificial Sequence
  MORF4 family-associated protein 1-like 1 (109-117)
aagauggccgagaugcugguggaacuc

SEQ ID NO: 53813 - RNA, 27 nt, Artificial Sequence
  ATP-binding cassette sub-family F member 3 (459-467)
aagaugcuggagaaacuccccgaacuu

SEQ ID NO: 53814 - RNA, 27 nt, Artificial Sequence
  Nodal modulator 3 (261-269)
aagaugauggacgugaccgucacaauc

SEQ ID NO: 53815 - RNA, 27 nt, Artificial Sequence
  Proteasome subunit beta type-2 (37-45)
aagaugagcgagaaaauccugcuccuu

SEQ ID NO: 53816 - RNA, 30 nt, Artificial Sequence
  cAMP-dependent protein kinase type I-beta regulatory subunit (244-253)
aagauguacgaggaauuccugagcaaagug

SEQ ID NO: 53817 - RNA, 27 nt, Artificial Sequence
  Rap1 GTPase-GDP dissociation stimulator 1 (67-75)
aagguggccaacaucauugcugagguc

SEQ ID NO: 53818 - RNA, 27 nt, Artificial Sequence
  Myosin light polypeptide 6 (69-77)
aaggugcuggacuucgagcacuuucuc

SEQ ID NO: 53819 - RNA, 27 nt, Artificial Sequence
  Probable E3 ubiquitin-protein ligase HERC4 (595-603)
aaggugcuggagauccuccacagaguc

SEQ ID NO: 53820 - RNA, 33 nt, Artificial Sequence
  Protein SON (298-308)
aaggugcuggagcccagcgaaacccucgucguu

SEQ ID NO: 53821 - RNA, 27 nt, Artificial Sequence
  Proteasome activator complex subunit 2 (145-153)
aaggugcuggagagagucaacgccguu

SEQ ID NO: 53822 - RNA, 27 nt, Artificial Sequence
  CCR4-NOT transcription complex subunit 1 (128-136)
aaggugcugggcaucgucguuggggug

SEQ ID NO: 53823 - RNA, 27 nt, Artificial Sequence
  Amyloid beta A4 protein (9-17)
cugcucgccgcuuggaccgcaagagcc

SEQ ID NO: 53824 - RNA, 27 nt, Artificial Sequence
  DNA fragmentation factor subunit beta (69-77)
cugcucgccgaccuucugcacaacgug

SEQ ID NO: 53825 - RNA, 27 nt, Artificial Sequence
  CREB-binding protein (653-661)
cugcucgccgagaagaucuacaaaauu

SEQ ID NO: 53826 - RNA, 27 nt, Artificial Sequence
  Nuclear autoantigenic sperm protein (243-251)
cugcucgccgagacccacuaccagcuu

SEQ ID NO: 53827 - RNA, 33 nt, Artificial Sequence
  SCAN domain-containing protein 1 (194-204)
cugcucgccauccuucccgaggcugcaagagcc

SEQ ID NO: 53828 - RNA, 27 nt, Artificial Sequence
  Cyclin-dependent kinase inhibitor 1C (103-111)
cugcucgcccccagaccuguggcuguc

SEQ ID NO: 53829 - RNA, 27 nt, Artificial Sequence
  Protein quaking (40-48)
cugcucgacgaggaaaucagcagagug

SEQ ID NO: 53830 - RNA, 24 nt, Artificial Sequence
  T-complex protein 1 subunit beta (219-226)
cugcucgacaagaaaaucggcgug

SEQ ID NO: 53831 - RNA, 33 nt, Artificial Sequence; identical to SEQ ID NO: 29604
  ERI1 exoribonuclease 3 (155-165)

SEQ ID NO: 53832 - RNA, 27 nt, Artificial Sequence
  Talin-1 (1761-1769)
cugcucgaccagaccaagacacuugcc

SEQ ID NO: 53833 - RNA, 27 nt, Artificial Sequence
  Cyclin-I (72-80)
cugcucgacagauuccuugccaccgug

SEQ ID NO: 53834 - RNA, 27 nt, Artificial Sequence
  Tight junction protein ZO-2 (821-829)
cugcucgacgugacccccaaggccguc

SEQ ID NO: 53835 - RNA, 27 nt, Artificial Sequence
  Exocyst complex component 4 (7-15)
cugcucuucgacaaguuuaacgccgug

SEQ ID NO: 53836 - RNA, 27 nt, Artificial Sequence
  Heterogeneous nuclear ribonucleoprotein M (229-237)
cugcucuucgacagacccaugcacgug

SEQ ID NO: 53837 - RNA, 30 nt, Artificial Sequence
  DNA-directed RNA polymerase II subunit RPB11-b1 (11-20)
cugcucuucgagggcgaaaagaucaccauu

SEQ ID NO: 53838 - RNA, 27 nt, Artificial Sequence
  Conserved oligomeric Golgi complex subunit 4 (51-59)
cugcucuucgagggcaucgccagaauu

SEQ ID NO: 53839 - RNA, 27 nt, Artificial Sequence
  Cip1-interacting zinc finger protein (83-91)
cugcucggccccccuccaguggggguc

SEQ ID NO: 53840 - RNA, 24 nt, Artificial Sequence
  Neuferricin (59-66)
cugcucggcagaguguacgacguc

SEQ ID NO: 53841 - RNA, 33 nt, Artificial Sequence
  Cyclin-dependent kinase 1 (134-144)
cugcucaucgacgauaagggcaccauuaaacuu

SEQ ID NO: 53842 - RNA, 27 nt, Artificial Sequence
  Nuclear pore complex protein Nup205 (248-256)
cugcucaucggccaccuugagagagug

SEQ ID NO: 53843 - RNA, 27 nt, Artificial Sequence
  RCC1 and BTB domain-containing protein 1 (125-133)
cugcucaucaagcagguggucgagguu

SEQ ID NO: 53844 - RNA, 36 nt, Artificial Sequence
  Histone H2B type 2-F (101-112)
cugcuccuucccggcgagcuggccaagcacgcugug

SEQ ID NO: 53845 - RNA, 27 nt, Artificial Sequence
  Eukaryotic translation initiation factor 3 subunit H (242-250)
cugcucauggacagaguggaugagaug

SEQ ID NO: 53846 - RNA, 27 nt, Artificial Sequence
  CDK5 regulatory subunit-associated protein 2 (1394-1402)
cugcucauggagcacauccaggaaauu

SEQ ID NO: 53847 - RNA, 27 nt, Artificial Sequence
  Zinc finger SWIM domain-containing protein 1 (234-242)
cugcucaacgacagaaucuggcuugcc

SEQ ID NO: 53848 - RNA, 27 nt, Artificial Sequence
  DNA-directed RNA polymerase II subunit RPB4 (32-40)
cugcucaacagcgaggugcacaugcuu

SEQ ID NO: 53849 - RNA, 27 nt, Artificial Sequence
  Rho guanine nucleotide exchange factor 2 (627-635)
cugcuccaggacgccaucagagaggug

SEQ ID NO: 53850 - RNA, 27 nt, Artificial Sequence
  Vam6/Vps39-like protein (218-226)
cugcuccaggacaagcaauucgagcuu

SEQ ID NO: 53851 - RNA, 27 nt, Artificial Sequence
  E3 ubiquitin-protein ligase TRIM37 (221-229)
cugcuccaggagguggaacaccaacuu

SEQ ID NO: 53852 - RNA, 27 nt, Artificial Sequence
  DEP domain-containing protein 1A (20-28)
cugcuccagccccaccuugagagagug

SEQ ID NO: 53853 - RNA, 27 nt, Artificial Sequence
  Small nuclear ribonucleoprotein Sm D1 (38-46)
cugcucguggacgucgagcccaagguu

SEQ ID NO: 53854 - RNA, 30 nt, Artificial Sequence
  Lipopolysaccharide-responsive and beige-like anchor protein (407-416)
cugcucuacgacggcaagcuuagcuccgcc

SEQ ID NO: 53855 - RNA, 33 nt, Artificial Sequence
  Electron transfer flavoprotein subunit alpha, mitochondrial (184-194)
cugcucuacgaccuugccgaucagcugcacgcu

SEQ ID NO: 53856 - RNA, 27 nt, Artificial Sequence
  Solute carrier family 43 member 3 (191-199)
cugcucuacgagaagggcaucagccuu

SEQ ID NO: 53857 - RNA, 30 nt, Artificial Sequence
  Integrin alpha-4 (42-51)
cugcucuaccagggcccccacaacacccuu

SEQ ID NO: 53858 - RNA, 30 nt, Artificial Sequence; identical to SEQ ID NO: 29631
  Uridine-cytidine kinase-like 1 (470-479)

SEQ ID NO: 53859 - RNA, 27 nt, Artificial Sequence
  KH domain-containing, RNA-binding, signal transduction-associated protein 1 (243-251)
cugauggcccacgcuauggaggaagug

SEQ ID NO: 53860 - RNA, 27 nt, Artificial Sequence
  Rho guanine nucleotide exchange factor 18 (267-275)
cugaugcagaccgaggugcaccauguc

SEQ ID NO: 53861 - RNA, 27 nt, Artificial Sequence
  Steroid receptor RNA activator 1 (183-191)
cugaugguggaccacgucaccgagguu

SEQ ID NO: 53862 - RNA, 30 nt, Artificial Sequence
  Cytochrome c oxidase subunit 7C, mitochondrial (54-63)
cugguggucagacaccagcuccuuaagacc

SEQ ID NO: 53863 - RNA, 27 nt, Artificial Sequence
  EH domain-containing protein 1 (385-393)
augcuggccaacgacaucgcuagacuc

SEQ ID NO: 53864 - RNA, 27 nt, Artificial Sequence
  Ubiquitin carboxyl-terminal hydrolase 11 (568-576)
augcuguucggccacccccuccuugug

SEQ ID NO: 53865 - RNA, 27 nt, Artificial Sequence
  Flotillin-1 (356-364)
augcugcucgagaagcuuccccaggug

SEQ ID NO: 53866 - RNA, 27 nt, Artificial Sequence
  Breast cancer type 1 susceptibility protein (1657-1665)
augcugaacgagcacgacuucgaagug

SEQ ID NO: 53867 - RNA, 27 nt, Artificial Sequence
  trim5alpha (75-83)
aacaucguggagaagcugagagaaguc

SEQ ID NO: 53868 - RNA, 27 nt, Artificial Sequence
  E3 ubiquitin-protein ligase TRIM22 (76-84)
aacaucguggagagagucaaggaaguu

SEQ ID NO: 53869 - RNA, 27 nt, Artificial Sequence
  Ral GTPase-activating protein subunit beta (190-198)
aaccuggccgagaagcucaucggcgug

SEQ ID NO: 53870 - RNA, 27 nt, Artificial Sequence
  F-box only protein 22 (24-32)
aaccuggccgagguggucgaaagaguu

SEQ ID NO: 53871 - RNA, 27 nt, Artificial Sequence
  Glycerol-3-phosphate dehydrogenase, mitochondrial (146-154)
aaccugcucgagaucgccccccaccuu

SEQ ID NO: 53872 - RNA, 27 nt, Artificial Sequence
  Propionyl-CoA carboxylase beta chain, mitochondrial (27-35)
aacaugguggacaucauucacagcguc

SEQ ID NO: 53873 - RNA, 27 nt, Artificial Sequence
  Transcription elongation factor SPT5 (558-566)
aacauguacggcaagguggucaccguu

SEQ ID NO: 53874 - RNA, 30 nt, Artificial Sequence
  Utrophin (2315-2324)
aaccagugggacggcacccaacacggggug

SEQ ID NO: 53875 - RNA, 39 nt, Artificial Sequence
  Melanocyte protein PMEL (45-57)
aacagacagcuguaccccgaguggaccgaagcccaaagg

SEQ ID NO: 53876 - RNA, 27 nt, Artificial Sequence
  60S ribosomal protein L35 (20-28)
cagcuggacgaucucaagguggagcuu

SEQ ID NO: 53877 - RNA, 27 nt, Artificial Sequence
  SNARE-associated protein Snapin (39-47)
cagcuggacagccacgugcaugccguc

SEQ ID NO: 53878 - RNA, 27 nt, Artificial Sequence
  Testis-expressed sequence 10 protein (575-583)
cagcugaucgacauuauacacaccgcc

SEQ ID NO: 53879 - RNA, 27 nt, Artificial Sequence
  SEC14-like protein 1 (559-567)
cagcugaucgacaagguguggcaacuc

SEQ ID NO: 53880 - RNA, 27 nt, Artificial Sequence
  Ethylmalonyl-CoA decarboxylase (79-87)
cagcugcucgagaaggugaucgaacuu

SEQ ID NO: 53881 - RNA, 27 nt, Artificial Sequence
  HEAT repeat-containing protein 2 (843-851)
cagcugcuccaacacgugcaggccguc

SEQ ID NO: 53882 - RNA, 27 nt, Artificial Sequence
  60S ribosomal protein L6 (267-275)
cagcugcaaggcuaccucagaagcgug

SEQ ID NO: 53883 - RNA, 27 nt, Artificial Sequence
  Mitochondrial dynamics protein MID51 (384-392)
cagcugaccaacgugauccuccaccuu

SEQ ID NO: 53884 - RNA, 27 nt, Artificial Sequence
  Casein kinase I isoform delta (111-119)
cagaugaucagcagaauugaguacaua

SEQ ID NO: 53885 - RNA, 33 nt, Artificial Sequence
  Zinc finger protein 131 (113-123)
cagaugcuggaggccaucaaggcucucgaagug

SEQ ID NO: 53886 - RNA, 27 nt, Artificial Sequence
  40S ribosomal protein S8 (77-85)
agaaucauugacguggucuacaacgcc

SEQ ID NO: 53887 - RNA, 33 nt, Artificial Sequence
  CCR4-NOT transcription complex subunit 1 (459-469)
agacuggccgaggugggccaguacgaacaaguc

SEQ ID NO: 53888 - RNA, 27 nt, Artificial Sequence
  DNA replication licensing factor MCM7 (164-172)
agacuggcccagcacaucaccuacgug

SEQ ID NO: 53889 - RNA, 27 nt, Artificial Sequence
  Vacuolar protein sorting-associated protein 53 homolog (74-82)
agacuggacgauaacaucaggaccgug

SEQ ID NO: 53890 - RNA, 33 nt, Artificial Sequence
  Putative sodium-coupled neutral amino acid transporter 10 (413-423)
agacugggcgaggccgaagggcucaugaaggug

SEQ ID NO: 53891 - RNA, 30 nt, Artificial Sequence
  Protein quaking (39-48)
agacugcucgacgaggaaaucagcagggug

SEQ ID NO: 53892 - RNA, 27 nt, Artificial Sequence
  CLIP-associating protein 1 (367-375)
agacugcucgacggcgccuucaagcuu

SEQ ID NO: 53893 - RNA, 27 nt, Artificial Sequence
  KN motif and ankyrin repeat domain-containing protein 2 (654-662)
agacugcucgacuacguggucaacauc

SEQ ID NO: 53894 - RNA, 33 nt, Artificial Sequence
  Pyridoxal-dependent decarboxylase domain-containing protein 1 (630-640)
agacugcucgaggaaggcgugcuuaggcagauc

SEQ ID NO: 53895 - RNA, 27 nt, Artificial Sequence
  Pinin (207-215)
agacugcucgagcagaagguggaacuu

SEQ ID NO: 53896 - RNA, 27 nt, Artificial Sequence
  E3 ubiquitin-protein ligase RNF213 (4648-4656)
agacugcuccaggagcaacaccagcuu

SEQ ID NO: 53897 - RNA, 27 nt, Artificial Sequence
  V-type proton ATPase subunit H (382-390)
agacugaacgagaagaauuacgaacuc

SEQ ID NO: 53898 - RNA, 27 nt, Artificial Sequence
  Cytospin-A (639-647)
agacugcaggacgccaucgcuaaggug

SEQ ID NO: 53899 - RNA, 30 nt, Artificial Sequence
  Ubiquitin-conjugating enzyme E2 A (15-24)
agacugcaggaggaccccccugccggcgug

SEQ ID NO: 53900 - RNA, 30 nt, Artificial Sequence
  Ubiquitin-conjugating enzyme E2 B (15-24)
agacugcaggaggaccccccugugggcguc

SEQ ID NO: 53901 - RNA, 27 nt, Artificial Sequence
  Inhibitor of nuclear factor kappa-B kinase-interacting protein (38-46)
agacugcaggaggaaaucaacgaggug

SEQ ID NO: 53902 - RNA, 27 nt, Artificial Sequence
  Double-strand-break repair protein rad21 homolog (450-458)
agacugcaggagagcgugauggaagcc

SEQ ID NO: 53903 - RNA, 30 nt, Artificial Sequence
  SHC SH2 domain-binding protein 1 (594-603)
agacugagcgagcucggcaucacccaggcc

SEQ ID NO: 53904 - RNA, 27 nt, Artificial Sequence
  PRA1 family protein 3 (178-186)
agacugaccgacuacaucagcaaggug

SEQ ID NO: 53905 - RNA, 27 nt, Artificial Sequence
  Eukaryotic translation initiation factor 3 subunit H (165-173)
agacugacccccaagcucauggaggug

SEQ ID NO: 53906 - RNA, 33 nt, Artificial Sequence
  Proliferating cell nuclear antigen (5-15)
agacuggugcagggcagcauccucaagaaaguc

SEQ ID NO: 53907 - RNA, 27 nt, Artificial Sequence
  DEP domain-containing protein 1B (15-23)
agacuguggaacgagaccguggaacuc

SEQ ID NO: 53908 - RNA, 27 nt, Artificial Sequence
  DNA damage-binding protein 1 (134-142)
agacuguacgacggccucuucaaggug

SEQ ID NO: 53909 - RNA, 36 nt, Artificial Sequence
  ATP-binding cassette sub-family B member 10, mitochondrial (542-553)
agacuguacgaccccgccagcggcaccaucucccuc

SEQ ID NO: 53910 - RNA, 27 nt, Artificial Sequence
  Serine/threonine-protein kinase Kist (287-295)
agaauguucgacggcaaguuugugguc

SEQ ID NO: 53911 - RNA, 30 nt, Artificial Sequence
  Serine/threonine-protein kinase Kist (287-296)
agaauguucgacggcaaguuuguggucgcc

SEQ ID NO: 53912 - RNA, 36 nt, Artificial Sequence
  Melanocyte protein PMEL (46-57)
agacagcuguaccccgaguggaccgaagcccaaagg

SEQ ID NO: 53913 - RNA, 42 nt, Artificial Sequence
  Melanocyte protein PMEL (46-59)
agacagcuguaccccgaguggaccgaagcccaaaggcucgac

SEQ ID NO: 53914 - RNA, 54 nt, Artificial Sequence
  Melanocyte protein PMEL (40-57)
agaaccaaggccuggaacaggcagcuguaccccgaguggacagaagcucaacgg

SEQ ID NO: 53915 - RNA, 33 nt, Artificial Sequence
  Aurora kinase B (360-370)
agagugcugcccccuagcgcccuccaguccguc

SEQ ID NO: 53916 - RNA, 27 nt, Artificial Sequence
  SHC-transforming protein 1 (255-263)
agagugcccccuccaccgcagagcguc

SEQ ID NO: 53917 - RNA, 27 nt, Artificial Sequence
  Serine/threonine-protein phosphatase PP1-gamma catalytic subunit (7-15)
agcaucauucagagacugcucgaggug

SEQ ID NO: 53918 - RNA, 27 nt, Artificial Sequence
  Eukaryotic translation initiation factor 2 subunit 1 (110-118)
agcauccugagacacguggccgagguc

SEQ ID NO: 53919 - RNA, 27 nt, Artificial Sequence
  Anaphase-promoting complex subunit 7 (276-284)
agccuggccgaccucuacuucagagcu

SEQ ID NO: 53920 - RNA, 27 nt, Artificial Sequence
  TATA-binding protein-associated factor 172 (784-792)
agccuggccgacgugcacaucgagguc

SEQ ID NO: 53921 - RNA, 27 nt, Artificial Sequence
  2'-5'-oligoadenylate synthase 3 (247-255)
agccuggccgagggccucagaaccgug

SEQ ID NO: 53922 - RNA, 27 nt, Artificial Sequence
  LisH domain-containing protein ARMC9 (400-408)
agccuggccgagggcagacucuaccuu

SEQ ID NO: 53923 - RNA, 27 nt, Artificial Sequence
  Ankyrin repeat and SOCS box protein 6 (353-361)
agccuggccgagaagauccaggcucuc

SEQ ID NO: 53924 - RNA, 30 nt, Artificial Sequence
  DNA polymerase epsilon catalytic subunit A (943-952)
agccuggccgagcucaagggcuucgaagug

SEQ ID NO: 53925 - RNA, 27 nt, Artificial Sequence
  Sestrin-1 (129-137)
agccuggccgagcucgugcacgcuguc

SEQ ID NO: 53926 - RNA, 30 nt, Artificial Sequence
  V-type proton ATPase catalytic subunit A (500-509)
agccuggccgagaccgacaagaucacacuc

SEQ ID NO: 53927 - RNA, 27 nt, Artificial Sequence
  Trinucleotide repeat-containing gene 6A protein (198-206)
agccuggcccacgagcucuggaaggug

SEQ ID NO: 53928 - RNA, 27 nt, Artificial Sequence
  TNFAIP3-interacting protein 2 (146-154)
agccuggccaacgagacccaccagcuc

SEQ ID NO: 53929 - RNA, 27 nt, Artificial Sequence
  Phosphatidylinositol 3-kinase regulatory subunit gamma (63-71)
agccuggcccaguacaaccccaagcuc

SEQ ID NO: 53930 - RNA, 27 nt, Artificial Sequence
  Baculoviral IAP repeat-containing protein 6 (1230-1238)
agccuggccucccuccuugcuaaggug

SEQ ID NO: 53931 - RNA, 27 nt, Artificial Sequence
  TELO2-interacting protein 1 homolog (380-388)
agccuggccaccucccuccccagacuu

SEQ ID NO: 53932 - RNA, 27 nt, Artificial Sequence
  Leucine-rich repeat and coiled-coil domain-containing protein 1 (37-45)
agccuggacuccacccuccacgccgug

SEQ ID NO: 53933 - RNA, 30 nt, Artificial Sequence
  Transmembrane emp24 domain-containing protein 9 (130-139)
agccuguucgccggcgggaugcucagagug

SEQ ID NO: 53934 - RNA, 30 nt, Artificial Sequence
  F-box/LRR-repeat protein 5 (73-82)
agccuguucgagaagggccucaaaaacgug

SEQ ID NO: 53935 - RNA, 27 nt, Artificial Sequence
  Programmed cell death 6-interacting protein (103-111)
agccuguucggcggguccgugaagcuc

SEQ ID NO: 53936 - RNA, 30 nt, Artificial Sequence
  Ribosome production factor 1 (265-274)
agccuguucccccacaacccucaguuuauc

SEQ ID NO: 53937 - RNA, 27 nt, Artificial Sequence
  Exostosin-2 (478-486)
agccuguucagagugaucaccgagguc

SEQ ID NO: 53938 - RNA, 24 nt, Artificial Sequence
  Bloom syndrome protein (853-860)
agccugggcaagguguucgggguc

SEQ ID NO: 53939 - RNA, 27 nt, Artificial Sequence
  U1 small nuclear ribonucleoprotein C (24-32)
agccugaucgacaagaccacagccgcu

SEQ ID NO: 53940 - RNA, 27 nt, Artificial Sequence
  AAC41999.1 (170-178)
agccugaucgagaagauucccaccgcc

SEQ ID NO: 53941 - RNA, 27 nt, Artificial Sequence
  Transcription factor RFX3 (374-382)
agccugaucgagaagcucuggcagacc

SEQ ID NO: 53942 - RNA, 27 nt, Artificial Sequence
  Importin subunit alpha-1 (490-498)
agccugaucgagaaguacuucuccgug

SEQ ID NO: 53943 - RNA, 27 nt, Artificial Sequence
  Ubiquitin carboxyl-terminal hydrolase 34 (1442-1450)
agccugauccagagacucauguccgug

SEQ ID NO: 53944 - RNA, 27 nt, Artificial Sequence
  Polymerase I and transcript release factor (56-64)
agccugcucgacaagaucauuggcgcc

SEQ ID NO: 53945 - RNA, 30 nt, Artificial Sequence
  Rho guanine nucleotide exchange factor 18 (642-651)
agccugcucgagaagcagcaaaucuaccuu

SEQ ID NO: 53946 - RNA, 27 nt, Artificial Sequence
  Mediator of RNA polymerase II transcription subunit 12 (1224-1232)
agccugcucgagaacaucgccaaggcu

SEQ ID NO: 53947 - RNA, 27 nt, Artificial Sequence
  Heterogeneous nuclear ribonucleoprotein C-like 1 (196-204)
agccugcucgagaaccuugaaaagauc

SEQ ID NO: 53948 - RNA, 27 nt, Artificial Sequence
  Serine/threonine-protein kinase ATR (549-557)
agccugcucgaguccgugcagaagcuu

SEQ ID NO: 53949 - RNA, 33 nt, Artificial Sequence
  Neurochondrin (337-347)
agccugcucaaggagccccagaaagugcaacuu

SEQ ID NO: 53950 - RNA, 30 nt, Artificial Sequence
  Adrenocortical dysplasia protein homolog (124-133)
agccugcuccccaccgagcagccuagacuu

SEQ ID NO: 53951 - RNA, 27 nt, Artificial Sequence
  Ran GTPase-activating protein 1 (579-587)
agccugcuccagacccuuuacaaggug

SEQ ID NO: 53952 - RNA, 27 nt, Artificial Sequence
  Arfaptin-2 (71-79)
agccugcuccagacccaacacgcccuu

SEQ ID NO: 53953 - RNA, 30 nt, Artificial Sequence
  Pericentrin (1754-1763)
agccugaugggccccgugguccacgagguu

SEQ ID NO: 53954 - RNA, 27 nt, Artificial Sequence
  Hermansky-Pudlak syndrome 4 protein (573-581)
agccugaacggccucgaggugcaccuu

SEQ ID NO: 53955 - RNA, 27 nt, Artificial Sequence
  Choline/ethanolamine kinase (86-94)
agccugcccgaccaccucccuuccgug

SEQ ID NO: 53956 - RNA, 27 nt, Artificial Sequence
  WD repeat-containing protein 3 (348-356)
agccugcaggacgagauccaaagagug

SEQ ID NO: 53957 - RNA, 27 nt, Artificial Sequence
  Peroxisomal membrane protein 4 (59-67)
agccugcaggagaagcucugggccauc

SEQ ID NO: 53958 - RNA, 27 nt, Artificial Sequence
  Dynactin subunit 1 (1169-1177)
agccuguccgacaccguggagaagcuc

SEQ ID NO: 53959 - RNA, 27 nt, Artificial Sequence
  AP-3 complex subunit mu-1 (219-227)
agccuguccuucaugaaccccagacuc

SEQ ID NO: 53960 - RNA, 27 nt, Artificial Sequence
  Alsin (755-763)
agccuguccucuuuccuccacggcgug

SEQ ID NO: 53961 - RNA, 27 nt, Artificial Sequence
  Eukaryotic translation initiation factor 3 subunit F (301-309)
agccuggugaaccagguccccaagauc

SEQ ID NO: 53962 - RNA, 27 nt, Artificial Sequence
  FACT complex subunit SSRP1 (309-317)
agccuguacgagaugguguccagaguc

SEQ ID NO: 53963 - RNA, 27 nt, Artificial Sequence
  Mediator of RNA polymerase II transcription subunit 12 (1349-1357)
agccuguacucccaggugcaccaaauc

SEQ ID NO: 53964 - RNA, 27 nt, Artificial Sequence
  RNA-binding protein 28 (53-61)
agcaugcuggaggacgugcagagagcc

SEQ ID NO: 53965 - RNA, 27 nt, Artificial Sequence
  Zinc finger MYM-type protein 3 (1346-1354)
agcaugcugaacagaauccucgccgug

SEQ ID NO: 53966 - RNA, 27 nt, Artificial Sequence
  RNA polymerase II-associated protein 1 (1333-1341)
agcaugcugcagaagaccuggcuccuu

SEQ ID NO: 53967 - RNA, 27 nt, Artificial Sequence
  General transcription factor 3C polypeptide 5 (74-82)
agcauguacgacaaggugcugaugcuc

SEQ ID NO: 53968 - RNA, 27 nt, Artificial Sequence
  EH domain-containing protein 4 (482-490)
agcgugcugggcaagaucuggaaacuc

SEQ ID NO: 53969 - RNA, 27 nt, Artificial Sequence
  Huntingtin (111-119)
acccuggccgcugcagugcccaagauc

SEQ ID NO: 53970 - RNA, 27 nt, Artificial Sequence
  Set1/Ash2 histone methyltransferase complex subunit ASH2 (512-520)
acccuggccgacgugcucuaccacguc

SEQ ID NO: 53971 - RNA, 30 nt, Artificial Sequence
  Non-POU domain-containing octamer-binding protein (31-40)
acccuggccgagaucgcuaagguggaacuc

SEQ ID NO: 53972 - RNA, 27 nt, Artificial Sequence
  Ancient ubiquitous protein 1 (365-373)
acccuggcccagagagugaaggagguc

SEQ ID NO: 53973 - RNA, 27 nt, Artificial Sequence
  Pre-mRNA-processing factor 40 homolog A (170-178)
acccuggacgccggcaacaucaagcuc

SEQ ID NO: 53974 - RNA, 27 nt, Artificial Sequence
  Coiled-coil domain-containing protein 93 (524-532)
acccuggacgauaagaaaguguaccuc

SEQ ID NO: 53975 - RNA, 27 nt, Artificial Sequence
  Probable ATP-dependent RNA helicase DDX27 (87-95)
acccuggacgagaagaucgaaaaagug

SEQ ID NO: 53976 - RNA, 27 nt, Artificial Sequence
  Nuclear respiratory factor 1 (118-126)
acccuggacgaguacacaacuagagug

SEQ ID NO: 53977 - RNA, 27 nt, Artificial Sequence
  Fanconi anemia group D2 protein (847-855)
acccuggacaucacaccccacacugug

SEQ ID NO: 53978 - RNA, 27 nt, Artificial Sequence
  E3 ubiquitin-protein ligase UHRF1 (57-65)
acccuguucgacuacgaggugagacuc

SEQ ID NO: 53979 - RNA, 27 nt, Artificial Sequence
  Staphylococcal nuclease domain-containing protein 1 (582-590)
acccuguucacaaaggagcucgugcuu

SEQ ID NO: 53980 - RNA, 33 nt, Artificial Sequence
  Dynamin-2 (133-143)
acccugaucgaccuccccggcauuacaaaggug

SEQ ID NO: 53981 - RNA, 27 nt, Artificial Sequence
  Cyclic AMP-dependent transcription factor ATF-1 (254-262)
acccugaucgaggaacucaagacacuu

SEQ ID NO: 53982 - RNA, 30 nt, Artificial Sequence
  Cleavage and polyadenylation specificity factor subunit 1 (348-357)
acccugaucacagacggcaugagaagcgug

SEQ ID NO: 53983 - RNA, 27 nt, Artificial Sequence
  Negative elongation factor C/D (294-302)
acccugcucgacagaauggugcaccuu

SEQ ID NO: 53984 - RNA, 30 nt, Artificial Sequence
  HEAT repeat-containing protein 5B (1620-1629)
acccugcucgacagccccuacgccagagug

SEQ ID NO: 53985 - RNA, 30 nt, Artificial Sequence
  NmrA-like family domain-containing protein 1 (23-32)
acccugcucgaggacggcacauucaaggug

SEQ ID NO: 53986 - RNA, 27 nt, Artificial Sequence
  Tetratricopeptide repeat protein 21B (311-319)
acccugcucgagagagccuucagccuu

SEQ ID NO: 53987 - RNA, 27 nt, Artificial Sequence
  Cell division cycle protein 27 homolog (544-552)
acccugcucggccacgaguucgugcuu

SEQ ID NO: 53988 - RNA, 27 nt, Artificial Sequence
  Coatomer subunit alpha (88-96)
acccugcucggccaccuugacuacauc

SEQ ID NO: 53989 - RNA, 27 nt, Artificial Sequence
  Inositol 1,4,5-trisphosphate receptor type 1 (2386-2394)
acccugcucaacgugaucaagagcguc

SEQ ID NO: 53990 - RNA, 27 nt, Artificial Sequence
  Perilipin-2 (327-335)
acccugcucagcaacauccagggcgug

SEQ ID NO: 53991 - RNA, 27 nt, Artificial Sequence
  V-type proton ATPase subunit C 1 (184-192)
acccugcucguggucguucccaagcuu

SEQ ID NO: 53992 - RNA, 27 nt, Artificial Sequence
  Protein NOXP20 (254-262)
acccugauggagagaacagugagccuc

SEQ ID NO: 53993 - RNA, 27 nt, Artificial Sequence
  CAD protein (639-647)
acccugaacgacagagaguaccagcuc

SEQ ID NO: 53994 - RNA, 27 nt, Artificial Sequence
  Short transient receptor potential channel 1 (45-53)
acccugaacgagaagcucuuccuucug

SEQ ID NO: 53995 - RNA, 27 nt, Artificial Sequence
  Pinin (7-15)
acccugcaggagcaacucgaaaaggcc

SEQ ID NO: 53996 - RNA, 27 nt, Artificial Sequence
  Mitochondrial import receptor subunit TOM22 homolog (35-43)
acccugagcgagagacucuggggccuu

SEQ ID NO: 53997 - RNA, 27 nt, Artificial Sequence
  AP-3 complex subunit mu-2 (219-227)
acccugagcuucaugaaccccagacuc

SEQ ID NO: 53998 - RNA, 27 nt, Artificial Sequence
  Splicing factor 3B subunit 3 (165-173)
acccugguguaccacgucguuggcgug

SEQ ID NO: 53999 - RNA, 33 nt, Artificial Sequence
  Malate dehydrogenase, mitochondrial (54-64)
acccuguacgacaucgcccacacacccggcgug

SEQ ID NO: 54000 - RNA, 27 nt, Artificial Sequence
  60S ribosomal protein L10a (9-17)
acccuguacgaggccgugagagaaguc

SEQ ID NO: 54001 - RNA, 33 nt, Artificial Sequence
  Quinone oxidoreductase (225-235)
accauggccaaggagagcuccaucauuggcgug

SEQ ID NO: 54002 - RNA, 27 nt, Artificial Sequence
  Dual specificity protein phosphatase 14 (92-100)
accguggccgacaagauccacagcguc

SEQ ID NO: 54003 - RNA, 27 nt, Artificial Sequence
  EH domain-containing protein 1 (479-487)
accgugcugggcaagaucuggaaacuc

SEQ ID NO: 54004 - RNA, 27 nt, Artificial Sequence
  Cell division cycle and apoptosis regulator protein 1 (1120-1128)
accgugauggacgagauccacacaguc

SEQ ID NO: 54005 - RNA, 27 nt, Artificial Sequence
  Protein PAT1 homolog 1 (459-467)
gugaucauugagaagaccuacagccug

SEQ ID NO: 54006 - RNA, 30 nt, Artificial Sequence
  Tropomyosin alpha-4 chain (134-143)
gugauccuggagggcgaacucgagagagcc

SEQ ID NO: 54007 - RNA, 27 nt, Artificial Sequence
  40S ribosomal protein S15a (6-14)
gugcuggccgacgcucucaagagcauc

SEQ ID NO: 54008 - RNA, 27 nt, Artificial Sequence
  Prefoldin subunit 4 (107-115)
gugcuggccgaccucaagguccagcuu

SEQ ID NO: 54009 - RNA, 27 nt, Artificial Sequence
  Neurobeachin-like protein 2 (65-73)
gugcuggccgagcagcuccaccaagcu

SEQ ID NO: 54010 - RNA, 30 nt, Artificial Sequence
  E3 ubiquitin-protein ligase RNF130 (74-83)
gugcuggccccccucccucuucacggcguc

SEQ ID NO: 54011 - RNA, 27 nt, Artificial Sequence
  Calmodulin-regulated spectrin-associated protein 1 (1065-1073)
gugcuggacgccagcgucaaggagguu

SEQ ID NO: 54012 - RNA, 27 nt, Artificial Sequence
  HEAT repeat-containing protein 3 (702-710)
gugcuggacaacgucaagaugaaucuc

SEQ ID NO: 54013 - RNA, 27 nt, Artificial Sequence
  Carbohydrate sulfotransferase 14 (134-142)
gugcuggacagcgucgauguuagacuc

SEQ ID NO: 54014 - RNA, 30 nt, Artificial Sequence
  Cytosolic carboxypeptidase 1 (592-601)
gugcuguucgagggcagaaccguccagcuc

SEQ ID NO: 54015 - RNA, 27 nt, Artificial Sequence
  Isochorismatase domain-containing protein 1 (143-151)
gugcuguucggcgucgagacccacguu

SEQ ID NO: 54016 - RNA, 27 nt, Artificial Sequence
  Rab GTPase-activating protein 1-like (129-137)
gugcuguucaacaagcucaccuaccuu

SEQ ID NO: 54017 - RNA, 27 nt, Artificial Sequence
  Sorting nexin-5 (197-205)
gugcuguucaccggcgucaaggagguu

SEQ ID NO: 54018 - RNA, 33 nt, Artificial Sequence
  Centrosomal protein of 76 kDa (112-122)
gugcugggcgggaaggccuuccucgagcaccuu

SEQ ID NO: 54019 - RNA, 27 nt, Artificial Sequence
  Exportin-1 (784-792)
gugcugaucgacuaccagagaaacguc

SEQ ID NO: 54020 - RNA, 27 nt, Artificial Sequence
  ORM1-like protein 3 (134-142)
gugcugauccccaagcucccucagcuu

SEQ ID NO: 54021 - RNA, 27 nt, Artificial Sequence
  von Willebrand factor A domain-containing protein 8 (511-519)
gugcugcucgacggcauccacagaguc

SEQ ID NO: 54022 - RNA, 36 nt, Artificial Sequence
  Asparagine synthetase (glutamine-hydrolyzing) (41-52)
gugcugcucgacaccgccaacaagaaagucuuccuu

SEQ ID NO: 54023 - RNA, 39 nt, Artificial Sequence
  Ras-related protein Rab-5A (24-36)
gugcugcucggcgagagcgccgucgggaaguccucucuu

SEQ ID NO: 54024 - RNA, 27 nt, Artificial Sequence
  MAU2 chromatid cohesion factor homolog (356-364)
gugcugcucggccacaucuucuacguc

SEQ ID NO: 54025 - RNA, 27 nt, Artificial Sequence
  Kelch-like protein 24 (404-412)
gugcugcucggcaaggucuacguugug

SEQ ID NO: 54026 - RNA, 30 nt, Artificial Sequence
  Protein FAM171B (19-28)
gugcugcucaaggccagacuuguccccgcu

SEQ ID NO: 54027 - RNA, 33 nt, Artificial Sequence
  Anamorsin (98-108)
gugcugcucagcgacuccaaccuucacgaugcc

SEQ ID NO: 54028 - RNA, 27 nt, Artificial Sequence
  Protein yippee-like 1 (66-74)
gugcugcucaccggccuucacgccguc

SEQ ID NO: 54029 - RNA, 27 nt, Artificial Sequence
  Inhibitor of nuclear factor kappa-B kinase subunit alpha (271-279)
gugcugauggaccacauccucaaccuu

SEQ ID NO: 54030 - RNA, 27 nt, Artificial Sequence
  Probable ATP-dependent RNA helicase DDX56 (130-138)
gugcugauggagaagcccgacgucguu

SEQ ID NO: 54031 - RNA, 27 nt, Artificial Sequence
  Uncharacterized protein C18orf8 (434-442)
gugcugauggaguacaucagaagccuc

SEQ ID NO: 54032 - RNA, 27 nt, Artificial Sequence
  Protein LLP homolog (39-47)
gugcugaugaaggacguccaggagauc

SEQ ID NO: 54033 - RNA, 30 nt, Artificial Sequence
  Cyclin-dependent kinase 1 (69-78)
gugcugaugcaggacagcagacucuaccuu

SEQ ID NO: 54034 - RNA, 27 nt, Artificial Sequence
  AP-2 complex subunit sigma (90-98)
gugcugaacgaguacuuccacaauguc

SEQ ID NO: 54035 - RNA, 27 nt, Artificial Sequence
  Maestro heat-like repeat-containing protein family member 1 (1078-1086)
gugcugcaggagaagguccccgaaauc

SEQ ID NO: 54036 - RNA, 30 nt, Artificial Sequence
  Nucleolar protein 9 (544-553)
gugcugcagaaccucaagggccaauacguc

SEQ ID NO: 54037 - RNA, 27 nt, Artificial Sequence
  High mobility group protein 20A (167-175)
gugcugcagcaacaccucgagacccuu

SEQ ID NO: 54038 - RNA, 27 nt, Artificial Sequence
  HLA class II histocompatibility antigen, DR beta 3 chain (2-10)
gugcugagcuccagacucgccuucgcu

SEQ ID NO: 54039 - RNA, 27 nt, Artificial Sequence
  Importin-9 (169-177)
gugcugaccgaguucacaagagaaguc

SEQ ID NO: 54040 - RNA, 27 nt, Artificial Sequence
  Protein asunder homolog (229-237)
gugcugaccagcgagguccacuccguu

SEQ ID NO: 54041 - RNA, 27 nt, Artificial Sequence
  ELAV-like protein 1 (137-145)
gugcuggucgaccagaccacaggccuc

SEQ ID NO: 54042 - RNA, 27 nt, Artificial Sequence
  Ribonuclease UK114 (25-33)
gugcuggucgacagaaccaucuacauu

SEQ ID NO: 54043 - RNA, 33 nt, Artificial Sequence
  Zinc finger BED domain-containing protein 1 (374-384)
gugcuggucgaggacagcaacaaucaccaucuc

SEQ ID NO: 54044 - RNA, 27 nt, Artificial Sequence
  Tyrosine-protein kinase JAK1 (997-1005)
gugcuggucgagagcgaacaccagguu

SEQ ID NO: 54045 - RNA, 27 nt, Artificial Sequence
  Signal transducer and activator of transcription 1-alpha/beta (300-308)
gugcugugggacagaaccuucagccuc

SEQ ID NO: 54046 - RNA, 27 nt, Artificial Sequence
  Mediator of RNA polymerase II transcription subunit 12 (571-579)
gugcuguacgaccagcccagacacguc

SEQ ID NO: 54047 - RNA, 27 nt, Artificial Sequence
  Putative RNA-binding protein 15 (219-227)
gugcuguacgacagaccccucaagauc

SEQ ID NO: 54048 - RNA, 27 nt, Artificial Sequence
  AKT-interacting protein (200-208)
gugcuguacgagaaggacauccagcuc

SEQ ID NO: 54049 - RNA, 27 nt, Artificial Sequence
  Werner syndrome ATP-dependent helicase (1155-1163)
gugcuguacggcaagcucgucgaggcc

SEQ ID NO: 54050 - RNA, 27 nt, Artificial Sequence
  Set1/Ash2 histone methyltransferase complex subunit ASH2 (516-524)
gugcuguaccacgucgagaccgaaguu

SEQ ID NO: 54051 - RNA, 30 nt, Artificial Sequence
  Protein downstream neighbor of Son (395-404)
gugcuguacccccacgagccuaccgccguc

SEQ ID NO: 54052 - RNA, 27 nt, Artificial Sequence
  Protein artemis (131-139)
gugcuguacaccggcgacuucagacuc

SEQ ID NO: 54053 - RNA, 27 nt, Artificial Sequence
  Anaphase-promoting complex subunit 1 (498-506)
gugcuguacaccggcgucguuagagug

SEQ ID NO: 54054 - RNA, 30 nt, Artificial Sequence
  Adenosylhomocysteinase 2 (277-286)
gugauguucggcgggaagcaggucguugug

SEQ ID NO: 54055 - RNA, 27 nt, Artificial Sequence
  Ligand-dependent nuclear receptor-interacting factor 1 (358-366)
gugauguucaacggcaaggucuaccug

SEQ ID NO: 54056 - RNA, 24 nt, Artificial Sequence
  Kelch-like protein 8 (201-208)
gugaugggcaagaucuucgccguc

SEQ ID NO: 54057 - RNA, 30 nt, Artificial Sequence
  Adenosylhomocysteinase (209-218)
gugaugaucgccggcaaggucgcuguugug

SEQ ID NO: 54058 - RNA, 27 nt, Artificial Sequence
  Cullin-2 (25-33)
gugaugcuggaguacgucgaaagagcc

SEQ ID NO: 54059 - RNA, 27 nt, Artificial Sequence
  DNA-directed RNA polymerases I, II, and III subunit RPABC3 (55-63)
gugauguacggcaaggucuauagaauc

SEQ ID NO: 54060 - RNA, 27 nt, Artificial Sequence
  Cytoskeleton-associated protein 5 (1001-1009)
uggcuggccgagaagcuccccacccuu

SEQ ID NO: 54061 - RNA, 27 nt, Artificial Sequence
  Transcription factor 25 (392-400)
uggcuggaggaaaacgugcacgagguc

SEQ ID NO: 54062 - RNA, 33 nt, Artificial Sequence
  Nuclear migration protein nudC (184-194)
uggcugaucgaggacggcaagguggucaccguu

SEQ ID NO: 54063 - RNA, 27 nt, Artificial Sequence
  Serine/threonine-protein phosphatase 2A 65 kDa regulatory subunit A alpha isoform isoform X1 (271-279)
uggcugguggaccacgucuacgccauc

SEQ ID NO: 54064 - RNA, 42 nt, Artificial Sequence
  Melanocyte protein PMEL (44-57)
uggaacagacagcuguaccccgaguggaccgaagcccaaagg

SEQ ID NO: 54065 - RNA, 30 nt, Artificial Sequence
  Helicase-like transcription factor (121-130)
uacaucauggacaacaagcuggcccagauu

SEQ ID NO: 54066 - RNA, 27 nt, Artificial Sequence
  Unconventional myosin-If (18-26)
uacaucaugagcuauauuuccagagug

SEQ ID NO: 54067 - RNA, 27 nt, Artificial Sequence
  CCR4-NOT transcription complex subunit 1 (237-245)
uaccuggcccccuuccucagaaacgug

SEQ ID NO: 54068 - RNA, 27 nt, Artificial Sequence
  COP9 signalosome complex subunit 1 (357-365)
uaccuggccccccacgugagaacccuc

SEQ ID NO: 54069 - RNA, 27 nt, Artificial Sequence
  Nucleoprotein TPR (422-430)
uaccuggacgagaucgugaaggaaguc

SEQ ID NO: 54070 - RNA, 27 nt, Artificial Sequence
  Tuberin (190-198)
uaccuggacgaguauaucgccagaaug

SEQ ID NO: 54071 - RNA, 27 nt, Artificial Sequence
  Neutral alpha-glucosidase C (478-486)
uaccuggacuucaccaaccccaaggug

SEQ ID NO: 54072 - RNA, 27 nt, Artificial Sequence
  Protein flightless-1 homolog (154-162)
uaccuggaccucagcgagaacagacuu

SEQ ID NO: 54073 - RNA, 27 nt, Artificial Sequence
  UPF0585 protein C16orf13 (21-29)
uaccuggaccccgcccagagaggcgug

SEQ ID NO: 54074 - RNA, 27 nt, Artificial Sequence
  BTB/POZ domain-containing protein KCTD3 (224-232)
uaccuggacuggaccaucgagagagug

SEQ ID NO: 54075 - RNA, 27 nt, Artificial Sequence
  DBF4-type zinc finger-containing protein 2 (1397-1405)
uaccuggaggacaagagcuauaaacuc

SEQ ID NO: 54076 - RNA, 27 nt, Artificial Sequence
  NADH dehydrogenase (ubiquinone) iron-sulfur protein 8, mitochondrial (74-82)
uaccuguucagagagcccgccaccauc

SEQ ID NO: 54077 - RNA, 27 nt, Artificial Sequence
  Protein unc-50 homolog (55-63)
uaccuguucaccagcccccagagagug

SEQ ID NO: 54078 - RNA, 27 nt, Artificial Sequence
  Vacuole membrane protein 1 (137-145)
uaccugggcccccacaucgccagcgug

SEQ ID NO: 54079 - RNA, 24 nt, Artificial Sequence
  SUMO-activating enzyme subunit 2 (164-171)
uaccugggccaggugaccacaauc

SEQ ID NO: 54080 - RNA, 27 nt, Artificial Sequence
  Mitotic checkpoint serine/threonine-protein kinase BUB1 beta (141-149)
uaccugcacaaccagggcaucggggug

SEQ ID NO: 54081 - RNA, 33 nt, Artificial Sequence
  EKC/KEOPS complex subunit TPRKB (121-131)
uaccugaucagccagguggagggccaccaaguc

SEQ ID NO: 54082 - RNA, 27 nt, Artificial Sequence
  Myosin-10 (264-272)
uaccugcucgagaagagcagagccgug

SEQ ID NO: 54083 - RNA, 33 nt, Artificial Sequence
  Cyclin-D1-binding protein 1 (104-114)
uaccugcuccccaaggaccagggcaucacccuu

SEQ ID NO: 54084 - RNA, 30 nt, Artificial Sequence
  PRKC apoptosis WT1 regulator protein (215-224)
uaccugcuccaggagcccccuagaaccgug

SEQ ID NO: 54085 - RNA, 27 nt, Artificial Sequence
  Probable methyltransferase TARBP1 (286-294)
uaccugcuccagagagccguggagguc

SEQ ID NO: 54086 - RNA, 30 nt, Artificial Sequence
  E3 ubiquitin-protein ligase HUWE1 (1351-1360)
uaccugcucacccaccccccuccaaucaug

SEQ ID NO: 54087 - RNA, 30 nt, Artificial Sequence
  26S proteasome non-ATPase regulatory subunit 8 (142-151)
uaccugauggagggcagcuauaacaaggug

SEQ ID NO: 54088 - RNA, 27 nt, Artificial Sequence
  Leucine-tRNA ligase, cytoplasmic (901-909)
uaccugauggaggugacccacgaccuc

SEQ ID NO: 54089 - RNA, 27 nt, Artificial Sequence
  Striatin-interacting protein 2 (207-215)
uaccugaugguggagaacaucagacuc

SEQ ID NO: 54090 - RNA, 27 nt, Artificial Sequence
  Zinc finger protein Pegasus (211-219)
uaccugaacgacuucacccacgagauc

SEQ ID NO: 54091 - RNA, 27 nt, Artificial Sequence
  A-kinase anchor protein 10, mitochondrial (504-512)
uaccugaacgaccucauccacagcgug

SEQ ID NO: 54092 - RNA, 27 nt, Artificial Sequence
  RNA polymerase II subunit A C-terminal domain phosphatase (611-619)
uaccugaacaaggagaucgaagaggcc

SEQ ID NO: 54093 - RNA, 27 nt, Artificial Sequence
  DNA repair protein complementing XP-G cells (242-250)
uaccugaaccagcacaucgagcaugug

SEQ ID NO: 54094 - RNA, 33 nt, Artificial Sequence
  Protein phosphatase 1G (74-84)
uaccugcccgacaucauuaaggaucagaaagcc

SEQ ID NO: 54095 - RNA, 27 nt, Artificial Sequence
  Interleukin-1 receptor-associated kinase-like 2 (381-389)
uaccugcccgaggacuucaucagagug

SEQ ID NO: 54096 - RNA, 27 nt, Artificial Sequence
  Dual specificity protein kinase CLK2 (259-267)
uaccugcccuauccuauccaccaggug

SEQ ID NO: 54097 - RNA, 27 nt, Artificial Sequence
  Sterol regulatory element-binding protein 2 (379-387)
uaccugcagcaagugaaccacaagcuc

SEQ ID NO: 54098 - RNA, 27 nt, Artificial Sequence
  Actin-related protein 2/3 complex subunit 4 (8-16)
uaccugagcgccgugagagcuacccuc

SEQ ID NO: 54099 - RNA, 27 nt, Artificial Sequence
  Hsp90 co-chaperone Cdc37 (174-182)
uaccugagcgacaacgugcaccucguc

SEQ ID NO: 54100 - RNA, 27 nt, Artificial Sequence
  Replication factor C subunit 5 (157-165)
uaccugagcaagaucauucccgcccuc

SEQ ID NO: 54101 - RNA, 27 nt, Artificial Sequence
  SLC45A3-BRAF fusion protein (236-244)
uaccugagccccgaccucuccaaggug

SEQ ID NO: 54102 - RNA, 27 nt, Artificial Sequence
  THO complex subunit 5 homolog (225-233)
uaccugagcucccuccagcccagacuu

SEQ ID NO: 54103 - RNA, 27 nt, Artificial Sequence
  Histone deacetylase 3 (183-191)
uaccugaccgacagagugaugacaguc

SEQ ID NO: 54104 - RNA, 30 nt, Artificial Sequence
  40S ribosomal protein S10 (70-79)
uaccugaccaacgagggcauccaguaucuc

SEQ ID NO: 54105 - RNA, 27 nt, Artificial Sequence
  Heat shock protein HSP 90-alpha (142-150)
uaccugguggccgagaaggucaccguu

SEQ ID NO: 54106 - RNA, 27 nt, Artificial Sequence
  Protein unc-93 homolog B1 (246-254)
uaccuguaugaccucaaccacacccuu

SEQ ID NO: 54107 - RNA, 27 nt, Artificial Sequence
  Sodium- and chloride-dependent taurine transporter (277-285)
uaccuguaucccgacaucaccagacuc

SEQ ID NO: 54108 - RNA, 27 nt, Artificial Sequence
  Cullin-7 (1355-1363)
uacauggccgacagacugcucggcgug

SEQ ID NO: 54109 - RNA, 27 nt, Artificial Sequence
  Kinetochore-associated protein 1 (1575-1583)
uacaugcuggagcacgugaucacccuc

SEQ ID NO: 54110 - RNA, 27 nt, Artificial Sequence
  Elongation of very long chain fatty acids protein 1 (200-208)
uaccaguaucccgugaucauucaccug

SEQ ID NO: 54111 - RNA, 27 nt, Artificial Sequence
  Histone deacetylase 1 (188-196)
uacaccacagacagagugaugacuguc

SEQ ID NO: 54112 - RNA, 30 nt, Artificial Sequence
  Syntaxin-binding protein 5 (234-243)
uacaccuaugacgaggccauccacagcgug

SEQ ID NO: 54113 - RNA, 27 nt, Artificial Sequence
  Speriolin-like protein (56-64)
uacguguuccccggcgucaccagacug

SEQ ID NO: 54114 - RNA, 33 nt, Artificial Sequence
  Plectin (3961-3971)
uacgugaucgaccccauuaagggccugaaacuc

SEQ ID NO: 54115 - RNA, 27 nt, Artificial Sequence
  Erythroid differentiation-related factor 1 (607-615)
uacgugcuggagggccucaagagcguc

SEQ ID NO: 54116 - RNA, 27 nt, Artificial Sequence
  Translation initiation factor eIF-2B subunit delta (413-421)
uacgugcugcccgaggucagcaagguu

SEQ ID NO: 54117 - RNA, 45 nt, Artificial Sequence
  Vimentin (452-466)
ggccaggugaucaacgagaccagccaacaccaugacgaucuggaa

SEQ ID NO: 54118 - RNA, 27 nt, Artificial Sequence
  Ubiquitin-conjugating enzyme E2 J2 (121-129)
uucaugguggagaagggccccacccug

SEQ ID NO: 54119 - RNA, 27 nt, Artificial Sequence
  26S proteasome non-ATPase regulatory subunit 3 (216-224)
agaguguacgaguuccuggacaagcuc

SEQ ID NO: 54120 - RNA, 27 nt, Artificial Sequence
  E3 ubiquitin-protein ligase Hakai (341-349)
gcccccccuccaccgcccccuccaccc

SEQ ID NO: 54121 - RNA, 27 nt, Artificial Sequence
  Farnesyl pyrophosphate synthase (36-44)
gccagacugaaggaggugcucgaauac

SEQ ID NO: 54122 - RNA, 27 nt, Artificial Sequence
  Annexin A5 (92-100)
gacgccuacgagcugaagcacgcucuc

SEQ ID NO: 54123 - RNA, 27 nt, Artificial Sequence
  cAMP-dependent protein kinase catalytic subunit alpha (34-42)
gaccaguucgagagaaucaagacccug

SEQ ID NO: 54124 - RNA, 27 nt, Artificial Sequence
  Cytochrome c (90-98)
gaggaaagagccgaccugaucgcuuac

SEQ ID NO: 54125 - RNA, 27 nt, Artificial Sequence
  T-complex protein 1 subunit theta (418-426)
gagcuggccaagcagaucaccagcuac

SEQ ID NO: 54126 - RNA, 27 nt, Artificial Sequence
  COMM domain-containing protein 2 (116-124)
gagcuggcccccagccucccuuccuac

SEQ ID NO: 54127 - RNA, 27 nt, Artificial Sequence
  Akirin-1 (166-174)
gagcaguacgaaagcuucgugaaguuu

SEQ ID NO: 54128 - RNA, 24 nt, Artificial Sequence
  U5 small nuclear ribonucleoprotein 200 kDa helicase (1231-1238)
gaggugauccugcaccaugaauac

SEQ ID NO: 54129 - RNA, 27 nt, Artificial Sequence
  ORM1-like protein 1 (9-17)
gaggugaaccccaauaccagagucaug

SEQ ID NO: 54130 - RNA, 27 nt, Artificial Sequence
  Proteasome subunit alpha type-5 (125-133)
gagguguaccacaagagcaugacccug

SEQ ID NO: 54131 - RNA, 27 nt, Artificial Sequence
  Transcription factor 25 (248-256)
uucgccuuugagcacagcgaagaguac

SEQ ID NO: 54132 - RNA, 27 nt, Artificial Sequence
  Septin-6 (154-162)
uucaucgcccccaccggccacagccug

SEQ ID NO: 54133 - RNA, 27 nt, Artificial Sequence
  Sodium channel and clathrin linker 1 (55-63)
uuccuggccccccucgugaccgaguac

SEQ ID NO: 54134 - RNA, 27 nt, Artificial Sequence
  Tetratricopeptide repeat protein 14 (257-265)
uucgugaaccccggcgucguugaguuu

SEQ ID NO: 54135 - RNA, 27 nt, Artificial Sequence
  Structural maintenance of chromosomes protein 4 (524-532)
ggcagaauccccgggauuuacggaagg

SEQ ID NO: 54136 - RNA, 30 nt, Artificial Sequence
  BCL-6 corepressor (860-869)
ggcagaaucagcgacuuccacgagaccuac

SEQ ID NO: 54137 - RNA, 27 nt, Artificial Sequence
  NEDD8-activating enzyme E1 regulatory subunit (434-442)
ggcagauaccccggggugagcaacuau

SEQ ID NO: 54138 - RNA, 27 nt, Artificial Sequence
  RANBP2-like and GRIP domain-containing protein 2 (188-196)
cacgaggccgaaagaaacaucgcucug

SEQ ID NO: 54139 - RNA, 27 nt, Artificial Sequence
  Heterogeneous nuclear ribonucleoprotein L (348-356)
caccccccuccaccgcccccuccaccc

SEQ ID NO: 54140 - RNA, 30 nt, Artificial Sequence
  Nodal modulator 3 (227-236)
cacagauucgagcaggccuuuuacaccuau

SEQ ID NO: 54141 - RNA, 27 nt, Artificial Sequence
  Mediator of RNA polymerase II transcription subunit 19 (27-35)
aagcccccuccaccgcccccuccaccc

SEQ ID NO: 54142 - RNA, 27 nt, Artificial Sequence
  Afadin (1323-1331)
cugcccccuccaccgcccccuccaccc

SEQ ID NO: 54143 - RNA, 27 nt, Artificial Sequence
  Tubulin beta-2A chain (233-241)
cugagauuccccggccagcucaacgcc

SEQ ID NO: 54144 - RNA, 27 nt, Artificial Sequence
  Keratinocyte-associated protein 2 (1-9)
augguggucggcaccgggacaagccug

SEQ ID NO: 54145 - RNA, 27 nt, Artificial Sequence
  Heat shock protein HSP 90-beta (28-36)
aacccccaggagagaacccugacacuc

SEQ ID NO: 54146 - RNA, 27 nt, Artificial Sequence
  N-alpha-acetyltransferase 50 (23-31)
aaccaggugaucuuccccgucagcuac

SEQ ID NO: 54147 - RNA, 27 nt, Artificial Sequence
  Origin recognition complex subunit 1 (665-673)
aacagagugagcuccaggcugggccuc

SEQ ID NO: 54148 - RNA, 27 nt, Artificial Sequence
  Alanine-tRNA ligase, cytoplasmic (55-63)
aacaccaucgaccccagccacccuaug

SEQ ID NO: 54149 - RNA, 27 nt, Artificial Sequence
  Histone H4 (34-42)
aacgugaucagagacgccgucaccuac

SEQ ID NO: 54150 - RNA, 27 nt, Artificial Sequence
  Anaphase-promoting complex subunit 7 (184-192)
caggagagacccagcgugaccuccuac

SEQ ID NO: 54151 - RNA, 27 nt, Artificial Sequence
  Syntaxin-binding protein 2 (143-151)
agccuggacgccccccacuccaccuac

SEQ ID NO: 54152 - RNA, 27 nt, Artificial Sequence
  Fructose-bisphosphate aldolase A (356-364)
agccuguucguguccaaccacgccuac

SEQ ID NO: 54153 - RNA, 27 nt, Artificial Sequence
  Abl interactor 1 (398-406)
agccccccuccaccgcccccuccaccc

SEQ ID NO: 54154 - RNA, 27 nt, Artificial Sequence
  T-complex protein 1 subunit eta (208-216)
agccagcugguggccggcgucgcuuuc

SEQ ID NO: 54155 - RNA, 27 nt, Artificial Sequence
  FERM domain-containing protein 4A (824-832)
agccagucccaacccucuucacaguac

SEQ ID NO: 54156 - RNA, 27 nt, Artificial Sequence
  60S ribosome subunit biogenesis protein NIP7 homolog (126-134)
agccaguaccaaggcguggucguuuau

SEQ ID NO: 54157 - RNA, 24 nt, Artificial Sequence
  Dolichol-phosphate mannosyltransferase subunit 3 (78-85)
gugggcuacagagucgccaccuuc

SEQ ID NO: 54158 - RNA, 27 nt, Artificial Sequence
  Protein enabled homolog (379-387)
gugcccccuccaccgcccccuccaccc

SEQ ID NO: 54159 - RNA, 27 nt, Artificial Sequence
  Endoplasmin (727-735)
uaccugcuccccgacaccaaggccuau

SEQ ID NO: 54160 - RNA, 27 nt, Artificial Sequence
  Elongation factor 2 (489-497)
gagcacgcccauaacaugagagugaug

SEQ ID NO: 54161 - RNA, 27 nt, Artificial Sequence
  T-complex protein 1 subunit eta (282-290)
caccauagcggcgccaaggugguccug

SEQ ID NO: 54162 - RNA, 30 nt, Artificial Sequence
  60S ribosomal protein L8 (49-58)
auccacgaccccggcagaggggccccucug

SEQ ID NO: 54163 - RNA, 33 nt, Artificial Sequence
  Heat shock protein HSP 90-beta (441-451)
auccacgaggacagcaccaacagaaggcggcug

SEQ ID NO: 54164 - RNA, 27 nt, Artificial Sequence
  F-actin-capping protein subunit beta (235-243)
aagaccaaagacaucgugaacggccug

SEQ ID NO: 54165 - RNA, 27 nt, Artificial Sequence
  Transcription activator BRG1 (899-907)
acccacuacguggcccccagaaggcug

SEQ ID NO: 54166 - RNA, 27 nt, Artificial Sequence
  Actin-related protein 2 (378-386)
uaccaggagaagggcgugagaguccug

SEQ ID NO: 54167 - RNA, 27 nt, Artificial Sequence
  Centromere protein W (77-85)
gccgcugcaaaggugauccugaaaaag

SEQ ID NO: 54168 - RNA, 27 nt, Artificial Sequence
  Histone H1.1 (63-71)
gccgcucugaagaaagcacucgccgcg

SEQ ID NO: 54169 - RNA, 27 nt, Artificial Sequence
  MICOS complex subunit MIC60 (93-101)
gccgcuuacaacgugccccugccuaag

SEQ ID NO: 54170 - RNA, 30 nt, Artificial Sequence
  Crooked neck-like protein 1 (493-502)
gccgaggcugaagcagugagagaggucuac

SEQ ID NO: 54171 - RNA, 27 nt, Artificial Sequence
  Dystonin (6939-6947)
gccgaggcugaacagacccugagauuc

SEQ ID NO: 54172 - RNA, 27 nt, Artificial Sequence
  Exportin-T (39-47)
gccgaggcucuggcacagagaaccuac

SEQ ID NO: 54173 - RNA, 27 nt, Artificial Sequence
  DNA replication licensing factor MCM5 (620-628)
gccgaggcucugagcaagaugaaacuc

SEQ ID NO: 54174 - RNA, 27 nt, Artificial Sequence
  Chondroitin sulfate glucuronyltransferase (568-576)
gccgaggcucccagccaggugagacug

SEQ ID NO: 54175 - RNA, 27 nt, Artificial Sequence
  78 kDa glucose-regulated protein (157-165)
gccgaggcuuaccugggcaagaaagug

SEQ ID NO: 54176 - RNA, 30 nt, Artificial Sequence
  X-ray repair cross-complementing protein 6 (224-233)
gccgaggacgaagaucugagagugcacuuc

SEQ ID NO: 54177 - RNA, 27 nt, Artificial Sequence
  WD and tetratricopeptide repeats protein 1 (45-53)
gccgaggacggccugaucagacaguac

SEQ ID NO: 54178 - RNA, 30 nt, Artificial Sequence
  DNA replication licensing factor MCM3 (278-287)
gccgaggacaucgcuaagauuaaaaaguuc

SEQ ID NO: 54179 - RNA, 30 nt, Artificial Sequence
  Transmembrane emp24 domain-containing protein 3 (50-59)
gccgaggaccugaacagcagaguguccuac

SEQ ID NO: 54180 - RNA, 30 nt, Artificial Sequence
  Transmembrane emp24 domain-containing protein 7 (179-188)
gccgaggaccugaacaccagaguggcuuac

SEQ ID NO: 54181 - RNA, 33 nt, Artificial Sequence
  Retinoblastoma-like protein 1 (193-203)
gccgaggaagagaucggcacccccagaaaguuc

SEQ ID NO: 54182 - RNA, 27 nt, Artificial Sequence
  Clathrin heavy chain 1 (360-368)
gccgaggaacuguucgcuagaaaguuu

SEQ ID NO: 54183 - RNA, 27 nt, Artificial Sequence
  Alpha-2-macroglobulin receptor-associated protein (250-258)
gccgaguucgaagagcccagagugauc

SEQ ID NO: 54184 - RNA, 27 nt, Artificial Sequence
  Immunoglobulin-binding protein 1 (122-130)
gccgaguucgaacugcccaagaccaug

SEQ ID NO: 54185 - RNA, 27 nt, Artificial Sequence
  Myeloid leukemia factor 2 (224-232)
gccgagggccccccuagacuggcuauc

SEQ ID NO: 54186 - RNA, 33 nt, Artificial Sequence
  Histone-lysine N-methyltransferase NSD3 (1027-1037)
gccgagggccagaccagcaucaacaagacauuc

SEQ ID NO: 54187 - RNA, 27 nt, Artificial Sequence
  Plectin (1687-1695)
gccgagggcaccgcucagcaaagacug

SEQ ID NO: 54188 - RNA, 27 nt, Artificial Sequence
  RNA-binding protein 34 (222-230)
gccgagggcacccugagcaagaaacuc

SEQ ID NO: 54189 - RNA, 27 nt, Artificial Sequence
  Perilipin-2 (303-311)
gccgagcacaucgaaagcagaacccug

SEQ ID NO: 54190 - RNA, 27 nt, Artificial Sequence
  Secernin-1 (219-227)
gccgagcaccccgaacugagaagcuac

SEQ ID NO: 54191 - RNA, 30 nt, Artificial Sequence
  DNA dC-dU-editing enzyme APOBEC-3D (121-130)
gccgagcaccccaacgugacccugacaauc

SEQ ID NO: 54192 - RNA, 27 nt, Artificial Sequence
  Vacuolar protein sorting-associated protein 13A (547-555)
gccgagcacagcaccgugaucacauuc

SEQ ID NO: 54193 - RNA, 27 nt, Artificial Sequence
  Syntaxin-18 (279-287)
gccgagaucgacagcauucaccagcug

SEQ ID NO: 54194 - RNA, 30 nt, Artificial Sequence
  Nesprin-2 (1575-1584)
gccgagaucgaaauugugaaggaggaauuc

SEQ ID NO: 54195 - RNA, 33 nt, Artificial Sequence
  WD repeat-containing protein 91 (30-40)
gccgagaucaaggcugacaaagaaaagggcuuc

SEQ ID NO: 54196 - RNA, 27 nt, Artificial Sequence
  Tubulin-specific chaperone A (54-62)
gccgagauccugcaggaaagcagaaug

SEQ ID NO: 54197 - RNA, 33 nt, Artificial Sequence
  MAP3K12-binding inhibitory protein 1 (172-182)
gccgagaucaacgaaaauaacgugagagaguuc

SEQ ID NO: 54198 - RNA, 30 nt, Artificial Sequence
  Myosin light polypeptide 6 (107-116)
gccgagaucagacacgugcuggucacccuc

SEQ ID NO: 54199 - RNA, 27 nt, Artificial Sequence
  BAG64702.1 (1-9)
gccgagaucaccgacaagcugggccuc

SEQ ID NO: 54200 - RNA, 27 nt, Artificial Sequence
  Nuclear migration protein nudC (2-10)
gccgagaagcugaucacccagacauuc

SEQ ID NO: 54201 - RNA, 30 nt, Artificial Sequence
  Spectrin alpha chain, non-erythrocytic 1 (381-390)
gccgagcuggacagacagaucaagagcuuc

SEQ ID NO: 54202 - RNA, 30 nt, Artificial Sequence
  Transcriptional regulator ATRX (1293-1302)
gccgagcuggaagagaaccagagaagcuac

SEQ ID NO: 54203 - RNA, 27 nt, Artificial Sequence
  Dolichyl-diphosphooligosaccharide-proteinosyltransferase subunit 2 (288-296)
gccgagcugaccccccaccagacauuc

SEQ ID NO: 54204 - RNA, 27 nt, Artificial Sequence
  Nuclear receptor corepressor 1 (522-530)
gccgagaacgaccccaccagacaguac

SEQ ID NO: 54205 - RNA, 27 nt, Artificial Sequence
  General transcription factor 3C polypeptide 1 (42-50)
gccgagaacggccugaccgugagacuc

SEQ ID NO: 54206 - RNA, 33 nt, Artificial Sequence
  Eukaryotic translation initiation factor 4 gamma 1 (544-554)
gccgagaacauccagcccggcgaacaaaaguac

SEQ ID NO: 54207 - RNA, 27 nt, Artificial Sequence
  Glycogen phosphorylase, muscle form (273-281)
gccgagaacaucagcagagugcuguac

SEQ ID NO: 54208 - RNA, 27 nt, Artificial Sequence
  X-ray repair cross-complementing protein 5 (48-56)
gccgagaacaaggacgaaaucgcucug

SEQ ID NO: 54209 - RNA, 27 nt, Artificial Sequence
  Protein kinase C delta type (405-413)
gccgagaaccccuuccugacccaccuc

SEQ ID NO: 54210 - RNA, 30 nt, Artificial Sequence
  ATP-dependent RNA helicase DDX42 (93-102)
gccgagaacagccccaccagacagcaauuc

SEQ ID NO: 54211 - RNA, 27 nt, Artificial Sequence
  E3 ubiquitin-protein ligase TTC3 (1392-1400)
gccgagaacguggcuggccaccagauc

SEQ ID NO: 54212 - RNA, 27 nt, Artificial Sequence
  RAB6A-GEF complex partner protein 1 (906-914)
gccgagaacgugcccgcuagcaaguuc

SEQ ID NO: 54213 - RNA, 33 nt, Artificial Sequence
  Vigilin (1010-1020)
gccgagcaggaagacagagcucugaggagcuuc

SEQ ID NO: 54214 - RNA, 27 nt, Artificial Sequence
  Plectin (2014-2022)
gccgagcaggaaagcgcuagacaacug

SEQ ID NO: 54215 - RNA, 33 nt, Artificial Sequence
  B-cell receptor-associated protein 31 (21-31)
gccgagagcgcuuccgaagcagccaagaaauac

SEQ ID NO: 54216 - RNA, 27 nt, Artificial Sequence
  T-complex protein 1 subunit beta (113-121)
gccgagagccugaucgcuaagaaaauu

SEQ ID NO: 54217 - RNA, 27 nt, Artificial Sequence
  Sphingomyelin phosphodiesterase 4 (513-521)
gccgagagccccgcuggccacuccuuc

SEQ ID NO: 54218 - RNA, 27 nt, Artificial Sequence
  Protein THEMIS2 (120-128)
gccgagagccccgaaagagugcugcuc

SEQ ID NO: 54219 - RNA, 33 nt, Artificial Sequence
  Chitinase domain-containing protein 1 (57-67)
gccgagagcgugguccuggaacacagauccuac

SEQ ID NO: 54220 - RNA, 27 nt, Artificial Sequence
  Poly(A)-specific ribonuclease PARN (455-463)
gccgagagcuacagaauccagaccuau

SEQ ID NO: 54221 - RNA, 30 nt, Artificial Sequence
  Translation initiation factor eIF-2B subunit epsilon (406-415)
gccgaggugggcgcugcagggaagggauac

SEQ ID NO: 54222 - RNA, 33 nt, Artificial Sequence
  RNA-binding protein 8A (78-88)
gccgaguacggcgaaaucaagaacauucaccug

SEQ ID NO: 54223 - RNA, 27 nt, Artificial Sequence
  Histone deacetylase 1 (239-247)
gccaucuucaagcccgugaugagcaaa

SEQ ID NO: 54224 - RNA, 27 nt, Artificial Sequence
  Pre-mRNA-processing factor 6 (764-772)
gccauccuggagaagagcagacucaaa

SEQ ID NO: 54225 - RNA, 33 nt, Artificial Sequence
  Serine/threonine-protein phosphatase 2A 65 kDa regulatory subunit A alpha isoform (457-467)
gccaucagagaggcugcaaccagcaaccugaag

SEQ ID NO: 54226 - RNA, 27 nt, Artificial Sequence
  Cleavage and polyadenylation specificity factor subunit 7 (346-354)
gccaucagcuccucugcuauuucaaag

SEQ ID NO: 54227 - RNA, 27 nt, Artificial Sequence
  39S ribosomal protein L20, mitochondrial (106-114)
gccaucuacgagcccaagaccuucaaa

SEQ ID NO: 54228 - RNA, 27 nt, Artificial Sequence
  Melanoma-associated antigen F1 (61-69)
gcccuggcugcaaaggcccucgcgaga

SEQ ID NO: 54229 - RNA, 27 nt, Artificial Sequence
  Proteasome subunit alpha type-4 (120-128)
gcccuggcuaucaaggugcucaacaaa

SEQ ID NO: 54230 - RNA, 27 nt, Artificial Sequence
  Lysine-specific demethylase 2B (171-179)
gcccuggcuaacaagccccucagaagg

SEQ ID NO: 54231 - RNA, 27 nt, Artificial Sequence
  Eukaryotic translation initiation factor 3 subunit C-like protein (251-259)
gcccuggcuagcagauuccucaagaaa

SEQ ID NO: 54232 - RNA, 27 nt, Artificial Sequence
  Translation factor GUF1, mitochondrial (274-282)
gcccuguucgacggcguggucagcaag

SEQ ID NO: 54233 - RNA, 27 nt, Artificial Sequence
  V-type proton ATPase subunit E 1 (214-222)
gcccuguucggcgcuaacgcaaauaga

SEQ ID NO: 54234 - RNA, 30 nt, Artificial Sequence
  Sorting nexin-5 (315-324)
gcccugaucgacuacgagaacagcaauaag

SEQ ID NO: 54235 - RNA, 30 nt, Artificial Sequence
  T-complex protein 1 subunit zeta (279-288)
gcccugaucaagcacaaacccagcgugaag

SEQ ID NO: 54236 - RNA, 30 nt, Artificial Sequence
  60S ribosomal protein L9 (159-168)
gcccugauccagcaagcuaccacagugaag

SEQ ID NO: 54237 - RNA, 30 nt, Artificial Sequence
  Actin-related protein 2/3 complex subunit 5 (58-67)
gcccugaagaaccccccuaucaauaccaaa

SEQ ID NO: 54238 - RNA, 30 nt, Artificial Sequence
  40S ribosomal protein S15a (10-19)
gcccugaagagcaucaacaaugcugagaaa

SEQ ID NO: 54239 - RNA, 27 nt, Artificial Sequence
  Eukaryotic translation initiation factor 4 gamma 1 (785-793)
gcccugaaggugcccaccacagagaaa

SEQ ID NO: 54240 - RNA, 33 nt, Artificial Sequence; identical to SEQ ID NO: 30013
  Prefoldin subunit 6 (48-58)

SEQ ID NO: 54241 - RNA, 27 nt, Artificial Sequence
  Serine hydroxymethyltransferase, mitochondrial (340-348)
gcccugcucgagagaggcuacagccuu

SEQ ID NO: 54242 - RNA, 27 nt, Artificial Sequence
  Interferon alpha-inducible protein 6 (113-121)
gcccugaugggcuacgcuacccacaag

SEQ ID NO: 54243 - RNA, 27 nt, Artificial Sequence
  Engulfment and cell motility protein 2 (573-581)
gcccugaaccacaaggugcuccauuac

SEQ ID NO: 54244 - RNA, 27 nt, Artificial Sequence
  60S ribosomal protein L4 (132-140)
gcccugcccgcucucgugaugagcaag

SEQ ID NO: 54245 - RNA, 27 nt, Artificial Sequence
  AT-rich interactive domain-containing protein 4B (407-415)
gcccugcccgagaagguggucaacaaa

SEQ ID NO: 54246 - RNA, 30 nt, Artificial Sequence
  m7GpppX diphosphatase (320-329)
gcccugagagcugacgauccccuccuuaag

SEQ ID NO: 54247 - RNA, 27 nt, Artificial Sequence
  Probable helicase senataxin (1619-1627)
gcccugagccccucccucaagaacaaa

SEQ ID NO: 54248 - RNA, 27 nt, Artificial Sequence
  Transcription initiation factor IIE subunit beta (16-24)
gcccugagcacccccguggucgagaag

SEQ ID NO: 54249 - RNA, 30 nt, Artificial Sequence
  Nuclear receptor corepressor 1 (607-616)
gcccuggugagcacccccgucagaacaaag

SEQ ID NO: 54250 - RNA, 27 nt, Artificial Sequence
  F-box only protein 21 (373-381)
gcccuguacggcguggucaacguuaag

SEQ ID NO: 54251 - RNA, 33 nt, Artificial Sequence
  Cytochrome c oxidase subunit 7A-related protein, mitochondrial (104-114)
gcccuguacauggcuagccagcccaagaacaaa

SEQ ID NO: 54252 - RNA, 27 nt, Artificial Sequence
  Anaphase-promoting complex subunit 1 (1587-1595)
gcccuguacccccacuucccugcucau

SEQ ID NO: 54253 - RNA, 27 nt, Artificial Sequence
  Nucleosome assembly protein 1-like 4 (97-105)
gcccuguaccagccccucuucgacaag

SEQ ID NO: 54254 - RNA, 27 nt, Artificial Sequence
  Mitochondrial ubiquitin ligase activator of NFKB 1 (24-32)
gcccuguacagcguguauagacagaag

SEQ ID NO: 54255 - RNA, 27 nt, Artificial Sequence
  Pyruvate kinase PKM (21-29)
gccauggcugacaccuuccuggagcac

SEQ ID NO: 54256 - RNA, 27 nt, Artificial Sequence
  Baculoviral IAP repeat-containing protein 6 (2448-2456)
gccaugaagcccaaaccucugagcgug

SEQ ID NO: 54257 - RNA, 33 nt, Artificial Sequence
  NAD(P)H dehydrogenase (quinone) 1 (128-138)
gccauguacgacaagggccccuucagaagcaaa

SEQ ID NO: 54258 - RNA, 24 nt, Artificial Sequence
  Lysine-specific demethylase 5D (795-802)
gccaacaaggugagagucgcucug

SEQ ID NO: 54259 - RNA, 27 nt, Artificial Sequence
  Major facilitator superfamily domain-containing protein 12 (11-19)
gcccccagcccuagaccacugucccuc

SEQ ID NO: 54260 - RNA, 27 nt, Artificial Sequence
  THO complex subunit 4 (51-59)
gcccccuacagcagaccuaagcagcug

SEQ ID NO: 54261 - RNA, 27 nt, Artificial Sequence
  40S ribosomal protein S3 (44-52)
gcccaggcugagagccugagauacaag

SEQ ID NO: 54262 - RNA, 33 nt, Artificial Sequence
  Hydroxymethylglutaryl-CoA synthase, cytoplasmic (393-403)
gcccaguacagcccccaacagcuggcuggcaag

SEQ ID NO: 54263 - RNA, 30 nt, Artificial Sequence; identical to SEQ ID NO: 30036
  Nucleolar protein 58 (344-353)

SEQ ID NO: 54264 - RNA, 27 nt, Artificial Sequence
  Casein kinase II subunit beta (204-212)
gccagcaacuucaagucccccgugaaa

SEQ ID NO: 54265 - RNA, 27 nt, Artificial Sequence
  Sec1 family domain-containing protein 1 (482-490)
gccagcuacggcuccaccacaacuaag

SEQ ID NO: 54266 - RNA, 33 nt, Artificial Sequence
  Actin, cytoplasmic 2 (19-29)
gccaccgcugcaagcuccucuucacuggagaag

SEQ ID NO: 54267 - RNA, 30 nt, Artificial Sequence
  Receptor expression-enhancing protein 3 (130-139)
gccaccgcugcagugacagccgcggucaag

SEQ ID NO: 54268 - RNA, 27 nt, Artificial Sequence
  Mediator of RNA polymerase II transcription subunit 12 (294-302)
gccaccgcuggcuucacaaucgggaga

SEQ ID NO: 54269 - RNA, 27 nt, Artificial Sequence
  Kinetochore protein Nuf2 (353-361)
gccaccgcucaguucaagaucaacaaa

SEQ ID NO: 54270 - RNA, 27 nt, Artificial Sequence
  E3 ubiquitin-protein ligase makorin-1 (117-125)
gccaccgcuacagagcugacuacgaag

SEQ ID NO: 54271 - RNA, 27 nt, Artificial Sequence
  Adenomatous polyposis coli protein (1083-1091)
gccaccgacauccccagcucccagaag

SEQ ID NO: 54272 - RNA, 27 nt, Artificial Sequence
  Myosin-9 (540-548)
gccaccgacaagagcuucguggagaaa

SEQ ID NO: 54273 - RNA, 27 nt, Artificial Sequence
  Probable ATP-dependent RNA helicase DHX37 (603-611)
gccaccuuccccguggcuccuagauac

SEQ ID NO: 54274 - RNA, 33 nt, Artificial Sequence
  Protein transport protein Sec31A (61-71)
gccaccuucagcuccucucacagauaccauaag

SEQ ID NO: 54275 - RNA, 27 nt, Artificial Sequence
  Exosome complex component RRP41 (79-87)
gccaccuucagcacaggcgagagaaag

SEQ ID NO: 54276 - RNA, 30 nt, Artificial Sequence; identical to SEQ ID NO: 30049
  Angio-associated migratory cell protein (18-27)

SEQ ID NO: 54277 - RNA, 27 nt, Artificial Sequence
  Trans-3-hydroxy-L-proline dehydratase (302-310)
gccaccggcagcguguucacagggaag

SEQ ID NO: 54278 - RNA, 27 nt, Artificial Sequence
  Lamina-associated polypeptide 2, isoform alpha (583-591)
gccacccacacagcuuucguggcaaag

SEQ ID NO: 54279 - RNA, 27 nt, Artificial Sequence
  Helicase with zinc finger domain 2 (1314-1322)
gccaccaucacaaaggugcugcagaaa

SEQ ID NO: 54280 - RNA, 27 nt, Artificial Sequence
  Hexokinase-2 (388-396)
gccacccuggcugcagugcuccagaga

SEQ ID NO: 54281 - RNA, 30 nt, Artificial Sequence
  Fanconi anemia group I protein (1123-1132)
gccacccugcccaaccagccuguggagaag

SEQ ID NO: 54282 - RNA, 27 nt, Artificial Sequence
  Pescadillo homolog (14-22)
gccaccaacuacaucacaagaaauaag

SEQ ID NO: 54283 - RNA, 27 nt, Artificial Sequence
  Nucleolar and spindle-associated protein 1 (346-354)
gccacccagacacccgugagcaacaag

SEQ ID NO: 54284 - RNA, 27 nt, Artificial Sequence
  Retinoblastoma-associated protein (27-35)
gccaccagcgcuuuccagacacaaaag

SEQ ID NO: 54285 - RNA, 27 nt, Artificial Sequence
  DNA repair protein XRCC2 (193-201)
gccaccacacagacuaucaugcaaaag

SEQ ID NO: 54286 - RNA, 30 nt, Artificial Sequence
  Derlin-1 (21-30)
gccaccguggcugucccccugguuggcaag

SEQ ID NO: 54287 - RNA, 27 nt, Artificial Sequence
  Pre-mRNA-processing-splicing factor 8 (765-773)
gccaccguggacaagacagucugcaaa

SEQ ID NO: 54288 - RNA, 30 nt, Artificial Sequence
  Importin subunit beta-1 (862-871)
gccaccugggcuacaaaggagcugagaaaa

SEQ ID NO: 54289 - RNA, 30 nt, Artificial Sequence
  60S ribosomal protein L13 (23-32)
gccaccugguucaaccagcccgcuagaaag

SEQ ID NO: 54290 - RNA, 30 nt, Artificial Sequence
  DNA (cytosine-5)-methyltransferase 3A (168-177)
gccaccuacaacaagcagcccauguauaga

SEQ ID NO: 54291 - RNA, 27 nt, Artificial Sequence
  Putative rhophilin-2-like protein RHPN2P1 (502-510)
gccaccuacagcgugggcaugcagaag

SEQ ID NO: 54292 - RNA, 30 nt, Artificial Sequence
  TRAF2 and NCK-interacting protein kinase (83-92)
gccaccuacuauggcgcuuucaucaagaaa

SEQ ID NO: 54293 - RNA, 27 nt, Artificial Sequence
  T-complex protein 1 subunit gamma (73-81)
gccguggcucacgcacugaccgagaag

SEQ ID NO: 54294 - RNA, 30 nt, Artificial Sequence; identical to SEQ ID NO: 30067
  WD repeat-containing protein 3 (14-23)

SEQ ID NO: 54295 - RNA, 33 nt, Artificial Sequence
  Importin subunit alpha-1 (338-348)
gccguguuccccagccugcucaccaacccuaag

SEQ ID NO: 54296 - RNA, 30 nt, Artificial Sequence
  Nucleoside diphosphate kinase 6 (39-48)
gccgugcaccagcaaauccugagcaacaag

SEQ ID NO: 54297 - RNA, 27 nt, Artificial Sequence
  Methylsterol monooxygenase 1 (15-23)
gccgugaucgaggacaccuggcacuac

SEQ ID NO: 54298 - RNA, 33 nt, Artificial Sequence
  Protein HIRA (394-404)
gccgugaucgagaaccccgaaaugcugaaguac

SEQ ID NO: 54299 - RNA, 27 nt, Artificial Sequence
  Probable phospholipid-transporting ATPase IF (301-309)
gccgugaucagcaccauucugaaguac

SEQ ID NO: 54300 - RNA, 27 nt, Artificial Sequence
  Integrator complex subunit 12 (240-248)
gccgugaaggacccccuggucaaaaag

SEQ ID NO: 54301 - RNA, 27 nt, Artificial Sequence
  Nuclear pore complex protein Nup160 (1177-1185)
gccgugcugggcaaggggcaccaguac

SEQ ID NO: 54302 - RNA, 27 nt, Artificial Sequence
  Cyclin-I (179-187)
gccgugcugaccaagcagcuccuucac

SEQ ID NO: 54303 - RNA, 30 nt, Artificial Sequence
  Signal peptidase complex catalytic subunit SEC11C (180-189)
gccgugaugggcgcuuacguccugcucaag

SEQ ID NO: 54304 - RNA, 30 nt, Artificial Sequence
  Structural maintenance of chromosomes protein 4 (1190-1199)
gccgugaaccccaaggagaucgcuagcaaa

SEQ ID NO: 54305 - RNA, 27 nt, Artificial Sequence
  Sororin (53-61)
gccgugagaaagcccaucguccugaaa

SEQ ID NO: 54306 - RNA, 27 nt, Artificial Sequence
  Histone H2B type 1-K (118-126)
gccgugaccaaguacacaagcgcuaaa

SEQ ID NO: 54307 - RNA, 33 nt, Artificial Sequence
  Nuclear pore complex protein Nup160 (1113-1123)
gccguguacgacagacccggcgcuagcccuaag

SEQ ID NO: 54308 - RNA, 27 nt, Artificial Sequence
  Integrator complex subunit 8 (269-277)
gccguguacgagaacgcuagagaaaag

SEQ ID NO: 54309 - RNA, 27 nt, Artificial Sequence
  Toll-interacting protein (84-92)
gccguguacgagacccccacagcucac

SEQ ID NO: 54310 - RNA, 33 nt, Artificial Sequence
  Ras GTPase-activating protein-binding protein 1 (54-64)
gccguguacggccagaaggagauccacagaaaa

SEQ ID NO: 54311 - RNA, 27 nt, Artificial Sequence
  Amyloid protein-binding protein 2 (337-345)
gccuacagcuccuaugugcaccaguac

SEQ ID NO: 54312 - RNA, 27 nt, Artificial Sequence
  182 kDa tankyrase-1-binding protein (415-423)
gacgcccaccugagacccaccagccuc

SEQ ID NO: 54313 - RNA, 24 nt, Artificial Sequence
  Cytoplasmic FMR1-interacting protein 2 (285-292)
gacgccaagaaaagaaucaaccug

SEQ ID NO: 54314 - RNA, 27 nt, Artificial Sequence
  Heat shock protein 105 kDa (255-263)
gacgccaagagcaaaaucagagcucug

SEQ ID NO: 54315 - RNA, 27 nt, Artificial Sequence
  Chromodomain-helicase-DNA-binding protein 2 (106-114)
gacgaggcccugaucggcaagaaauuc

SEQ ID NO: 54316 - RNA, 30 nt, Artificial Sequence
  Pre-mRNA-processing-splicing factor 8 (1104-1113)
gacgaggccagagaucugauccagagguac

SEQ ID NO: 54317 - RNA, 30 nt, Artificial Sequence
  EH domain-containing protein 4 (201-210)
gacgaguucagcgaagccaucaaggcuuuu

SEQ ID NO: 54318 - RNA, 33 nt, Artificial Sequence
  26S protease regulatory subunit 10B (247-257)
gacgagaucgaugccauuggcgggagaagguuc

SEQ ID NO: 54319 - RNA, 30 nt, Artificial Sequence
  U4/U6 small nuclear ribonucleoprotein Prp31 (322-331)
gacgagaucgaaagaaaguucgauaaaugg

SEQ ID NO: 54320 - RNA, 27 nt, Artificial Sequence
  Zinc finger MYND domain-containing protein 11 (348-356)
gacgagcuggaacuccaccagagauuc

SEQ ID NO: 54321 - RNA, 30 nt, Artificial Sequence
  General transcription factor IIH subunit 5 (24-33)
gacgagagcaacgcccugggcaagaaauuc

SEQ ID NO: 54322 - RNA, 27 nt, Artificial Sequence
  Ubiquitin carboxyl-terminal hydrolase 19 (1197-1205)
gacgagagccagguggucaccagauac

SEQ ID NO: 54323 - RNA, 27 nt, Artificial Sequence
  Serrate RNA effector molecule homolog (164-172)
gacgagaccgaagccgugaagagauac

SEQ ID NO: 54324 - RNA, 30 nt, Artificial Sequence
  60S ribosomal protein L26 (53-62)
gacgaggugcaggucguuagaggccacuac

SEQ ID NO: 54325 - RNA, 27 nt, Artificial Sequence
  Ras GTPase-activating protein-binding protein 2 (60-68)
gacauccaccauaaggugcugagccuc

SEQ ID NO: 54326 - RNA, 27 nt, Artificial Sequence
  Heat shock 70 kDa protein 4 (255-263)
gacaucaagagcaaaauuagagcccug

SEQ ID NO: 54327 - RNA, 27 nt, Artificial Sequence
  Heterogeneous nuclear ribonucleoprotein F (196-204)
gaccccccucugaaguucaugagcgug

SEQ ID NO: 54328 - RNA, 27 nt, Artificial Sequence
  Cullin-1 (348-356)
gacgugcacaagaaauacaacgcccug

SEQ ID NO: 54329 - RNA, 27 nt, Artificial Sequence
  Spectrin alpha chain, non-erythrocytic 1 (50-58)
gacgugaaggccaaacugcacgagcuc

SEQ ID NO: 54330 - RNA, 27 nt, Artificial Sequence
  Coatomer subunit beta (34-42)
gacgugaagagcaaaaccgaggcccug

SEQ ID NO: 54331 - RNA, 24 nt, Artificial Sequence
  Pumilio homolog 3 (320-327)
gaggccgugaucaagcacagccug

SEQ ID NO: 54332 - RNA, 30 nt, Artificial Sequence
  NADH dehydrogenase (ubiquinone) 1 alpha subcomplex subunit 13 (122-131)
gaggaagcccugcacgcuagccauggcuuc

SEQ ID NO: 54333 - RNA, 27 nt, Artificial Sequence
  DDB1- and CUL4-associated factor 10 (132-140)
gaggaagccaacgugggcagaggguac

SEQ ID NO: 54334 - RNA, 33 nt, Artificial Sequence
  15 kDa selenoprotein (76-86)
gaggaagcccaguucgagaccaagaaacuguac

SEQ ID NO: 54335 - RNA, 30 nt, Artificial Sequence
  Negative elongation factor E (10-19)
gaggaagaggaagcccugcagaagaaauuc

SEQ ID NO: 54336 - RNA, 27 nt, Artificial Sequence
  60S ribosomal protein L13 (171-179)
gaggaagagaagaacuucaaagccuuu

SEQ ID NO: 54337 - RNA, 30 nt, Artificial Sequence
  Coiled-coil domain-containing protein 66 (780-789)
gaggaagagccccugaacauccacagcuuc

SEQ ID NO: 54338 - RNA, 27 nt, Artificial Sequence
  HLA class II histocompatibility antigen, DR alpha chain (41-49)
gaggaauucggcagauuugccagcuuc

SEQ ID NO: 54339 - RNA, 30 nt, Artificial Sequence
  E3 ubiquitin-protein ligase MGRN1 (140-149)
gaggaauuccugaacggcagagccguguac

SEQ ID NO: 54340 - RNA, 27 nt, Artificial Sequence
  Cullin-4A (269-277)
gaggaaggcgacagagugaucaccuac

SEQ ID NO: 54341 - RNA, 27 nt, Artificial Sequence
  WD repeat-containing protein 36 (776-784)
gaggaaggccuggugaacaauaaguac

SEQ ID NO: 54342 - RNA, 30 nt, Artificial Sequence
  A-kinase anchor protein 2 (256-265)
gaggaacaccuggagagccauaagaaauac

SEQ ID NO: 54343 - RNA, 27 nt, Artificial Sequence
  Unconventional myosin-Ie (749-757)
gaggaacaccccgagcugcagcaauuc

SEQ ID NO: 54344 - RNA, 27 nt, Artificial Sequence
  Vimentin (229-237)
gaggaaaucgccuuccugaagaaacuc

SEQ ID NO: 54345 - RNA, 30 nt, Artificial Sequence
  PH domain leucine-rich repeat-containing protein phosphatase 1 (287-296)
gaggaaaucgaccugagcggcaacaagcuc

SEQ ID NO: 54346 - RNA, 24 nt, Artificial Sequence
  Probable ATP-dependent RNA helicase DDX56 (421-428)
gaggaaaucgagggcuucagauac

SEQ ID NO: 54347 - RNA, 27 nt, Artificial Sequence
  Paxillin (389-397)
gaggaaaucggcagcagaaacuucuuu

SEQ ID NO: 54348 - RNA, 27 nt, Artificial Sequence
  Retinoblastoma-like protein 1 (195-203)
gaggaaaucggcacccccagaaaguuc

SEQ ID NO: 54349 - RNA, 30 nt, Artificial Sequence
  Bloom syndrome protein (942-951)
gaggaaauccccgugagcucccacuacuuc

SEQ ID NO: 54350 - RNA, 30 nt, Artificial Sequence
  Kinesin-like protein KIF21A (473-482)
gaggaaaucagcaacaugauucacuccuac

SEQ ID NO: 54351 - RNA, 33 nt, Artificial Sequence
  Thioredoxin-related transmembrane protein 2 (148-158)
gaggaacuggagagagacaagagggugaccugg

SEQ ID NO: 54352 - RNA, 24 nt, Artificial Sequence
  Clathrin heavy chain 1 (361-368)
gaggaacuguucgccagaaaguuu

SEQ ID NO: 54353 - RNA, 27 nt, Artificial Sequence
  2',3'-cyclic-nucleotide 3'-phosphodiesterase (191-199)
gaggaacugggcaaccacaaggccuuc

SEQ ID NO: 54354 - RNA, 27 nt, Artificial Sequence
  Protein FAM192A (107-115)
gaggaacugaaggagcucaaagaauac

SEQ ID NO: 54355 - RNA, 30 nt, Artificial Sequence
  Proteasome subunit beta type-4 (119-128)
gaggaacugcucggcgacgggcacagcuac

SEQ ID NO: 54356 - RNA, 30 nt, Artificial Sequence
  Sorting nexin-14 (340-349)
gaggaacugcagaagaucuacaaaaccuau

SEQ ID NO: 54357 - RNA, 27 nt, Artificial Sequence
  Krueppel-like factor 6 (124-132)
gaggaacugagccccaccgccaaguuc

SEQ ID NO: 54358 - RNA, 33 nt, Artificial Sequence
  Eukaryotic initiation factor 4A-I (239-249)
gaggaacugacccucgagggcaucagacaguuc

SEQ ID NO: 54359 - RNA, 30 nt, Artificial Sequence
  Coiled-coil domain-containing protein 93 (132-141)
gaggaaaugggcgacuacaucagaagcuau

SEQ ID NO: 54360 - RNA, 30 nt, Artificial Sequence
  Nuclear pore complex protein Nup153 (1104-1113)
gaggaaaugcccgccaccaagggcggguuc

SEQ ID NO: 54361 - RNA, 30 nt, Artificial Sequence
  Folliculin-interacting protein 1 (434-443)
gaggaaaacgccguggacgucaagcaguac

SEQ ID NO: 54362 - RNA, 27 nt, Artificial Sequence
  Tropomodulin-3 (310-318)
gaggaaaacaccaauauccugaaguuc

SEQ ID NO: 54363 - RNA, 27 nt, Artificial Sequence
  G2/mitotic-specific cyclin-B1 (183-191)
gaggaacaggccgugagacccaaguac

SEQ ID NO: 54364 - RNA, 27 nt, Artificial Sequence
  Targeting protein for Xklp2 (170-178)
gaggaacaggagcuggaaaagagcaug

SEQ ID NO: 54365 - RNA, 27 nt, Artificial Sequence
  Nuclear receptor-binding protein (235-243)
gaggaacagaagaaccugcacuucuuu

SEQ ID NO: 54366 - RNA, 30 nt, Artificial Sequence
  Cyclin-G-associated kinase (740-749)
gaggaacagcaagacauccugagcaaguuc

SEQ ID NO: 54367 - RNA, 30 nt, Artificial Sequence
  Nitrogen permease regulator 2-like protein (336-345)
gaggaacagagccaccccgccagacuguac

SEQ ID NO: 54368 - RNA, 27 nt, Artificial Sequence
  OTU domain-containing protein 5 (177-185)
gaggaacagguggccagagagagcuac

SEQ ID NO: 54369 - RNA, 27 nt, Artificial Sequence
  Histone-binding protein RBBP4 (13-21)
gaggaaagagugaucaacgaggaauac

SEQ ID NO: 54370 - RNA, 27 nt, Artificial Sequence
  Sorting nexin-24 (11-19)
gaggaaagcgaccuggagagaggcuac

SEQ ID NO: 54371 - RNA, 27 nt, Artificial Sequence
  Poly(rC)-binding protein 2 (41-49)
gaggaaagcggcgccagaaucaacauu

SEQ ID NO: 54372 - RNA, 27 nt, Artificial Sequence
  Vacuolar fusion protein CCZ1 homolog (215-223)
gaggaaagccugaacaucgugaaguac

SEQ ID NO: 54373 - RNA, 30 nt, Artificial Sequence
  ATP-dependent RNA helicase DDX19B (301-310)
gaggaaacccuggacacaaucaagcaguac

SEQ ID NO: 54374 - RNA, 30 nt, Artificial Sequence
  Elongation factor 1-gamma (325-334)
gaggaaacccagacacuggugagagaguac

SEQ ID NO: 54375 - RNA, 30 nt, Artificial Sequence
  Adenylate cyclase type 3 (1088-1097)
gaggaaacccaggugauccugagagaguac

SEQ ID NO: 54376 - RNA, 30 nt, Artificial Sequence
  Cleavage and polyadenylation specificity factor subunit 1 (1111-1120)
gaggaaaccgugagcggccugaagggguac

SEQ ID NO: 54377 - RNA, 30 nt, Artificial Sequence
  MICOS complex subunit MIC19 (168-177)
gaggaaguggaggccaaguucaaaagauac

SEQ ID NO: 54378 - RNA, 24 nt, Artificial Sequence
  G patch domain-containing protein 4 (211-218)
gaggaaguggagagcagagccuac

SEQ ID NO: 54379 - RNA, 30 nt, Artificial Sequence
  Chromodomain-helicase-DNA-binding protein 1-like (214-223)
gaggaagugggcgacuucauccagagauac

SEQ ID NO: 54380 - RNA, 27 nt, Artificial Sequence
  Ferritin light chain (137-145)
gaggaagugaagcugaucaaaaagaug

SEQ ID NO: 54381 - RNA, 27 nt, Artificial Sequence
  Alanine-tRNA ligase, cytoplasmic (378-386)
gaggaagugcaguuccugaagacccuc

SEQ ID NO: 54382 - RNA, 30 nt, Artificial Sequence
  Glutaredoxin-3 (139-148)
gaggaagugagacagggccugaaggccuac

SEQ ID NO: 54383 - RNA, 24 nt, Artificial Sequence
  Pre-B-cell leukemia transcription factor 3 (11-18)
gagaucaaggaaaaaaccggccug

SEQ ID NO: 54384 - RNA, 27 nt, Artificial Sequence
  AP-2 complex subunit alpha-1 (29-37)
gagaucaagagaauuaacaaagaacug

SEQ ID NO: 54385 - RNA, 27 nt, Artificial Sequence
  40S ribosomal protein S24 (39-47)
gagaucagagaaaagcuggccaaaaug

SEQ ID NO: 54386 - RNA, 27 nt, Artificial Sequence
  Crooked neck-like protein 1 (571-579)
gagaucagacagaagaaccugagccuc

SEQ ID NO: 54387 - RNA, 27 nt, Artificial Sequence
  Enhancer of mRNA-decapping protein 3 (285-293)
gagcugcacaagaaacuccuuagcgug

SEQ ID NO: 54388 - RNA, 27 nt, Artificial Sequence
  Alpha-2-macroglobulin receptor-associated protein (20-28)
gagcugaaggaaaaacucagaagcauc

SEQ ID NO: 54389 - RNA, 24 nt, Artificial Sequence
  Neuroblastoma-amplified sequence (1048-1055)
gagcugcucgaaaagcacggccuu

SEQ ID NO: 54390 - RNA, 27 nt, Artificial Sequence
  Heat shock protein HSP 90-beta (529-537)
gagagaaucaugaaggcccaggcucug

SEQ ID NO: 54391 - RNA, 27 nt, Artificial Sequence
  Protein phosphatase 1 regulatory subunit 7 (95-103)
gaggugcugaagaaagucaagacccuc

SEQ ID NO: 54392 - RNA, 24 nt, Artificial Sequence
  Heterogeneous nuclear ribonucleoprotein M (130-137)
gaggugcugaacaagcacagccuc

SEQ ID NO: 54393 - RNA, 27 nt, Artificial Sequence
  Exosome component 10 (254-262)
uucgcccaccccuaccaguaugagcug

SEQ ID NO: 54394 - RNA, 27 nt, Artificial Sequence
  Long-chain-fatty-acid-CoA ligase 3 (551-559)
uucgaggacgaaaacggccagagaugg

SEQ ID NO: 54395 - RNA, 30 nt, Artificial Sequence
  X-ray repair cross-complementing protein 6 (478-487)
uucgagaaccccgugcugcagcaacacuuu

SEQ ID NO: 54396 - RNA, 27 nt, Artificial Sequence
  Cyclin-dependent kinase 14 (275-283)
uucggccuggccagagcuaagagcgug

SEQ ID NO: 54397 - RNA, 27 nt, Artificial Sequence
  Translocation protein SEC62 (278-286)
uucagaccccuguacacccacgaguau

SEQ ID NO: 54398 - RNA, 24 nt, Artificial Sequence
  Myosin-9 (831-838)
uucaccaaggugaaaccccugcuc

SEQ ID NO: 54399 - RNA, 27 nt, Artificial Sequence
  Gamma-interferon-inducible protein 16 (533-541)
uucguguacgagcccaaggaacagaaa

SEQ ID NO: 54400 - RNA, 30 nt, Artificial Sequence
  Constitutive coactivator of peroxisome proliferator-activated receptor gamma (663-672)
uucguguaccccggcaacccucugagacac

SEQ ID NO: 54401 - RNA, 27 nt, Artificial Sequence
  Serine/threonine-protein phosphatase 2A 65 kDa regulatory subunit A alpha isoform (190-198)
ggcgaguucgccaaggugcuggaacuc

SEQ ID NO: 54402 - RNA, 33 nt, Artificial Sequence
  DNA replication licensing factor MCM5 (552-562)
ggcgagaucgaccuggccaagcucaaaaaguuc

SEQ ID NO: 54403 - RNA, 27 nt, Artificial Sequence
  Serine/threonine-protein phosphatase PP1-beta catalytic subunit (216-224)
ggcgagaacgacagaggggugagcuuc

SEQ ID NO: 54404 - RNA, 30 nt, Artificial Sequence
  HLA class I histocompatibility antigen, B-7 alpha chain (42-51)
ggcgagcccagauucaucagcgugggguac

SEQ ID NO: 54405 - RNA, 30 nt, Artificial Sequence
  Protein SCAF11 (201-210)
ggcgagagcuccuucaccuacagagccuau

SEQ ID NO: 54406 - RNA, 27 nt, Artificial Sequence
  Rho GTPase-activating protein 21 (129-137)
ggcgagagcgugaucgggaagaccuac

SEQ ID NO: 54407 - RNA, 33 nt, Artificial Sequence
  Arfaptin-1 (19-29)
ggcgagguggacgauagcagagaacacuccuuc

SEQ ID NO: 54408 - RNA, 27 nt, Artificial Sequence
  AP-2 complex subunit mu (12-20)
ggcgaggugcugaucagcagagucuac

SEQ ID NO: 54409 - RNA, 27 nt, Artificial Sequence
  Endoplasmic reticulum-Golgi intermediate compartment protein 3 (255-263)
ggcgaggugcugagaaccaaccaguuc

SEQ ID NO: 54410 - RNA, 30 nt, Artificial Sequence
  Proline and serine-rich protein 1 (157-166)
ggcaucuuccccgggaccccucugaagaaa

SEQ ID NO: 54411 - RNA, 30 nt, Artificial Sequence
  Ubiquitin carboxyl-terminal hydrolase 36 (460-469)
ggcaucauuagcuccccccugaccgggaag

SEQ ID NO: 54412 - RNA, 27 nt, Artificial Sequence
  Alpha-2-macroglobulin receptor-associated protein (145-153)
ggccuggacgaucccagacucgagaag

SEQ ID NO: 54413 - RNA, 33 nt, Artificial Sequence
  Targeting protein for Xklp2 (12-22)
ggccuguuccaggggaagaccccccucagaaaa

SEQ ID NO: 54414 - RNA, 30 nt, Artificial Sequence
  Glutathione S-transferase kappa 1 (142-151)
ggccugcucgagaagaucgccacccccaaa

SEQ ID NO: 54415 - RNA, 27 nt, Artificial Sequence
  Kelch repeat and BTB domain-containing protein 7 (280-288)
ggccugcucaccaagcccaucgugaaa

SEQ ID NO: 54416 - RNA, 27 nt, Artificial Sequence
  Microtubule-associated protein 4 (735-743)
ggccugaacaagaaacccaugagccuc

SEQ ID NO: 54417 - RNA, 27 nt, Artificial Sequence
  Epidermal growth factor receptor substrate 15-like 1 (46-54)
ggccugagcgacaucauucucgggaag

SEQ ID NO: 54418 - RNA, 27 nt, Artificial Sequence
  Calcium homeostasis endoplasmic reticulum protein (680-688)
ggccuguacgaguucuuuagagccaag

SEQ ID NO: 54419 - RNA, 27 nt, Artificial Sequence
  Cyclin-dependent kinase 9 (136-144)
ggccuguacuauauccacagaaacaag

SEQ ID NO: 54420 - RNA, 30 nt, Artificial Sequence
  26S proteasome non-ATPase regulatory subunit 8 (146-155)
ggcagcuacaacaagguguuccuggccaaa

SEQ ID NO: 54421 - RNA, 27 nt, Artificial Sequence
  RNA polymerase II-associated protein 3 (188-196)
ggcagcuacuccaaggccuucgcuaga

SEQ ID NO: 54422 - RNA, 30 nt, Artificial Sequence
  Zinc finger E-box-binding homeobox 1 (190-199)
ggcagcuacuccucucacaucucaaguaag

SEQ ID NO: 54423 - RNA, 27 nt, Artificial Sequence
  Dynein light chain 1, cytoplasmic (63-71)
ggcagcuacgugacccacgagacaaag

SEQ ID NO: 54424 - RNA, 30 nt, Artificial Sequence
  39S ribosomal protein L2, mitochondrial (222-231)
ggcaccgccaucauucagcugcccagcaag

SEQ ID NO: 54425 - RNA, 27 nt, Artificial Sequence
  Fidgetin-like protein 1 (444-452)
ggcaccgggaagacacugaucggaaaa

SEQ ID NO: 54426 - RNA, 27 nt, Artificial Sequence
  ATP-binding cassette sub-family F member 3 (103-111)
ggcaccaagcugcccgggcuccuuaaa

SEQ ID NO: 54427 - RNA, 27 nt, Artificial Sequence
  WD repeat-containing protein 46 (390-398)
ggcaccuaccagccccugagcacaaga

SEQ ID NO: 54428 - RNA, 27 nt, Artificial Sequence
  Protein quaking (198-206)
ggcaccuacagagacgccaacaucaag

SEQ ID NO: 54429 - RNA, 27 nt, Artificial Sequence
  Rho-associated protein kinase 1 (285-293)
ggcaccuacagcaagaucaugaaccac

SEQ ID NO: 54430 - RNA, 27 nt, Artificial Sequence
  Protein phosphatase 1 regulatory subunit 7 (159-167)
ggcguggacaagcugaccagacucaaa

SEQ ID NO: 54431 - RNA, 27 nt, Artificial Sequence
  Profilin-1 (118-126)
ggcgugcacgggggacugaucaacaag

SEQ ID NO: 54432 - RNA, 33 nt, Artificial Sequence
  Exosome complex component RRP40 (136-146)
ggcgugaucgggcaggacggacugcucuucaag

SEQ ID NO: 54433 - RNA, 27 nt, Artificial Sequence
  Ubiquinol-cytochrome-c reductase complex assembly factor 1 (118-126)
ggcgugaaccccuacauccugaagaaa

SEQ ID NO: 54434 - RNA, 27 nt, Artificial Sequence
  Eukaryotic translation initiation factor 3 subunit C-like protein (190-198)
ggcgugagcgccgcuaccuuccugaag

SEQ ID NO: 54435 - RNA, 27 nt, Artificial Sequence
  Antizyme inhibitor 1 (319-327)
ggcguguacgggagcuucgccuccaag

SEQ ID NO: 54436 - RNA, 30 nt, Artificial Sequence
  Nuclear pore complex protein Nup160 (105-114)
ggcguguacgucagcgagacccagaacaga

SEQ ID NO: 54437 - RNA, 27 nt, Artificial Sequence
  Alanine-tRNA ligase, cytoplasmic (301-309)
cacgccagaaccaucacaguggcucug

SEQ ID NO: 54438 - RNA, 27 nt, Artificial Sequence
  Transketolase (243-251)
cacgccagcgacagaaucauugcucug

SEQ ID NO: 54439 - RNA, 27 nt, Artificial Sequence
  Stathmin (64-72)
cacgaggccgaagugcugaagcagcuc

SEQ ID NO: 54440 - RNA, 27 nt, Artificial Sequence
  WD repeat-containing protein 6 (315-323)
cacgagggcgaaauccugcaggccuuc

SEQ ID NO: 54441 - RNA, 33 nt, Artificial Sequence
  Carbohydrate sulfotransferase 10 (215-225)
cacgagaucgcccccggcauuauaagaaaguac

SEQ ID NO: 54442 - RNA, 27 nt, Artificial Sequence
  Nardilysin (1054-1062)
cacgagaucgaagcccugaagagcuuc

SEQ ID NO: 54443 - RNA, 24 nt, Artificial Sequence
  LanC-like protein 1 (89-96)
cacggcuacgugaagcagagccug

SEQ ID NO: 54444 - RNA, 27 nt, Artificial Sequence
  Histone H2A.V (87-95)
cacauccauaagagccugauuggcaaa

SEQ ID NO: 54445 - RNA, 27 nt, Artificial Sequence
  E3 ubiquitin-protein ligase TRIP12 (1751-1759)
caccuggaggacaucgugagacagaag

SEQ ID NO: 54446 - RNA, 27 nt, Artificial Sequence
  Unconventional myosin-VI (430-438)
caccuguucgaccauguggucaacaga

SEQ ID NO: 54447 - RNA, 27 nt, Artificial Sequence
  Nardilysin (708-716)
caccugaucagcccccucauucagaag

SEQ ID NO: 54448 - RNA, 33 nt, Artificial Sequence
  Hermansky-Pudlak syndrome 5 protein (400-410)
caccugaagagccagcucgaccauggcaccuac

SEQ ID NO: 54449 - RNA, 27 nt, Artificial Sequence
  Integrin-linked protein kinase (248-256)
cacacccuggagccccucaucccuaga

SEQ ID NO: 54450 - RNA, 30 nt, Artificial Sequence
  Serine/threonine-protein kinase WNK1 (339-348)
cacaccagaacacccccuaucauucauagg

SEQ ID NO: 54451 - RNA, 27 nt, Artificial Sequence
  Centromere protein M (122-130)
cacaccuaccagagcccccugcucuau

SEQ ID NO: 54452 - RNA, 30 nt, Artificial Sequence
  T-complex protein 1 subunit epsilon (135-144)
cacgugaucgagacccugauuggcaagaaa

SEQ ID NO: 54453 - RNA, 27 nt, Artificial Sequence
  Gamma-interferon-inducible protein 16 (241-249)
cacgugaagguccugaacaccagccuc

SEQ ID NO: 54454 - RNA, 27 nt, Artificial Sequence
  Ankyrin repeat family A protein 2 (113-121)
cacguguacacccccagcacaacuaag

SEQ ID NO: 54455 - RNA, 30 nt, Artificial Sequence
  Little elongation complex subunit 1 (1936-1945)
cacguguacgucggcaacaucagcaagaaa

SEQ ID NO: 54456 - RNA, 33 nt, Artificial Sequence
  Deoxynucleoside triphosphate triphosphohydrolase SAMHD1 (397-407)
aucgagauuaccggcgccgggggaaagaaauac

SEQ ID NO: 54457 - RNA, 27 nt, Artificial Sequence
  Lanosterol 14-alpha demethylase (175-183)
aucgagaaggaaaccaaagaguacuuc

SEQ ID NO: 54458 - RNA, 27 nt, Artificial Sequence
  NADH dehydrogenase (ubiquinone) 1 beta subcomplex subunit 4 (60-68)
aucgagaaccccgcccugcucagaugg

SEQ ID NO: 54459 - RNA, 27 nt, Artificial Sequence
  Constitutive coactivator of PPAR-gamma-like protein 1 (325-333)
aucggcuacuauagcgccaccuccaag

SEQ ID NO: 54460 - RNA, 27 nt, Artificial Sequence
  T-complex protein 1 subunit gamma (155-163)
aucauuaacagcuccauaaccacaaag

SEQ ID NO: 54461 - RNA, 27 nt, Artificial Sequence
  TFIIH basal transcription factor complex helicase XPD subunit (533-541)
auccuggagaacauucagagaaauaag

SEQ ID NO: 54462 - RNA, 27 nt, Artificial Sequence
  Thymidine kinase, cytosolic (24-32)
auccugggccccauguucagcgggaag

SEQ ID NO: 54463 - RNA, 27 nt, Artificial Sequence
  Pre-mRNA-processing-splicing factor 8 (2105-2113)
auccugcccaagaacgugcucaaaaag

SEQ ID NO: 54464 - RNA, 30 nt, Artificial Sequence
  BAG35700.1 (99-108)
auccugagagacggcauuaccgccgggaag

SEQ ID NO: 54465 - RNA, 27 nt, Artificial Sequence
  Trifunctional purine biosynthetic protein adenosine-3 (190-198)
auccugagcggccccuucgugcagaag

SEQ ID NO: 54466 - RNA, 27 nt, Artificial Sequence
  Actin, gamma-enteric smooth muscle (150-158)
auccugaccgagagaggcuacagcuuc

SEQ ID NO: 54467 - RNA, 27 nt, Artificial Sequence
  Ornithine decarboxylase (218-226)
auccuguacgaccacgcccaugugaag

SEQ ID NO: 54468 - RNA, 27 nt, Artificial Sequence
  Peroxiredoxin-6 (147-155)
auccuguaccccgccaccacaggcaga

SEQ ID NO: 54469 - RNA, 27 nt, Artificial Sequence
  LYR motif-containing protein 1 (79-87)
auccccuacccuagaccaauucaccug

SEQ ID NO: 54470 - RNA, 27 nt, Artificial Sequence
  SWI/SNF complex subunit SMARCC2 (39-47)
auccaggccgagcccccuaccaacaag

SEQ ID NO: 54471 - RNA, 30 nt, Artificial Sequence
  Lysine-specific histone demethylase 1B (637-646)
auccaguucaaccccccucugagcgagaag

SEQ ID NO: 54472 - RNA, 27 nt, Artificial Sequence
  Induced myeloid leukemia cell differentiation protein Mcl-1 (115-123)
aucagcuucggcgccuuuguggcuaag

SEQ ID NO: 54473 - RNA, 27 nt, Artificial Sequence
  3-hydroxy-3-methylglutaryl-coenzyme A reductase (354-362)
aucaccagccccguggucacacagaag

SEQ ID NO: 54474 - RNA, 27 nt, Artificial Sequence
  Pre-mRNA-processing factor 40 homolog A (229-237)
aucguggccggcagccugauuaccaag

SEQ ID NO: 54475 - RNA, 27 nt, Artificial Sequence
  V-type proton ATPase 16 kDa proteolipid subunit (147-155)
aucguggcccugauucucagcaccaag

SEQ ID NO: 54476 - RNA, 27 nt, Artificial Sequence
  HLA class II histocompatibility antigen, DP alpha 1 chain (238-246)
aucgugggcaccguccugauuauaaag

SEQ ID NO: 54477 - RNA, 33 nt, Artificial Sequence; identical to SEQ ID NO: 30250
  ATP synthase subunit g, mitochondrial (56-66)

SEQ ID NO: 54478 - RNA, 30 nt, Artificial Sequence
  Interferon regulatory factor 9 (119-128)
aucgugagcggccagcccgggacccaaaag

SEQ ID NO: 54479 - RNA, 30 nt, Artificial Sequence; identical to SEQ ID NO: 30252
  Cleavage and polyadenylation specificity factor subunit 2 (17-26)

SEQ ID NO: 54480 - RNA, 27 nt, Artificial Sequence
  Serine palmitoyltransferase 2 (237-245)
aucguguacggccagcccagaaccagg

SEQ ID NO: 54481 - RNA, 27 nt, Artificial Sequence
  Sentrin-specific protease 6 (648-656)
aucguguaccccccuccaccggccaag

SEQ ID NO: 54482 - RNA, 30 nt, Artificial Sequence
  Elongation factor 1-gamma (428-437)
aaggccuucaaccagggcaaaaucuuuaag

SEQ ID NO: 54483 - RNA, 27 nt, Artificial Sequence
  Tyrosine-protein kinase BAZ1B (885-893)
aaggccuuccaggagggcaucgcuaaa

SEQ ID NO: 54484 - RNA, 30 nt, Artificial Sequence
  Zinc finger CCCH domain-containing protein 4 (890-899)
aaggccaaagagcccccuuucgugagaaag

SEQ ID NO: 54485 - RNA, 27 nt, Artificial Sequence
  Squalene monooxygenase (318-326)
aaggccaaccacgcugagcugauccuc

SEQ ID NO: 54486 - RNA, 27 nt, Artificial Sequence
  RNA cytidine acetyltransferase (367-375)
aaggccagcgagguguuccugcagaga

SEQ ID NO: 54487 - RNA, 27 nt, Artificial Sequence
  Ribonuclease inhibitor (226-234)
aaggccagccugagagagcucgcucuu

SEQ ID NO: 54488 - RNA, 27 nt, Artificial Sequence
  UDP-glucose:glycoprotein glucosyltransferase 2 (5-13)
aaggccaccaacguggucagacugcuc

SEQ ID NO: 54489 - RNA, 27 nt, Artificial Sequence
  Bifunctional apoptosis regulator (261-269)
aaggccgugaaccccggcagaagccug

SEQ ID NO: 54490 - RNA, 27 nt, Artificial Sequence
  SWI/SNF-related matrix-associated actin-dependent regulator of chromatin subfamily E member 1 (113-121)
aaggccuaccacaacagccccgcuuau

SEQ ID NO: 54491 - RNA, 27 nt, Artificial Sequence
  Zinc finger protein 302 (72-80)
aaggccuaccccuucccucugagccac

SEQ ID NO: 54492 - RNA, 27 nt, Artificial Sequence
  Phosphatidylinositol 4-phosphate 5-kinase type-1 alpha (187-195)
aaggaggccgaauuccugcagaaacuc

SEQ ID NO: 54493 - RNA, 33 nt, Artificial Sequence
  Transmembrane emp24 domain-containing protein 10 (87-97)
aaggaggacgccaccaaaggcaaguucgcuuuu

SEQ ID NO: 54494 - RNA, 27 nt, Artificial Sequence
  COP9 signalosome complex subunit 6 (78-86)
aaggaggaacaguucaaacaaguguuu

SEQ ID NO: 54495 - RNA, 27 nt, Artificial Sequence
  Septin-7 (100-108)
aaggagggcggggugcagcugcuccuu

SEQ ID NO: 54496 - RNA, 30 nt, Artificial Sequence
  Phosphatidylinositol-binding clathrin assembly protein (231-240)
aaggagggccuggacaucuacaaaaaguuc

SEQ ID NO: 54497 - RNA, 33 nt, Artificial Sequence
  Adenosylhomocysteinase 2 (20-30)
aaggagaucgaagacgccgagaaauacagcuuc

SEQ ID NO: 54498 - RNA, 27 nt, Artificial Sequence
  Heat shock protein HSP 90-alpha A2 (41-49)
aaggagaucuuccugagagaacucauu

SEQ ID NO: 54499 - RNA, 30 nt, Artificial Sequence
  Putative homeodomain transcription factor 2 (737-746)
aaggagcuggacagccccuucagacucuac

SEQ ID NO: 54500 - RNA, 30 nt, Artificial Sequence
  DnaJ homolog subfamily B member 14 (282-291)
aaggagcuggaaagacucaccagccuuuac

SEQ ID NO: 54501 - RNA, 27 nt, Artificial Sequence
  Ezrin (61-69)
aaggagaacccccugcaguucaaauuu

SEQ ID NO: 54502 - RNA, 30 nt, Artificial Sequence
  Integrator complex subunit 11 (493-502)
aaggagcaggaaaccgcccugagaguguac

SEQ ID NO: 54503 - RNA, 27 nt, Artificial Sequence
  Hypoxia-inducible factor 1-alpha (32-40)
aaggagagcgaaguguucuacgagcug

SEQ ID NO: 54504 - RNA, 27 nt, Artificial Sequence
  Moesin (72-80)
aaggagagcccccugcucuucaaauuu

SEQ ID NO: 54505 - RNA, 27 nt, Artificial Sequence
  Transcription elongation factor B polypeptide 2 (19-27)
aaggagagcuccaccguguucgaacug

SEQ ID NO: 54506 - RNA, 27 nt, Artificial Sequence
  CCAAT/enhancer-binding protein zeta (652-660)
aaggagaccgaaaucgugaaaaagcug

SEQ ID NO: 54507 - RNA, 27 nt, Artificial Sequence
  Small kinetochore-associated protein (78-86)
aaggagguggacgucagcaaacagcug

SEQ ID NO: 54508 - RNA, 27 nt, Artificial Sequence
  RANBP2-like and GRIP domain-containing protein 1 (31-39)
aaggaguacgaccuggccaaaaaguau

SEQ ID NO: 54509 - RNA, 27 nt, Artificial Sequence
  Mitochondrial fission 1 protein (85-93)
aaggaguacgaaaaagcccugaaguau

SEQ ID NO: 54510 - RNA, 27 nt, Artificial Sequence
  Spliceosome RNA helicase DDX39B (131-139)
aaggaguacgaaagauucagcaaauau

SEQ ID NO: 54511 - RNA, 27 nt, Artificial Sequence
  Activating signal cointegrator 1 complex subunit 2 (170-178)
aagggcaacagcccccugcuccagaaa

SEQ ID NO: 54512 - RNA, 27 nt, Artificial Sequence
  Fibroblast growth factor receptor 1 (669-677)
aagaucgccgacuucggccuggcuaga

SEQ ID NO: 54513 - RNA, 30 nt, Artificial Sequence
  Kinetochore protein Nuf2 (447-456)
aagaucgacgagaaaaccgccgaacugaag

SEQ ID NO: 54514 - RNA, 27 nt, Artificial Sequence
  60S ribosomal protein L7-like 1 (114-122)
aagaucuucagcggcguguuugucaaa

SEQ ID NO: 54515 - RNA, 27 nt, Artificial Sequence
  Tyrosine-protein kinase JAK2 (842-850)
aagaucggcgacuucgggcugaccaaa

SEQ ID NO: 54516 - RNA, 27 nt, Artificial Sequence
  Replication factor C subunit 1 (306-314)
aagaucggcgaggugagcucccccaaa

SEQ ID NO: 54517 - RNA, 27 nt, Artificial Sequence
  Replication factor C subunit 2 (176-184)
aagaucauugagcccauacagagcaga

SEQ ID NO: 54518 - RNA, 30 nt, Artificial Sequence
  T-complex protein 1 subunit eta (48-57)
aagaucaaagagauugccgugaccgucaag

SEQ ID NO: 54519 - RNA, 27 nt, Artificial Sequence
  40S ribosomal protein S18 (78-86)
aagauccccgacugguuccugaacaga

SEQ ID NO: 54520 - RNA, 27 nt, Artificial Sequence
  SAGA-associated factor 29 (50-58)
aagaucagccccuacuauagaaccaaa

SEQ ID NO: 54521 - RNA, 27 nt, Artificial Sequence
  B-cell linker protein (6-14)
aagaucaccgugcccgccagccagaaa

SEQ ID NO: 54522 - RNA, 30 nt, Artificial Sequence
  COMM domain-containing protein 2 (42-51)
aagaucuacgagggcgccgcuagaaaacug

SEQ ID NO: 54523 - RNA, 24 nt, Artificial Sequence
  SWI/SNF-related matrix-associated actin-dependent regulator of chromatin subfamily A member 5 (411-418)
aagaucuacgugggccugagcaaa

SEQ ID NO: 54524 - RNA, 27 nt, Artificial Sequence
  Cyclin-dependent kinase 4 (81-89)
aagcuggccgacuucggccucgcuaga

SEQ ID NO: 54525 - RNA, 27 nt, Artificial Sequence
  DNA-dependent protein kinase catalytic subunit (1617-1625)
aagcuggccaccacaauccuccagcac

SEQ ID NO: 54526 - RNA, 27 nt, Artificial Sequence
  Myc proto-oncogene protein (341-349)
aagcuggacagcgugagaguccucagg

SEQ ID NO: 54527 - RNA, 33 nt, Artificial Sequence
  Translationally-controlled tumor protein (102-112)
aagcuggaggaacagagacccgagagggugaaa

SEQ ID NO: 54528 - RNA, 33 nt, Artificial Sequence
  Cleavage stimulation factor subunit 1 (198-208)
aagcuguucgacuacagcaaacccuccgccaag

SEQ ID NO: 54529 - RNA, 27 nt, Artificial Sequence
  Baculoviral IAP repeat-containing protein 2 (45-53)
aagcugggcgacagccccauccagaaa

SEQ ID NO: 54530 - RNA, 27 nt, Artificial Sequence
  Nucleolar protein 58 (93-101)
aagcugggcggggugaucaaagagaag

SEQ ID NO: 54531 - RNA, 30 nt, Artificial Sequence
  Serine/threonine-protein kinase Chk1 (461-470)
aagcugaucgacauugugagcucccagaaa

SEQ ID NO: 54532 - RNA, 27 nt, Artificial Sequence
  SHC SH2 domain-binding protein 1 (262-270)
aagcugaucgagaacccccuccuuaga

SEQ ID NO: 54533 - RNA, 33 nt, Artificial Sequence
  40S ribosomal protein S9 (30-40)
aagcugaucggcgaguacgggcucagaaacaaa

SEQ ID NO: 54534 - RNA, 33 nt, Artificial Sequence
  60S ribosomal protein L19 (24-34)
aagcugaucaaagacggccucauuauaagaaag

SEQ ID NO: 54535 - RNA, 33 nt, Artificial Sequence
  Myc proto-oncogene protein (413-423)
aagcugaucagcgaggaagaccuccuuagaaaa

SEQ ID NO: 54536 - RNA, 30 nt, Artificial Sequence
  60S ribosomal protein L4 (173-182)
aagcugaaagccuggaacgacaucaagaaa

SEQ ID NO: 54537 - RNA, 27 nt, Artificial Sequence
  Galactosylgalactosylxylosylprotein 3-beta-glucuronosyltransferase 3 (4-12)
aagcugaaaaacguguuccucgccuac

SEQ ID NO: 54538 - RNA, 27 nt, Artificial Sequence
  BRISC and BRCA1-A complex member 1 (297-305)
aagcugcucgcccacccccuucagaga

SEQ ID NO: 54539 - RNA, 30 nt, Artificial Sequence
  SWI/SNF-related matrix-associated actin-dependent regulator of chromatin subfamily D member 3 (176-185)
aagcugcucgacgaucccagcaaacagaag

SEQ ID NO: 54540 - RNA, 27 nt, Artificial Sequence
  Tyrosine-tRNA ligase, cytoplasmic (319-327)
aagcugcucgaccccaucagagagaaa

SEQ ID NO: 54541 - RNA, 33 nt, Artificial Sequence
  T-complex protein 1 subunit eta (55-65)
aagcugcucgacgugguccaccccgccgcuaaa

SEQ ID NO: 54542 - RNA, 33 nt, Artificial Sequence
  40S ribosomal protein S16 (49-59)
aagcugcucgagcccgugcuucuguugggcaaa

SEQ ID NO: 54543 - RNA, 27 nt, Artificial Sequence
  Prefoldin subunit 6 (58-66)
aagcugcucggccccgugcuugucaaa

SEQ ID NO: 54544 - RNA, 30 nt, Artificial Sequence
  Nucleolar protein 7 (112-121)
aagcugcuccccgacaccauccuugagaaa

SEQ ID NO: 54545 - RNA, 27 nt, Artificial Sequence
  Target of rapamycin complex 2 subunit MAPKAP1 (222-230)
aagcugaacgacaaugugagcgccuac

SEQ ID NO: 54546 - RNA, 27 nt, Artificial Sequence
  116 kDa U5 small nuclear ribonucleoprotein component (409-417)
aagcugaacaucagaccccuccuuagg

SEQ ID NO: 54547 - RNA, 30 nt, Artificial Sequence
  60S ribosomal protein L4 (327-336)
aagcugaaccccuacgccaaaaccaugaga

SEQ ID NO: 54548 - RNA, 27 nt, Artificial Sequence
  Activator of 90 kDa heat shock protein ATPase homolog 1 (10-18)
aagcugaacuggaccggcacaagcaaa

SEQ ID NO: 54549 - RNA, 27 nt, Artificial Sequence
  U5 small nuclear ribonucleoprotein 200 kDa helicase (885-893)
aagcugcccgaggaaguggucaaaaag

SEQ ID NO: 54550 - RNA, 27 nt, Artificial Sequence
  Class E basic helix-loop-helix protein 40 (51-59)
aagcugccccacagacucaucgagaaa

SEQ ID NO: 54551 - RNA, 30 nt, Artificial Sequence
  60S ribosomal protein L27a (116-125)
aagcugcccaaacagccugugaucgucaag

SEQ ID NO: 54552 - RNA, 30 nt, Artificial Sequence
  Hematopoietic SH2 domain-containing protein  (6-15)
aagcugccccucccucuuccaccgagacug

SEQ ID NO: 54553 - RNA, 27 nt, Artificial Sequence
  EH domain-containing protein 1 (475-483)
aagcugcccaacaccgugcucggcaaa

SEQ ID NO: 54554 - RNA, 27 nt, Artificial Sequence
  Protein SET (75-83)
aagcugagacagcccuucuuucaaaaa

SEQ ID NO: 54555 - RNA, 27 nt, Artificial Sequence
  Phosphatidylethanolamine-binding protein 1 (88-96)
aagcuguacgagcagcucagcggcaaa

SEQ ID NO: 54556 - RNA, 27 nt, Artificial Sequence
  Cilia- and flagella-associated protein 20 (182-190)
aagcuguaccuccccgugcagaacaaa

SEQ ID NO: 54557 - RNA, 27 nt, Artificial Sequence
  Polyribonucleotide 5'-hydroxyl-kinase Clp1 (198-206)
aagcuguacaacaaaaucaccagcaga

SEQ ID NO: 54558 - RNA, 27 nt, Artificial Sequence
  DnaJ homolog subfamily B member 14 (36-44)
aagcuguacccccucccuagcgccaga

SEQ ID NO: 54559 - RNA, 27 nt, Artificial Sequence
  Elongator complex protein 3 (316-324)
aagcuguaccccacccucgugaucaga

SEQ ID NO: 54560 - RNA, 33 nt, Artificial Sequence
  Nodal modulator 2 (57-67)
aagcuguacaccaaacacggcacacucaaguau

SEQ ID NO: 54561 - RNA, 30 nt, Artificial Sequence
  Midasin (592-601)
aagauggccgaggugaucggcagcaaacug

SEQ ID NO: 54562 - RNA, 27 nt, Artificial Sequence
  BCL-6 corepressor (460-468)
aagauggcccccaccgugcugguccac

SEQ ID NO: 54563 - RNA, 27 nt, Artificial Sequence
  Low density lipoprotein receptor adapter protein 1 (123-131)
aagaugcacgacaaaguguucgccuac

SEQ ID NO: 54564 - RNA, 33 nt, Artificial Sequence
  Protein FAM136A (128-138)
aagaugaaagaggcccugcucagcaucggcaag

SEQ ID NO: 54565 - RNA, 27 nt, Artificial Sequence
  Protein LAP2 (174-182)
aagaugcugcccaaaaccaugaacaga

SEQ ID NO: 54566 - RNA, 33 nt, Artificial Sequence
  Selenoprotein T (32-42)
aagaugcaguacgccaccggcccccugcucaaa

SEQ ID NO: 54567 - RNA, 27 nt, Artificial Sequence
  Enhancer of rudimentary homolog (34-42)
aagauguacgaggaacaccugaaaaga

SEQ ID NO: 54568 - RNA, 30 nt, Artificial Sequence
  cAMP-dependent protein kinase catalytic subunit beta (71-80)
aagcagaucgagcacacccugaacgaaaaa

SEQ ID NO: 54569 - RNA, 30 nt, Artificial Sequence
  Pumilio homolog 3 (310-319)
aagcagauccugacccccauggcccaaaaa

SEQ ID NO: 54570 - RNA, 33 nt, Artificial Sequence
  Small EDRK-rich factor 2 (37-47)
aagcagagagacagcgagaucaugcaacagaaa

SEQ ID NO: 54571 - RNA, 33 nt, Artificial Sequence
  T-complex protein 1 subunit theta (98-108)
aagcaguacggcaacgagguguuccuggccaaa

SEQ ID NO: 54572 - RNA, 27 nt, Artificial Sequence
  60S ribosomal protein L10a (47-55)
aagagauucagcggcaccgugaggcug

SEQ ID NO: 54573 - RNA, 27 nt, Artificial Sequence
  A-kinase anchor protein 13 (266-274)
aagagacaggaggugaucuacgaacug

SEQ ID NO: 54574 - RNA, 27 nt, Artificial Sequence
  DNA replication licensing factor MCM4 (216-224)
aagagcuucgacaaaaaccuguacaga

SEQ ID NO: 54575 - RNA, 30 nt, Artificial Sequence
  Renin receptor (255-264)
aagagcuucgacaccucccugaucagaaaa

SEQ ID NO: 54576 - RNA, 27 nt, Artificial Sequence
  Chromosome alignment-maintaining phosphoprotein 1 (334-342)
aagagcggccccccugagcugagaaaa

SEQ ID NO: 54577 - RNA, 27 nt, Artificial Sequence
  Aurora kinase B (125-133)
aagagccacuucaucguggcccugaaa

SEQ ID NO: 54578 - RNA, 30 nt, Artificial Sequence
  Cytoplasmic FMR1-interacting protein 2 (777-786)
aagagccuggaccaggccaucuccagauuc

SEQ ID NO: 54579 - RNA, 30 nt, Artificial Sequence
  WD repeat-containing protein 36 (360-369)
aagagccugggccacgggcucaucaacaaa

SEQ ID NO: 54580 - RNA, 27 nt, Artificial Sequence
  Mediator of RNA polymerase II transcription subunit 27 (195-203)
aagagcaacuaccagguguuccaaaaa

SEQ ID NO: 54581 - RNA, 27 nt, Artificial Sequence
  Transport and Golgi organization protein 6 homolog (711-719)
aagagcuccgacuucgccgugcugaaa

SEQ ID NO: 54582 - RNA, 27 nt, Artificial Sequence
  Histone H3.3 (57-65)
aagagcaccgagcugcucaucagaaaa

SEQ ID NO: 54583 - RNA, 27 nt, Artificial Sequence
  Nucleolar protein 7 (170-178)
aagagcuaccuggccgugagacucaaa

SEQ ID NO: 54584 - RNA, 27 nt, Artificial Sequence
  116 kDa U5 small nuclear ribonucleoprotein component (612-620)
aagagcuaccccucccugaccacaaaa

SEQ ID NO: 54585 - RNA, 30 nt, Artificial Sequence
  Pre-mRNA-processing-splicing factor 8 (1792-1801)
aagaccuucgagggcaaccugacaacuaaa

SEQ ID NO: 54586 - RNA, 27 nt, Artificial Sequence
  Zinc finger and BTB domain-containing protein 40 (1053-1061)
aagaccuuccccaacacaaucgagcac

SEQ ID NO: 54587 - RNA, 27 nt, Artificial Sequence
  Protein FAM3C (112-120)
aagaccggcgaggugcuggacacaaaa

SEQ ID NO: 54588 - RNA, 30 nt, Artificial Sequence
  Pseudouridylate synthase 7 homolog (77-86)
aagaccaaagaccccacagccgcucugaga

SEQ ID NO: 54589 - RNA, 30 nt, Artificial Sequence
  60S ribosomal protein L4 (163-172)
aagaccaaagaggccgugcugcuccuuaag

SEQ ID NO: 54590 - RNA, 30 nt, Artificial Sequence
  Cyclin-dependent kinase 11A (11-20)
aagacccuggacgagauccuccaggaaaaa

SEQ ID NO: 54591 - RNA, 33 nt, Artificial Sequence
  RNA cytidine acetyltransferase (184-194)
aagacccuggaccaggccaaagcugugcucaag

SEQ ID NO: 54592 - RNA, 27 nt, Artificial Sequence
  Huntingtin (1402-1410)
aagaccaaccugacaagcgugacuaaa

SEQ ID NO: 54593 - RNA, 27 nt, Artificial Sequence
  Actin-related protein 2/3 complex subunit 2 (214-222)
aagaccagcgacuuccugaaagugcuc

SEQ ID NO: 54594 - RNA, 27 nt, Artificial Sequence
  Cyclin-dependent kinase 11B (551-559)
aagaccagcaaccugcuccuuucccac

SEQ ID NO: 54595 - RNA, 27 nt, Artificial Sequence
  26S proteasome non-ATPase regulatory subunit 1 (302-310)
aagaccagcuccgccuucgugggcaaa

SEQ ID NO: 54596 - RNA, 27 nt, Artificial Sequence
  Zinc finger FYVE domain-containing protein 16 (1328-1336)
aagaccagcuccggcuuccuggccaaa

SEQ ID NO: 54597 - RNA, 33 nt, Artificial Sequence
  Cyclic AMP-dependent transcription factor ATF-6 beta (655-665)
aagaccagcacagugcccccuucccugagaaaa

SEQ ID NO: 54598 - RNA, 27 nt, Artificial Sequence
  Bridging integrator 3 (67-75)
aagaccgugaucgagccccugaaaaag

SEQ ID NO: 54599 - RNA, 30 nt, Artificial Sequence
  DNA damage-binding protein 1 (191-200)
aagaccuacgaggugagccugagagaaaaa

SEQ ID NO: 54600 - RNA, 33 nt, Artificial Sequence
  26S proteasome non-ATPase regulatory subunit 11 (175-185)
aagaccuaccacgcccugagcaaccuccccaaa

SEQ ID NO: 54601 - RNA, 33 nt, Artificial Sequence
  High mobility group protein B1 (76-86)
aagaccuacauccccccuaaaggcgagacaaag

SEQ ID NO: 54602 - RNA, 33 nt, Artificial Sequence
  DNA-directed RNA polymerase II subunit RPB1 (697-707)
aagaccuaccaggacauccaaaacacaauuaaa

SEQ ID NO: 54603 - RNA, 27 nt, Artificial Sequence
  Interferon-induced, double-stranded RNA-activated protein kinase (291-299)
aagaccuacgugaucaaaagagucaag

SEQ ID NO: 54604 - RNA, 27 nt, Artificial Sequence
  T-complex protein 1 subunit theta (296-304)
aagguggccgacauggcucugcacuac

SEQ ID NO: 54605 - RNA, 30 nt, Artificial Sequence
  RNA-binding protein 43 (71-80)
aagguggccgagaacgucaucagacagaaa

SEQ ID NO: 54606 - RNA, 27 nt, Artificial Sequence
  Serine/threonine-protein kinase Chk2 (245-253)
aagguggccaucaaaauuauaagcaag

SEQ ID NO: 54607 - RNA, 30 nt, Artificial Sequence
  60S ribosomal protein L7a (11-20)
aagguggcccccgcuccugcagucguuaaa

SEQ ID NO: 54608 - RNA, 33 nt, Artificial Sequence
  60S ribosomal protein L7a (11-21)
aagguggcccccgcuccugcagucguuaaaaag

SEQ ID NO: 54609 - RNA, 30 nt, Artificial Sequence
  Heat shock cognate 71 kDa protein (601-610)
aaggugugcaaccccaucauuaccaaacug

SEQ ID NO: 54610 - RNA, 30 nt, Artificial Sequence
  60S ribosomal protein L13a (103-112)
aagguguucgacggcauccccccuccauac

SEQ ID NO: 54611 - RNA, 30 nt, Artificial Sequence
  GMP synthase (glutamine-hydrolyzing) (207-216)
aagguguucggcgggaccguccacaaaaag

SEQ ID NO: 54612 - RNA, 27 nt, Artificial Sequence
  Cytoskeleton-associated protein 5 (96-104)
aagguguucaaccagcccaaagccaag

SEQ ID NO: 54613 - RNA, 30 nt, Artificial Sequence
  Thioredoxin (64-73)
aaggugggcgaguucagcggggccaacaaa

SEQ ID NO: 54614 - RNA, 27 nt, Artificial Sequence
  28S ribosomal protein S17, mitochondrial (90-98)
aaggugaucgaccccgucaccggcaaa

SEQ ID NO: 54615 - RNA, 27 nt, Artificial Sequence
  Serine hydroxymethyltransferase, mitochondrial (238-246)
aaggugauccccagcccuuucaaacac

SEQ ID NO: 54616 - RNA, 30 nt, Artificial Sequence
  Structural maintenance of chromosomes protein 4 (512-521)
aaggugcuggacgccaucauucaggagaaa

SEQ ID NO: 54617 - RNA, 30 nt, Artificial Sequence
  Eukaryotic translation initiation factor 3 subunit L (292-301)
aaggugcuggagaacaucgaacucaauaaa

SEQ ID NO: 54618 - RNA, 33 nt, Artificial Sequence
  G2/mitotic-specific cyclin-B2 (318-328)
aaggugcugggccaggggaaauggaaccucaag

SEQ ID NO: 54619 - RNA, 27 nt, Artificial Sequence
  Tryptophan-tRNA ligase, mitochondrial (333-341)
aaggugcugcagaucggcagcgccaaa

SEQ ID NO: 54620 - RNA, 30 nt, Artificial Sequence
  Septin-7 (185-194)
aaggugaacaucauuccccugauagccaaa

SEQ ID NO: 54621 - RNA, 30 nt, Artificial Sequence
  Septin-2 (174-183)
aaggugaacaucguccccguuauugccaaa

SEQ ID NO: 54622 - RNA, 27 nt, Artificial Sequence
  Transferrin receptor protein 1 (495-503)
aaggugagcgccuccccccugcucuac

SEQ ID NO: 54623 - RNA, 27 nt, Artificial Sequence
  B-lymphocyte antigen CD19 (291-299)
aaggugagcgccgucacccuggcuuac

SEQ ID NO: 54624 - RNA, 27 nt, Artificial Sequence
  Astrotactin-2 (149-157)
aaggugagcgacuacauccugcagcac

SEQ ID NO: 54625 - RNA, 27 nt, Artificial Sequence
  Thioredoxin-related transmembrane protein 2 (207-215)
aaggugagcaccuccccccugacaaaa

SEQ ID NO: 54626 - RNA, 30 nt, Artificial Sequence
  Rab GDP dissociation inhibitor beta (23-32)
aaggugaccgagggcagcuucgucuacaaa

SEQ ID NO: 54627 - RNA, 27 nt, Artificial Sequence
  Unconventional myosin-Id (707-715)
aagguguggagaggcacccuggccagg

SEQ ID NO: 54628 - RNA, 27 nt, Artificial Sequence
  Nipped-B-like protein (52-60)
aagguguacgacaaagccaucaacaga

SEQ ID NO: 54629 - RNA, 33 nt, Artificial Sequence
  78 kDa glucose-regulated protein (446-456)
aagguguacgagggcgaaagaccccugaccaaa

SEQ ID NO: 54630 - RNA, 27 nt, Artificial Sequence
  Eukaryotic translation initiation factor 3 subunit L (70-78)
aagguguacgagcugcaggccagcaga

SEQ ID NO: 54631 - RNA, 27 nt, Artificial Sequence
  E3 ubiquitin-protein ligase RAD18 (115-123)
aagguguacacccccgucgccagcaga

SEQ ID NO: 54632 - RNA, 30 nt, Artificial Sequence
  Motile sperm domain-containing protein 2 (172-181)
aagguguacuaucccaaauaccugagcaag

SEQ ID NO: 54633 - RNA, 30 nt, Artificial Sequence; identical to SEQ ID NO: 30406
  Ubiquitin-associated protein 2-like (87-96)

SEQ ID NO: 54634 - RNA, 27 nt, Artificial Sequence
  Microtubule-associated protein RP/EB family member 1 (67-75)
cuggagcacgaauacauccagaacuuc

SEQ ID NO: 54635 - RNA, 24 nt, Artificial Sequence
  Hyaluronan mediated motility receptor (121-128)
cuggagaagcagcucaucgaacuu

SEQ ID NO: 54636 - RNA, 30 nt, Artificial Sequence
  DNA replication licensing factor MCM2 (790-799)
cuggagagcuucaucgacacccagaaguuu

SEQ ID NO: 54637 - RNA, 30 nt, Artificial Sequence
  Guanine nucleotide-binding protein G(s) subunit alpha isoforms short (286-295)
cugcucgccgagaaggugcuugcuggcaaa

SEQ ID NO: 54638 - RNA, 33 nt, Artificial Sequence
  Eukaryotic translation initiation factor 3 subunit C-like protein (634-644)
cugcucgacauccagagcuccggcagagccaag

SEQ ID NO: 54639 - RNA, 27 nt, Artificial Sequence
  Prelamin-A/C (140-148)
cugcucaacagcaaggaggccgcucuu

SEQ ID NO: 54640 - RNA, 33 nt, Artificial Sequence
  T-complex protein 1 subunit beta (109-119)
cugcucagagaggccgaaagccuuaucgcuaag

SEQ ID NO: 54641 - RNA, 33 nt, Artificial Sequence
  Methionine synthase reductase (6-16)
cugcucuacgccacccagcaaggccaggcuaag

SEQ ID NO: 54642 - RNA, 30 nt, Artificial Sequence
  Replication factor C subunit 5 (57-66)
cugcucuacggccccccugggaccggaaag

SEQ ID NO: 54643 - RNA, 27 nt, Artificial Sequence
  Leucine-rich repeat-containing protein 58 (83-91)
cugccccacaacagacucgugagccuu

SEQ ID NO: 54644 - RNA, 27 nt, Artificial Sequence
  Ribosomal RNA processing protein 1 homolog B (585-593)
cugcccagccagaagaccgccucccuc

SEQ ID NO: 54645 - RNA, 27 nt, Artificial Sequence
  Proteasome assembly chaperone 2 (40-48)
cugcccagcagaaagcucguggcccuu

SEQ ID NO: 54646 - RNA, 27 nt, Artificial Sequence
  Squalene monooxygenase (548-556)
cugagcuccggcgccgugcucuacaag

SEQ ID NO: 54647 - RNA, 27 nt, Artificial Sequence
  Neuroguidin (201-209)
cugagcuccucugugaucagagagcuc

SEQ ID NO: 54648 - RNA, 27 nt, Artificial Sequence
  60S ribosomal protein L34 (11-19)
cugagcuacaacaccgccuccaauaag

SEQ ID NO: 54649 - RNA, 30 nt, Artificial Sequence
  Importin subunit alpha-1 (344-353)
cugaccaaccccaagacaaauauccagaaa

SEQ ID NO: 54650 - RNA, 30 nt, Artificial Sequence; identical to SEQ ID NO: 30423
  40S ribosomal protein S7 (131-140)

SEQ ID NO: 54651 - RNA, 27 nt, Artificial Sequence
  Filamin-A (1766-1774)
cuggugauccccuucaccauuaagaaa

SEQ ID NO: 54652 - RNA, 27 nt, Artificial Sequence
  PRELI domain containing protein 3B (186-194)
auggccgcugcagccuucgcggagaag

SEQ ID NO: 54653 - RNA, 27 nt, Artificial Sequence
  Cyclin-T1 (410-418)
auggaggccaacgugaagagccaguac

SEQ ID NO: 54654 - RNA, 27 nt, Artificial Sequence
  Transformation/transcription domain-associated protein (1736-1744)
auggaggaagagauccccaagaacuac

SEQ ID NO: 54655 - RNA, 27 nt, Artificial Sequence
  Nucleolar protein 58 (64-72)
auggagggcaagaucaacaaacagcug

SEQ ID NO: 54656 - RNA, 27 nt, Artificial Sequence
  Ribonucleoside-diphosphate reductase subunit M2 (228-236)
auggagaacauccacagcgaaauguac

SEQ ID NO: 54657 - RNA, 30 nt, Artificial Sequence
  Dolichyl-diphosphooligosaccharide-proteinosyltransferase 48 kDa subunit (18-27)
auggagcccagcaccgccgcuagagcaugg

SEQ ID NO: 54658 - RNA, 33 nt, Artificial Sequence
  Large proline-rich protein BAG6 (929-939)
augcccgugggcccugacgccauccugagauac

SEQ ID NO: 54659 - RNA, 27 nt, Artificial Sequence
  60S ribosomal protein L26 (30-38)
augagcuccccccugucuaaggagcuc

SEQ ID NO: 54660 - RNA, 27 nt, Artificial Sequence
  Histone deacetylase 1 (37-45)
augacccacaaccugcuccuuaauuac

SEQ ID NO: 54661 - RNA, 27 nt, Artificial Sequence
  Myosin-7B (138-146)
aacgaggccagcgugcugcacaaucuc

SEQ ID NO: 54662 - RNA, 27 nt, Artificial Sequence
  DnaJ homolog subfamily B member 5 (16-24)
aacgaggacgaaaucaagaaagccuac

SEQ ID NO: 54663 - RNA, 27 nt, Artificial Sequence
  Nuclear factor interleukin-3-regulated protein (343-351)
aacgaguucgaagccacccagaagcug

SEQ ID NO: 54664 - RNA, 27 nt, Artificial Sequence
  Ras-related protein Rab-7a (184-192)
aacgaguuccccgaaccuaucaagcug

SEQ ID NO: 54665 - RNA, 30 nt, Artificial Sequence
  Kinetochore protein NDC80 homolog (555-564)
aacgagcuggacgccgugcagagagaauac

SEQ ID NO: 54666 - RNA, 27 nt, Artificial Sequence
  Putative eukaryotic translation initiation factor 2 subunit 3-like protein (71-79)
aacgagcuggaaagaaauaucaccauu

SEQ ID NO: 54667 - RNA, 27 nt, Artificial Sequence
  Fizzy-related protein homolog (412-420)
aacgagcuggugagcacccacggcuac

SEQ ID NO: 54668 - RNA, 27 nt, Artificial Sequence
  Mediator of RNA polymerase II transcription subunit 23 (148-156)
aacgagaaugacaucauuacccacuuc

SEQ ID NO: 54669 - RNA, 27 nt, Artificial Sequence
  CUGBP Elav-like family member 2 (120-128)
aacgagaaugacaucagagugauguuc

SEQ ID NO: 54670 - RNA, 27 nt, Artificial Sequence
  Serine/threonine-protein kinase PAK 2 (445-453)
aacgagaauccccugagagcccucuac

SEQ ID NO: 54671 - RNA, 27 nt, Artificial Sequence
  Serine/threonine/tyrosine-interacting-like protein 1 (124-132)
aacgagcagacccugcaaagaagcugg

SEQ ID NO: 54672 - RNA, 27 nt, Artificial Sequence
  Monocarboxylate transporter 7 (57-65)
aacgagagcaauuccagaaucucuugg

SEQ ID NO: 54673 - RNA, 27 nt, Artificial Sequence
  Oxysterol-binding protein-related protein 9 (671-679)
aacgaguacgaaagcagaucccugugg

SEQ ID NO: 54674 - RNA, 27 nt, Artificial Sequence
  DnaJ homolog subfamily A member 1 (120-128)
aacggcgccaccagaaagcuggcucuc

SEQ ID NO: 54675 - RNA, 27 nt, Artificial Sequence
  Lysine-specific histone demethylase 1A (474-482)
aaccugaaggagaaaaucaaggaacuc

SEQ ID NO: 54676 - RNA, 27 nt, Artificial Sequence
  Histone-binding protein RBBP4 (245-253)
aaccugaagcucaaacuucacagcuuc

SEQ ID NO: 54677 - RNA, 27 nt, Artificial Sequence
  AP-3 complex subunit delta-1 (372-380)
aaccugauggagaucgugaagaaacuc

SEQ ID NO: 54678 - RNA, 24 nt, Artificial Sequence
  Serine/threonine-protein phosphatase 2A 65 kDa regulatory subunit A beta isoform isoform b (350-357)
aaccagcacgugaagagcgcccug

SEQ ID NO: 54679 - RNA, 27 nt, Artificial Sequence
  Copine-8 (263-271)
aacguguacgaggucguuaaucccaag

SEQ ID NO: 54680 - RNA, 30 nt, Artificial Sequence
  Polypyrimidine tract-binding protein 1 (440-449)
caggaggaccaaggccugaccaaggauuac

SEQ ID NO: 54681 - RNA, 30 nt, Artificial Sequence
  Forkhead box protein K2 (318-327)
caggaggaacccggcaaggggagcuucugg

SEQ ID NO: 54682 - RNA, 33 nt, Artificial Sequence
  RNA polymerase II subunit A C-terminal domain phosphatase SSU72 (177-187)
caggaguucgaagagaagagcggcagaaccuuu

SEQ ID NO: 54683 - RNA, 27 nt, Artificial Sequence
  Alpha-galactosidase A (357-365)
caggagaucggcgggcccagaagcuac

SEQ ID NO: 54684 - RNA, 33 nt, Artificial Sequence
  Splicing factor 3B subunit 1 (41-51)
caggagaucuacggcgggagcgacuccagauuc

SEQ ID NO: 54685 - RNA, 30 nt, Artificial Sequence
  Translin-associated protein X (44-53)
caggagcuggacgccagacacgauaaguac

SEQ ID NO: 54686 - RNA, 27 nt, Artificial Sequence
  Mis18-binding protein 1 (582-590)
caggagcugaucggcaagaaagaauac

SEQ ID NO: 54687 - RNA, 30 nt, Artificial Sequence
  Desmin (113-122)
caggagcugaacgacagauucgccaauuac

SEQ ID NO: 54688 - RNA, 30 nt, Artificial Sequence
  DNA-(apurinic or apyrimidinic site) lyase (109-118)
caggagcugcccggccucagccaccaauac

SEQ ID NO: 54689 - RNA, 30 nt, Artificial Sequence
  Protein phosphatase 1G (202-211)
caggagaacggccccaccgccaaggcuuac

SEQ ID NO: 54690 - RNA, 27 nt, Artificial Sequence
  tRNA (cytosine(34)-C(5))-methyltransferase (545-553)
caggagaaccccuucuuuagaaagcug

SEQ ID NO: 54691 - RNA, 27 nt, Artificial Sequence
  Condensin-2 complex subunit H2 (444-452)
caggagaccgaacugagccaaagaauc

SEQ ID NO: 54692 - RNA, 27 nt, Artificial Sequence
  Protein C10 (28-36)
caggaggugaucaaggccuacggcuuc

SEQ ID NO: 54693 - RNA, 24 nt, Artificial Sequence
  60S ribosomal protein L6 (269-276)
cagggcuaccugagaagcguguuc

SEQ ID NO: 54694 - RNA, 27 nt, Artificial Sequence
  Histone deacetylase 2 (240-248)
cagaucuucaagcccauuauaagcaaa

SEQ ID NO: 54695 - RNA, 27 nt, Artificial Sequence
  60S ribosomal protein L7 (116-124)
cagaucuucaacggcaccuuugugaag

SEQ ID NO: 54696 - RNA, 30 nt, Artificial Sequence
  Ubiquitin-60S ribosomal protein L40 (7-16)
cagaucuucgugaagacccugacaggcaaa

SEQ ID NO: 54697 - RNA, 33 nt, Artificial Sequence
  40S ribosomal protein S16 (79-89)
cagaucuacgccauuagacaaagcauauccaag

SEQ ID NO: 54698 - RNA, 24 nt, Artificial Sequence
  60S ribosomal protein L15 (91-98)
cagcugaaguucgccagaagccuc

SEQ ID NO: 54699 - RNA, 27 nt, Artificial Sequence
  Cleft lip and palate transmembrane protein 1 (316-324)
cagcuguacgccgcucaaagcaccaag

SEQ ID NO: 54700 - RNA, 27 nt, Artificial Sequence
  Myosin-9 (648-656)
cagcuguacaaggagcaacucgccaaa

SEQ ID NO: 54701 - RNA, 27 nt, Artificial Sequence
  F-box only protein 5 (293-301)
cagcuguacagcaaggccauccaaaga

SEQ ID NO: 54702 - RNA, 24 nt, Artificial Sequence
  40S ribosomal protein S11 (18-25)
cagaacaagaaaagagugcugcuc

SEQ ID NO: 54703 - RNA, 27 nt, Artificial Sequence
  TRAF3-interacting JNK-activating modulator (38-46)
cagagcacccaaagaucccuggcccuc

SEQ ID NO: 54704 - RNA, 27 nt, Artificial Sequence
  U5 small nuclear ribonucleoprotein 200 kDa helicase (438-446)
cagaccuacgugggcaucacagagaag

SEQ ID NO: 54705 - RNA, 27 nt, Artificial Sequence
  40S ribosomal protein S9 (113-121)
cagguguucaagcugggccucgccaaa

SEQ ID NO: 54706 - RNA, 27 nt, Artificial Sequence
  Eukaryotic translation initiation factor 3 subunit E (354-362)
caggugaucgagaagaccaaaagccug

SEQ ID NO: 54707 - RNA, 27 nt, Artificial Sequence
  TCF3 fusion partner (94-102)
caggugaacgagagaguccugaauagg

SEQ ID NO: 54708 - RNA, 27 nt, Artificial Sequence
  Inorganic pyrophosphatase (9-17)
agagccgcucccuucagccuggaguac

SEQ ID NO: 54709 - RNA, 27 nt, Artificial Sequence
  ATP-dependent RNA helicase DDX19B (56-64)
agagccgcucagagccugcucaacaag

SEQ ID NO: 54710 - RNA, 27 nt, Artificial Sequence
  LBH domain-containing protein 1 (95-103)
agagccaacaucacccugagcggcaag

SEQ ID NO: 54711 - RNA, 27 nt, Artificial Sequence
  Midasin (1000-1008)
agagccagccaccccaucgugcagaag

SEQ ID NO: 54712 - RNA, 27 nt, Artificial Sequence
  Perilipin-2 (230-238)
agagccuaccagcaagcucugagcagg

SEQ ID NO: 54713 - RNA, 30 nt, Artificial Sequence
  Protein VPRBP (31-40)
agagaggccgaccagccccugaggaccuac

SEQ ID NO: 54714 - RNA, 27 nt, Artificial Sequence
  Signal peptidase complex subunit 2 (185-193)
agagaggccgaauucaccaagagcauc

SEQ ID NO: 54715 - RNA, 27 nt, Artificial Sequence
  NADH dehydrogenase (ubiquinone) 1 beta subcomplex subunit 11, mitochondrial (120-128)
agagaggccgaaaggcuggugaaguac

SEQ ID NO: 54716 - RNA, 27 nt, Artificial Sequence
  Ubiquilin-2 (597-605)
agagaggccaaccugcaggcucucauc

SEQ ID NO: 54717 - RNA, 27 nt, Artificial Sequence
  Gamma-taxilin (154-162)
agagaggaacacaucgacaagguguuc

SEQ ID NO: 54718 - RNA, 30 nt, Artificial Sequence
  Nuclear receptor-binding protein (234-243)
agagaggaacagaagaaccugcacuucuuu

SEQ ID NO: 54719 - RNA, 30 nt, Artificial Sequence
  Exostosin-2 (567-576)
agagaguuccccgacaggcuggugggcuac

SEQ ID NO: 54720 - RNA, 30 nt, Artificial Sequence
  Di-N-acetylchitobiase (169-178)
agagagaucgaaggcagccaggugaccuuc

SEQ ID NO: 54721 - RNA, 27 nt, Artificial Sequence
  Ataxin-2-like protein (324-332)
agagagaucgaaagcuccccccaguac

SEQ ID NO: 54722 - RNA, 30 nt, Artificial Sequence
  Sorting nexin-17 (146-155)
agagagaaggaagacggcgccuucagcuuu

SEQ ID NO: 54723 - RNA, 30 nt, Artificial Sequence
  Ras-related GTP-binding protein A (97-106)
agagagcuggaaaaggacaugcacuacuau

SEQ ID NO: 54724 - RNA, 27 nt, Artificial Sequence
  Tropomyosin alpha-3 chain (7-15)
agagagauggacgaacagaucaggcug

SEQ ID NO: 54725 - RNA, 30 nt, Artificial Sequence
  Tetratricopeptide repeat protein 39C (46-55)
agagagagcgaccagcuguucaagcaauac

SEQ ID NO: 54726 - RNA, 27 nt, Artificial Sequence
  Aurora kinase A (180-188)
agagagguggaaauccagagccaccug

SEQ ID NO: 54727 - RNA, 33 nt, Artificial Sequence
  Histone H2B type 2-E (48-58)
agaaucgccggcgaggcuagcaggcuggcacac

SEQ ID NO: 54728 - RNA, 33 nt, Artificial Sequence
  40S ribosomal protein S19 (133-143)
agaaucgccggccagguggcugcagccaacaag

SEQ ID NO: 54729 - RNA, 33 nt, Artificial Sequence
  60S ribosomal protein L18a (31-41)
agaaucuucgcccccaaccacguggucgcuaag

SEQ ID NO: 54730 - RNA, 27 nt, Artificial Sequence
  60S ribosomal protein L10 (32-40)
agaaucuucgaccugggcaggaagaaa

SEQ ID NO: 54731 - RNA, 33 nt, Artificial Sequence
  Nuclear pore complex protein Nup214 (26-36)
agaaucuucgacagccccgaggaacugccuaag

SEQ ID NO: 54732 - RNA, 30 nt, Artificial Sequence
  Ribonucleoside-diphosphate reductase subunit M2 (50-59)
agaaucuuccaggagcccaccgaaccuaag

SEQ ID NO: 54733 - RNA, 27 nt, Artificial Sequence
  Unconventional myosin-Ie (627-635)
agaaucuuccagaaguuucugcaaagg

SEQ ID NO: 54734 - RNA, 27 nt, Artificial Sequence
  Sorbitol dehydrogenase (56-64)
agaaucggcaacuucauugugaagaaa

SEQ ID NO: 54735 - RNA, 30 nt, Artificial Sequence
  Serine/threonine-protein kinase Nek6 (243-252)
agaauccacgagaacggcuacaauuucaag

SEQ ID NO: 54736 - RNA, 27 nt, Artificial Sequence
  U3 small nucleolar ribonucleoprotein protein MPP10 (48-56)
agaauccacggcagcccccugcagaag

SEQ ID NO: 54737 - RNA, 27 nt, Artificial Sequence
  60S ribosomal protein L31 (32-40)
agaauccacggcgugggguucaagaaa

SEQ ID NO: 54738 - RNA, 27 nt, Artificial Sequence
  Importin-8 (433-441)
agaaucauugaccuggugcuccagaag

SEQ ID NO: 54739 - RNA, 27 nt, Artificial Sequence
  Replication factor C subunit 4 (185-193)
agaaucauugagccccugaccagcagg

SEQ ID NO: 54740 - RNA, 27 nt, Artificial Sequence
  Putative Polycomb group protein ASXL1 (573-581)
agaaucaagcccccuuggguggucaaa

SEQ ID NO: 54741 - RNA, 27 nt, Artificial Sequence
  26S proteasome non-ATPase regulatory subunit 8 (196-204)
agaauccuguucuuuaacacccccaag

SEQ ID NO: 54742 - RNA, 27 nt, Artificial Sequence
  60S ribosomal protein L10a (122-130)
agaauccugggccccgggcucaacaag

SEQ ID NO: 54743 - RNA, 27 nt, Artificial Sequence
  40S ribosomal protein S7 (97-105)
agaauccugcccaagccuaccaggaaa

SEQ ID NO: 54744 - RNA, 27 nt, Artificial Sequence
  40S ribosomal protein S11 (71-79)
agaauccugagcggcguggucaccaag

SEQ ID NO: 54745 - RNA, 30 nt, Artificial Sequence
  Helicase-like transcription factor (514-523)
agaaucagggagcccgcccugcucagcaag

SEQ ID NO: 54746 - RNA, 33 nt, Artificial Sequence
  Heat shock 70 kDa protein 14 (56-66)
agaaucaggaacauuagcaauaccgugaugaag

SEQ ID NO: 54747 - RNA, 33 nt, Artificial Sequence
  Protein PML (31-41)
agaaucaggaccggcagcgcccuggugcagcgg

SEQ ID NO: 54748 - RNA, 27 nt, Artificial Sequence
  DNA-directed RNA polymerases I, II, and III subunit RPABC2 (51-59)
agaaucaccacacccuacaugacuaag

SEQ ID NO: 54749 - RNA, 27 nt, Artificial Sequence
  Translational activator GCN1 (122-130)
agaaucguguuccccagcagggccaag

SEQ ID NO: 54750 - RNA, 27 nt, Artificial Sequence
  Zinc finger protein 195 (247-255)
agaaucuacgccggcggggagcacuau

SEQ ID NO: 54751 - RNA, 33 nt, Artificial Sequence
  Fragile X mental retardation syndrome-related protein 1 (263-273)
agaaucuacggcgagagcgccgacgcugugaag

SEQ ID NO: 54752 - RNA, 27 nt, Artificial Sequence
  Dual specificity tyrosine-phosphorylation-regulated kinase 1A (317-325)
agaaucuaccaguauauucaaagcagg

SEQ ID NO: 54753 - RNA, 30 nt, Artificial Sequence
  Integrator complex subunit 1 (219-228)
agacuggccgaggcugcaguggccgaaaag

SEQ ID NO: 54754 - RNA, 30 nt, Artificial Sequence
  RNA pseudouridylate synthase domain-containing protein 4 (45-54)
agacuggccgagaagcucagggcucagaaa

SEQ ID NO: 54755 - RNA, 27 nt, Artificial Sequence
  Ubiquitin carboxyl-terminal hydrolase 19 (897-905)
agacuggccgaggugaucaagaacagg

SEQ ID NO: 54756 - RNA, 30 nt, Artificial Sequence
  Phosducin-like protein 3 (78-87)
agacuggccgaguggaaggcuaccaaacuc

SEQ ID NO: 54757 - RNA, 33 nt, Artificial Sequence
  40S ribosomal protein S21 (71-81)
agacuggccaaggcugacggcaucgugagcaaa

SEQ ID NO: 54758 - RNA, 27 nt, Artificial Sequence
  Golgi phosphoprotein 3 (176-184)
agacuggccaagaaccucguggagaaa

SEQ ID NO: 54759 - RNA, 33 nt, Artificial Sequence
  60S ribosomal protein L19 (9-19)
agacuggccagcuccgugcucaggugcggcaag

SEQ ID NO: 54760 - RNA, 30 nt, Artificial Sequence
  Guanine nucleotide-binding protein G(I)/G(S)/G(O) subunit gamma-5 (18-27)
agacuggaggccggccucaacagggugaag

SEQ ID NO: 54761 - RNA, 30 nt, Artificial Sequence
  40S ribosomal protein S9 (70-79)
agacuguucgagggcaacgcccuccuuagg

SEQ ID NO: 54762 - RNA, 27 nt, Artificial Sequence
  Cartilage-associated protein (107-115)
agacuguucggcgggcuccuuaggcgg

SEQ ID NO: 54763 - RNA, 24 nt, Artificial Sequence
  60S ribosomal protein L13 (190-197)
agacuguucggcaucagggccaag

SEQ ID NO: 54764 - RNA, 27 nt, Artificial Sequence
  Ubiquitin-associated domain-containing protein 2 (164-172)
agacuguuccccccucucaggcagcgg

SEQ ID NO: 54765 - RNA, 27 nt, Artificial Sequence
  Heterogeneous nuclear ribonucleoprotein R (146-154)
agacuguucgugggcagcauccccaag

SEQ ID NO: 54766 - RNA, 33 nt, Artificial Sequence
  Heterogeneous nuclear ribonucleoprotein Q (244-254)
agacuguucgugggcagcauccccaaguccaaa

SEQ ID NO: 54767 - RNA, 27 nt, Artificial Sequence
  DNA damage-binding protein 1 (327-335)
agacugggcgacagccagcucgugaag

SEQ ID NO: 54768 - RNA, 27 nt, Artificial Sequence
  Semaphorin-7A (24-32)
agacugggccucccccuuaggcugcgg

SEQ ID NO: 54769 - RNA, 27 nt, Artificial Sequence
  Cleavage and polyadenylation specificity factor subunit 1 (387-395)
agacugggcaacagccuccuucugaag

SEQ ID NO: 54770 - RNA, 27 nt, Artificial Sequence
  Pentatricopeptide repeat domain-containing protein 3, mitochondrial (15-23)
agacugggccagccccucaccgggagg

SEQ ID NO: 54771 - RNA, 30 nt, Artificial Sequence
  Egl nine homolog 2 (270-279)
agacugggcagcuacgugaucaacgggagg

SEQ ID NO: 54772 - RNA, 33 nt, Artificial Sequence
  Parkinson disease 7 domain-containing protein 1 (68-78)
agacugaaggccuacgcuagccccgcaaaacuc

SEQ ID NO: 54773 - RNA, 27 nt, Artificial Sequence
  Protein RRP5 homolog (385-393)
agacugaaggacggcgugcucgccuac

SEQ ID NO: 54774 - RNA, 33 nt, Artificial Sequence
  Nuclear pore complex protein Nup98-Nup96 (515-525)
agacugaagcccaccaacccugccgcucagaaa

SEQ ID NO: 54775 - RNA, 30 nt, Artificial Sequence
  HAUS augmin-like complex subunit 1 (226-235)
agacugaagcagcaaaccaucccccucaaa

SEQ ID NO: 54776 - RNA, 33 nt, Artificial Sequence
  FERM, RhoGEF and pleckstrin domain-containing protein 2 (321-331)
agacugcucgaccagcccaagccuaaagccaag

SEQ ID NO: 54777 - RNA, 30 nt, Artificial Sequence
  Glycogen synthase kinase-3 beta (319-328)
agacugcucgaguacacccccacagccagg

SEQ ID NO: 54778 - RNA, 33 nt, Artificial Sequence
  Nucleolar protein 56 (77-87)
agacugcuccuugagacccaccugcccagcaag

SEQ ID NO: 54779 - RNA, 30 nt, Artificial Sequence
  Histone H2B type 2-F (100-109)
agacugcuccuucccggcgagcuggccaag

SEQ ID NO: 54780 - RNA, 33 nt, Artificial Sequence
  Poly (ADP-ribose) polymerase 14 (858-868)
agacugcuccccggcaacgccaccaucagcaag

SEQ ID NO: 54781 - RNA, 27 nt, Artificial Sequence
  BTB/POZ domain-containing protein KCTD20 (259-267)
agacugaacgccccccucagccagaug

SEQ ID NO: 54782 - RNA, 30 nt, Artificial Sequence
  Tubulin gamma-1 chain (156-165)
agacugaacgacagguaccccaagaaacuc

SEQ ID NO: 54783 - RNA, 30 nt, Artificial Sequence
  LYR motif-containing protein 2 (5-14)
agacugcccccugccacccucacacuuaag

SEQ ID NO: 54784 - RNA, 27 nt, Artificial Sequence
  NF-kappa-B inhibitor beta (339-347)
agacugcccccuaccccagccagcaag

SEQ ID NO: 54785 - RNA, 27 nt, Artificial Sequence
  Kinesin-like protein KIF18B (390-398)
agacugcccagcuccacccucaagagg

SEQ ID NO: 54786 - RNA, 30 nt, Artificial Sequence
  Histone deacetylase 5 (529-538)
agacugcaggagaccggccuccuuagcaag

SEQ ID NO: 54787 - RNA, 33 nt, Artificial Sequence
  Egl nine homolog 2 (218-228)
agacugagggacggccagcucgugagccaacgg

SEQ ID NO: 54788 - RNA, 27 nt, Artificial Sequence
  HCLS1-associated protein X-1 (118-126)
agacugagggagggccagacccuccgg

SEQ ID NO: 54789 - RNA, 27 nt, Artificial Sequence
  AP-5 complex subunit zeta-1 (429-437)
agacugagcuuccccaaccucuuuaag

SEQ ID NO: 54790 - RNA, 27 nt, Artificial Sequence
  A-kinase anchor protein 11 (941-949)
agacugagcaaguccaucauuaaacac

SEQ ID NO: 54791 - RNA, 30 nt, Artificial Sequence
  40S ribosomal protein S4, X isoform (202-211)
agacugagcaacaucuucgugauuggcaag

SEQ ID NO: 54792 - RNA, 30 nt, Artificial Sequence
  Prelamin-A/C (307-316)
agacugagccccuccccuaccucucagagg

SEQ ID NO: 54793 - RNA, 30 nt, Artificial Sequence
  60S ribosomal protein L34 (10-19)
agacugagcuacaacaccgccuccaauaag

SEQ ID NO: 54794 - RNA, 30 nt, Artificial Sequence
  Proliferating cell nuclear antigen (5-14)
agacuggugcagggcagcauccucaagaaa

SEQ ID NO: 54795 - RNA, 30 nt, Artificial Sequence
  E3 ubiquitin-protein ligase MARCH6 (597-606)
agacuguacgagcacaucaagaacgacaaa

SEQ ID NO: 54796 - RNA, 27 nt, Artificial Sequence
  ATP-binding cassette sub-family D member 1 (172-180)
agacuguacuucagccagcaaaccuau

SEQ ID NO: 54797 - RNA, 27 nt, Artificial Sequence
  Kelch-like protein 20 (534-542)
agacuguacggcgggaugaacuauagg

SEQ ID NO: 54798 - RNA, 30 nt, Artificial Sequence
  Protein KIAA0100 (809-818)
agacuguacggcaacacccccaugaggcgg

SEQ ID NO: 54799 - RNA, 30 nt, Artificial Sequence
  Terminal uridylyltransferase 4 (269-278)
agacuguacggcagcucccucaccagguuc

SEQ ID NO: 54800 - RNA, 33 nt, Artificial Sequence
  TNF receptor-associated factor 1 (308-318)
agacuguaccucaacggcgacgggaccggaaag

SEQ ID NO: 54801 - RNA, 27 nt, Artificial Sequence
  DnaJ homolog subfamily B member 12 (36-44)
agacuguaccccaccccuagggugcgg

SEQ ID NO: 54802 - RNA, 30 nt, Artificial Sequence
  E3 ubiquitin-protein ligase UBR5 (2771-2780)
agacuguacgugccccucuauagcuccaag

SEQ ID NO: 54803 - RNA, 30 nt, Artificial Sequence
  60S ribosomal protein L4 (100-109)
agaauguucgcccccaccaagacauggagg

SEQ ID NO: 54804 - RNA, 33 nt, Artificial Sequence
  DNA methyltransferase 1-associated protein 1 (326-336)
agaaugaagcugcccagcuccgugggccagaaa

SEQ ID NO: 54805 - RNA, 27 nt, Artificial Sequence
  Dolichyl-diphosphooligosaccharide-proteinosyltransferase subunit 2 (619-627)
agaaugcuggcccagcaagcugugaag

SEQ ID NO: 54806 - RNA, 24 nt, Artificial Sequence
  Proteasome subunit beta type-5 (80-87)
agaaacaaggagaggaucagcgug

SEQ ID NO: 54807 - RNA, 27 nt, Artificial Sequence
  Chromosome transmission fidelity protein 8 homolog (109-117)
agacccaagccuaucauuaccagcgug

SEQ ID NO: 54808 - RNA, 24 nt, Artificial Sequence
  Zinc finger MIZ domain-containing protein 1 (589-596)
agacccagcgugagguccguccug

SEQ ID NO: 54809 - RNA, 27 nt, Artificial Sequence
  Apoptosis inhibitor 5 (189-197)
agacaggccgugccccuguucagcaag

SEQ ID NO: 54810 - RNA, 27 nt, Artificial Sequence
  39S ribosomal protein L55, mitochondrial (47-55)
agacaguucuggaccaggacaaagaaa

SEQ ID NO: 54811 - RNA, 27 nt, Artificial Sequence
  Phosphate carrier protein, mitochondrial (224-232)
agacagauccccuacaccaugaugaag

SEQ ID NO: 54812 - RNA, 27 nt, Artificial Sequence
  60S ribosomal protein L7a (89-97)
agacagaccgccacacaacugcucaag

SEQ ID NO: 54813 - RNA, 27 nt, Artificial Sequence
  Formin-binding protein 1 (239-247)
agacaggugauccccauuauaggcaag

SEQ ID NO: 54814 - RNA, 27 nt, Artificial Sequence
  F-box only protein 33 (21-29)
agacaguacgacaaguuccugacccac

SEQ ID NO: 54815 - RNA, 27 nt, Artificial Sequence
  Protein-lysine N-methyltransferase EEF2KMT (18-26)
agaagguuccuggccgcucggacccuc

SEQ ID NO: 54816 - RNA, 27 nt, Artificial Sequence
  Growth factor receptor-bound protein 2 (137-145)
agaaggggcgacuucauccacgugaug

SEQ ID NO: 54817 - RNA, 27 nt, Artificial Sequence
  60S ribosomal protein L23 (89-97)
agaaggaaggacggcguguuccuguac

SEQ ID NO: 54818 - RNA, 27 nt, Artificial Sequence
  Neuroepithelial cell-transforming gene 1 protein (32-40)
agaaggcaggaggccaucuacgaaaug

SEQ ID NO: 54819 - RNA, 27 nt, Artificial Sequence
  Isoleucine-tRNA ligase, cytoplasmic (402-410)
agaagcgacaccccccugaucuacaag

SEQ ID NO: 54820 - RNA, 27 nt, Artificial Sequence
  Uncharacterized protein KIAA1551 (365-373)
agaagccugggcuccucucccgugaag

SEQ ID NO: 54821 - RNA, 30 nt, Artificial Sequence
  60S ribosomal protein L30 (106-115)
agaagcaugcccgagcagaccggcgaaaag

SEQ ID NO: 54822 - RNA, 27 nt, Artificial Sequence
  Structural maintenance of chromosomes protein 3 (132-140)
agaagcaaccccuacuauaucgugaag

SEQ ID NO: 54823 - RNA, 30 nt, Artificial Sequence
  Protein BRICK1 (44-53)
agaagcaggcuggccacccucaacgagaag

SEQ ID NO: 54824 - RNA, 27 nt, Artificial Sequence
  Protein PRRC2C (2148-2156)
agaagcaccgaccccgugacaacuaag

SEQ ID NO: 54825 - RNA, 33 nt, Artificial Sequence
  Cytoskeleton-associated protein 2-like (319-329)
agaagcuaccccgugaccgagcagagggucaag

SEQ ID NO: 54826 - RNA, 27 nt, Artificial Sequence
  Heterogeneous nuclear ribonucleoprotein F (192-200)
agaagcuacuccgaccccccucugaag

SEQ ID NO: 54827 - RNA, 27 nt, Artificial Sequence
  Vimentin (28-36)
agaagcuacgugaccacauccacuagg

SEQ ID NO: 54828 - RNA, 27 nt, Artificial Sequence
  Sorting and assembly machinery component 50 homolog (240-248)
agaaccgccagcuucgcugugaggaag

SEQ ID NO: 54829 - RNA, 30 nt, Artificial Sequence
  T-complex protein 1 subunit eta (114-123)
agaaccgccacacagcuggcugugaacaag

SEQ ID NO: 54830 - RNA, 30 nt, Artificial Sequence
  UAP56-interacting factor (226-235)
agaaccgccgugcccagcuuccugacaaag

SEQ ID NO: 54831 - RNA, 27 nt, Artificial Sequence
  Plectin (471-479)
agaaccgaguacaaccugaggcucaag

SEQ ID NO: 54832 - RNA, 27 nt, Artificial Sequence
  Cyclin-dependent kinase 12 (1374-1382)
agaaccuucagcggcucccugucucac

SEQ ID NO: 54833 - RNA, 30 nt, Artificial Sequence
  Cold shock domain-containing protein E1 (78-87)
agaaccggcaagcccaucgccgugaaacug

SEQ ID NO: 54834 - RNA, 27 nt, Artificial Sequence
  Eukaryotic translation initiation factor 4H (221-229)
agaaccggccccccuauggggagcagg

SEQ ID NO: 54835 - RNA, 30 nt, Artificial Sequence
  Eukaryotic translation initiation factor 4H (155-164)
agaaccggccccccuauggggagcagguuc

SEQ ID NO: 54836 - RNA, 27 nt, Artificial Sequence
  Cell division cycle 5-like protein (83-91)
agaaccaucgcccccauuauaggcagg

SEQ ID NO: 54837 - RNA, 27 nt, Artificial Sequence
  Biogenesis of lysosome-related organelles complex 1 subunit 1 (106-114)
agaaccaucgccacagcucuggaguac

SEQ ID NO: 54838 - RNA, 27 nt, Artificial Sequence
  Beta-catenin-like protein 1 (270-278)
agaaccaucuucccccuguuuaugaag

SEQ ID NO: 54839 - RNA, 30 nt, Artificial Sequence
  60S ribosomal protein L37a (4-13)
agaaccaagaaagugggcaucgucgggaag

SEQ ID NO: 54840 - RNA, 30 nt, Artificial Sequence
  39S ribosomal protein L2, mitochondrial (69-78)
agaaccaaguacacaaucacucccgugaaa

SEQ ID NO: 54841 - RNA, 30 nt, Artificial Sequence
  Peroxisomal multifunctional enzyme type 2 (251-260)
agaacccugggcgccaucgugaggcagaag

SEQ ID NO: 54842 - RNA, 27 nt, Artificial Sequence
  Cytosolic carboxypeptidase 1 (1067-1075)
agaacccugcccaagauccucagccac

SEQ ID NO: 54843 - RNA, 30 nt, Artificial Sequence
  Ubiquitin-40S ribosomal protein S27a (74-83)
agaacccugagcgacuacaacauccagaag

SEQ ID NO: 54844 - RNA, 27 nt, Artificial Sequence
  RAD50-interacting protein 1 (155-163)
agaaccaacuggcccaauacaggcaag

SEQ ID NO: 54845 - RNA, 33 nt, Artificial Sequence
  Dynamin-binding protein (144-154)
agaaccagggacuacgccagccugcccccuaag

SEQ ID NO: 54846 - RNA, 27 nt, Artificial Sequence
  ATP-dependent RNA helicase DDX24 (666-674)
agaaccagcgagaucuacgugcacagg

SEQ ID NO: 54847 - RNA, 27 nt, Artificial Sequence
  Sterol regulatory element-binding protein 2 (332-340)
agaaccacacacaacaucauugagaag

SEQ ID NO: 54848 - RNA, 30 nt, Artificial Sequence
  Cleavage and polyadenylation specificity factor subunit 2 (358-367)
agaaccacacccggcacucuggccagguuc

SEQ ID NO: 54849 - RNA, 30 nt, Artificial Sequence
  Diphosphoinositol polyphosphate phosphohydrolase 1 (10-19)
agaaccuacgacggcgauggguauaagaaa

SEQ ID NO: 54850 - RNA, 30 nt, Artificial Sequence
  Diphosphoinositol polyphosphate phosphohydrolase 2 (7-16)
agaaccuacgacagggagggcuucaagaaa

SEQ ID NO: 54851 - RNA, 30 nt, Artificial Sequence
  Coatomer subunit beta' (759-768)
agaaccuaccugcccagccagguguccagg

SEQ ID NO: 54852 - RNA, 27 nt, Artificial Sequence
  Exocyst complex component 4 (74-82)
agaaccuaccagagcaucacagagagg

SEQ ID NO: 54853 - RNA, 30 nt, Artificial Sequence
  Lon protease homolog 2, peroxisomal (371-380)
agaaccuacgugggcagcaugcccgggagg

SEQ ID NO: 54854 - RNA, 27 nt, Artificial Sequence
  Plakophilin-4 (418-426)
agaaccuacuauagccccguguacagg

SEQ ID NO: 54855 - RNA, 33 nt, Artificial Sequence
  tRNA pseudouridine synthase-like 1 (270-280)
agaguggcccccgcucacggccuguuccucaag

SEQ ID NO: 54856 - RNA, 30 nt, Artificial Sequence
  Protein ERGIC-53 (12-21)
agaguggcccccagccugaagucccagagg

SEQ ID NO: 54857 - RNA, 33 nt, Artificial Sequence
  Chromobox protein homolog 6 (9-19)
agaguguucgccgcugagagcaucauuaagagg

SEQ ID NO: 54858 - RNA, 27 nt, Artificial Sequence
  F-box only protein 3 (143-151)
agaguguucgacguccccaucaggcgg

SEQ ID NO: 54859 - RNA, 33 nt, Artificial Sequence
  ATP synthase mitochondrial F1 complex assembly factor 1 (45-55)
agaguguuccccgucaggccuggcagcgggcgg

SEQ ID NO: 54860 - RNA, 30 nt, Artificial Sequence
  tRNA (guanine(26)-N(2))-dimethyltransferase (327-336)
agaguguucaccggccaggccaaggucaaa

SEQ ID NO: 54861 - RNA, 27 nt, Artificial Sequence
  Poly (ADP-ribose) polymerase 3 (110-118)
agagugggcgaggucgggcagagcaag

SEQ ID NO: 54862 - RNA, 30 nt, Artificial Sequence
  Poly (ADP-ribose) polymerase 1 (591-600)
agagugggcaccgucaucgggagcaacaag

SEQ ID NO: 54863 - RNA, 33 nt, Artificial Sequence
  Bifunctional methylenetetrahydrofolate dehydrogenase/cyclohydrolase, mitochondrial (278-288)
agagugcacgaccccgucaccgccaagccuaaa

SEQ ID NO: 54864 - RNA, 30 nt, Artificial Sequence
  Choline/ethanolaminephosphotransferase 1 (267-276)
agagugaucuucaccggcggggucggaaag

SEQ ID NO: 54865 - RNA, 33 nt, Artificial Sequence
  Drebrin-like protein (68-78)
agagugaaggaccccaacagcggccugccuaaa

SEQ ID NO: 54866 - RNA, 27 nt, Artificial Sequence
  YEATS domain-containing protein 4 (11-19)
agagugaagggcgucaccaucguuaaa

SEQ ID NO: 54867 - RNA, 30 nt, Artificial Sequence
  60S ribosomal protein L8 (147-156)
agagugaagcugcccagcggcuccaaaaag

SEQ ID NO: 54868 - RNA, 30 nt, Artificial Sequence
  Sorting nexin-3 (52-61)
agagugaagaccaaccugcccaucuucaaa

SEQ ID NO: 54869 - RNA, 30 nt, Artificial Sequence
  Copper transport protein ATOX1 (20-29)
agagugcugaacaagcucggcggggucaaa

SEQ ID NO: 54870 - RNA, 27 nt, Artificial Sequence
  U3 small nucleolar RNA-associated protein 14 homolog A (631-639)
agagugcugcccuacccuuucacccac

SEQ ID NO: 54871 - RNA, 27 nt, Artificial Sequence
  60S ribosomal export protein NMD3 (397-405)
agagugcccgacgucguucugaucaag

SEQ ID NO: 54872 - RNA, 33 nt, Artificial Sequence
  Protein FAM136A (8-18)
agagugcaggaggccgucgaaagcaugguuaag

SEQ ID NO: 54873 - RNA, 30 nt, Artificial Sequence
  Acetolactate synthase-like protein (181-190)
agagugagggacaucguccccacccugcgg

SEQ ID NO: 54874 - RNA, 27 nt, Artificial Sequence
  Inosine-5'-monophosphate dehydrogenase 2 (126-134)
agagugagggacgucuucgaggccaag

SEQ ID NO: 54875 - RNA, 30 nt, Artificial Sequence
  Transmembrane protein 107 (3-12)
agagugagcggccugguccccuccagguuc

SEQ ID NO: 54876 - RNA, 27 nt, Artificial Sequence
  Mitochondrial import receptor subunit TOM5 homolog (39-47)
agagugacccccuucauccugaagaaa

SEQ ID NO: 54877 - RNA, 27 nt, Artificial Sequence
  Dolichyl-diphosphooligosaccharide-proteinosyltransferase subunit 2 (256-264)
agagugaccuaccccgccaaggcuaaa

SEQ ID NO: 54878 - RNA, 33 nt, Artificial Sequence
  Fanconi anemia group D2 protein (185-195)
agaguggucgacggcaaggaucugaccacaaaa

SEQ ID NO: 54879 - RNA, 33 nt, Artificial Sequence
  Ribosome biogenesis protein WDR12 (281-291)
agagugugggacgucgagagcggcucccugaag

SEQ ID NO: 54880 - RNA, 27 nt, Artificial Sequence
  Splicing factor 3B subunit 3 (968-976)
agaguguacgaccugggcaagaaaaag

SEQ ID NO: 54881 - RNA, 33 nt, Artificial Sequence
  WD repeat-containing protein 74 (208-218)
agaguguacgaccccgccagcccucagaggcgg

SEQ ID NO: 54882 - RNA, 30 nt, Artificial Sequence
  Arf-GAP with coiled-coil, ANK repeat and PH domain-containing protein 2 (477-486)
agaguguacgaggccaacgucgaaaagaug

SEQ ID NO: 54883 - RNA, 33 nt, Artificial Sequence
  Centrosomal protein of 104 kDa (621-631)
agaguguacgaggucagggaaaccgccguucgg

SEQ ID NO: 54884 - RNA, 27 nt, Artificial Sequence
  Programmed cell death 6-interacting protein (606-614)
agaguguacggcgggcugaccacaaag

SEQ ID NO: 54885 - RNA, 27 nt, Artificial Sequence
  Probable E3 ubiquitin-protein ligase TRIM8 (538-546)
agaguguacggccagcccagcaccaag

SEQ ID NO: 54886 - RNA, 33 nt, Artificial Sequence
  Probable E3 ubiquitin-protein ligase TRIM8 (538-548)
agaguguacggccagcccagcaccaagcacuau

SEQ ID NO: 54887 - RNA, 33 nt, Artificial Sequence
  UPF0769 protein C21orf59 (33-43)
agaguguacaacggcaggcugaagguccagcgg

SEQ ID NO: 54888 - RNA, 33 nt, Artificial Sequence
  Serine/threonine-protein kinase pim-2 (201-211)
agaguguacagccccccugaguggaucuccagg

SEQ ID NO: 54889 - RNA, 30 nt, Artificial Sequence
  E3 ubiquitin-protein ligase Itchy homolog (177-186)
agaguguacuaugucgaccacguugagaag

SEQ ID NO: 54890 - RNA, 27 nt, Artificial Sequence
  Superkiller viralicidic activity 2-like 2 (738-746)
agcgccaucuccucugugagacuguac

SEQ ID NO: 54891 - RNA, 27 nt, Artificial Sequence
  Ubiquilin-1 (452-460)
agcgccauguccaaccccagagcuaug

SEQ ID NO: 54892 - RNA, 30 nt, Artificial Sequence
  40S ribosomal protein S21 (18-27)
agcgccuccaacagaaucauuggcgcuaag

SEQ ID NO: 54893 - RNA, 27 nt, Artificial Sequence
  Condensin-2 complex subunit G2 (606-614)
agcgaggccgcugcacccagagccuuc

SEQ ID NO: 54894 - RNA, 27 nt, Artificial Sequence
  Ferritin heavy chain (79-87)
agcgaggccgcuaucaacagacagauu

SEQ ID NO: 54895 - RNA, 27 nt, Artificial Sequence
  Microtubule-actin cross-linking factor 1, isoforms 1/2/3/5 (3831-3839)
agcgaggccgaacagacccugagauuc

SEQ ID NO: 54896 - RNA, 27 nt, Artificial Sequence
  Single-stranded DNA-binding protein 2 (86-94)
agcgaggccaaggcuuuccacgacuac

SEQ ID NO: 54897 - RNA, 30 nt, Artificial Sequence
  PERQ amino acid-rich with GYF domain-containing protein 2 (1182-1191)
agcgaggccaaggaauucgcuaaacaguuu

SEQ ID NO: 54898 - RNA, 33 nt, Artificial Sequence; identical to SEQ ID NO: 30671
  Transcriptional adapter 1 (16-26)

SEQ ID NO: 54899 - RNA, 27 nt, Artificial Sequence
  Cytoplasmic dynein 1 heavy chain 1 (1405-1413)
agcgaggcccugaaggacagacacugg

SEQ ID NO: 54900 - RNA, 27 nt, Artificial Sequence
  Zinc finger protein 296 (189-197)
agcgaggcccccgaagcuccucugcuc

SEQ ID NO: 54901 - RNA, 30 nt, Artificial Sequence; identical to SEQ ID NO: 30674
  ATP-dependent RNA helicase DDX50 (2-11)

SEQ ID NO: 54902 - RNA, 27 nt, Artificial Sequence
  UV-stimulated scaffold protein A (35-43)
agcgaggaacagcuguccagagccuac

SEQ ID NO: 54903 - RNA, 27 nt, Artificial Sequence
  X-ray repair cross-complementing protein 5 (650-658)
agcgaggaacagagauucaacaauuuu

SEQ ID NO: 54904 - RNA, 27 nt, Artificial Sequence
  WD repeat-containing protein 63 (190-198)
agcgaguucggcgcccccaucaaguuu

SEQ ID NO: 54905 - RNA, 30 nt, Artificial Sequence
  Pre-mRNA-processing-splicing factor 8 (1377-1386)
agcgaguucaucgacucccagagagugugg

SEQ ID NO: 54906 - RNA, 27 nt, Artificial Sequence
  Programmed cell death protein 6 (83-91)
agcgaguucaccggcguguggaaguac

SEQ ID NO: 54907 - RNA, 33 nt, Artificial Sequence
  Proteasome subunit beta type-5 (72-82)
agcgagggcaacagaaucuccggggccaccuuc

SEQ ID NO: 54908 - RNA, 33 nt, Artificial Sequence
  WD repeat-containing protein 62 (1273-1283)
agcgagggccaggaacccgcccugagauccugg

SEQ ID NO: 54909 - RNA, 30 nt, Artificial Sequence
  E3 ubiquitin-protein ligase MARCH6 (14-23)
agcgagggcacccccgaaaagccucuguac

SEQ ID NO: 54910 - RNA, 30 nt, Artificial Sequence
  Serine hydroxymethyltransferase, mitochondrial (67-76)
agcgagggcuaccccgggaagagauauuac

SEQ ID NO: 54911 - RNA, 27 nt, Artificial Sequence
  Serine hydroxymethyltransferase, cytosolic (74-82)
agcgagggcuaccccgggcagagauau

SEQ ID NO: 54912 - RNA, 27 nt, Artificial Sequence
  Pre-mRNA-splicing factor CWC22 homolog (326-334)
agcgagaucgacaagagagugcaguac

SEQ ID NO: 54913 - RNA, 27 nt, Artificial Sequence
  Talin-1 (290-298)
agcgagaucgaagccaaggugagauac

SEQ ID NO: 54914 - RNA, 27 nt, Artificial Sequence
  Beta-parvin (141-149)
agcgagaucggccagaagcaaaaacug

SEQ ID NO: 54915 - RNA, 33 nt, Artificial Sequence
  Ribosome-binding protein 1 (242-252)
agcgagaaggccggcaucauucaggacaccugg

SEQ ID NO: 54916 - RNA, 27 nt, Artificial Sequence
  Nuclear pore complex protein Nup155 (295-303)
agcgagaagggcgugauccaggucuac

SEQ ID NO: 54917 - RNA, 27 nt, Artificial Sequence
  Plectin (3212-3220)
agcgagcugcaggccagagaaaccuuc

SEQ ID NO: 54918 - RNA, 27 nt, Artificial Sequence
  Inositol 1,4,5-trisphosphate receptor type 1 (2099-2107)
agcgagaacgccgaaagaauccuguac

SEQ ID NO: 54919 - RNA, 27 nt, Artificial Sequence
  AP-2 complex subunit mu (347-355)
agcgagaacgccaucguguggaagauu

SEQ ID NO: 54920 - RNA, 27 nt, Artificial Sequence
  DnaJ homolog subfamily A member 2 (20-28)
agcgagaacgaacugaagaaagccuac

SEQ ID NO: 54921 - RNA, 33 nt, Artificial Sequence
  DNA-dependent protein kinase catalytic subunit (2174-2184)
agcgagaacaauggcggggaaggaauccacuac

SEQ ID NO: 54922 - RNA, 30 nt, Artificial Sequence
  Mediator of RNA polymerase II transcription subunit 12 (891-900)
agcgagaaccccgccaauagauacuccuuc

SEQ ID NO: 54923 - RNA, 27 nt, Artificial Sequence
  F-box/LRR-repeat protein 3 (261-269)
agcgagaaccccggccagacccacuuc

SEQ ID NO: 54924 - RNA, 33 nt, Artificial Sequence
  Protein sel-1 homolog 1 (20-30)
agcgagcagcaacacuccgcccaggcuauguuc

SEQ ID NO: 54925 - RNA, 27 nt, Artificial Sequence
  HLA class II histocompatibility antigen, DRB1-11 beta chain (221-229)
agcgaguccgcccagucuaagaugcug

SEQ ID NO: 54926 - RNA, 33 nt, Artificial Sequence
  Eukaryotic initiation factor 4A-I (40-50)
agcgagucccugcucagaggcaucuacgccuau

SEQ ID NO: 54927 - RNA, 27 nt, Artificial Sequence
  Retinoic acid receptor alpha (17-25)
agcgaguccagaaugguggucaccuuc

SEQ ID NO: 54928 - RNA, 27 nt, Artificial Sequence
  Vacuolar protein sorting-associated protein 51 homolog (16-24)
agcgagaccgacauggugagacagauc

SEQ ID NO: 54929 - RNA, 27 nt, Artificial Sequence
  26S proteasome non-ATPase regulatory subunit 2 (546-554)
agcgagaccgaacugaaggacacauac

SEQ ID NO: 54930 - RNA, 27 nt, Artificial Sequence
  Misshapen-like kinase 1 (969-977)
agcgagacccccgaaaucagaaaguac

SEQ ID NO: 54931 - RNA, 27 nt, Artificial Sequence
  Serine/threonine-protein kinase Nek6 (224-232)
agcgagaccacagccgcucacucccug

SEQ ID NO: 54932 - RNA, 27 nt, Artificial Sequence
  U5 small nuclear ribonucleoprotein 200 kDa helicase (1230-1238)
agcgaggugauccugcaccaugaauac

SEQ ID NO: 54933 - RNA, 27 nt, Artificial Sequence
  Arginine-glutamic acid dipeptide repeats protein (1257-1265)
agcgaguacgccagaccccacgugaug

SEQ ID NO: 54934 - RNA, 30 nt, Artificial Sequence
  Proteasome subunit alpha type-5 (6-15)
agcgaguacgacagaggcgugaacaccuuc

SEQ ID NO: 54935 - RNA, 30 nt, Artificial Sequence
  Nucleolar protein 56 (275-284)
agcgaguacagacagucccugcacaccuau

SEQ ID NO: 54936 - RNA, 24 nt, Artificial Sequence
  Pleiotropic regulator 1 (226-233)
agcggcaagcugaaacucucccuu

SEQ ID NO: 54937 - RNA, 27 nt, Artificial Sequence
  Manganese-transporting ATPase 13A1 (75-83)
agcaucgccgcucccuucaccuccaag

SEQ ID NO: 54938 - RNA, 27 nt, Artificial Sequence
  Myotubularin-related protein 10 (210-218)
agcauccugggcaccccccucuccaag

SEQ ID NO: 54939 - RNA, 30 nt, Artificial Sequence
  U2 small nuclear ribonucleoprotein A' (119-128)
agcauccugagaaaccccgugaccaauaag

SEQ ID NO: 54940 - RNA, 30 nt, Artificial Sequence
  Cytospin-A (887-896)
agcaucuccggccccauuucuaccucaaag

SEQ ID NO: 54941 - RNA, 33 nt, Artificial Sequence
  Double-stranded RNA-specific adenosine deaminase (1110-1120)
agcaucuacgacuccaagagacagucuggcaaa

SEQ ID NO: 54942 - RNA, 27 nt, Artificial Sequence
  Importin-8 (234-242)
agccuggccgagauccuccuuaagaaa

SEQ ID NO: 54943 - RNA, 30 nt, Artificial Sequence
  Heterogeneous nuclear ribonucleoprotein K (154-163)
agccuggccggcgggaucauuggagugaag

SEQ ID NO: 54944 - RNA, 27 nt, Artificial Sequence
  G2/M phase-specific E3 ubiquitin-protein ligase (424-432)
agccuguucgagggcucccucucuaag

SEQ ID NO: 54945 - RNA, 27 nt, Artificial Sequence
  Serine/threonine-protein phosphatase 2A 56 kDa regulatory subunit epsilon isoform (278-286)
agccuguuccacgcccagcucgcuuac

SEQ ID NO: 54946 - RNA, 27 nt, Artificial Sequence
  Adenylate cyclase type 6 (161-169)
agccuguuccccaaggcccuccagaga

SEQ ID NO: 54947 - RNA, 27 nt, Artificial Sequence
  Cytochrome c oxidase subunit 6C (30-38)
agccugggcguggccgcucucuacaag

SEQ ID NO: 54948 - RNA, 30 nt, Artificial Sequence
  Histone H2A.V (91-100)
agccugaucggcaagaaagggcagcaaaag

SEQ ID NO: 54949 - RNA, 27 nt, Artificial Sequence
  N-alpha-acetyltransferase 30 (63-71)
agccugaaguccaaagugcucucuguc

SEQ ID NO: 54950 - RNA, 27 nt, Artificial Sequence
  COP9 signalosome complex subunit 2 (433-441)
agccugaaccaggccguggucuccaag

SEQ ID NO: 54951 - RNA, 30 nt, Artificial Sequence
  Cell division cycle-associated protein 2 (247-256)
agccugcccgccaacaccccucucagaaag

SEQ ID NO: 54952 - RNA, 27 nt, Artificial Sequence
  Zinc finger protein 697 (327-335)
agccuguccucucaccuccuuucacau

SEQ ID NO: 54953 - RNA, 33 nt, Artificial Sequence
  Protection of telomeres protein 1 (417-427)
agccuguacgacuccaagaucuggaccacaaaa

SEQ ID NO: 54954 - RNA, 33 nt, Artificial Sequence
  MICOS complex subunit MIC26 (41-51)
agccuguacuccgugcccgagggccagucuaag

SEQ ID NO: 54955 - RNA, 27 nt, Artificial Sequence
  A-kinase anchor protein 13 (930-938)
agcccccugaccaaguccaucucucuc

SEQ ID NO: 54956 - RNA, 24 nt, Artificial Sequence
  Elongation factor 2 (95-102)
agccccaacaagcacaauagacug

SEQ ID NO: 54957 - RNA, 27 nt, Artificial Sequence
  WD repeat-containing protein 3 (558-566)
agccccaaccagaagcugcucgccgug

SEQ ID NO: 54958 - RNA, 24 nt, Artificial Sequence
  Gamma-interferon-inducible protein 16 (166-173)
agccccuccccuaagaccucucug

SEQ ID NO: 54959 - RNA, 24 nt, Artificial Sequence
  Elongation factor 2 (2-9)
agccccguggucagaguugccgug

SEQ ID NO: 54960 - RNA, 27 nt, Artificial Sequence
  Uridine diphosphate glucose pyrophosphatase (83-91)
agccccuaccugagaccucucacccuu

SEQ ID NO: 54961 - RNA, 27 nt, Artificial Sequence
  Ubiquitin carboxyl-terminal hydrolase 48 (410-418)
agcagaaacgccuacaugcugguguau

SEQ ID NO: 54962 - RNA, 27 nt, Artificial Sequence
  RNA-binding protein EWS (328-336)
agcuccgcccccccucugaccggcaag

SEQ ID NO: 54963 - RNA, 27 nt, Artificial Sequence
  Immediate early response gene 5 protein (275-283)
agcuccuucucuggccugcucagaaag

SEQ ID NO: 54964 - RNA, 27 nt, Artificial Sequence
  40S ribosomal protein S5 (184-192)
agcuccaacucuuacgccaucaagaaa

SEQ ID NO: 54965 - RNA, 27 nt, Artificial Sequence
  Proteasome activator complex subunit 4 (977-985)
agcuccuacucucaggugagaaacaag

SEQ ID NO: 54966 - RNA, 27 nt, Artificial Sequence
  PCI domain-containing protein 2 (203-211)
agcaccgcccagagagugacauacaag

SEQ ID NO: 54967 - RNA, 27 nt, Artificial Sequence
  MAP7 domain-containing protein 1 (454-462)
agcaccgccuccgagcugucucccaag

SEQ ID NO: 54968 - RNA, 27 nt, Artificial Sequence
  60S ribosomal protein L18 (41-49)
agcaccuucaaccaggugguccugaag

SEQ ID NO: 54969 - RNA, 27 nt, Artificial Sequence
  WD repeat and coiled-coil-containing protein C2orf44 (449-457)
agcaccuucuccgccccccugaacaag

SEQ ID NO: 54970 - RNA, 27 nt, Artificial Sequence
  Kanadaptin (238-246)
agcacccacggcacauuccugaacaag

SEQ ID NO: 54971 - RNA, 27 nt, Artificial Sequence
  Double-stranded RNA-binding protein Staufen homolog 2 (41-49)
agcacccugcccaagccugugcagaaa

SEQ ID NO: 54972 - RNA, 27 nt, Artificial Sequence
  F-box only protein 11 (143-151)
agcaccaacucccaccccauccugaga

SEQ ID NO: 54973 - RNA, 27 nt, Artificial Sequence
  LisH domain-containing protein ARMC9 (382-390)
agcaccuccgacguggucagacaguac

SEQ ID NO: 54974 - RNA, 27 nt, Artificial Sequence
  E3 ubiquitin-protein ligase CHFR (78-86)
agcaccuccggcacagugaucaacaag

SEQ ID NO: 54975 - RNA, 27 nt, Artificial Sequence
  Lysine-specific histone demethylase 1A (633-641)
agcaccucccagacauucaucuacaag

SEQ ID NO: 54976 - RNA, 27 nt, Artificial Sequence
  Heterogeneous nuclear ribonucleoprotein U-like protein 2 (165-173)
agcaccuacggcgugacaaaggggaaa

SEQ ID NO: 54977 - RNA, 27 nt, Artificial Sequence
  Cathepsin Z (38-46)
agcaccuaccccagaccucacgaguau

SEQ ID NO: 54978 - RNA, 27 nt, Artificial Sequence
  Nucleolar pre-ribosomal-associated protein 1 (2084-2092)
agcguggccgagcacccccuguccaga

SEQ ID NO: 54979 - RNA, 27 nt, Artificial Sequence
  MOB kinase activator 1A (188-196)
agcguggccaagaccauccugaaaaga

SEQ ID NO: 54980 - RNA, 30 nt, Artificial Sequence
  Lysine-specific demethylase 5C (959-968)
agcguggcccccuccccugcugucgacaag

SEQ ID NO: 54981 - RNA, 27 nt, Artificial Sequence
  Lysine-specific demethylase 5A (796-804)
agcguggcccagcugcuccuuuccaag

SEQ ID NO: 54982 - RNA, 27 nt, Artificial Sequence
  Probable cation-transporting ATPase 13A4 (871-879)
agcguggccucccccuucaccucuaag

SEQ ID NO: 54983 - RNA, 27 nt, Artificial Sequence
  Sentrin-specific protease 5 (115-123)
agcguggacggccccgucucccagaag

SEQ ID NO: 54984 - RNA, 27 nt, Artificial Sequence
  Exostosin-2 (692-700)
agcguguucggcaccaugccccugaag

SEQ ID NO: 54985 - RNA, 27 nt, Artificial Sequence
  SRR1-like protein (301-309)
agcgugcacugguuccccguccagaag

SEQ ID NO: 54986 - RNA, 27 nt, Artificial Sequence
  Epidermal growth factor receptor kinase substrate 8 (380-388)
agcgugcuguccccccuccuuaacaag

SEQ ID NO: 54987 - RNA, 27 nt, Artificial Sequence
  Nodal modulator 2 (130-138)
agcgugaacggcaagguccuguccaaa

SEQ ID NO: 54988 - RNA, 27 nt, Artificial Sequence
  Ubiquitin carboxyl-terminal hydrolase 11 (442-450)
agcgugccccugccuaucucccacaag

SEQ ID NO: 54989 - RNA, 30 nt, Artificial Sequence
  Cytoplasmic dynein 1 light intermediate chain 1 (419-428)
agcgugucccccaucccugccggcucuaag

SEQ ID NO: 54990 - RNA, 30 nt, Artificial Sequence
  Zinc finger protein 697 (10-19)
agcguguccucucaccuguucacccauaag

SEQ ID NO: 54991 - RNA, 27 nt, Artificial Sequence
  Zinc finger protein 619 (226-234)
agcguguccacccaccugaucacaaag

SEQ ID NO: 54992 - RNA, 27 nt, Artificial Sequence
  Fatty acyl-CoA reductase 1 (39-47)
agcguguacguccugguuagacagaag

SEQ ID NO: 54993 - RNA, 27 nt, Artificial Sequence
  Histone H2B type 2-F (39-47)
agcguguacgucuauaagguucugaaa

SEQ ID NO: 54994 - RNA, 27 nt, Artificial Sequence
  Nucleolar RNA helicase 2 (15-23)
accgccaugaagaaaggcgagacacug

SEQ ID NO: 54995 - RNA, 30 nt, Artificial Sequence
  Pre-mRNA-processing-splicing factor 8 (1079-1088)
accgaggccgcucaccccaucagacuguuc

SEQ ID NO: 54996 - RNA, 30 nt, Artificial Sequence
  NHP2-like protein 1 (2-11)
accgaggccgacgugaaccccaaggcuuac

SEQ ID NO: 54997 - RNA, 27 nt, Artificial Sequence
  Splicing factor, proline- and glutamine-rich (309-317)
accgaggacgaauucaagagacuguuu

SEQ ID NO: 54998 - RNA, 30 nt, Artificial Sequence
  60S ribosomal protein L13 (170-179)
accgaggaagagaagaacuucaaagccuuu

SEQ ID NO: 54999 - RNA, 30 nt, Artificial Sequence
  Protein SET (136-145)
accgaguucgaagacaucaagagcggcuac

SEQ ID NO: 55000 - RNA, 30 nt, Artificial Sequence
  Neutral alpha-glucosidase AB (174-183)
accgagggcggggaacccuacagacuguau

SEQ ID NO: 55001 - RNA, 27 nt, Artificial Sequence
  T-complex protein 1 subunit theta (342-350)
accgagaucgaacuggccaagcagauu

SEQ ID NO: 55002 - RNA, 27 nt, Artificial Sequence
  RNA-binding protein 27 (734-742)
accgagcuggaccuccacaagagacuu

SEQ ID NO: 55003 - RNA, 27 nt, Artificial Sequence
  RNA-binding protein 26 (793-801)
accgagcuggaccucuacaagaaaaug

SEQ ID NO: 55004 - RNA, 27 nt, Artificial Sequence
  Cell cycle progression protein 1 (432-440)
accgagcuggaaagaaagcucacauuc

SEQ ID NO: 55005 - RNA, 30 nt, Artificial Sequence
  Exocyst complex component 4 (67-76)
accgagcugacaacugccaucagaacguac

SEQ ID NO: 55006 - RNA, 27 nt, Artificial Sequence
  Geranylgeranyl pyrophosphate synthase (238-246)
accgagaacaucgacauuaagaaauac

SEQ ID NO: 55007 - RNA, 33 nt, Artificial Sequence
  Fructose-bisphosphate aldolase A (103-113)
accgagaacacagaagagaauagaagguucuac

SEQ ID NO: 55008 - RNA, 27 nt, Artificial Sequence
  Probable cation-transporting ATPase 13A3 (132-140)
accgagagccagcaaaucagauacuuc

SEQ ID NO: 55009 - RNA, 27 nt, Artificial Sequence
  Nuclear factor erythroid 2-related factor 2 (198-206)
accgagguggacaacuaccacuucuau

SEQ ID NO: 55010 - RNA, 24 nt, Artificial Sequence
  Basigin (48-55)
accgaggugacaggccacagaugg

SEQ ID NO: 55011 - RNA, 27 nt, Artificial Sequence
  Myosin phosphatase Rho-interacting protein (441-449)
accgaguaccccgugcagagaaacuau

SEQ ID NO: 55012 - RNA, 33 nt, Artificial Sequence
  GPI transamidase component PIG-T (450-460)
accgaguacacacccgacccuaaccacggcuuc

SEQ ID NO: 55013 - RNA, 27 nt, Artificial Sequence
  Protein kinase C delta-binding protein (181-189)
accggccugcagaaggugcaaagccuc

SEQ ID NO: 55014 - RNA, 27 nt, Artificial Sequence
  Alpha-enolase (72-80)
accaucgcccccgcucuggugagcaag

SEQ ID NO: 55015 - RNA, 27 nt, Artificial Sequence
  Histidine triad nucleotide-binding protein 1 (17-25)
accaucuucggcaagauuauaagaaaa

SEQ ID NO: 55016 - RNA, 27 nt, Artificial Sequence
  NHP2-like protein 1 (105-113)
accaucaaggagggcagccagcugaaa

SEQ ID NO: 55017 - RNA, 27 nt, Artificial Sequence
  H/ACA ribonucleoprotein complex subunit 3 (47-55)
accaucaagaaaagauucaaggugcug

SEQ ID NO: 55018 - RNA, 27 nt, Artificial Sequence
  Signal peptidase complex subunit 2 (129-137)
accaucuacacaagcuauaaggagaaa

SEQ ID NO: 55019 - RNA, 24 nt, Artificial Sequence
  Retinoblastoma-like protein 1 (803-810)
accaucuacgugggcagagucaag

SEQ ID NO: 55020 - RNA, 24 nt, Artificial Sequence
  Interferon-related developmental regulator 1 (118-125)
acccugggccccauccucaagaaa

SEQ ID NO: 55021 - RNA, 27 nt, Artificial Sequence
  Protein BRICK1 (49-57)
acccugaacgagaagcucacagcccuu

SEQ ID NO: 55022 - RNA, 27 nt, Artificial Sequence
  GPI mannosyltransferase 3 (40-48)
acccuguacuucaacacacaggagaag

SEQ ID NO: 55023 - RNA, 27 nt, Artificial Sequence
  Splicing factor 3B subunit 3 (759-767)
accaacacacugagaauccucgcccuu

SEQ ID NO: 55024 - RNA, 27 nt, Artificial Sequence
  Ubiquitin-like protein 7 (248-256)
acccccagcuccagaccugccucucug

SEQ ID NO: 55025 - RNA, 27 nt, Artificial Sequence
  Exportin-6 (55-63)
accagaaacgacuacgugaugauguau

SEQ ID NO: 55026 - RNA, 27 nt, Artificial Sequence
  Perilipin-2 (63-71)
accagcgcccugcccaucauucagaag

SEQ ID NO: 55027 - RNA, 27 nt, Artificial Sequence
  Huntingtin (1215-1223)
accagcggccccgugacaacuuccaag

SEQ ID NO: 55028 - RNA, 24 nt, Artificial Sequence
  YTH domain-containing protein 1 (327-334)
accagcaagcugaaauacgugcuc

SEQ ID NO: 55029 - RNA, 27 nt, Artificial Sequence
  Male-specific lethal 3 homolog (328-336)
accacaggcgagcccgccacuccuaag

SEQ ID NO: 55030 - RNA, 30 nt, Artificial Sequence
  Flap endonuclease 1 (60-69)
accacaagccaccugaugggcauguucuac

SEQ ID NO: 55031 - RNA, 27 nt, Artificial Sequence
  Elongation factor 1-alpha 1 (22-30)
accacaacuggccaccugaucuacaag

SEQ ID NO: 55032 - RNA, 27 nt, Artificial Sequence
  Derlin-1 (22-30)
accguggccgucccccugguuggcaag

SEQ ID NO: 55033 - RNA, 27 nt, Artificial Sequence
  COP9 signalosome complex subunit 3 (378-386)
accgugaacccccaguucguccaaaag

SEQ ID NO: 55034 - RNA, 30 nt, Artificial Sequence
  HIG1 domain family member 2A, mitochondrial (27-36)
accguguacagaaaccccgagagcuucaag

SEQ ID NO: 55035 - RNA, 27 nt, Artificial Sequence
  Talin-1 (1188-1196)
guggccaaggcugucacccaggcacug

SEQ ID NO: 55036 - RNA, 27 nt, Artificial Sequence
  DNA damage-binding protein 1 (510-518)
guggccgucggcagagcucuguacuau

SEQ ID NO: 55037 - RNA, 27 nt, Artificial Sequence
  Translin-associated protein X (128-136)
guggaggccgucagcuuccagcacuuu

SEQ ID NO: 55038 - RNA, 33 nt, Artificial Sequence; identical to SEQ ID NO: 30811
  Nodal modulator 3 (448-458)

SEQ ID NO: 55039 - RNA, 27 nt, Artificial Sequence
  3-phosphoinositide-dependent protein kinase 1 (325-333)
guggagaacaaucugauccucaagaug

SEQ ID NO: 55040 - RNA, 27 nt, Artificial Sequence
  Sodium-coupled neutral amino acid transporter 2 (354-362)
guggagagcgaacugcuccacaccuac

SEQ ID NO: 55041 - RNA, 27 nt, Artificial Sequence
  Intraflagellar transport protein 81 homolog (196-204)
guggagaccgcccagaaccaccaaugg

SEQ ID NO: 55042 - RNA, 30 nt, Artificial Sequence; identical to SEQ ID NO: 30815
  Cleavage and polyadenylation specificity factor subunit 3 (444-453)

SEQ ID NO: 55043 - RNA, 27 nt, Artificial Sequence
  Centrosomal protein of 57 kDa (326-334)
gugaucaacagcauuccccuggccaag

SEQ ID NO: 55044 - RNA, 27 nt, Artificial Sequence
  DNA-directed RNA polymerase I subunit RPA2 (81-89)
gugaucagccccccuaccgucccaaag

SEQ ID NO: 55045 - RNA, 33 nt, Artificial Sequence
  Ras GTPase-activating protein-binding protein 1 (113-123)
gugcuggcccccgagggcagcgucgcuaacaag

SEQ ID NO: 55046 - RNA, 33 nt, Artificial Sequence
  Ras GTPase-activating protein-binding protein 2 (113-123)
gugcuggcccccgagggcagcgucccuaacaag

SEQ ID NO: 55047 - RNA, 27 nt, Artificial Sequence
  Interferon-stimulated gene 20 kDa protein (132-140)
gugcugagcgagagacuccuucacaag

SEQ ID NO: 55048 - RNA, 27 nt, Artificial Sequence
  DNA-directed RNA polymerase II subunit RPB2 (1020-1028)
gugcuguacaacggcuucaccgggaga

SEQ ID NO: 55049 - RNA, 27 nt, Artificial Sequence
  Long-chain-fatty-acid-CoA ligase 4 (576-584)
gugcccaaccagaagagacugacccuc

SEQ ID NO: 55050 - RNA, 27 nt, Artificial Sequence
  Protein kintoun (155-163)
gugcccagaauccagccucaaagccug

SEQ ID NO: 55051 - RNA, 27 nt, Artificial Sequence
  Leucine-rich repeat-containing protein 20 (35-43)
gugagcuuccccaucggcauuuacaag

SEQ ID NO: 55052 - RNA, 24 nt, Artificial Sequence
  Vimentin (31-38)
gugaccacaagcacuagaacguac

SEQ ID NO: 55053 - RNA, 27 nt, Artificial Sequence
  Nucleolar and spindle-associated protein 1 (308-316)
gugaccgucagcggcgggacacccaag

SEQ ID NO: 55054 - RNA, 30 nt, Artificial Sequence
  Septin-7 (317-326)
gugaccuacaacggcgucgacaauaacaag

SEQ ID NO: 55055 - RNA, 27 nt, Artificial Sequence
  Histone deacetylase 9 (78-86)
guggucgaccccguugugagagagaag

SEQ ID NO: 55056 - RNA, 27 nt, Artificial Sequence
  Probable 18S rRNA (guanine-N(7))-methyltransferase (188-196)
guggucgacuaccccaacagcgccaag

SEQ ID NO: 55057 - RNA, 27 nt, Artificial Sequence
  Heterogeneous nuclear ribonucleoproteins A2/B1 (39-47)
guggucaugagagaccccgccagcaag

SEQ ID NO: 55058 - RNA, 27 nt, Artificial Sequence
  Heterogeneous nuclear ribonucleoprotein A3 (65-73)
guggucaugagagacccccagaccaag

SEQ ID NO: 55059 - RNA, 30 nt, Artificial Sequence
  Transmembrane protein 263 (101-110)
guggucaacaagguuccccugaccggcaaa

SEQ ID NO: 55060 - RNA, 33 nt, Artificial Sequence
  X-ray repair cross-complementing protein 5 (574-584)
gugguccaggacggcaucacccugauuacaaag

SEQ ID NO: 55061 - RNA, 27 nt, Artificial Sequence
  60S ribosomal protein L22-like 1 (65-73)
guggucagcgagaagcaguucuccaaa

SEQ ID NO: 55062 - RNA, 27 nt, Artificial Sequence
  Glutathione S-transferase P (6-14)
guggucuacuuccccguuagaggcagg

SEQ ID NO: 55063 - RNA, 27 nt, Artificial Sequence
  Adenylosuccinate lyase (363-371)
guggucuaccccaagguuaucgagaga

SEQ ID NO: 55064 - RNA, 27 nt, Artificial Sequence
  ER membrane protein complex subunit 1 (790-798)
guggucuaccaguauuggaacaccaag

SEQ ID NO: 55065 - RNA, 33 nt, Artificial Sequence
  NmrA-like family domain-containing protein 1 (109-119)
guggucuacagcggccuggagaacaucaagaaa

SEQ ID NO: 55066 - RNA, 27 nt, Artificial Sequence
  JmjC domain-containing protein 8 (81-89)
uacgccuucgugagacccgucauccug

SEQ ID NO: 55067 - RNA, 27 nt, Artificial Sequence
  CCR4-NOT transcription complex subunit 1 (93-101)
uacgccaucgacaacccccugcacuau

SEQ ID NO: 55068 - RNA, 27 nt, Artificial Sequence
  WD repeat-containing protein 82 (63-71)
uacgccaacagcaaggcugugacccug

SEQ ID NO: 55069 - RNA, 27 nt, Artificial Sequence
  Splicing factor 3B subunit 1 (761-769)
uacgccaacuauuacaccagagaggug

SEQ ID NO: 55070 - RNA, 27 nt, Artificial Sequence
  WD repeat-containing protein 3 (84-92)
uacgaggacggcagcaucagaauuuuc

SEQ ID NO: 55071 - RNA, 30 nt, Artificial Sequence
  NADH dehydrogenase (ubiquinone) 1 beta subcomplex subunit 11, mitochondrial (67-76)
uacgagaagaaccccgacagccacggcuau

SEQ ID NO: 55072 - RNA, 27 nt, Artificial Sequence
  Lon protease homolog 2, peroxisomal (599-607)
uacgagauggaagugagccagagacug

SEQ ID NO: 55073 - RNA, 27 nt, Artificial Sequence
  AN1-type zinc finger protein 5 (21-29)
uacggcaaccccagaaccaaugggaug

SEQ ID NO: 55074 - RNA, 27 nt, Artificial Sequence
  Cullin-3 (34-42)
uacagaaacgccuauaccauggugcug

SEQ ID NO: 55075 - RNA, 27 nt, Artificial Sequence
  MICOS complex subunit MIC27 (44-52)
uacaccgcccccccucugcagagcaag

SEQ ID NO: 55076 - RNA, 27 nt, Artificial Sequence
  ATP-dependent RNA helicase DDX3X (200-208)
uacaccagacccacaccugugcagaag

SEQ ID NO: 55077 - RNA, 27 nt, Artificial Sequence
  Vimentin (30-38)
uacgugaccacaagcacuagaacguau

SEQ ID NO: 55078 - RNA, 27 nt, Artificial Sequence
  Serine/threonine-protein kinase mTOR (853-861)
uacguggucgagcccuauagaaaguac

SEQ ID NO: 55079 - RNA, 27 nt, Artificial Sequence
  Enhancer of filamentation 1 (164-172)
uacguguaugaguaccccagcagauau

SEQ ID NO: 55080 - RNA, 30 nt, Artificial Sequence
  Nucleolar pre-ribosomal-associated protein 1 (1468-1477)
uacuauagccaccuggagggcgccagauuc

SEQ ID NO: 55081 - RNA, 27 nt, Artificial Sequence
  Selenoprotein H (10-18)
gccgaggcugcaguggucgccguugcg

SEQ ID NO: 55082 - RNA, 27 nt, Artificial Sequence
  Transcription factor BTF3 (128-136)
gccgaggcucugcccaagcagagcgug

SEQ ID NO: 55083 - RNA, 27 nt, Artificial Sequence
  E3 ubiquitin-protein ligase HUWE1 (1156-1164)
gccgaggacaaggauacccccgcucug

SEQ ID NO: 55084 - RNA, 33 nt, Artificial Sequence
  Centromere protein H (228-238)
gccgaggaccccgcucugaaggaaaucgugcuc

SEQ ID NO: 55085 - RNA, 33 nt, Artificial Sequence
  Probable ATP-dependent RNA helicase DDX56 (121-131)
gccgaggacagcgugucccagagagcuguccug

SEQ ID NO: 55086 - RNA, 27 nt, Artificial Sequence
  Transforming acidic coiled-coil-containing protein 3 (469-477)
gccgaggacacccccgugguccagcug

SEQ ID NO: 55087 - RNA, 30 nt, Artificial Sequence
  Beta-hexosaminidase subunit alpha (266-275)
gccgaguucgacacccccggccacacacug

SEQ ID NO: 55088 - RNA, 30 nt, Artificial Sequence
  26S proteasome non-ATPase regulatory subunit 8 (113-122)
gccgaguuccacaccgaacuggagagacuc

SEQ ID NO: 55089 - RNA, 27 nt, Artificial Sequence
  Zinc phosphodiesterase ELAC protein 2 (677-685)
gccgaguucaucaugcugaaccacuuu

SEQ ID NO: 55090 - RNA, 30 nt, Artificial Sequence
  Calmodulin (11-20)
gccgaguucaaggaagcuuuuagccuguuc

SEQ ID NO: 55091 - RNA, 30 nt, Artificial Sequence
  BRCA1-A complex subunit BRE (90-99)
gccgaguuccugcccgacccuagcgcucuc

SEQ ID NO: 55092 - RNA, 36 nt, Artificial Sequence
  DNA dC-dU-editing enzyme APOBEC-3B (105-116)
gccgaguuccugagcgaacaccccaacgugacccuc

SEQ ID NO: 55093 - RNA, 27 nt, Artificial Sequence
  ATP-dependent RNA helicase DHX8 (979-987)
gccgaguucccccuggaaccuaugcuc

SEQ ID NO: 55094 - RNA, 27 nt, Artificial Sequence
  Cytochrome c oxidase subunit 6B1 (9-17)
gccgagggcaccuuccccgggaagauc

SEQ ID NO: 55095 - RNA, 27 nt, Artificial Sequence
  SRSF protein kinase 1 (114-122)
gccgagcacuacaccgaaacagcucug

SEQ ID NO: 55096 - RNA, 33 nt, Artificial Sequence
  DNA repair protein RAD50 (134-144)
gccgagaucgacagagaaaugauuagcucccug

SEQ ID NO: 55097 - RNA, 27 nt, Artificial Sequence
  Insulin-like growth factor 2 mRNA-binding protein 2 (201-209)
gccgagaucgaaauuaugaagaaacug

SEQ ID NO: 55098 - RNA, 36 nt, Artificial Sequence
  Sodium/potassium-transporting ATPase subunit alpha-1 (69-80)
gccgagauccuggcuagagacggccccaacgcacuc

SEQ ID NO: 55099 - RNA, 33 nt, Artificial Sequence
  Lamin-B1 (347-357)
gccgagaucagagaccagaugcaacagcagcug

SEQ ID NO: 55100 - RNA, 27 nt, Artificial Sequence
  Transcription factor 25 (361-369)
gccgagaucagccagcccccugcucug

SEQ ID NO: 55101 - RNA, 36 nt, Artificial Sequence
  BAG64702.1 (100-111)
gccgagaucaccgacaagcugggccuccacagccuu

SEQ ID NO: 55102 - RNA, 30 nt, Artificial Sequence
  Importin subunit alpha-1 (451-460)
gccgagaagcugggcgaaaccgagaaacuc

SEQ ID NO: 55103 - RNA, 27 nt, Artificial Sequence
  T-complex protein 1 subunit epsilon (350-358)
gccgagaagcugggcuucgcugggcuc

SEQ ID NO: 55104 - RNA, 30 nt, Artificial Sequence
  Coiled-coil domain-containing protein 85B (121-130)
gccgagcuggaaggcagacaggaggaacuc

SEQ ID NO: 55105 - RNA, 30 nt, Artificial Sequence
  Centrosomal protein of 55 kDa (140-149)
gccgagcuggaaagcaagaccaacacacuc

SEQ ID NO: 55106 - RNA, 36 nt, Artificial Sequence
  Tropomodulin-3 (286-297)
gccgagcugaagaucgacaaccagagacaacagcuc

SEQ ID NO: 55107 - RNA, 27 nt, Artificial Sequence
  COMM domain-containing protein 4 (192-200)
gccgagcugaagcaggcucaaacccuc

SEQ ID NO: 55108 - RNA, 27 nt, Artificial Sequence
  trabeculin-alpha (1770-1778)
gccgagcugaagcaggugcaaacccuc

SEQ ID NO: 55109 - RNA, 30 nt, Artificial Sequence
  Microtubule-associated protein RP/EB family member 1 (194-203)
gccgagcugaugcagcaagugaacguccuc

SEQ ID NO: 55110 - RNA, 33 nt, Artificial Sequence
  14-3-3 protein theta (34-44)
gccgagcugagcaacgaagagagaaaucuccuu

SEQ ID NO: 55111 - RNA, 33 nt, Artificial Sequence
  Sodium/potassium-transporting ATPase subunit alpha-1 (677-687)
gccgagaacggcuuccugcccauccaccuccuu

SEQ ID NO: 55112 - RNA, 33 nt, Artificial Sequence
  Armadillo repeat-containing X-linked protein 3 (271-281)
gccgagaaccccgcuaugaccagagaacugcuc

SEQ ID NO: 55113 - RNA, 27 nt, Artificial Sequence
  Eukaryotic translation initiation factor 4 gamma 1 (1379-1387)
gccgagcagaagguggaauacacccug

SEQ ID NO: 55114 - RNA, 27 nt, Artificial Sequence
  Double-strand-break repair protein rad21 homolog (576-584)
gccgagagcaucucccugcucgaacuu

SEQ ID NO: 55115 - RNA, 27 nt, Artificial Sequence
  Uncharacterized protein C6orf226 (67-75)
gccgagagccugcccccuccaacccuc

SEQ ID NO: 55116 - RNA, 33 nt, Artificial Sequence
  Endoplasmin (528-538)
gccgagagcucccccuucguggaaagacugcuc

SEQ ID NO: 55117 - RNA, 27 nt, Artificial Sequence
  Magnesium transporter protein 1 (299-307)
gccgagacccacaucgugcugcucuuc

SEQ ID NO: 55118 - RNA, 27 nt, Artificial Sequence
  DNA-directed RNA polymerase I subunit RPA1 (1590-1598)
gccgaggugcuggaccucagaaggcuu

SEQ ID NO: 55119 - RNA, 33 nt, Artificial Sequence
  Syntaxin-binding protein 1 (297-307)
gccgaggugagccaggaagucaccagaucccug

SEQ ID NO: 55120 - RNA, 30 nt, Artificial Sequence
  Cytochrome b-c1 complex subunit 9 (42-51)
gccaucuacgaccacauuaacgagggcgug

SEQ ID NO: 55121 - RNA, 30 nt, Artificial Sequence
  Rab GDP dissociation inhibitor beta (137-146)
gccagauacggcaagagccccuaucuguac

SEQ ID NO: 55122 - RNA, 27 nt, Artificial Sequence
  Replication factor C subunit 4 (343-351)
gacgagcaccugcagcucaucagccuu

SEQ ID NO: 55123 - RNA, 33 nt, Artificial Sequence
  Small nuclear ribonucleoprotein Sm D2 (22-32)
gaggaauucaacaccggcccccugagcgugcuc

SEQ ID NO: 55124 - RNA, 27 nt, Artificial Sequence
  Transmembrane emp24 domain-containing protein 10 (136-144)
gaggaaaucgccaagguggagaaacug

SEQ ID NO: 55125 - RNA, 27 nt, Artificial Sequence
  Protein RRP5 homolog (820-828)
gaggaacugcagggcgugagaagccuc

SEQ ID NO: 55126 - RNA, 33 nt, Artificial Sequence
  T-complex protein 1 subunit delta (363-373)
gaggaagugaaccugaauggcagcgggaagcuc

SEQ ID NO: 55127 - RNA, 27 nt, Artificial Sequence
  Nucleophosmin (92-100)
uucgagaucacccccccugugguccug

SEQ ID NO: 55128 - RNA, 27 nt, Artificial Sequence
  Actin, cytoplasmic 1 (223-231)
uucgagcaggaaauggccaccgcugca

SEQ ID NO: 55129 - RNA, 27 nt, Artificial Sequence
  Serine/arginine repetitive matrix protein 2 (873-881)
uucgagagcucccccgacccugaacug

SEQ ID NO: 55130 - RNA, 30 nt, Artificial Sequence; identical to SEQ ID NO: 30903
  Mitochondrial Rho GTPase 2 (11-20)

SEQ ID NO: 55131 - RNA, 36 nt, Artificial Sequence
  Heterogeneous nuclear ribonucleoprotein C-like 1 (69-80)
ggcgaggacgggagaaugaucgccggacaggugcug

SEQ ID NO: 55132 - RNA, 30 nt, Artificial Sequence; identical to SEQ ID NO: 30905
  Cytoplasmic dynein 1 heavy chain 1 (1073-1082)

SEQ ID NO: 55133 - RNA, 30 nt, Artificial Sequence
  HDAC2 protein (482-491)
ggcgaggaccccgauaagagaaucagcauu

SEQ ID NO: 55134 - RNA, 27 nt, Artificial Sequence
  Histone-binding protein RBBP7 (146-154)
ggcgaguucgggggauuugguagcgug

SEQ ID NO: 55135 - RNA, 33 nt, Artificial Sequence; identical to SEQ ID NO: 30908
  PC4 and SFRS1-interacting protein (251-261)

SEQ ID NO: 55136 - RNA, 27 nt, Artificial Sequence
  Nardilysin-arginine dibasic convertase), isoform CRA_d (823-831)
ggcgagcacgggcugaucauuagagug

SEQ ID NO: 55137 - RNA, 33 nt, Artificial Sequence
  Elongation factor 2 (42-52)
ggcgagcacaucauugccggggcuggagaacug

SEQ ID NO: 55138 - RNA, 27 nt, Artificial Sequence
  Ragulator complex protein LAMTOR4 (44-52)
ggcgagcacacccugcucgugacaguc

SEQ ID NO: 55139 - RNA, 33 nt, Artificial Sequence
  26S protease regulatory subunit 10B (338-348)
ggcgagaucgacuacgaagccauugugaagcug

SEQ ID NO: 55140 - RNA, 33 nt, Artificial Sequence
  Golgin subfamily B member 1 (2640-2650)
ggcgagaucgaagacaagcugaaaaaggagcuc

SEQ ID NO: 55141 - RNA, 33 nt, Artificial Sequence
  Coatomer subunit beta' (518-528)
ggcgagauccaggaaauugugaagaccgggcug

SEQ ID NO: 55142 - RNA, 27 nt, Artificial Sequence
  Prolyl 4-hydroxylase subunit alpha-1 (197-205)
ggcgagaucagcaccauugacaaggug

SEQ ID NO: 55143 - RNA, 27 nt, Artificial Sequence
  Filamin-A (1802-1810)
ggcgagaucaccggggaagugagaaug

SEQ ID NO: 55144 - RNA, 27 nt, Artificial Sequence
  Coatomer subunit beta' (549-557)
ggcgagaucgugaccauugcccaccug

SEQ ID NO: 55145 - RNA, 30 nt, Artificial Sequence
  Proliferating cell nuclear antigen (173-182)
ggcgagcuggggaacggaaauaucaagcuc

SEQ ID NO: 55146 - RNA, 27 nt, Artificial Sequence
  E3 SUMO-protein ligase PIAS3 (130-138)
ggcgagcugaucagacccaccacacuc

SEQ ID NO: 55147 - RNA, 27 nt, Artificial Sequence
  Prohibitin (137-145)
ggcgagcugaucacccagagagaacuc

SEQ ID NO: 55148 - RNA, 30 nt, Artificial Sequence
  40S ribosomal protein S21 (63-72)
ggcgagagcgacgauuccauccugagacuc

SEQ ID NO: 55149 - RNA, 33 nt, Artificial Sequence
  Ubiquitin carboxyl-terminal hydrolase 22 (352-362)
ggcgagagccacguguccgggaccacaacucug

SEQ ID NO: 55150 - RNA, 33 nt, Artificial Sequence
  Maspardin (165-175)
ggccagagcgagcuggccuccagacucacccuu

SEQ ID NO: 55151 - RNA, 30 nt, Artificial Sequence
  RNA-binding protein EWS (382-391)
cacgaggcccagcauggcgugaccagccug

SEQ ID NO: 55152 - RNA, 27 nt, Artificial Sequence
  Kinesin-associated protein 3 (357-365)
cacgaggaccugcucaacaucacccuu

SEQ ID NO: 55153 - RNA, 27 nt, Artificial Sequence
  Chromodomain-helicase-DNA-binding protein 6 (1642-1650)
cacgaggaccccggccaggccacccug

SEQ ID NO: 55154 - RNA, 27 nt, Artificial Sequence
  V-type proton ATPase subunit D (113-121)
cacgagggcaccgacagcuacgaacug

SEQ ID NO: 55155 - RNA, 30 nt, Artificial Sequence
  Taperin (362-371)
cacgagaucgaagugauuggcggguaccug

SEQ ID NO: 55156 - RNA, 27 nt, Artificial Sequence
  Transcription elongation factor SPT6 (746-754)
cacgagcuggaccagggccaacagcuc

SEQ ID NO: 55157 - RNA, 33 nt, Artificial Sequence; identical to SEQ ID NO: 30930
  Coronin-1C (313-323)

SEQ ID NO: 55158 - RNA, 27 nt, Artificial Sequence
  Importin subunit alpha-4 (468-476)
cacgagaacgaagacaucuacaagcug

SEQ ID NO: 55159 - RNA, 30 nt, Artificial Sequence; identical to SEQ ID NO: 30932
  Pre-mRNA-processing factor 19 (305-314)

SEQ ID NO: 55160 - RNA, 27 nt, Artificial Sequence
  Single-stranded DNA-binding protein, mitochondrial (16-24)
cacgagagcgaaaccacaacuucccug

SEQ ID NO: 55161 - RNA, 27 nt, Artificial Sequence
  Vacuolar protein sorting-associated protein 33A (58-66)
cacgagguggaaaagauguucacccug

SEQ ID NO: 55162 - RNA, 27 nt, Artificial Sequence
  STAGA complex 65 subunit gamma (219-227)
cacgaggugggcaucgggagcguccug

SEQ ID NO: 55163 - RNA, 27 nt, Artificial Sequence
  DNA replication licensing factor MCM4 (588-596)
cacgaggugauggaacagcaaacccug

SEQ ID NO: 55164 - RNA, 27 nt, Artificial Sequence
  F-box only protein 38 (323-331)
cacgaggugagaauccagcccagccug

SEQ ID NO: 55165 - RNA, 30 nt, Artificial Sequence
  3-hydroxy-3-methylglutaryl-coenzyme A reductase (619-628)
cacgaguacuuccccgaaaugcagauccug

SEQ ID NO: 55166 - RNA, 27 nt, Artificial Sequence
  Protein C-ets-1 (189-197)
caccccaucagcuccgaggaacugcuc

SEQ ID NO: 55167 - RNA, 33 nt, Artificial Sequence
  DNA repair endonuclease XPF (748-758)
aucgaguucgaccccagcaagccuuuuucccug

SEQ ID NO: 55168 - RNA, 27 nt, Artificial Sequence
  Proliferating cell nuclear antigen (197-205)
aucgagaugaacgaacccgugcagcug

SEQ ID NO: 55169 - RNA, 30 nt, Artificial Sequence
  Nuclear poreoprotein p62 (366-375)
aucgagaacggcgaaaagauuaccagccug

SEQ ID NO: 55170 - RNA, 30 nt, Artificial Sequence
  Melanoma-associated antigen F1 (112-121)
auccuguuccccgacauuauagccagagcu

SEQ ID NO: 55171 - RNA, 30 nt, Artificial Sequence; identical to SEQ ID NO: 30944
  Clathrin light chain A (227-236)

SEQ ID NO: 55172 - RNA, 27 nt, Artificial Sequence
  NAD(P)H dehydrogenase (quinone) 1 (143-151)
aucugggacgagaccccccuguacuuc

SEQ ID NO: 55173 - RNA, 24 nt, Artificial Sequence
  Guanine nucleotide-binding protein subunit beta-2-like 1 (106-113)
aaggacgugcugagcgucgccuuc

SEQ ID NO: 55174 - RNA, 33 nt, Artificial Sequence
  T-complex protein 1 subunit theta (367-377)
aaggaggacggcgccaucagcaccauugugcug

SEQ ID NO: 55175 - RNA, 27 nt, Artificial Sequence
  Ubiquitin carboxyl-terminal hydrolase 48 (790-798)
aaggaggacagcaaacugaucgcccuc

SEQ ID NO: 55176 - RNA, 27 nt, Artificial Sequence
  Myosin-9 (1084-1092)
aaggaggaagagcugcaggccgcucuc

SEQ ID NO: 55177 - RNA, 30 nt, Artificial Sequence
  Plasminogen activator inhibitor 1 RNA-binding protein (8-17)
aaggaggaaacccagcccccuguggcccug

SEQ ID NO: 55178 - RNA, 30 nt, Artificial Sequence
  Chitinase domain-containing protein 1 (269-278)
aaggaguucgaacagcuggcccccgugcuc

SEQ ID NO: 55179 - RNA, 30 nt, Artificial Sequence
  ATP-dependent RNA helicase DDX24 (116-125)
aaggaguucgaagugaaagaccccgagcug

SEQ ID NO: 55180 - RNA, 33 nt, Artificial Sequence
  E3 ubiquitin-protein ligase listerin (1308-1318)
aaggaguucuuuagccagggcauccacucccug

SEQ ID NO: 55181 - RNA, 30 nt, Artificial Sequence
  Inhibitor of growth protein 4 (52-61)
aaggaguucggcgacgauaaagugcagcug

SEQ ID NO: 55182 - RNA, 30 nt, Artificial Sequence
  Eukaryotic translation initiation factor 4 gamma 1 (1365-1374)
aaggaguuccugcccgaaggccaggacauc

SEQ ID NO: 55183 - RNA, 33 nt, Artificial Sequence
  Serine-tRNA ligase, cytoplasmic (457-467)
aaggaguucaugcccccuggccugcaggaacuc

SEQ ID NO: 55184 - RNA, 36 nt, Artificial Sequence
  Heterogeneous nuclear ribonucleoprotein Q (66-77)
aaggaguucaacgaagacggcgcccuggcugugcuc

SEQ ID NO: 55185 - RNA, 27 nt, Artificial Sequence
  Protein zer-1 homolog (579-587)
aaggaguuccccgaaaaacaggagcug

SEQ ID NO: 55186 - RNA, 27 nt, Artificial Sequence
  Regulator of G-protein signaling 10 (61-69)
aaggaguucagcgaagagaacgugcug

SEQ ID NO: 55187 - RNA, 36 nt, Artificial Sequence
  Apolipoprotein L2 (196-207)
aaggaguucgugggcgggaacacccccaauguccug

SEQ ID NO: 55188 - RNA, 27 nt, Artificial Sequence
  Cyclin-dependent kinase 9 (56-64)
aaggagggcuuccccaucaccgcccug

SEQ ID NO: 55189 - RNA, 33 nt, Artificial Sequence
  Vacuolar protein sorting-associated protein 33A (56-66)
aaggagcacgaaguggagaaaauguucacccug

SEQ ID NO: 55190 - RNA, 36 nt, Artificial Sequence
  Serine/Arginine-related protein 53 (223-234)
aaggagaucgaccccaccagcauuccuacagccaua

SEQ ID NO: 55191 - RNA, 27 nt, Artificial Sequence
  Ran GTPase-activating protein 1 (43-51)
aaggagaucgaagacuucgauagccug

SEQ ID NO: 55192 - RNA, 30 nt, Artificial Sequence
  RNA cytidine acetyltransferase (729-738)
aaggagaucgaacugcccagcggccagcuc

SEQ ID NO: 55193 - RNA, 27 nt, Artificial Sequence
  Transcription initiation factor IIB (272-280)
aaggagaucggcgacauugccggggug

SEQ ID NO: 55194 - RNA, 27 nt, Artificial Sequence
  Ras suppressor protein 1 (177-185)
aaggagaucggcgaacugacccagcuc

SEQ ID NO: 55195 - RNA, 30 nt, Artificial Sequence
  V-type proton ATPase 116 kDa subunit a isoform 1 (109-118)
aaggagaucaacaccaaucaggaagcccug

SEQ ID NO: 55196 - RNA, 27 nt, Artificial Sequence
  Scavenger receptor class B member 1 (57-65)
aaggagauccccauuccuuucuaccug

SEQ ID NO: 55197 - RNA, 30 nt, Artificial Sequence
  Centromere protein F (1675-1684)
aaggagauccaggaacuggagcaacuccuu

SEQ ID NO: 55198 - RNA, 30 nt, Artificial Sequence
  Spatacsin (1706-1715)
aaggagaucacccaggaaaugcaaacacug

SEQ ID NO: 55199 - RNA, 36 nt, Artificial Sequence
  Importin-11 (778-789)
aaggagaucaccacagaaggccaggugcaaguccug

SEQ ID NO: 55200 - RNA, 30 nt, Artificial Sequence
  Eukaryotic translation initiation factor 3 subunit E (29-38)
aaggagaucuacaacgaaaaagagcugcuc

SEQ ID NO: 55201 - RNA, 30 nt, Artificial Sequence
  Double-stranded RNA-binding protein Staufen homolog 2 (288-297)
aaggagaaagaacccgacuacgugcugcuc

SEQ ID NO: 55202 - RNA, 30 nt, Artificial Sequence
  Double-stranded RNA-binding protein Staufen homolog 1 (258-267)
aaggagaaagaacccgaguacacccugcuc

SEQ ID NO: 55203 - RNA, 27 nt, Artificial Sequence
  Protein transport protein Sec16A (1490-1498)
aaggagaaacccgaagaggaaagccug

SEQ ID NO: 55204 - RNA, 30 nt, Artificial Sequence
  Heat shock protein HSP 90-alpha A2 (280-289)
aaggagaaauacaucgaccaggaagagcug

SEQ ID NO: 55205 - RNA, 30 nt, Artificial Sequence
  Alpha-2-macroglobulin receptor-associated protein (272-281)
aaggagcuggaagccuucagagaggaacuc

SEQ ID NO: 55206 - RNA, 30 nt, Artificial Sequence
  Ribosome-binding protein 1 (235-244)
aaggagcuggaaagccagguguccggccuc

SEQ ID NO: 55207 - RNA, 33 nt, Artificial Sequence
  Probable ATP-dependent RNA helicase DDX56 (208-218)
aaggagcugauccuccacaaccccgugacccuu

SEQ ID NO: 55208 - RNA, 30 nt, Artificial Sequence; identical to SEQ ID NO: 30981
  CDK5 regulatory subunit-associated protein 2 (665-674)

SEQ ID NO: 55209 - RNA, 27 nt, Artificial Sequence
  Aurora kinase B (57-65)
aaggagcccgugaccccuagcgcccug

SEQ ID NO: 55210 - RNA, 27 nt, Artificial Sequence
  CDK5 regulatory subunit-associated protein 2 (559-567)
aaggagcaggacaucuacacccaccug

SEQ ID NO: 55211 - RNA, 27 nt, Artificial Sequence
  Plectin (2047-2055)
aaggagcaggaacugcaacagacccuc

SEQ ID NO: 55212 - RNA, 30 nt, Artificial Sequence
  Nucleoprotein TPR (995-1004)
aaggagagcgccgaauuccagacccaacug

SEQ ID NO: 55213 - RNA, 30 nt, Artificial Sequence; identical to SEQ ID NO: 30986
  Antizyme inhibitor 1 (203-212)

SEQ ID NO: 55214 - RNA, 27 nt, Artificial Sequence
  Gamma-interferon-inducible protein 16 (299-307)
aaggagacccugaaaaucgacauucuc

SEQ ID NO: 55215 - RNA, 27 nt, Artificial Sequence
  Periodic tryptophan protein 1 homolog (19-27)
aaggagacccccgacaaaguggaacug

SEQ ID NO: 55216 - RNA, 39 nt, Artificial Sequence
  Sequestosome-1 (324-336)
aaggagguggaccccagcaccggcgaacugcagucccuc

SEQ ID NO: 55217 - RNA, 27 nt, Artificial Sequence
  DNA replication licensing factor MCM6 (332-340)
aaggagugggaaaaaguguucgagaug

SEQ ID NO: 55218 - RNA, 33 nt, Artificial Sequence
  Lupus La protein (75-85)
aaggaguggcuggaagacaaaggccaggugcuc

SEQ ID NO: 55219 - RNA, 27 nt, Artificial Sequence
  40S ribosomal protein S2 (58-66)
aaggaguggaugcccgugaccaaacug

SEQ ID NO: 55220 - RNA, 27 nt, Artificial Sequence
  DNA-directed RNA polymerases I, II, and III subunit RPABC4 (50-58)
aagagacugguggucuucgacgccagg

SEQ ID NO: 55221 - RNA, 33 nt, Artificial Sequence
  Dual specificity protein kinase CLK3 (601-611)
cuggaguucgaccccgcccagagaaucacccuc

SEQ ID NO: 55222 - RNA, 27 nt, Artificial Sequence
  Microtubule-associated protein RP/EB family member 2 (98-106)
cuggagcacgaauacauccauaacuuc

SEQ ID NO: 55223 - RNA, 27 nt, Artificial Sequence
  Mitochondrial import inner membrane translocase subunit TIM50 (324-332)
cuggagcaggaagagcaacagagacuc

SEQ ID NO: 55224 - RNA, 30 nt, Artificial Sequence
  Cyclin-dependent kinase 7 (5-14)
cuggaggugaucauuaaggacaacagccuc

SEQ ID NO: 55225 - RNA, 33 nt, Artificial Sequence
  POTE ankyrin domain family member F (794-804)
cugagaguggcccccgaggaacacccuguccuc

SEQ ID NO: 55226 - RNA, 30 nt, Artificial Sequence
  Eukaryotic translation initiation factor 4 gamma 1 (1290-1299)
auggagaucgacauuccccacguguggcug

SEQ ID NO: 55227 - RNA, 27 nt, Artificial Sequence
  MICOS complex subunit MIC60 (474-482)
auggagaacgaaaugagaacccagcug

SEQ ID NO: 55228 - RNA, 30 nt, Artificial Sequence
  Interleukin enhancer-binding factor 3 (561-570)
auggagguggaagucgacggccagaaguuc

SEQ ID NO: 55229 - RNA, 27 nt, Artificial Sequence
  Pre-mRNA-processing-splicing factor 8 (1868-1876)
augcuggacccccucgaggugcaccuu

SEQ ID NO: 55230 - RNA, 27 nt, Artificial Sequence
  Elongation factor 2 (673-681)
aacgagaucaaggacagcguggucgcc

SEQ ID NO: 55231 - RNA, 24 nt, Artificial Sequence
  Heterogeneous nuclear ribonucleoprotein K (38-45)
aacaccgacgagaugguggaacug

SEQ ID NO: 55232 - RNA, 30 nt, Artificial Sequence
  Poly(U)-binding-splicing factor PUF60 (318-327)
caggaggccguggcuggcgcagccguccug

SEQ ID NO: 55233 - RNA, 33 nt, Artificial Sequence
  Tyrosine-protein kinase BAZ1B (891-901)
caggaguuccugaccgacaugaagcaaguguuu

SEQ ID NO: 55234 - RNA, 27 nt, Artificial Sequence
  Pumilio homolog 3 (495-503)
caggagcacgcccaagaagugguccug

SEQ ID NO: 55235 - RNA, 27 nt, Artificial Sequence
  Nuclear pore complex protein Nup205 (13-21)
caggagauccccgaaccucugcaacuc

SEQ ID NO: 55236 - RNA, 27 nt, Artificial Sequence
  Fc receptor-like A (166-174)
caggagcuguuccccgccccuauccuc

SEQ ID NO: 55237 - RNA, 33 nt, Artificial Sequence
  40S ribosomal protein S9 (27-37)
caggagcugaagcucaucggcgaauacgggcuu

SEQ ID NO: 55238 - RNA, 36 nt, Artificial Sequence
  Heterogeneous nuclear ribonucleoprotein H (438-449)
caggagaacagcuccgacuuccaaucuaauaucgcc

SEQ ID NO: 55239 - RNA, 33 nt, Artificial Sequence; identical to SEQ ID NO: 31012
  T-complex protein 1 subunit theta (95-105)

SEQ ID NO: 55240 - RNA, 24 nt, Artificial Sequence
  Coatomer subunit epsilon (97-104)
agagacagcaucguggccgagcug

SEQ ID NO: 55241 - RNA, 30 nt, Artificial Sequence
  Ribosome-binding protein 1 (360-369)
agagaggccgaagagacccagagcacacug

SEQ ID NO: 55242 - RNA, 33 nt, Artificial Sequence
  Nodal modulator 2 (274-284)
agagaggacggcagcuucuccuuuuacucucug

SEQ ID NO: 55243 - RNA, 27 nt, Artificial Sequence
  Guanine nucleotide-binding protein G(s) subunit alpha isoforms short (244-252)
agagaggacaaccagaccaauaggcug

SEQ ID NO: 55244 - RNA, 27 nt, Artificial Sequence
  Nucleolar complex protein 2 homolog (609-617)
agagaggaaggcaccccccugacacuc

SEQ ID NO: 55245 - RNA, 27 nt, Artificial Sequence
  DNA topoisomerase 1 (708-716)
agagaggaaaacaagcagaucgcccug

SEQ ID NO: 55246 - RNA, 27 nt, Artificial Sequence
  Eukaryotic initiation factor 4A-II (256-264)
agagaggaauggaagcuggacacccuc

SEQ ID NO: 55247 - RNA, 30 nt, Artificial Sequence
  Spermine synthase (251-260)
agagaguucgacuacgugaucaacgaucug

SEQ ID NO: 55248 - RNA, 30 nt, Artificial Sequence
  DNA mismatch repair protein Msh6 (1321-1330)
agagaguucgaaaagaugaaccagagccug

SEQ ID NO: 55249 - RNA, 36 nt, Artificial Sequence
  Heterogeneous nuclear ribonucleoprotein R (69-80)
agagaguucaacgaagagggcgcccugagcgugcuc

SEQ ID NO: 55250 - RNA, 27 nt, Artificial Sequence
  Inner centromere protein (47-55)
agagaguucagcaaggaacccgagcug

SEQ ID NO: 55251 - RNA, 27 nt, Artificial Sequence
  Eukaryotic translation initiation factor 3 subunit I (20-28)
agagagggcgaccugcucuucaccgug

SEQ ID NO: 55252 - RNA, 27 nt, Artificial Sequence
  ZW10 interactor (104-112)
agagagcacguggaagccaucaagauu

SEQ ID NO: 55253 - RNA, 33 nt, Artificial Sequence
  ZW10 interactor (104-114)
agagagcacguggaagccaucaagauuggccug

SEQ ID NO: 55254 - RNA, 33 nt, Artificial Sequence
  Histone H3.3 (73-83)
agagagaucgcccaggacuucaagaccgaucug

SEQ ID NO: 55255 - RNA, 33 nt, Artificial Sequence
  Serine/threonine-protein phosphatase PP1-alpha catalytic subunit (21-31)
agagagaucuuccugagccagcccauucuccuu

SEQ ID NO: 55256 - RNA, 30 nt, Artificial Sequence
  Structural maintenance of chromosomes flexible hinge domain-containing protein 1 (393-402)
agagagauccaggacgauaugcaaacccug

SEQ ID NO: 55257 - RNA, 27 nt, Artificial Sequence
  DNA-dependent protein kinase catalytic subunit (2753-2761)
agagagaaggaaaucaaaagcgagcug

SEQ ID NO: 55258 - RNA, 27 nt, Artificial Sequence
  Actin-related protein 2 (125-133)
agagagaagaucguggaagucauguuc

SEQ ID NO: 55259 - RNA, 27 nt, Artificial Sequence
  Aurora kinase A (151-159)
agagagaagcagagcaaauucauccug

SEQ ID NO: 55260 - RNA, 30 nt, Artificial Sequence
  Myosin-9 (1110-1119)
agagagcuggaaagccagaucuccgagcuc

SEQ ID NO: 55261 - RNA, 30 nt, Artificial Sequence
  TRAF3-interacting JNK-activating modulator (73-82)
agagagcuggaaagccagcuccacgugcuu

SEQ ID NO: 55262 - RNA, 33 nt, Artificial Sequence
  NADH dehydrogenase (ubiquinone) 1 alpha subcomplex subunit 13 (79-89)
agagagaaccuggaagaggaagccaucauuaug

SEQ ID NO: 55263 - RNA, 36 nt, Artificial Sequence
  T-complex protein 1 subunit delta (160-171)
agagagacccugcucaacagcgccacaacuucccuu

SEQ ID NO: 55264 - RNA, 33 nt, Artificial Sequence
  Elongation factor 2 (80-90)
agagagaccgugagcgaagaguccaacguccug

SEQ ID NO: 55265 - RNA, 30 nt, Artificial Sequence
  Epsilon-sarcoglycan (213-222)
agagagguggaaaacccccagaaucaacug

SEQ ID NO: 55266 - RNA, 27 nt, Artificial Sequence
  Protein disulfide-isomerase A6 (18-26)
agagaggugauccagagcgacucccug

SEQ ID NO: 55267 - RNA, 30 nt, Artificial Sequence
  Proteasome subunit beta type-4 (165-174)
agagaggugcuggaaaagcagcccguccuc

SEQ ID NO: 55268 - RNA, 27 nt, Artificial Sequence
  SWI/SNF complex subunit SMARCC2 (599-607)
agagaguggaccgaacaggagacacug

SEQ ID NO: 55269 - RNA, 30 nt, Artificial Sequence
  Transcription factor E2F7 (615-624)
agagaguacgaagacggcccccugagccuc

SEQ ID NO: 55270 - RNA, 33 nt, Artificial Sequence
  GDP-L-fucose synthase (38-48)
agagaguacaacgaaguggagcccaucauucug

SEQ ID NO: 55271 - RNA, 33 nt, Artificial Sequence
  Vimentin (381-391)
agagaguaccaggaccugcucaacgugaagaug

SEQ ID NO: 55272 - RNA, 27 nt, Artificial Sequence
  Metastasis-associated protein MTA2 (188-196)
agacagaucgaccaauuccuggugguc

SEQ ID NO: 55273 - RNA, 27 nt, Artificial Sequence
  Runt-related transcription factor 3 (264-272)
agaagcuuccccacccugccuacacuc

SEQ ID NO: 55274 - RNA, 33 nt, Artificial Sequence
  HLA class I histocompatibility antigen, B-15 alpha chain (352-362)
agcgcccagggcuccgacgugucucugaccgcu

SEQ ID NO: 55275 - RNA, 27 nt, Artificial Sequence
  Asparagine synthetase (glutamine-hydrolyzing) (159-167)
agcgaggccaagggccuggugacccuc

SEQ ID NO: 55276 - RNA, 27 nt, Artificial Sequence
  Chromodomain-helicase-DNA-binding protein 4 (1833-1841)
agcgaggaccccucccacccuucuaug

SEQ ID NO: 55277 - RNA, 27 nt, Artificial Sequence
  SRA stem-loop-interacting RNA-binding protein, mitochondrial (69-77)
agcgaggaaggccugagaaacgcccuc

SEQ ID NO: 55278 - RNA, 30 nt, Artificial Sequence
  Poly (ADP-ribose) polymerase 9 (292-301)
agcgaguucauccugggcaaguccgaacuc

SEQ ID NO: 55279 - RNA, 30 nt, Artificial Sequence
  Cold shock domain-containing protein E1 (183-192)
agcgaguucaagggcgaccuggaaacccuc

SEQ ID NO: 55280 - RNA, 30 nt, Artificial Sequence
  Cold shock domain-containing protein E1 (519-528)
agcgaguucuccggcgacguggauucucug

SEQ ID NO: 55281 - RNA, 27 nt, Artificial Sequence
  Zinc finger protein 451 (35-43)
agcgagggcccccugagaccugugcuc

SEQ ID NO: 55282 - RNA, 27 nt, Artificial Sequence
  Protein SON (1526-1534)
agcgagcacggcaucaacauugaccug

SEQ ID NO: 55283 - RNA, 33 nt, Artificial Sequence
  Spectrin beta chain, non-erythrocytic 1 (1024-1034)
agcgagcaccccgaccaggcccaagcuauccug

SEQ ID NO: 55284 - RNA, 36 nt, Artificial Sequence
  Copper transport protein ATOX1 (44-55)
agcgagcacuccauggacacccugcucgccacacuu

SEQ ID NO: 55285 - RNA, 27 nt, Artificial Sequence
  Coatomer subunit zeta-1 (34-42)
agcgagaucgcccugcucgaaggccuu

SEQ ID NO: 55286 - RNA, 30 nt, Artificial Sequence
  Cyclin-dependent kinase 1 (208-217)
agcgagaucgaccagcuguucagaauuuuu

SEQ ID NO: 55287 - RNA, 27 nt, Artificial Sequence
  Rho guanine nucleotide exchange factor 18 (689-697)
agcgagaucgaaggcauucagucccug

SEQ ID NO: 55288 - RNA, 30 nt, Artificial Sequence
  Neuroblast differentiation-associated protein AHNAK (845-854)
agcgagaucaaggugcccgacgucgaacug

SEQ ID NO: 55289 - RNA, 30 nt, Artificial Sequence
  Eukaryotic translation initiation factor 4B (442-451)
agcgagaagucccuggaaaacgagacccuc

SEQ ID NO: 55290 - RNA, 27 nt, Artificial Sequence
  116 kDa U5 small nuclear ribonucleoprotein component (91-99)
agcgagcugaucagaaacgugacccuc

SEQ ID NO: 55291 - RNA, 33 nt, Artificial Sequence
  E3 ubiquitin-protein ligase UBR5 (466-476)
agcgagcugcagggcgaaagaaucgugucccuc

SEQ ID NO: 55292 - RNA, 27 nt, Artificial Sequence
  Death-associated protein kinase 3 (429-437)
agcgagaugagauucgugcaggaccug

SEQ ID NO: 55293 - RNA, 27 nt, Artificial Sequence
  Leucine-rich repeat-containing protein 47 (315-323)
agcgagaaccccgugccucugaccguc

SEQ ID NO: 55294 - RNA, 27 nt, Artificial Sequence
  Protein SON (197-205)
agcgagccccacauccuggaaacccuc

SEQ ID NO: 55295 - RNA, 27 nt, Artificial Sequence
  Programmed cell death protein 5 (88-96)
agcgagcagggccugaucgaaauucuc

SEQ ID NO: 55296 - RNA, 27 nt, Artificial Sequence
  DNA replication licensing factor MCM4 (142-150)
agcgagcagucccugggccaaaagcuc

SEQ ID NO: 55297 - RNA, 27 nt, Artificial Sequence
  Guanylate-binding protein 1 (360-368)
agcgagagagaagccaucgagguguuc

SEQ ID NO: 55298 - RNA, 27 nt, Artificial Sequence
  Signal peptidase complex catalytic subunit SEC11C (57-65)
agcgagucccccaucguggucguucug

SEQ ID NO: 55299 - RNA, 27 nt, Artificial Sequence
  Actin-related protein 2/3 complex subunit 1B (242-250)
agcgagacccugccccuccuugcccug

SEQ ID NO: 55300 - RNA, 36 nt, Artificial Sequence
  Annexin A2 (296-307)
agcgagguggacaugcugaagaucagauccgaauuc

SEQ ID NO: 55301 - RNA, 27 nt, Artificial Sequence
  Proteasome maturation protein (124-132)
agcgaggugaugggcgaaccccaccug

SEQ ID NO: 55302 - RNA, 27 nt, Artificial Sequence
  AP-1 complex subunit beta-1 (347-355)
agccaggccaacaucgcucaagugcug

SEQ ID NO: 55303 - RNA, 27 nt, Artificial Sequence
  Rab GTPase-activating protein 1-like (162-170)
agccaguaccccuucccugugacccug

SEQ ID NO: 55304 - RNA, 33 nt, Artificial Sequence
  Probable ATP-dependent RNA helicase DDX41 (118-128)
agcguggccgagggcagagcucugauguccguc

SEQ ID NO: 55305 - RNA, 27 nt, Artificial Sequence
  General vesicular transport factor p115 (18-26)
accgaggccgaaacaauccagaagcug

SEQ ID NO: 55306 - RNA, 27 nt, Artificial Sequence
  SH2 domain-containing protein 3C (769-777)
accgagcacggcguggaagucguucug

SEQ ID NO: 55307 - RNA, 30 nt, Artificial Sequence
  Nucleolin (452-461)
accgagaucgacggcagaagcauuucccug

SEQ ID NO: 55308 - RNA, 27 nt, Artificial Sequence
  Adenosylhomocysteinase (244-252)
accgagaucgaccccauuaacgcccug

SEQ ID NO: 55309 - RNA, 30 nt, Artificial Sequence
  Polyadenylate-binding protein-interacting protein 1 (66-75)
accgagaucgaacaguucgccgagacacug

SEQ ID NO: 55310 - RNA, 27 nt, Artificial Sequence
  Suppressor of SWI4 1 homolog (72-80)
accgagaucggccccagaaugacacug

SEQ ID NO: 55311 - RNA, 33 nt, Artificial Sequence
  Microtubule-associated protein 4 (428-438)
accgagaucagcuccgccgaaaagguggcucug

SEQ ID NO: 55312 - RNA, 24 nt, Artificial Sequence
  Histone H3.1 (59-66)
accgagcugcucaucagaaagcuu

SEQ ID NO: 55313 - RNA, 30 nt, Artificial Sequence
  Chromodomain-helicase-DNA-binding protein 4 (1265-1274)
accgagcugcagggcaugaacgaauaccuc

SEQ ID NO: 55314 - RNA, 33 nt, Artificial Sequence
  Transcription factor BTF3 (106-116)
accgagaugcugcccagcauccucaaccagcuu

SEQ ID NO: 55315 - RNA, 27 nt, Artificial Sequence
  Probable ATP-dependent RNA helicase DDX6 (6-14)
accgagaaccccgugaucaugggccug

SEQ ID NO: 55316 - RNA, 27 nt, Artificial Sequence
  Poly(rC)-binding protein 1 (6-14)
accgagagcggccugaacgugacacuc

SEQ ID NO: 55317 - RNA, 27 nt, Artificial Sequence
  Steroid hormone receptor ERR1 (88-96)
accgagacagaacccccuguggcccug

SEQ ID NO: 55318 - RNA, 24 nt, Artificial Sequence
  Elongation factor 1-alpha 1 (287-294)
accgaggugaagagcgucgaaaug

SEQ ID NO: 55319 - RNA, 27 nt, Artificial Sequence
  Pinin (538-546)
accgaggugcccgucgaaccuguucug

SEQ ID NO: 55320 - RNA, 27 nt, Artificial Sequence
  Cytoskeleton-associated protein 4 (55-63)
accgaggugagagaacuggucagccuc

SEQ ID NO: 55321 - RNA, 27 nt, Artificial Sequence
  Asparagine synthetase (glutamine-hydrolyzing) (269-277)
acccugcucaagcagcuuaaagaggcc

SEQ ID NO: 55322 - RNA, 33 nt, Artificial Sequence
  Integrin beta-7 (702-712)
guggaggacgaugccagaggcaccgucguucug

SEQ ID NO: 55323 - RNA, 30 nt, Artificial Sequence; identical to SEQ ID NO: 31096
  Eukaryotic translation initiation factor 3 subunit A (253-262)

SEQ ID NO: 55324 - RNA, 33 nt, Artificial Sequence
  Serine/threonine-protein phosphatase 2A 65 kDa regulatory subunit A alpha isoform (436-446)
guggaguucuuugacgaaaagcugaacagccuc

SEQ ID NO: 55325 - RNA, 27 nt, Artificial Sequence
  F-box only protein 7 (135-143)
guggagggccaggucccccacagccug

SEQ ID NO: 55326 - RNA, 27 nt, Artificial Sequence
  GPN-loop GTPase 2 (169-177)
guggagcugccccacaucaaccuccuu

SEQ ID NO: 55327 - RNA, 27 nt, Artificial Sequence
  Melanoma-associated antigen 12 (279-287)
guggagaccagcuacgucaagguucug

SEQ ID NO: 55328 - RNA, 27 nt, Artificial Sequence
  Melanoma-associated antigen D2 (37-45)
guggagguccccgaaaccccuaaggcc

SEQ ID NO: 55329 - RNA, 27 nt, Artificial Sequence
  Vigilin (656-664)
guggaggucagcauccccgccaagcug

SEQ ID NO: 55330 - RNA, 27 nt, Artificial Sequence
  Basic leucine zipper and W2 domain-containing protein 2 (305-313)
guggaguggaacaagaaagaagagcug

SEQ ID NO: 55331 - RNA, 30 nt, Artificial Sequence
  Stomatin-like protein 3 (151-160)
gugcugggcacccagacacucagccaaauc

SEQ ID NO: 55332 - RNA, 27 nt, Artificial Sequence
  Condensin complex subunit 1 (162-170)
ugggaggaagagagacagcccauccug

SEQ ID NO: 55333 - RNA, 27 nt, Artificial Sequence
  Catenin beta-1 (66-74)
ugggagcagggcuucagccaauccuuu

SEQ ID NO: 55334 - RNA, 27 nt, Artificial Sequence
  Myosin light polypeptide 6 (141-149)
uacgaggaacuggugagaaugguccuc

SEQ ID NO: 55335 - RNA, 30 nt, Artificial Sequence; identical to SEQ ID NO: 31108
  Nucleophosmin (67-76)

SEQ ID NO: 55336 - RNA, 27 nt, Artificial Sequence
  60S ribosomal protein L6 (240-248)
uacgagaucaccgaacagagaaagauu

SEQ ID NO: 55337 - RNA, 30 nt, Artificial Sequence
  Septin-11 (95-104)
uacgagcugcaggaaagcaacgugagacuc

SEQ ID NO: 55338 - RNA, 30 nt, Artificial Sequence; identical to SEQ ID NO: 31111
  Glutamine-dependent NAD(+) synthetase (58-67)

SEQ ID NO: 55339 - RNA, 36 nt, Artificial Sequence
  Mitogen-activated protein kinase kinase kinase 5 (675-686)
uacgaguaugacgaaaacggcgauagagugguccug

SEQ ID NO: 55340 - RNA, 27 nt, Artificial Sequence
  60S ribosomal protein L7a (158-166)
gcccacgacguggaucccaucgagcug

SEQ ID NO: 55341 - RNA, 30 nt, Artificial Sequence
  40S ribosomal protein S29 (47-56)
gccaaggacaucggcuucauuaaacuggau

SEQ ID NO: 55342 - RNA, 24 nt, Artificial Sequence
  Long-chain-fatty-acid-CoA ligase 4 (42-49)
uucgaccacgccgugagcaaguuu

SEQ ID NO: 55343 - RNA, 27 nt, Artificial Sequence
  Eukaryotic translation initiation factor 3 subunit L (478-486)
uuccuggaccucaccgagcaggaauuu

SEQ ID NO: 55344 - RNA, 27 nt, Artificial Sequence
  Ubiquitin-like modifier-activating enzyme 1 (637-645)
uuccccaacgccaucgagcacacccug

SEQ ID NO: 55345 - RNA, 27 nt, Artificial Sequence
  Bcl-2-associated transcription factor 1 (338-346)
uucaccgacgaggaaagcagaguguuu

SEQ ID NO: 55346 - RNA, 30 nt, Artificial Sequence
  Bcl-2-associated transcription factor 1 (338-347)
uucaccgacgaggaaagcagaguguuucug

SEQ ID NO: 55347 - RNA, 27 nt, Artificial Sequence
  Disco-interacting protein 2 homolog B (444-452)
uucuacgacgagagaaucguggucguu

SEQ ID NO: 55348 - RNA, 27 nt, Artificial Sequence
  WD repeat-containing protein 46 (188-196)
cacuucgaccugaaccucagacaguuu

SEQ ID NO: 55349 - RNA, 30 nt, Artificial Sequence
  HLA class I histocompatibility antigen, A-24 alpha chain (216-225)
caccccaucagcgaccaugaggccacccug

SEQ ID NO: 55350 - RNA, 27 nt, Artificial Sequence
  Integrator complex subunit 2 (1006-1014)
aucgccgaccccaacauugcuaagcug

SEQ ID NO: 55351 - RNA, 27 nt, Artificial Sequence
  Heterogeneous nuclear ribonucleoprotein M (188-196)
auccccaacgagauuauacacgcccug

SEQ ID NO: 55352 - RNA, 27 nt, Artificial Sequence
  UPF0428 protein CXorf56 (100-108)
aucguggacggcgccgucguuaaguuc

SEQ ID NO: 55353 - RNA, 27 nt, Artificial Sequence
  Long-chain-fatty-acid-CoA ligase 4 (41-49)
cuguucgaccacgccgugagcaaguuu

SEQ ID NO: 55354 - RNA, 27 nt, Artificial Sequence
  Cleavage stimulation factor subunit 1 (370-378)
cugcccgacgagagaaccaucagccuc

SEQ ID NO: 55355 - RNA, 30 nt, Artificial Sequence
  Nucleolar transcription factor 1 (365-374)
cugcccgaggaagagcagcaaagagugcuc

SEQ ID NO: 55356 - RNA, 27 nt, Artificial Sequence
  Microtubule-associated protein 4 (308-316)
cugcccaccgagaaggaaguggcccuc

SEQ ID NO: 55357 - RNA, 24 nt, Artificial Sequence
  Fructose-bisphosphate aldolase A (271-278)
cugagcgaccaccauaucuaccuc

SEQ ID NO: 55358 - RNA, 27 nt, Artificial Sequence
  MMS19 nucleotide excision repair protein homolog (636-644)
augcccgagaaggaaccuagcgugcug

SEQ ID NO: 55359 - RNA, 27 nt, Artificial Sequence
  AF4/FMR2 family member 4 (1053-1061)
augcccagcccuguguccccaaagcug

SEQ ID NO: 55360 - RNA, 27 nt, Artificial Sequence
  Ras-related C3 botulinum toxin substrate 1 (45-53)
augguggacggcaagcccgucaaccug

SEQ ID NO: 55361 - RNA, 27 nt, Artificial Sequence
  Bone morphogenetic protein receptor type-1B (507-515)
aaccccgccagcagacugaccgcucuc

SEQ ID NO: 55362 - RNA, 27 nt, Artificial Sequence
  Multiple epidermal growth factor-like domains protein 8 (2530-2538)
cccgccccuccaccgcccccuccaccc

SEQ ID NO: 55363 - RNA, 30 nt, Artificial Sequence
  Keratin, type II cytoskeletal 1 (338-347)
agcauggacaacaauagaucccuggaucuc

SEQ ID NO: 55364 - RNA, 27 nt, Artificial Sequence
  Nuclear pore complex protein Nup155 (220-228)
agcaccgacaacggcagaaucuuccug

SEQ ID NO: 55365 - RNA, 27 nt, Artificial Sequence
  Coatomer subunit epsilon (111-119)
agcguggacgucaccaacacaacuuuc

SEQ ID NO: 55366 - RNA, 27 nt, Artificial Sequence
  Fatty acid synthase (545-553)
accuucgacgauaucgugcacagcuuu

SEQ ID NO: 55367 - RNA, 27 nt, Artificial Sequence
  Tumor suppressor candidate 3 (165-173)
accuucgaccugcagagaaucggcuuu

SEQ ID NO: 55368 - RNA, 27 nt, Artificial Sequence
  Rho GTPase-activating protein 24 (436-444)
accuacgacaacgugcaccagcaauuc

SEQ ID NO: 55369 - RNA, 27 nt, Artificial Sequence
  ATP-dependent RNA helicase A (697-705)
guguucgaccccgucccuguuggcgug

SEQ ID NO: 55370 - RNA, 30 nt, Artificial Sequence
  10 kDa heat shock protein, mitochondrial (81-90)
gugcuggacgauaaggacuacuuccucuuu

SEQ ID NO: 55371 - RNA, 30 nt, Artificial Sequence
  Metastasis-associated protein MTA3 (135-144)
guguacgaccccagccugaagacccuccuu

SEQ ID NO: 55372 - RNA, 24 nt, Artificial Sequence
  ADP-ribosylation factor GTPase-activating protein 3 (312-319)
uacuucgacgagcccguggaacug

SEQ ID NO: 55373 - RNA, 27 nt, Artificial Sequence
  Transcription factor HES-1 (155-163)
uaccccggccagccucacccagcccug

SEQ ID NO: 55374 - RNA, 27 nt, Artificial Sequence
  Nuclear nucleic acid-binding protein C1D (10-18)
uaccccguggagauccacgaauaucug

SEQ ID NO: 55375 - RNA, 27 nt, Artificial Sequence
  Pecanex-like protein 1 (22-30)
uacuaugacccccaccaggccaccuuc

SEQ ID NO: 55376 - RNA, 27 nt, Artificial Sequence
  ATP-binding cassette sub-family F member 3 (500-508)
uacuaugaccccaagcacgugaucuuc

SEQ ID NO: 55377 - RNA, 30 nt, Artificial Sequence
  Melanoma antigen preferentially expressed in tumors (300-309)
gcccuguacguggacagccucuucuuucuu

SEQ ID NO: 55378 - RNA, 27 nt, Artificial Sequence
  Fatty acid synthase (986-994)
gcccaggcugagguguacaaggaacug

SEQ ID NO: 55379 - RNA, 30 nt, Artificial Sequence
  2',3'-cyclic-nucleotide 3'-phosphodiesterase (249-258)
gcccagcaagacgugcugaagaaaagcuac

SEQ ID NO: 55380 - RNA, 24 nt, Artificial Sequence
  Cytochrome c oxidase subunit 2 (156-163)
agccaggacgugcugcacuccugg

SEQ ID NO: 55381 - RNA, 27 nt, Artificial Sequence
  RNA exonuclease 4 (126-134)
gccagagugagcaucgucaaccaguac

SEQ ID NO: 55382 - RNA, 30 nt, Artificial Sequence
  RNA-binding protein 14 (646-655)
gccagauacagcggcuccuauaacgacuac

SEQ ID NO: 55383 - RNA, 30 nt, Artificial Sequence
  Talin-1 (1272-1281)
ggcagauucgggcaggacuuuagcaccuuc

SEQ ID NO: 55384 - RNA, 27 nt, Artificial Sequence
  YTH domain-containing family protein 2 (30-38)
ggcagaguguucaucauuaagagcuac

SEQ ID NO: 55385 - RNA, 27 nt, Artificial Sequence
  ATP-dependent RNA helicase DDX42 (228-236)
aagagauucggcaaagccuacaaccug

SEQ ID NO: 55386 - RNA, 27 nt, Artificial Sequence
  Eukaryotic translation initiation factor 3 subunit E (73-81)
aagagaaccacaguggucgcccagcug

SEQ ID NO: 55387 - RNA, 27 nt, Artificial Sequence
  Proteasome subunit beta type-5 (113-121)
agaagggccaucuaccaggcuaccuau

SEQ ID NO: 55388 - RNA, 27 nt, Artificial Sequence
  DNA replication licensing factor MCM5 (602-610)
agaaggagcuccauccccauuaccgug

SEQ ID NO: 55389 - RNA, 39 nt, Artificial Sequence
  HLA class I histocompatibility antigen, B-15 alpha chain (193-205)
agaagguaccuggagaacggcaaggaaacccuccagcgg

SEQ ID NO: 55390 - RNA, 30 nt, Artificial Sequence
  Probable bifunctional methylenetetrahydrofolate dehydrogenase/cyclohydrolase 2 (246-255)
cacagauacacccccaaggagcagcugaaa

SEQ ID NO: 55391 - RNA, 27 nt, Artificial Sequence
  60S ribosomal protein L7 (199-207)
aagagauucaaagaggccaacaauuuu

SEQ ID NO: 55392 - RNA, 45 nt, Artificial Sequence
  Heat shock 70 kDa protein 1-like (171-185)
gugcugagaaucauuaacgagcccaccgccgcugcaauagccuac

SEQ ID NO: 55393 - RNA, 27 nt, Artificial Sequence
  Polypyrimidine tract-binding protein 1 (169-177)
gccgcuguggacgcaggcauggccaug

SEQ ID NO: 55394 - RNA, 33 nt, Artificial Sequence
  HLA class I histocompatibility antigen, alpha chain E (137-147)
uucgccuacgacggcaaggauuaucugacccuc

SEQ ID NO: 55395 - RNA, 42 nt, Artificial Sequence
  HLA class I histocompatibility antigen, A-29 alpha chain (21-34)
uucaucgccgugggcuacgucgacgauacccaguuuguuaga

SEQ ID NO: 55396 - RNA, 30 nt, Artificial Sequence
  Ubiquitin-like protein ISG15 (45-54)
cuggccgugcaccccagcggcgucgcucuc

SEQ ID NO: 55397 - RNA, 27 nt, Artificial Sequence
  N-acetyltransferase 8 (174-182)
auccuggacaccggcacaauucagcuc

SEQ ID NO: 55398 - RNA, 27 nt, Artificial Sequence
  Protein prune homolog 2 (1910-1918)
gcccuguucgacggcgauccccaccuc

SEQ ID NO: 55399 - RNA, 27 nt, Artificial Sequence
  Phosphatidylinositol 4,5-bisphosphate 3-kinase catalytic subunit delta isoform (477-485)
gagguggccccccacccugucuacuau

SEQ ID NO: 55400 - RNA, 27 nt, Artificial Sequence
  Chloride intracellular channel protein 1 (167-175)
uuccuggacggcaacgagcucacccuu

SEQ ID NO: 55401 - RNA, 27 nt, Artificial Sequence
  Carbonic anhydrase 9 (254-262)
caccugagcaccgccuucgcuagagug

SEQ ID NO: 55402 - RNA, 27 nt, Artificial Sequence
  40S ribosomal protein S16 (49-57)
aagcugcucgagcccgugcuucuguug

SEQ ID NO: 55403 - RNA, 27 nt, Artificial Sequence
  Glutathione peroxidase 1 (40-48)
cugcucaucgagaacguggccagccuu

SEQ ID NO: 55404 - RNA, 27 nt, Artificial Sequence
  Proliferating cell nuclear antigen (228-236)
agcauguccgccgacgugccccugguc

SEQ ID NO: 55405 - RNA, 39 nt, Artificial Sequence
  Dermokine (410-422)
gccaucauugagggcgcugacgcaagcucccugcagaag

SEQ ID NO: 55406 - RNA, 33 nt, Artificial Sequence
  PRELI domain-containing protein 1, mitochondrial (142-152)
gccgugcaggaguucggccuggcuagauuuaag

SEQ ID NO: 55407 - RNA, 27 nt, Artificial Sequence
  Putative WAS protein family homolog 3 (42-50)
aaggugagcggcgacaucuucuccaga

SEQ ID NO: 55408 - RNA, 39 nt, Artificial Sequence
  Mitochondrial import inner membrane translocase subunit Tim23 (156-168)
accguggccgcuggcacaaugacugggaugcuguacaag

SEQ ID NO: 55409 - RNA, 33 nt, Artificial Sequence
  Tryptophan-tRNA ligase, mitochondrial (162-172)
gugcugcaggccgcugacauccuccuuuacaag

SEQ ID NO: 55410 - RNA, 27 nt, Artificial Sequence
  Cytochrome c oxidase subunit 6A1, mitochondrial (29-37)
gugagcaugcugaacgucuaccucaag

SEQ ID NO: 55411 - RNA, 27 nt, Artificial Sequence
  40S ribosomal protein S4, X isoform (171-179)
ggcagaaucggggugauuaccaacagg

SEQ ID NO: 55412 - RNA, 51 nt, Artificial Sequence
  SLAM family member 6 (103-119)
gacaccggcagcuacagagcccagaucuccacaaagacuucugcuaaacug

SEQ ID NO: 55413 - RNA, 45 nt, Artificial Sequence
  Transferrin receptor protein 1 (680-694)
agaguggaguaccacuuccugagccccuaugucuccccuaaggaa

SEQ ID NO: 55414 - RNA, 54 nt, Artificial Sequence
  Transferrin receptor protein 1 (680-697)
agaguggaguaccacuuccugagccccuaugucuccccuaaggaaucuccauuu

SEQ ID NO: 55415 - RNA, 45 nt, Artificial Sequence
  HLA class I histocompatibility antigen, A-1 alpha chain (28-42)
gacgauacccaguucgugagauuugacagcgaugccgcuucccaa

SEQ ID NO: 55416 - RNA, 48 nt, Artificial Sequence
  HLA class I histocompatibility antigen, A-2 alpha chain (28-43)
gacgauacccaguucgugagauuugacagcgaugccgcuucccaaagg

SEQ ID NO: 55417 - RNA, 51 nt, Artificial Sequence
  HLA class I histocompatibility antigen, A-2 alpha chain (28-44)
gacgauacccaguucgugagauuugacagcgaugccgcuucccaaaggaug

SEQ ID NO: 55418 - RNA, 54 nt, Artificial Sequence
  HLA class I histocompatibility antigen, A-2 alpha chain (28-45)
gacgauacccaguucgugagauuugacagcgaugccgcuucccaaaggauggag

SEQ ID NO: 55419 - RNA, 51 nt, Artificial Sequence
  HLA class I histocompatibility antigen, Cw-7 alpha chain (153-169)
gaccugagaagcuggaccgccgcugauacagcagcccagaucacucaaagg

SEQ ID NO: 55420 - RNA, 39 nt, Artificial Sequence
  HLA class I histocompatibility antigen, alpha chain E (140-152)
gaccugagaagcuggaccgccguggauacagcugcacag

SEQ ID NO: 55421 - RNA, 48 nt, Artificial Sequence
  HLA class I histocompatibility antigen, A-2 alpha chain (29-44)
gacacccaguucgugagauuugauagcgacgccgcuucccaaaggaug

SEQ ID NO: 55422 - RNA, 54 nt, Artificial Sequence
  HLA class I histocompatibility antigen, Cw-7 alpha chain (152-169)
gaggaccugagaagcuggaccgccgcugauacagcagcccagaucacucaaagg

SEQ ID NO: 55423 - RNA, 54 nt, Artificial Sequence
  HLA class I histocompatibility antigen, B-15 alpha chain (152-169)
gaggaccugagcuccuggaccgccgcugauacagcagcccagaucacucaaaga

SEQ ID NO: 55424 - RNA, 36 nt, Artificial Sequence
  HLA class I histocompatibility antigen, A-2 alpha chain (32-43)
uucgugagauuugacagcgaugccgcuucccagagg

SEQ ID NO: 55425 - RNA, 45 nt, Artificial Sequence
  Heat shock cognate 71 kDa protein (484-498)
ggcauccugaacgugagcgccgucgacaaguccaccgggaaagag

SEQ ID NO: 55426 - RNA, 42 nt, Artificial Sequence
  HLA class I histocompatibility antigen, B-15 alpha chain (154-167)
cugagcuccuggaccgccgcugacacagcagcccagaucacu

SEQ ID NO: 55427 - RNA, 48 nt, Artificial Sequence
  HLA class I histocompatibility antigen, B-15 alpha chain (154-169)
cugagcuccuggaccgccgcugacacagcagcccagaucacucaaaga

SEQ ID NO: 55428 - RNA, 54 nt, Artificial Sequence
  HLA class I histocompatibility antigen, Cw-7 alpha chain (151-168)
aacgaggaccugagaagcuggaccgccgcugauacagcagcccagaucacucaa

SEQ ID NO: 55429 - RNA, 42 nt, Artificial Sequence
  HLA class I histocompatibility antigen, B-15 alpha chain (155-168)
agcuccuggaccgccgcugacacagcagcccagaucacucaa

SEQ ID NO: 55430 - RNA, 42 nt, Artificial Sequence
  HLA class I histocompatibility antigen, B-15 alpha chain (55-68)
acccaguucgugagauuugacagcgaugccgcuucccccagg

SEQ ID NO: 55431 - RNA, 42 nt, Artificial Sequence
  HLA class I histocompatibility antigen, A-2 alpha chain (30-43)
acccaguucgugagauuugacagcgaugccgcuucccaaagg

SEQ ID NO: 55432 - RNA, 48 nt, Artificial Sequence
  HLA class I histocompatibility antigen, A-1 alpha chain (27-42)
guggacgauacccaguucgucagauuugacagcgaugccgcuucccaa

SEQ ID NO: 55433 - RNA, 54 nt, Artificial Sequence
  HLA class I histocompatibility antigen, A-2 alpha chain (27-44)
guggacgauacccaguucgucagauuugacagcgaugccgcuucccaaaggaug

SEQ ID NO: 55434 - RNA, 27 nt, Artificial Sequence
  Ankyrin repeat domain-containing protein 17 (744-752)
gcccccagagugccuguccaggcucug

SEQ ID NO: 55435 - RNA, 27 nt, Artificial Sequence
  Probable ubiquitin carboxyl-terminal hydrolase FAF-Y (2050-2058)
gccagauuccuguuuaccacaggcuuc

SEQ ID NO: 55436 - RNA, 42 nt, Artificial Sequence
  Transferrin receptor protein 1 (15-28)
ggcgagccccugagcuacaccagauucucccucgccaggcag

SEQ ID NO: 55437 - RNA, 48 nt, Artificial Sequence
  Transferrin receptor protein 1 (15-30)
ggcgagccccugagcuacaccagauucucccucgccaggcagguggac

SEQ ID NO: 55438 - RNA, 51 nt, Artificial Sequence
  Transferrin receptor protein 1 (14-30)
ggcggggagccccugagcuacaccagauucucccucgccaggcagguggac

SEQ ID NO: 55439 - RNA, 54 nt, Artificial Sequence
  Transferrin receptor protein 1 (14-31)
ggcggggagccccugagcuacaccagauucucccucgccaggcagguggacgga

SEQ ID NO: 55440 - RNA, 27 nt, Artificial Sequence
  Annexin A3 (33-41)
ggcaucgggaccgacgagaagaugcug

SEQ ID NO: 55441 - RNA, 27 nt, Artificial Sequence
  Microtubule-associated protein 1B (225-233)
ggccugagcgaguucaccgaauaccuc

SEQ ID NO: 55442 - RNA, 27 nt, Artificial Sequence
  SCAN domain-containing protein 1 (121-129)
ggccccagagaggccuucaggcagcug

SEQ ID NO: 55443 - RNA, 27 nt, Artificial Sequence
  Splicing factor 3B subunit 3 (430-438)
ggccccagaagcucccugagggugcuc

SEQ ID NO: 55444 - RNA, 27 nt, Artificial Sequence
  Glyoxylate reductase/hydroxypyruvate reductase (162-170)
ggcagaaucgggcaggccauugcuagg

SEQ ID NO: 55445 - RNA, 30 nt, Artificial Sequence
  40S ribosomal protein S11 (70-79)
ggcagaauccugagcgggguggucaccaag

SEQ ID NO: 55446 - RNA, 27 nt, Artificial Sequence
  Eukaryotic initiation factor 4A-II (368-376)
ggcagaaaggggguggccaucaacuuc

SEQ ID NO: 55447 - RNA, 27 nt, Artificial Sequence
  40S ribosomal protein S4, Y isoform 1 (190-198)
ggcagagugggggucaucaccaacagg

SEQ ID NO: 55448 - RNA, 27 nt, Artificial Sequence
  Splicing factor 3B subunit 3 (957-965)
ggcagagugcugaucggggucggaaag

SEQ ID NO: 55449 - RNA, 30 nt, Artificial Sequence
  Nucleolar RNA helicase 2 (403-412)
aucccccagaagcaaagagagauuacccug

SEQ ID NO: 55450 - RNA, 27 nt, Artificial Sequence
  Probable ATP-dependent RNA helicase DDX4 (355-363)
aucaccgccagcagauucaaggagcug

SEQ ID NO: 55451 - RNA, 27 nt, Artificial Sequence
  EH domain-containing protein 2 (480-488)
aagcugcccaacagcgugcucggcaga

SEQ ID NO: 55452 - RNA, 27 nt, Artificial Sequence
  Speriolin-like protein (246-254)
aagcugagagagcucacccagagguac

SEQ ID NO: 55453 - RNA, 27 nt, Artificial Sequence
  Ubiquitin carboxyl-terminal hydrolase 45 (297-305)
cugcuccacuaccuucuggacgccgug

SEQ ID NO: 55454 - RNA, 27 nt, Artificial Sequence
  40S ribosomal protein S4, X isoform (238-246)
cugcccagaggcaaggggaucaggcuc

SEQ ID NO: 55455 - RNA, 30 nt, Artificial Sequence
  DNA replication licensing factor MCM6 (215-224)
cugcccagaggcagcaucccuaggucccuc

SEQ ID NO: 55456 - RNA, 33 nt, Artificial Sequence
  2',3'-cyclic-nucleotide 3'-phosphodiesterase (303-313)
cugcccagaggcagcagggcccacaucacccuc

SEQ ID NO: 55457 - RNA, 27 nt, Artificial Sequence
  39S ribosomal protein L20, mitochondrial (89-97)
aaccuggugaagugccaggucgagcuc

SEQ ID NO: 55458 - RNA, 33 nt, Artificial Sequence
  Trinucleotide repeat-containing gene 18 protein (554-564)
aacagaaaggcccuggcuaaaggccucgggcuu

SEQ ID NO: 55459 - RNA, 33 nt, Artificial Sequence
  Transmembrane emp24 domain-containing protein 4 (23-33)
aacuaccccgagaucgccgcuaaggacaaacug

SEQ ID NO: 55460 - RNA, 27 nt, Artificial Sequence
  Lymphocyte antigen 75 (791-799)
cagauccccaagggcagaaccccuaaa

SEQ ID NO: 55461 - RNA, 27 nt, Artificial Sequence
  Ribonucleoside-diphosphate reductase large subunit (742-750)
agacccgccgcuaacccuauccaguuc

SEQ ID NO: 55462 - RNA, 27 nt, Artificial Sequence
  Aldo-keto reductase family 1 member C1 (91-99)
agacccgagcuggugaggccugcccuc

SEQ ID NO: 55463 - RNA, 30 nt, Artificial Sequence
  Protein phosphatase 1 regulatory subunit 35 (234-243)
agacccaggccuagcgaggacaccuuccug

SEQ ID NO: 55464 - RNA, 27 nt, Artificial Sequence
  Frizzled-2 (2-10)
agacccaggagcgcccugccucggcuc

SEQ ID NO: 55465 - RNA, 27 nt, Artificial Sequence
  HLA class I histocompatibility antigen, alpha chain E (25-33)
agccugaaguacuuccacaccuccgug

SEQ ID NO: 55466 - RNA, 27 nt, Artificial Sequence
  Histone H2B type 2-F (79-87)
agcagacuggcccacuacaacaagagg

SEQ ID NO: 55467 - RNA, 27 nt, Artificial Sequence
  EH domain-containing protein 2 (484-492)
agcgugcugggcagaaucuggaagcuc

SEQ ID NO: 55468 - RNA, 33 nt, Artificial Sequence
  Heterogeneous nuclear ribonucleoprotein K (78-88)
gugcccgacagcuccggcccugagagaauccug

SEQ ID NO: 55469 - RNA, 27 nt, Artificial Sequence
  Vimentin (216-224)
gccagacuggaccucgagaggaaggug

SEQ ID NO: 55470 - RNA, 27 nt, Artificial Sequence
  E3 ubiquitin-protein ligase HECTD1 (174-182)
gccagacugggcgugaucagcaagguc

SEQ ID NO: 55471 - RNA, 30 nt, Artificial Sequence
  V-type proton ATPase subunit S1 (217-226)
gccagacugagccucaccuacgagaggcuu

SEQ ID NO: 55472 - RNA, 27 nt, Artificial Sequence
  Peroxisomal membrane protein PEX16 (38-46)
ggcagauucgccgacagccacgagcug

SEQ ID NO: 55473 - RNA, 30 nt, Artificial Sequence
  40S ribosomal protein S21 (44-53)
ggcagauucaacgggcaguuuaagaccuac

SEQ ID NO: 55474 - RNA, 27 nt, Artificial Sequence
  Pro-interleukin-16 (881-889)
ggcagauucagcgggcugcucggaagg

SEQ ID NO: 55475 - RNA, 27 nt, Artificial Sequence
  60S ribosomal protein L13a (17-25)
ggcagacuggccgcuaucguggcaaag

SEQ ID NO: 55476 - RNA, 27 nt, Artificial Sequence
  Leucine-tRNA ligase, cytoplasmic (57-65)
ggcagacugcaccucgggcauaccuuc

SEQ ID NO: 55477 - RNA, 27 nt, Artificial Sequence
  Amidophosphoribosyltransferase (354-362)
ggcagaaccuucauccagcccaacaug

SEQ ID NO: 55478 - RNA, 27 nt, Artificial Sequence
  Ubiquitin-60S ribosomal protein L40 (58-66)
ggcagaacccugagcgacuacaacauc

SEQ ID NO: 55479 - RNA, 30 nt, Artificial Sequence
  Lamin-B receptor (14-23)
ggcagauggcccgggagcucccuguacuau

SEQ ID NO: 55480 - RNA, 27 nt, Artificial Sequence
  40S ribosomal protein S25 (103-111)
cacagagcccaggugaucuacaccagg

SEQ ID NO: 55481 - RNA, 27 nt, Artificial Sequence
  Transcription activator BRG1 (1255-1263)
cacagaaucggccagcaaaacgaggug

SEQ ID NO: 55482 - RNA, 27 nt, Artificial Sequence
  H/ACA ribonucleoprotein complex subunit 3 (44-52)
cacagaaucaccauuaagaaaagguuc

SEQ ID NO: 55483 - RNA, 30 nt, Artificial Sequence
  Heterogeneous nuclear ribonucleoprotein H (274-283)
cacagauacggcgacgggggaagcaccuuc

SEQ ID NO: 55484 - RNA, 27 nt, Artificial Sequence
  Histone H2A type 1-A (88-96)
aucagaaacgacgaggaacugaauaag

SEQ ID NO: 55485 - RNA, 27 nt, Artificial Sequence
  Hsc70-interacting protein (153-161)
aagagagccagcguguucgucaaacug

SEQ ID NO: 55486 - RNA, 27 nt, Artificial Sequence
  Signal peptidase complex subunit 2 (164-172)
aagagauucgacgauaaauacacccug

SEQ ID NO: 55487 - RNA, 27 nt, Artificial Sequence
  YEATS domain-containing protein 2 (299-307)
aagagaaucgacauuauacacaaccug

SEQ ID NO: 55488 - RNA, 27 nt, Artificial Sequence
  Protein arginine N-methyltransferase 1 (266-274)
aagagaaacgacuacgugcacgcccug

SEQ ID NO: 55489 - RNA, 27 nt, Artificial Sequence
  Cyclic AMP-responsive element-binding protein 3-like protein 2 (270-278)
aagagaacccugaucgccgagggcuac

SEQ ID NO: 55490 - RNA, 30 nt, Artificial Sequence
  DNA-dependent protein kinase catalytic subunit (263-272)
aagagauacgccgugcccagcgcuggccug

SEQ ID NO: 55491 - RNA, 27 nt, Artificial Sequence
  Small nuclear ribonucleoprotein Sm D2 (110-118)
cugagaaacccccucaucgccggcaag

SEQ ID NO: 55492 - RNA, 30 nt, Artificial Sequence
  Solute carrier family 25 member 46 (98-107)
aacagauucgccggcuuugggaucggacug

SEQ ID NO: 55493 - RNA, 27 nt, Artificial Sequence
  General transcription factor II-I (491-499)
aacagaaucaaguucgugauuaaaagg

SEQ ID NO: 55494 - RNA, 27 nt, Artificial Sequence
  L-lactate dehydrogenase A chain (111-119)
cagagaaacgugaauaucuucaaguuu

SEQ ID NO: 55495 - RNA, 27 nt, Artificial Sequence
  Annexin A2 (67-75)
cagagacaagacaucgccuucgcuuac

SEQ ID NO: 55496 - RNA, 36 nt, Artificial Sequence
  40S ribosomal protein S30 (114-125)
agaagguucgugaacgucguucccaccuuuggcaag

SEQ ID NO: 55497 - RNA, 27 nt, Artificial Sequence
  2'-5'-oligoadenylate synthase 1 (94-102)
agaaggggcgaguucauccaggaaauu

SEQ ID NO: 55498 - RNA, 30 nt, Artificial Sequence
  NADH dehydrogenase (ubiquinone) 1 alpha subcomplex subunit 1 (52-61)
agaaggaucagcggcguggaccgguacuau

SEQ ID NO: 55499 - RNA, 30 nt, Artificial Sequence
  Protein disulfide-isomerase A3 (4-13)
agaaggcuggcccucuuccccggcguggcu

SEQ ID NO: 55500 - RNA, 27 nt, Artificial Sequence
  Reticulocalbin-1 (8-16)
agaaggcugggccucgcccuugggcug

SEQ ID NO: 55501 - RNA, 27 nt, Artificial Sequence
  S-adenosylmethionine synthase isoform type-1 (312-320)
agaagggugcugguccagguuagcuac

SEQ ID NO: 55502 - RNA, 33 nt, Artificial Sequence
  Probable ATP-dependent RNA helicase DDX5 (24-34)
agcagagccggcccccuguccgggaagaaauuc

SEQ ID NO: 55503 - RNA, 27 nt, Artificial Sequence
  Membralin (120-128)
agcagagcccccguguuccugcaguuu

SEQ ID NO: 55504 - RNA, 30 nt, Artificial Sequence
  Dynamin-like 120 kDa protein, mitochondrial (499-508)
agcagaauccagcaaauuauagagggcaag

SEQ ID NO: 55505 - RNA, 27 nt, Artificial Sequence
  Growth hormone-inducible transmembrane protein (146-154)
agcagaacccccgugcugaugaacuuc

SEQ ID NO: 55506 - RNA, 30 nt, Artificial Sequence
  Clathrin heavy chain 1 (1341-1350)
agcagagugaacauccccaagguccugagg

SEQ ID NO: 55507 - RNA, 27 nt, Artificial Sequence
  Heat shock-related 70 kDa protein 2 (344-352)
accagaauccccaagauucagaaacug

SEQ ID NO: 55508 - RNA, 27 nt, Artificial Sequence
  Polyadenylate-binding protein 1 (289-297)
accagauaccagggcgugaaccuguau

SEQ ID NO: 55509 - RNA, 33 nt, Artificial Sequence
  Histone H2B type 2-F (99-109)
gugagacugcuccuucccggcgagcuggccaag

SEQ ID NO: 55510 - RNA, 30 nt, Artificial Sequence
  Eukaryotic translation initiation factor 3 subunit B (340-349)
gugagauggagccccaagggcaccuaccug

SEQ ID NO: 55511 - RNA, 27 nt, Artificial Sequence
  Ras-specific guanine nucleotide-releasing factor 1 (983-991)
gccgcugcaaacaucauuagaacccug

SEQ ID NO: 55512 - RNA, 27 nt, Artificial Sequence
  Cytoskeleton-associated protein 4 (73-81)
gccgcugacaccgagagacuggcacuc

SEQ ID NO: 55513 - RNA, 42 nt, Artificial Sequence
  Voltage-dependent anion-selective channel protein 2 (222-235)
gccgcuaaguaccagcuggaccccaccgcaagcaucuccgcc

SEQ ID NO: 55514 - RNA, 27 nt, Artificial Sequence
  RNA polymerase II subunit A C-terminal domain phosphatase (41-49)
gccgcugugagaaucggcagcguccug

SEQ ID NO: 55515 - RNA, 36 nt, Artificial Sequence
  Protein unc-13 homolog D (1011-1022)
gccgacgaucuggagggcgaagcuuuccucccccuu

SEQ ID NO: 55516 - RNA, 39 nt, Artificial Sequence
  Protein unc-13 homolog D (1011-1023)
gccgacgaucuggagggcgaagcuuuccucccccuuaga

SEQ ID NO: 55517 - RNA, 42 nt, Artificial Sequence
  Protein unc-13 homolog D (1011-1024)
gccgacgaucuggagggcgaagcuuuccucccccuuagagag

SEQ ID NO: 55518 - RNA, 45 nt, Artificial Sequence
  SLAM family member 6 (47-61)
gccgacgauaacgugagcuucagaugggaggcucugggcaauacc

SEQ ID NO: 55519 - RNA, 48 nt, Artificial Sequence
  SLAM family member 6 (47-62)
gccgacgauaacgugagcuucagaugggaggcucugggcaauacccuc

SEQ ID NO: 55520 - RNA, 36 nt, Artificial Sequence
  Golgi apparatus protein 1 (724-735)
gccgacaucuucguggaucccguccugcacaccgcu

SEQ ID NO: 55521 - RNA, 42 nt, Artificial Sequence
  Golgi apparatus protein 1 (1059-1072)
gccgacaucuucguggaucccguccugcacaccgcuugcgca

SEQ ID NO: 55522 - RNA, 36 nt, Artificial Sequence
  Low affinity immunoglobulin epsilon Fc receptor (40-51)
gccgaccugagcuccuucaagucucaggagcucaac

SEQ ID NO: 55523 - RNA, 42 nt, Artificial Sequence
  Low affinity immunoglobulin epsilon Fc receptor (40-53)
gccgaccugagcuccuucaagucucaggagcucaacgaaaga

SEQ ID NO: 55524 - RNA, 45 nt, Artificial Sequence
  Low affinity immunoglobulin epsilon Fc receptor (40-54)
gccgaccugagcuccuucaagucucaggagcucaacgaaagaaau

SEQ ID NO: 55525 - RNA, 48 nt, Artificial Sequence
  Low affinity immunoglobulin epsilon Fc receptor (40-55)
gccgaccugagcuccuucaagucucaggagcucaacgaaagaaaugag

SEQ ID NO: 55526 - RNA, 51 nt, Artificial Sequence
  Low affinity immunoglobulin epsilon Fc receptor (40-56)
gccgaccugagcuccuucaagucucaggagcucaacgaaagaaaugaggcu

SEQ ID NO: 55527 - RNA, 48 nt, Artificial Sequence
  T-complex protein 1 subunit beta (163-178)
gccgacagcuaccuggaugagggcuuccuccuugacaagaaaaucggg

SEQ ID NO: 55528 - RNA, 27 nt, Artificial Sequence
  Eukaryotic translation initiation factor 6 (130-138)
gccgacgugcugaaggucgagguuuuc

SEQ ID NO: 55529 - RNA, 27 nt, Artificial Sequence
  Proline-rich protein 12 (390-398)
gccgaggaagcuggcgggaccagacug

SEQ ID NO: 55530 - RNA, 27 nt, Artificial Sequence
  Probable ribonuclease ZC3H12D (154-162)
gccgagcuggaaagacaggcugugcuc

SEQ ID NO: 55531 - RNA, 30 nt, Artificial Sequence
  A-kinase anchor protein 2 (688-697)
gccgagcugagaagcaccgcuucccuccuu

SEQ ID NO: 55532 - RNA, 48 nt, Artificial Sequence
  Ragulator complex protein LAMTOR1 (36-51)
gccgagcccaacuaccacagccugccuuccgcuagaaccgacgaacag

SEQ ID NO: 55533 - RNA, 57 nt, Artificial Sequence
  Low affinity immunoglobulin epsilon Fc receptor (19-37)
gccgagcagcaaagacugaagagccaggaccucgaacuuuccuggaaccugaauggc

SEQ ID NO: 55534 - RNA, 30 nt, Artificial Sequence
  Ribonucleoside-diphosphate reductase subunit M2 B (284-293)
gccgagaccacagacaacguguucacucug

SEQ ID NO: 55535 - RNA, 27 nt, Artificial Sequence
  Zinc finger protein 638 (1263-1271)
gccgagguggaaaagaacgagaccguc

SEQ ID NO: 55536 - RNA, 45 nt, Artificial Sequence
  Peroxisomal multifunctional enzyme type 2 (19-33)
gccggccuggggagagcuuacgcacucgccuucgcggagagggga

SEQ ID NO: 55537 - RNA, 45 nt, Artificial Sequence
  B- and T-lymphocyte attenuator (191-205)
gccggcagagagaucaaccugguggacgcucaccucaagagcgaa

SEQ ID NO: 55538 - RNA, 51 nt, Artificial Sequence
  B- and T-lymphocyte attenuator (191-207)
gccggcagagagaucaaccugguggacgcucaccucaagagcgaacagacc

SEQ ID NO: 55539 - RNA, 36 nt, Artificial Sequence
  CD44 antigen (8-19)
gccggcguguuccacgucgagaagaacgggagauac

SEQ ID NO: 55540 - RNA, 30 nt, Artificial Sequence
  Cordon-bleu protein-like 1 (1088-1097)
gccaucagaagcggcgaggcugcagccaag

SEQ ID NO: 55541 - RNA, 36 nt, Artificial Sequence
  C-C chemokine receptor type 7 (94-105)
gccaucgugcaggcugucagcgcacacagacauagg

SEQ ID NO: 55542 - RNA, 42 nt, Artificial Sequence
  Ragulator complex protein LAMTOR3 (21-34)
gccaucguggucagcgacagagauggcguucccgugauuaag

SEQ ID NO: 55543 - RNA, 45 nt, Artificial Sequence
  IgG receptor FcRn large subunit p51 (131-145)
gccaaguucgcucugaacggcgaggaauuuaugaauuucgaccuc

SEQ ID NO: 55544 - RNA, 48 nt, Artificial Sequence
  IgG receptor FcRn large subunit p51 (131-146)
gccaaguucgcucugaacggcgaggaauuuaugaauuucgaccucaaa

SEQ ID NO: 55545 - RNA, 42 nt, Artificial Sequence
  Glutathione peroxidase 1 (84-97)
gcccugaugaccgaccccaagcucaucacauggagcccugug

SEQ ID NO: 55546 - RNA, 39 nt, Artificial Sequence
  IgG receptor FcRn large subunit p51 (134-146)
gcccugaacggcgaggaauucaugaauuuugaccucaag

SEQ ID NO: 55547 - RNA, 27 nt, Artificial Sequence
  Serine/threonine-protein kinase LATS1 (729-737)
gcccuguacgcuaccaagacacucaga

SEQ ID NO: 55548 - RNA, 42 nt, Artificial Sequence
  E3 ubiquitin-protein ligase CHIP (43-56)
gccaaccugcagagagcuuacagccucgcaaaggagcaaagg

SEQ ID NO: 55549 - RNA, 33 nt, Artificial Sequence
  A-kinase anchor protein 2 (298-308)
gcccccgcuagcucccacgagagagcaucuaug

SEQ ID NO: 55550 - RNA, 30 nt, Artificial Sequence
  Interferon regulatory factor 9 (199-208)
gcccccuuccagggcgaccaaagaagccug

SEQ ID NO: 55551 - RNA, 30 nt, Artificial Sequence
  T-cell activation Rho GTPase-activating protein (268-277)
gcccccggcagcgugcugccuagagcucuc

SEQ ID NO: 55552 - RNA, 45 nt, Artificial Sequence
  Platelet endothelial cell adhesion molecule (159-173)
gcccccauccacuucaccauugagaagcuggaacucaacgagaaa

SEQ ID NO: 55553 - RNA, 42 nt, Artificial Sequence
  Alpha-1B-glycoprotein (205-218)
gccccccuggagggcgcuagauucgcacucgugagggaagac

SEQ ID NO: 55554 - RNA, 27 nt, Artificial Sequence
  TBC1 domain family member 22A (113-121)
gccccccugcagagaagccaaucccuc

SEQ ID NO: 55555 - RNA, 27 nt, Artificial Sequence
  Cordon-bleu protein-like 1 (891-899)
gcccccaacccugcuccaaaggagcug

SEQ ID NO: 55556 - RNA, 24 nt, Artificial Sequence
  Negative elongation factor E (257-264)
gcccccagaaagggcaacacccug

SEQ ID NO: 55557 - RNA, 27 nt, Artificial Sequence
  Cyclin-dependent kinase inhibitor 1C (105-113)
gcccccagaccuguggcugucgcaguu

SEQ ID NO: 55558 - RNA, 27 nt, Artificial Sequence
  Endoplasmic reticulum resident protein 44 (391-399)
gcccccagcgaguacagauauacccug

SEQ ID NO: 55559 - RNA, 30 nt, Artificial Sequence
  Endoplasmic reticulum resident protein 44 (391-400)
gcccccagcgaguacagauauacccugcuc

SEQ ID NO: 55560 - RNA, 48 nt, Artificial Sequence
  Lipolysis-stimulated lipoprotein receptor (216-231)
gcccccagcaccuacgcucaccuguccccugcaaagacaccaccgccc

SEQ ID NO: 55561 - RNA, 51 nt, Artificial Sequence
  Lipolysis-stimulated lipoprotein receptor (216-232)
gcccccagcaccuacgcucaccuguccccugcaaagacaccaccgcccccu

SEQ ID NO: 55562 - RNA, 54 nt, Artificial Sequence
  Lipolysis-stimulated lipoprotein receptor (216-233)
gcccccagcaccuacgcucaccuguccccugcaaagacaccaccgcccccugcc

SEQ ID NO: 55563 - RNA, 39 nt, Artificial Sequence
  C-C chemokine receptor type 7 (190-202)
gccagaaacuucgagaggaauaaggcuaucaaagugauu

SEQ ID NO: 55564 - RNA, 45 nt, Artificial Sequence
  C-C chemokine receptor type 7 (190-204)
gccagaaacuucgagaggaauaaggcuaucaaagugauuauagca

SEQ ID NO: 55565 - RNA, 48 nt, Artificial Sequence
  Glucose-6-phosphate isomerase (181-196)
gccagcaagaccuucacaacucaggagacgaucaccaacgcugaaaca

SEQ ID NO: 55566 - RNA, 45 nt, Artificial Sequence
  Cystatin-C (63-77)
gccagcaacgacauguaccacuccagagcucugcagguggucagg

SEQ ID NO: 55567 - RNA, 48 nt, Artificial Sequence
  Cystatin-C (63-78)
gccagcaacgacauguaccacuccagagcucugcagguggucagggca

SEQ ID NO: 55568 - RNA, 27 nt, Artificial Sequence
  A-kinase anchor protein 2 (107-115)
gccagcagacaggcucccccucacauc

SEQ ID NO: 55569 - RNA, 30 nt, Artificial Sequence; identical to SEQ ID NO: 31342
  Exostosin-2 (691-700)

SEQ ID NO: 55570 - RNA, 30 nt, Artificial Sequence
  Fatty acyl-CoA reductase 2 (227-236)
gccaccuucgagaagauccccuuugaaaga

SEQ ID NO: 55571 - RNA, 45 nt, Artificial Sequence
  Ras-related protein Rab-11A (49-63)
gccaccagaagcauccagguggacggcaagacaauuaaagcucaa

SEQ ID NO: 55572 - RNA, 48 nt, Artificial Sequence
  Ras-related protein Rab-11A (49-64)
gccaccagaagcauccagguggacggcaagacaauuaaagcucaaaua

SEQ ID NO: 55573 - RNA, 27 nt, Artificial Sequence
  Cadherin EGF LAG seven-pass G-type receptor 1 (1076-1084)
gccaccagcgcuccccugguguccaga

SEQ ID NO: 55574 - RNA, 33 nt, Artificial Sequence
  Tumor protein p53-inducible protein 11 (90-100)
gccguguucgacggcgcucaggucaccagcaag

SEQ ID NO: 55575 - RNA, 27 nt, Artificial Sequence
  Short-chain dehydrogenase/reductase 3 (9-17)
gccgugggccugguccuccccgcuaag

SEQ ID NO: 55576 - RNA, 30 nt, Artificial Sequence
  A-kinase anchor protein 2 (230-239)
gccgugaagaaaaaccccggcaucgcugca

SEQ ID NO: 55577 - RNA, 51 nt, Artificial Sequence
  SLAM family member 6 (46-62)
gacgccgaugacaacgugagcuucagaugggaggcucugggcaauacccuc

SEQ ID NO: 55578 - RNA, 42 nt, Artificial Sequence
  Peroxisomal multifunctional enzyme type 2 (88-101)
gacgccuucggcagaaucgauguggucguuaacaaugcuggg

SEQ ID NO: 55579 - RNA, 45 nt, Artificial Sequence
  Lymphocyte antigen 9 (125-139)
gacgccggcagcuacaaggcucagaucaaccaaagaaauuucgag

SEQ ID NO: 55580 - RNA, 51 nt, Artificial Sequence
  Lymphocyte antigen 9 (125-141)
gacgccggcagcuacaaggcucagaucaaccaaagaaauuucgaggugacc

SEQ ID NO: 55581 - RNA, 24 nt, Artificial Sequence
  Cell division cycle-associated 7-like protein (200-207)
gacgcccugcucaagagaaccaug

SEQ ID NO: 55582 - RNA, 27 nt, Artificial Sequence
  Probable ribosome biogenesis protein RLP24 (91-99)
gacgccaugaagagaguggaggaaauc

SEQ ID NO: 55583 - RNA, 39 nt, Artificial Sequence
  Platelet endothelial cell adhesion molecule (416-428)
gacgcccaguucgaggugaucaagggccaaaccauugaa

SEQ ID NO: 55584 - RNA, 45 nt, Artificial Sequence
  Platelet endothelial cell adhesion molecule (416-430)
gacgcccaguucgaggugaucaagggccaaaccauugaagucaga

SEQ ID NO: 55585 - RNA, 36 nt, Artificial Sequence
  Ceruloplasmin (715-726)
gacgauaacaucaagaccuacagcgaccaccccgag

SEQ ID NO: 55586 - RNA, 39 nt, Artificial Sequence
  Ceruloplasmin (715-727)
gacgauaacaucaagaccuacagcgaccaccccgagaaa

SEQ ID NO: 55587 - RNA, 42 nt, Artificial Sequence
  SLAM family member 6 (48-61)
gacgauaacgugagcuucagaugggaggcccugggcaauacc

SEQ ID NO: 55588 - RNA, 45 nt, Artificial Sequence
  SLAM family member 6 (48-62)
gacgauaacgugagcuucagaugggaggcccugggcaauacccuc

SEQ ID NO: 55589 - RNA, 51 nt, Artificial Sequence
  Ceramide glucosyltransferase (91-107)
gacgaucccgccaucgacgugugcaagaaacugcucggcaaguacccuaac

SEQ ID NO: 55590 - RNA, 27 nt, Artificial Sequence
  Dystrophin (386-394)
gacgagcaccugcucauccagcauuac

SEQ ID NO: 55591 - RNA, 27 nt, Artificial Sequence
  E3 ubiquitin-protein ligase Mdm2 (68-76)
gacgagaagcagcaacacaucguguac

SEQ ID NO: 55592 - RNA, 27 nt, Artificial Sequence
  Dynamin-binding protein (858-866)
gacgagcugcccaaguuccaccaguac

SEQ ID NO: 55593 - RNA, 27 nt, Artificial Sequence
  Transmembrane emp24 domain-containing protein 4 (48-56)
gacgagaccauggugaucggcaacuac

SEQ ID NO: 55594 - RNA, 27 nt, Artificial Sequence
  Uncharacterized protein CXorf21 (47-55)
gacgagacccaggugagaagccuguac

SEQ ID NO: 55595 - RNA, 24 nt, Artificial Sequence
  TBC1 domain family member 22A (223-230)
gacgaggugcaccaggauaccuac

SEQ ID NO: 55596 - RNA, 27 nt, Artificial Sequence
  E3 ubiquitin-protein ligase Mdm2 (273-281)
gacgagguguaccaggucaccguuuau

SEQ ID NO: 55597 - RNA, 42 nt, Artificial Sequence
  MyoD family inhibitor domain-containing protein (67-80)
gacggcgagcugaucagaacccagccccaaaggcucccucag

SEQ ID NO: 55598 - RNA, 24 nt, Artificial Sequence
  Obscurin-like protein 1 (299-306)
gacggcggguucgugcugaagguc

SEQ ID NO: 55599 - RNA, 54 nt, Artificial Sequence
  Beta-1,4-galactosyltransferase 1 (110-127)
gacggccugaacagccucaccuaccaggugcuugauguccaaagauauccccug

SEQ ID NO: 55600 - RNA, 39 nt, Artificial Sequence
  Plasma membrane calcium-transporting ATPase 1 (257-269)
gacggcagcuacagaaucuucuccaagggggccucugag

SEQ ID NO: 55601 - RNA, 24 nt, Artificial Sequence
  T-cell activation Rho GTPase-activating protein (29-36)
gacaucaaggagcacccccugcuc

SEQ ID NO: 55602 - RNA, 27 nt, Artificial Sequence
  Probable ribosome biogenesis protein RLP24 (123-131)
gacaucaaggaggugaaacagaacauu

SEQ ID NO: 55603 - RNA, 48 nt, Artificial Sequence
  Vesicle-associated membrane protein 3 (27-42)
gacaucaugagagugaacgucgauaagguucuggagagggaccagaaa

SEQ ID NO: 55604 - RNA, 51 nt, Artificial Sequence
  Vesicle-associated membrane protein 3 (27-43)
gacaucaugagagugaacgucgauaagguucuggagagggaccagaaacuc

SEQ ID NO: 55605 - RNA, 39 nt, Artificial Sequence
  Endoplasmin (536-548)
gacaagaucuacuucauggccggcagcuccagaaaagag

SEQ ID NO: 55606 - RNA, 48 nt, Artificial Sequence
  Ceramide glucosyltransferase (43-58)
gacaagcagcccuacagcaaacugccuggcgugucccuccuuaagcca

SEQ ID NO: 55607 - RNA, 51 nt, Artificial Sequence
  Ceramide glucosyltransferase (43-59)
gacaagcagcccuacagcaaacugccuggcgugucccuccuuaagccacug

SEQ ID NO: 55608 - RNA, 27 nt, Artificial Sequence
  Poly (ADP-ribose) polymerase 3 (217-225)
gaccuggaugugaagaaaaugccccuc

SEQ ID NO: 55609 - RNA, 45 nt, Artificial Sequence
  Perilipin-3 (369-383)
gaccugagcuccucuauccucgcccagucaagagagaggguggcu

SEQ ID NO: 55610 - RNA, 27 nt, Artificial Sequence
  Cytoskeleton-associated protein 4 (188-196)
gacaugaaggccaaaguggcuagccug

SEQ ID NO: 55611 - RNA, 48 nt, Artificial Sequence
  Phosphoinositide-3-kinase-interacting protein 1 (28-43)
gacaacggccaccuguacagagaggaucagaccagccccgccccuggg

SEQ ID NO: 55612 - RNA, 54 nt, Artificial Sequence
  Phosphoinositide-3-kinase-interacting protein 1 (28-45)
gacaacggccaccuguacagagaggaucagaccagccccgccccugggcucagg

SEQ ID NO: 55613 - RNA, 42 nt, Artificial Sequence
  Protein CDV3 homolog (139-152)
gacaaccaguacgccgugcuggagaaucaaaagagcucccac

SEQ ID NO: 55614 - RNA, 39 nt, Artificial Sequence
  SLAM family member 6 (49-61)
gacaacgugagcuucagaugggaggcccugggcaauacc

SEQ ID NO: 55615 - RNA, 42 nt, Artificial Sequence
  SLAM family member 6 (49-62)
gacaacgugagcuucagaugggaggcccugggcaauacccuc

SEQ ID NO: 55616 - RNA, 45 nt, Artificial Sequence
  SLAM family member 6 (49-63)
gacaacgugagcuucagaugggaggcccugggcaauacccucucc

SEQ ID NO: 55617 - RNA, 45 nt, Artificial Sequence
  Golgi apparatus protein 1 (492-506)
gaccccggcgccgauuacagaaucgacagggcucugaacgaggca

SEQ ID NO: 55618 - RNA, 51 nt, Artificial Sequence
  Peroxiredoxin-1 (107-123)
gaccccaagagaaccaucgcccaggauuacggcgugcugaaagcugacgag

SEQ ID NO: 55619 - RNA, 54 nt, Artificial Sequence
  Peroxiredoxin-1 (107-124)
gaccccaagagaaccaucgcccaggauuacggcgugcugaaagcugacgagggg

SEQ ID NO: 55620 - RNA, 27 nt, Artificial Sequence
  Methyltransferase-like protein 7A (98-106)
gaccccaacccuaauuucgagaaguuu

SEQ ID NO: 55621 - RNA, 45 nt, Artificial Sequence
  Glucose-6-phosphate isomerase (276-290)
gaccagcacuucagaaccacaccccuggagaagaacgccccugug

SEQ ID NO: 55622 - RNA, 27 nt, Artificial Sequence
  Perilipin-2 (38-46)
gaccaguaccccuaucugaagagcgug

SEQ ID NO: 55623 - RNA, 27 nt, Artificial Sequence
  T-cell activation Rho GTPase-activating protein (165-173)
gacagcgccggcccccaggaugcuaga

SEQ ID NO: 55624 - RNA, 42 nt, Artificial Sequence
  Ceruloplasmin (187-200)
gacagcgccguguucuuugagcagggcaccacaagaaucggg

SEQ ID NO: 55625 - RNA, 39 nt, Artificial Sequence
  T-complex protein 1 subunit beta (164-176)
gacagcuaccuggaugagggcuuccuccuugacaagaaa

SEQ ID NO: 55626 - RNA, 45 nt, Artificial Sequence
  T-complex protein 1 subunit beta (164-178)
gacagcuaccuggaugagggcuuccuccuugacaagaaaaucggg

SEQ ID NO: 55627 - RNA, 48 nt, Artificial Sequence
  SLAM family member 6 (103-118)
gacaccggcagcuacagagcccagaucuccacaaagacuucugcuaaa

SEQ ID NO: 55628 - RNA, 39 nt, Artificial Sequence
  SLAM family member 6 (193-205)
gacaccaucacaauuuacagcacuauaaaccacuccaag

SEQ ID NO: 55629 - RNA, 27 nt, Artificial Sequence
  Interferon regulatory factor 9 (104-112)
gacguggccgagcccuacaaggucuau

SEQ ID NO: 55630 - RNA, 45 nt, Artificial Sequence
  HLA class II histocompatibility antigen, DO beta chain (69-83)
gacgugggcauguucgucgcccugaccaagcucgggcagcccgau

SEQ ID NO: 55631 - RNA, 60 nt, Artificial Sequence
  Endoplasmin (783-802)
gacgugggcaccgaugaggaagaggaaacagccaaggagagcacugcugaaaaagacgag

SEQ ID NO: 55632 - RNA, 30 nt, Artificial Sequence
  Dynamin-binding protein (46-55)
gacgugaccggccaguuccccagcuccuuu

SEQ ID NO: 55633 - RNA, 48 nt, Artificial Sequence
  Testican-2 (66-81)
gaggacgauuacaucaagagcugggaagacaaccagcaaggcgaugag

SEQ ID NO: 55634 - RNA, 27 nt, Artificial Sequence
  Elongator complex protein 3 (321-329)
gaggaccccgaucaggacauccugauu

SEQ ID NO: 55635 - RNA, 51 nt, Artificial Sequence
  SLAM family member 6 (102-118)
gaggacaccggcagcuacagagcccagaucuccacaaagacuucugcuaaa

SEQ ID NO: 55636 - RNA, 45 nt, Artificial Sequence
  Receptor-type tyrosine-protein phosphatase alpha (384-398)
gaggaauucaagaaacugaccagcaucaagauucagaacgacaaa

SEQ ID NO: 55637 - RNA, 27 nt, Artificial Sequence
  ATP-binding cassette sub-family A member 6 (1600-1608)
gaggaaaucgacaccacaaugagaugg

SEQ ID NO: 55638 - RNA, 51 nt, Artificial Sequence
  14-3-3 protein beta/alpha (41-57)
gaggaaagaaaccugcucagcguggccuacaagaaugucguuggcgcuagg

SEQ ID NO: 55639 - RNA, 42 nt, Artificial Sequence
  Ras GTPase-activating-like protein IQGAP1 (61-74)
gaggaagugaucacccugauuagaagcaaccagcaacucgag

SEQ ID NO: 55640 - RNA, 45 nt, Artificial Sequence
  Ras GTPase-activating-like protein IQGAP1 (61-75)
gaggaagugaucacccugauuagaagcaaccagcaacucgagaau

SEQ ID NO: 55641 - RNA, 39 nt, Artificial Sequence
  Glycosyltransferase 8 domain-containing protein 1 (272-284)
gagggccuguacagcagaacccucgccggguccaucaca

SEQ ID NO: 55642 - RNA, 48 nt, Artificial Sequence
  Glycosyltransferase 8 domain-containing protein 1 (272-287)
gagggccuguacagcagaacccucgccggguccaucacaacucccccu

SEQ ID NO: 55643 - RNA, 39 nt, Artificial Sequence
  Serine incorporator 3 (399-411)
gagggcgugcaguacagcuauucccuguuccaccucaug

SEQ ID NO: 55644 - RNA, 42 nt, Artificial Sequence
  Serine incorporator 3 (399-412)
gagggcgugcaguacagcuauucccuguuccaccucaugcuu

SEQ ID NO: 55645 - RNA, 45 nt, Artificial Sequence
  Cystatin-C (47-61)
gagggcgugagaagggcccuggacuucgcugucggggaauacaac

SEQ ID NO: 55646 - RNA, 48 nt, Artificial Sequence
  Cystatin-C (47-62)
gagggcgugagaagggcccuggacuucgcugucggggaauacaacaag

SEQ ID NO: 55647 - RNA, 27 nt, Artificial Sequence
  Lysine-specific demethylase 2B (554-562)
gagcacgccgacgaugaccccagccug

SEQ ID NO: 55648 - RNA, 27 nt, Artificial Sequence
  Dynamin-binding protein (916-924)
gagcacagcagagugcugcagcaacuc

SEQ ID NO: 55649 - RNA, 27 nt, Artificial Sequence
  Endoplasmic reticulum resident protein 44 (277-285)
gagaucuuccagaacgaaguggccaga

SEQ ID NO: 55650 - RNA, 45 nt, Artificial Sequence
  Calsyntenin-1 (203-217)
gagaucauuacccccgacgugccuuucacagucgauaaggacggc

SEQ ID NO: 55651 - RNA, 48 nt, Artificial Sequence
  Perilipin-3 (64-79)
gagaagggcgugagaacccugacagccgcugcagucagcggggcccag

SEQ ID NO: 55652 - RNA, 51 nt, Artificial Sequence
  Perilipin-3 (64-80)
gagaagggcgugagaacccugacagccgcugcagucagcggggcccagccc

SEQ ID NO: 55653 - RNA, 54 nt, Artificial Sequence
  Perilipin-3 (64-81)
gagaagggcgugagaacccugacagccgcugcagucagcggggcccagcccauc

SEQ ID NO: 55654 - RNA, 39 nt, Artificial Sequence
  Glycosyltransferase 8 domain-containing protein 1 (347-359)
gagaagugguacauccccgacccuaccggcaaauucaac

SEQ ID NO: 55655 - RNA, 48 nt, Artificial Sequence
  Testican-2 (316-331)
gagcuggaaagaauccagauucaagaggccgcuaagaaaaagcccggc

SEQ ID NO: 55656 - RNA, 42 nt, Artificial Sequence
  ATP synthase subunit alpha, mitochondrial (295-308)
gagcuguucuacaagggcaucagacccgccauuaacgugggg

SEQ ID NO: 55657 - RNA, 39 nt, Artificial Sequence
  Alpha-1B-glycoprotein (176-188)
gagcugauccucagcgacgaaacccuucccgccccugag

SEQ ID NO: 55658 - RNA, 27 nt, Artificial Sequence
  NACHT, LRR and PYD domains-containing protein 2 (1026-1034)
gagcugaacaagcuccuugaagagauc

SEQ ID NO: 55659 - RNA, 27 nt, Artificial Sequence
  Baculoviral IAP repeat-containing protein 5 (95-103)
gagcugacccucggcgaauuccuuaag

SEQ ID NO: 55660 - RNA, 45 nt, Artificial Sequence
  SLAM family member 6 (191-205)
gagaacgacaccaucacaauuuacagcacuauaaaucacuccaag

SEQ ID NO: 55661 - RNA, 60 nt, Artificial Sequence
  SLAM family member 6 (191-210)
gagaacgacaccaucacaauuuacagcacuauaaaucacuccaaggaaucuaaacccacg

SEQ ID NO: 55662 - RNA, 45 nt, Artificial Sequence
  Alpha-mannosidase 2 (64-78)
gagaacaaugaaaucauuagcaacauaagagacuccgugaucaau

SEQ ID NO: 55663 - RNA, 24 nt, Artificial Sequence
  Proline-rich protein 12 (830-837)
gagaacgugaauaagaaagacuac

SEQ ID NO: 55664 - RNA, 45 nt, Artificial Sequence
  Low affinity immunoglobulin epsilon Fc receptor (20-34)
gagcagcaaagacugaagagccaggaccucgaacuuuccuggaac

SEQ ID NO: 55665 - RNA, 27 nt, Artificial Sequence
  RNA polymerase II subunit A C-terminal domain phosphatase (86-94)
gagagagccggcguggucagggaacug

SEQ ID NO: 55666 - RNA, 39 nt, Artificial Sequence
  Testican-2 (318-330)
gagagaauccagauucaagaagccgcuaagaaaaagccc

SEQ ID NO: 55667 - RNA, 42 nt, Artificial Sequence
  Testican-2 (318-331)
gagagaauccagauucaagaagccgcuaagaaaaagcccggc

SEQ ID NO: 55668 - RNA, 45 nt, Artificial Sequence
  Testican-2 (318-332)
gagagaauccagauucaagaagccgcuaagaaaaagcccggcaua

SEQ ID NO: 55669 - RNA, 48 nt, Artificial Sequence
  14-3-3 protein beta/alpha (42-57)
gagagaaaccugcucagcguggccuacaagaaugucguuggcgcuagg

SEQ ID NO: 55670 - RNA, 45 nt, Artificial Sequence
  Platelet endothelial cell adhesion molecule (92-106)
gagagcuacuucauccccgaagugagaauuuaugacuccggcacc

SEQ ID NO: 55671 - RNA, 51 nt, Artificial Sequence
  DnaJ homolog subfamily C member 5 (180-196)
gagaccacacagcugacugccgacagccaccccuccuaccauacggauggc

SEQ ID NO: 55672 - RNA, 27 nt, Artificial Sequence
  DNA dC-dU-editing enzyme APOBEC-3D (299-307)
gagguggccgaauuccuggcuagacac

SEQ ID NO: 55673 - RNA, 27 nt, Artificial Sequence
  Zinc finger protein 638 (1173-1181)
gaggugaaggaagagaucccccugguc

SEQ ID NO: 55674 - RNA, 48 nt, Artificial Sequence
  Phosphoinositide-3-kinase-interacting protein 1 (127-142)
gaggugcaggucuucgcccccgcuaacgcacugccugccagaagcgaa

SEQ ID NO: 55675 - RNA, 45 nt, Artificial Sequence
  Endoplasmin (359-373)
gaggugaccuucaagagcauccuguuuguccccacauccgccccu

SEQ ID NO: 55676 - RNA, 36 nt, Artificial Sequence
  Fas apoptotic inhibitory molecule 3 (253-264)
gaguacgugagccuguaucaccagcccgccgcuaug

SEQ ID NO: 55677 - RNA, 42 nt, Artificial Sequence
  CD44 antigen (7-20)
uucgccggcguguuucacgucgagaagaacgggagauacagc

SEQ ID NO: 55678 - RNA, 42 nt, Artificial Sequence
  HLA class II histocompatibility antigen, DM alpha chain (67-80)
uucgacuuuagccagaacaccagagugcccaggcugccugag

SEQ ID NO: 55679 - RNA, 69 nt, Artificial Sequence
  Heterogeneous nuclear ribonucleoprotein A1-like 2 (110-132)
uucggcaacuacaauaaccagagcuccaauuuugggcccaugaagggagguaacuucggcgggagaucu

SEQ ID NO: 55680 - RNA, 69 nt, Artificial Sequence
  Heterogeneous nuclear ribonucleoprotein A1-like 2 (120-142)
uucggccccaugaaggggggaaacuuugguggcagaagcuccgggccuuacggaggcggugggcaguau

SEQ ID NO: 55681 - RNA, 27 nt, Artificial Sequence
  T-cell activation Rho GTPase-activating protein (545-553)
uuccaguacgccaaggagagcuauauc

SEQ ID NO: 55682 - RNA, 27 nt, Artificial Sequence
  Transcription regulator protein BACH2 (345-353)
uucagcaucaccaaguccguggagcug

SEQ ID NO: 55683 - RNA, 27 nt, Artificial Sequence
  Poly (ADP-ribose) polymerase 3 (264-272)
uucuacaccgugaucccccacaacuuu

SEQ ID NO: 55684 - RNA, 30 nt, Artificial Sequence
  RNA polymerase II subunit A C-terminal domain phosphatase (40-49)
ggcgccgcugugagaaucgggagcguccug

SEQ ID NO: 55685 - RNA, 42 nt, Artificial Sequence
  Protein unc-13 homolog D (1010-1023)
ggcgccgacgaucuggagggggaagcuuuccucccccuuaga

SEQ ID NO: 55686 - RNA, 42 nt, Artificial Sequence
  Glycosyltransferase 8 domain-containing protein 1 (79-92)
ggcgccaucgcugcaauuaacagcauacagcacaauaccaga

SEQ ID NO: 55687 - RNA, 36 nt, Artificial Sequence
  HLA class II histocompatibility antigen, DM alpha chain (89-100)
ggcgacgcccccgcuauccuguucgauaaggaguuu

SEQ ID NO: 55688 - RNA, 48 nt, Artificial Sequence
  Ceruloplasmin (102-117)
ggcgacaagguguacguccaccugaaaaaccucgccagcagacccuau

SEQ ID NO: 55689 - RNA, 51 nt, Artificial Sequence
  Ceruloplasmin (102-118)
ggcgacaagguguacguccaccugaaaaaccucgccagcagacccuauacc

SEQ ID NO: 55690 - RNA, 27 nt, Artificial Sequence
  Zinc finger protein 107 (751-759)
ggcgacuacgggagagccuucaaccug

SEQ ID NO: 55691 - RNA, 27 nt, Artificial Sequence
  Cell division cycle-associated 7-like protein (377-385)
ggcgaggacgugagaagcgcccugcuc

SEQ ID NO: 55692 - RNA, 27 nt, Artificial Sequence
  A-kinase anchor protein 2 (435-443)
ggcgaguucaccagcgccagagcugug

SEQ ID NO: 55693 - RNA, 27 nt, Artificial Sequence
  E3 ubiquitin-protein ligase Mdm2 (339-347)
ggcgagaucagcgaaaaggccaaacug

SEQ ID NO: 55694 - RNA, 39 nt, Artificial Sequence
  MyoD family inhibitor domain-containing protein (68-80)
ggcgagcugaucagaacccagccccaaaggcucccucag

SEQ ID NO: 55695 - RNA, 51 nt, Artificial Sequence
  Transferrin receptor protein 1 (15-31)
ggcgagccccugagcuacaccagauucucccucgccaggcagguggacggg

SEQ ID NO: 55696 - RNA, 54 nt, Artificial Sequence
  Heterogeneous nuclear ribonucleoprotein A3 (172-189)
ggcgggggauacgguagcggcgggggauccggcgguuaugggucuagaagguuc

SEQ ID NO: 55697 - RNA, 36 nt, Artificial Sequence
  Heterogeneous nuclear ribonucleoprotein A3 (159-170)
ggcgggagcuucggagguagauccucuggcucaccc

SEQ ID NO: 55698 - RNA, 27 nt, Artificial Sequence
  Probable ATP-dependent RNA helicase DDX46 (366-374)
ggcaucgccaagaccgggagcggaaaa

SEQ ID NO: 55699 - RNA, 36 nt, Artificial Sequence
  Kynureninase (432-443)
ggcaucagaguggcccccgucccucuguacaacagc

SEQ ID NO: 55700 - RNA, 42 nt, Artificial Sequence
  Kynureninase (432-445)
ggcaucagaguggcccccgucccucuguacaacagcuuccac

SEQ ID NO: 55701 - RNA, 39 nt, Artificial Sequence
  Peroxiredoxin-1 (129-141)
ggccuguucaucauugacgauaaggggauacucagacag

SEQ ID NO: 55702 - RNA, 45 nt, Artificial Sequence
  Peroxiredoxin-1 (129-143)
ggccuguucaucauugacgauaaggggauacucagacagaucacc

SEQ ID NO: 55703 - RNA, 39 nt, Artificial Sequence
  Peroxisomal multifunctional enzyme type 2 (20-32)
ggccuggggagagccuacgcucucgcauucgccgagagg

SEQ ID NO: 55704 - RNA, 42 nt, Artificial Sequence
  Peroxisomal multifunctional enzyme type 2 (20-33)
ggccuggggagagccuacgcucucgcauucgccgagagggga

SEQ ID NO: 55705 - RNA, 45 nt, Artificial Sequence
  Ragulator complex protein LAMTOR3 (18-32)
ggccugcacgccaucguggucagcgacagagaugggguucccgug

SEQ ID NO: 55706 - RNA, 51 nt, Artificial Sequence
  Ragulator complex protein LAMTOR3 (18-34)
ggccugcacgccaucguggucagcgacagagaugggguucccgugauuaag

SEQ ID NO: 55707 - RNA, 42 nt, Artificial Sequence
  Interleukin-4 receptor subunit alpha (192-205)
ggcaaccccgccuacagaagcuucuccaauucucugucacag

SEQ ID NO: 55708 - RNA, 51 nt, Artificial Sequence
  Polypeptide N-acetylgalactosaminyltransferase 1 (404-420)
ggcaaccagguguucagcuacaccgccaauaaggagaucagaacagacgau

SEQ ID NO: 55709 - RNA, 36 nt, Artificial Sequence
  Fibromodulin (4-15)
ggcaacagaaucaaugaguucagcauuuccucuuuu

SEQ ID NO: 55710 - RNA, 45 nt, Artificial Sequence
  Pericentriolar material 1 protein (1456-1470)
ggcaacaccgugauccaccuggaccaggcccucgcuagaaugagg

SEQ ID NO: 55711 - RNA, 42 nt, Artificial Sequence
  CD44 antigen (141-154)
ggccccaucaccauuacaauagugaacagagacgggacuagg

SEQ ID NO: 55712 - RNA, 27 nt, Artificial Sequence
  Probable ribosome biogenesis protein RLP24 (11-19)
ggccccaucuacccugggcacggaaug

SEQ ID NO: 55713 - RNA, 45 nt, Artificial Sequence
  Cation-independent mannose-6-phosphate receptor (972-986)
ggcccccugaaguuccuccaccaggacaucgauagcgggcaagga

SEQ ID NO: 55714 - RNA, 51 nt, Artificial Sequence
  Cation-independent mannose-6-phosphate receptor (972-988)
ggcccccugaaguuccuccaccaggacaucgauagcgggcaaggaauuaga

SEQ ID NO: 55715 - RNA, 45 nt, Artificial Sequence
  Heterogeneous nuclear ribonucleoprotein A1-like 2 (121-135)
ggccccaugaaggggggaaacuucgguggcagaagcuccgggccu

SEQ ID NO: 55716 - RNA, 39 nt, Artificial Sequence
  Protein CDV3 homolog (83-95)
ggccccccugagaucuacagcgacacccaguucccaucc

SEQ ID NO: 55717 - RNA, 45 nt, Artificial Sequence
  Protein CDV3 homolog (83-97)
ggccccccugagaucuacagcgacacccaguucccaucccugcaa

SEQ ID NO: 55718 - RNA, 48 nt, Artificial Sequence
  Interleukin-4 receptor subunit alpha (295-310)
ggccccccuggggaggccggauacaaggcuuucagcucccugcucgca

SEQ ID NO: 55719 - RNA, 54 nt, Artificial Sequence
  Interleukin-4 receptor subunit alpha (295-312)
ggccccccuggggaggccggauacaaggcuuucagcucccugcucgcaucuuca

SEQ ID NO: 55720 - RNA, 57 nt, Artificial Sequence
  Interleukin-4 receptor subunit alpha (295-313)
ggccccccuggggaggccggauacaaggcuuucagcucccugcucgcaucuucagcc

SEQ ID NO: 55721 - RNA, 69 nt, Artificial Sequence
  Interleukin-4 receptor subunit alpha (295-317)
ggccccccuggggaggccggauacaaggcuuucagcucccugcucgcaucuucagccgugaguccagaa

SEQ ID NO: 55722 - RNA, 72 nt, Artificial Sequence
  Interleukin-4 receptor subunit alpha (295-318)
ggccccccuggggaggccggauacaaggcuuucagcucccugcucgcaucuucagccgugaguccagaaaaa

SEQ ID NO: 55723 - RNA, 30 nt, Artificial Sequence
  Ubiquitin-like protein 7 (263-272)
ggccccagaccuaucacccagagcgagcug

SEQ ID NO: 55724 - RNA, 39 nt, Artificial Sequence
  Heterogeneous nuclear ribonucleoprotein A1-like 2 (134-146)
ggccccuacgggggagguggccaguauuucgccaagccu

SEQ ID NO: 55725 - RNA, 48 nt, Artificial Sequence
  60S ribosomal protein L3 (136-151)
ggccagggguaccugaucaaggacggaaaacucauuaagaacaaugcc

SEQ ID NO: 55726 - RNA, 27 nt, Artificial Sequence
  Glycosylphosphatidylinositol anchor attachment 1 protein (448-456)
ggccagcacguggccacccaacauuuc

SEQ ID NO: 55727 - RNA, 27 nt, Artificial Sequence
  AT-rich interactive domain-containing protein 5B (138-146)
ggccagaaggaggcccugcucaaauac

SEQ ID NO: 55728 - RNA, 39 nt, Artificial Sequence
  ATP synthase subunit alpha, mitochondrial (147-159)
ggccagaagagaagcaccguggcccaacuggucaaaagg

SEQ ID NO: 55729 - RNA, 30 nt, Artificial Sequence
  A-kinase anchor protein 2 (343-352)
ggccagagcacccccagacuguucuccauc

SEQ ID NO: 55730 - RNA, 27 nt, Artificial Sequence
  Transcription regulator protein BACH2 (68-76)
ggccagaccaagaacgaccuggugguc

SEQ ID NO: 55731 - RNA, 42 nt, Artificial Sequence
  B- and T-lymphocyte attenuator (193-206)
ggcagagagaucaaccugguggacgcccaccucaagagcgaa

SEQ ID NO: 55732 - RNA, 30 nt, Artificial Sequence
  Ras-specific guanine nucleotide-releasing factor 1 (386-395)
ggcagauucaagaaccugagggaggcccuc

SEQ ID NO: 55733 - RNA, 27 nt, Artificial Sequence
  Protein asunder homolog (674-682)
ggcagacugaacagcgugaauaacagg

SEQ ID NO: 55734 - RNA, 27 nt, Artificial Sequence
  Probable ribonuclease ZC3H12D (383-391)
ggcagagugcccgggccucugagccuc

SEQ ID NO: 55735 - RNA, 42 nt, Artificial Sequence
  Carbohydrate sulfotransferase 2 (176-189)
ggcagcuccuucuuuggggagcuguucaaccagaaucccgaa

SEQ ID NO: 55736 - RNA, 42 nt, Artificial Sequence
  SLAM family member 6 (105-118)
ggcagcuacagagcccagaucuccaccaagacaucugcuaaa

SEQ ID NO: 55737 - RNA, 36 nt, Artificial Sequence
  Plasma membrane calcium-transporting ATPase 1 (258-269)
ggcagcuacagaaucuucuccaagggggccucugag

SEQ ID NO: 55738 - RNA, 30 nt, Artificial Sequence
  Kelch-like ECH-associated protein 1 (419-428)
ggcgugaucgacgggcacauuuacgccguc

SEQ ID NO: 55739 - RNA, 36 nt, Artificial Sequence
  Serine incorporator 3 (400-411)
ggcgugcaguacagcuauucccuguuccaccucaug

SEQ ID NO: 55740 - RNA, 39 nt, Artificial Sequence
  Serine incorporator 3 (400-412)
ggcgugcaguacagcuauucccuguuccaccucaugcuu

SEQ ID NO: 55741 - RNA, 48 nt, Artificial Sequence
  Interleukin-4 receptor subunit alpha (301-316)
ggcuacaaggccuucagcucccugcucgcuucuucagcagugaguccc

SEQ ID NO: 55742 - RNA, 51 nt, Artificial Sequence
  Interleukin-4 receptor subunit alpha (301-317)
ggcuacaaggccuucagcucccugcucgcuucuucagcagugagucccgag

SEQ ID NO: 55743 - RNA, 27 nt, Artificial Sequence
  Dystrophin (325-333)
ggcuaccugcccgugcagaccguccuc

SEQ ID NO: 55744 - RNA, 39 nt, Artificial Sequence
  Ragulator complex protein LAMTOR3 (20-32)
cacgccaucguggucagcgacagagauggcguucccgug

SEQ ID NO: 55745 - RNA, 27 nt, Artificial Sequence
  HLA class II histocompatibility antigen, DM alpha chain (87-95)
cacgagaucgacagauacaccgccauu

SEQ ID NO: 55746 - RNA, 27 nt, Artificial Sequence
  Elongator complex protein 3 (261-269)
cacggcaaccugagagagcucgcccuu

SEQ ID NO: 55747 - RNA, 42 nt, Artificial Sequence
  Fibromodulin (137-150)
cacggcaaccagaucaccagcgacaagguggggagaaaaguc

SEQ ID NO: 55748 - RNA, 30 nt, Artificial Sequence
  Poly (ADP-ribose) polymerase 3 (457-466)
caccauaucaacaccgacaaucccagccug

SEQ ID NO: 55749 - RNA, 27 nt, Artificial Sequence
  DmX-like protein 1 (888-896)
caccugaagagcauccccgugucccuc

SEQ ID NO: 55750 - RNA, 27 nt, Artificial Sequence
  Cyclin-dependent kinase 14 (229-237)
caccccgacaacgugaagcuguuccuc

SEQ ID NO: 55751 - RNA, 42 nt, Artificial Sequence
  Ceramide glucosyltransferase (193-206)
caccccagauacuauaucagcgccaacgugaccggcuucaag

SEQ ID NO: 55752 - RNA, 42 nt, Artificial Sequence
  Beta-1,4-galactosyltransferase 1 (199-212)
caccccgugcugcagagacaacagcucgacuacggcaucuau

SEQ ID NO: 55753 - RNA, 27 nt, Artificial Sequence
  Hematopoietic SH2 domain-containing protein (64-72)
cacgugggcuacacccugagcuauaag

SEQ ID NO: 55754 - RNA, 27 nt, Artificial Sequence
  Cytoskeleton-associated protein 4 (129-137)
cacgugcuggaggaaguccagcaaguu

SEQ ID NO: 55755 - RNA, 45 nt, Artificial Sequence
  Voltage-dependent anion-selective channel protein 2 (221-235)
aucgccgcuaaguaccagcuggaccccaccgcaagcauuuccgcc

SEQ ID NO: 55756 - RNA, 48 nt, Artificial Sequence
  Voltage-dependent anion-selective channel protein 2 (221-236)
aucgccgcuaaguaccagcuggaccccaccgcaagcauuuccgccaaa

SEQ ID NO: 55757 - RNA, 42 nt, Artificial Sequence
  14-3-3 protein zeta/delta (61-74)
aucgccgagcuggacacccucagcgaagaguccuacaaggau

SEQ ID NO: 55758 - RNA, 45 nt, Artificial Sequence
  14-3-3 protein zeta/delta (61-75)
aucgccgagcuggacacccucagcgaagaguccuacaaggauucu

SEQ ID NO: 55759 - RNA, 36 nt, Artificial Sequence
  Golgi apparatus protein 1 (362-373)
aucgcccaggacuacaaggugagcuauucccuggcu

SEQ ID NO: 55760 - RNA, 39 nt, Artificial Sequence
  Golgi apparatus protein 1 (362-374)
aucgcccaggacuacaaggugagcuauucccuggcuaaa

SEQ ID NO: 55761 - RNA, 27 nt, Artificial Sequence
  Perilipin-2 (313-321)
aucgccagaaaccugacccagcaacuc

SEQ ID NO: 55762 - RNA, 45 nt, Artificial Sequence
  60S ribosomal protein L3 (216-230)
aucgacaccacaagcaaguucggccacgggagauuucagacuaug

SEQ ID NO: 55763 - RNA, 57 nt, Artificial Sequence
  60S ribosomal protein L3 (65-83)
aucgacgugauuggcgucaccaaggggaaaggauacaaggguguuacaagcagaugg

SEQ ID NO: 55764 - RNA, 30 nt, Artificial Sequence
  Plexin-B3 (1741-1750)
aucgaggaccccggcacccugcacauuugg

SEQ ID NO: 55765 - RNA, 42 nt, Artificial Sequence
  Polypeptide N-acetylgalactosaminyltransferase 1 (88-101)
aucgaggaaauugugcuggucgacgaugccagcgagagagac

SEQ ID NO: 55766 - RNA, 45 nt, Artificial Sequence
  Polypeptide N-acetylgalactosaminyltransferase 1 (88-102)
aucgaggaaauugugcuggucgacgaugccagcgagagagacuuc

SEQ ID NO: 55767 - RNA, 27 nt, Artificial Sequence
  Perilipin-2 (306-314)
aucgagagcagaacccuggccauugcu

SEQ ID NO: 55768 - RNA, 45 nt, Artificial Sequence
  Ras-related protein Rab-11A (44-58)
aucggcguggaguucgccaccagaagcauucaggucgacgggaag

SEQ ID NO: 55769 - RNA, 27 nt, Artificial Sequence
  Elongation factor Tu, mitochondrial (171-179)
aucggcguggagcacgucguuguguac

SEQ ID NO: 55770 - RNA, 42 nt, Artificial Sequence
  Calsyntenin-1 (204-217)
aucauuacccccgacgugccuuucacagucgauaaggacggc

SEQ ID NO: 55771 - RNA, 48 nt, Artificial Sequence
  Fas apoptotic inhibitory molecule 3 (68-83)
aucaaggccgaguacaaaggcagagugacccugaagcaguaucccagg

SEQ ID NO: 55772 - RNA, 24 nt, Artificial Sequence
  Dynamin-binding protein (527-534)
aucaaggugagcaaacagcugcuc

SEQ ID NO: 55773 - RNA, 27 nt, Artificial Sequence
  ATP-binding cassette sub-family A member 6 (1270-1278)
auccuggacgagaagcccgugauuaua

SEQ ID NO: 55774 - RNA, 27 nt, Artificial Sequence
  DNA dC-dU-editing enzyme APOBEC-3D (26-34)
auccuguacggcagaagcuauaccugg

SEQ ID NO: 55775 - RNA, 45 nt, Artificial Sequence
  Vesicle-associated membrane protein 3 (28-42)
aucaugagagugaacgucgacaagguucuggagagggaucagaaa

SEQ ID NO: 55776 - RNA, 39 nt, Artificial Sequence
  Receptor-type tyrosine-protein phosphatase alpha (79-91)
aucaacagaaggauggccgacgauaauaagcuguuccgg

SEQ ID NO: 55777 - RNA, 42 nt, Artificial Sequence
  Protocadherin-9 (157-170)
aucaacagcagauuccccauuccuuccgccaccgacccagau

SEQ ID NO: 55778 - RNA, 48 nt, Artificial Sequence
  Ras GTPase-activating-like protein IQGAP1 (232-247)
auccccgccgacaccuucgcugcacugaagaacccuaaugccaugcuc

SEQ ID NO: 55779 - RNA, 36 nt, Artificial Sequence
  Platelet endothelial cell adhesion molecule (96-107)
auccccgaggugagaauuuacgacagcggcaccuau

SEQ ID NO: 55780 - RNA, 27 nt, Artificial Sequence
  NACHT, LRR and PYD domains-containing protein 2 (193-201)
auccccuucagcaacccuagagugcug

SEQ ID NO: 55781 - RNA, 42 nt, Artificial Sequence
  Fibromodulin (308-321)
auccccccugugaacaccaaucuggagaaccucuaccuucag

SEQ ID NO: 55782 - RNA, 24 nt, Artificial Sequence
  Eukaryotic translation initiation factor 6 (46-53)
auccccgugguccacgccagcauu

SEQ ID NO: 55783 - RNA, 27 nt, Artificial Sequence
  Monoglyceride lipase (24-32)
auccccuaccaggaccugccucaccuc

SEQ ID NO: 55784 - RNA, 27 nt, Artificial Sequence
  Methyltransferase-like protein 7A (225-233)
auccaggccccccugagcugggagcuc

SEQ ID NO: 55785 - RNA, 27 nt, Artificial Sequence
  Cyclin-dependent kinase 14 (264-272)
aucagcgacaccggcgagcugaagcuc

SEQ ID NO: 55786 - RNA, 27 nt, Artificial Sequence
  Probable ATP-dependent RNA helicase DDX46 (331-339)
aucagcaugaagauucugaacucccuc

SEQ ID NO: 55787 - RNA, 48 nt, Artificial Sequence
  Low affinity immunoglobulin epsilon Fc receptor (10-25)
aucagccaggagcuggaagagcucagagccgaacaacagaggcuuaag

SEQ ID NO: 55788 - RNA, 42 nt, Artificial Sequence
  Golgi apparatus protein 1 (553-566)
aucagcagagacuggaagcuggaucccgugcucuacaggaaa

SEQ ID NO: 55789 - RNA, 24 nt, Artificial Sequence
  B-lymphocyte antigen CD19 (274-281)
aucaccgccagacccgugcugugg

SEQ ID NO: 55790 - RNA, 27 nt, Artificial Sequence
  Zinc finger protein 107 (139-147)
aaggccuucaacugguuuagcacccug

SEQ ID NO: 55791 - RNA, 45 nt, Artificial Sequence
  Interleukin-4 receptor subunit alpha (303-317)
aaggccuucagcucccugcucgcuucuucagcagugagucccgag

SEQ ID NO: 55792 - RNA, 42 nt, Artificial Sequence
  Platelet endothelial cell adhesion molecule (274-287)
aaggacaaagccaucguggcucacaacagacauggcaauaag

SEQ ID NO: 55793 - RNA, 45 nt, Artificial Sequence
  Platelet endothelial cell adhesion molecule (274-288)
aaggacaaagccaucguggcucacaacagacauggcaauaaggca

SEQ ID NO: 55794 - RNA, 27 nt, Artificial Sequence
  Endoplasmic reticulum resident protein 44 (336-344)
aaggacgugcugauccccggcaaacuc

SEQ ID NO: 55795 - RNA, 27 nt, Artificial Sequence
  Cytoskeleton-associated protein 4 (71-79)
aaggaggccgcugacaccgaaagacug

SEQ ID NO: 55796 - RNA, 33 nt, Artificial Sequence
  Uncharacterized protein CXorf21 (31-41)
aaggaggaagagaccaacagcguggccacacug

SEQ ID NO: 55797 - RNA, 24 nt, Artificial Sequence
  Negative elongation factor E (373-380)
aaggagaaccugguggacggcuuc

SEQ ID NO: 55798 - RNA, 27 nt, Artificial Sequence
  Cell division cycle-associated 7-like protein (280-288)
aaguucgccgaggaauuuuacagcuuc

SEQ ID NO: 55799 - RNA, 42 nt, Artificial Sequence
  IgG receptor FcRn large subunit p51 (132-145)
aaguucgcccugaacggcgaggaauuuaugaauuucgaccuc

SEQ ID NO: 55800 - RNA, 36 nt, Artificial Sequence
  Heterogeneous nuclear ribonucleoprotein A1-like 2 (124-135)
aagggcgggaacuucggagguagaagcuccggcccc

SEQ ID NO: 55801 - RNA, 39 nt, Artificial Sequence
  Heterogeneous nuclear ribonucleoprotein A3 (158-170)
aagggcgggagcuucggagguagauccucuggcucaccc

SEQ ID NO: 55802 - RNA, 36 nt, Artificial Sequence
  Low affinity immunoglobulin epsilon Fc receptor (101-112)
aagggcaccaaacagugggugcacgccagauacgcu

SEQ ID NO: 55803 - RNA, 42 nt, Artificial Sequence
  Perilipin-3 (65-78)
aagggcgugagaacccugacagccgcugcagucagcggggcc

SEQ ID NO: 55804 - RNA, 45 nt, Artificial Sequence
  Perilipin-3 (65-79)
aagggcgugagaacccugacagccgcugcagucagcggggcccag

SEQ ID NO: 55805 - RNA, 30 nt, Artificial Sequence
  B-cell linker protein (6-15)
aagaucaccgugcccgccagccagaaacug

SEQ ID NO: 55806 - RNA, 27 nt, Artificial Sequence
  Afadin- and alpha-actinin-binding protein (328-336)
aagcuggacaaccaggugagcaaaguc

SEQ ID NO: 55807 - RNA, 30 nt, Artificial Sequence
  B-lymphocyte antigen CD19 (150-159)
aagcugaugagccccaaacucuacgugugg

SEQ ID NO: 55808 - RNA, 54 nt, Artificial Sequence
  Ragulator complex protein LAMTOR3 (12-29)
aagcugcccagcguggagggccuccacgccaucgucguuuccgacagagauggg

SEQ ID NO: 55809 - RNA, 30 nt, Artificial Sequence
  RNA polymerase II subunit A C-terminal domain phosphatase (238-247)
aagcuguacgagcuccacguguucaccuuu

SEQ ID NO: 55810 - RNA, 27 nt, Artificial Sequence
  Ubiquitin-like protein 7 (100-108)
aagcccgagccuguggacaaagucgcc

SEQ ID NO: 55811 - RNA, 45 nt, Artificial Sequence
  B- and T-lymphocyte attenuator (252-266)
aagcccggcaucguguacgccagccugaaccacuccgucauuggg

SEQ ID NO: 55812 - RNA, 27 nt, Artificial Sequence
  hematopoietic SH2 domain-containing protein isoform X7 (112-120)
aagcccaucgagccuagaagggaacug

SEQ ID NO: 55813 - RNA, 27 nt, Artificial Sequence
  Dynamin-binding protein (183-191)
aagcccagacagagcuccccucaacug

SEQ ID NO: 55814 - RNA, 27 nt, Artificial Sequence
  AT-rich interactive domain-containing protein 5B (518-526)
aagcccagcgaggaaagaaaaaccauc

SEQ ID NO: 55815 - RNA, 27 nt, Artificial Sequence
  Plateletoprotein 4 (394-402)
aagcccagcgagaaaauccaggugcug

SEQ ID NO: 55816 - RNA, 27 nt, Artificial Sequence
  Zinc finger protein 638 (538-546)
aagcccaccagcgccagauccggccug

SEQ ID NO: 55817 - RNA, 27 nt, Artificial Sequence
  Dynamin-binding protein (531-539)
aagcagcugcucgccgcucuugagauc

SEQ ID NO: 55818 - RNA, 27 nt, Artificial Sequence
  AT-rich interactive domain-containing protein 5B (171-179)
aagcagacccccaaagugcuggucguu

SEQ ID NO: 55819 - RNA, 27 nt, Artificial Sequence
  Dystrophin (152-160)
aagcagguggccagcuccaccggcuuc

SEQ ID NO: 55820 - RNA, 39 nt, Artificial Sequence
  Endoplasmin (72-84)
aagagcgagaaauucgccuuucaggcugaagugaacaga

SEQ ID NO: 55821 - RNA, 30 nt, Artificial Sequence
  Probable ATP-dependent RNA helicase DDX46 (374-383)
aagaccaucgccuuccugcuccccauguuu

SEQ ID NO: 55822 - RNA, 27 nt, Artificial Sequence
  T-cell activation Rho GTPase-activating protein (56-64)
aaggugcugagcuggcccuuccucaug

SEQ ID NO: 55823 - RNA, 30 nt, Artificial Sequence
  Cyclin-dependent kinase 14 (155-164)
aaggugaacggcaaacuggucgcccucaag

SEQ ID NO: 55824 - RNA, 27 nt, Artificial Sequence
  DmX-like protein 1 (194-202)
aaggugugguacaacgucgagaauugg

SEQ ID NO: 55825 - RNA, 30 nt, Artificial Sequence
  Zinc finger protein 638 (730-739)
aaguacaucgagaccacaccccugacuauu

SEQ ID NO: 55826 - RNA, 42 nt, Artificial Sequence
  Alpha-1B-glycoprotein (204-217)
cuggccccccucgagggcgcuagauucgcacuugugagggaa

SEQ ID NO: 55827 - RNA, 45 nt, Artificial Sequence
  Alpha-1B-glycoprotein (204-218)
cuggccccccucgagggcgcuagauucgcacuugugagggaagac

SEQ ID NO: 55828 - RNA, 45 nt, Artificial Sequence
  Transmembrane protein C16orf54 (117-131)
cuggaggccagagcuaccgcacccccugccccaagcgcgccgaac

SEQ ID NO: 55829 - RNA, 27 nt, Artificial Sequence
  T-cell activation Rho GTPase-activating protein (66-74)
cuggagaacgaccagagccucuccuuc

SEQ ID NO: 55830 - RNA, 39 nt, Artificial Sequence
  Polypeptide N-acetylgalactosaminyltransferase 1 (355-367)
cuggagaacaucuaccccgacagccagauuccuagacac

SEQ ID NO: 55831 - RNA, 42 nt, Artificial Sequence
  Polypeptide N-acetylgalactosaminyltransferase 1 (355-368)
cuggagaacaucuaccccgacagccagauuccuagacacuau

SEQ ID NO: 55832 - RNA, 27 nt, Artificial Sequence
  Uncharacterized protein CXorf21 (214-222)
cuggagcagaagguggucgaacucuac

SEQ ID NO: 55833 - RNA, 30 nt, Artificial Sequence
  Cadherin EGF LAG seven-pass G-type receptor 1 (2401-2410)
cuggagguggaagagagaaccaagcccguc

SEQ ID NO: 55834 - RNA, 39 nt, Artificial Sequence
  Cation-independent mannose-6-phosphate receptor (2073-2085)
cugggcgacaucuacuucaagcucuuuagagccagcggg

SEQ ID NO: 55835 - RNA, 42 nt, Artificial Sequence
  Ragulator complex protein LAMTOR3 (19-32)
cugcacgccaucguggucagcgacagagauggcguucccgug

SEQ ID NO: 55836 - RNA, 45 nt, Artificial Sequence
  Ragulator complex protein LAMTOR3 (19-33)
cugcacgccaucguggucagcgacagagauggcguucccgugauu

SEQ ID NO: 55837 - RNA, 48 nt, Artificial Sequence
  Ragulator complex protein LAMTOR3 (19-34)
cugcacgccaucguggucagcgacagagauggcguucccgugauuaag

SEQ ID NO: 55838 - RNA, 39 nt, Artificial Sequence
  Golgi apparatus protein 1 (361-373)
cugaucgcccaggacuacaaggugagcuauucccucgcu

SEQ ID NO: 55839 - RNA, 45 nt, Artificial Sequence
  Ras GTPase-activating-like protein IQGAP1 (347-361)
cugaagcagcuccuuagcgacaaacaacagaagagacaguccggc

SEQ ID NO: 55840 - RNA, 48 nt, Artificial Sequence
  Ras GTPase-activating-like protein IQGAP1 (347-362)
cugaagcagcuccuuagcgacaaacaacagaagagacaguccggccag

SEQ ID NO: 55841 - RNA, 30 nt, Artificial Sequence
  NACHT, LRR and PYD domains-containing protein 2 (823-832)
cugcucgacgagggcgccaagcuucuguac

SEQ ID NO: 55842 - RNA, 39 nt, Artificial Sequence
  Beta-1,4-galactosyltransferase 1 (112-124)
cugaacagccucaccuaccaggugcuugacguccaaaga

SEQ ID NO: 55843 - RNA, 45 nt, Artificial Sequence
  Beta-1,4-galactosyltransferase 1 (112-126)
cugaacagccucaccuaccaggugcuugacguccaaagauauccc

SEQ ID NO: 55844 - RNA, 48 nt, Artificial Sequence
  Beta-1,4-galactosyltransferase 1 (112-127)
cugaacagccucaccuaccaggugcuugacguccaaagauauccccug

SEQ ID NO: 55845 - RNA, 45 nt, Artificial Sequence
  Fas apoptotic inhibitory molecule 3 (120-134)
cugaacgugcacagcgaguacgaacccuccugggaggaacagccu

SEQ ID NO: 55846 - RNA, 45 nt, Artificial Sequence
  Phosphoinositide-3-kinase-interacting protein 1 (137-151)
cugcccgccagaagcgaggcugcagccgugcagccugucaucggc

SEQ ID NO: 55847 - RNA, 27 nt, Artificial Sequence
  DmX-like protein 1 (1557-1565)
cugcccgccuacagagcucagcuccuu

SEQ ID NO: 55848 - RNA, 42 nt, Artificial Sequence
  Putative endoplasmin-like protein (219-232)
cugcccgaguucgacggcaagagauuucagaacguggccaaa

SEQ ID NO: 55849 - RNA, 36 nt, Artificial Sequence
  Cullin-associated NEDD8-dissociated protein 1 (297-308)
cugcccgaguucuacaagaccgugagcccugcccuc

SEQ ID NO: 55850 - RNA, 27 nt, Artificial Sequence
  TBC1 domain family member 22A (121-129)
cugccccacagcgccaccgugacacuc

SEQ ID NO: 55851 - RNA, 36 nt, Artificial Sequence
  Glycosyltransferase 8 domain-containing protein 1 (157-168)
cugcccauccucgugccuagcgccaagaaagcuauu

SEQ ID NO: 55852 - RNA, 39 nt, Artificial Sequence
  Glycosyltransferase 8 domain-containing protein 1 (157-169)
cugcccauccucgugccuagcgccaagaaagcuauuuac

SEQ ID NO: 55853 - RNA, 42 nt, Artificial Sequence
  Glycosyltransferase 8 domain-containing protein 1 (157-170)
cugcccauccucgugccuagcgccaagaaagcuauuuacaug

SEQ ID NO: 55854 - RNA, 45 nt, Artificial Sequence
  Glycosyltransferase 8 domain-containing protein 1 (157-171)
cugcccauccucgugccuagcgccaagaaagcuauuuacauggac

SEQ ID NO: 55855 - RNA, 48 nt, Artificial Sequence
  Glycosyltransferase 8 domain-containing protein 1 (157-172)
cugcccauccucgugccuagcgccaagaaagcuauuuacauggacgau

SEQ ID NO: 55856 - RNA, 27 nt, Artificial Sequence
  ATP-binding cassette sub-family A member 6 (899-907)
cugccccaggagccuagaaccagccuc

SEQ ID NO: 55857 - RNA, 39 nt, Artificial Sequence
  Beta-1,4-galactosyltransferase 1 (50-62)
cugccccagcucgugggcgucagcaccccucuucaaggg

SEQ ID NO: 55858 - RNA, 42 nt, Artificial Sequence
  Beta-1,4-galactosyltransferase 1 (50-63)
cugccccagcucgugggcgucagcaccccucuucaaggggga

SEQ ID NO: 55859 - RNA, 45 nt, Artificial Sequence
  Beta-1,4-galactosyltransferase 1 (50-64)
cugccccagcucgugggcgucagcaccccucuucaagggggaucc

SEQ ID NO: 55860 - RNA, 27 nt, Artificial Sequence
  Proline and serine-rich protein 2 (219-227)
cugcccagaccucagggcaucaccgug

SEQ ID NO: 55861 - RNA, 42 nt, Artificial Sequence
  Pro-cathepsin H (48-61)
cugcccagccaggccuucgaguacauccucuauaacaagggc

SEQ ID NO: 55862 - RNA, 45 nt, Artificial Sequence
  Pro-cathepsin H (48-62)
cugcccagccaggccuucgaguacauccucuauaacaagggcauu

SEQ ID NO: 55863 - RNA, 48 nt, Artificial Sequence
  Pro-cathepsin H (48-63)
cugcccagccaggccuucgaguacauccucuauaacaagggcauuaug

SEQ ID NO: 55864 - RNA, 51 nt, Artificial Sequence
  Pro-cathepsin H (48-64)
cugcccagccaggccuucgaguacauccucuauaacaagggcauuaugggg

SEQ ID NO: 55865 - RNA, 45 nt, Artificial Sequence
  Ragulator complex protein LAMTOR3 (13-27)
cugcccagcguggagggccuccacgccaucgucguuuccgacaga

SEQ ID NO: 55866 - RNA, 42 nt, Artificial Sequence
  Fas apoptotic inhibitory molecule 3 (32-45)
cugcccuaccucuuccagaugccugccuaugcuagcuccucu

SEQ ID NO: 55867 - RNA, 45 nt, Artificial Sequence
  Fas apoptotic inhibitory molecule 3 (32-46)
cugcccuaccucuuccagaugccugccuaugcuagcuccucuaag

SEQ ID NO: 55868 - RNA, 39 nt, Artificial Sequence
  Fibromodulin (27-39)
cugcaggugcucagacuugacggcaacgagaucaagagg

SEQ ID NO: 55869 - RNA, 42 nt, Artificial Sequence
  Fibromodulin (27-40)
cugcaggugcucagacuugacggcaacgagaucaagaggagc

SEQ ID NO: 55870 - RNA, 45 nt, Artificial Sequence
  Fibromodulin (27-41)
cugcaggugcucagacuugacggcaacgagaucaagaggagcgcc

SEQ ID NO: 55871 - RNA, 48 nt, Artificial Sequence
  Fibromodulin (178-193)
cugagagagcuccaccuugaccauaaccagaucagcagggugcccaau

SEQ ID NO: 55872 - RNA, 27 nt, Artificial Sequence
  DmX-like protein 1 (2001-2009)
cugagcgagcagaccuccgugccccuc

SEQ ID NO: 55873 - RNA, 24 nt, Artificial Sequence
  Transcription regulator protein BACH2 (709-716)
cugagccaggaggugugcagagac

SEQ ID NO: 55874 - RNA, 36 nt, Artificial Sequence
  Testican-2 (45-56)
cugagcuccaucucucaguacucaggcaagauuaaa

SEQ ID NO: 55875 - RNA, 24 nt, Artificial Sequence
  Baculoviral IAP repeat-containing protein 5 (96-103)
cugacccucggcgaguuccuuaag

SEQ ID NO: 55876 - RNA, 27 nt, Artificial Sequence
  Baculoviral IAP repeat-containing protein 5 (96-104)
cugacccucggcgaguuccuuaagcug

SEQ ID NO: 55877 - RNA, 24 nt, Artificial Sequence
  ATP-binding cassette sub-family A member 6 (1544-1551)
cugaccuacaagcuccccguggcc

SEQ ID NO: 55878 - RNA, 24 nt, Artificial Sequence
  A-kinase anchor protein 2 (561-568)
cugguggacgauccccucgaguac

SEQ ID NO: 55879 - RNA, 27 nt, Artificial Sequence
  RNA polymerase II subunit A C-terminal domain phosphatase (239-247)
cuguacgagcuccacguguucaccuuu

SEQ ID NO: 55880 - RNA, 42 nt, Artificial Sequence
  Fibromodulin (271-284)
cuguacgugagacucagccacaacucccuuaccaauaacggc

SEQ ID NO: 55881 - RNA, 45 nt, Artificial Sequence
  60S ribosomal protein L3 (237-251)
augggcccccugaagaaagacagaaucgccaaggaggaaggggcu

SEQ ID NO: 55882 - RNA, 39 nt, Artificial Sequence
  Pro-cathepsin H (222-234)
augaacggcuacuuccugaucgagagagggaagaauaug

SEQ ID NO: 55883 - RNA, 27 nt, Artificial Sequence
  Ras-specific guanine nucleotide-releasing factor 1 (773-781)
augagccccuucuccaaggccacccug

SEQ ID NO: 55884 - RNA, 30 nt, Artificial Sequence
  Perilipin-2 (62-71)
augaccagcgcccugcccaucauucagaag

SEQ ID NO: 55885 - RNA, 27 nt, Artificial Sequence
  RUN and FYVE domain-containing protein 1 (291-299)
auguacagcgacguguggaagcagcug

SEQ ID NO: 55886 - RNA, 45 nt, Artificial Sequence
  Heterogeneous nuclear ribonucleoprotein A1-like 2 (108-122)
aacgacuucggcaauuacaacaaucagagcuccaacuuugggccc

SEQ ID NO: 55887 - RNA, 36 nt, Artificial Sequence
  SLAM family member 6 (192-203)
aacgacaccaucacaauuuacagcacuauaaaucac

SEQ ID NO: 55888 - RNA, 39 nt, Artificial Sequence
  SLAM family member 6 (192-204)
aacgacaccaucacaauuuacagcacuauaaaucacucc

SEQ ID NO: 55889 - RNA, 42 nt, Artificial Sequence
  SLAM family member 6 (192-205)
aacgacaccaucacaauuuacagcacuauaaaucacuccaag

SEQ ID NO: 55890 - RNA, 48 nt, Artificial Sequence
  Glutathione peroxidase 1 (100-115)
aacgacguggccuggaauuucgagaaguuucuggucggccccgauggg

SEQ ID NO: 55891 - RNA, 30 nt, Artificial Sequence
  ATP-binding cassette sub-family A member 6 (811-820)
aacgagauggaacuggcccacagcuccuuc

SEQ ID NO: 55892 - RNA, 24 nt, Artificial Sequence
  Ribonucleoside-diphosphate reductase subunit M2 B (50-57)
aacgagaaucugguggaaagauuc

SEQ ID NO: 55893 - RNA, 36 nt, Artificial Sequence
  C-C chemokine receptor type 7 (192-203)
aacuucgagagaaauaaggccaucaaagugauuaua

SEQ ID NO: 55894 - RNA, 39 nt, Artificial Sequence
  C-C chemokine receptor type 7 (192-204)
aacuucgagagaaauaaggccaucaaagugauuauagcu

SEQ ID NO: 55895 - RNA, 36 nt, Artificial Sequence
  Fas apoptotic inhibitory molecule 3 (66-77)
aacuucaucaaggccgaguacaaaggcagagugacc

SEQ ID NO: 55896 - RNA, 42 nt, Artificial Sequence
  Platelet endothelial cell adhesion molecule (187-200)
aacuucgugauccuggaguuucccgucgaagagcaggacaga

SEQ ID NO: 55897 - RNA, 45 nt, Artificial Sequence
  Phosphoinositide-3-kinase-interacting protein 1 (29-43)
aacggccaccuguacagagaggaccagaccagccccgccccuggg

SEQ ID NO: 55898 - RNA, 48 nt, Artificial Sequence
  Phosphoinositide-3-kinase-interacting protein 1 (29-44)
aacggccaccuguacagagaggaccagaccagccccgccccugggcuc

SEQ ID NO: 55899 - RNA, 51 nt, Artificial Sequence
  Phosphoinositide-3-kinase-interacting protein 1 (29-45)
aacggccaccuguacagagaggaccagaccagccccgccccugggcucagg

SEQ ID NO: 55900 - RNA, 42 nt, Artificial Sequence
  CD44 antigen (16-29)
aacggcagauacagcaucuccaggaccgaggccgcugaccug

SEQ ID NO: 55901 - RNA, 36 nt, Artificial Sequence
  Pro-cathepsin H (223-234)
aacggcuacuuccugaucgagagagggaagaauaug

SEQ ID NO: 55902 - RNA, 30 nt, Artificial Sequence
  Thymidylate synthase (260-269)
aaccacaucgagccccugaagauucagcuc

SEQ ID NO: 55903 - RNA, 48 nt, Artificial Sequence
  B- and T-lymphocyte attenuator (251-266)
aacaagcccggcaucguguacgccagccugaaucacuccgucauuggg

SEQ ID NO: 55904 - RNA, 39 nt, Artificial Sequence
  E3 ubiquitin-protein ligase CHIP (44-56)
aaccugcagagagccuacagccucgcuaaggagcaaagg

SEQ ID NO: 55905 - RNA, 42 nt, Artificial Sequence
  Alpha-mannosidase 2 (65-78)
aacaaugagaucauuagcaacauaagagacuccgugaucaau

SEQ ID NO: 55906 - RNA, 39 nt, Artificial Sequence
  Neurofibromin (66-78)
aacaauaugagaaucuucggcgaggccgcugaaaagaac

SEQ ID NO: 55907 - RNA, 39 nt, Artificial Sequence
  Interleukin-4 receptor subunit alpha (193-205)
aaccccgccuacagaagcuucuccaauucucugucacag

SEQ ID NO: 55908 - RNA, 51 nt, Artificial Sequence
  Transferrin receptor protein 1 (215-231)
aaccccggcggguacguggccuauagcaaggcugcaaccgucacaggaaaa

SEQ ID NO: 55909 - RNA, 33 nt, Artificial Sequence
  Uncharacterized protein CXorf21 (203-213)
aaccccaucagcaaugccgugcugaacgaguac

SEQ ID NO: 55910 - RNA, 51 nt, Artificial Sequence
  Kynureninase (429-445)
aaccccaauggcaucagaguggccccugucccacuguacaacagcuuccac

SEQ ID NO: 55911 - RNA, 48 nt, Artificial Sequence
  MyoD family inhibitor domain-containing protein (64-79)
aaccccagcgacggcgagcugaucagaacccagccucaaaggcuccca

SEQ ID NO: 55912 - RNA, 51 nt, Artificial Sequence
  MyoD family inhibitor domain-containing protein (64-80)
aaccccagcgacggcgagcugaucagaacccagccucaaaggcucccacag

SEQ ID NO: 55913 - RNA, 54 nt, Artificial Sequence
  MyoD family inhibitor domain-containing protein (64-81)
aaccccagcgacggcgagcugaucagaacccagccucaaaggcucccacagcuu

SEQ ID NO: 55914 - RNA, 39 nt, Artificial Sequence
  Polypeptide N-acetylgalactosaminyltransferase 1 (405-417)
aaccagguguucagcuacaccgccaauaaggagaucaga

SEQ ID NO: 55915 - RNA, 42 nt, Artificial Sequence
  Polypeptide N-acetylgalactosaminyltransferase 1 (405-418)
aaccagguguucagcuacaccgccaauaaggagaucagaaca

SEQ ID NO: 55916 - RNA, 48 nt, Artificial Sequence
  Polypeptide N-acetylgalactosaminyltransferase 1 (405-420)
aaccagguguucagcuacaccgccaauaaggagaucagaacagacgau

SEQ ID NO: 55917 - RNA, 27 nt, Artificial Sequence
  Cyclin-dependent kinase 14 (406-414)
aacagacugagcgcccaggcugcacuc

SEQ ID NO: 55918 - RNA, 36 nt, Artificial Sequence
  Transferrin receptor protein 1 (198-209)
aacagcgugaucauugucgacaagaauggcagacug

SEQ ID NO: 55919 - RNA, 39 nt, Artificial Sequence
  Transferrin receptor protein 1 (198-210)
aacagcgugaucauugucgacaagaauggcagacugguu

SEQ ID NO: 55920 - RNA, 42 nt, Artificial Sequence
  Transferrin receptor protein 1 (198-211)
aacagcgugaucauugucgacaagaauggcagacugguuuac

SEQ ID NO: 55921 - RNA, 42 nt, Artificial Sequence
  Glucose-6-phosphate isomerase (108-121)
aacacccccauccugguggacggcaaggaugucaugccugag

SEQ ID NO: 55922 - RNA, 45 nt, Artificial Sequence
  Glucose-6-phosphate isomerase (108-122)
aacacccccauccugguggacggcaaggaugucaugccugagguu

SEQ ID NO: 55923 - RNA, 48 nt, Artificial Sequence
  Glucose-6-phosphate isomerase (108-123)
aacacccccauccugguggacggcaaggaugucaugccugagguuaau

SEQ ID NO: 55924 - RNA, 42 nt, Artificial Sequence
  Pericentriolar material 1 protein (1457-1470)
aacaccgugauccaccuggaccaggcccucgcuagaaugagg

SEQ ID NO: 55925 - RNA, 45 nt, Artificial Sequence
  Pericentriolar material 1 protein (1457-1471)
aacaccgugauccaccuggaccaggcccucgcuagaaugagggag

SEQ ID NO: 55926 - RNA, 39 nt, Artificial Sequence
  SLAM family member 6 (50-62)
aacgugagcuucagaugggaggcccugggcaauacccuc

SEQ ID NO: 55927 - RNA, 51 nt, Artificial Sequence
  Peroxiredoxin-1 (108-124)
cccaagagaaccaucgcccaggacuacggcgugcugaaagcugaugagggg

SEQ ID NO: 55928 - RNA, 39 nt, Artificial Sequence
  Calsyntenin-1 (57-69)
cccccucugaucgcccucgacaaggaugcuccacuuaga

SEQ ID NO: 55929 - RNA, 39 nt, Artificial Sequence
  Pro-cathepsin H (49-61)
cccagccaggccuucgaguacauccuguauaacaagggc

SEQ ID NO: 55930 - RNA, 42 nt, Artificial Sequence
  Pro-cathepsin H (49-62)
cccagccaggccuucgaguacauccuguauaacaagggcauu

SEQ ID NO: 55931 - RNA, 45 nt, Artificial Sequence
  Pro-cathepsin H (49-63)
cccagccaggccuucgaguacauccuguauaacaagggcauuaug

SEQ ID NO: 55932 - RNA, 45 nt, Artificial Sequence
  Low affinity immunoglobulin epsilon Fc receptor (39-53)
caggccgaccugagcuccuucaagucucaagagcucaacgaaaga

SEQ ID NO: 55933 - RNA, 33 nt, Artificial Sequence
  Ras-specific guanine nucleotide-releasing factor 1 (993-1003)
caggaggaccccggcgauaaccaaaucacccug

SEQ ID NO: 55934 - RNA, 30 nt, Artificial Sequence
  ATP synthase F(0) complex subunit C1, mitochondrial (106-115)
cagcuguucagcuacgccauccucggcuuu

SEQ ID NO: 55935 - RNA, 27 nt, Artificial Sequence
  Transmembrane emp24 domain-containing protein 4 (162-170)
cagcugcucgaccaaguggagcagauc

SEQ ID NO: 55936 - RNA, 39 nt, Artificial Sequence
  Glutathione peroxidase 1 (12-24)
cagagcguguacgccuucuccgcuagaccccuggcaggc

SEQ ID NO: 55937 - RNA, 51 nt, Artificial Sequence
  Glutathione peroxidase 1 (12-28)
cagagcguguacgccuucuccgcuagaccccuggcaggcggggagccuguc

SEQ ID NO: 55938 - RNA, 45 nt, Artificial Sequence
  Lipolysis-stimulated lipoprotein receptor (423-437)
agagacgaucuguacgaccaggaugacagcagggauuucccccgg

SEQ ID NO: 55939 - RNA, 33 nt, Artificial Sequence
  Dystrophin (314-324)
agagacuucggccccgccagccagcacuuucug

SEQ ID NO: 55940 - RNA, 27 nt, Artificial Sequence
  Transcription regulator protein BACH2 (715-723)
agagacauccagagccccgagcaaauu

SEQ ID NO: 55941 - RNA, 24 nt, Artificial Sequence
  Elongation factor Tu, mitochondrial (53-60)
agagacaagccccacgugaacguc

SEQ ID NO: 55942 - RNA, 33 nt, Artificial Sequence
  TRAF3-interacting JNK-activating modulator (92-102)
agagaccugcagaugaaccaagcccucagguuc

SEQ ID NO: 55943 - RNA, 24 nt, Artificial Sequence
  Probable ATP-dependent RNA helicase DDX46 (658-665)
agagacagcaucauuaacgauuuc

SEQ ID NO: 55944 - RNA, 27 nt, Artificial Sequence
  Eukaryotic translation initiation factor 6 (237-245)
agagacagccugaucgauucccucacc

SEQ ID NO: 55945 - RNA, 33 nt, Artificial Sequence
  Cadherin EGF LAG seven-pass G-type receptor 1 (380-390)
agagacagccccaucaacgccaaucugagguac

SEQ ID NO: 55946 - RNA, 27 nt, Artificial Sequence
  Transcription regulator protein BACH2 (258-266)
agagaggacaacagcuccaauucucug

SEQ ID NO: 55947 - RNA, 30 nt, Artificial Sequence
  ATP-binding cassette sub-family A member 6 (1183-1192)
agagaguuccccgaagccaacuuugagcug

SEQ ID NO: 55948 - RNA, 48 nt, Artificial Sequence
  Alpha-1B-glycoprotein (123-138)
agaggcgagaaggaacugcucgugcccaggagcuccaccucuccugac

SEQ ID NO: 55949 - RNA, 39 nt, Artificial Sequence
  Peroxiredoxin-1 (128-140)
agaggccuguucaucauugacgauaaggggauacucagg

SEQ ID NO: 55950 - RNA, 42 nt, Artificial Sequence
  Peroxiredoxin-1 (128-141)
agaggccuguucaucauugacgauaaggggauacucaggcag

SEQ ID NO: 55951 - RNA, 48 nt, Artificial Sequence
  Peroxiredoxin-1 (128-143)
agaggccuguucaucauugacgauaaggggauacucaggcagaucacc

SEQ ID NO: 55952 - RNA, 27 nt, Artificial Sequence
  DNA dC-dU-editing enzyme APOBEC-3D (306-314)
agacacagcaacgugaaucugaccauc

SEQ ID NO: 55953 - RNA, 30 nt, Artificial Sequence
  Zinc finger protein 107 (152-161)
agaauccacaccggcgagaagcccuacaaa

SEQ ID NO: 55954 - RNA, 30 nt, Artificial Sequence
  Fibromodulin (324-333)
agaaucaacgaguucagcauuuccucuuuu

SEQ ID NO: 55955 - RNA, 27 nt, Artificial Sequence
  Cytoskeleton-associated protein 4 (199-207)
agaaucagcgaggugcugcagaagcuc

SEQ ID NO: 55956 - RNA, 42 nt, Artificial Sequence
  Leukosialin (349-362)
agaaagagcaggcagggcucccuggccauggaggaacucaaa

SEQ ID NO: 55957 - RNA, 48 nt, Artificial Sequence
  Beta-1,4-galactosyltransferase 1 (49-64)
agacugccccagcucgugggcgucagcaccccucuucaagggggaucc

SEQ ID NO: 55958 - RNA, 36 nt, Artificial Sequence
  Proline-rich protein 12 (1113-1124)
agacccgccggcgagccuuacaacaggaagacccug

SEQ ID NO: 55959 - RNA, 24 nt, Artificial Sequence
  Cadherin EGF LAG seven-pass G-type receptor 1 (2237-2244)
agacccuucgugaucgucaccgcc

SEQ ID NO: 55960 - RNA, 27 nt, Artificial Sequence
  Cadherin EGF LAG seven-pass G-type receptor 1 (2367-2375)
agacccaucauuaacaccccuauggug

SEQ ID NO: 55961 - RNA, 27 nt, Artificial Sequence
  A-kinase anchor protein 2 (800-808)
agacccaagaaccugaugcagacccuc

SEQ ID NO: 55962 - RNA, 24 nt, Artificial Sequence
  B-lymphocyte antigen CD20 (222-229)
agacccaagagcaacaucgugcug

SEQ ID NO: 55963 - RNA, 27 nt, Artificial Sequence
  Arrestin domain-containing protein 4 (148-156)
agacccaaggugccugaccagagcguc

SEQ ID NO: 55964 - RNA, 27 nt, Artificial Sequence
  A-kinase anchor protein 2 (109-117)
agacaggcccccccucacaucgagcug

SEQ ID NO: 55965 - RNA, 42 nt, Artificial Sequence
  Golgi apparatus protein 1 (358-371)
agacagaagcugaucgcccaagacuacaaagugagcuauucc

SEQ ID NO: 55966 - RNA, 45 nt, Artificial Sequence
  Golgi apparatus protein 1 (358-372)
agacagaagcugaucgcccaagacuacaaagugagcuauucccuc

SEQ ID NO: 55967 - RNA, 48 nt, Artificial Sequence
  Golgi apparatus protein 1 (358-373)
agacagaagcugaucgcccaagacuacaaagugagcuauucccucgcu

SEQ ID NO: 55968 - RNA, 51 nt, Artificial Sequence
  Golgi apparatus protein 1 (358-374)
agacagaagcugaucgcccaagacuacaaagugagcuauucccucgcuaag

SEQ ID NO: 55969 - RNA, 27 nt, Artificial Sequence
  Dystrophin (178-186)
agacagcugggcgagguggccagcuuc

SEQ ID NO: 55970 - RNA, 24 nt, Artificial Sequence
  Cordon-bleu protein-like 1 (1082-1089)
agacagagccugcucaccgccauc

SEQ ID NO: 55971 - RNA, 27 nt, Artificial Sequence
  Dynamin-binding protein (661-669)
agaaggaaggaccuggugcucaaauac

SEQ ID NO: 55972 - RNA, 45 nt, Artificial Sequence
  Leukosialin (348-362)
agaaggaagagccggcagggcucccuggccauggaggaacucaaa

SEQ ID NO: 55973 - RNA, 36 nt, Artificial Sequence
  Ras-related protein Rab-11A (51-62)
agaagcauccagguggacggcaagaccauuaaagcc

SEQ ID NO: 55974 - RNA, 39 nt, Artificial Sequence
  Ras-related protein Rab-11A (51-63)
agaagcauccagguggacggcaagaccauuaaagcccaa

SEQ ID NO: 55975 - RNA, 42 nt, Artificial Sequence
  Ras-related protein Rab-11A (51-64)
agaagcauccagguggacggcaagaccauuaaagcccaaaua

SEQ ID NO: 55976 - RNA, 33 nt, Artificial Sequence
  TP53-target gene 5 protein (40-50)
agaaccgugcugaagaaccucagccuucugaaa

SEQ ID NO: 55977 - RNA, 42 nt, Artificial Sequence
  Golgi apparatus protein 1 (995-1008)
agcgcccuggacuacagacucgauccccagcuucaacugcac

SEQ ID NO: 55978 - RNA, 33 nt, Artificial Sequence
  AN1-type zinc finger protein 5 (63-73)
agcgccuccgugcagagagcugacaccucucug

SEQ ID NO: 55979 - RNA, 42 nt, Artificial Sequence
  IgG receptor FcRn large subunit p51 (253-266)
agcgacggcuccuuccacgccucuucaagucugaccgugaag

SEQ ID NO: 55980 - RNA, 42 nt, Artificial Sequence
  Plasma membrane calcium-transporting ATPase 1 (256-269)
agcgacggcuccuacagaaucuucucuaagggggccucagag

SEQ ID NO: 55981 - RNA, 27 nt, Artificial Sequence
  Probable ribonuclease ZC3H12D (505-513)
agcgaccuggccagacucauccuucug

SEQ ID NO: 55982 - RNA, 45 nt, Artificial Sequence
  ATP synthase subunit alpha, mitochondrial (348-362)
agcgaccuggaugccgcuacccagcaacuccuuuccagaggcgug

SEQ ID NO: 55983 - RNA, 27 nt, Artificial Sequence
  TRAF3-interacting JNK-activating modulator (138-146)
agcgaggccgaaaagcugacccucgug

SEQ ID NO: 55984 - RNA, 30 nt, Artificial Sequence
  Lysine-specific demethylase 2B (477-486)
agcgaggaauccgugaagucuaccacacug

SEQ ID NO: 55985 - RNA, 27 nt, Artificial Sequence
  Elongator complex protein 3 (338-346)
agcgaggaaaccuucagauuugagcug

SEQ ID NO: 55986 - RNA, 27 nt, Artificial Sequence
  Zinc finger protein 638 (865-873)
agcgagaucaagaccuccauugaagug

SEQ ID NO: 55987 - RNA, 27 nt, Artificial Sequence
  Ribonucleoside-diphosphate reductase subunit M2 B (275-283)
agcgaguaccagagauucgccgugaug

SEQ ID NO: 55988 - RNA, 57 nt, Artificial Sequence
  DnaJ homolog subfamily C member 5 (12-30)
agcggcgagucccuguaccacgugcucgggcuugacaagaacgccaccucugaugac

SEQ ID NO: 55989 - RNA, 42 nt, Artificial Sequence
  Heterogeneous nuclear ribonucleoprotein A1-like 2 (133-146)
agcggccccuacgggggagguggccaguauuucgccaagccu

SEQ ID NO: 55990 - RNA, 75 nt, Artificial Sequence
  Heterogeneous nuclear ribonucleoprotein A3 (147-171)
agcggccagcaacaguccaacuacgggcccaugaagggagguucuuucggcgggagaucaaguggaagcccuuau

SEQ ID NO: 55991 - RNA, 69 nt, Artificial Sequence
  Heterogeneous nuclear ribonucleoprotein A3 (167-189)
agcggcucccccuacgggggagguuauggcucugggggaggcucagguggguacggaaguagaagguuc

SEQ ID NO: 55992 - RNA, 45 nt, Artificial Sequence
  Carbohydrate sulfotransferase 2 (175-189)
agcggcuccucuuucuuuggggagcuguucaaccagaaucccgaa

SEQ ID NO: 55993 - RNA, 39 nt, Artificial Sequence
  Ceramide glucosyltransferase (192-204)
agccaccccagauacuauaucuccgccaacgugaccggc

SEQ ID NO: 55994 - RNA, 45 nt, Artificial Sequence
  Ceramide glucosyltransferase (192-206)
agccaccccagauacuauaucuccgccaacgugaccggcuucaag

SEQ ID NO: 55995 - RNA, 27 nt, Artificial Sequence
  Hematopoietic SH2 domain-containing protein (61-69)
agccacucccaugugggcuacacccug

SEQ ID NO: 55996 - RNA, 45 nt, Artificial Sequence
  Serine incorporator 3 (252-266)
agcaucauuuccauacaccccaagauccaggagcaucaaccuaga

SEQ ID NO: 55997 - RNA, 24 nt, Artificial Sequence
  Uncharacterized protein CXorf21 (192-199)
agcaucaaggagaaauccucucug

SEQ ID NO: 55998 - RNA, 27 nt, Artificial Sequence
  Protein asunder homolog (394-402)
agcauccuggaggaccccccuuccauu

SEQ ID NO: 55999 - RNA, 42 nt, Artificial Sequence
  Golgi apparatus protein 1 (1057-1070)
agcaaggccgacaucuucguggaucccguccugcacaccgcu

SEQ ID NO: 56000 - RNA, 36 nt, Artificial Sequence
  Perilipin-2 (369-380)
agccugcucaccuccucuaagggccagcuucaaaaa

SEQ ID NO: 56001 - RNA, 27 nt, Artificial Sequence
  DmX-like protein 1 (607-615)
agccugaaccaguggcucguguccuuc

SEQ ID NO: 56002 - RNA, 27 nt, Artificial Sequence
  DmX-like protein 1 (1285-1293)
agcaugaccucccuggcccagaagauc

SEQ ID NO: 56003 - RNA, 42 nt, Artificial Sequence
  Cystatin-C (64-77)
agcaacgacauguaccacuccagagcccugcagguggucagg

SEQ ID NO: 56004 - RNA, 42 nt, Artificial Sequence
  Vitamin D-binding protein (234-247)
agcaaccugaucaagcucgcccagaaagugcccaccgcugac

SEQ ID NO: 56005 - RNA, 45 nt, Artificial Sequence
  Glucose-6-phosphate isomerase (107-121)
agcaacacccccauccugguggacggcaaggaugucaugccugag

SEQ ID NO: 56006 - RNA, 51 nt, Artificial Sequence
  Glucose-6-phosphate isomerase (107-123)
agcaacacccccauccugguggacggcaaggaugucaugccugagguuaau

SEQ ID NO: 56007 - RNA, 27 nt, Artificial Sequence
  NACHT, LRR and PYD domains-containing protein 2 (739-747)
agccccgccgacgcucacagaaaccug

SEQ ID NO: 56008 - RNA, 36 nt, Artificial Sequence
  Calcium and integrin-binding protein 1 (80-91)
agccccgccaaggacucccugucuuucgaggauuuu

SEQ ID NO: 56009 - RNA, 45 nt, Artificial Sequence
  Calcium and integrin-binding protein 1 (80-94)
agccccgccaaggacucccugucuuucgaggauuuucucgaccuu

SEQ ID NO: 56010 - RNA, 24 nt, Artificial Sequence
  Tumor necrosis factor receptor superfamily member 13C (50-57)
agccccgccccuagaaccgcucug

SEQ ID NO: 56011 - RNA, 27 nt, Artificial Sequence
  Cordon-bleu protein-like 1 (911-919)
agccccgagcagacccuguccccucuc

SEQ ID NO: 56012 - RNA, 45 nt, Artificial Sequence
  Transferrin receptor protein 1 (695-709)
agccccuucagacacguguuuuggggcuccgggucucauacccug

SEQ ID NO: 56013 - RNA, 24 nt, Artificial Sequence
  Ras-specific guanine nucleotide-releasing factor 1 (774-781)
agccccuucuccaaggccacccug

SEQ ID NO: 56014 - RNA, 42 nt, Artificial Sequence
  Beta-1,4-galactosyltransferase 1 (174-187)
agcccccacaagguggccaucauuauaccuuucagaaacagg

SEQ ID NO: 56015 - RNA, 48 nt, Artificial Sequence
  Beta-1,4-galactosyltransferase 1 (174-189)
agcccccacaagguggccaucauuauaccuuucagaaacaggcaggag

SEQ ID NO: 56016 - RNA, 51 nt, Artificial Sequence
  Beta-1,4-galactosyltransferase 1 (174-190)
agcccccacaagguggccaucauuauaccuuucagaaacaggcaggagcau

SEQ ID NO: 56017 - RNA, 39 nt, Artificial Sequence
  Phosphate-regulating neutral endopeptidase (424-436)
agccccccucaguucagagugaacggcgccaucuccaau

SEQ ID NO: 56018 - RNA, 45 nt, Artificial Sequence
  Phosphate-regulating neutral endopeptidase (424-438)
agccccccucaguucagagugaacggcgccaucuccaauuuugag

SEQ ID NO: 56019 - RNA, 48 nt, Artificial Sequence
  Phosphate-regulating neutral endopeptidase (424-439)
agccccccucaguucagagugaacggcgccaucuccaauuuugaggaa

SEQ ID NO: 56020 - RNA, 51 nt, Artificial Sequence
  Phosphate-regulating neutral endopeptidase (424-440)
agccccccucaguucagagugaacggcgccaucuccaauuuugaggaauuc

SEQ ID NO: 56021 - RNA, 27 nt, Artificial Sequence
  Zinc finger protein 296 (218-226)
agccccagagccuccggcucugggcug

SEQ ID NO: 56022 - RNA, 30 nt, Artificial Sequence
  Lysine-specific demethylase 2B (832-841)
agccccagaccuccacugggcuccucucuc

SEQ ID NO: 56023 - RNA, 45 nt, Artificial Sequence
  Golgi apparatus protein 1 (1141-1155)
agccccuccaagaacuacauccugucugugauuucaggcaguaua

SEQ ID NO: 56024 - RNA, 24 nt, Artificial Sequence
  T-cell activation Rho GTPase-activating protein (149-156)
agccccuccagacagccucaagug

SEQ ID NO: 56025 - RNA, 54 nt, Artificial Sequence
  SLAM family member 6 (167-184)
agccccaccaacaauacaguguacgccuccgucacucacucuaacagagagacg

SEQ ID NO: 56026 - RNA, 30 nt, Artificial Sequence
  Cadherin EGF LAG seven-pass G-type receptor 1 (2960-2969)
agccccaccuccucuagaacaucaagucug

SEQ ID NO: 56027 - RNA, 42 nt, Artificial Sequence
  Alpha-mannosidase 2 (670-683)
agccccaccgugcaggucuucuccgccucuggcaagccuguu

SEQ ID NO: 56028 - RNA, 33 nt, Artificial Sequence
  ATP synthase F(0) complex subunit C1, mitochondrial (32-42)
agccccgugaacuccucuaagcagccuucauac

SEQ ID NO: 56029 - RNA, 24 nt, Artificial Sequence
  Lysine-specific demethylase 2B (842-849)
agccccugguggagauccucucug

SEQ ID NO: 56030 - RNA, 63 nt, Artificial Sequence
  Heterogeneous nuclear ribonucleoprotein A3 (169-189)
agccccuacggcgggggauaugguuccggcgggggaucuggcgguuacgggucaagaagguuc

SEQ ID NO: 56031 - RNA, 27 nt, Artificial Sequence
  Melanoma antigen preferentially expressed in tumors (406-414)
agccagcugaccacacucuccuucuac

SEQ ID NO: 56032 - RNA, 45 nt, Artificial Sequence
  Platelet endothelial cell adhesion molecule (409-423)
agccagcccagaaucuccuacgacgcccaauucgaggugauuaag

SEQ ID NO: 56033 - RNA, 48 nt, Artificial Sequence
  Platelet endothelial cell adhesion molecule (409-424)
agccagcccagaaucuccuacgacgcccaauucgaggugauuaagggc

SEQ ID NO: 56034 - RNA, 27 nt, Artificial Sequence
  Tumor protein p53-inducible protein 11 (14-22)
agccagaccgaccugguguccagacuc

SEQ ID NO: 56035 - RNA, 45 nt, Artificial Sequence
  Interleukin-4 receptor subunit alpha (90-104)
agcagagacgauuuccaggagggcagggaagggaucguggcccgg

SEQ ID NO: 56036 - RNA, 27 nt, Artificial Sequence
  T-cell activation Rho GTPase-activating protein (308-316)
agcagacaccaguccuucaccacaaag

SEQ ID NO: 56037 - RNA, 27 nt, Artificial Sequence
  T-cell activation Rho GTPase-activating protein (5-13)
agcucccacaacgccucuaagacccug

SEQ ID NO: 56038 - RNA, 45 nt, Artificial Sequence
  Ragulator complex protein LAMTOR1 (55-69)
agcuccauccuggccaagaccgcuucuaacauuauagacguguca

SEQ ID NO: 56039 - RNA, 39 nt, Artificial Sequence
  Serine incorporator 3 (351-363)
agcuccaucagaaccucuacaaacucacagguggacaag

SEQ ID NO: 56040 - RNA, 48 nt, Artificial Sequence
  Alpha-mannosidase 2 (669-684)
agcucccccaccgugcaggucuucucugccucaggcaagccuguugag

SEQ ID NO: 56041 - RNA, 27 nt, Artificial Sequence
  DmX-like protein 1 (1271-1279)
agcuccucuggccugcaccccccuaag

SEQ ID NO: 56042 - RNA, 39 nt, Artificial Sequence
  Interleukin-4 receptor subunit alpha (490-502)
agcuccucuucauuccaccccgccccuggcaacgcucag

SEQ ID NO: 56043 - RNA, 27 nt, Artificial Sequence
  Interleukin-1 beta (84-92)
agcguggaccccaagaacuacccuaaa

SEQ ID NO: 56044 - RNA, 39 nt, Artificial Sequence
  15 kDa selenoprotein (150-162)
agcguggaggaauuccuguccgagaagcucgaaagaauc

SEQ ID NO: 56045 - RNA, 36 nt, Artificial Sequence
  Transferrin receptor protein 1 (199-210)
agcgugaucauugucgacaagaacggcagacugguu

SEQ ID NO: 56046 - RNA, 27 nt, Artificial Sequence
  AT-rich interactive domain-containing protein 5B (278-286)
agcgugauccagcacguccaauccuuc

SEQ ID NO: 56047 - RNA, 30 nt, Artificial Sequence
  Probable ATP-dependent RNA helicase DDX46 (198-207)
agcgugaagggcgggggagguaacgagaaa

SEQ ID NO: 56048 - RNA, 42 nt, Artificial Sequence
  Plasma membrane calcium-transporting ATPase 1 (110-123)
agcgugaagaaaaugaugaaggacaacaaucuggucagacac

SEQ ID NO: 56049 - RNA, 27 nt, Artificial Sequence
  Zinc finger protein 638 (619-627)
agcgugaagcccaccuccgccacaaaa

SEQ ID NO: 56050 - RNA, 33 nt, Artificial Sequence
  Interleukin-17 receptor A (789-799)
agcgugcaguccgaccaaggcuacaucucuaga

SEQ ID NO: 56051 - RNA, 45 nt, Artificial Sequence
  Low affinity immunoglobulin epsilon Fc receptor (32-46)
agcuggaaccugaauggccuccaggccgaccuuuccucuuucaag

SEQ ID NO: 56052 - RNA, 45 nt, Artificial Sequence
  Receptor-type tyrosine-protein phosphatase alpha (182-196)
accgccacaaucgugauggucacuaaccugaaggagagaaaagaa

SEQ ID NO: 56053 - RNA, 30 nt, Artificial Sequence
  Dystrophin (30-39)
accgaggccgaaacaacugcuaacgugcug

SEQ ID NO: 56054 - RNA, 24 nt, Artificial Sequence
  Transcription regulator protein BACH2 (559-566)
accgagcaccaggaacccggccug

SEQ ID NO: 56055 - RNA, 27 nt, Artificial Sequence
  Cordon-bleu protein-like 1 (804-812)
accgagcaccaggugcccagcuccguc

SEQ ID NO: 56056 - RNA, 33 nt, Artificial Sequence
  Uncharacterized protein CXorf21 (281-291)
accgagaucacagaaauuagcacucccucccug

SEQ ID NO: 56057 - RNA, 27 nt, Artificial Sequence
  Ribonucleoside-diphosphate reductase subunit M2 B (128-136)
accuucggcgagagaguggucgccuuu

SEQ ID NO: 56058 - RNA, 45 nt, Artificial Sequence
  Cation-independent mannose-6-phosphate receptor (1446-1460)
accggccaccuguucgaccucagcucccuuucugggagagccgga

SEQ ID NO: 56059 - RNA, 42 nt, Artificial Sequence
  Low affinity immunoglobulin epsilon Fc receptor (139-152)
accggcagcuggaucgggcugagaaaccucgaccuuaaggga

SEQ ID NO: 56060 - RNA, 45 nt, Artificial Sequence
  SLAM family member 6 (104-118)
accggcagcuacagagcccagaucuccacaaagacuucugcuaaa

SEQ ID NO: 56061 - RNA, 27 nt, Artificial Sequence
  ATP-binding cassette sub-family A member 6 (728-736)
acccaccauauccccgacgccaagcug

SEQ ID NO: 56062 - RNA, 27 nt, Artificial Sequence
  Transcription regulator protein BACH2 (70-78)
accaagaacgaccugguggucagccuc

SEQ ID NO: 56063 - RNA, 24 nt, Artificial Sequence
  Baculoviral IAP repeat-containing protein 5 (97-104)
acccugggcgaguuccucaagcuu

SEQ ID NO: 56064 - RNA, 39 nt, Artificial Sequence
  Fas apoptotic inhibitory molecule 3 (65-77)
accaacuucaucaaggccgaguacaaaggcagagugaca

SEQ ID NO: 56065 - RNA, 42 nt, Artificial Sequence
  Calsyntenin-1 (140-153)
accaacgugaagaaaagccacaaggccacaguccauauccag

SEQ ID NO: 56066 - RNA, 27 nt, Artificial Sequence
  Interferon regulatory factor 9 (382-390)
acccccgagcagcaagccgcuauccug

SEQ ID NO: 56067 - RNA, 27 nt, Artificial Sequence
  Cyclin-dependent kinase 14 (174-182)
acccccuucacagccaucagagaggcu

SEQ ID NO: 56068 - RNA, 27 nt, Artificial Sequence
  AT-rich interactive domain-containing protein 5B (36-44)
acccccaucgagagaauuccuuaccug

SEQ ID NO: 56069 - RNA, 36 nt, Artificial Sequence
  Glucose-6-phosphate isomerase (109-120)
acccccauccugguggacggcaaggaugucaugccu

SEQ ID NO: 56070 - RNA, 39 nt, Artificial Sequence
  Glucose-6-phosphate isomerase (109-121)
acccccauccugguggacggcaaggaugucaugccugag

SEQ ID NO: 56071 - RNA, 42 nt, Artificial Sequence
  Glucose-6-phosphate isomerase (109-122)
acccccauccugguggacggcaaggaugucaugccugagguu

SEQ ID NO: 56072 - RNA, 45 nt, Artificial Sequence
  Glucose-6-phosphate isomerase (109-123)
acccccauccugguggacggcaaggaugucaugccugagguuaac

SEQ ID NO: 56073 - RNA, 27 nt, Artificial Sequence
  Probable ribonuclease ZC3H12D (145-153)
acccccaucagagagcagcacgugcug

SEQ ID NO: 56074 - RNA, 48 nt, Artificial Sequence
  Protein CDV3 homolog (80-95)
accccccagggcccuccagagaucuacagcgacacacaauucccgucc

SEQ ID NO: 56075 - RNA, 54 nt, Artificial Sequence
  Protein CDV3 homolog (80-97)
accccccagggcccuccagagaucuacagcgacacacaauucccgucccugcag

SEQ ID NO: 56076 - RNA, 60 nt, Artificial Sequence
  Protein CDV3 homolog (80-99)
accccccagggcccuccagagaucuacagcgacacacaauucccgucccugcagucuacu

SEQ ID NO: 56077 - RNA, 54 nt, Artificial Sequence
  SLAM family member 6 (188-205)
acccccagagagaacgacacaaucacuauuuacagcacgauaaaucacuccaag

SEQ ID NO: 56078 - RNA, 69 nt, Artificial Sequence
  SLAM family member 6 (188-210)
acccccagagagaacgacacaaucacuauuuacagcacgauaaaucacuccaaggaaucuaaaccuacc

SEQ ID NO: 56079 - RNA, 27 nt, Artificial Sequence
  Protein asunder homolog (320-328)
acccccagaacaaacaauaucgagcug

SEQ ID NO: 56080 - RNA, 45 nt, Artificial Sequence
  E3 ubiquitin-protein ligase CHIP (246-260)
acccccagcggcaucacauacgacagaaaggauauugaggaacac

SEQ ID NO: 56081 - RNA, 36 nt, Artificial Sequence
  Putative heat shock 70 kDa protein 7 (40-51)
acccccagcuacguggccuucacagacacugagaga

SEQ ID NO: 56082 - RNA, 39 nt, Artificial Sequence
  Putative heat shock 70 kDa protein 7 (40-52)
acccccagcuacguggccuucacagacacugagagacug

SEQ ID NO: 56083 - RNA, 27 nt, Artificial Sequence
  Zinc finger protein 107 (512-520)
accagacacaagaucgugcauacaaaa

SEQ ID NO: 56084 - RNA, 42 nt, Artificial Sequence
  Cytochrome b ascorbate-dependent protein 3 (187-200)
accagacccuaccacagccugccuuccgaggccguguucgcu

SEQ ID NO: 56085 - RNA, 45 nt, Artificial Sequence
  Cytochrome b ascorbate-dependent protein 3 (187-201)
accagacccuaccacagccugccuuccgaggccguguucgcuaac

SEQ ID NO: 56086 - RNA, 42 nt, Artificial Sequence
  Ras-related protein Rab-11A (50-63)
accagaagcauccagguggacggcaagacaauuaaagcccaa

SEQ ID NO: 56087 - RNA, 42 nt, Artificial Sequence
  Ceramide glucosyltransferase (191-204)
accagccaccccagauacuauaucuccgccaacgugacaggc

SEQ ID NO: 56088 - RNA, 48 nt, Artificial Sequence
  Ceramide glucosyltransferase (191-206)
accagccaccccagauacuauaucuccgccaacgugacaggcuucaag

SEQ ID NO: 56089 - RNA, 48 nt, Artificial Sequence
  B- and T-lymphocyte attenuator (128-143)
accacacuguacgugacugacgucaagagcgccuccgagagacccucu

SEQ ID NO: 56090 - RNA, 42 nt, Artificial Sequence
  Fas apoptotic inhibitory molecule 3 (64-77)
accacaaacuucaucaaggccgaguacaaaggcagagugacu

SEQ ID NO: 56091 - RNA, 42 nt, Artificial Sequence
  DnaJ homolog subfamily C member 5 (181-194)
accacacagcugacugccgacagccaccccuccuaccauacg

SEQ ID NO: 56092 - RNA, 45 nt, Artificial Sequence
  DnaJ homolog subfamily C member 5 (181-195)
accacacagcugacugccgacagccaccccuccuaccauacggau

SEQ ID NO: 56093 - RNA, 48 nt, Artificial Sequence
  DnaJ homolog subfamily C member 5 (181-196)
accacacagcugacugccgacagccaccccuccuaccauacggauggc

SEQ ID NO: 56094 - RNA, 27 nt, Artificial Sequence
  Cordon-bleu protein-like 1 (732-740)
accacauacaagaucgugcccccuaaa

SEQ ID NO: 56095 - RNA, 33 nt, Artificial Sequence
  Eukaryotic translation initiation factor 6 (141-151)
accguggccgaccagguccugguuggcagcuac

SEQ ID NO: 56096 - RNA, 27 nt, Artificial Sequence
  ATP-binding cassette sub-family A member 6 (572-580)
accgugaaggagaaccugagccucuuc

SEQ ID NO: 56097 - RNA, 36 nt, Artificial Sequence
  C-C chemokine receptor type 7 (93-104)
guggccaucguccaggcuguuagcgcacacagacau

SEQ ID NO: 56098 - RNA, 39 nt, Artificial Sequence
  C-C chemokine receptor type 7 (93-105)
guggccaucguccaggcuguuagcgcacacagacauagg

SEQ ID NO: 56099 - RNA, 42 nt, Artificial Sequence
  C-C chemokine receptor type 7 (93-106)
guggccaucguccaggcuguuagcgcacacagacauagggcc

SEQ ID NO: 56100 - RNA, 45 nt, Artificial Sequence
  C-C chemokine receptor type 7 (93-107)
guggccaucguccaggcuguuagcgcacacagacauagggcccgg

SEQ ID NO: 56101 - RNA, 36 nt, Artificial Sequence
  Interleukin-4 receptor subunit alpha (102-113)
guggccagacugaccgagagccucuuccuugaccug

SEQ ID NO: 56102 - RNA, 42 nt, Artificial Sequence
  Interleukin-4 receptor subunit alpha (102-115)
guggccagacugaccgagagccucuuccuugaccuguugggc

SEQ ID NO: 56103 - RNA, 36 nt, Artificial Sequence
  Cytochrome b ascorbate-dependent protein 3 (99-110)
guggccgucuucaccuuucacaaccauggcagaaca

SEQ ID NO: 56104 - RNA, 39 nt, Artificial Sequence
  Cytochrome b ascorbate-dependent protein 3 (99-111)
guggccgucuucaccuuucacaaccauggcagaacagcu

SEQ ID NO: 56105 - RNA, 45 nt, Artificial Sequence
  Cytochrome b ascorbate-dependent protein 3 (99-113)
guggccgucuucaccuuucacaaccauggcagaacagcuaaucug

SEQ ID NO: 56106 - RNA, 39 nt, Artificial Sequence
  Vesicle-associated membrane protein 1 (52-64)
guggacaagguccuggagagagaucagaaacucagcgaa

SEQ ID NO: 56107 - RNA, 45 nt, Artificial Sequence
  Vesicle-associated membrane protein 3 (33-47)
guggacaagguccuggagagagaucagaaacucagcgaacuugac

SEQ ID NO: 56108 - RNA, 48 nt, Artificial Sequence
  Vesicle-associated membrane protein 3 (33-48)
guggacaagguccuggagagagaucagaaacucagcgaacuugacgau

SEQ ID NO: 56109 - RNA, 51 nt, Artificial Sequence
  Vesicle-associated membrane protein 1 (52-68)
guggacaagguccuggagagagaucagaaacucagcgaacuugacgauagg

SEQ ID NO: 56110 - RNA, 45 nt, Artificial Sequence
  T-complex protein 1 subunit beta (408-422)
guggacaacaucauuaaggccgcucccagaaaaagggucccugau

SEQ ID NO: 56111 - RNA, 36 nt, Artificial Sequence
  15 kDa selenoprotein (151-162)
guggaggaauuccugagcgagaagcucgaaagaauc

SEQ ID NO: 56112 - RNA, 45 nt, Artificial Sequence
  Glycosyltransferase 8 domain-containing protein 1 (270-284)
guggaggaaggccuguacagcagaacccucgccggguccaucaca

SEQ ID NO: 56113 - RNA, 30 nt, Artificial Sequence
  B-lymphocyte antigen CD19 (115-124)
guggagggcagcggggaacuguucagaugg

SEQ ID NO: 56114 - RNA, 27 nt, Artificial Sequence
  Interferon regulatory factor 9 (320-328)
guggagcuguucagaaccgccuacuuu

SEQ ID NO: 56115 - RNA, 39 nt, Artificial Sequence
  Transferrin receptor protein 1 (681-693)
guggaguaccacuuccugagccccuaugucuccccuaag

SEQ ID NO: 56116 - RNA, 42 nt, Artificial Sequence
  Transferrin receptor protein 1 (681-694)
guggaguaccacuuccugagccccuaugucuccccuaaggaa

SEQ ID NO: 56117 - RNA, 45 nt, Artificial Sequence
  Phosphoinositide-3-kinase-interacting protein 1 (130-144)
guguucgcccccgcuaacgcacugccugccagaagcgaggcggcu

SEQ ID NO: 56118 - RNA, 27 nt, Artificial Sequence
  HLA class II histocompatibility antigen, DM alpha chain (12-20)
guguucacccugaagccccucgaguuu

SEQ ID NO: 56119 - RNA, 39 nt, Artificial Sequence
  Cystatin-C (57-69)
gugggcgaguacaacaaggccagcaaugacauguaucac

SEQ ID NO: 56120 - RNA, 45 nt, Artificial Sequence
  Phosphate-regulating neutral endopeptidase (131-145)
gugggcaagauguucgucgacguuuacuuucaggaggauaaaaag

SEQ ID NO: 56121 - RNA, 48 nt, Artificial Sequence
  Phosphate-regulating neutral endopeptidase (131-146)
gugggcaagauguucgucgacguuuacuuucaggaggauaaaaaggaa

SEQ ID NO: 56122 - RNA, 42 nt, Artificial Sequence; identical to SEQ ID NO: 31895
  HLA class II histocompatibility antigen, DO beta chain (70-83)

SEQ ID NO: 56123 - RNA, 51 nt, Artificial Sequence
  Perilipin-3 (406-422)
gugggccccuucgccccugggaucaccgagaaggcuccagaagagaaaaag

SEQ ID NO: 56124 - RNA, 42 nt, Artificial Sequence
  Cullin-associated NEDD8-dissociated protein 1 (747-760)
gugggccaguucauccaagacgucaagaacagcagauccacc

SEQ ID NO: 56125 - RNA, 45 nt, Artificial Sequence
  Cullin-associated NEDD8-dissociated protein 1 (747-761)
gugggccaguucauccaagacgucaagaacagcagauccaccgau

SEQ ID NO: 56126 - RNA, 36 nt, Artificial Sequence
  Ceruloplasmin (107-118)
gugcaccugaagaaccucgccagcagacccuacacc

SEQ ID NO: 56127 - RNA, 45 nt, Artificial Sequence
  Polypeptide N-acetylgalactosaminyltransferase 1 (76-90)
gugcacagcgucaucaacagaucccccaggcauaugauugaggaa

SEQ ID NO: 56128 - RNA, 39 nt, Artificial Sequence
  Interleukin-4 receptor subunit alpha (189-201)
gugaucgccggcaaccccgcuuacagaagcuucuccaau

SEQ ID NO: 56129 - RNA, 30 nt, Artificial Sequence; identical to SEQ ID NO: 31902
  Methyltransferase-like protein 7A (45-54)

SEQ ID NO: 56130 - RNA, 39 nt, Artificial Sequence
  Plasma membrane calcium-transporting ATPase 1 (111-123)
gugaagaaaaugaugaaggacaacaaucuggucagacac

SEQ ID NO: 56131 - RNA, 42 nt, Artificial Sequence
  Vesicle-associated membrane protein 1 (55-68)
gugcuggagagagaccagaagcucagcgaacuugaugacagg

SEQ ID NO: 56132 - RNA, 24 nt, Artificial Sequence
  ATP-binding cassette sub-family A member 6 (320-327)
gugcugcucaagaaagccguccuu

SEQ ID NO: 56133 - RNA, 27 nt, Artificial Sequence
  Methyltransferase-like protein 7A (163-171)
gugcugagacccggcggggccuucuac

SEQ ID NO: 56134 - RNA, 36 nt, Artificial Sequence
  Serine incorporator 3 (91-102)
gugcuggucggcuacaaggccguuuauagaaucagc

SEQ ID NO: 56135 - RNA, 27 nt, Artificial Sequence
  Ras GTPase-activating protein nGAP (848-856)
gugaugcuggacguccccaucagacuc

SEQ ID NO: 56136 - RNA, 30 nt, Artificial Sequence
  B-cell linker protein (9-18)
gugcccgccagccagaagcugagacaacuc

SEQ ID NO: 56137 - RNA, 27 nt, Artificial Sequence
  Endoplasmic reticulum resident protein 44 (242-250)
gugccccuggucagagagaucaccuuc

SEQ ID NO: 56138 - RNA, 27 nt, Artificial Sequence
  BRCA2 and CDKN1A-interacting protein (285-293)
gugcccaugaccccucugagaacaguc

SEQ ID NO: 56139 - RNA, 57 nt, Artificial Sequence
  Interleukin-4 receptor subunit alpha (241-259)
gugccccagccugagccagaaaccugggagcaaauccugagaaggaacguccuccag

SEQ ID NO: 56140 - RNA, 48 nt, Artificial Sequence
  Cation-independent mannose-6-phosphate receptor (1001-1016)
gugcccagcccugucgacugccagguuaccgaucuggccggcaacgag

SEQ ID NO: 56141 - RNA, 42 nt, Artificial Sequence
  Fibromodulin (103-116)
gugcccagcagaaugaaguacgucuauuuccagaacaaucaa

SEQ ID NO: 56142 - RNA, 48 nt, Artificial Sequence
  Fibromodulin (103-118)
gugcccagcagaaugaaguacgucuauuuccagaacaaucaaaucacc

SEQ ID NO: 56143 - RNA, 51 nt, Artificial Sequence
  Fibromodulin (103-119)
gugcccagcagaaugaaguacgucuauuuccagaacaaucaaaucaccucc

SEQ ID NO: 56144 - RNA, 39 nt, Artificial Sequence
  Ragulator complex protein LAMTOR3 (30-42)
gugcccgucaucaagguugccaacgacaaugcuccugag

SEQ ID NO: 56145 - RNA, 27 nt, Artificial Sequence
  Beta-1,4-galactosyltransferase 1 (117-125)
gugcccgucccucacaccacagcccug

SEQ ID NO: 56146 - RNA, 27 nt, Artificial Sequence
  Plateletoprotein 4 (96-104)
gugcccuacccugucaccacaacuguu

SEQ ID NO: 56147 - RNA, 42 nt, Artificial Sequence
  Protocadherin-9 (176-189)
gugcagcacuacgagcugcucaacggccaaagcgucuucggg

SEQ ID NO: 56148 - RNA, 45 nt, Artificial Sequence
  Phosphoinositide-3-kinase-interacting protein 1 (128-142)
gugcaggucuucgcccccgcuaacgcacugccugccagaagcgag

SEQ ID NO: 56149 - RNA, 39 nt, Artificial Sequence
  Cystatin-C (76-88)
gugagagccaggaagcagaucgucgcuggcguuaacuac

SEQ ID NO: 56150 - RNA, 27 nt, Artificial Sequence
  Perilipin-2 (218-226)
gugagacugggcagccucuccaccaag

SEQ ID NO: 56151 - RNA, 54 nt, Artificial Sequence
  Cystatin-C (49-66)
gugagaagggcccuggacuucgcugucggcgaguacaacaaggcaagcaaugau

SEQ ID NO: 56152 - RNA, 36 nt, Artificial Sequence
  SLAM family member 6 (51-62)
gugagcuucagaugggaggcccugggcaacacccuc

SEQ ID NO: 56153 - RNA, 42 nt, Artificial Sequence
  Rab GTPase-activating protein 1 (17-30)
gugagcacccugaacuccgaggacuucguccucguuucuaga

SEQ ID NO: 56154 - RNA, 45 nt, Artificial Sequence
  Rab GTPase-activating protein 1 (17-31)
gugagcacccugaacuccgaggacuucguccucguuucuagacag

SEQ ID NO: 56155 - RNA, 48 nt, Artificial Sequence
  Rab GTPase-activating protein 1 (17-32)
gugagcacccugaacuccgaggacuucguccucguuucuagacagggc

SEQ ID NO: 56156 - RNA, 39 nt, Artificial Sequence
  HLA class II histocompatibility antigen, DM alpha chain (200-212)
gugacccacgagaucgacagauacacagccauugcuuau

SEQ ID NO: 56157 - RNA, 51 nt, Artificial Sequence
  Fas apoptotic inhibitory molecule 3 (118-134)
gugacccugaacguccacagcgaguacgaacccuccugggaggaacagccu

SEQ ID NO: 56158 - RNA, 27 nt, Artificial Sequence
  Zinc finger protein 296 (209-217)
guggucggccccgccgcugaggcaaag

SEQ ID NO: 56159 - RNA, 42 nt, Artificial Sequence
  Cullin-associated NEDD8-dissociated protein 1 (746-759)
guggucggccaguucauccaagacguuaagaacagcagaucc

SEQ ID NO: 56160 - RNA, 45 nt, Artificial Sequence
  Cullin-associated NEDD8-dissociated protein 1 (746-760)
guggucggccaguucauccaagacguuaagaacagcagauccacc

SEQ ID NO: 56161 - RNA, 48 nt, Artificial Sequence
  Cullin-associated NEDD8-dissociated protein 1 (746-761)
guggucggccaguucauccaagacguuaagaacagcagauccaccgau

SEQ ID NO: 56162 - RNA, 51 nt, Artificial Sequence
  Cullin-associated NEDD8-dissociated protein 1 (746-762)
guggucggccaguucauccaagacguuaagaacagcagauccaccgauucu

SEQ ID NO: 56163 - RNA, 39 nt, Artificial Sequence
  Cystatin-C (75-87)
guggucagagccaggaagcagaucguugcuggcgugaac

SEQ ID NO: 56164 - RNA, 42 nt, Artificial Sequence
  Cystatin-C (75-88)
guggucagagccaggaagcagaucguugcuggcgugaacuac

SEQ ID NO: 56165 - RNA, 30 nt, Artificial Sequence; identical to SEQ ID NO: 31938
  Negative elongation factor E (371-380)

SEQ ID NO: 56166 - RNA, 30 nt, Artificial Sequence
  Lysine-specific demethylase 2B (316-325)
guguacacccccgucgacagccugguuuuc

SEQ ID NO: 56167 - RNA, 39 nt, Artificial Sequence
  Ceruloplasmin (105-117)
guguacguccaccugaagaaccucgccagcagacccuau

SEQ ID NO: 56168 - RNA, 42 nt, Artificial Sequence
  Ceruloplasmin (105-118)
guguacguccaccugaagaaccucgccagcagacccuauacc

SEQ ID NO: 56169 - RNA, 48 nt, Artificial Sequence
  Ceruloplasmin (105-120)
guguacguccaccugaagaaccucgccagcagacccuauaccuuccau

SEQ ID NO: 56170 - RNA, 42 nt, Artificial Sequence
  Glycosyltransferase 8 domain-containing protein 1 (346-359)
ugggagaagugguacauccccgacccuaccggcaaauucaac

SEQ ID NO: 56171 - RNA, 36 nt, Artificial Sequence
  Fibromodulin (133-144)
uggaucgcccugcacggcaaccagauuaccagcgac

SEQ ID NO: 56172 - RNA, 39 nt, Artificial Sequence
  Fibromodulin (133-145)
uggaucgcccugcacggcaaccagauuaccagcgacaag

SEQ ID NO: 56173 - RNA, 36 nt, Artificial Sequence
  Glutathione peroxidase 1 (104-115)
uggaacuucgagaaguuucuggugggccccgacggg

SEQ ID NO: 56174 - RNA, 42 nt, Artificial Sequence
  Platelet endothelial cell adhesion molecule (415-428)
uacgacgcccaguucgaggugaucaagggccaaaccauugaa

SEQ ID NO: 56175 - RNA, 36 nt, Artificial Sequence
  Vitamin D-binding protein (84-95)
uacgacaccagaacaagcgcccuguccgcuaagucu

SEQ ID NO: 56176 - RNA, 57 nt, Artificial Sequence
  Heterogeneous nuclear ribonucleoprotein A3 (171-189)
uacggcgggggauaugguagcggcgggggauccggcgguuacgggucuagaagguuc

SEQ ID NO: 56177 - RNA, 42 nt, Artificial Sequence
  Interleukin-4 receptor subunit alpha (302-315)
uacaaggccuucagcucccugcucgcuucuucagcagugagu

SEQ ID NO: 56178 - RNA, 45 nt, Artificial Sequence
  Interleukin-4 receptor subunit alpha (302-316)
uacaaggccuucagcucccugcucgcuucuucagcagugaguccc

SEQ ID NO: 56179 - RNA, 48 nt, Artificial Sequence
  Interleukin-4 receptor subunit alpha (302-317)
uacaaggccuucagcucccugcucgcuucuucagcagugagucccgag

SEQ ID NO: 56180 - RNA, 36 nt, Artificial Sequence
  Glycosyltransferase 8 domain-containing protein 1 (123-134)
uacaagaucgugaacuucgaccccaaacugcucgag

SEQ ID NO: 56181 - RNA, 39 nt, Artificial Sequence
  Glycosyltransferase 8 domain-containing protein 1 (123-135)
uacaagaucgugaacuucgaccccaaacugcucgagggc

SEQ ID NO: 56182 - RNA, 45 nt, Artificial Sequence
  Glycosyltransferase 8 domain-containing protein 1 (123-137)
uacaagaucgugaacuucgaccccaaacugcucgagggcaagguc

SEQ ID NO: 56183 - RNA, 39 nt, Artificial Sequence
  Ragulator complex protein LAMTOR3 (68-80)
uacaacaccuaucaggugguccaauucaauagacugccc

SEQ ID NO: 56184 - RNA, 42 nt, Artificial Sequence
  Ragulator complex protein LAMTOR3 (68-81)
uacaacaccuaucaggugguccaauucaauagacugccccuc

SEQ ID NO: 56185 - RNA, 45 nt, Artificial Sequence
  Ragulator complex protein LAMTOR3 (68-82)
uacaacaccuaucaggugguccaauucaauagacugccccucguu

SEQ ID NO: 56186 - RNA, 48 nt, Artificial Sequence
  Ragulator complex protein LAMTOR3 (68-83)
uacaacaccuaucaggugguccaauucaauagacugccccucguugug

SEQ ID NO: 56187 - RNA, 27 nt, Artificial Sequence
  Zinc finger protein 638 (459-467)
uaccccaacaagggcguggggcaggcc

SEQ ID NO: 56188 - RNA, 57 nt, Artificial Sequence
  Fas apoptotic inhibitory molecule 3 (81-99)
uaccccagaaagaaccuguuccucguggaggucacccagcuuacagaaagcgacucc

SEQ ID NO: 56189 - RNA, 60 nt, Artificial Sequence
  Fas apoptotic inhibitory molecule 3 (81-100)
uaccccagaaagaaccuguuccucguggaggucacccagcuuacagaaagcgacuccggc

SEQ ID NO: 56190 - RNA, 27 nt, Artificial Sequence
  Beta-1,4-galactosyltransferase 1 (117-125)
uaccaggugcuggacguccaaagauau

SEQ ID NO: 56191 - RNA, 42 nt, Artificial Sequence
  Serine incorporator 3 (350-363)
uacagcuccaucagaaccucuacaaacucacagguggacaag

SEQ ID NO: 56192 - RNA, 27 nt, Artificial Sequence
  E3 ubiquitin-protein ligase Mdm2 (48-56)
uacaccaugaaggaggugcuguucuau

SEQ ID NO: 56193 - RNA, 36 nt, Artificial Sequence
  Ceruloplasmin (106-117)
uacgugcaccugaagaaccucgccagcagacccuau

SEQ ID NO: 56194 - RNA, 39 nt, Artificial Sequence
  Ceruloplasmin (106-118)
uacgugcaccugaagaaccucgccagcagacccuauacc

SEQ ID NO: 56195 - RNA, 45 nt, Artificial Sequence
  Ceruloplasmin (106-120)
uacgugcaccugaagaaccucgccagcagacccuauaccuuccau

SEQ ID NO: 56196 - RNA, 24 nt, Artificial Sequence
  HLA class II histocompatibility antigen, DM alpha chain (116-123)
uacugggugcccagaaacgcccug

SEQ ID NO: 56197 - RNA, 42 nt, Artificial Sequence
  Ragulator complex protein LAMTOR3 (67-80)
uacuauaacaccuaccaggugguccaauucaauagacugccc

SEQ ID NO: 56198 - RNA, 45 nt, Artificial Sequence
  Ragulator complex protein LAMTOR3 (67-81)
uacuauaacaccuaccaggugguccaauucaauagacugccccuc

SEQ ID NO: 56199 - RNA, 48 nt, Artificial Sequence
  Ragulator complex protein LAMTOR3 (67-82)
uacuauaacaccuaccaggugguccaauucaauagacugccccucguu

SEQ ID NO: 56200 - RNA, 30 nt, Artificial Sequence
  Melanoma-associated antigen C2 (191-200)
cugcucuucggccuugcccugaucgaggug

SEQ ID NO: 56201 - RNA, 42 nt, Artificial Sequence
  C-C motif chemokine 3 (59-72)
aagcccggcgugaucuuccugaccaaaagaagcaggcagguc

SEQ ID NO: 56202 - RNA, 15 nt, Artificial Sequence
  Ig gamma-1 chain C region (91-95)
agcgccguguacuau

SEQ ID NO: 56203 - RNA, 27 nt, Artificial Sequence
  Serum albumin (444-452)
acccccacacugguggaggucagcaga

SEQ ID NO: 56204 - RNA, 36 nt, Artificial Sequence
  DNA topoisomerase 2-alpha (978-989)
gccgaggcugaaagagugggccugcacaaggucuuc

SEQ ID NO: 56205 - RNA, 36 nt, Artificial Sequence
  Basement membrane-specific heparan sulfate proteoglycan core protein (1484-1495)
gcccuggcugaccucgaugagcuucugaucagagca

SEQ ID NO: 56206 - RNA, 36 nt, Artificial Sequence
  Protein phosphatase 1M (122-133)
gcccuguucgacggccacgggggacccgcugcagcc

SEQ ID NO: 56207 - RNA, 39 nt, Artificial Sequence
  Sequestosome-1 (53-65)
gcccuguuccccgcucucagaccuggcggguuucaggca

SEQ ID NO: 56208 - RNA, 36 nt, Artificial Sequence
  UPF0585 protein C16orf13 (153-164)
gcccugcucgaggaccuuggcaaggcuagcgggcug

SEQ ID NO: 56209 - RNA, 39 nt, Artificial Sequence
  Signal transducer and activator of transcription 1-alpha/beta (589-601)
gcccugcucaaggaccagcaacccggcaccuuccuucug

SEQ ID NO: 56210 - RNA, 51 nt, Artificial Sequence
  Glyceraldehyde-3-phosphate dehydrogenase (202-218)
gcccugcagaacaucauucccgcuagcaccggcgcagccaaggcggugggg

SEQ ID NO: 56211 - RNA, 36 nt, Artificial Sequence
  Guanine nucleotide-binding protein G(I)/G(S)/G(T) subunit beta-1 (74-85)
gcccugugggacaucgagaccggccagcaaacaacu

SEQ ID NO: 56212 - RNA, 36 nt, Artificial Sequence
  26S protease regulatory subunit 7 (76-87)
gcccugugggaccucgcugcagauaagcagacccuu

SEQ ID NO: 56213 - RNA, 36 nt, Artificial Sequence
  Peroxisomal multifunctional enzyme type 2 (193-204)
gcccccaacgcuggcagcagaaugacccagacagug

SEQ ID NO: 56214 - RNA, 39 nt, Artificial Sequence
  60S ribosomal protein L13 (47-59)
gcccccagaccugcuagcggcccaaucaggccgauugug

SEQ ID NO: 56215 - RNA, 39 nt, Artificial Sequence
  HLA class I histocompatibility antigen, A-23 alpha chain (5-17)
gcccccagaacccuggugcuccuucugagcggcgcuuug

SEQ ID NO: 56216 - RNA, 48 nt, Artificial Sequence
  HLA class II histocompatibility antigen, DR alpha chain (51-66)
gcccagggcgcucuggcaaacaucgccguggacaaggcgaaucucgag

SEQ ID NO: 56217 - RNA, 36 nt, Artificial Sequence
  Actin, cytoplasmic 2 (19-30)
gccaccgcugcaagcuccucuucacuggagaagagu

SEQ ID NO: 56218 - RNA, 48 nt, Artificial Sequence
  Annexin A2 (52-67)
gacgaggugaccaucgucaacauucugacaaauagaagcaacgcccag

SEQ ID NO: 56219 - RNA, 39 nt, Artificial Sequence
  Interferon-induced transmembrane protein 1 (71-83)
gacgugaccggcgcccaggcuuacgcaagcacagccaag

SEQ ID NO: 56220 - RNA, 39 nt, Artificial Sequence
  HLA class II histocompatibility antigen, DR alpha chain (50-62)
gaggcccagggcgcucuggcaaacaucgccguggacaag

SEQ ID NO: 56221 - RNA, 51 nt, Artificial Sequence
  HLA class I histocompatibility antigen, Cw-7 alpha chain (152-168)
gaggaccugagaagcuggaccgccgcugauacagcagcccagaucacucaa

SEQ ID NO: 56222 - RNA, 48 nt, Artificial Sequence
  Myosin-9 (1232-1247)
gaggaaguggacggcaaggccgauggggcugaggcaaaacccgccgaa

SEQ ID NO: 56223 - RNA, 51 nt, Artificial Sequence
  Heat shock cognate 71 kDa protein (444-460)
gagggcgaaagagccaugaccaaggacaacaaucugcucgggaaauucgag

SEQ ID NO: 56224 - RNA, 48 nt, Artificial Sequence
  Actin, cytoplasmic 2 (15-30)
gagcaggaaauggccaccgcugcaagcuccucuucacuggagaagagu

SEQ ID NO: 56225 - RNA, 36 nt, Artificial Sequence
  Zinc finger protein ZPR1 (349-360)
uucaucauggacgaucccgccggcaacagcuaccug

SEQ ID NO: 56226 - RNA, 36 nt, Artificial Sequence
  Sorting nexin-14 (234-245)
uuccuggccgaccccgauaccgugaaccaccuccuu

SEQ ID NO: 56227 - RNA, 36 nt, Artificial Sequence
  Cytochrome c oxidase assembly factor 3 homolog, mitochondrial (84-95)
uuccuggacgagcucgaagaugaggccaaggcugca

SEQ ID NO: 56228 - RNA, 36 nt, Artificial Sequence
  Heterogeneous nuclear ribonucleoprotein U (198-209)
uuccugugggccggcgggagagcuagcuacggagug

SEQ ID NO: 56229 - RNA, 36 nt, Artificial Sequence
  Arf-GAP with Rho-GAP domain, ANK repeat and PH domain-containing protein 1 (1183-1194)
uucaccgccgacccccugagccuccuuagaaacgug

SEQ ID NO: 56230 - RNA, 36 nt, Artificial Sequence
  Nucleolin (630-641)
ggcgagaucgacgggaacaaggugacccuggauugg

SEQ ID NO: 56231 - RNA, 48 nt, Artificial Sequence
  Heat shock cognate 71 kDa protein (445-460)
ggcgagagagccaugaccaaggacaacaaucugcucgggaaauucgaa

SEQ ID NO: 56232 - RNA, 51 nt, Artificial Sequence
  Keratin, type I cytoskeletal 9 (15-31)
ggcgggggagguggcgggggacugggcagcgguggguccaucagaucuuca

SEQ ID NO: 56233 - RNA, 36 nt, Artificial Sequence
  Putative RNA-binding protein 15 (1399-1410)
ggccuggcccccgcugagguggucguugcaaccgug

SEQ ID NO: 56234 - RNA, 36 nt, Artificial Sequence; identical to SEQ ID NO: 32007
  ERI1 exoribonuclease 3 (154-165)

SEQ ID NO: 56235 - RNA, 39 nt, Artificial Sequence
  Anion exchange protein 2 (714-726)
ggccugcucggggagaagacccaggaccuuaucggagug

SEQ ID NO: 56236 - RNA, 48 nt, Artificial Sequence
  Phosphoglycerate kinase 1 (338-353)
ggccccgugggggucuucgagugggaagccuuugcuagaggaaccaag

SEQ ID NO: 56237 - RNA, 51 nt, Artificial Sequence
  Phosphoglycerate kinase 1 (338-354)
ggccccgugggggucuucgagugggaagccuuugcuagaggaaccaaggca

SEQ ID NO: 56238 - RNA, 45 nt, Artificial Sequence
  Calmodulin (135-149)
ggccaggugaacuacgaggaauucguccaaaugaugaccgccaag

SEQ ID NO: 56239 - RNA, 57 nt, Artificial Sequence
  Keratin, type II cytoskeletal 1 (560-578)
ggcagcgggggagguuccuacggcucugggggaggcggugggggacacggcucauau

SEQ ID NO: 56240 - RNA, 48 nt, Artificial Sequence
  HLA class I histocompatibility antigen, B-39 alpha chain (25-40)
ggcagccacuccaugagauacuucuauaccucugugucaaggcccggg

SEQ ID NO: 56241 - RNA, 39 nt, Artificial Sequence
  Tumor susceptibility gene 101 protein (219-231)
ggcaccaucagcgaggacacaauuagagccucccugaua

SEQ ID NO: 56242 - RNA, 36 nt, Artificial Sequence
  A-kinase anchor protein 1, mitochondrial (608-619)
aucauuugggagauagaagugcccaagcaccugguc

SEQ ID NO: 56243 - RNA, 36 nt, Artificial Sequence
  Cirhin (454-465)
auccuguucagcgaggacuccaccaagcucuuugug

SEQ ID NO: 56244 - RNA, 36 nt, Artificial Sequence
  4-hydroxyphenylpyruvate dioxygenase-like protein (312-323)
auccugcucgacggcgauaaggggaaauuccuucug

SEQ ID NO: 56245 - RNA, 39 nt, Artificial Sequence
  Nucleosome-remodeling factor subunit BPTF (1571-1583)
aagaucauucccgagaacgacauaaaaagccugaccgug

SEQ ID NO: 56246 - RNA, 39 nt, Artificial Sequence
  Centrin-3 (108-120)
aagcuguucgacgaugacgauagcggcaaaaucucccuc

SEQ ID NO: 56247 - RNA, 36 nt, Artificial Sequence
  Uridine-cytidine kinase 2 (2-13)
aagcuguucguggacaccgaugccgacacaagacuc

SEQ ID NO: 56248 - RNA, 36 nt, Artificial Sequence
  Retinoic acid receptor RXR-gamma (441-452)
aagcugaucggcgacacccccauugauacauuccuc

SEQ ID NO: 56249 - RNA, 39 nt, Artificial Sequence
  40S ribosomal protein S17 (107-119)
aagcugcucgacuucggcagccuuuccaaccugcaggug

SEQ ID NO: 56250 - RNA, 36 nt, Artificial Sequence
  Golgin subfamily A member 4 (849-860)
aagcugcucgaccuugagaccgaaagaauccuguug

SEQ ID NO: 56251 - RNA, 36 nt, Artificial Sequence
  Utrophin (226-237)
aagcugcucgaccccgaggauguggccguccagcuu

SEQ ID NO: 56252 - RNA, 36 nt, Artificial Sequence
  Prelamin-A/C (297-308)
aagcugcucgagggcgaagaggaaagacuuaggcug

SEQ ID NO: 56253 - RNA, 36 nt, Artificial Sequence
  Vimentin (236-247)
aagcugcucgagggcgaagagagcagaaucucccuu

SEQ ID NO: 56254 - RNA, 42 nt, Artificial Sequence
  V-type proton ATPase subunit H (396-409)
aagcugcucgaggugagcgacgauccccagguccuugccguu

SEQ ID NO: 56255 - RNA, 39 nt, Artificial Sequence
  Methionine aminopeptidase 1 (15-27)
aagcugcucagcuccgaggacaucgaaggcaugagacuu

SEQ ID NO: 56256 - RNA, 36 nt, Artificial Sequence
  Isovaleryl-CoA dehydrogenase, mitochondrial (398-409)
aagcuguacgagaucggcgccgggaccagcgaagug

SEQ ID NO: 56257 - RNA, 36 nt, Artificial Sequence
  Eukaryotic translation initiation factor 3 subunit C-like protein (765-776)
aaggugugggaccuguuccccgaggccgauaaaguc

SEQ ID NO: 56258 - RNA, 45 nt, Artificial Sequence
  HLA class I histocompatibility antigen, Cw-7 alpha chain (154-168)
cugagaagcuggaccgccgcugacacagcagcccagaucacucaa

SEQ ID NO: 56259 - RNA, 42 nt, Artificial Sequence
  Mitochondrial import receptor subunit TOM5 homolog (38-51)
cugagagugacccccuucauccucaagaaacuugacagcauu

SEQ ID NO: 56260 - RNA, 39 nt, Artificial Sequence
  Beta-2-microglobulin (89-101)
cugagccagcccaagaucgugaaaugggacagagauaug

SEQ ID NO: 56261 - RNA, 39 nt, Artificial Sequence
  Actin, cytoplasmic 2 (18-30)
auggccaccgcugcaagcuccucuucacuggagaagagu

SEQ ID NO: 56262 - RNA, 57 nt, Artificial Sequence
  HLA class I histocompatibility antigen, Cw-7 alpha chain (151-169)
aacgaggaccugagaagcuggaccgccgcugauacagcagcccagaucacucaaagg

SEQ ID NO: 56263 - RNA, 36 nt, Artificial Sequence
  Alkyldihydroxyacetonephosphate synthase, peroxisomal (324-335)
aacaucuacggcaauauugaggaccuggugguccac

SEQ ID NO: 56264 - RNA, 36 nt, Artificial Sequence
  Poly(U)-binding-splicing factor PUF60 (270-281)
aaccuguucgaccucggcgggcaguaccuuagagug

SEQ ID NO: 56265 - RNA, 36 nt, Artificial Sequence
  Inosine-5'-monophosphate dehydrogenase 2 (312-323)
aaccugaucgacgccggcguggaugcucucagaguc

SEQ ID NO: 56266 - RNA, 36 nt, Artificial Sequence
  Cyclin-dependent kinase 1 (133-144)
aaccugcucaucgacgauaagggcaccauuaaacuu

SEQ ID NO: 56267 - RNA, 42 nt, Artificial Sequence
  Protein ERGIC-53 (162-175)
aaccccgccaucgugauuauaggcaauaacgggcagauccac

SEQ ID NO: 56268 - RNA, 51 nt, Artificial Sequence
  Heat shock 70 kDa protein 1-like (170-186)
aacgugcugagaaucauuaaugagcccaccgccgcugcaauagccuacggc

SEQ ID NO: 56269 - RNA, 51 nt, Artificial Sequence
  Hsp90 co-chaperone Cdc37 (362-378)
ccccugcucgaggccgugccuaagaccggcgacgaaaaagaugucagcguu

SEQ ID NO: 56270 - RNA, 36 nt, Artificial Sequence
  Nucleolar RNA helicase 2 (109-120)
caggagauccccguggaacaaaaggagggcgccuuc

SEQ ID NO: 56271 - RNA, 36 nt, Artificial Sequence
  Signal recognition particle 54 kDa protein (385-396)
caggagcuggacagcaccgauggcgccaagguguuc

SEQ ID NO: 56272 - RNA, 48 nt, Artificial Sequence
  Septin-2 (381-396)
cagaugcaaggcggggacggagaugguggcgcccuggggcaccaugug

SEQ ID NO: 56273 - RNA, 36 nt, Artificial Sequence
  Polyadenylate-binding protein 4 (179-190)
agagaggccgaacugggcgcuaaggcaaaagaguuc

SEQ ID NO: 56274 - RNA, 36 nt, Artificial Sequence
  Polyadenylate-binding protein 3 (179-190)
agagaggccgaacugggcgcuagggcaaaggaguuc

SEQ ID NO: 56275 - RNA, 36 nt, Artificial Sequence
  Bromodomain adjacent to zinc finger domain protein 2B (1684-1695)
agaaucauugaccccgaggaucugaaggcccuccuu

SEQ ID NO: 56276 - RNA, 36 nt, Artificial Sequence
  Nucleolar complex protein 2 homolog (10-21)
agacuggccgagcucaccguggacgaauuccuugcu

SEQ ID NO: 56277 - RNA, 36 nt, Artificial Sequence
  Protein unc-45 homolog A (202-213)
agacugcucgacaugggcgagaccgaucuuaugcug

SEQ ID NO: 56278 - RNA, 36 nt, Artificial Sequence
  Iron-sulfur cluster assembly 2 homolog, mitochondrial (59-70)
agacugcucgagaucaccgaaggcagcgaguuccuu

SEQ ID NO: 56279 - RNA, 36 nt, Artificial Sequence
  Cytoskeleton-associated protein 5 (1718-1729)
agacugcuccccgacaccaucaacagcauuaaucuu

SEQ ID NO: 56280 - RNA, 39 nt, Artificial Sequence
  ATP-dependent RNA helicase DHX36 (643-655)
agacugauggaccccccuagcaacgaggccgugcuccuu

SEQ ID NO: 56281 - RNA, 36 nt, Artificial Sequence
  Multidrug resistance protein 1 (378-389)
agacuguacgaccccaccgagggcauggugagcguc

SEQ ID NO: 56282 - RNA, 42 nt, Artificial Sequence
  WD repeat-containing protein 11 (918-931)
agacuguacggcgacgagagcgaacuccacuucuggaccgug

SEQ ID NO: 56283 - RNA, 36 nt, Artificial Sequence
  Transmembrane emp24 domain-containing protein 9 (11-22)
agacccaggccuggcaccgggcugggacgggugaug

SEQ ID NO: 56284 - RNA, 36 nt, Artificial Sequence
  Serine-rich coiled-coil domain-containing protein 2 (24-35)
agacccuacgccgcuggcgggaagaaacuggcacuc

SEQ ID NO: 56285 - RNA, 36 nt, Artificial Sequence
  Anaphase-promoting complex subunit 2 (163-174)
agagugcuggaccccagcauggucauccucgagguu

SEQ ID NO: 56286 - RNA, 42 nt, Artificial Sequence
  HLA class I histocompatibility antigen, A-23 alpha chain (352-365)
agcgcccagggcuccgacgugucucugaccgcuugcaagguc

SEQ ID NO: 56287 - RNA, 36 nt, Artificial Sequence
  Protein KRI1 homolog (456-467)
agcgagcaggaagagcugagagacaagagggccuac

SEQ ID NO: 56288 - RNA, 48 nt, Artificial Sequence
  Keratin, type I cytoskeletal 9 (13-28)
agcggcgggggagguggcgggggacugggcuccggugggucuaucaga

SEQ ID NO: 56289 - RNA, 36 nt, Artificial Sequence
  Stress-70 protein, mitochondrial (253-264)
agcauccuggagauucagaagggcguguucgaaguc

SEQ ID NO: 56290 - RNA, 36 nt, Artificial Sequence
  Centrosomal protein of 192 kDa (19-30)
agccuguucggcaacuccgggauccucgagaaugug

SEQ ID NO: 56291 - RNA, 36 nt, Artificial Sequence
  DNA-dependent protein kinase catalytic subunit (3305-3316)
agccugcucgacgagaacaauguguccucuuaccuu

SEQ ID NO: 56292 - RNA, 36 nt, Artificial Sequence
  Zinc finger protein 829 (85-96)
agccugcucgagcagggcaaggaacccuggauggug

SEQ ID NO: 56293 - RNA, 42 nt, Artificial Sequence
  Renin receptor (241-254)
agccuguacggcgggaacgccguggucgagcucguuaccgug

SEQ ID NO: 56294 - RNA, 39 nt, Artificial Sequence
  Protein kinase C-binding protein 1 (470-482)
agccccgccuccaccaagacaggccaggcugggucucug

SEQ ID NO: 56295 - RNA, 42 nt, Artificial Sequence
  AT-rich interactive domain-containing protein 1A (233-246)
agccccagaggcgggaccccuggauccggugccgcugcagcc

SEQ ID NO: 56296 - RNA, 36 nt, Artificial Sequence
  E3 ubiquitin-protein ligase TRIP12 (1954-1965)
agccccagacugccugugggcggguucaggucccuc

SEQ ID NO: 56297 - RNA, 36 nt, Artificial Sequence
  Msx2-interacting protein (1024-1035)
agccccagaccuuccggcccagggccgucuucauuc

SEQ ID NO: 56298 - RNA, 36 nt, Artificial Sequence
  Long-chain-fatty-acid-CoA ligase 1 (687-698)
agccagaucgacgaucuguacuccaccauuaaggug

SEQ ID NO: 56299 - RNA, 54 nt, Artificial Sequence
  Keratin, type I cytoskeletal 9 (12-29)
agcagauccggcgggggagguggcgggggacugggcucuggugggucaaucagg

SEQ ID NO: 56300 - RNA, 60 nt, Artificial Sequence
  Keratin, type I cytoskeletal 9 (12-31)
agcagauccggcgggggagguggcgggggacugggcucuggugggucaaucaggaguagc

SEQ ID NO: 56301 - RNA, 63 nt, Artificial Sequence
  Keratin, type I cytoskeletal 9 (12-32)
agcagauccggcgggggagguggcgggggacugggcucuggugggucaaucaggaguagcuac

SEQ ID NO: 56302 - RNA, 60 nt, Artificial Sequence
  Cytochrome c oxidase subunit 6A1, mitochondrial (2-21)
agcuccggcgcccacggggaggaaggaucugcuagaauguggaagacccugacauucuuu

SEQ ID NO: 56303 - RNA, 42 nt, Artificial Sequence
  Glyceraldehyde-3-phosphate dehydrogenase (2-15)
agcaccuucgacgccggcgcugggaucgcacugaacgaucac

SEQ ID NO: 56304 - RNA, 36 nt, Artificial Sequence
  HLA class I histocompatibility antigen, B-15 alpha chain (158-169)
accgccgcugacacagcagcccagaucacucaaaga

SEQ ID NO: 56305 - RNA, 36 nt, Artificial Sequence
  Intercellular adhesion molecule 3 (536-547)
accgaggccaugggcgaagagcccagcagagcugaa

SEQ ID NO: 56306 - RNA, 36 nt, Artificial Sequence; identical to SEQ ID NO: 32079
  Ragulator complex protein LAMTOR5 (36-47)

SEQ ID NO: 56307 - RNA, 36 nt, Artificial Sequence
  Treacle protein (102-113)
acccccagacuggccagcacaaacuccucugugcuc

SEQ ID NO: 56308 - RNA, 36 nt, Artificial Sequence
  Neuropilin-2 (234-245)
acccccagcgagcugagauccucuacaggcauccuc

SEQ ID NO: 56309 - RNA, 66 nt, Artificial Sequence
  Cytochrome c oxidase subunit 7A2, mitochondrial (62-83)
accgugggcgggacagccuacgcuaucuaugagcuggcagucgccagcuuccccaagaaacaggaa

SEQ ID NO: 56310 - RNA, 51 nt, Artificial Sequence
  HLA class I histocompatibility antigen, Cw-5 alpha chain (52-68)
guggacgauacccaguucguccaauuugacagcgaugccgcuucccccaga

SEQ ID NO: 56311 - RNA, 51 nt, Artificial Sequence
  HLA class I histocompatibility antigen, alpha chain E (49-65)
guggacgauacccaguucgucagauuugacaacgaugccgcuagccccagg

SEQ ID NO: 56312 - RNA, 57 nt, Artificial Sequence
  HLA class I histocompatibility antigen, B-55 alpha chain (52-70)
guggacgauacccaguucgucagauuugacagcgaugccgcuucccccagggaggaa

SEQ ID NO: 56313 - RNA, 60 nt, Artificial Sequence
  HLA class I histocompatibility antigen, B-55 alpha chain (52-71)
guggacgauacccaguucgucagauuugacagcgaugccgcuucccccagggaggaaccu

SEQ ID NO: 56314 - RNA, 39 nt, Artificial Sequence
  butyrophilin subfamily 3 member A3 secreted isoform (174-186)
gugauccuggaccccgauaccgccaacgcuauucuccuu

SEQ ID NO: 56315 - RNA, 39 nt, Artificial Sequence
  Dihydropyrimidinase-related protein 2 (374-386)
gugaucugggaccccgauagcgucaagaccauuuccgcc

SEQ ID NO: 56316 - RNA, 36 nt, Artificial Sequence
  Exocyst complex component 4 (203-214)
gugcuggccgagaucaacaaggaaauugagggcguc

SEQ ID NO: 56317 - RNA, 36 nt, Artificial Sequence
  Deoxyuridine 5'-triphosphate nucleotidohydrolase, mitochondrial (112-123)
gugcuguucaacuuuggcaaggagaaauucgaaguc

SEQ ID NO: 56318 - RNA, 42 nt, Artificial Sequence
  Translocon-associated protein subunit alpha (19-32)
gugcuguucagaggcgggcccaggggacuccuugccgucgcu

SEQ ID NO: 56319 - RNA, 48 nt, Artificial Sequence
  Heat shock 70 kDa protein 1-like (171-186)
gugcugagaaucauuaacgagcccaccgccgcugcaauagccuacggc

SEQ ID NO: 56320 - RNA, 39 nt, Artificial Sequence
  G2/mitotic-specific cyclin-B1 (388-400)
gugauggucaaccagggccugaccaagcacaugacaguu

SEQ ID NO: 56321 - RNA, 39 nt, Artificial Sequence
  Endoplasmic reticulum resident protein 29 (5-17)
gugcccagagccgcuuuccugagcccucuccuuccacug

SEQ ID NO: 56322 - RNA, 36 nt, Artificial Sequence
  Lysosomal alpha-glucosidase (38-49)
gugcccagagagcugagcggcuccucuccuguccuc

SEQ ID NO: 56323 - RNA, 42 nt, Artificial Sequence
  HLA class I histocompatibility antigen, B-15 alpha chain (241-254)
uggcagagagacggcgaggaucaaacccaggacacagaacug

SEQ ID NO: 56324 - RNA, 39 nt, Artificial Sequence
  V-type proton ATPase subunit S1 (77-89)
uaccuggaccccgcccucgagcuuggcccuagaaacgug

SEQ ID NO: 56325 - RNA, 36 nt, Artificial Sequence
  Armadillo repeat-containing protein 8 (306-317)
uaccugaucgagcccgacguggaacuccagagaauu

SEQ ID NO: 56326 - RNA, 36 nt, Artificial Sequence
  F-actin-capping protein subunit beta (120-131)
uaccugugggaccucgaucacggcuucgccggggug

SEQ ID NO: 56327 - RNA, 36 nt, Artificial Sequence
  40S ribosomal protein S8 (188-199)
uacgugcuggagggcaaggaacucgaguucuaucuu

SEQ ID NO: 56328 - RNA, 45 nt, Artificial Sequence
  DnaJ homolog subfamily C member 3 (3-17)
gcccccggcagcgugaccuccagacuggggucugucuucccuuuu

SEQ ID NO: 56329 - RNA, 27 nt, Artificial Sequence
  Pre-rRNA-processing protein TSR1 homolog (480-488)
gccagaaucuuccaguuucaaaacuuc

SEQ ID NO: 56330 - RNA, 27 nt, Artificial Sequence
  Protein FAM98B (250-258)
gccagaaucuaccagcccaagagguau

SEQ ID NO: 56331 - RNA, 27 nt, Artificial Sequence
  Acyl-CoA desaturase (130-138)
gccagacugccccucaggcuuuuccug

SEQ ID NO: 56332 - RNA, 27 nt, Artificial Sequence
  Serine/arginine-rich splicing factor 3 (42-50)
gccagaaaccccccuggcuucgcuuuu

SEQ ID NO: 56333 - RNA, 33 nt, Artificial Sequence
  ATP synthase F(0) complex subunit C1, mitochondrial (62-72)
gccagaaaccccagccugaagcagcaacucuuc

SEQ ID NO: 56334 - RNA, 27 nt, Artificial Sequence
  40S ribosomal protein S28 (12-20)
gccagagugaccaagguccugggcagg

SEQ ID NO: 56335 - RNA, 27 nt, Artificial Sequence
  Rab GDP dissociation inhibitor alpha (217-225)
gccagauacggcaagagccccuaucug

SEQ ID NO: 56336 - RNA, 27 nt, Artificial Sequence
  Vacuolar fusion protein CCZ1 homolog (167-175)
gagagacuggaaaaguucuuucacagg

SEQ ID NO: 56337 - RNA, 27 nt, Artificial Sequence
  Mitochondrial import receptor subunit TOM5 homolog (2-10)
uucagaaucgagggccuggcccccaag

SEQ ID NO: 56338 - RNA, 33 nt, Artificial Sequence
  Lysosome-associated membraneoprotein 2 (4-14)
uucagacuguuucccgugccuggcagcgggcuc

SEQ ID NO: 56339 - RNA, 30 nt, Artificial Sequence
  60S ribosomal protein L28 (38-47)
uucagauacaacggccugauccacaggaag

SEQ ID NO: 56340 - RNA, 30 nt, Artificial Sequence
  Menin (410-419)
ggcagauucgaggggcaggugaggcaaaag

SEQ ID NO: 56341 - RNA, 36 nt, Artificial Sequence
  Myelin basic protein (43-54)
ggcagauucuuugggggagacaggggugcccccaag

SEQ ID NO: 56342 - RNA, 27 nt, Artificial Sequence
  Rho guanine nucleotide exchange factor 2 (459-467)
ggcagauucaaggacgugcugguccuc

SEQ ID NO: 56343 - RNA, 27 nt, Artificial Sequence
  Protein OS-9 (125-133)
ggcagacacauccagcaauaccauaug

SEQ ID NO: 56344 - RNA, 27 nt, Artificial Sequence
  26S protease regulatory subunit 4 (345-353)
ggcagaaucgacaggaagauugaguuc

SEQ ID NO: 56345 - RNA, 27 nt, Artificial Sequence
  Uncharacterized protein C1orf131 (262-270)
ggcagaaucgggcaggugggaaaguuc

SEQ ID NO: 56346 - RNA, 27 nt, Artificial Sequence
  Glyceraldehyde-3-phosphate dehydrogenase (12-20)
ggcagaaucgggaggcuggugacccgg

SEQ ID NO: 56347 - RNA, 27 nt, Artificial Sequence
  Induced myeloid leukemia cell differentiation protein Mcl-1 (109-117)
ggcagaaucgugacccugauuagcuuc

SEQ ID NO: 56348 - RNA, 33 nt, Artificial Sequence
  60S ribosomal protein L13a (139-149)
ggcagacuggcccacgaggugggguggaaguac

SEQ ID NO: 56349 - RNA, 27 nt, Artificial Sequence
  Protein MON2 homolog (593-601)
ggcagacuggggcucgugaccagcagg

SEQ ID NO: 56350 - RNA, 27 nt, Artificial Sequence
  Protein transport protein Sec23B (152-160)
ggcagaauggugcagguccacgagcug

SEQ ID NO: 56351 - RNA, 27 nt, Artificial Sequence
  Major facilitator superfamily domain-containing protein 10 (356-364)
ggcagaagccugcccgugcucgggcuu

SEQ ID NO: 56352 - RNA, 27 nt, Artificial Sequence
  Unconventional myosin-Ic (676-684)
ggcagaaccaagaucuucauuagguuu

SEQ ID NO: 56353 - RNA, 27 nt, Artificial Sequence
  Protein CNPPD1 (197-205)
ggcagauggagggggugguacaccuau

SEQ ID NO: 56354 - RNA, 27 nt, Artificial Sequence
  E3 ubiquitin-protein ligase MYCBP2 (3264-3272)
ggcagauacgccgggggacaggguuau

SEQ ID NO: 56355 - RNA, 27 nt, Artificial Sequence
  NEDD4 family-interacting protein 1 (145-153)
ggcagauacggggccaucagcggauuc

SEQ ID NO: 56356 - RNA, 33 nt, Artificial Sequence
  NEDD4 family-interacting protein 1 (145-155)
ggcagauacggggccaucagcggauucggucug

SEQ ID NO: 56357 - RNA, 27 nt, Artificial Sequence
  Inositol hexakisphosphate kinase 2 (296-304)
ggcagauaccugaggcgggagcuccuu

SEQ ID NO: 56358 - RNA, 27 nt, Artificial Sequence
  Translocon-associated protein subunit delta (84-92)
ggcagauaccaggugagcuggucccug

SEQ ID NO: 56359 - RNA, 27 nt, Artificial Sequence
  Cleavage and polyadenylation specificity factor subunit 5 (89-97)
cacagacugccccaugugcuccuucug

SEQ ID NO: 56360 - RNA, 27 nt, Artificial Sequence
  Zinc finger protein 281 (55-63)
cacagacugcccccugugaccagcuuc

SEQ ID NO: 56361 - RNA, 30 nt, Artificial Sequence
  Calpain-1 catalytic subunit (132-141)
cacagaguggucccccauggccagagcuuc

SEQ ID NO: 56362 - RNA, 30 nt, Artificial Sequence
  X-ray repair cross-complementing protein 6 (338-347)
aagagauucgacgaucccggccugaugcuc

SEQ ID NO: 56363 - RNA, 30 nt, Artificial Sequence
  Copine-1 (190-199)
aagagauucagcgugcccguccagcacuuu

SEQ ID NO: 56364 - RNA, 27 nt, Artificial Sequence
  Ornithine decarboxylase antizyme 1 (58-66)
aagagaaucaacuggaggaccgugcug

SEQ ID NO: 56365 - RNA, 27 nt, Artificial Sequence
  Bax inhibitor 1 (129-137)
aagagacugggccuccuugccggguuc

SEQ ID NO: 56366 - RNA, 27 nt, Artificial Sequence
  Pre-rRNA-processing protein TSR1 homolog (726-734)
aagagaguguuccccaaauggaccuac

SEQ ID NO: 56367 - RNA, 30 nt, Artificial Sequence
  Pre-mRNA-processing-splicing factor 8 (85-94)
aagagaguguaccugggcgcccucaaauau

SEQ ID NO: 56368 - RNA, 30 nt, Artificial Sequence
  ER degradation-enhancing alpha-mannosidase-like protein 1 (467-476)
aagagauacggcgcccugcccgagagguau

SEQ ID NO: 56369 - RNA, 27 nt, Artificial Sequence
  Mitochondrial import receptor subunit TOM5 homolog (38-46)
cugagagugacccccuucauccucaag

SEQ ID NO: 56370 - RNA, 27 nt, Artificial Sequence
  Interferon alpha-inducible protein 6 (1-9)
augagacagaaggccgugagccuguuc

SEQ ID NO: 56371 - RNA, 30 nt, Artificial Sequence
  Interferon alpha-inducible protein 6 (1-10)
augagacagaaggccgugagccuguuccuc

SEQ ID NO: 56372 - RNA, 27 nt, Artificial Sequence
  Double-strand-break repair protein rad21 homolog (383-391)
aacagacugcucaagcuuuucaccagg

SEQ ID NO: 56373 - RNA, 27 nt, Artificial Sequence
  ER degradation-enhancing alpha-mannosidase-like protein 1 (35-43)
cagagauucccccugagcuuuggcuuc

SEQ ID NO: 56374 - RNA, 27 nt, Artificial Sequence
  B-cell receptor-associated protein 31 (100-108)
cagagaaaccuguacaucgccggcuuc

SEQ ID NO: 56375 - RNA, 33 nt, Artificial Sequence
  Chondroitin sulfate glucuronyltransferase (434-444)
agaagguucgaccccgcccggggcauggaguac

SEQ ID NO: 56376 - RNA, 27 nt, Artificial Sequence
  Nuclear envelope integral membrane protein 1 (157-165)
agaagguucgaccccaagcuguuucuc

SEQ ID NO: 56377 - RNA, 27 nt, Artificial Sequence
  ER membrane protein complex subunit 4 (13-21)
agaagguucaagugggccaucgagcug

SEQ ID NO: 56378 - RNA, 27 nt, Artificial Sequence
  Ras GTPase-activating protein-binding protein 1 (106-114)
agaagguucaugcagaccuuugugcug

SEQ ID NO: 56379 - RNA, 27 nt, Artificial Sequence
  Cullin-7 (439-447)
agaagguuccggccccgcagcgaguuu

SEQ ID NO: 56380 - RNA, 27 nt, Artificial Sequence
  Ubiquitin carboxyl-terminal hydrolase 22 (367-375)
agaagguucacccggcccgagcaccug

SEQ ID NO: 56381 - RNA, 27 nt, Artificial Sequence
  Cytochrome c oxidase subunit 7C, mitochondrial (7-15)
agaagguucaccacaagcgugguccgg

SEQ ID NO: 56382 - RNA, 33 nt, Artificial Sequence
  40S ribosomal protein S30 (114-124)
agaagguucgugaacgucguucccaccuuuggc

SEQ ID NO: 56383 - RNA, 27 nt, Artificial Sequence
  Acyl-CoA desaturase (174-182)
agaaggggcuucuuuuucagccacgug

SEQ ID NO: 56384 - RNA, 27 nt, Artificial Sequence
  Store-operated calcium entry-associated regulatory factor (56-64)
agaaggcuggaccccaucccucagcuc

SEQ ID NO: 56385 - RNA, 30 nt, Artificial Sequence
  Melanoma-associated antigen F1 (195-204)
agaaggcugggcgugcagcccagcaaguac

SEQ ID NO: 56386 - RNA, 27 nt, Artificial Sequence
  Transformation/transcription domain-associated protein (2920-2928)
agaaggcugccccacguggucagccau

SEQ ID NO: 56387 - RNA, 27 nt, Artificial Sequence
  Heat shock protein HSP 90-beta (375-383)
agaaggcugagcgagcuccuucgguac

SEQ ID NO: 56388 - RNA, 27 nt, Artificial Sequence
  DNA-directed RNA polymerase II subunit RPB1 (1052-1060)
agaaggauggccgaggaauuccggcug

SEQ ID NO: 56389 - RNA, 30 nt, Artificial Sequence
  Signal-induced proliferation-associated 1-like protein 2 (954-963)
agaaggaacggccuggggcagcucggauuc

SEQ ID NO: 56390 - RNA, 27 nt, Artificial Sequence
  NADH dehydrogenase (ubiquinone) 1 subunit C2 (4-12)
agaaggaaccccgagccucugcgguuc

SEQ ID NO: 56391 - RNA, 30 nt, Artificial Sequence
  Elongation factor 2 (341-350)
agaagguggcugcccgccggcgacgcucuc

SEQ ID NO: 56392 - RNA, 27 nt, Artificial Sequence
  Eukaryotic initiation factor 4A-I (168-176)
agaagguaccugagccccaaguauauc

SEQ ID NO: 56393 - RNA, 27 nt, Artificial Sequence
  60S ribosomal protein L17 (61-69)
agaagguacaacggcggggugggacgg

SEQ ID NO: 56394 - RNA, 30 nt, Artificial Sequence
  Eukaryotic translation initiation factor 3 subunit L (327-336)
agaagguaccaggacgccauccggguguuc

SEQ ID NO: 56395 - RNA, 27 nt, Artificial Sequence
  Charged multivesicular body protein 2a (70-78)
agaagguacgugcggaaguucguccug

SEQ ID NO: 56396 - RNA, 27 nt, Artificial Sequence
  Histone H2A type 1-A (20-28)
agcagagccggccugcaguuccccgug

SEQ ID NO: 56397 - RNA, 27 nt, Artificial Sequence
  Pre-mRNA cleavage complex 2 protein Pcf11 (1103-1111)
agcagauucgacaucccccugggccuc

SEQ ID NO: 56398 - RNA, 27 nt, Artificial Sequence
  Pericentrin (1289-1297)
agcagauucgagaaggaauuuuccuuc

SEQ ID NO: 56399 - RNA, 27 nt, Artificial Sequence
  Myosin-7 (242-250)
agcagauucggcaaguuuaucaggauu

SEQ ID NO: 56400 - RNA, 27 nt, Artificial Sequence
  Pre-mRNA-processing-splicing factor 8 (538-546)
agcagauucggcaacgccuuucaccug

SEQ ID NO: 56401 - RNA, 33 nt, Artificial Sequence
  EH domain-containing protein 4 (129-139)
agcagauucggcaacgccuuucugaauagguuc

SEQ ID NO: 56402 - RNA, 27 nt, Artificial Sequence
  DNA replication licensing factor MCM7 (227-235)
agcagauucaucaaguuucaggagaug

SEQ ID NO: 56403 - RNA, 27 nt, Artificial Sequence
  ATP-dependent RNA helicase DDX3X (591-599)
agcagauucuccggcggguuuggagcc

SEQ ID NO: 56404 - RNA, 30 nt, Artificial Sequence
  NADH dehydrogenase (ubiquinone) 1 beta subcomplex subunit 5, mitochondrial (60-69)
agcagauucuacgacaggcgguuucugaag

SEQ ID NO: 56405 - RNA, 27 nt, Artificial Sequence
  Hypoxia-inducible factor 1-alpha (268-276)
agcagacacucccuggacaugaaguuc

SEQ ID NO: 56406 - RNA, 33 nt, Artificial Sequence
  Ubiquitin fusion degradation protein 1 homolog (57-67)
agcagacugaacaucaccuaccccaugcucuuc

SEQ ID NO: 56407 - RNA, 27 nt, Artificial Sequence
  Protein diaphanous homolog 3 (854-862)
agcagaaacgcccagaccuucggcuuu

SEQ ID NO: 56408 - RNA, 27 nt, Artificial Sequence
  Cytochrome b-c1 complex subunit 8 (9-17)
accagaaugaggcacgugaucagcuac

SEQ ID NO: 56409 - RNA, 27 nt, Artificial Sequence
  WD repeat-containing protein 36 (383-391)
gugagacugcccccuaucaccaaguuc

SEQ ID NO: 56410 - RNA, 42 nt, Artificial Sequence
  POTE ankyrin domain family member F (791-804)
uacaacgagcugagaguggcccccgaagagcacccuguccuc

SEQ ID NO: 56411 - RNA, 27 nt, Artificial Sequence
  Dystonin (7305-7313)
uacagauucuuucugggcaaccaguuc

SEQ ID NO: 56412 - RNA, 27 nt, Artificial Sequence
  BTB/POZ domain-containing protein KCTD20 (192-200)
ggcagaagcgaggugaucuacaacuau

SEQ ID NO: 56413 - RNA, 27 nt, Artificial Sequence
  Filamin-B (2069-2077)
ggcagagugaaggagagcaucaccagg

SEQ ID NO: 56414 - RNA, 27 nt, Artificial Sequence
  Intron-binding protein aquarius (896-904)
ggcagagugaacuacguccuggccagg

SEQ ID NO: 56415 - RNA, 33 nt, Artificial Sequence
  Integrin-linked protein kinase (149-159)
ggcagauggcaggggaacgacaucguggucaag

SEQ ID NO: 56416 - RNA, 27 nt, Artificial Sequence
  Serine/threonine-protein kinase 38 (446-454)
aagagauucgagggccugaccgccagg

SEQ ID NO: 56417 - RNA, 27 nt, Artificial Sequence
  39S ribosomal protein L43, mitochondrial (27-35)
cagagacugagcuucuccgugucuagg

SEQ ID NO: 56418 - RNA, 27 nt, Artificial Sequence
  Protein diaphanous homolog 1 (967-975)
agcagaaacgccggcgcuuucggguuu

SEQ ID NO: 56419 - RNA, 30 nt, Artificial Sequence
  WD repeat-containing protein 1 (55-64)
gugagauucagccccgacggcaacagguuu

SEQ ID NO: 56420 - RNA, 39 nt, Artificial Sequence
  Elongation factor 1-beta (213-225)
uacgugcagagcauggacgucgccgcuuucaacaagauc

SEQ ID NO: 56421 - RNA, 27 nt, Artificial Sequence
  T-complex protein 1 subunit zeta (2-10)
gccgcugugaagacccugaaccccaaa

SEQ ID NO: 56422 - RNA, 33 nt, Artificial Sequence
  40S ribosomal protein S21 (73-83)
gccaaggcugacggcaucgugagcaaaaacuuc

SEQ ID NO: 56423 - RNA, 33 nt, Artificial Sequence
  Alpha-enolase (13-23)
gacagcagaggcaaccccaccguggaggucgau

SEQ ID NO: 56424 - RNA, 27 nt, Artificial Sequence
  Triosephosphate isomerase (159-167)
uucguggacaucauuaacgccaagcag

SEQ ID NO: 56425 - RNA, 27 nt, Artificial Sequence
  60S ribosomal protein L37 (76-84)
cacggcuucagagaggggaccacaccc

SEQ ID NO: 56426 - RNA, 27 nt, Artificial Sequence
  Store-operated calcium entry-associated regulatory factor (103-111)
aucgccuacaaguucggcaaaaccgug

SEQ ID NO: 56427 - RNA, 27 nt, Artificial Sequence
  Ubiquitin-60S ribosomal protein L40 (48-56)
aucauugagcccagccugagacagcuc

SEQ ID NO: 56428 - RNA, 27 nt, Artificial Sequence
  Eukaryotic translation initiation factor 4 gamma 1 (1452-1460)
aucauuuucgagaccccccugagagug

SEQ ID NO: 56429 - RNA, 27 nt, Artificial Sequence
  Vacuolar protein sorting-associated protein 4A (144-152)
auccugcccauuaaguucccucaccuc

SEQ ID NO: 56430 - RNA, 30 nt, Artificial Sequence
  40S ribosomal protein S21 (74-83)
aaggccgacggcaucgugagcaaaaacuuc

SEQ ID NO: 56431 - RNA, 27 nt, Artificial Sequence
  COMM domain-containing protein 3 (187-195)
aagagccuggagagagccacccagcuc

SEQ ID NO: 56432 - RNA, 27 nt, Artificial Sequence
  POTE ankyrin domain family member E (805-813)
cugaccgaggccccccucaacccuaag

SEQ ID NO: 56433 - RNA, 27 nt, Artificial Sequence
  DNA-dependent protein kinase catalytic subunit (1340-1348)
agaaucauggaguucaccacaacucug

SEQ ID NO: 56434 - RNA, 33 nt, Artificial Sequence
  TAR DNA-binding protein 43 (248-258)
agcauggacuccaagucuucaggcugggggaug

SEQ ID NO: 56435 - RNA, 33 nt, Artificial Sequence
  Vimentin (2-12)
agcaccagauccgugucuucaaguagcuacagg

SEQ ID NO: 56436 - RNA, 42 nt, Artificial Sequence
  Vimentin (446-459)
accguggagacaagagacggccaggucaucaacgaaacuagc

SEQ ID NO: 56437 - RNA, 30 nt, Artificial Sequence
  60S ribosomal protein L31 (106-115)
gugaccuacguccccguuacaacuuucaag

SEQ ID NO: 56438 - RNA, 27 nt, Artificial Sequence
  Hemoglobin subunit delta (34-42)
guggucuaccccuggacccagagauuc

SEQ ID NO: 56439 - RNA, 27 nt, Artificial Sequence
  Guanine nucleotide-binding protein subunit beta-2-like 1 (192-200)
accggcuaccugaacacagugacuguc

SEQ ID NO: 56440 - RNA, 24 nt, Artificial Sequence
  Ubiquitin-conjugating enzyme E2 D2 (59-66)
uaccccuucaagccuccaaaagug

SEQ ID NO: 56441 - RNA, 57 nt, Artificial Sequence
  Histone H2B type 2-E (83-101)
gccaagcacgcugugagcgagggcaccaaagcagucacaaaguacacuuccucuaaa

SEQ ID NO: 56442 - RNA, 30 nt, Artificial Sequence
  HLA class II histocompatibility antigen, DP beta 1 chain (9-18)
gcccccagaaccguggcucugacagcacuc

SEQ ID NO: 56443 - RNA, 27 nt, Artificial Sequence
  SWI/SNF-related matrix-associated actin-dependent regulator of chromatin subfamily E member 1 (114-122)
gccuaccacaacagccccgcuuaucug

SEQ ID NO: 56444 - RNA, 27 nt, Artificial Sequence
  Chloride intracellular channel protein 4 (243-251)
gccuacagcgacguggcuaagagacug

SEQ ID NO: 56445 - RNA, 27 nt, Artificial Sequence
  CDK5 regulatory subunit-associated protein 1 (381-389)
gccuacguggagcugguccaccauauc

SEQ ID NO: 56446 - RNA, 30 nt, Artificial Sequence; identical to SEQ ID NO: 32219
  Exocyst complex component 2 (85-94)

SEQ ID NO: 56447 - RNA, 27 nt, Artificial Sequence
  60S ribosomal protein L23a (148-156)
gacguggccaacaagaucggcauuaua

SEQ ID NO: 56448 - RNA, 27 nt, Artificial Sequence
  Spectrin beta chain, non-erythrocytic 1 (1643-1651)
gacuacgccgagaccgugcaccagcug

SEQ ID NO: 56449 - RNA, 27 nt, Artificial Sequence
  Nuclear export mediator factor NEMF (234-242)
gacuacaugaagaccacaagcaacuuc

SEQ ID NO: 56450 - RNA, 27 nt, Artificial Sequence
  Formin-binding protein 1 (189-197)
gacuacagcuccauccugcagaaguuc

SEQ ID NO: 56451 - RNA, 27 nt, Artificial Sequence
  Myosin light polypeptide 6 (94-102)
gacuacguggagggccugagagucuuc

SEQ ID NO: 56452 - RNA, 27 nt, Artificial Sequence
  Sterol regulatory element-binding protein 2 (839-847)
gaguaccugaagcuccuucacagcuuc

SEQ ID NO: 56453 - RNA, 27 nt, Artificial Sequence
  Clathrin heavy chain 1 (1605-1613)
gaguaccugaccaagguggacaaacuc

SEQ ID NO: 56454 - RNA, 30 nt, Artificial Sequence
  Tubulin beta chain (158-167)
gaguaccccgacagaaucaugaacaccuuc

SEQ ID NO: 56455 - RNA, 27 nt, Artificial Sequence
  Histone deacetylase 1 (86-94)
gaguacagcaagcagaugcaaagauuc

SEQ ID NO: 56456 - RNA, 27 nt, Artificial Sequence
  DNA repair protein RAD50 (1281-1289)
gaguacguggaaaaguucuauagaauc

SEQ ID NO: 56457 - RNA, 30 nt, Artificial Sequence
  V-type proton ATPase catalytic subunit A (463-472)
gaguacuaugacaagcacuucaccgaauuu

SEQ ID NO: 56458 - RNA, 27 nt, Artificial Sequence
  Exostosin-2 (609-617)
uucuaccacaaguauuuuaacuaccug

SEQ ID NO: 56459 - RNA, 27 nt, Artificial Sequence
  Late secretory pathway protein AVL9 homolog (280-288)
uucuacaucagccccgugaacaagcug

SEQ ID NO: 56460 - RNA, 33 nt, Artificial Sequence
  60S ribosomal protein L7 (81-91)
uucuacgugcccgccgagccuaagcuggcuuuu

SEQ ID NO: 56461 - RNA, 48 nt, Artificial Sequence
  Elongation factor 1-beta (2-17)
ggcuucggggaccugaagagccccgccggacuccaggugcuuaacgau

SEQ ID NO: 56462 - RNA, 36 nt, Artificial Sequence
  60S ribosomal protein L5 (2-13)
ggcuucgugaaggucguuaaaaacaaggccuacuuu

SEQ ID NO: 56463 - RNA, 27 nt, Artificial Sequence
  Poly(A) RNA polymerase GLD2 (252-260)
ggcuacaucgagagaccccagcugauu

SEQ ID NO: 56464 - RNA, 27 nt, Artificial Sequence
  Mannose-1-phosphate guanyltransferase alpha (166-174)
cacuacguggagaagcccagcaccuuc

SEQ ID NO: 56465 - RNA, 27 nt, Artificial Sequence
  Little elongation complex subunit 2 (341-349)
aucuuccacgaggugccccugaaguuu

SEQ ID NO: 56466 - RNA, 33 nt, Artificial Sequence
  Modulator of apoptosis 1 (92-102)
aucuucaagcccccugacccagauaacaccuuu

SEQ ID NO: 56467 - RNA, 30 nt, Artificial Sequence
  DNA replication licensing factor MCM7 (276-285)
aucuuccugcccauucucagaaccggcuuu

SEQ ID NO: 56468 - RNA, 27 nt, Artificial Sequence
  Putative eukaryotic translation initiation factor 2 subunit 3-like protein (314-322)
aucuucagcaagauugugucccuguuu

SEQ ID NO: 56469 - RNA, 27 nt, Artificial Sequence
  X-ray repair cross-complementing protein 5 (134-142)
aucuucaccgaccugagcuccagauuu

SEQ ID NO: 56470 - RNA, 27 nt, Artificial Sequence
  A-kinase anchor protein 11 (638-646)
aucuucaccaacacaguggccagauuu

SEQ ID NO: 56471 - RNA, 27 nt, Artificial Sequence
  Zinc finger protein 24 (103-111)
auccugcccaaggagcuccagaccugg

SEQ ID NO: 56472 - RNA, 30 nt, Artificial Sequence; identical to SEQ ID NO: 32245
  DNA polymerase epsilon catalytic subunit A (1791-1800)

SEQ ID NO: 56473 - RNA, 27 nt, Artificial Sequence
  G1/S-specific cyclin-E2 (202-210)
aucuacgcccccaagcugcaggaguuc

SEQ ID NO: 56474 - RNA, 27 nt, Artificial Sequence
  A-kinase anchor protein 1, mitochondrial (683-691)
aucuacgcccccccucugccaagccuc

SEQ ID NO: 56475 - RNA, 27 nt, Artificial Sequence
  Signal peptidase complex subunit 1 (37-45)
aucuacggcuauguggccgagcaguuc

SEQ ID NO: 56476 - RNA, 30 nt, Artificial Sequence
  Lon protease homolog, mitochondrial (188-197)
aucuaccacaccggcacauucgcccagauu

SEQ ID NO: 56477 - RNA, 27 nt, Artificial Sequence
  Heterogeneous nuclear ribonucleoprotein L (145-153)
aucuacauugccggccaccccgcuuuc

SEQ ID NO: 56478 - RNA, 27 nt, Artificial Sequence
  Tuftelin-interacting protein 11 (168-176)
aucuacauugacagaggcguggucuuc

SEQ ID NO: 56479 - RNA, 36 nt, Artificial Sequence
  Clathrin heavy chain 1 (882-893)
aucuacauugacagcaacaauaaccccgagagauuc

SEQ ID NO: 56480 - RNA, 27 nt, Artificial Sequence
  Deoxynucleotidyltransferase terminal-interacting protein 1 (232-240)
aucuacauuaagcacccccaucuguuc

SEQ ID NO: 56481 - RNA, 27 nt, Artificial Sequence
  Retinoblastoma-like protein 2 (1012-1020)
aucuacauuaagcagauaaaaaccuuc

SEQ ID NO: 56482 - RNA, 30 nt, Artificial Sequence
  Activator of 90 kDa heat shock protein ATPase homolog 1 (74-83)
aucuacauuagcacccugaagacagaguuc

SEQ ID NO: 56483 - RNA, 33 nt, Artificial Sequence
  Ras-related GTP-binding protein C (99-109)
aucuacaaggacgauauuagcaacuccucuuuc

SEQ ID NO: 56484 - RNA, 27 nt, Artificial Sequence
  Leucine-rich PPR motif-containing protein, mitochondrial (1129-1137)
aucuacaagcccgugaccgacuucuuu

SEQ ID NO: 56485 - RNA, 30 nt, Artificial Sequence
  DNA-directed RNA polymerases I, II, and III subunit RPABC3 (11-20)
aucuaccccguggaccugggcgauaaguuc

SEQ ID NO: 56486 - RNA, 30 nt, Artificial Sequence
  Cullin-4B (362-371)
aucuaccaggacagcuucgagcaaagauuu

SEQ ID NO: 56487 - RNA, 27 nt, Artificial Sequence
  Transmembrane protein 209 (509-517)
aucuaccagagacacguguauaaccug

SEQ ID NO: 56488 - RNA, 27 nt, Artificial Sequence
  Coatomer subunit beta' (535-543)
aucuacaccagcuccgugaacagacug

SEQ ID NO: 56489 - RNA, 27 nt, Artificial Sequence
  Retinoblastoma-like protein 1 (804-812)
aucuacgugggcagagucaagagcuuc

SEQ ID NO: 56490 - RNA, 27 nt, Artificial Sequence
  Vam6/Vps39-like protein (97-105)
aucuacgugcacgaccugcucaccuuc

SEQ ID NO: 56491 - RNA, 33 nt, Artificial Sequence
  DDB1- and CUL4-associated factor 8 (337-347)
aucuacgugaaccccgccaauacccaccaguuc

SEQ ID NO: 56492 - RNA, 27 nt, Artificial Sequence
  60S ribosomal protein L3 (361-369)
aaguucaucgacaccacaagcaaauuu

SEQ ID NO: 56493 - RNA, 27 nt, Artificial Sequence
  Zyxin (193-201)
aaguucacccccguggccagcaaauuu

SEQ ID NO: 56494 - RNA, 27 nt, Artificial Sequence
  Protein SDA1 homolog (8-16)
aagcugcccagcaaccucccucagcuu

SEQ ID NO: 56495 - RNA, 27 nt, Artificial Sequence
  Protein sel-1 homolog 1 (504-512)
aagcaggcccugaaauacuucaaccuc

SEQ ID NO: 56496 - RNA, 27 nt, Artificial Sequence
  Muscleblind-like protein 3 (180-188)
aaguacuuccaccccccugcccaucug

SEQ ID NO: 56497 - RNA, 27 nt, Artificial Sequence
  Nardilysin (660-668)
aaguacaucgccaccgacuucacacug

SEQ ID NO: 56498 - RNA, 27 nt, Artificial Sequence
  U6 snRNA-associated Sm-like protein LSm7 (17-25)
aaguacaucgacaaaaccauuagagug

SEQ ID NO: 56499 - RNA, 30 nt, Artificial Sequence
  RuvB-like 1 (285-294)
aaguacaucgaccagggcauugccgagcug

SEQ ID NO: 56500 - RNA, 27 nt, Artificial Sequence
  Short transient receptor potential channel 4-associated protein (594-602)
aaguacaucaacaccgacgccaaauuc

SEQ ID NO: 56501 - RNA, 27 nt, Artificial Sequence
  Interferon-induced GTP-binding protein Mx2 (223-231)
aaguacauccagagacaacagaccauu

SEQ ID NO: 56502 - RNA, 27 nt, Artificial Sequence
  Centromere protein F (1270-1278)
aaguacaucagcggcccccacgagcug

SEQ ID NO: 56503 - RNA, 27 nt, Artificial Sequence
  Calcium-binding protein 39-like (247-255)
aaguacaucagcaaacccgagaaccug

SEQ ID NO: 56504 - RNA, 27 nt, Artificial Sequence
  Small subunit processome component 20 homolog (1425-1433)
aaguacaucaccgacguggucaaacug

SEQ ID NO: 56505 - RNA, 30 nt, Artificial Sequence
  Poly(A)-specific ribonuclease PARN (21-30)
aaguacaucaccaaaagcuucaacuuuuau

SEQ ID NO: 56506 - RNA, 33 nt, Artificial Sequence
  Elongation of very long chain fatty acids protein 5 (200-210)
aaguacaucacccagggccaacugcuccaguuc

SEQ ID NO: 56507 - RNA, 27 nt, Artificial Sequence
  Phosphate carrier protein, mitochondrial (97-105)
aaguacaaaggcaucuucaacggguuu

SEQ ID NO: 56508 - RNA, 33 nt, Artificial Sequence
  S-adenosylmethionine synthase isoform type-2 (234-244)
aaguaccuggacgaggauaccaucuaucaccuc

SEQ ID NO: 56509 - RNA, 27 nt, Artificial Sequence
  Mitochondrial-processing peptidase subunit alpha (106-114)
aaguaccugagcggcaucgcccacuuc

SEQ ID NO: 56510 - RNA, 27 nt, Artificial Sequence
  DNA ligase 1 (566-574)
aaguaccccgacaucauuagcagaaua

SEQ ID NO: 56511 - RNA, 27 nt, Artificial Sequence
  Gamma-aminobutyric acid receptor-associated protein-like 1 (24-32)
aaguaccccgacagagugccugucauc

SEQ ID NO: 56512 - RNA, 27 nt, Artificial Sequence
  Rho guanine nucleotide exchange factor 2 (366-374)
aaguacccccugcucaucagcagaauu

SEQ ID NO: 56513 - RNA, 24 nt, Artificial Sequence
  ATP-dependent RNA helicase A (169-176)
aaguaccccagcccuuucuuugug

SEQ ID NO: 56514 - RNA, 27 nt, Artificial Sequence
  Translocating chain-associated membrane protein 1 (245-253)
aaguaccagaaaggcuucagccugugg

SEQ ID NO: 56515 - RNA, 27 nt, Artificial Sequence
  NADH dehydrogenase (ubiquinone) iron-sulfur protein 5 (91-99)
aaguacacccccccuccacaccauauc

SEQ ID NO: 56516 - RNA, 27 nt, Artificial Sequence
  Heme oxygenase 2 (124-132)
aaguacguggagagaauccacuauauu

SEQ ID NO: 56517 - RNA, 27 nt, Artificial Sequence
  WD repeat-containing protein 35 (371-379)
aaguacgugaaaggccugaucagcauu

SEQ ID NO: 56518 - RNA, 27 nt, Artificial Sequence
  Zinc finger protein 195 (148-156)
aaguacgugaaaaucuucgacaacuuu

SEQ ID NO: 56519 - RNA, 30 nt, Artificial Sequence
  NADH dehydrogenase (ubiquinone) 1 alpha subcomplex subunit 12 (47-56)
aaguacuaugaggacaacaaacaguucuuu

SEQ ID NO: 56520 - RNA, 45 nt, Artificial Sequence
  Phosphoglycerate kinase 1 (403-417)
cuggagggcaaggugcuccccggggucgacgcccuuagcaacauc

SEQ ID NO: 56521 - RNA, 24 nt, Artificial Sequence
  Superkiller viralicidic activity 2-like 2 (586-593)
cuggagaagagcuucuaccaguuu

SEQ ID NO: 56522 - RNA, 33 nt, Artificial Sequence
  Gamma-interferon-inducible lysosomal thiol reductase (15-25)
cugcuccuugacgugcccaccgccgcuguccag

SEQ ID NO: 56523 - RNA, 45 nt, Artificial Sequence
  Polypyrimidine tract-binding protein 1 (359-373)
cuggugagcaaccucaaucccgagagagucaccccucagucccuu

SEQ ID NO: 56524 - RNA, 30 nt, Artificial Sequence; identical to SEQ ID NO: 32297
  Translocon-associated protein subunit delta (66-75)

SEQ ID NO: 56525 - RNA, 27 nt, Artificial Sequence
  Nuclear factor erythroid 2-related factor 3 (413-421)
cuguaccacgacaucuucagcagacuc

SEQ ID NO: 56526 - RNA, 27 nt, Artificial Sequence
  Rho GTPase-activating protein 1 (181-189)
cuguacaucgugcaccccaccauguuc

SEQ ID NO: 56527 - RNA, 30 nt, Artificial Sequence
  60S ribosomal protein L19 (104-113)
cuguaccucaaggugaaaggcaacgucuuc

SEQ ID NO: 56528 - RNA, 33 nt, Artificial Sequence
  Signal transducer and activator of transcription 1-alpha/beta (667-677)
cuguaccccaacaucgacaaggaucacgccuuc

SEQ ID NO: 56529 - RNA, 27 nt, Artificial Sequence
  BTB/POZ domain-containing protein KCTD20 (142-150)
cuguacagcuccaagcucuauagauuc

SEQ ID NO: 56530 - RNA, 27 nt, Artificial Sequence
  Alpha-taxilin (389-397)
cuguacaccgagaaguucgaagaguuu

SEQ ID NO: 56531 - RNA, 27 nt, Artificial Sequence
  40S ribosomal protein S29 (6-14)
cuguacuggagccaccccagaaaguuc

SEQ ID NO: 56532 - RNA, 42 nt, Artificial Sequence
  Calmodulin (125-138)
augaucagagaggccgacauugauggcgacgggcaggugaac

SEQ ID NO: 56533 - RNA, 27 nt, Artificial Sequence
  Tubulin alpha-1C chain (172-180)
aacuacgccagaggccacuauaccauc

SEQ ID NO: 56534 - RNA, 27 nt, Artificial Sequence
  Sorting nexin-4 (257-265)
aacuacggcagaguguucagcgagugg

SEQ ID NO: 56535 - RNA, 27 nt, Artificial Sequence
  Abl interactor 1 (434-442)
aacuacaucgagaagguggucgccauu

SEQ ID NO: 56536 - RNA, 27 nt, Artificial Sequence
  Unconventional myosin-Id (229-237)
aacuacauccacgugggcgcccagcug

SEQ ID NO: 56537 - RNA, 27 nt, Artificial Sequence
  CTD small phosphatase-like protein 2 (385-393)
aacuacaucaaggaccugaauauucuc

SEQ ID NO: 56538 - RNA, 27 nt, Artificial Sequence
  CWF19-like protein 1 (409-417)
aacuacaagagccaccaucugcagcuc

SEQ ID NO: 56539 - RNA, 27 nt, Artificial Sequence
  Polyadenylate-binding protein-interacting protein 1 (111-119)
aacuaccugagccaccaucucaccauc

SEQ ID NO: 56540 - RNA, 27 nt, Artificial Sequence
  Methionine-tRNA ligase, cytoplasmic (152-160)
aacuacacccuggugagccaccucauc

SEQ ID NO: 56541 - RNA, 27 nt, Artificial Sequence
  Ribosomal RNA processing protein 1 homolog B (648-656)
cccuuccugccuaagccacucuuuuuc

SEQ ID NO: 56542 - RNA, 27 nt, Artificial Sequence
  Ribosome biogenesis protein BRX1 homolog (200-208)
cccuucguggaccacgucuuuaccuuc

SEQ ID NO: 56543 - RNA, 36 nt, Artificial Sequence
  40S ribosomal protein S19 (2-13)
cccggcgugaccgucaaggacguuaaccagcaagag

SEQ ID NO: 56544 - RNA, 51 nt, Artificial Sequence
  Nuclease-sensitive element-binding protein 1 (304-320)
cccccugccgagaacagcuccgcuccagaagcagagcagggcggggccgaa

SEQ ID NO: 56545 - RNA, 27 nt, Artificial Sequence
  Protein AATF (255-263)
ccccagccugacguguucccacuguuu

SEQ ID NO: 56546 - RNA, 30 nt, Artificial Sequence
  pre-mRNA 3' end processing protein WDR33 (495-504)
cccuacgccaagccuaucccagcucaguuc

SEQ ID NO: 56547 - RNA, 27 nt, Artificial Sequence
  Fatty acid desaturase 2 (227-235)
cccuacaaccaccagcaugaguauuuc

SEQ ID NO: 56548 - RNA, 27 nt, Artificial Sequence
  Methionine-tRNA ligase, cytoplasmic (273-281)
cccuacgugaacaaugucccucaccug

SEQ ID NO: 56549 - RNA, 27 nt, Artificial Sequence
  Surfeit locus protein 4 (23-31)
caguaccugccccacguggccagacuc

SEQ ID NO: 56550 - RNA, 33 nt, Artificial Sequence
  Moesin (48-58)
caguaccaagacaccaagggcuucagcacaugg

SEQ ID NO: 56551 - RNA, 27 nt, Artificial Sequence
  Protein BIVM-ERCC5 (1290-1298)
caguacguggacuuccacaaccaacug

SEQ ID NO: 56552 - RNA, 30 nt, Artificial Sequence
  Elongation factor 1-gamma (245-254)
agauuccccgaggaacugacccagacauuu

SEQ ID NO: 56553 - RNA, 27 nt, Artificial Sequence
  60S ribosomal protein L17 (82-90)
agauggcccaagaaaagcgccgaguuc

SEQ ID NO: 56554 - RNA, 30 nt, Artificial Sequence
  Elongation factor 2 (264-273)
agauacuucgaccccgccaacggcaaguuu

SEQ ID NO: 56555 - RNA, 27 nt, Artificial Sequence
  Casein kinase II subunit alpha (195-203)
agauacuucaagggccccgagcugcuc

SEQ ID NO: 56556 - RNA, 27 nt, Artificial Sequence
  Interferon-induced helicase C domain-containing protein 1 (806-814)
agauacggccuggugaccaacgagauc

SEQ ID NO: 56557 - RNA, 27 nt, Artificial Sequence
  Pre-mRNA-processing-splicing factor 8 (1090-1098)
agauacaucgacaggauucacauauuc

SEQ ID NO: 56558 - RNA, 33 nt, Artificial Sequence
  Alpha-enolase (99-109)
agauacaucagccccgaccagcuggccgaucuc

SEQ ID NO: 56559 - RNA, 30 nt, Artificial Sequence
  E3 ubiquitin-protein ligase MGRN1 (24-33)
agauaccccccuaagagcggcaacuauuuc

SEQ ID NO: 56560 - RNA, 27 nt, Artificial Sequence
  Mitotic checkpoint protein BUB3 (274-282)
agauaccccaccagcaucgccucccug

SEQ ID NO: 56561 - RNA, 33 nt, Artificial Sequence
  Mitotic checkpoint protein BUB3 (274-284)
agauaccccaccagcaucgccucccuggcuuuc

SEQ ID NO: 56562 - RNA, 27 nt, Artificial Sequence
  Tyrosine-protein kinase BAZ1B (609-617)
agauaccaggacaucauucacagcaua

SEQ ID NO: 56563 - RNA, 27 nt, Artificial Sequence
  Histone H3.1 (54-62)
agauaccagaagagcaccgagcugcuc

SEQ ID NO: 56564 - RNA, 27 nt, Artificial Sequence
  Thioredoxin-related transmembrane protein 2 (198-206)
agauacaccgacgugagcacaagguau

SEQ ID NO: 56565 - RNA, 30 nt, Artificial Sequence
  Suppressor of fused homolog (146-155)
agauacguguuccagagcgagaacaccuuu

SEQ ID NO: 56566 - RNA, 27 nt, Artificial Sequence
  WD repeat-containing protein 36 (350-358)
agcuucuccaccgugcacgagaaguuu

SEQ ID NO: 56567 - RNA, 27 nt, Artificial Sequence
  Astrocytic phosphoprotein PEA-15 (61-69)
agcuacaucgagcacauuuucgaaaua

SEQ ID NO: 56568 - RNA, 27 nt, Artificial Sequence
  Protein ELYS (236-244)
agcuacaucuccagaaccaaccagcug

SEQ ID NO: 56569 - RNA, 27 nt, Artificial Sequence
  Solute carrier family 23 member 2 (617-625)
agcuaccugcccaucuccccuaccuuc

SEQ ID NO: 56570 - RNA, 27 nt, Artificial Sequence
  Splicing factor 3B subunit 5 (42-50)
agcuacaugggccacuucgaccugcuc

SEQ ID NO: 56571 - RNA, 27 nt, Artificial Sequence
  Lymphokine-activated killer T-cell-originated protein kinase (300-308)
agcuaccagaaggugaucgagcuguuc

SEQ ID NO: 56572 - RNA, 27 nt, Artificial Sequence
  Heterogeneous nuclear ribonucleoprotein F (193-201)
agcuacuccgaccccccucugaaguuc

SEQ ID NO: 56573 - RNA, 24 nt, Artificial Sequence
  Signal transducer and activator of transcription 2 (259-266)
accgccggcgcuaagcugcucuuc

SEQ ID NO: 56574 - RNA, 27 nt, Artificial Sequence
  Zinc finger protein 280C (189-197)
accuucagcgacguggaggcccacuuu

SEQ ID NO: 56575 - RNA, 27 nt, Artificial Sequence
  NADH dehydrogenase (ubiquinone) 1 subunit C2 (107-115)
accuacggcgagaucuucgaaaaguuu

SEQ ID NO: 56576 - RNA, 27 nt, Artificial Sequence
  Peroxisomal acyl-coenzyme A oxidase 3 (142-150)
accuacauccagaagauuuucagaaug

SEQ ID NO: 56577 - RNA, 27 nt, Artificial Sequence
  Oxidative stress-induced growth inhibitor 2 (326-334)
accuacaucacaagcguguccagacug

SEQ ID NO: 56578 - RNA, 27 nt, Artificial Sequence
  Ubiquitin carboxyl-terminal hydrolase 7 (1092-1100)
accuaccuggagaaggccaucaaaauu

SEQ ID NO: 56579 - RNA, 27 nt, Artificial Sequence
  Iron-responsive element-binding protein 2 (410-418)
accuaccugaaggccgugaaacucuuc

SEQ ID NO: 56580 - RNA, 30 nt, Artificial Sequence; identical to SEQ ID NO: 32353
  Cellular tumor antigen p53 (125-134)

SEQ ID NO: 56581 - RNA, 30 nt, Artificial Sequence
  StAR-related lipid transfer protein 7, mitochondrial (95-104)
accuacacagacgugacucccagacaguuc

SEQ ID NO: 56582 - RNA, 33 nt, Artificial Sequence
  StAR-related lipid transfer protein 7, mitochondrial (95-105)
accuacacagacgugacucccagacaguucuuu

SEQ ID NO: 56583 - RNA, 27 nt, Artificial Sequence
  Nesprin-2 (590-598)
accuacguggagaaccugagacuccuu

SEQ ID NO: 56584 - RNA, 27 nt, Artificial Sequence
  Choline/ethanolaminephosphotransferase 1 (200-208)
accuacgugagcggcacacugagauuc

SEQ ID NO: 56585 - RNA, 33 nt, Artificial Sequence
  Bifunctional glutamate/proline-tRNA ligase (557-567)
guguucaucgagggcgccgacgcugaaaccuuu

SEQ ID NO: 56586 - RNA, 27 nt, Artificial Sequence
  F-actin-capping protein subunit alpha-2 (30-38)
guguucaacgacgucagacugcuccuu

SEQ ID NO: 56587 - RNA, 27 nt, Artificial Sequence
  Nucleolysin TIAR (236-244)
guguuccccgagaagggcuacagcuuu

SEQ ID NO: 56588 - RNA, 27 nt, Artificial Sequence
  3-hydroxy-3-methylglutaryl-coenzyme A reductase (105-113)
guguucagcaccgucguuauccacuuu

SEQ ID NO: 56589 - RNA, 33 nt, Artificial Sequence
  H/ACA ribonucleoprotein complex subunit 3 (54-64)
gugcugaugacccagcaacccagaccuguccuc

SEQ ID NO: 56590 - RNA, 27 nt, Artificial Sequence
  40S ribosomal protein S26 (63-71)
gugcugcccaagcucuacgucaaacuu

SEQ ID NO: 56591 - RNA, 36 nt, Artificial Sequence
  60S ribosomal protein L31 (106-117)
gugaccuacguccccguuacaacuuucaagaaccug

SEQ ID NO: 56592 - RNA, 27 nt, Artificial Sequence
  Mitochondrial folate transporter/carrier (299-307)
guguacgagaacgucagccacuuccug

SEQ ID NO: 56593 - RNA, 27 nt, Artificial Sequence
  Protein-lysine N-methyltransferase METTL10 (41-49)
guguacgagagagaacugcagaccuuc

SEQ ID NO: 56594 - RNA, 39 nt, Artificial Sequence
  Nuclear pore complex protein Nup153 (381-393)
guguacuucaagcccagccugaccccuuccggcgaguuu

SEQ ID NO: 56595 - RNA, 27 nt, Artificial Sequence
  Cytochrome c oxidase subunit 4 isoform 1, mitochondrial (125-133)
guguacggcccccugccucagagcuuc

SEQ ID NO: 56596 - RNA, 27 nt, Artificial Sequence
  26S proteasome non-ATPase regulatory subunit 8 (131-139)
guguacaucaagcaccccgucagccug

SEQ ID NO: 56597 - RNA, 30 nt, Artificial Sequence
  DNA replication licensing factor MCM3 (192-201)
guguacaaggaccaccagaccaucacaauu

SEQ ID NO: 56598 - RNA, 30 nt, Artificial Sequence; identical to SEQ ID NO: 32371
  Afadin (161-170)

SEQ ID NO: 56599 - RNA, 27 nt, Artificial Sequence
  Guanine nucleotide-binding protein-like 3-like protein (293-301)
guguaccuggacaaguucaucagacuc

SEQ ID NO: 56600 - RNA, 27 nt, Artificial Sequence
  Rho-related BTB domain-containing protein 1 (526-534)
guguaccugcccaacaucaauaagauu

SEQ ID NO: 56601 - RNA, 30 nt, Artificial Sequence
  Pre-mRNA-splicing factor SPF27 (137-146)
guguacaacgagaaucugguccacaugauc

SEQ ID NO: 56602 - RNA, 27 nt, Artificial Sequence
  Splicing factor 3B subunit 3 (519-527)
guguaccccgacggcaucagacacauu

SEQ ID NO: 56603 - RNA, 30 nt, Artificial Sequence
  Proteasome-associated protein ECM29 homolog (682-691)
guguaccccgagaagcuggccaccaaauuc

SEQ ID NO: 56604 - RNA, 27 nt, Artificial Sequence
  AP-5 complex subunit zeta-1 (388-396)
guguaccagcaccuguucaccagaauc

SEQ ID NO: 56605 - RNA, 33 nt, Artificial Sequence
  Serine/arginine-rich splicing factor 1 (152-162)
guguacagagacggcaccggggucguugaguuc

SEQ ID NO: 56606 - RNA, 27 nt, Artificial Sequence
  Dynamin-2 (124-132)
guguacagcccccacguccugaaccuc

SEQ ID NO: 56607 - RNA, 33 nt, Artificial Sequence
  Dynamin-2 (124-134)
guguacagcccccacguccugaaccucacccuu

SEQ ID NO: 56608 - RNA, 33 nt, Artificial Sequence
  E3 ubiquitin-protein ligase UBR5 (1809-1819)
guguacagccagauccccgccgcugucaagcug

SEQ ID NO: 56609 - RNA, 33 nt, Artificial Sequence
  Ribosome biogenesis protein BMS1 homolog (352-362)
guguacgucgaccugggcgggagccacguuuuc

SEQ ID NO: 56610 - RNA, 27 nt, Artificial Sequence
  BRCA1-associated protein (237-245)
guguacgucgagagagccgaaguucug

SEQ ID NO: 56611 - RNA, 27 nt, Artificial Sequence
  AP-3 complex subunit mu-1 (274-282)
guguacgucaagcacagcaucuccuuc

SEQ ID NO: 56612 - RNA, 27 nt, Artificial Sequence
  Lipopolysaccharide-induced tumor necrosis factor-alpha factor (79-87)
guguacguccagcaccccaucaccuuc

SEQ ID NO: 56613 - RNA, 27 nt, Artificial Sequence
  AP-3 complex subunit delta-1 (521-529)
guguacguccagaacguugugaagcug

SEQ ID NO: 56614 - RNA, 27 nt, Artificial Sequence
  Signal transducer and activator of transcription 2 (828-836)
guguacgucagcagacccucccacuuc

SEQ ID NO: 56615 - RNA, 27 nt, Artificial Sequence
  TraB domain-containing protein (75-83)
guguacgucguuggcaccgcccacuuc

SEQ ID NO: 56616 - RNA, 24 nt, Artificial Sequence
  Dystonin (673-680)
uacgccgagaagcugcacagacuc

SEQ ID NO: 56617 - RNA, 24 nt, Artificial Sequence
  Histone deacetylase 1 (87-94)
uacagcaagcagaugcaaagauuc

SEQ ID NO: 56618 - RNA, 30 nt, Artificial Sequence
  Activator of 90 kDa heat shock protein ATPase homolog 1 (246-255)
uacuauuucgagggcaucaagcagaccuuu

SEQ ID NO: 56619 - RNA, 30 nt, Artificial Sequence
  Phosphatidylinositol 4-kinase alpha (328-337)
uacuauaugaaggaccugcccaccagcuuc

SEQ ID NO: 56620 - RNA, 27 nt, Artificial Sequence
  Eukaryotic translation initiation factor 3 subunit A (275-283)
uacuauaacaaggugagcaccgucuuc

SEQ ID NO: 56621 - RNA, 30 nt, Artificial Sequence
  Eukaryotic translation initiation factor 4 gamma 1 (169-178)
uacuaucccgcccagggcgugcaacaguuc

SEQ ID NO: 56622 - RNA, 27 nt, Artificial Sequence
  40S ribosomal protein S17 (20-28)
uacuauaccagacugggcaacgacuuc

SEQ ID NO: 56623 - RNA, 27 nt, Artificial Sequence
  Transmembrane protein 43 (102-110)
ggcagauucuuucugagcuccgggcuc

SEQ ID NO: 56624 - RNA, 30 nt, Artificial Sequence
  Microsomal glutathione S-transferase 3 (82-91)
caccccagaaucgccagcggccuggggcuc

SEQ ID NO: 56625 - RNA, 27 nt, Artificial Sequence
  Non-specific lipid-transfer protein (373-381)
aagaucggcgggauuuucgccuuuaaa

SEQ ID NO: 56626 - RNA, 24 nt, Artificial Sequence
  Cyclin-dependent kinase 11B (590-597)
uacagagcccccgagcugcuccuu

SEQ ID NO: 56627 - RNA, 27 nt, Artificial Sequence
  Spectrin beta chain, non-erythrocytic 1 (1663-1671)
caccccgagagcgaaagaaucuccaug

SEQ ID NO: 56628 - RNA, 27 nt, Artificial Sequence
  Mitochondrial import receptor subunit TOM7 homolog (44-52)
augcccgagccuaccgugcugagccuc

SEQ ID NO: 56629 - RNA, 27 nt, Artificial Sequence
  Histidine triad nucleotide-binding protein 1 (8-16)
agcccccaggccccuacccacuuccug

SEQ ID NO: 56630 - RNA, 27 nt, Artificial Sequence
  Prolyl endopeptidase (534-542)
gccgaguaccugaucaaggaaggcuau

SEQ ID NO: 56631 - RNA, 30 nt, Artificial Sequence
  Tuftelin-interacting protein 11 (216-225)
gaggaauuccagaaggagcugagccaaugg

SEQ ID NO: 56632 - RNA, 30 nt, Artificial Sequence
  Protein unc-93 homolog B1 (315-324)
gaggaaaucgaccugagaagcgugggcugg

SEQ ID NO: 56633 - RNA, 27 nt, Artificial Sequence
  Spatacsin (901-909)
ggcgaguuccagacccaacacagcuac

SEQ ID NO: 56634 - RNA, 30 nt, Artificial Sequence; identical to SEQ ID NO: 32407
  HLA class I histocompatibility antigen, alpha chain E (109-118)

SEQ ID NO: 56635 - RNA, 27 nt, Artificial Sequence
  Vacuolar protein sorting-associated protein 41 homolog (103-111)
agcgaggacggcaaggugcaggucuuc

SEQ ID NO: 56636 - RNA, 36 nt, Artificial Sequence
  Plastin-3 (65-76)
agcgagcuguccucugaaggcacccagcacucauac

SEQ ID NO: 56637 - RNA, 21 nt, Artificial Sequence
  GTPase-activating protein and VPS9 domain-containing protein 1 (36-42)
gccuucagcauccuguuuaag

SEQ ID NO: 56638 - RNA, 33 nt, Artificial Sequence
  40S ribosomal protein S3 (42-52)
gccaucgcucaggcagagagccugagauacaag

SEQ ID NO: 56639 - RNA, 27 nt, Artificial Sequence
  26S proteasome non-ATPase regulatory subunit 4 (282-290)
gccaucagaaacgcuaugggcagccug

SEQ ID NO: 56640 - RNA, 33 nt, Artificial Sequence
  Exportin-2 (374-384)
gccaucuaccuggugaccagccucgcuuccaag

SEQ ID NO: 56641 - RNA, 27 nt, Artificial Sequence
  DNA-dependent protein kinase catalytic subunit (28-36)
gcccuggcuggccaccagcucaucaga

SEQ ID NO: 56642 - RNA, 27 nt, Artificial Sequence
  Coatomer subunit beta (905-913)
gcccuggcuaacgugagcaucgagaag

SEQ ID NO: 56643 - RNA, 30 nt, Artificial Sequence
  Protein SDE2 homolog (346-355)
gcccuguucgcuaagccccucaaaggcaag

SEQ ID NO: 56644 - RNA, 27 nt, Artificial Sequence
  Cytochrome c oxidase subunit 2 (41-49)
gcccuguuccucacccuuacaacuaag

SEQ ID NO: 56645 - RNA, 27 nt, Artificial Sequence
  ADP-ribosylation factor 5 (7-15)
gcccuguucagcagaaucuuuggcaag

SEQ ID NO: 56646 - RNA, 27 nt, Artificial Sequence
  Similar to 60S ribosomal protein L7 (172-180)
gcccugaucgcuagaagccucggcaag

SEQ ID NO: 56647 - RNA, 30 nt, Artificial Sequence
  Regulation of nuclear pre-mRNA domain-containing protein 2 (166-175)
gcccugaucgaggaacuccuucuguacaag

SEQ ID NO: 56648 - RNA, 33 nt, Artificial Sequence
  Mitochondrial import receptor subunit TOM5 homolog (36-46)
gcccugcucagagugacccccuucauccuuaag

SEQ ID NO: 56649 - RNA, 27 nt, Artificial Sequence
  ADP/ATP translocase 3 (38-46)
gcccugaacuucgcuuuuaaggacaaa

SEQ ID NO: 56650 - RNA, 42 nt, Artificial Sequence
  Heat shock protein HSP 90-beta (536-549)
gcccugagagacaacagcaccaugggcuacaugauggcuaag

SEQ ID NO: 56651 - RNA, 33 nt, Artificial Sequence
  Vimentin (43-53)
gcccugagacccagcaccuccaggucucucuac

SEQ ID NO: 56652 - RNA, 36 nt, Artificial Sequence
  60S ribosomal protein L36 (2-13)
gcccugagauaccccauggcugugggccucaacaag

SEQ ID NO: 56653 - RNA, 27 nt, Artificial Sequence
  Heterogeneous nuclear ribonucleoprotein U-like protein 1 (367-375)
gcccuguacccccacgugcucgucaag

SEQ ID NO: 56654 - RNA, 30 nt, Artificial Sequence
  60S ribosomal protein L6 (61-70)
gccauguacagcagaaaggcuauguauaaa

SEQ ID NO: 56655 - RNA, 27 nt, Artificial Sequence
  HCG15392, isoform CRA_b (43-51)
gcccccgcuccuccaaaggcagaggcc

SEQ ID NO: 56656 - RNA, 33 nt, Artificial Sequence
  Myotrophin (63-73)
gcccccgacaagcaccauaucaccccucugcuc

SEQ ID NO: 56657 - RNA, 24 nt, Artificial Sequence
  Actin, cytoplasmic 1 (14-21)
gcccccgaggaacacccugugcug

SEQ ID NO: 56658 - RNA, 27 nt, Artificial Sequence
  CCR4-NOT transcription complex subunit 1 (239-247)
gcccccuuccugagaaacguggagcuc

SEQ ID NO: 56659 - RNA, 30 nt, Artificial Sequence
  Protein PRRC2A (692-701)
gccccccaggcuccuccaccgcccccuaag

SEQ ID NO: 56660 - RNA, 33 nt, Artificial Sequence
  60S ribosomal protein L13 (47-57)
gcccccagaccugcuagcggcccaaucaggccg

SEQ ID NO: 56661 - RNA, 30 nt, Artificial Sequence
  NSFL1 cofactor p47 (66-75)
gcccccagcgacaacagagugaccuccuuc

SEQ ID NO: 56662 - RNA, 27 nt, Artificial Sequence
  60S ribosomal protein L13 (2-10)
gcccccagcagaaacggcauggugcug

SEQ ID NO: 56663 - RNA, 48 nt, Artificial Sequence
  Heat shock protein HSP 90-beta (534-549)
gcccaggcucugagagacaacagcaccaugggcuacaugauggcaaag

SEQ ID NO: 56664 - RNA, 24 nt, Artificial Sequence
  DNA-directed RNA polymerase II subunit RPB2 (365-372)
gccagaggccccauccagauucug

SEQ ID NO: 56665 - RNA, 24 nt, Artificial Sequence
  Interferon regulatory factor 2-binding protein 1 (263-270)
gccagacccccuggcuacgaguuc

SEQ ID NO: 56666 - RNA, 27 nt, Artificial Sequence
  Serine/threonine-protein kinase 4 (270-278)
gccaccgcuacacagcugcuccaacac

SEQ ID NO: 56667 - RNA, 27 nt, Artificial Sequence
  DNA-dependent protein kinase catalytic subunit (4080-4088)
gccaccgaccccaacauccugggcaga

SEQ ID NO: 56668 - RNA, 30 nt, Artificial Sequence
  S-formylglutathione hydrolase (124-133)
gccaccgaggaccccuggaagacaaacuac

SEQ ID NO: 56669 - RNA, 27 nt, Artificial Sequence
  Probable ATP-dependent RNA helicase DDX6 (267-275)
gccaccuucccccugagcgugcagaag

SEQ ID NO: 56670 - RNA, 30 nt, Artificial Sequence
  General transcription factor II-I repeat domain-containing protein 2B (163-172)
gccacccugaaguggauccucgagaacaaa

SEQ ID NO: 56671 - RNA, 30 nt, Artificial Sequence
  Phosphatidylinositol-binding clathrin assembly protein (29-38)
gccaccacacacgagaucaugggccccaag

SEQ ID NO: 56672 - RNA, 33 nt, Artificial Sequence
  Tubulin alpha-1C chain (340-350)
gccaccuacgcucccgugaucagcgcagagaag

SEQ ID NO: 56673 - RNA, 33 nt, Artificial Sequence
  E3 ubiquitin/ISG15 ligase TRIM25 (592-602)
gccguggcugacaagguccaccugauguacaaa

SEQ ID NO: 56674 - RNA, 36 nt, Artificial Sequence
  Omega-amidase NIT2 (98-109)
gccguguucggccccgacgggacccugcucgcuaag

SEQ ID NO: 56675 - RNA, 27 nt, Artificial Sequence
  Farnesyl pyrophosphate synthase (332-340)
gccguguuccugggccucgcuagaaag

SEQ ID NO: 56676 - RNA, 33 nt, Artificial Sequence
  COP9 signalosome complex subunit 8 (4-14)
gccgugauggcugagagcgcauucuccuuuaag

SEQ ID NO: 56677 - RNA, 33 nt, Artificial Sequence; identical to SEQ ID NO: 32450
  Asparagine-tRNA ligase, cytoplasmic (180-190)

SEQ ID NO: 56678 - RNA, 33 nt, Artificial Sequence
  Ras GTPase-activating protein-binding protein 2 (54-64)
gccguguacggccagaacgacauccaccauaag

SEQ ID NO: 56679 - RNA, 30 nt, Artificial Sequence
  ATP-dependent RNA helicase DHX8 (1045-1054)
gccguguacaacagcuggaagaauaacaaa

SEQ ID NO: 56680 - RNA, 33 nt, Artificial Sequence
  E3 ubiquitin/ISG15 ligase TRIM25 (55-65)
gccguguaccaggcuagaccccaacugcacaag

SEQ ID NO: 56681 - RNA, 33 nt, Artificial Sequence; identical to SEQ ID NO: 32454
  DNA damage-binding protein 1 (869-879)

SEQ ID NO: 56682 - RNA, 27 nt, Artificial Sequence
  Glucose-6-phosphate 1-dehydrogenase (246-254)
gccguguacaccaagaugaugacaaaa

SEQ ID NO: 56683 - RNA, 30 nt, Artificial Sequence
  Glucose-6-phosphate 1-dehydrogenase (246-255)
gccguguacaccaagaugaugacaaaaaag

SEQ ID NO: 56684 - RNA, 27 nt, Artificial Sequence
  COP9 signalosome complex subunit 3 (239-247)
gccuaccacgagcuggcucagguguau

SEQ ID NO: 56685 - RNA, 90 nt, Artificial Sequence
  60 kDa heat shock protein, mitochondrial (315-344)
gacauggccaucgcuaccggcggggcaguguucggagaggaaggucugacacucaaccuugaggauguccagccccacgaccugggcaag

SEQ ID NO: 56686 - RNA, 24 nt, Artificial Sequence
  Protein FAM136A (11-18)
gaggccguggaaagcauggucaag

SEQ ID NO: 56687 - RNA, 27 nt, Artificial Sequence
  60S ribosomal protein L4 (213-221)
gaggacaacggcaucauuaaggccuuc

SEQ ID NO: 56688 - RNA, 33 nt, Artificial Sequence
  Basic leucine zipper and W2 domain-containing protein 2 (51-61)
uuccuggacagcaccggcuccagacucgauuac

SEQ ID NO: 56689 - RNA, 30 nt, Artificial Sequence
  Rab GDP dissociation inhibitor beta (29-38)
uucguguacaagggcgggaaaaucuauaag

SEQ ID NO: 56690 - RNA, 27 nt, Artificial Sequence
  Protein PRRC2C (2390-2398)
uucuacauggacaccagccaccuguuu

SEQ ID NO: 56691 - RNA, 24 nt, Artificial Sequence
  Probable ATP-dependent RNA helicase DDX5 (58-65)
uucuaccaggagcaccccgaccug

SEQ ID NO: 56692 - RNA, 36 nt, Artificial Sequence
  Peroxisomal multifunctional enzyme type 2 (235-246)
ggccuguucgaggugggggccggauggaucgguaag

SEQ ID NO: 56693 - RNA, 27 nt, Artificial Sequence
  RNA cytidine acetyltransferase (821-829)
ggccuguucaacagaaucauuaggaag

SEQ ID NO: 56694 - RNA, 36 nt, Artificial Sequence
  Transgelin-2 (142-153)
ggccuguucagcggggaccccaacugguuuccuaag

SEQ ID NO: 56695 - RNA, 27 nt, Artificial Sequence
  Heterogeneous nuclear ribonucleoprotein Q (269-277)
ggccugaccgacgugauccucuaccac

SEQ ID NO: 56696 - RNA, 27 nt, Artificial Sequence
  Malignant T-cell-amplified sequence 1 (174-182)
ggccuguggcacaugaagaccuacaaa

SEQ ID NO: 56697 - RNA, 30 nt, Artificial Sequence; identical to SEQ ID NO: 32470
  Synaptic vesicle membrane protein VAT-1 homolog (282-291)

SEQ ID NO: 56698 - RNA, 27 nt, Artificial Sequence
  Reticulocalbin-2 (4-12)
ggccccagaaccgccgcucuggggcuc

SEQ ID NO: 56699 - RNA, 30 nt, Artificial Sequence
  Superkiller viralicidic activity 2-like 2 (368-377)
ggcaccaaggggcccagcaacguguucaaa

SEQ ID NO: 56700 - RNA, 30 nt, Artificial Sequence; identical to SEQ ID NO: 32473
  Calnexin (78-87)

SEQ ID NO: 56701 - RNA, 27 nt, Artificial Sequence
  Parafibromin (313-321)
ggcaccuaccacgggaugacacugaag

SEQ ID NO: 56702 - RNA, 27 nt, Artificial Sequence
  Transcription factor 12 (417-425)
cacgccgugggccccagcaccucccug

SEQ ID NO: 56703 - RNA, 30 nt, Artificial Sequence
  GMP synthase (glutamine-hydrolyzing) (436-445)
caccccuucccuggcccagggcuggccauc

SEQ ID NO: 56704 - RNA, 27 nt, Artificial Sequence
  Superkiller viralicidic activity 2-like 2 (807-815)
cacccccugcauaacgacccuaaucuc

SEQ ID NO: 56705 - RNA, 27 nt, Artificial Sequence
  Staphylococcal nuclease domain-containing protein 1 (254-262)
caccccaacggcaauaucaccgagcug

SEQ ID NO: 56706 - RNA, 33 nt, Artificial Sequence
  Extended synaptotagmin-1 (652-662)
cacgugcuggaggcccaggaccucaucgcuaag

SEQ ID NO: 56707 - RNA, 27 nt, Artificial Sequence
  Pre-mRNA-processing factor 19 (442-450)
aucuucgaccagagcggcaccuaccug

SEQ ID NO: 56708 - RNA, 30 nt, Artificial Sequence
  Heterogeneous nuclear ribonucleoprotein C-like 1 (20-29)
aucggcaaccugaauacccucguggucaag

SEQ ID NO: 56709 - RNA, 27 nt, Artificial Sequence
  Catenin alpha-1 (90-98)
auccugcagaagaacgugcccauucuc

SEQ ID NO: 56710 - RNA, 27 nt, Artificial Sequence
  60S ribosomal protein L10a (82-90)
aucccccacauggacauugaggcccug

SEQ ID NO: 56711 - RNA, 33 nt, Artificial Sequence
  Spectrin beta chain, non-erythrocytic 1 (2247-2257)
auccccuaccacagcgaggugccugucucccug

SEQ ID NO: 56712 - RNA, 27 nt, Artificial Sequence
  Bifunctional glutamate/proline-tRNA ligase (415-423)
aucagaaagcccuacauuugggaguau

SEQ ID NO: 56713 - RNA, 27 nt, Artificial Sequence
  Histone deacetylase 1 (79-87)
aucagacccgacaacaugagcgaguac

SEQ ID NO: 56714 - RNA, 27 nt, Artificial Sequence
  DNA replication licensing factor MCM5 (289-297)
aucagaagcuccuacauuagggugcug

SEQ ID NO: 56715 - RNA, 30 nt, Artificial Sequence
  Spectrin beta chain, non-erythrocytic 4 (145-154)
aucguggacggcaaccacagacugacccuc

SEQ ID NO: 56716 - RNA, 27 nt, Artificial Sequence
  Cytochrome c oxidase subunit 2 (209-217)
aucgugcuggagcucauuccccuuaag

SEQ ID NO: 56717 - RNA, 27 nt, Artificial Sequence
  Mitotic checkpoint protein BUB3 (234-242)
aucuaccccgugaacgccauuagcuuc

SEQ ID NO: 56718 - RNA, 27 nt, Artificial Sequence
  Non-POU domain-containing octamer-binding protein (10-18)
aaggccggcgagguguucauccacaaa

SEQ ID NO: 56719 - RNA, 45 nt, Artificial Sequence
  ATP synthase-coupling factor 6, mitochondrial (94-108)
aaguucgaggaccccaaauuugaagugaucgagaagccucaggcc

SEQ ID NO: 56720 - RNA, 27 nt, Artificial Sequence
  60S ribosomal protein L10 (156-164)
aaguucaaauuucccggcagacagaag

SEQ ID NO: 56721 - RNA, 27 nt, Artificial Sequence
  Coatomer subunit beta' (413-421)
aagaucuucaaaaacuuuaaggagaaa

SEQ ID NO: 56722 - RNA, 27 nt, Artificial Sequence
  Elongation factor 2 (571-579)
aagaaaagcgaccccguggucuccuac

SEQ ID NO: 56723 - RNA, 27 nt, Artificial Sequence
  Apoptosis inhibitor 5 (238-246)
aagcuguucgacaaacuccuugaguac

SEQ ID NO: 56724 - RNA, 33 nt, Artificial Sequence
  COX assembly mitochondrial protein 2 homolog (69-79)
aagcuguucaaccccccugaggaaagcgagaaa

SEQ ID NO: 56725 - RNA, 27 nt, Artificial Sequence
  116 kDa U5 small nuclear ribonucleoprotein component (713-721)
aagcugggcgaguucuuucagaccaaa

SEQ ID NO: 56726 - RNA, 27 nt, Artificial Sequence
  40S ribosomal protein S5 (86-94)
aagcugaugaccgugagaaucgucaaa

SEQ ID NO: 56727 - RNA, 27 nt, Artificial Sequence
  60S ribosomal protein L23a (115-123)
aagcuguacgacaucgauguggccaaa

SEQ ID NO: 56728 - RNA, 39 nt, Artificial Sequence
  ATP-citrate synthase (650-662)
aagcuguacagacccggcagcguggccuaugucuccagg

SEQ ID NO: 56729 - RNA, 30 nt, Artificial Sequence
  Signal recognition particle 54 kDa protein (433-442)
aagaugggcgggaucaaaggacuguucaag

SEQ ID NO: 56730 - RNA, 27 nt, Artificial Sequence
  Charged multivesicular body protein 5 (9-17)
aagcccaaagccccuccaccgagccug

SEQ ID NO: 56731 - RNA, 66 nt, Artificial Sequence
  60 kDa heat shock protein, mitochondrial (153-174)
aagccccuggugaucauugccgaggacgucgauggcgaagcucucagcacccuuguucugaacaga

SEQ ID NO: 56732 - RNA, 27 nt, Artificial Sequence
  Lysine-specific histone demethylase 1A (200-208)
aagcccgugagccugggccaggcccuc

SEQ ID NO: 56733 - RNA, 39 nt, Artificial Sequence
  Histone H4 (80-92)
aagaccgugacagccauggacgucguuuacgcucugaaa

SEQ ID NO: 56734 - RNA, 36 nt, Artificial Sequence
  High mobility group protein B1 (76-87)
aagaccuacauccccccuaaaggcgagacaaagaaa

SEQ ID NO: 56735 - RNA, 27 nt, Artificial Sequence
  GMP synthase (glutamine-hydrolyzing) (112-120)
aagguguucggcgggaccguccacaaa

SEQ ID NO: 56736 - RNA, 27 nt, Artificial Sequence
  Splicing factor 3B subunit 1 (554-562)
aaggugaucgacagaauucuguacaaa

SEQ ID NO: 56737 - RNA, 27 nt, Artificial Sequence
  SRSF protein kinase 1 (4-12)
aaggugcuggcccuccaggcuagaaaa

SEQ ID NO: 56738 - RNA, 33 nt, Artificial Sequence
  RANBP2-like and GRIP domain-containing protein 2 (608-618)
aaggugcugccccuccuuaaaaucauuaagaaa

SEQ ID NO: 56739 - RNA, 33 nt, Artificial Sequence
  Cytochrome c oxidase subunit 4 isoform 1, mitochondrial (149-159)
aaggugaaccccauccagggccuggccagcaaa

SEQ ID NO: 56740 - RNA, 27 nt, Artificial Sequence
  PC4 and SFRS1-interacting protein (228-236)
aaggugagccaggucaucauggagaaa

SEQ ID NO: 56741 - RNA, 30 nt, Artificial Sequence
  Rab GDP dissociation inhibitor alpha (103-112)
aagguggucgagggcagcuucguuuacaaa

SEQ ID NO: 56742 - RNA, 27 nt, Artificial Sequence
  Lymphocyte cytosolic protein 2 (468-476)
aagguguacaacauccagauuagauau

SEQ ID NO: 56743 - RNA, 27 nt, Artificial Sequence
  ATP-dependent RNA helicase A (169-177)
aaguaccccagcccuuucuuuguguuc

SEQ ID NO: 56744 - RNA, 57 nt, Artificial Sequence
  Vimentin (79-97)
cugcuccaggacagcguggauuucucccuugccgacgcuaucaacaccgaguuuaag

SEQ ID NO: 56745 - RNA, 27 nt, Artificial Sequence
  Actin, gamma-enteric smooth muscle (200-208)
cugcccgacggccaggugaucaccauu

SEQ ID NO: 56746 - RNA, 27 nt, Artificial Sequence
  Polypyrimidine tract-binding protein 3 (123-131)
cugcccuucggcaaggugaccaaccuc

SEQ ID NO: 56747 - RNA, 27 nt, Artificial Sequence
  Histone deacetylase 1 (373-381)
cugccccacgccccuggcgugcagaug

SEQ ID NO: 56748 - RNA, 30 nt, Artificial Sequence
  Eukaryotic translation initiation factor 4B (90-99)
cugcccaagagcccuccauacaccgccuuc

SEQ ID NO: 56749 - RNA, 27 nt, Artificial Sequence
  DNA polymerase epsilon subunit 3 (10-18)
cugcccaacgccgugaucaccagaauu

SEQ ID NO: 56750 - RNA, 30 nt, Artificial Sequence
  Sorting nexin-1 (270-279)
cugcccagagccgugggcacccagacacuc

SEQ ID NO: 56751 - RNA, 27 nt, Artificial Sequence
  T-complex protein 1 subunit theta (260-268)
cugcccagacucaccccuccagugcuu

SEQ ID NO: 56752 - RNA, 27 nt, Artificial Sequence
  Phosphate carrier protein, mitochondrial (340-348)
cugcccagaccuccaccgcccgagaug

SEQ ID NO: 56753 - RNA, 27 nt, Artificial Sequence
  Protein flightless-1 homolog (881-889)
cugcccagacagccuccaaugagccuc

SEQ ID NO: 56754 - RNA, 27 nt, Artificial Sequence
  Cytochrome c oxidase subunit 2 (78-86)
cugcccagccucagaauccuuuacaug

SEQ ID NO: 56755 - RNA, 27 nt, Artificial Sequence
  BAG family molecular chaperone regulator 3 (188-196)
cugcccagcuccggcagaucuucacuc

SEQ ID NO: 56756 - RNA, 27 nt, Artificial Sequence
  Staphylococcal nuclease domain-containing protein 1 (747-755)
cugcccagcaccagacucggcacacuu

SEQ ID NO: 56757 - RNA, 27 nt, Artificial Sequence
  Beta-enolase (102-110)
cugcccgugccugccuucaacgucauc

SEQ ID NO: 56758 - RNA, 27 nt, Artificial Sequence
  RNA-binding protein 4 (186-194)
cugaccgagcaguacaacgaacaauau

SEQ ID NO: 56759 - RNA, 27 nt, Artificial Sequence
  60S ribosomal protein L13 (150-158)
cugaccggccccgugaugccugucaga

SEQ ID NO: 56760 - RNA, 27 nt, Artificial Sequence
  Proteasome activator complex subunit 3 (29-37)
cugguggccaacuucuuucccaagaaa

SEQ ID NO: 56761 - RNA, 27 nt, Artificial Sequence
  CD99 antigen (1-9)
auggccagaggcgcugcacuggcccuc

SEQ ID NO: 56762 - RNA, 33 nt, Artificial Sequence
  Destrin (115-125)
augaucuacgccagcuccaaggacgcuauuaaa

SEQ ID NO: 56763 - RNA, 36 nt, Artificial Sequence
  Destrin (115-126)
augaucuacgccagcuccaaggacgcuauuaaaaag

SEQ ID NO: 56764 - RNA, 33 nt, Artificial Sequence
  Peroxiredoxin-1 (21-31)
augcccgacggccaguucaaggauaucagccug

SEQ ID NO: 56765 - RNA, 27 nt, Artificial Sequence
  E3 ubiquitin-protein ligase HECTD1 (409-417)
augcccagaggcguggucguuacccug

SEQ ID NO: 56766 - RNA, 33 nt, Artificial Sequence
  Double-stranded RNA-binding protein Staufen homolog 1 (482-492)
augcccagaaccggcaacgggccuaugagcgug

SEQ ID NO: 56767 - RNA, 27 nt, Artificial Sequence
  60S acidic ribosomal protein P2 (1-9)
augagauacguggccagcuaucugcuc

SEQ ID NO: 56768 - RNA, 27 nt, Artificial Sequence
  Eukaryotic translation initiation factor 1A, Y-chromosomal (87-95)
aacaaggccgacgugauccugaaauac

SEQ ID NO: 56769 - RNA, 27 nt, Artificial Sequence
  ATP-dependent RNA helicase DDX24 (498-506)
aaccccaagagacagacccugguguuc

SEQ ID NO: 56770 - RNA, 30 nt, Artificial Sequence
  Transgelin-2 (158-167)
aaccccagaaauuucagcgacaaccagcug

SEQ ID NO: 56771 - RNA, 27 nt, Artificial Sequence
  5'-3' exoribonuclease 2 (456-464)
aaccccagacaggccgcuuacgagaug

SEQ ID NO: 56772 - RNA, 27 nt, Artificial Sequence
  Lysine-specific histone demethylase 1A (407-415)
aacagacugcucgaggccaccagcuac

SEQ ID NO: 56773 - RNA, 27 nt, Artificial Sequence
  Nesprin-2 (5548-5556)
aacagacccgaguucaucaccgaauuu

SEQ ID NO: 56774 - RNA, 27 nt, Artificial Sequence
  Protein DEK (115-123)
aacagacccggcaccgugagcucccug

SEQ ID NO: 56775 - RNA, 27 nt, Artificial Sequence
  ATP-dependent RNA helicase DDX3X (644-652)
aacagcgacggcuacgggggaaauuau

SEQ ID NO: 56776 - RNA, 24 nt, Artificial Sequence
  40S ribosomal protein S26 (108-115)
cccagaccuccaccgaagcccaug

SEQ ID NO: 56777 - RNA, 27 nt, Artificial Sequence
  Tubulin beta chain (43-51)
cagcuggacagaaucagcguguacuau

SEQ ID NO: 56778 - RNA, 27 nt, Artificial Sequence
  Isoleucine-tRNA ligase, cytoplasmic (165-173)
cagcuguacgacaagggccucguguau

SEQ ID NO: 56779 - RNA, 27 nt, Artificial Sequence
  Filamin-A (2017-2025)
cagcccgccagcuucgcugugucccug

SEQ ID NO: 56780 - RNA, 27 nt, Artificial Sequence
  Lysine-specific histone demethylase 1A (574-582)
cagcccaucaccccuggcccaagcauu

SEQ ID NO: 56781 - RNA, 27 nt, Artificial Sequence
  Pericentriolar material 1 protein (1892-1900)
cagcccaacccucugccacucagacuu

SEQ ID NO: 56782 - RNA, 30 nt, Artificial Sequence
  Cytochrome c oxidase subunit 4 isoform 1, mitochondrial (93-102)
cagagcuucgacaaggaguggguggccaaa

SEQ ID NO: 56783 - RNA, 30 nt, Artificial Sequence
  Nucleoporin SEH1 (246-255)
agaaucuucacccugaagcccgugaggaaa

SEQ ID NO: 56784 - RNA, 30 nt, Artificial Sequence
  L-lactate dehydrogenase B chain (270-279)
agaauccaccccgugagcaccauggucaag

SEQ ID NO: 56785 - RNA, 27 nt, Artificial Sequence
  DNA replication licensing factor MCM6 (131-139)
agaaucauugagaaggugauacacagg

SEQ ID NO: 56786 - RNA, 36 nt, Artificial Sequence
  Reticulon-4 (62-73)
agaaucuacaagggcgugauucaggccauacaaaaa

SEQ ID NO: 56787 - RNA, 27 nt, Artificial Sequence
  DNA (cytosine-5)-methyltransferase 1 (1459-1467)
agacuguucggcaacauccucgacaag

SEQ ID NO: 56788 - RNA, 30 nt, Artificial Sequence
  26S protease regulatory subunit 6B (342-351)
agacugaucuucagcaccauuacauccaag

SEQ ID NO: 56789 - RNA, 33 nt, Artificial Sequence
  26S protease regulatory subunit 6A (11-21)
agacugcucgacagcgagaucaagauuaugaaa

SEQ ID NO: 56790 - RNA, 39 nt, Artificial Sequence
  Heat shock 70 kDa protein 4L (128-140)
agacugaugaacgagaccacagccguggcucucgcauac

SEQ ID NO: 56791 - RNA, 30 nt, Artificial Sequence
  DNA-dependent protein kinase catalytic subunit (659-668)
agacugccccucaucagcggcuucuacaag

SEQ ID NO: 56792 - RNA, 30 nt, Artificial Sequence
  Vimentin (69-78)
agacugaggagcuccgugcccggcguccgg

SEQ ID NO: 56793 - RNA, 27 nt, Artificial Sequence
  Cytoskeleton-associated protein 2 (369-377)
agacugagcgaguggaaggccggcaaa

SEQ ID NO: 56794 - RNA, 30 nt, Artificial Sequence
  Coiled-coil domain-containing protein 124 (192-201)
agacugagccagcucaagcaacuucugaaa

SEQ ID NO: 56795 - RNA, 27 nt, Artificial Sequence
  E3 ubiquitin-protein ligase HECTD1 (170-178)
agacugguggaccuccccaucagcaag

SEQ ID NO: 56796 - RNA, 27 nt, Artificial Sequence
  Serine-threonine kinase receptor-associated protein (290-298)
agacuguggcagaccguggucggcaag

SEQ ID NO: 56797 - RNA, 39 nt, Artificial Sequence
  Mitotic checkpoint protein BUB3 (40-52)
agacuguacgacgugcccgccaacagcaugaggcucaag

SEQ ID NO: 56798 - RNA, 27 nt, Artificial Sequence
  DNA damage-binding protein 1 (889-897)
agacuguacgaguggaccacagaaaag

SEQ ID NO: 56799 - RNA, 36 nt, Artificial Sequence
  60S ribosomal protein L23a (129-140)
agacccgacggcgagaagaaagccuacgugaggcug

SEQ ID NO: 56800 - RNA, 27 nt, Artificial Sequence
  26S proteasome non-ATPase regulatory subunit 12 (417-425)
agacccaaggacccuaacaaucugcuc

SEQ ID NO: 56801 - RNA, 27 nt, Artificial Sequence
  Ataxin-3 (188-196)
agacccaagcugaucggcgaggaacuc

SEQ ID NO: 56802 - RNA, 33 nt, Artificial Sequence
  Poly(rC)-binding protein 2 (183-193)
agacccaagccuagcuccucuccagugaucuuc

SEQ ID NO: 56803 - RNA, 27 nt, Artificial Sequence
  40S ribosomal protein S11 (132-140)
agaccccugagcaagaccgugagguuc

SEQ ID NO: 56804 - RNA, 27 nt, Artificial Sequence
  Splicing factor 3B subunit 2 (222-230)
agacccaggggcccuccaccgcccccu

SEQ ID NO: 56805 - RNA, 33 nt, Artificial Sequence
  Vimentin (23-33)
agacccagcuccucuaggucauacgugaccaca

SEQ ID NO: 56806 - RNA, 27 nt, Artificial Sequence
  Elongation factor 1-alpha 1 (240-248)
agacccaccgacaagccucugaggcuc

SEQ ID NO: 56807 - RNA, 30 nt, Artificial Sequence
  Translation initiation factor eIF-2B subunit delta (385-394)
agacccuggcuggagggcaggcacacccuc

SEQ ID NO: 56808 - RNA, 30 nt, Artificial Sequence
  Polyglutamine-binding protein 1 (242-251)
agacccuacccuagcccaggcgccgugcug

SEQ ID NO: 56809 - RNA, 30 nt, Artificial Sequence
  Transcriptional repressor p66-alpha (257-266)
agaagcaucccccaguccgccaccuggaag

SEQ ID NO: 56810 - RNA, 30 nt, Artificial Sequence
  Constitutive coactivator of PPAR-gamma-like protein 1 (313-322)
agaaccgacgauaaggugaucagguucaaa

SEQ ID NO: 56811 - RNA, 33 nt, Artificial Sequence
  Ras GTPase-activating protein-binding protein 1 (247-257)
agaaccuucagcugggccuccgugacaucuaag

SEQ ID NO: 56812 - RNA, 27 nt, Artificial Sequence
  42 kda non-muscle cytoplasmic actin (2-10)
agaguggcccccgaggaacacccuguc

SEQ ID NO: 56813 - RNA, 39 nt, Artificial Sequence
  Heterogeneous nuclear ribonucleoprotein C-like 1 (17-29)
agaguguucaucggcaaccugaauacccucgucguuaag

SEQ ID NO: 56814 - RNA, 36 nt, Artificial Sequence
  Elongation factor 2 (415-426)
agaguguucagcggccuggucuccaccgggcucaag

SEQ ID NO: 56815 - RNA, 27 nt, Artificial Sequence
  Paired amphipathic helix protein Sin3a (1263-1271)
agagugaaguacggcaccgucuucaaa

SEQ ID NO: 56816 - RNA, 36 nt, Artificial Sequence
  Prohibitin (117-128)
agagugcugcccagcaucaccacagagauucucaag

SEQ ID NO: 56817 - RNA, 39 nt, Artificial Sequence
  Coatomer subunit beta (327-339)
agagugcugagcacccccgaccucgaggucaggaagaaa

SEQ ID NO: 56818 - RNA, 27 nt, Artificial Sequence
  Filamin-A (2022-2030)
agagugagggucagcggccaggggcug

SEQ ID NO: 56819 - RNA, 27 nt, Artificial Sequence
  Pre-mRNA-processing-splicing factor 8 (444-452)
agagugagcuaccagaagcugcucaaa

SEQ ID NO: 56820 - RNA, 48 nt, Artificial Sequence
  Ribose-5-phosphate isomerase (219-234)
agaguguacuucggcaugcaggacgggagcgucaacaugagggagaag

SEQ ID NO: 56821 - RNA, 27 nt, Artificial Sequence
  Antigen KI-67 (420-428)
agcgagaaccugcucggcaagcaguuc

SEQ ID NO: 56822 - RNA, 30 nt, Artificial Sequence
  Heterogeneous nuclear ribonucleoproteins A2/B1 (73-82)
agcaucgacggcagaguggucgagcccaag

SEQ ID NO: 56823 - RNA, 30 nt, Artificial Sequence
  Transmembrane and coiled-coil domain-containing protein 1 (107-116)
agcaucuucgacggcagaguggucgccaag

SEQ ID NO: 56824 - RNA, 33 nt, Artificial Sequence
  Phosphoglycerate kinase 1 (87-97)
agccugcucggcaaggacgugcuuuuccugaaa

SEQ ID NO: 56825 - RNA, 27 nt, Artificial Sequence
  Dynein light chain roadblock-type 1 (51-59)
agccugaugcacuccuucauccucaag

SEQ ID NO: 56826 - RNA, 30 nt, Artificial Sequence; identical to SEQ ID NO: 32599
  Vimentin (430-439)

SEQ ID NO: 56827 - RNA, 42 nt, Artificial Sequence
  Vimentin (51-64)
agccuguacgccuccucucccggcgggguguaugcuaccaga

SEQ ID NO: 56828 - RNA, 27 nt, Artificial Sequence
  Fatty acid synthase (2326-2334)
agccccgccccuacccacaacucccug

SEQ ID NO: 56829 - RNA, 27 nt, Artificial Sequence
  Ataxin-2-like protein (516-524)
agccccgccuccccuaagaucucucug

SEQ ID NO: 56830 - RNA, 27 nt, Artificial Sequence
  Chromosome alignment-maintaining phosphoprotein 1 (618-626)
agccccgagcaguccagaaacgugcug

SEQ ID NO: 56831 - RNA, 27 nt, Artificial Sequence
  Rho guanine nucleotide exchange factor 1 (10-18)
agccccggcccuuccagaccagggcug

SEQ ID NO: 56832 - RNA, 30 nt, Artificial Sequence
  Isocitrate dehydrogenase (NADP) cytoplasmic (28-37)
agccccaacggcaccaucagaaauauucug

SEQ ID NO: 56833 - RNA, 27 nt, Artificial Sequence
  Trifunctional enzyme subunit alpha, mitochondrial (56-64)
agccccaacuccaaggugaauacccug

SEQ ID NO: 56834 - RNA, 27 nt, Artificial Sequence
  Cleavage stimulation factor subunit 2 (153-161)
agcccccaggaggccagaaacaugcug

SEQ ID NO: 56835 - RNA, 27 nt, Artificial Sequence
  Poly(rC)-binding protein 1 (173-181)
agcccccagggcagagugaugaccauc

SEQ ID NO: 56836 - RNA, 27 nt, Artificial Sequence
  E3 ubiquitin-protein ligase TRIP12 (1954-1962)
agccccagacugccugugggcggguuc

SEQ ID NO: 56837 - RNA, 27 nt, Artificial Sequence
  Cytoplasmic dynein 1 light intermediate chain 1 (398-406)
agccccagagugccuggcgggucccca

SEQ ID NO: 56838 - RNA, 30 nt, Artificial Sequence
  Telomeric repeat-binding factor 2-interacting protein 1 (154-163)
agccccuccucugugaccggcaacgcccug

SEQ ID NO: 56839 - RNA, 27 nt, Artificial Sequence
  Transketolase (386-394)
agcagacccgagaacgccaucauuuac

SEQ ID NO: 56840 - RNA, 24 nt, Artificial Sequence
  Heterogeneous nuclear ribonucleoprotein K (81-88)
agcuccggccccgagagaauccug

SEQ ID NO: 56841 - RNA, 36 nt, Artificial Sequence
  RNA-binding protein FUS (44-55)
agcaccgacacauccggcuacgggcagucuucauau

SEQ ID NO: 56842 - RNA, 27 nt, Artificial Sequence
  DNA-dependent protein kinase catalytic subunit (1861-1869)
agcaccuucgacacacagaucacuaag

SEQ ID NO: 56843 - RNA, 27 nt, Artificial Sequence
  60S ribosomal protein L10a (153-161)
agcaccaucaaguuccagaugaaaaag

SEQ ID NO: 56844 - RNA, 27 nt, Artificial Sequence
  Cytoskeleton-associated protein 5 (430-438)
agcacccugcccaagucccuccuuaaa

SEQ ID NO: 56845 - RNA, 33 nt, Artificial Sequence
  Dolichyl-diphosphooligosaccharide-proteinosyltransferase subunit 2 (254-264)
agcguggccuccgcugcagccguccugucucac

SEQ ID NO: 56846 - RNA, 27 nt, Artificial Sequence
  Cytoplasmic FMR1-interacting protein 1 (504-512)
agcguguucaaccacgccaucagacau

SEQ ID NO: 56847 - RNA, 27 nt, Artificial Sequence
  Far upstream element-binding protein 3 (77-85)
agcguguacggcuaugggguccagaag

SEQ ID NO: 56848 - RNA, 27 nt, Artificial Sequence
  YTH domain-containing protein 1 (570-578)
agcuacaacgacuaugugagagaguuc

SEQ ID NO: 56849 - RNA, 27 nt, Artificial Sequence
  RNA binding motif protein, X-linked-like-1 (280-288)
agcuacagagacuccuaugagucuuac

SEQ ID NO: 56850 - RNA, 27 nt, Artificial Sequence
  Nuclear pore complex protein Nup98-Nup96 (1516-1524)
accgccgacccccuggauuacagacuc

SEQ ID NO: 56851 - RNA, 27 nt, Artificial Sequence
  Fatty acid synthase (1230-1238)
accgccguggagaacaugcccagccug

SEQ ID NO: 56852 - RNA, 30 nt, Artificial Sequence
  T-complex protein 1 subunit theta (13-22)
accgccuacggccccaacgggaugaauaag

SEQ ID NO: 56853 - RNA, 27 nt, Artificial Sequence
  Eukaryotic translation elongation factor 1 epsilon-1 (114-122)
acccuggccgacauccuccuuuacuau

SEQ ID NO: 56854 - RNA, 27 nt, Artificial Sequence
  Coatomer subunit beta' (828-836)
acccccaacgaggaaagaaaugugaug

SEQ ID NO: 56855 - RNA, 27 nt, Artificial Sequence
  Extended synaptotagmin-1 (769-777)
acccccagaccuacagccgcugagcug

SEQ ID NO: 56856 - RNA, 27 nt, Artificial Sequence
  Serine/arginine repetitive matrix protein 2 (2049-2057)
acccccguggccggcagccagucccug

SEQ ID NO: 56857 - RNA, 27 nt, Artificial Sequence
  Exportin-1 (61-69)
accagaguggacacaauccuggaguuc

SEQ ID NO: 56858 - RNA, 30 nt, Artificial Sequence
  TATA-binding protein-associated factor 2N (41-50)
accacagacagcuccuacggccagaacuau

SEQ ID NO: 56859 - RNA, 30 nt, Artificial Sequence
  Retinoblastoma-associated protein (408-417)
accgugaaccccaaggagagcauccugaaa

SEQ ID NO: 56860 - RNA, 27 nt, Artificial Sequence
  Prosaposin (51-59)
accguguggaacaagcccacagucaaa

SEQ ID NO: 56861 - RNA, 24 nt, Artificial Sequence
  Zinc phosphodiesterase ELAC protein 2 (581-588)
guggagagacugaucagcucccuc

SEQ ID NO: 56862 - RNA, 24 nt, Artificial Sequence
  Antigen KI-67 (75-82)
gugaucgacgagcccgucagacug

SEQ ID NO: 56863 - RNA, 39 nt, Artificial Sequence
  Myb-binding protein 1A (543-555)
gugaucagaagccccucccugcuccagucuggcgccaag

SEQ ID NO: 56864 - RNA, 30 nt, Artificial Sequence
  Filamin-A (331-340)
gugcuguucgccggccagcacaucgcuaag

SEQ ID NO: 56865 - RNA, 27 nt, Artificial Sequence
  Barrier-to-autointegration factor (45-53)
gugcugggccaguuccucguccuuaag

SEQ ID NO: 56866 - RNA, 27 nt, Artificial Sequence
  Protein flightless-1 homolog (179-187)
gugcugaacggcaauccccuccuucac

SEQ ID NO: 56867 - RNA, 27 nt, Artificial Sequence
  Signal recognition particle subunit SRP68 (453-461)
gugcuguacgacagaguccucaaguau

SEQ ID NO: 56868 - RNA, 27 nt, Artificial Sequence
  60S ribosomal protein L7 (83-91)
gugcccgccgagccuaagcuggcuuuc

SEQ ID NO: 56869 - RNA, 27 nt, Artificial Sequence
  Protein FAM219A (74-82)
gugcccaacaagggcuacagcucccug

SEQ ID NO: 56870 - RNA, 30 nt, Artificial Sequence
  Long-chain-fatty-acid-CoA ligase 4 (576-585)
gugcccaaccagaagagacugacccuccuu

SEQ ID NO: 56871 - RNA, 27 nt, Artificial Sequence
  ATP-dependent RNA helicase DDX24 (199-207)
gugcccagaccuguccugagggcccuc

SEQ ID NO: 56872 - RNA, 27 nt, Artificial Sequence
  Ankyrin repeat and KH domain-containing protein 1 (748-756)
gugcccagagucccuacccacacacug

SEQ ID NO: 56873 - RNA, 27 nt, Artificial Sequence
  Nuclear pore complex protein Nup153 (582-590)
gugcccgucgccaagaccgcugagcug

SEQ ID NO: 56874 - RNA, 27 nt, Artificial Sequence
  60S ribosomal protein L27a (104-112)
gugagaagcggcuacuauaagguccug

SEQ ID NO: 56875 - RNA, 27 nt, Artificial Sequence
  RNA-binding protein 4 (197-205)
gugagaacccccuacacaaugagcuau

SEQ ID NO: 56876 - RNA, 33 nt, Artificial Sequence
  Tripeptidyl-peptidase 1 (68-78)
gugagcgaccccuccucuccucaguacggcaag

SEQ ID NO: 56877 - RNA, 33 nt, Artificial Sequence
  Vimentin (31-41)
gugaccacaagcacuagaacguacucccugggc

SEQ ID NO: 56878 - RNA, 30 nt, Artificial Sequence
  60S ribosomal protein L8 (15-24)
guggucuucagagaccccuacagguuuaag

SEQ ID NO: 56879 - RNA, 24 nt, Artificial Sequence
  Non-specific lipid-transfer protein (16-23)
guggucggcguugggaugaccaag

SEQ ID NO: 56880 - RNA, 30 nt, Artificial Sequence
  Filamin-A (391-400)
guggucauccaggaccccaugggccaaaag

SEQ ID NO: 56881 - RNA, 30 nt, Artificial Sequence
  Barrier-to-autointegration factor (44-53)
gugguccugggccaguuccucguucuuaag

SEQ ID NO: 56882 - RNA, 63 nt, Artificial Sequence
  Glyceraldehyde-3-phosphate dehydrogenase (87-107)
uggggcgacgccggggcugaguacguggucgaaagcaccggaguuuucacaacuauggagaag

SEQ ID NO: 56883 - RNA, 27 nt, Artificial Sequence
  Tubulin beta chain (179-187)
uaccccgacagaaucaugaacaccuuc

SEQ ID NO: 56884 - RNA, 27 nt, Artificial Sequence
  RNA-binding protein 14 (249-257)
uacagagcccagcccagcgcuucccug

SEQ ID NO: 56885 - RNA, 27 nt, Artificial Sequence
  RNA-binding protein 14 (237-245)
uacagagcccagcccagcgugucccug

SEQ ID NO: 56886 - RNA, 27 nt, Artificial Sequence
  RNA-binding protein 14 (540-548)
uacagaggccagcccgggaacgccuau

SEQ ID NO: 56887 - RNA, 24 nt, Artificial Sequence
  Cyclin-dependent kinase 9 (194-201)
uacagacccccugagcugcuccuu

SEQ ID NO: 56888 - RNA, 27 nt, Artificial Sequence
  Pre-mRNA-processing-splicing factor 8 (1470-1478)
uacagaaccgacaugauccaggcccug

SEQ ID NO: 56889 - RNA, 36 nt, Artificial Sequence
  Plectin (3167-3178)
uacagcgaccccuccaccggcgagccugccacauau

SEQ ID NO: 56890 - RNA, 27 nt, Artificial Sequence
  Protein SON (1132-1140)
uacaccgacagcuauacagauacuuac

SEQ ID NO: 56891 - RNA, 33 nt, Artificial Sequence
  HLA class I histocompatibility antigen, B-38 alpha chain (140-150)
uucgccuacgacggcaaggauuauaucgcucug

SEQ ID NO: 56892 - RNA, 27 nt, Artificial Sequence
  Proteasome subunit beta type-7 (202-210)
aucgccgcuggcauuuucaacgaccug

SEQ ID NO: 56893 - RNA, 27 nt, Artificial Sequence
  40S ribosomal protein S17 (38-46)
aucgccauuauacccagcaagaaacug

SEQ ID NO: 56894 - RNA, 27 nt, Artificial Sequence
  Neudesin (21-29)
gcccuggcucccggccucccuaccgca

SEQ ID NO: 56895 - RNA, 30 nt, Artificial Sequence
  TRAF2 and NCK-interacting protein kinase (1170-1179)
gccugggcucccaagccuuaccacaaauuc

SEQ ID NO: 56896 - RNA, 27 nt, Artificial Sequence
  Neuroblast differentiation-associated protein AHNAK (739-747)
gacgugcacggccccgauuggcaucug

SEQ ID NO: 56897 - RNA, 27 nt, Artificial Sequence
  Prelamin-A/C (53-61)
gaggaacuggacuuccagaagaacauc

SEQ ID NO: 56898 - RNA, 27 nt, Artificial Sequence
  Protein flightless-1 homolog (1158-1166)
gaguacaugaagcacaccagacuguuc

SEQ ID NO: 56899 - RNA, 27 nt, Artificial Sequence
  Non-POU domain-containing octamer-binding protein (374-382)
uuccccgacgccagagagcaggaaauc

SEQ ID NO: 56900 - RNA, 24 nt, Artificial Sequence
  Probable RNA-binding protein 23 (351-358)
uuccccgacggcgaucaggagcug

SEQ ID NO: 56901 - RNA, 27 nt, Artificial Sequence
  Tubulin beta-6 chain (159-167)
uuccccgacagaaucaugaacaccuuu

SEQ ID NO: 56902 - RNA, 27 nt, Artificial Sequence
  Actin-related protein 2/3 complex subunit 3 (103-111)
uuccccaucccuggcgagccaggguuu

SEQ ID NO: 56903 - RNA, 27 nt, Artificial Sequence
  Solute carrier family 35 member F5 (288-296)
uuccccagcaacuccggcgacagauuu

SEQ ID NO: 56904 - RNA, 30 nt, Artificial Sequence; identical to SEQ ID NO: 32677
  Myoferlin (286-295)

SEQ ID NO: 56905 - RNA, 30 nt, Artificial Sequence
  HLA class I histocompatibility antigen, B-44 alpha chain (216-225)
caccccaucagcgaccaugaggugacccug

SEQ ID NO: 56906 - RNA, 24 nt, Artificial Sequence
  Fructose-bisphosphate aldolase B (192-199)
auccccgacggcgaucacgaccug

SEQ ID NO: 56907 - RNA, 27 nt, Artificial Sequence
  Neutral cholesterol ester hydrolase 1 (34-42)
aaguacuuccugaaacccgaggugcuc

SEQ ID NO: 56908 - RNA, 27 nt, Artificial Sequence
  Vacuolar protein sorting-associated protein 13B (2853-2861)
cugcccgacccuaucauuauacaccuc

SEQ ID NO: 56909 - RNA, 27 nt, Artificial Sequence
  FERM domain-containing protein 6 (550-558)
cuguaccagaaggacuuccucagaauc

SEQ ID NO: 56910 - RNA, 27 nt, Artificial Sequence
  Microtubule-associated protein RP/EB family member 1 (50-58)
augcuguuccccggcagcaucgcccuc

SEQ ID NO: 56911 - RNA, 27 nt, Artificial Sequence
  Cyclic AMP-dependent transcription factor ATF-4 (108-116)
augcccgacgaucugcucaccacacuu

SEQ ID NO: 56912 - RNA, 24 nt, Artificial Sequence
  Neuroblast differentiation-associated protein AHNAK (820-827)
augcccgacguggaucugcaccuc

SEQ ID NO: 56913 - RNA, 27 nt, Artificial Sequence
  Transcription factor AP-1 (42-50)
augguggcccccgcugucgcaagcguu

SEQ ID NO: 56914 - RNA, 27 nt, Artificial Sequence
  Chloride intracellular channel protein 4 (190-198)
aaccugcuccccaagcuucacaucgug

SEQ ID NO: 56915 - RNA, 27 nt, Artificial Sequence
  Growth arrest and DNA damage-inducible protein GADD45 alpha (48-56)
aacguggaccccgauaaugucguucug

SEQ ID NO: 56916 - RNA, 27 nt, Artificial Sequence
  Probable C-mannosyltransferase DPY19L4 (693-701)
aacuacagccccuaugugaauuacuuc

SEQ ID NO: 56917 - RNA, 33 nt, Artificial Sequence
  Integrin alpha-3 (412-422)
cagccccaacaggugauccacggcgagaagcug

SEQ ID NO: 56918 - RNA, 27 nt, Artificial Sequence
  Protein transport protein Sec61 subunit alpha isoform 2 (393-401)
agauacauccccaccgccgcugcauuc

SEQ ID NO: 56919 - RNA, 30 nt, Artificial Sequence
  Tumor suppressor candidate 3 (18-27)
agauaccugcccaccggcagcuucccuuuu

SEQ ID NO: 56920 - RNA, 27 nt, Artificial Sequence
  Rho GTPase-activating protein 7 (915-923)
agcgagggccccccucugagacucugg

SEQ ID NO: 56921 - RNA, 27 nt, Artificial Sequence
  Exosome complex component RRP42 (222-230)
agccuggccucccuccuugugucuguc

SEQ ID NO: 56922 - RNA, 27 nt, Artificial Sequence
  AAC83183.1 (1386-1394)
agccugcucgaccccgugccugagguc

SEQ ID NO: 56923 - RNA, 27 nt, Artificial Sequence
  E3 ubiquitin-protein ligase BRE1A (312-320)
agccuguacggcgggaccaucacaauu

SEQ ID NO: 56924 - RNA, 27 nt, Artificial Sequence
  WD repeat-containing protein 48 (452-460)
agccccgacggcuccgauccuaagcug

SEQ ID NO: 56925 - RNA, 27 nt, Artificial Sequence
  Pericentriolar material 1 protein (1935-1943)
agccccgacaccgaguccccugugcug

SEQ ID NO: 56926 - RNA, 30 nt, Artificial Sequence
  Protein LDOC1 (73-82)
agcuacaugcuggugaacgagaauagauuc

SEQ ID NO: 56927 - RNA, 27 nt, Artificial Sequence
  Nardilysin (1115-1123)
accuaccugcccacaagcccucuccuu

SEQ ID NO: 56928 - RNA, 27 nt, Artificial Sequence
  Calnexin (12-20)
gugcugggcaccgccaucgucgaggcu

SEQ ID NO: 56929 - RNA, 27 nt, Artificial Sequence
  Cleft lip and palate transmembrane protein 1 (107-115)
guguacaucagcgagcacgaacauuuc

SEQ ID NO: 56930 - RNA, 27 nt, Artificial Sequence
  U5 small nuclear ribonucleoprotein 200 kDa helicase (1389-1397)
guguacauggacugguaugagaaguuc

SEQ ID NO: 56931 - RNA, 30 nt, Artificial Sequence
  BTB/POZ domain-containing protein KCTD4 (77-86)
uacuucaucgacagagauggccugcucuuu

SEQ ID NO: 56932 - RNA, 30 nt, Artificial Sequence; identical to SEQ ID NO: 32705
  DNA-binding protein SATB2 (639-648)

SEQ ID NO: 56933 - RNA, 30 nt, Artificial Sequence
  Long-chain-fatty-acid-CoA ligase 4 (238-247)
uaccccgagggcuucgaaauccacagcaug

SEQ ID NO: 56934 - RNA, 30 nt, Artificial Sequence
  Tribbles homolog 3 (259-268)
uaccccuuccaggacagcgagccugugcug

SEQ ID NO: 56935 - RNA, 27 nt, Artificial Sequence
  Protein LAP2 (483-491)
uaccccaccccuuauccagacgagcug

SEQ ID NO: 56936 - RNA, 27 nt, Artificial Sequence
  V-type proton ATPase catalytic subunit A (464-472)
uacuaugacaagcacuucaccgaguuu

SEQ ID NO: 56937 - RNA, 33 nt, Artificial Sequence
  Filamin-B (515-525)
uacuaucccagcaccccuggcagauacuccauc

SEQ ID NO: 56938 - RNA, 27 nt, Artificial Sequence
  Polypyrimidine tract-binding protein 3 (113-121)
uacuauacccccaucacaccucaccug

SEQ ID NO: 56939 - RNA, 27 nt, Artificial Sequence
  Small nuclear ribonucleoprotein E (28-36)
agaagcaggauccagguguggcuguac

SEQ ID NO: 56940 - RNA, 63 nt, Artificial Sequence
  60S ribosomal protein L30 (95-115)
gccaucauugaccccggcgauagcgacauaaucagauccaugccugagcagaccggggaaaag

SEQ ID NO: 56941 - RNA, 30 nt, Artificial Sequence
  Catenin beta-1 (115-124)
gacgccgcucaccccaccaacgugcagaga

SEQ ID NO: 56942 - RNA, 27 nt, Artificial Sequence
  HLA class I histocompatibility antigen, B-51 alpha chain (161-169)
gacaccgccgcucagaucacacaaaga

SEQ ID NO: 56943 - RNA, 27 nt, Artificial Sequence
  Heterogeneous nuclear ribonucleoproteins A2/B1 (139-147)
gacaccaucgagauuauaacagauaga

SEQ ID NO: 56944 - RNA, 27 nt, Artificial Sequence
  Translocon-associated protein subunit beta isoform X1 (107-115)
gacgugagccacaccgucguucugaga

SEQ ID NO: 56945 - RNA, 27 nt, Artificial Sequence
  Actin, aortic smooth muscle (366-374)
gaggccggccccagcaucgugcacaga

SEQ ID NO: 56946 - RNA, 27 nt, Artificial Sequence
  Fructose-bisphosphate aldolase A (35-43)
gagagcaccggcuccaucgccaagaga

SEQ ID NO: 56947 - RNA, 27 nt, Artificial Sequence
  SH3 domain-binding glutamic acid-rich-like protein 3 (23-31)
gaggugaccagaauccuggacggcaag

SEQ ID NO: 56948 - RNA, 48 nt, Artificial Sequence
  HLA class II histocompatibility antigen, DRB1-4 beta chain (62-77)
caccaggaggaauacgugagauucgacagcgaugucggcgaguauagg

SEQ ID NO: 56949 - RNA, 45 nt, Artificial Sequence
  Sodium/potassium-transporting ATPase subunit alpha-1 (60-74)
aucguggucuacaccggcgacagaacaguuauggggaggauugcc

SEQ ID NO: 56950 - RNA, 48 nt, Artificial Sequence
  NEDD4 family-interacting protein 1 (63-78)
aagcccccuagcuacaacguggccaccacacugccauccuaugacgag

SEQ ID NO: 56951 - RNA, 27 nt, Artificial Sequence
  Keratin, type I cytoskeletal 18 (32-40)
agacuggccagcuaccucgacagggug

SEQ ID NO: 56952 - RNA, 27 nt, Artificial Sequence
  60S ribosomal protein L24 (86-94)
agccuggccgacaucauggcuaagaga

SEQ ID NO: 56953 - RNA, 33 nt, Artificial Sequence
  HLA class I histocompatibility antigen, Cw-4 alpha chain (133-143)
accgccgcugacacagcagcccagaucacuaga

SEQ ID NO: 56954 - RNA, 30 nt, Artificial Sequence; identical to SEQ ID NO: 32727
  WD repeat-containing protein 6 (462-471)

SEQ ID NO: 56955 - RNA, 27 nt, Artificial Sequence
  Fatty acid-binding protein, liver (114-122)
acccugggcgacaucguguucaagaga

SEQ ID NO: 56956 - RNA, 27 nt, Artificial Sequence
  Actin, aortic smooth muscle (204-212)
accacagccgagagagaaaucgugagg

SEQ ID NO: 56957 - RNA, 27 nt, Artificial Sequence
  Polymeric immunoglobulin receptor (656-664)
guggccgucggcguugcuagagcaagg

SEQ ID NO: 56958 - RNA, 27 nt, Artificial Sequence
  DAZ-associated protein 2 (63-71)
gccgcuuuccccggcgcaagccuguac

SEQ ID NO: 56959 - RNA, 27 nt, Artificial Sequence
  Kelch-like protein 24 (576-584)
gccgcuaugcccagaccugugagcuac

SEQ ID NO: 56960 - RNA, 27 nt, Artificial Sequence
  Lck-interacting transmembrane adapter 1 (159-167)
gccgcuagccccguggucgcagaguac

SEQ ID NO: 56961 - RNA, 27 nt, Artificial Sequence
  Cysteine-rich protein 2-binding protein (154-162)
gccuucaucgagaagcacuggaccuuu

SEQ ID NO: 56962 - RNA, 27 nt, Artificial Sequence
  Bifunctional 3'-phosphoadenosine 5'-phosphosulfate synthase 2 (479-487)
gccaucuuccccagcccuaugcuguac

SEQ ID NO: 56963 - RNA, 27 nt, Artificial Sequence
  Bifunctional 3'-phosphoadenosine 5'-phosphosulfate synthase 1 (488-496)
gccaucuuccccagcccuaugauguac

SEQ ID NO: 56964 - RNA, 27 nt, Artificial Sequence
  Phosphatidylinositol 5-phosphate 4-kinase type-2 alpha (356-364)
gccaucauugacauacugacccacuac

SEQ ID NO: 56965 - RNA, 30 nt, Artificial Sequence
  Calsyntenin-3 (69-78)
gcccuggacaaggaugcuccccucagauac

SEQ ID NO: 56966 - RNA, 27 nt, Artificial Sequence
  Ras-related protein Rab-20 (156-164)
gcccuguacaagaaaauccucaaguau

SEQ ID NO: 56967 - RNA, 27 nt, Artificial Sequence
  Structure-specific endonuclease subunit SLX4 (1765-1773)
gcccuguaccagaaggugcuccuuuau

SEQ ID NO: 56968 - RNA, 33 nt, Artificial Sequence
  Myosin regulatory light polypeptide 9 (24-34)
gccauguucgaccagagccaaauccaggaguuu

SEQ ID NO: 56969 - RNA, 27 nt, Artificial Sequence
  60S ribosomal protein L6 (61-69)
gccauguacagcagaaaggcuauguau

SEQ ID NO: 56970 - RNA, 27 nt, Artificial Sequence
  Junction plakoglobin (472-480)
gcccagaacagcgugagacugaauuac

SEQ ID NO: 56971 - RNA, 27 nt, Artificial Sequence
  Protein transport protein Sec23B (125-133)
gcccagagcccccugaucuuccucuac

SEQ ID NO: 56972 - RNA, 27 nt, Artificial Sequence
  Centrosome-associated protein 350 (330-338)
gccaccgcucccccugcaccagccuac

SEQ ID NO: 56973 - RNA, 27 nt, Artificial Sequence
  Protein transport protein Sec31A (61-69)
gccaccuucagcuccucucacagauac

SEQ ID NO: 56974 - RNA, 30 nt, Artificial Sequence
  E3 ubiquitin/ISG15 ligase TRIM25 (592-601)
gccguggcugacaagguccaccugauguac

SEQ ID NO: 56975 - RNA, 27 nt, Artificial Sequence
  StAR-related lipid transfer protein 5 (12-20)
gccguggcugagaagaugcugcaguac

SEQ ID NO: 56976 - RNA, 27 nt, Artificial Sequence
  WASH complex subunit 7 (624-632)
gccguggacgcugcaagacugcacuac

SEQ ID NO: 56977 - RNA, 30 nt, Artificial Sequence; identical to SEQ ID NO: 32750
  Nuclear pore membraneoprotein 210 (497-506)

SEQ ID NO: 56978 - RNA, 27 nt, Artificial Sequence
  Lysocardiolipin acyltransferase 1 (91-99)
gccgugcacgacaucaccgucgcuuac

SEQ ID NO: 56979 - RNA, 30 nt, Artificial Sequence; identical to SEQ ID NO: 32752
  Methylsterol monooxygenase 1 (15-24)

SEQ ID NO: 56980 - RNA, 27 nt, Artificial Sequence
  V-type proton ATPase subunit d 1 (111-119)
gccuaccuggagagcuucuauaaguuu

SEQ ID NO: 56981 - RNA, 27 nt, Artificial Sequence
  Protein S100-A9 (67-75)
gacaccaacgccgauaagcagcugagc

SEQ ID NO: 56982 - RNA, 27 nt, Artificial Sequence
  Transcription elongation factor SPT6 (339-347)
gacguguacaaccacuuccugcucuau

SEQ ID NO: 56983 - RNA, 27 nt, Artificial Sequence
  MOB kinase activator 1A (175-183)
gaggaagcccaccugaacaccagcuuc

SEQ ID NO: 56984 - RNA, 27 nt, Artificial Sequence
  HLA class II histocompatibility antigen, DP alpha 1 chain (43-51)
gaggaauucggccaggccuuuagcuuc

SEQ ID NO: 56985 - RNA, 27 nt, Artificial Sequence
  Protein arginine N-methyltransferase 1 (319-327)
gaggaaaucuucggcaccauugggaug

SEQ ID NO: 56986 - RNA, 30 nt, Artificial Sequence
  Puromycin-sensitive aminopeptidase-like protein (113-122)
gaggaaauccacgccaccggcuucaacuac

SEQ ID NO: 56987 - RNA, 30 nt, Artificial Sequence
  Myocyte-specific enhancer factor 2D (127-136)
gaggaacuggacggccucuucagaagguac

SEQ ID NO: 56988 - RNA, 27 nt, Artificial Sequence
  Ribosomal RNA processing protein 36 homolog (132-140)
gagguguucgacaagaccuaccaguuu

SEQ ID NO: 56989 - RNA, 27 nt, Artificial Sequence
  G1/S-specific cyclin-D3 (26-34)
gagguguucccccuggccaugaacuac

SEQ ID NO: 56990 - RNA, 27 nt, Artificial Sequence
  Golgi resident protein GCP60 (490-498)
gagguguacgccggcagccaccaguau

SEQ ID NO: 56991 - RNA, 27 nt, Artificial Sequence
  Dipeptidyl peptidase 1 (375-383)
gagguguacgacgauuuccugcacuau

SEQ ID NO: 56992 - RNA, 27 nt, Artificial Sequence
  Sphingolipid delta(4)-desaturase DES1 (176-184)
uucaucaaccccaagccuauuaccuac

SEQ ID NO: 56993 - RNA, 27 nt, Artificial Sequence
  Histone acetyltransferase KAT6A (600-608)
uuccuggaccacaagacccucuacuau

SEQ ID NO: 56994 - RNA, 27 nt, Artificial Sequence
  Putative ATP-dependent RNA helicase DHX57 (392-400)
uuccuguacgacaaggcccucaccuuu

SEQ ID NO: 56995 - RNA, 27 nt, Artificial Sequence
  Calnexin (230-238)
uucaccgacaagaaaacacaccuguac

SEQ ID NO: 56996 - RNA, 30 nt, Artificial Sequence; identical to SEQ ID NO: 32769
  Histone-arginine methyltransferase CARM1 (584-593)

SEQ ID NO: 56997 - RNA, 42 nt, Artificial Sequence
  Myosin regulatory light chain 12A (164-177)
uucaccagaauccugaagcacggcgccaaagacaaggaugac

SEQ ID NO: 56998 - RNA, 27 nt, Artificial Sequence
  Plastin-3 (324-332)
uucguggccaaccuguuuaauaaguac

SEQ ID NO: 56999 - RNA, 33 nt, Artificial Sequence
  U5 small nuclear ribonucleoprotein 200 kDa helicase (1845-1855)
uucguggcccccgcuaccggcgcacacaacuac

SEQ ID NO: 57000 - RNA, 42 nt, Artificial Sequence
  Cytochrome c oxidase subunit NDUFA4 (19-32)
uucguguuuaucggcaccggggccacaggagcuacucuguac

SEQ ID NO: 57001 - RNA, 27 nt, Artificial Sequence
  Ras-related protein Rab-5B (92-100)
uucgugaagggccaguuucacgaguac

SEQ ID NO: 57002 - RNA, 27 nt, Artificial Sequence
  COP9 signalosome complex subunit 6 (275-283)
uucgugaacaaguuuaauguccuguac

SEQ ID NO: 57003 - RNA, 30 nt, Artificial Sequence
  Probable ATP-dependent RNA helicase DDX5 (549-558)
uucgugagcgccggcauccagaccuccuuu

SEQ ID NO: 57004 - RNA, 30 nt, Artificial Sequence
  Transmembrane protein 258 (37-46)
uucguguacgaggucaccagcacaaaguau

SEQ ID NO: 57005 - RNA, 36 nt, Artificial Sequence
  Dermcidin (97-108)
ggcgccgugcacgacgucaaggauguucuggacagc

SEQ ID NO: 57006 - RNA, 27 nt, Artificial Sequence
  Vacuolar protein sorting-associated protein 51 homolog (121-129)
ggcgccuacgggcaggcugugagauau

SEQ ID NO: 57007 - RNA, 27 nt, Artificial Sequence
  Histone H2B type 2-F (76-84)
ggcgaggccagcagacuggcucacuac

SEQ ID NO: 57008 - RNA, 27 nt, Artificial Sequence
  RING finger and transmembrane domain-containing protein 2 (264-272)
ggcaucgccgacuucgugcugaaguac

SEQ ID NO: 57009 - RNA, 36 nt, Artificial Sequence
  Myosin-9 (1952-1963)
ggcaaggccgacggggcugaggcaaaacccgccgaa

SEQ ID NO: 57010 - RNA, 27 nt, Artificial Sequence
  Inositol 1,4,5-trisphosphate receptor type 3 (2333-2341)
ggccuguucgcccacgagcucuuuuac

SEQ ID NO: 57011 - RNA, 27 nt, Artificial Sequence
  E3 ubiquitin-protein ligase TRIM56 (486-494)
ggccugcuccccagaccuaucuucuac

SEQ ID NO: 57012 - RNA, 27 nt, Artificial Sequence
  Protein transport protein Sec16A (1463-1471)
ggccugugggggcacgcccuccuucug

SEQ ID NO: 57013 - RNA, 27 nt, Artificial Sequence
  DNA repair protein complementing XP-C cells (639-647)
ggccuguacaagaaccacccccucuau

SEQ ID NO: 57014 - RNA, 42 nt, Artificial Sequence
  Heterogeneous nuclear ribonucleoproteins A2/B1 (241-254)
ggcaacuacgggagcggaaauuauaacgacuucgguaauuac

SEQ ID NO: 57015 - RNA, 24 nt, Artificial Sequence
  HLA class I histocompatibility antigen, B-15 alpha chain (25-32)
ggcagccacuccaugagauacuuc

SEQ ID NO: 57016 - RNA, 27 nt, Artificial Sequence
  HLA class I histocompatibility antigen, B-35 alpha chain (25-33)
ggcagccacuccaugagauacuucuau

SEQ ID NO: 57017 - RNA, 27 nt, Artificial Sequence
  Heterogeneous nuclear ribonucleoprotein A1 (310-318)
ggcagcuacaacgacuucgggaauuau

SEQ ID NO: 57018 - RNA, 27 nt, Artificial Sequence
  E3 ubiquitin-protein ligase MARCH6 (620-628)
ggcaccgccaagauccacgagcuguac

SEQ ID NO: 57019 - RNA, 27 nt, Artificial Sequence
  DNA topoisomerase 2-beta (560-568)
ggcaccgccacaaagcaccugacuuac

SEQ ID NO: 57020 - RNA, 27 nt, Artificial Sequence
  Filamin-A (2181-2189)
ggcacccacacagugagcgucaaguac

SEQ ID NO: 57021 - RNA, 27 nt, Artificial Sequence
  Ubiquitin-conjugating enzyme E2 C (71-79)
ggcaccguguacgaggaccugagauau

SEQ ID NO: 57022 - RNA, 30 nt, Artificial Sequence; identical to SEQ ID NO: 32795
  Cold shock domain-containing protein E1 (28-37)

SEQ ID NO: 57023 - RNA, 39 nt, Artificial Sequence
  ADP-ribosylation factor GTPase-activating protein 2 (469-481)
ggcgugaugaacagccugcaggacagauacggguccuau

SEQ ID NO: 57024 - RNA, 27 nt, Artificial Sequence
  Bardet-Biedl syndrome 2 protein (227-235)
ggcguguacgacaagaccagcagauau

SEQ ID NO: 57025 - RNA, 27 nt, Artificial Sequence
  Coatomer subunit alpha (633-641)
ggcuaccccgagguggcccugcacuuc

SEQ ID NO: 57026 - RNA, 33 nt, Artificial Sequence
  Protein S100-A8 (27-37)
cacgccguguacagagacgaucugaagaaacuc

SEQ ID NO: 57027 - RNA, 27 nt, Artificial Sequence
  Zinc finger protein 608 (1347-1355)
cacgccuaccccuauccucagauguac

SEQ ID NO: 57028 - RNA, 27 nt, Artificial Sequence
  Sphingolipid delta(4)-desaturase DES1 (228-236)
cacuucaucgccgagcauuacauguuu

SEQ ID NO: 57029 - RNA, 27 nt, Artificial Sequence
  BTB/POZ domain-containing protein KCTD1 (41-49)
cacaucgacgugggcgggcauauguac

SEQ ID NO: 57030 - RNA, 27 nt, Artificial Sequence
  RNA-binding protein with serine-rich domain 1 (176-184)
cacaucauggagauuuucagcaccuac

SEQ ID NO: 57031 - RNA, 27 nt, Artificial Sequence
  Laminin subunit beta-3 (1158-1166)
cacaucaacggcagagugcuguacuau

SEQ ID NO: 57032 - RNA, 27 nt, Artificial Sequence
  UDP-N-acetylglucosamine-dolichyl-phosphate N-acetylglucosaminephosphotransferase (55-63)
caccuggaccucggcauccuuuacuau

SEQ ID NO: 57033 - RNA, 27 nt, Artificial Sequence
  Nuclear pore complex protein Nup205 (240-248)
caccuguacggcagccuccuuuauuac

SEQ ID NO: 57034 - RNA, 27 nt, Artificial Sequence
  DAZ-associated protein 1 (397-405)
cacaacgugcagggcuuccaucccuac

SEQ ID NO: 57035 - RNA, 27 nt, Artificial Sequence
  pre-mRNA 3' end processing protein WDR33 (19-27)
caccaggcccccagacaacuguucuac

SEQ ID NO: 57036 - RNA, 27 nt, Artificial Sequence
  Nuclear receptor corepressor 2 (34-42)
cacaccgacgugggccugcucgaguac

SEQ ID NO: 57037 - RNA, 27 nt, Artificial Sequence
  Ribosomal protein S6 kinase alpha-1 (517-525)
cacaccaucggcaagacaguggaguac

SEQ ID NO: 57038 - RNA, 27 nt, Artificial Sequence
  Type II inositol 3,4-bisphosphate 4-phosphatase (657-665)
cacaccgugggccugaucguccaguac

SEQ ID NO: 57039 - RNA, 30 nt, Artificial Sequence
  Zinc finger CCHC domain-containing protein 14 (172-181)
cacguggaccuggauagcggccucagauac

SEQ ID NO: 57040 - RNA, 33 nt, Artificial Sequence
  Prefoldin subunit 5 (94-104)
cacgugcugaucgacgucggcaccggguacuau

SEQ ID NO: 57041 - RNA, 27 nt, Artificial Sequence
  Erythroid differentiation-related factor 1 (370-378)
cacgugaacggcaucguccagaaguac

SEQ ID NO: 57042 - RNA, 30 nt, Artificial Sequence
  Protein prenyltransferase alpha subunit repeat-containing protein 1 (213-222)
cacgugagcgaccauuccggcuuccacuac

SEQ ID NO: 57043 - RNA, 27 nt, Artificial Sequence
  Peroxisomal membrane protein PEX14 (119-127)
aucgccuucggcuuucaccagcuguac

SEQ ID NO: 57044 - RNA, 27 nt, Artificial Sequence
  Protein FAM134C (153-161)
aucuucauuagaaacgugcugcucuuu

SEQ ID NO: 57045 - RNA, 27 nt, Artificial Sequence
  Probable ATP-dependent RNA helicase DDX5 (604-612)
aucggcuaccccaugccuaccggguau

SEQ ID NO: 57046 - RNA, 27 nt, Artificial Sequence
  Dolichol kinase (352-360)
aucauuuucgacagaccccugcucuac

SEQ ID NO: 57047 - RNA, 27 nt, Artificial Sequence
  Dolichyl-diphosphooligosaccharide-proteinosyltransferase subunit 2 (410-418)
auccugagcccccuccuucuguuguuc

SEQ ID NO: 57048 - RNA, 33 nt, Artificial Sequence
  Beta-2-microglobulin (21-31)
auccagagaacccccaagauucaaguguacagc

SEQ ID NO: 57049 - RNA, 39 nt, Artificial Sequence
  Beta-2-microglobulin (21-33)
auccagagaacccccaagauucaaguguacagcaggcac

SEQ ID NO: 57050 - RNA, 27 nt, Artificial Sequence
  HLA class I histocompatibility antigen, B-52 alpha chain (90-98)
aucagcaagaccaacacacagacuuac

SEQ ID NO: 57051 - RNA, 33 nt, Artificial Sequence
  Eukaryotic peptide chain release factor subunit 1 (307-317)
aucguguacgagaaccuggacauuaugagauau

SEQ ID NO: 57052 - RNA, 27 nt, Artificial Sequence
  Cyclin-H (138-146)
aaggcccuggagcagauccucgaauac

SEQ ID NO: 57053 - RNA, 30 nt, Artificial Sequence
  Proliferating cell nuclear antigen (240-249)
aagaucgccgacaugggccaccugaaauac

SEQ ID NO: 57054 - RNA, 27 nt, Artificial Sequence
  Protein LAP2 (282-290)
aagaucgacgagaaccagcugauguac

SEQ ID NO: 57055 - RNA, 27 nt, Artificial Sequence
  Beta-2-microglobulin (90-98)
aagaucgugaaaugggacagagauaug

SEQ ID NO: 57056 - RNA, 30 nt, Artificial Sequence
  Ras GTPase-activating-like protein IQGAP1 (94-103)
aagaucuacgacagagagcagaccagguau

SEQ ID NO: 57057 - RNA, 27 nt, Artificial Sequence
  Phosphorylated CTD-interacting factor 1 (363-371)
aagaucuaccacauuagccuggaguau

SEQ ID NO: 57058 - RNA, 27 nt, Artificial Sequence
  Cytoplasmic FMR1-interacting protein 1 (739-747)
aagcuggccgaccagaucuucgcuuac

SEQ ID NO: 57059 - RNA, 30 nt, Artificial Sequence
  Cytoplasmic FMR1-interacting protein 1 (739-748)
aagcuggccgaccagaucuucgcuuacuau

SEQ ID NO: 57060 - RNA, 27 nt, Artificial Sequence
  Golgi-associated PDZ and coiled-coil motif-containing protein (394-402)
aagcuggacgaucuccacacccuuuac

SEQ ID NO: 57061 - RNA, 42 nt, Artificial Sequence
  Oxysterol-binding protein-related protein 8 (705-718)
aagcuguucgagcucgacccccuuaccggcgaauggcacuac

SEQ ID NO: 57062 - RNA, 30 nt, Artificial Sequence
  SHC SH2 domain-binding protein 1 (262-271)
aagcugaucgagaacccccuccuuagauac

SEQ ID NO: 57063 - RNA, 27 nt, Artificial Sequence
  Proteasome subunit alpha type (67-75)
aagcugaacgaguaccuccuucaguau

SEQ ID NO: 57064 - RNA, 27 nt, Artificial Sequence
  Protein farnesyltransferase/geranylgeranyltransferase type-1 subunit alpha (211-219)
aagcugugggacaacgagcuccaguac

SEQ ID NO: 57065 - RNA, 27 nt, Artificial Sequence
  Crooked neck-like protein 1 (615-623)
aagcuguacgagaaauuccucgaauuu

SEQ ID NO: 57066 - RNA, 27 nt, Artificial Sequence
  Tetratricopeptide repeat protein 21B (693-701)
aagauggccgacaucuaccugaaacac

SEQ ID NO: 57067 - RNA, 27 nt, Artificial Sequence
  SPRY domain-containing protein 3 (14-22)
aagauggacgaucugaaccuccacuac

SEQ ID NO: 57068 - RNA, 27 nt, Artificial Sequence
  Phosphatidylinositol 4-kinase alpha (321-329)
aagaugcugagagacacccucuacuau

SEQ ID NO: 57069 - RNA, 27 nt, Artificial Sequence
  Platelet-activating factor acetylhydrolase IB subunit alpha (95-103)
aagaugugggaggugcagaccggcuac

SEQ ID NO: 57070 - RNA, 30 nt, Artificial Sequence
  Clathrin heavy chain 1 (1209-1218)
aagauguacgacgccgcuaaacugcucuau

SEQ ID NO: 57071 - RNA, 27 nt, Artificial Sequence
  Elongation factor Tu GTP-binding domain-containing protein 1 (71-79)
aagagcuccgccaucucucugcacuac

SEQ ID NO: 57072 - RNA, 27 nt, Artificial Sequence
  Elongation factor 2 (71-79)
aagagcaccgccaucucccuguucuac

SEQ ID NO: 57073 - RNA, 27 nt, Artificial Sequence
  Flotillin-2 (214-222)
aagaccgccgaggcucagcuggcauac

SEQ ID NO: 57074 - RNA, 27 nt, Artificial Sequence
  Cytoplasmic dynein 1 heavy chain 1 (2633-2641)
aagaccuucgaccacuacugcgaguau

SEQ ID NO: 57075 - RNA, 27 nt, Artificial Sequence
  Protein RMD5 homolog B (13-21)
aaggugcugcagaaauuccucaccuac

SEQ ID NO: 57076 - RNA, 27 nt, Artificial Sequence
  Probable E3 ubiquitin-protein ligase HECTD4 (700-708)
aaggugcugagcagagcccucauguac

SEQ ID NO: 57077 - RNA, 27 nt, Artificial Sequence
  Cartilage-associated protein (329-337)
aaggugaugcagcaaaaccuggucuac

SEQ ID NO: 57078 - RNA, 27 nt, Artificial Sequence
  KIF1-binding protein (205-213)
aagguguacacccacaaccuguauuac

SEQ ID NO: 57079 - RNA, 30 nt, Artificial Sequence
  Protein S100-A9 (66-75)
cuggacaccaacgccgauaagcagcucagc

SEQ ID NO: 57080 - RNA, 24 nt, Artificial Sequence
  Engulfment and cell motility protein 2 (574-581)
cugaaccacaaggugcuccauuac

SEQ ID NO: 57081 - RNA, 27 nt, Artificial Sequence
  CDNA FLJ25829 fis, clone TST08126 (128-136)
augaccgccaagcugcagacacccuac

SEQ ID NO: 57082 - RNA, 27 nt, Artificial Sequence
  HLA class II histocompatibility antigen, DQ alpha 1 chain (247-255)
aacgccgcugagagaaggggcccccug

SEQ ID NO: 57083 - RNA, 27 nt, Artificial Sequence
  Heat shock protein beta-1 (177-185)
aacgagaucaccauucccgugacauuc

SEQ ID NO: 57084 - RNA, 27 nt, Artificial Sequence
  Serpin B12 (169-177)
aacaagacccagacaauccuguucuac

SEQ ID NO: 57085 - RNA, 27 nt, Artificial Sequence
  S1 RNA-binding domain-containing protein 1 (240-248)
aacaccauccccuucauuauaagauac

SEQ ID NO: 57086 - RNA, 42 nt, Artificial Sequence
  Mediator of RNA polymerase II transcription subunit 12 (2010-2023)
aacacccagccccaaccuagcacaaauaucuucggcagauac

SEQ ID NO: 57087 - RNA, 27 nt, Artificial Sequence
  Agrin (56-64)
aacguggaccccguccagcacaccuac

SEQ ID NO: 57088 - RNA, 27 nt, Artificial Sequence
  Abhydrolase domain-containing protein 2 (306-314)
aacgugaugagaaaguuccacggcuac

SEQ ID NO: 57089 - RNA, 30 nt, Artificial Sequence
  Tubulin beta chain (103-112)
cagaucuucagacccgacaacuuuguguuc

SEQ ID NO: 57090 - RNA, 27 nt, Artificial Sequence
  WD repeat-containing protein 19 (527-535)
cagcuguacgagaagggccucuauuac

SEQ ID NO: 57091 - RNA, 27 nt, Artificial Sequence
  Serine/threonine-protein phosphatase 2A 56 kDa regulatory subunit epsilon isoform (358-366)
cagguggccgagagagcucuguacuau

SEQ ID NO: 57092 - RNA, 30 nt, Artificial Sequence; identical to SEQ ID NO: 32865
  Muskelin (626-635)

SEQ ID NO: 57093 - RNA, 27 nt, Artificial Sequence
  Coatomer subunit beta' (136-144)
cagguguucgagggccacacccauuac

SEQ ID NO: 57094 - RNA, 27 nt, Artificial Sequence
  DNA polymerase epsilon subunit 3 (39-47)
agagccgcuagcguguucguccuguac

SEQ ID NO: 57095 - RNA, 27 nt, Artificial Sequence
  Histone H2B type 1-A (94-102)
agagagauccagaccgccgugaggcug

SEQ ID NO: 57096 - RNA, 27 nt, Artificial Sequence
  26S proteasome non-ATPase regulatory subunit 3 (294-302)
agaaucaaggccauucagcuggaguac

SEQ ID NO: 57097 - RNA, 33 nt, Artificial Sequence
  DNA polymerase delta catalytic subunit (386-396)
agaaucauggaccccgaugugauuaccggcuac

SEQ ID NO: 57098 - RNA, 27 nt, Artificial Sequence
  Protein TASOR (185-193)
agacuggacgauaagaaauuccucuac

SEQ ID NO: 57099 - RNA, 27 nt, Artificial Sequence
  F-box only protein 7 (266-274)
agacuguucaaggaccagcucguguac

SEQ ID NO: 57100 - RNA, 33 nt, Artificial Sequence
  Zinc finger protein 419 (43-53)
agacugcucgacgaugcccagaggcuucuguac

SEQ ID NO: 57101 - RNA, 27 nt, Artificial Sequence
  Angiomotin (17-25)
agacugcuccaggagcaacuuagguac

SEQ ID NO: 57102 - RNA, 27 nt, Artificial Sequence
  Protein Smaug homolog 2 (103-111)
agacugcuccagaaggugcuugccuac

SEQ ID NO: 57103 - RNA, 27 nt, Artificial Sequence
  N-acetylgalactosamine-6-sulfatase (376-384)
agacugauggacaggcccaucuucuac

SEQ ID NO: 57104 - RNA, 27 nt, Artificial Sequence
  Beta-catenin-like protein 1 (330-338)
agacugauggagcuccacuucaaguac

SEQ ID NO: 57105 - RNA, 27 nt, Artificial Sequence
  Mitochondrial folate transporter/carrier (251-259)
agacugcaggaccaacacauguucuac

SEQ ID NO: 57106 - RNA, 27 nt, Artificial Sequence
  Probable C-mannosyltransferase DPY19L3 (411-419)
agacugagcgacacccuccuuuucuac

SEQ ID NO: 57107 - RNA, 27 nt, Artificial Sequence
  Vacuolar protein sorting-associated protein 4A (30-38)
agacuguaccagcacgccguggaguau

SEQ ID NO: 57108 - RNA, 33 nt, Artificial Sequence
  Src substrate cortactin (94-104)
agaauggacaagagcgccgugggccacgaguac

SEQ ID NO: 57109 - RNA, 27 nt, Artificial Sequence
  ATP-dependent RNA helicase DDX42 (292-300)
agaauguucgacaugggcuuugaguac

SEQ ID NO: 57110 - RNA, 27 nt, Artificial Sequence
  Signal peptidase complex catalytic subunit SEC11A (12-20)
agaaugaacaagaggcagcuguacuau

SEQ ID NO: 57111 - RNA, 27 nt, Artificial Sequence
  60S ribosomal protein L24 (47-55)
agacagaucaacuggaccgugcuguac

SEQ ID NO: 57112 - RNA, 39 nt, Artificial Sequence
  Annexin A5 (245-257)
agaagcauccccgccuaccuggcugagacccucuauuac

SEQ ID NO: 57113 - RNA, 27 nt, Artificial Sequence
  Nuclear pore complex protein Nup160 (729-737)
agaaccgccccccugcuccuuagcuac

SEQ ID NO: 57114 - RNA, 30 nt, Artificial Sequence
  Matrin-3 (149-158)
agaaccgaggaaggccccacacugagcuac

SEQ ID NO: 57115 - RNA, 27 nt, Artificial Sequence
  26S proteasome non-ATPase regulatory subunit 2 (673-681)
agaaccuucggccaccugcucagguac

SEQ ID NO: 57116 - RNA, 27 nt, Artificial Sequence
  Tyrosine-protein phosphatase non-receptor type 23 (1272-1280)
agaaccggcgccuucgcucugcucuac

SEQ ID NO: 57117 - RNA, 27 nt, Artificial Sequence
  Msx2-interacting protein (176-184)
agaacccugcagcacggccucuacuau

SEQ ID NO: 57118 - RNA, 27 nt, Artificial Sequence
  NFX1-type zinc finger-containing protein 1 (334-342)
agaaccaugcccaucuacccuacauau

SEQ ID NO: 57119 - RNA, 27 nt, Artificial Sequence
  UPF0505 protein C16orf62 (929-937)
agaaccauggugaagacacuggaguac

SEQ ID NO: 57120 - RNA, 36 nt, Artificial Sequence
  DNA damage-regulated autophagy modulator protein 2 (236-247)
agaguggaggccaaccugcacggccucacccuuuac

SEQ ID NO: 57121 - RNA, 39 nt, Artificial Sequence
  Eukaryotic translation initiation factor 3 subunit C-like protein (873-885)
agaguguucgaccacaagcagggcaccuacgggggauau

SEQ ID NO: 57122 - RNA, 30 nt, Artificial Sequence
  Semaphorin-4C (339-348)
agaguguucgagggccccuacaaggaauau

SEQ ID NO: 57123 - RNA, 27 nt, Artificial Sequence
  Niemann-Pick C1 protein (1077-1085)
agaguguuccccuacagcgucuuuuau

SEQ ID NO: 57124 - RNA, 33 nt, Artificial Sequence
  26S protease regulatory subunit 4 (249-259)
agaguggucggcagcgagcugauccagaaguac

SEQ ID NO: 57125 - RNA, 27 nt, Artificial Sequence
  HLA class II histocompatibility antigen, DRB1-4 beta chain (123-131)
agaguguaccccgaggucaccguuuau

SEQ ID NO: 57126 - RNA, 27 nt, Artificial Sequence
  Sorting nexin-17 (432-440)
agcgccuccgacgugcacggcaacuuc

SEQ ID NO: 57127 - RNA, 27 nt, Artificial Sequence
  Splicing factor 3B subunit 3 (351-359)
agcgaguucggcaaccacuaccuguau

SEQ ID NO: 57128 - RNA, 27 nt, Artificial Sequence
  Mitotic checkpoint protein BUB3 (241-249)
agcuuccacaacauccauaauaccuuu

SEQ ID NO: 57129 - RNA, 27 nt, Artificial Sequence
  Transmembrane 9 superfamily member 2 (545-553)
agcaucuggucccaccagauguacuau

SEQ ID NO: 57130 - RNA, 30 nt, Artificial Sequence
  Vimentin (87-96)
agccuggccgacgcuaucaacaccgaguuc

SEQ ID NO: 57131 - RNA, 30 nt, Artificial Sequence
  Protein PRRC1 (47-56)
agcauggaguccuuccccccucuggccuac

SEQ ID NO: 57132 - RNA, 27 nt, Artificial Sequence
  Heterogeneous nuclear ribonucleoprotein A1 (304-312)
agcaacuucggcgggggagguuccuac

SEQ ID NO: 57133 - RNA, 36 nt, Artificial Sequence
  Cyclin-dependent kinase 19 (490-501)
agccaguaccaccccucccaucaagcccacagauau

SEQ ID NO: 57134 - RNA, 27 nt, Artificial Sequence
  Pre-mRNA-splicing factor ATP-dependent RNA helicase DHX15 (227-235)
agcuccgccaagaccauccugaaauac

SEQ ID NO: 57135 - RNA, 27 nt, Artificial Sequence
  Probable glutamate-tRNA ligase, mitochondrial (249-257)
agcaccgccaagcaccugcuccuuuac

SEQ ID NO: 57136 - RNA, 27 nt, Artificial Sequence
  Chondroitin sulfate proteoglycan 4 (745-753)
agcaccgacccccagcaccaugccuac

SEQ ID NO: 57137 - RNA, 27 nt, Artificial Sequence
  Peroxisomal carnitine O-octanoyltransferase (8-16)
agcaccgaggaaagaacauuccaguac

SEQ ID NO: 57138 - RNA, 33 nt, Artificial Sequence
  WD repeat-containing protein 44 (34-44)
agcaccuucaaggagacagaaaacacugccuac

SEQ ID NO: 57139 - RNA, 27 nt, Artificial Sequence
  Serine/threonine-protein kinase mTOR (1766-1774)
agcaccauccccaaggugcugcaguac

SEQ ID NO: 57140 - RNA, 27 nt, Artificial Sequence
  ADP-ribosylation factor GTPase-activating protein 3 (97-105)
agcaccaacgacacaaaugccaaguac

SEQ ID NO: 57141 - RNA, 33 nt, Artificial Sequence
  Cytochrome c oxidase subunit 1 (9-19)
agcaccaaccacaaggacaucggcacacuguac

SEQ ID NO: 57142 - RNA, 27 nt, Artificial Sequence
  Syntaxin-binding protein 1 (511-519)
agcaccacagccguguccgcuagauac

SEQ ID NO: 57143 - RNA, 27 nt, Artificial Sequence
  Regulator of microtubule dynamics protein 1 (209-217)
agcaccuacgagaaggcccugggcuau

SEQ ID NO: 57144 - RNA, 27 nt, Artificial Sequence
  GPI transamidase component PIG-S (261-269)
agcguggacucccagauccuguacuau

SEQ ID NO: 57145 - RNA, 27 nt, Artificial Sequence
  Ubiquitin-protein ligase E3C (150-158)
agcgugaucgagcagauucugcacuac

SEQ ID NO: 57146 - RNA, 27 nt, Artificial Sequence
  Transcription elongation regulator 1 (419-427)
accgccgacggcaagacauacuauuac

SEQ ID NO: 57147 - RNA, 27 nt, Artificial Sequence
  Sorting nexin-9 (146-154)
accgccuucggccacccccaggcuuac

SEQ ID NO: 57148 - RNA, 27 nt, Artificial Sequence
  Heterogeneous nuclear ribonucleoprotein F (301-309)
accgagaacgacaucuacaauuucuuu

SEQ ID NO: 57149 - RNA, 36 nt, Artificial Sequence; identical to SEQ ID NO: 32922
  N-acetylglucosamine-6-sulfatase (192-203)

SEQ ID NO: 57150 - RNA, 33 nt, Artificial Sequence
  Thymosin beta-4 (34-44)
accaucgagcaggaaaagcaagccggcgagagc

SEQ ID NO: 57151 - RNA, 27 nt, Artificial Sequence
  Integral membrane protein GPR155 (369-377)
accauggaccccaagccucuggccuac

SEQ ID NO: 57152 - RNA, 27 nt, Artificial Sequence
  Intraflagellar transport protein 122 homolog (937-945)
accaugcugggcaaguucuaccacuuu

SEQ ID NO: 57153 - RNA, 33 nt, Artificial Sequence
  Cytochrome c oxidase subunit 2 (182-192)
accacauucacugccacgagacccggcguguac

SEQ ID NO: 57154 - RNA, 36 nt, Artificial Sequence
  Cytochrome c oxidase subunit 2 (182-193)
accacauucacugccacgagacccggcguguacuau

SEQ ID NO: 57155 - RNA, 27 nt, Artificial Sequence
  Calponin-3 (136-144)
accacaaucgacauuggcgugaaguac

SEQ ID NO: 57156 - RNA, 27 nt, Artificial Sequence
  E3 ubiquitin/ISG15 ligase TRIM25 (593-601)
guggccgacaagguccaccugauguac

SEQ ID NO: 57157 - RNA, 27 nt, Artificial Sequence
  T-complex protein 1 subunit eta (127-135)
guggccuucaagaaaaccuuuagcuac

SEQ ID NO: 57158 - RNA, 27 nt, Artificial Sequence
  General transcription factor II-I (324-332)
guggaggaacuguucgagagaaaguac

SEQ ID NO: 57159 - RNA, 27 nt, Artificial Sequence
  Inactive hydroxysteroid dehydrogenase-like protein 1 (133-141)
guguucuaccccuauccucaguacuuu

SEQ ID NO: 57160 - RNA, 27 nt, Artificial Sequence
  NADH dehydrogenase (ubiquinone) 1 alpha subcomplex subunit 3 (30-38)
gugauccugcccccucucagcccauac

SEQ ID NO: 57161 - RNA, 27 nt, Artificial Sequence
  Tribbles homolog 3 (126-134)
gugcuggccggcacccagcuccuuuac

SEQ ID NO: 57162 - RNA, 27 nt, Artificial Sequence
  Transketolase (50-58)
gugcuguucuuucacaccaugagauac

SEQ ID NO: 57163 - RNA, 27 nt, Artificial Sequence
  Unconventional myosin-Id (415-423)
gugcugaagcaggagcaagaagaguac

SEQ ID NO: 57164 - RNA, 27 nt, Artificial Sequence
  Calcyclin-binding protein (63-71)
guggucgcccccaucaccacaggcuac

SEQ ID NO: 57165 - RNA, 27 nt, Artificial Sequence
  Nischarin (324-332)
guggucgacaaccugcagcaccucuac

SEQ ID NO: 57166 - RNA, 27 nt, Artificial Sequence
  F-box only protein 31 (26-34)
guguacgccaagcugcuccacagauau

SEQ ID NO: 57167 - RNA, 27 nt, Artificial Sequence
  DNA replication licensing factor MCM7 (101-109)
guguacaucgagcacagacugaugaug

SEQ ID NO: 57168 - RNA, 27 nt, Artificial Sequence
  MORN repeat-containing protein 1 (31-39)
guguaccccaacagcuucuuuagauau

SEQ ID NO: 57169 - RNA, 30 nt, Artificial Sequence
  Glycoprotein endo-alpha-1,2-mannosidase-like protein (101-110)
guguacagcgaccugcacgccuucuauuac

SEQ ID NO: 57170 - RNA, 30 nt, Artificial Sequence; identical to SEQ ID NO: 32943
  Prolyl endopeptidase (178-187)

SEQ ID NO: 57171 - RNA, 27 nt, Artificial Sequence
  Vimentin (53-61)
uacgccagcucccccggcgggguguau

SEQ ID NO: 57172 - RNA, 27 nt, Artificial Sequence
  NmrA-like family domain-containing protein 1 (73-81)
uacgccaccuucaucgugacaaacuau

SEQ ID NO: 57173 - RNA, 27 nt, Artificial Sequence
  Leukocyte receptor cluster member 8 (111-119)
uacgccuaucccuacagcuauuacuau

SEQ ID NO: 57174 - RNA, 36 nt, Artificial Sequence
  RNMT-activating mini protein (107-118)
uacggcuauaaccagagacccccuuacggguauuac

SEQ ID NO: 57175 - RNA, 27 nt, Artificial Sequence
  Serine/threonine-protein kinase NLK (415-423)
uaccuggacgagggcagacucagguau

SEQ ID NO: 57176 - RNA, 27 nt, Artificial Sequence
  chromosome 1 open reading frame 9, isoform CRA_e (1086-1094)
uaccuggaggaacucagccagagauau

SEQ ID NO: 57177 - RNA, 27 nt, Artificial Sequence
  Chromodomain-helicase-DNA-binding protein 1-like (385-393)
uacauggacuauagaggcuacagcuau

SEQ ID NO: 57178 - RNA, 30 nt, Artificial Sequence
  RNMT-activating mini protein (109-118)
uacaaccagagacccccuuauggcuacuau

SEQ ID NO: 57179 - RNA, 30 nt, Artificial Sequence
  ATP-dependent RNA helicase DDX3X (643-652)
uacaacagcgacggcuaugggggaaauuac

SEQ ID NO: 57180 - RNA, 27 nt, Artificial Sequence
  Histone acetyltransferase KAT6B (551-559)
uacagcucccccuauccucaggaguac

SEQ ID NO: 57181 - RNA, 27 nt, Artificial Sequence
  RNA-binding protein EWS (21-29)
uacaccgcccagcccacacaaggcuau

SEQ ID NO: 57182 - RNA, 30 nt, Artificial Sequence
  Protein FAM26F (92-101)
uacaccuucaaccccaagggccaguauuac

SEQ ID NO: 57183 - RNA, 27 nt, Artificial Sequence
  MORN repeat-containing protein 2 (30-38)
uacaccuuccccaacggcgccaaguau

SEQ ID NO: 57184 - RNA, 27 nt, Artificial Sequence
  Probable ATP-dependent RNA helicase YTHDC2 (389-397)
uacaccaacaaggagaugcugaaauau

SEQ ID NO: 57185 - RNA, 27 nt, Artificial Sequence
  Probable dolichyl pyrophosphate Glc1Man9GlcNAc2 alpha-1,3-glucosyltransferase (204-212)
uacguggcccccgcuuauggcgucuac

SEQ ID NO: 57186 - RNA, 27 nt, Artificial Sequence
  Filamin-A (1581-1589)
uacgugcccgacgucaccggcagauau

SEQ ID NO: 57187 - RNA, 27 nt, Artificial Sequence
  Leucine-rich repeat-containing protein 1 (26-34)
uacgugcccgaggaaaucuauagauac

SEQ ID NO: 57188 - RNA, 27 nt, Artificial Sequence
  Ectopic P granules protein 5 homolog (664-672)
uacgugagcgaccacugggcccaguau

SEQ ID NO: 57189 - RNA, 27 nt, Artificial Sequence
  Sphingomyelin phosphodiesterase 2 (133-141)
uacgugacccaccugcaugccgaguau

SEQ ID NO: 57190 - RNA, 30 nt, Artificial Sequence
  MORN repeat-containing protein 1 (30-39)
uacguguaucccaacagcuucuuuagauac

SEQ ID NO: 57191 - RNA, 27 nt, Artificial Sequence
  Protein polybromo-1 (132-140)
uacuauaagcccgacagcccugaguac

SEQ ID NO: 57192 - RNA, 27 nt, Artificial Sequence
  V-type proton ATPase subunit d 1 (7-15)
uacuaucccgaguacaagcugcucuuc

SEQ ID NO: 57193 - RNA, 51 nt, Artificial Sequence
  Calmodulin (133-149)
ggcgacgggcaggugaacuacgaggaauucguccaaaugaugaccgccaag

SEQ ID NO: 57194 - RNA, 69 nt, Artificial Sequence
  Myosin regulatory light chain 12B (150-172)
aagaaaggcaacuucaauuacaucgaguuuaccagaauucugaagcacggggccaaagacaaggaugac

SEQ ID NO: 57195 - RNA, 63 nt, Artificial Sequence
  HLA class I histocompatibility antigen, B-55 alpha chain (52-72)
guggacgauacccaguucgucagauuugacagcgaugccgcuucccccagggaggaaccucgg

SEQ ID NO: 57196 - RNA, 39 nt, Artificial Sequence
  Sorting nexin-6 (245-257)
gccgcugacgauuacaacagaaucggcagcucccuguau

SEQ ID NO: 57197 - RNA, 27 nt, Artificial Sequence
  Peptidyl-prolyl cis-trans isomerase-like 2 (27-35)
gccaucgacgaggaugugcugagauac

SEQ ID NO: 57198 - RNA, 27 nt, Artificial Sequence
  Nucleolar GTP-binding protein 2 (416-424)
gcccuggacgagaagaucgcuaaauac

SEQ ID NO: 57199 - RNA, 30 nt, Artificial Sequence
  Serine/threonine-protein kinase MRCK alpha (1203-1212)
gcccuggacggcagagagaccgauuucuac

SEQ ID NO: 57200 - RNA, 36 nt, Artificial Sequence
  Cleavage stimulation factor subunit 3 (120-131)
gcccuggacaagaucggcauggagauuaugagcuac

SEQ ID NO: 57201 - RNA, 36 nt, Artificial Sequence
  2-oxoisovalerate dehydrogenase subunit alpha, mitochondrial (80-91)
gcccuggacaacaccgaucucguguucggccaguac

SEQ ID NO: 57202 - RNA, 39 nt, Artificial Sequence
  Structural maintenance of chromosomes protein 1A (1161-1173)
gcccuggacaacaccaauaucggcaagguggcuaacuac

SEQ ID NO: 57203 - RNA, 27 nt, Artificial Sequence
  Ubiquitin-like modifier-activating enzyme 6 (331-339)
gcccuggaccaguuccaagagaaguac

SEQ ID NO: 57204 - RNA, 27 nt, Artificial Sequence
  SWI/SNF-related matrix-associated actin-dependent regulator of chromatin subfamily A member 5 (920-928)
gcccuggacaccaagaucggcagauac

SEQ ID NO: 57205 - RNA, 27 nt, Artificial Sequence
  Eukaryotic translation initiation factor 3 subunit E (54-62)
gccauggacguguacaagaaccuguau

SEQ ID NO: 57206 - RNA, 27 nt, Artificial Sequence
  SAFB-like transcription modulator (735-743)
gccagauucggccacgggagcgacuac

SEQ ID NO: 57207 - RNA, 30 nt, Artificial Sequence
  Putative heat shock protein HSP 90-beta 2 (88-97)
gccagcgacgcucuggauaagaucagauac

SEQ ID NO: 57208 - RNA, 30 nt, Artificial Sequence
  Gelsolin (362-371)
gccagcgacuucaucaccaagauggauuac

SEQ ID NO: 57209 - RNA, 27 nt, Artificial Sequence
  Ubiquitin-like protein 3 (32-40)
gccagcgacaucgcuaagcacguguac

SEQ ID NO: 57210 - RNA, 33 nt, Artificial Sequence
  Proteasome-associated protein ECM29 homolog (1073-1083)
gccagcgaccugucccagcccgaucucguguac

SEQ ID NO: 57211 - RNA, 27 nt, Artificial Sequence
  Kelch repeat and BTB domain-containing protein 6 (147-155)
gccagcgacaugcugcagcucgaguac

SEQ ID NO: 57212 - RNA, 27 nt, Artificial Sequence
  GPN-loop GTPase 2 (210-218)
gccagcgaccccuucuuuagacacuac

SEQ ID NO: 57213 - RNA, 33 nt, Artificial Sequence
  WD repeat-containing protein 81 (817-827)
gccagcgaccccauccacaccuucgaucuguac

SEQ ID NO: 57214 - RNA, 27 nt, Artificial Sequence
  DNA-directed RNA polymerase II subunit RPB2 (1103-1111)
gccagcgaccccuaccaggugcacguc

SEQ ID NO: 57215 - RNA, 27 nt, Artificial Sequence
  DDB1- and CUL4-associated factor 13 (368-376)
gccagcgacagaaacaucgugcuguac

SEQ ID NO: 57216 - RNA, 30 nt, Artificial Sequence
  Probable ATP-dependent RNA helicase DHX37 (105-114)
gccagcgaggcugaaaugagacuguucuac

SEQ ID NO: 57217 - RNA, 36 nt, Artificial Sequence
  Platelet-activating factor acetylhydrolase IB subunit alpha (4-15)
gccagcgaggacgcuaccaucaaggugugggauuac

SEQ ID NO: 57218 - RNA, 30 nt, Artificial Sequence; identical to SEQ ID NO: 32991
  T-complex protein 11-like protein 1 (271-280)

SEQ ID NO: 57219 - RNA, 30 nt, Artificial Sequence
  Splicing factor 3B subunit 3 (350-359)
gccagcgaguucggcaaccacuaccuguau

SEQ ID NO: 57220 - RNA, 39 nt, Artificial Sequence
  Aspartate-tRNA ligase, cytoplasmic (226-238)
gccagcgagggcggggcuaacguguucaccgucuccuac

SEQ ID NO: 57221 - RNA, 42 nt, Artificial Sequence
  MAP kinase-activated protein kinase 2 (163-176)
gccagcgagaucaugaaguccauuggcgaagcuauacaguac

SEQ ID NO: 57222 - RNA, 39 nt, Artificial Sequence
  Thyroid receptor-interacting protein 11 (84-96)
gccagcgagauccagauuaagcaacaguccaccucuuac

SEQ ID NO: 57223 - RNA, 36 nt, Artificial Sequence
  Clusterin-associated protein 1 (160-171)
gccagcgagaucaccuccaagggcgcuucucuguac

SEQ ID NO: 57224 - RNA, 27 nt, Artificial Sequence
  Cleavage stimulation factor subunit 3 (70-78)
gccagcgagcugaaggcucucggcuac

SEQ ID NO: 57225 - RNA, 36 nt, Artificial Sequence
  DNA-dependent protein kinase catalytic subunit (2173-2184)
gccagcgagaacaauggcggggaaggaauccacuac

SEQ ID NO: 57226 - RNA, 30 nt, Artificial Sequence
  Exocyst complex component 4 (72-81)
gccagcgagcccuccgcucagcugucuuac

SEQ ID NO: 57227 - RNA, 36 nt, Artificial Sequence
  Nucleoporin NUP188 homolog (766-777)
gccagcgagcagcaagcucugcacaccgugcaguac

SEQ ID NO: 57228 - RNA, 33 nt, Artificial Sequence
  Ubiquitin carboxyl-terminal hydrolase 32 (141-151)
gccagcgagaccgcuggcuccggguuccuguac

SEQ ID NO: 57229 - RNA, 30 nt, Artificial Sequence
  Low-density lipoprotein receptor class A domain-containing protein 3 (250-259)
gccagcgaggugggcucccccccuucuuac

SEQ ID NO: 57230 - RNA, 27 nt, Artificial Sequence
  Homeodomain-interacting protein kinase 2 (404-412)
gccagcgaguacgaccagaucagauau

SEQ ID NO: 57231 - RNA, 36 nt, Artificial Sequence
  Amyloid protein-binding protein 2 (330-341)
gccaccgcucacgaggaccuggcauacagcuccuau

SEQ ID NO: 57232 - RNA, 39 nt, Artificial Sequence
  Zinc finger protein 318 (1381-1393)
gccaccgcuaacgcaaaggaccuguacgauaucuucuau

SEQ ID NO: 57233 - RNA, 39 nt, Artificial Sequence
  E3 ubiquitin-protein ligase BRE1B (85-97)
gccaccgacgaugcuacacugcucaucgugaacagauac

SEQ ID NO: 57234 - RNA, 27 nt, Artificial Sequence
  O-acetyl-ADP-ribose deacetylase 1 (142-150)
gccaccgacaucaagauuacaguguac

SEQ ID NO: 57235 - RNA, 27 nt, Artificial Sequence
  Coiled-coil domain-containing protein 141 (498-506)
gccaccgaccuggcucagcaccucuac

SEQ ID NO: 57236 - RNA, 30 nt, Artificial Sequence
  Endoribonuclease Dicer (239-248)
gccaccgaccuggugguccucgauagauac

SEQ ID NO: 57237 - RNA, 30 nt, Artificial Sequence; identical to SEQ ID NO: 33010
  EVI5-like protein (131-140)

SEQ ID NO: 57238 - RNA, 27 nt, Artificial Sequence
  Dystonin (4021-4029)
gccaccgacagauucaggagccuguac

SEQ ID NO: 57239 - RNA, 39 nt, Artificial Sequence
  MAP kinase-interacting serine/threonine-protein kinase 2 (71-83)
gccaccgacagcuucuccggcagauuugaggauguguac

SEQ ID NO: 57240 - RNA, 30 nt, Artificial Sequence
  Nicotinamide phosphoribosyltransferase (14-23)
gccaccgacagcuacaaggugacacacuau

SEQ ID NO: 57241 - RNA, 39 nt, Artificial Sequence
  Spectrin beta chain, non-erythrocytic 1 (6-18)
gccaccgacuacgauaacaucgagauucagcaacaguau

SEQ ID NO: 57242 - RNA, 27 nt, Artificial Sequence
  Fibronectin type III domain-containing protein 3B (348-356)
gccaccgacuaccacgugagagucuau

SEQ ID NO: 57243 - RNA, 33 nt, Artificial Sequence
  Coatomer subunit beta' (480-490)
gccaccgaggaaagcuucuuuauccugaaguac

SEQ ID NO: 57244 - RNA, 27 nt, Artificial Sequence
  Cytoplasmic dynein 1 heavy chain 1 (3596-3604)
gccaccgaguucaucaugaacgaauac

SEQ ID NO: 57245 - RNA, 39 nt, Artificial Sequence
  T-complex protein 1 subunit theta (414-426)
gccaccgagaucgaacuggcuaagcagauuacaagcuac

SEQ ID NO: 57246 - RNA, 42 nt, Artificial Sequence
  Protein PRRC2A (1894-1907)
gccaccgagcugggcaagcuccccgcugggggagugcuuuac

SEQ ID NO: 57247 - RNA, 27 nt, Artificial Sequence
  Eukaryotic translation initiation factor 3 subunit D (422-430)
gccaccgagcugaagaacaauagcuac

SEQ ID NO: 57248 - RNA, 27 nt, Artificial Sequence
  Serine/threonine-protein kinase SMG1 (2701-2709)
gccaccgagaugacacugcagagauac

SEQ ID NO: 57249 - RNA, 36 nt, Artificial Sequence
  Protein phosphatase 1G (149-160)
gccaccaugacaaucgaggaacugcucacuagauac

SEQ ID NO: 57250 - RNA, 33 nt, Artificial Sequence
  Alpha-catulin (401-411)
gccacccagcuggcugcagaccuccuuaaguac

SEQ ID NO: 57251 - RNA, 30 nt, Artificial Sequence
  60S ribosomal protein L8 (27-36)
gccguggacuucgcugagagacacggcuac

SEQ ID NO: 57252 - RNA, 30 nt, Artificial Sequence
  Nuclear pore complex protein Nup160 (1036-1045)
gccguggaccugaugacccacaacuacuau

SEQ ID NO: 57253 - RNA, 27 nt, Artificial Sequence
  Chromodomain-helicase-DNA-binding protein 8 (2348-2356)
gccguggaccccagauuccuggcuuac

SEQ ID NO: 57254 - RNA, 36 nt, Artificial Sequence
  Short transient receptor potential channel 4-associated protein (530-541)
gccguggagagcuuccugagaggcaccacauccuac

SEQ ID NO: 57255 - RNA, 30 nt, Artificial Sequence
  TOX high mobility group box family member 4 (107-116)
gaccuggaucacagcaucggcacccaguac

SEQ ID NO: 57256 - RNA, 33 nt, Artificial Sequence
  Nuclear factor of activated T-cells 5 (12-22)
gaccuggaucucgagagccccaagucccuuuac

SEQ ID NO: 57257 - RNA, 27 nt, Artificial Sequence
  Myocyte-specific enhancer factor 2A (61-69)
gacauggauaaggugcugcucaaauac

SEQ ID NO: 57258 - RNA, 30 nt, Artificial Sequence
  Elongator complex protein 5 (57-66)
gacagcgauaucaacaauagacugguguac

SEQ ID NO: 57259 - RNA, 36 nt, Artificial Sequence
  Tubulin beta chain (39-50)
gacagcgaucugcagcucgacagaaucuccguguac

SEQ ID NO: 57260 - RNA, 39 nt, Artificial Sequence
  Tubulin beta chain (39-51)
gacagcgaucugcagcucgacagaaucuccguguacuau

SEQ ID NO: 57261 - RNA, 39 nt, Artificial Sequence
  Protein FAM13A (271-283)
gacagcgaucccaugcuguccccuagauucuacgccuau

SEQ ID NO: 57262 - RNA, 39 nt, Artificial Sequence
  Eukaryotic translation initiation factor 4B (229-241)
gacagcgauagauacagggacggcuaucgggauggguac

SEQ ID NO: 57263 - RNA, 36 nt, Artificial Sequence
  Eukaryotic translation initiation factor 4 gamma 3 (1501-1512)
gacagcgauaccgagaaggaacugcaggcccucuac

SEQ ID NO: 57264 - RNA, 36 nt, Artificial Sequence
  GPI transamidase component PIG-T (51-62)
gacagcgagcugcagagagaaggcgugucccacuac

SEQ ID NO: 57265 - RNA, 30 nt, Artificial Sequence
  Inositol 1,4,5-trisphosphate receptor type 1 (2098-2107)
gacagcgagaacgccgaaagaauccuguac

SEQ ID NO: 57266 - RNA, 27 nt, Artificial Sequence
  Transcription factor E2F3 (290-298)
gacagcgagaaccagagacuggccuac

SEQ ID NO: 57267 - RNA, 36 nt, Artificial Sequence
  Zinc finger MYND domain-containing protein 11 (140-151)
gacagcgagcaggccgauaucgcuagaaugcuguac

SEQ ID NO: 57268 - RNA, 27 nt, Artificial Sequence
  Tubulin-specific chaperone cofactor E-like protein (299-307)
gacagcgagagauucuuuaucagguac

SEQ ID NO: 57269 - RNA, 33 nt, Artificial Sequence
  Matrin-3 (233-243)
gacagcuucuuuggcgagaccucccacaacuac

SEQ ID NO: 57270 - RNA, 33 nt, Artificial Sequence
  Calcium and integrin-binding protein 1 (100-110)
gacaccgccacacccgauaucaagagccacuac

SEQ ID NO: 57271 - RNA, 36 nt, Artificial Sequence
  SAFB-like transcription modulator (732-743)
gacaccgaugccagauucggccacgggagcgacuac

SEQ ID NO: 57272 - RNA, 27 nt, Artificial Sequence
  Calnexin (92-100)
gacaccgaugacgagaucgccaaguac

SEQ ID NO: 57273 - RNA, 30 nt, Artificial Sequence
  Phospholipid scramblase 4 (159-168)
gacaccgaugacuucacaagaaacgccuac

SEQ ID NO: 57274 - RNA, 36 nt, Artificial Sequence
  Complex I intermediate-associated protein 30, mitochondrial (226-237)
gacaccgauuucuuucagagaacaaaccaaauguac

SEQ ID NO: 57275 - RNA, 30 nt, Artificial Sequence
  Aspartate-tRNA ligase, cytoplasmic (384-393)
gacaccgauuucuacauccuggacaaguau

SEQ ID NO: 57276 - RNA, 27 nt, Artificial Sequence
  Replication protein A 70 kDa DNA-binding subunit (504-512)
gacaccgaguuccccaacuuuaaguac

SEQ ID NO: 57277 - RNA, 27 nt, Artificial Sequence
  Adenylyl cyclase-associated protein 1 (344-352)
gacaccgagcugaagcagguggccuac

SEQ ID NO: 57278 - RNA, 27 nt, Artificial Sequence
  Actin, cytoplasmic 2 (77-85)
gacguggauaucagaaaggaccuguac

SEQ ID NO: 57279 - RNA, 27 nt, Artificial Sequence
  Heterogeneous nuclear ribonucleoprotein C-like 1 (32-40)
gacguggaggccaucuucagcaaguac

SEQ ID NO: 57280 - RNA, 30 nt, Artificial Sequence
  Protein arginine N-methyltransferase 7 (368-377)
gaggccgaaccccacccucugugggaguac

SEQ ID NO: 57281 - RNA, 27 nt, Artificial Sequence
  Melanoma-associated antigen D2 (338-346)
gagaucgacaagaacgaucaccuguac

SEQ ID NO: 57282 - RNA, 33 nt, Artificial Sequence
  Annexin A1 (305-315)
gagaucgacaugaacgauauuaaggccuucuac

SEQ ID NO: 57283 - RNA, 30 nt, Artificial Sequence; identical to SEQ ID NO: 33056
  LIM domain kinase 2 (716-725)

SEQ ID NO: 57284 - RNA, 33 nt, Artificial Sequence
  NADPH-cytochrome P450 reductase (304-314)
gagcuggacaucagcgauuccaagauuagauac

SEQ ID NO: 57285 - RNA, 33 nt, Artificial Sequence; identical to SEQ ID NO: 33058
  Splicing factor 3B subunit 2 (811-821)

SEQ ID NO: 57286 - RNA, 33 nt, Artificial Sequence; identical to SEQ ID NO: 33059
  Peptidyl-prolyl cis-trans isomerase D (301-311)

SEQ ID NO: 57287 - RNA, 27 nt, Artificial Sequence
  Ankyrin repeat and IBR domain-containing protein 1 (229-237)
gagcuggacagauucaugcacuacuau

SEQ ID NO: 57288 - RNA, 27 nt, Artificial Sequence
  Plectin (502-510)
gagcuggaagacagcacccucagauac

SEQ ID NO: 57289 - RNA, 30 nt, Artificial Sequence
  Small G protein signaling modulator 2 (307-316)
gagcuggaaaagagcguguacugggacuau

SEQ ID NO: 57290 - RNA, 30 nt, Artificial Sequence
  GPI transamidase component PIG-T (53-62)
gagcugcagagagaaggcgugagccacuac

SEQ ID NO: 57291 - RNA, 33 nt, Artificial Sequence
  60S ribosomal protein L4 (254-264)
gagagcgccuucagaaagcuggacgaacucuac

SEQ ID NO: 57292 - RNA, 30 nt, Artificial Sequence
  Protein-glutamate O-methyltransferase (101-110)
gagagcgacggcaaguccagaugguucuac

SEQ ID NO: 57293 - RNA, 27 nt, Artificial Sequence
  Guanine nucleotide-binding protein subunit beta-5 (239-247)
gagagcgacaucaacuccgugagauac

SEQ ID NO: 57294 - RNA, 27 nt, Artificial Sequence
  Zinc transporter 5 (26-34)
gagagcgacuccagacagaucuucuac

SEQ ID NO: 57295 - RNA, 42 nt, Artificial Sequence
  Proteasome activator complex subunit 3 (182-195)
gagagcgaagccgcuuccuaccuggaccagaucucuagauau

SEQ ID NO: 57296 - RNA, 36 nt, Artificial Sequence
  Myotubularin-related protein 5 (821-832)
gagagcgaaaacagauccuacgagggcacccuguau

SEQ ID NO: 57297 - RNA, 30 nt, Artificial Sequence
  Asparagine synthetase (glutamine-hydrolyzing) (389-398)
gagagcgaaagacugcucagggagcuuuac

SEQ ID NO: 57298 - RNA, 33 nt, Artificial Sequence
  Peptidyl-prolyl cis-trans isomerase FKBP8 (167-177)
gagaccgccauggugacagcugacagcaaguac

SEQ ID NO: 57299 - RNA, 30 nt, Artificial Sequence
  Eyes absent homolog 3 (87-96)
gagaccgccuaccccggccagacacaauau

SEQ ID NO: 57300 - RNA, 30 nt, Artificial Sequence
  ATP-dependent RNA helicase DDX24 (571-580)
gagaccgacgaaaaggauuucuaccuguau

SEQ ID NO: 57301 - RNA, 33 nt, Artificial Sequence
  TFIIH basal transcription factor complex helicase XPD subunit (251-261)
gagaccgacgaacagagacugagggaugaguac

SEQ ID NO: 57302 - RNA, 30 nt, Artificial Sequence; identical to SEQ ID NO: 33075
  Nicotinamide riboside kinase 1 (46-55)

SEQ ID NO: 57303 - RNA, 27 nt, Artificial Sequence
  RNA binding motif protein 22 (245-253)
gagaccgaccugagaaaccacuucuac

SEQ ID NO: 57304 - RNA, 42 nt, Artificial Sequence
  PCNA-interacting partner (146-159)
gagaccgaccugagcauccccacauccccuacuucuaaguac

SEQ ID NO: 57305 - RNA, 27 nt, Artificial Sequence
  Beta-mannosidase (118-126)
gagaccgacaacauguucaauagauac

SEQ ID NO: 57306 - RNA, 39 nt, Artificial Sequence
  Probable ATP-dependent RNA helicase DDX17 (61-73)
gagaccgacagagccggcuacgcuaacgggagcggauau

SEQ ID NO: 57307 - RNA, 27 nt, Artificial Sequence
  Synergin gamma (1198-1206)
gagaccgacagcuucaagcuggccuac

SEQ ID NO: 57308 - RNA, 33 nt, Artificial Sequence
  Probable ATP-dependent RNA helicase DDX56 (239-249)
gagaccgaagaggacaaguuccugcuccuuuac

SEQ ID NO: 57309 - RNA, 30 nt, Artificial Sequence
  Kremen protein 2 (104-113)
gagaccgaagagggcaucuacuggagauau

SEQ ID NO: 57310 - RNA, 27 nt, Artificial Sequence
  Intron-binding protein aquarius (887-895)
gagaccgaaaaggacuucagcagauac

SEQ ID NO: 57311 - RNA, 36 nt, Artificial Sequence
  Guanine nucleotide exchange factor VAV3 (683-694)
gagaccgaacugaucaacagagugaauagcacauac

SEQ ID NO: 57312 - RNA, 39 nt, Artificial Sequence
  DNA polymerase zeta catalytic subunit (827-839)
gagaccgaacagagcuucggccuguacgggaacaaguau

SEQ ID NO: 57313 - RNA, 33 nt, Artificial Sequence
  Protein transport protein Sec16A (1244-1254)
gagaccgaaagauucagggagcugcuccuuuac

SEQ ID NO: 57314 - RNA, 27 nt, Artificial Sequence
  Dynamin-2 (455-463)
gagaccgaaagaaucgugacaacuuac

SEQ ID NO: 57315 - RNA, 27 nt, Artificial Sequence
  Integrin alpha-3 (1043-1051)
gagaccgaaagacugacagacgauuac

SEQ ID NO: 57316 - RNA, 33 nt, Artificial Sequence
  DnaJ homolog subfamily C member 7 (29-39)
gagaccuucaaggaacagggcaacgccuacuau

SEQ ID NO: 57317 - RNA, 33 nt, Artificial Sequence
  HLA class I histocompatibility antigen, B-8 alpha chain (21-31)
gagaccugggccggcagccacuccaugagauac

SEQ ID NO: 57318 - RNA, 30 nt, Artificial Sequence
  Lamin-B1 (229-238)
gagguggacagcggcagacagaucgaauac

SEQ ID NO: 57319 - RNA, 30 nt, Artificial Sequence
  Fatty acid synthase (1244-1253)
gaggugcuggccggccacgggcaucucuac

SEQ ID NO: 57320 - RNA, 33 nt, Artificial Sequence
  Histone acetyltransferase type B catalytic subunit (191-201)
uucaucgacguggaugacgagagauggcacuac

SEQ ID NO: 57321 - RNA, 33 nt, Artificial Sequence
  Protein Smaug homolog 2 (118-128)
uucaucgaggaaagcagacagcugcucuccuac

SEQ ID NO: 57322 - RNA, 36 nt, Artificial Sequence
  Interferon regulatory factor 2-binding protein-like (420-431)
uucaucgaguaccccaccggcagcgggaacguguau

SEQ ID NO: 57323 - RNA, 39 nt, Artificial Sequence
  Protein YIF1B (69-81)
uuccuggccgaccccgugagcaacauggcuauggcauac

SEQ ID NO: 57324 - RNA, 27 nt, Artificial Sequence
  Asparagine synthetase (glutamine-hydrolyzing) (337-345)
uuccuggaccacagauuuagcuccuac

SEQ ID NO: 57325 - RNA, 30 nt, Artificial Sequence; identical to SEQ ID NO: 33098
  Phosphatidylinositol-binding clathrin assembly protein (109-118)

SEQ ID NO: 57326 - RNA, 33 nt, Artificial Sequence
  Rho GTPase-activating protein 35 (733-743)
uuccuggaccccgccagcgcuggcaucggguac

SEQ ID NO: 57327 - RNA, 33 nt, Artificial Sequence
  Ubiquitin carboxyl-terminal hydrolase 8 (552-562)
uuccuggaccccaucaccggcacauuuagauac

SEQ ID NO: 57328 - RNA, 36 nt, Artificial Sequence
  Group XV phospholipase A2 (126-137)
uuccuggaccccagcaaguccucugugggcucauac

SEQ ID NO: 57329 - RNA, 33 nt, Artificial Sequence
  Microtubule-associated protein 4 (103-113)
uuccuggaggaaaagauggccuaccaggaguau

SEQ ID NO: 57330 - RNA, 36 nt, Artificial Sequence
  Histone H4 (31-42)
uuccuggagaacgugaucagagacgccgucaccuac

SEQ ID NO: 57331 - RNA, 30 nt, Artificial Sequence
  Adenylate cyclase type 3 (615-624)
uucauggaccccgagauggaaaccagauac

SEQ ID NO: 57332 - RNA, 30 nt, Artificial Sequence
  Probable C-mannosyltransferase DPY19L1 (397-406)
uucauggagaaggaaaccccccugagauac

SEQ ID NO: 57333 - RNA, 36 nt, Artificial Sequence
  Probable E3 ubiquitin-protein ligase HERC1 (402-413)
uucagcgacgcccagaccaucgaggcuggccaauac

SEQ ID NO: 57334 - RNA, 30 nt, Artificial Sequence; identical to SEQ ID NO: 33107
  Iduronate 2-sulfatase (424-433)

SEQ ID NO: 57335 - RNA, 33 nt, Artificial Sequence
  Iduronate 2-sulfatase (424-434)
uucagcgacauccacgccggcgagcuguacuuu

SEQ ID NO: 57336 - RNA, 30 nt, Artificial Sequence; identical to SEQ ID NO: 33109
  Type 2 lactosamine alpha-2,3-sialyltransferase (283-292)

SEQ ID NO: 57337 - RNA, 33 nt, Artificial Sequence
  Type 2 lactosamine alpha-2,3-sialyltransferase (175-185)
uucagcgaccugaaguccccccuccacuacuau

SEQ ID NO: 57338 - RNA, 33 nt, Artificial Sequence; identical to SEQ ID NO: 33111
  Rab GTPase-activating protein 1-like (338-348)

SEQ ID NO: 57339 - RNA, 33 nt, Artificial Sequence
  DAZ-associated protein 1 (363-373)
uucagcgaccccucccagcaaccuccaucuuac

SEQ ID NO: 57340 - RNA, 27 nt, Artificial Sequence
  Nipped-B-like protein (37-45)
uucagcgacuccaagauccagaaauac

SEQ ID NO: 57341 - RNA, 33 nt, Artificial Sequence
  Protein FAM65B (671-681)
uucagcgacaccgagacagaaaagcacuccuac

SEQ ID NO: 57342 - RNA, 33 nt, Artificial Sequence
  Probable E3 ubiquitin-protein ligase HERC1 (3591-3601)
uucagcgaggacagacccuuugccgugggcuac

SEQ ID NO: 57343 - RNA, 30 nt, Artificial Sequence
  Programmed cell death protein 6 (82-91)
uucagcgaguuuaccggcguguggaaguac

SEQ ID NO: 57344 - RNA, 27 nt, Artificial Sequence
  Ubiquitin carboxyl-terminal hydrolase 32 (135-143)
uucagcgagggcgaaaaggugaacuac

SEQ ID NO: 57345 - RNA, 33 nt, Artificial Sequence
  Heat shock protein HSP 90-beta (342-352)
uucagcgagcuggccgaagacaaggagaacuac

SEQ ID NO: 57346 - RNA, 33 nt, Artificial Sequence
  Uncharacterized protein C14orf119 (120-130)
uucagcgagcccgacuuuguggccaaguucuac

SEQ ID NO: 57347 - RNA, 33 nt, Artificial Sequence
  Fc receptor-like A (67-77)
uucagcgagcccuuucaccugaucguguccuac

SEQ ID NO: 57348 - RNA, 27 nt, Artificial Sequence
  cAMP-dependent protein kinase catalytic subunit alpha (131-139)
uucagcgagccccacgccagauuuuac

SEQ ID NO: 57349 - RNA, 27 nt, Artificial Sequence
  Serine/threonine-protein kinase N1 (718-726)
uucagcgagcccagagccaucuuuuac

SEQ ID NO: 57350 - RNA, 33 nt, Artificial Sequence
  Protein C-ets-1 (175-185)
uucagcgagcccuccuuuaucaccgaaucuuac

SEQ ID NO: 57351 - RNA, 27 nt, Artificial Sequence
  Protein RCC2 (314-322)
uucagcgagcagguggccaugggcuac

SEQ ID NO: 57352 - RNA, 36 nt, Artificial Sequence
  DNA ligase 3 (127-138)
uucagcgaguccggcggggacaugaaggaaugguac

SEQ ID NO: 57353 - RNA, 30 nt, Artificial Sequence
  ETS translocation variant 5 (318-327)
uucagcuccucucacgagggcuuuucauac

SEQ ID NO: 57354 - RNA, 27 nt, Artificial Sequence
  FAS-associated factor 1 (337-345)
uucaccgccgaguuuagcuccagauac

SEQ ID NO: 57355 - RNA, 27 nt, Artificial Sequence
  Staphylococcal nuclease domain-containing protein 1 (607-615)
uucaccgccgagagaagcuccuacuau

SEQ ID NO: 57356 - RNA, 27 nt, Artificial Sequence
  LanC-like protein 1 (199-207)
uucaccgccaagagcccccugauguac

SEQ ID NO: 57357 - RNA, 27 nt, Artificial Sequence
  Cytochrome c oxidase subunit 2 (184-192)
uucaccgccacaagacccggcguguac

SEQ ID NO: 57358 - RNA, 33 nt, Artificial Sequence
  Splicing factor 3A subunit 3 (130-140)
uucaccgacgaggaaggcuacgggagauaucug

SEQ ID NO: 57359 - RNA, 24 nt, Artificial Sequence
  Gem-associated protein 5 (895-902)
uucaccgacagagccacacuguac

SEQ ID NO: 57360 - RNA, 39 nt, Artificial Sequence
  Geranylgeranyl transferase type-2 subunit alpha (166-178)
uucaccgacagccugaucacaagaaacuuuuccaauuac

SEQ ID NO: 57361 - RNA, 30 nt, Artificial Sequence
  CLIP-associating protein 2 (80-89)
uucaccgacgugcccagcauccagauuuac

SEQ ID NO: 57362 - RNA, 36 nt, Artificial Sequence
  Basic leucine zipper and W2 domain-containing protein 1 (149-160)
uucaccgaggccggccugaaggaacucagcgaguac

SEQ ID NO: 57363 - RNA, 33 nt, Artificial Sequence
  Heat shock protein HSP 90-alpha (546-556)
uucaccgagcuggccgaagacaaggagaacuac

SEQ ID NO: 57364 - RNA, 33 nt, Artificial Sequence
  Zinc finger protein 746 (547-557)
uucaccgagagaagcaagcugaucgaccacuac

SEQ ID NO: 57365 - RNA, 36 nt, Artificial Sequence
  Coatomer subunit gamma-1 (402-413)
uucaccaugcugagagaggaaggcggguuugaguac

SEQ ID NO: 57366 - RNA, 27 nt, Artificial Sequence
  Cytoplasmic dynein 1 heavy chain 1 (2784-2792)
uucacccaggacacacaaccccacuac

SEQ ID NO: 57367 - RNA, 33 nt, Artificial Sequence
  Dolichyl-diphosphooligosaccharide-proteinosyltransferase subunit 2 (449-459)
uucguggccgagcccgacaacaagaaugucuac

SEQ ID NO: 57368 - RNA, 36 nt, Artificial Sequence
  G patch domain and KOW motifs-containing protein (365-376)
uucguggacaacauguacaagggcgggcaguauuac

SEQ ID NO: 57369 - RNA, 36 nt, Artificial Sequence
  Retinoid-inducible serine carboxypeptidase (63-74)
uucguggacaaccccgucggcaccggguuuagcuac

SEQ ID NO: 57370 - RNA, 30 nt, Artificial Sequence
  Kelch-like protein 15 (325-334)
uucguggaccccuacccugucaacaaguau

SEQ ID NO: 57371 - RNA, 30 nt, Artificial Sequence
  Abhydrolase domain-containing protein 2 (146-155)
uucguggacuacgcccagaagaacggcuau

SEQ ID NO: 57372 - RNA, 39 nt, Artificial Sequence; identical to SEQ ID NO: 33145
  Trafficking protein particle complex subunit 3 (115-127)

SEQ ID NO: 57373 - RNA, 36 nt, Artificial Sequence
  ADP-ribosylation factor 5 (24-35)
ggccuggacgccgcugggaagaccacaauccucuac

SEQ ID NO: 57374 - RNA, 27 nt, Artificial Sequence
  Exosome complex exonuclease RRP44 (757-765)
ggcauggacaacgauuuccaccauuac

SEQ ID NO: 57375 - RNA, 27 nt, Artificial Sequence
  Archaemetzincin-2 (148-156)
ggcagcgacuucuacuccaugcacuau

SEQ ID NO: 57376 - RNA, 39 nt, Artificial Sequence
  Xaa-Pro aminopeptidase 1 (256-268)
ggcagcgacguggagcacaaccccgucuucuuuuccuac

SEQ ID NO: 57377 - RNA, 27 nt, Artificial Sequence
  Sorbitol dehydrogenase (46-54)
ggcagcgacgugcacuacugggaguau

SEQ ID NO: 57378 - RNA, 27 nt, Artificial Sequence
  Eukaryotic translation initiation factor 3 subunit D (443-451)
ggcagcgaguaccugaagcucggguau

SEQ ID NO: 57379 - RNA, 39 nt, Artificial Sequence
  PMS1 protein homolog 1 (39-51)
ggcaccgccgugaugaacaauauggagagcuuccaguac

SEQ ID NO: 57380 - RNA, 30 nt, Artificial Sequence
  SEC23-interacting protein (313-322)
ggcaccgacgggggaagauacgauguguau

SEQ ID NO: 57381 - RNA, 27 nt, Artificial Sequence
  Syndetin (394-402)
ggcaccgaccugagcaucuucaaguac

SEQ ID NO: 57382 - RNA, 36 nt, Artificial Sequence
  X-ray repair cross-complementing protein 5 (63-74)
ggcaccgacaacccccugagcgggggagaucaguac

SEQ ID NO: 57383 - RNA, 33 nt, Artificial Sequence
  DNA replication licensing factor MCM5 (45-55)
ggcaccgacagaacaggguucacuuuuaaguac

SEQ ID NO: 57384 - RNA, 27 nt, Artificial Sequence
  WD repeat-containing protein 19 (157-165)
ggcaccgacacaggggugguccaguac

SEQ ID NO: 57385 - RNA, 42 nt, Artificial Sequence
  E3 ubiquitin-protein ligase MYCBP2 (1371-1384)
ggcaccgacgugaacgccgggcagaucccccaacugcucuac

SEQ ID NO: 57386 - RNA, 39 nt, Artificial Sequence
  CDK5 regulatory subunit-associated protein 3 (77-89)
ggcaccgaggccagcacaaagaacaucuucgggagauac

SEQ ID NO: 57387 - RNA, 30 nt, Artificial Sequence
  Endophilin-B1 (5-14)
ggcaccgaguucgggcccggaacagccuac

SEQ ID NO: 57388 - RNA, 36 nt, Artificial Sequence
  GON-4-like protein (39-50)
ggcaccgaguuccccaacccucugaucagcaaguac

SEQ ID NO: 57389 - RNA, 36 nt, Artificial Sequence
  Nucleolin (451-462)
ggcaccgagaucgacgggagaagcauuucccuguac

SEQ ID NO: 57390 - RNA, 39 nt, Artificial Sequence
  Nucleolin (451-463)
ggcaccgagaucgacgggagaagcauuucccuguacuau

SEQ ID NO: 57391 - RNA, 30 nt, Artificial Sequence
  MHC class I polypeptide-related sequence A (50-59)
caccuggacggccagcccuuccucagauac

SEQ ID NO: 57392 - RNA, 30 nt, Artificial Sequence
  Zinc finger protein with KRAB and SCAN domains 5 (234-243)
caccuggaccagagccaaaagucccucuac

SEQ ID NO: 57393 - RNA, 27 nt, Artificial Sequence
  Zinc finger CW-type PWWP domain protein 1 (230-238)
caccuggacagccuccccuccaaguac

SEQ ID NO: 57394 - RNA, 36 nt, Artificial Sequence; identical to SEQ ID NO: 33167
  Conserved oligomeric Golgi complex subunit 6 (528-539)

SEQ ID NO: 57395 - RNA, 30 nt, Artificial Sequence
  Unconventional myosin-Va (41-50)
caccuggaggaaggcaaggaccucgaguac

SEQ ID NO: 57396 - RNA, 30 nt, Artificial Sequence
  N6-adenosine-methyltransferase 70 kDa subunit (322-331)
cacauggacaccugcaaguacgugcauuau

SEQ ID NO: 57397 - RNA, 30 nt, Artificial Sequence
  5'-nucleotidase domain-containing protein 1 (266-275)
cacagcgacaucuuccccgccagacauuac

SEQ ID NO: 57398 - RNA, 27 nt, Artificial Sequence
  Endoribonuclease Dicer (118-126)
cacagcgaccugaaggugggcgaguac

SEQ ID NO: 57399 - RNA, 30 nt, Artificial Sequence
  Arylamine N-acetyltransferase 1 (177-186)
cacagcgaccugcucgaggauuccaaguac

SEQ ID NO: 57400 - RNA, 36 nt, Artificial Sequence
  Protein virilizer homolog (783-794)
cacagcgaccugcucggcacccuucauaaccuguac

SEQ ID NO: 57401 - RNA, 33 nt, Artificial Sequence
  CD82 antigen (257-267)
cacagcgaggacuacuccaaggugcccaaauau

SEQ ID NO: 57402 - RNA, 36 nt, Artificial Sequence
  Ribonucleoside-diphosphate reductase subunit M2 B (68-79)
cacagcgagauguacucccugcucaucgacaccuau

SEQ ID NO: 57403 - RNA, 27 nt, Artificial Sequence
  Histone deacetylase 5 (338-346)
cacagcgaguaccauacccugcucuau

SEQ ID NO: 57404 - RNA, 36 nt, Artificial Sequence
  Acyl-CoA desaturase (302-313)
cacagcuuccccuacgacuauuccgccucugaguac

SEQ ID NO: 57405 - RNA, 30 nt, Artificial Sequence
  Elongation factor Tu, mitochondrial (124-133)
cacaccgacugccccggccaugccgauuac

SEQ ID NO: 57406 - RNA, 30 nt, Artificial Sequence
  Lathosterol oxidase (229-238)
cacaccgaccaucacauguucuuugauuac

SEQ ID NO: 57407 - RNA, 30 nt, Artificial Sequence
  NADPH-cytochrome P450 reductase (250-259)
cacaccgacaucgaugccgcuaagguguac

SEQ ID NO: 57408 - RNA, 30 nt, Artificial Sequence
  Synembryn-B (153-162)
cacaccgacaucagaagccagcugagguac

SEQ ID NO: 57409 - RNA, 30 nt, Artificial Sequence
  Mitochondrial enolase superfamily member 1 (29-38)
cacaccgaccccgauuacagcgccgcuuau

SEQ ID NO: 57410 - RNA, 39 nt, Artificial Sequence
  Serine/threonine-protein kinase N2 (593-605)
cacaccgacguguucagcgagcccagagccgucuuuuac

SEQ ID NO: 57411 - RNA, 33 nt, Artificial Sequence
  RNA polymerase II subunit A C-terminal domain phosphatase (601-611)
cacaccgacuacuaugccaaguacgauagauau

SEQ ID NO: 57412 - RNA, 39 nt, Artificial Sequence
  Hermansky-Pudlak syndrome 1 protein (98-110)
cacaccgagagcgaaggcgaccugagaaggaagcucuac

SEQ ID NO: 57413 - RNA, 27 nt, Artificial Sequence
  Protein 4.1 (461-469)
cacaccgagacaaagacuaucacguac

SEQ ID NO: 57414 - RNA, 33 nt, Artificial Sequence
  Histone-lysine N-methyltransferase, H3 lysine-79 specific (273-283)
cacaccaucgacagaacaauucuggagaacuac

SEQ ID NO: 57415 - RNA, 33 nt, Artificial Sequence; identical to SEQ ID NO: 33188
  Lysine-specific demethylase 2A (212-222)

SEQ ID NO: 57416 - RNA, 36 nt, Artificial Sequence
  MICOS complex subunit MIC27 (90-101)
aucauggacaccgugcaguucggcaaggaugccuac

SEQ ID NO: 57417 - RNA, 39 nt, Artificial Sequence
  TP53-regulating kinase (188-200)
aucagcgcccugcccgaggacaagggcguggaucucuac

SEQ ID NO: 57418 - RNA, 39 nt, Artificial Sequence
  Tubulin beta-4B chain (24-36)
aucagcgacgagcacggcauugaucccaccgggacauac

SEQ ID NO: 57419 - RNA, 36 nt, Artificial Sequence
  Integrin alpha-V (214-225)
aucagcgaccagguggccgagauugucuccaaguac

SEQ ID NO: 57420 - RNA, 27 nt, Artificial Sequence
  Reticulon-4 (90-98)
aucagcgaggaacuggugcagaaguac

SEQ ID NO: 57421 - RNA, 39 nt, Artificial Sequence
  Adenosylhomocysteinase (155-167)
aucagcgaggaaaccacaacuggcgugcacaaccuguac

SEQ ID NO: 57422 - RNA, 27 nt, Artificial Sequence
  Protein disulfide-isomerase A5 (349-357)
aucagcgaguuccccacccugaaguac

SEQ ID NO: 57423 - RNA, 33 nt, Artificial Sequence
  ATP-citrate synthase (6-16)
aucagcgagcagaccggcaaggaacugcucuac

SEQ ID NO: 57424 - RNA, 33 nt, Artificial Sequence
  Oligoribonuclease, mitochondrial (168-178)
aucagcgaguccauuaaggaacugcaguucuac

SEQ ID NO: 57425 - RNA, 33 nt, Artificial Sequence
  Protein furry homolog-like (546-556)
aucagcgagacccccauuauaggcaacaaguac

SEQ ID NO: 57426 - RNA, 27 nt, Artificial Sequence
  Bone morphogenetic protein receptor type-2 (374-382)
aucagcgaggugggcaccauuagauac

SEQ ID NO: 57427 - RNA, 33 nt, Artificial Sequence
  Beta-hexosaminidase subunit alpha (436-446)
aucagcuacggccccgacuggaaggauuucuau

SEQ ID NO: 57428 - RNA, 33 nt, Artificial Sequence
  N-alpha-acetyltransferase 16, NatA auxiliary subunit (155-165)
aucaccgacgaucaguucgacuuucacacauac

SEQ ID NO: 57429 - RNA, 30 nt, Artificial Sequence
  Trophinin (580-589)
aucaccgacgaguucgugaagcagaaauac

SEQ ID NO: 57430 - RNA, 24 nt, Artificial Sequence
  Vacuolar protein sorting-associated protein 13C (155-162)
aucaccgacauucacauaaaguac

SEQ ID NO: 57431 - RNA, 39 nt, Artificial Sequence
  Filamin-A (1793-1805)
aucaccgacaacaaggauggcacagugacugucagauac

SEQ ID NO: 57432 - RNA, 42 nt, Artificial Sequence
  Sorting nexin-1 (149-162)
aucaccgaccccgagaagauuggcgaugggaugaacgccuac

SEQ ID NO: 57433 - RNA, 36 nt, Artificial Sequence
  F-box/LRR-repeat protein 14 (130-141)
aucaccgacagcucccugggcagaauugcccaguac

SEQ ID NO: 57434 - RNA, 39 nt, Artificial Sequence
  Coatomer subunit gamma-1 (131-143)
aucaccgacagcacaaugcugcaggccauugagagauac

SEQ ID NO: 57435 - RNA, 36 nt, Artificial Sequence
  F-box/LRR-repeat protein 17 (206-217)
aucaccgacuacgcccugauugcuauaggcagauau

SEQ ID NO: 57436 - RNA, 39 nt, Artificial Sequence
  T-complex protein 1 subunit gamma (291-303)
aucaccgagaagggcauuagcgaccuggcccagcacuac

SEQ ID NO: 57437 - RNA, 33 nt, Artificial Sequence
  Tubulin alpha-1C chain (58-68)
aucaccggcaaggaggacgccgcuaacaauuac

SEQ ID NO: 57438 - RNA, 30 nt, Artificial Sequence
  Transmembrane protein 218 (3-12)
aucguggacgauuucuuuauuggcagauac

SEQ ID NO: 57439 - RNA, 27 nt, Artificial Sequence
  Protein unc-13 homolog B (372-380)
aucguggacgaguucgccaugagauac

SEQ ID NO: 57440 - RNA, 36 nt, Artificial Sequence
  116 kDa U5 small nuclear ribonucleoprotein component (281-292)
aucguggacgaggucaacggccugauuagcauguac

SEQ ID NO: 57441 - RNA, 27 nt, Artificial Sequence
  Putative eukaryotic translation initiation factor 2 subunit 3-like protein (421-429)
aaggccgaccugggcaaaaucgugcuc

SEQ ID NO: 57442 - RNA, 42 nt, Artificial Sequence
  Heterogeneous nuclear ribonucleoprotein L (552-565)
aagagcgacgcccuggagacccucggcuuccuuaaccacuac

SEQ ID NO: 57443 - RNA, 33 nt, Artificial Sequence
  Heterogeneous nuclear ribonucleoprotein C-like 1 (30-40)
aagagcgacguggaggccaucuucuccaaauac

SEQ ID NO: 57444 - RNA, 33 nt, Artificial Sequence
  RNA-binding protein Raly (35-45)
aagagcgacguggagaccaucuucuccaaauac

SEQ ID NO: 57445 - RNA, 30 nt, Artificial Sequence
  Interferon-induced protein with tetratricopeptide repeats 1 (393-402)
aagagcgacgugaacgccaucauucacuac

SEQ ID NO: 57446 - RNA, 33 nt, Artificial Sequence
  Ras GTPase-activating protein-binding protein 1 (353-363)
aagagcgagcugaaagacuucuuucaguccuac

SEQ ID NO: 57447 - RNA, 30 nt, Artificial Sequence
  Mitochondrial import receptor subunit TOM70 (576-585)
aagagcgagauggaaauggcccaccuguac

SEQ ID NO: 57448 - RNA, 27 nt, Artificial Sequence
  Epidermal growth factor receptor substrate 15-like 1 (284-292)
aagaccgaccuggaucucgacggcuac

SEQ ID NO: 57449 - RNA, 36 nt, Artificial Sequence
  Myosin-9 (289-300)
aagaccgaccugcuccuugagcccuacaacaaauau

SEQ ID NO: 57450 - RNA, 33 nt, Artificial Sequence
  Unconventional myosin-Id (307-317)
aagaccgacaugguggagaaagcccugcucuac

SEQ ID NO: 57451 - RNA, 36 nt, Artificial Sequence
  RNA polymerase II-associated factor 1 homolog (123-134)
aagaccgaguacaucagcacagaauucaacagauau

SEQ ID NO: 57452 - RNA, 33 nt, Artificial Sequence
  Cytokine receptor-like factor 3 (197-207)
aagguggacgaugacuucaccgcccaggauuac

SEQ ID NO: 57453 - RNA, 27 nt, Artificial Sequence
  X-ray repair cross-complementing protein 5 (221-229)
aagguggacgaggaacagaugaaauac

SEQ ID NO: 57454 - RNA, 27 nt, Artificial Sequence
  Dolichyl-diphosphooligosaccharide-proteinosyltransferase 48 kDa subunit (391-399)
aagguggacuacaacagacugggcuau

SEQ ID NO: 57455 - RNA, 30 nt, Artificial Sequence
  Cytosol aminopeptidase (431-440)
cuggccgacgugaacaauaucggcaaguac

SEQ ID NO: 57456 - RNA, 33 nt, Artificial Sequence
  Double-stranded RNA-specific adenosine deaminase (334-344)
cugaucgacauggagagacagggcgauguguac

SEQ ID NO: 57457 - RNA, 30 nt, Artificial Sequence
  Annexin A2 (190-199)
cugaucgaccaggaugccagagaccucuac

SEQ ID NO: 57458 - RNA, 33 nt, Artificial Sequence
  Protein zyg-11 homolog B (425-435)
cugaucgaggaaggcgggcuccagcaccuuuac

SEQ ID NO: 57459 - RNA, 42 nt, Artificial Sequence
  N-acetylglucosamine-1-phosphotransferase subunits alpha/beta (903-916)
cugcucgacgaggaagagagccuuaagacccagcuggccuac

SEQ ID NO: 57460 - RNA, 30 nt, Artificial Sequence
  Protein transport protein Sec61 subunit alpha isoform 1 (164-173)
cugcucgacgagcuucugcagaagggcuac

SEQ ID NO: 57461 - RNA, 36 nt, Artificial Sequence
  Mitogen-activated protein kinase kinase kinase 7 (547-558)
cugcucgacgagaacaagagccuuuccaccuacuau

SEQ ID NO: 57462 - RNA, 33 nt, Artificial Sequence
  Syntaxin-binding protein 2 (253-263)
cugcucgacaucgagcaggauaccuacagauau

SEQ ID NO: 57463 - RNA, 30 nt, Artificial Sequence
  Intraflagellar transport protein 43 homolog (4-13)
cugcucgaccuugaugaggaacugagauac

SEQ ID NO: 57464 - RNA, 30 nt, Artificial Sequence
  Zinc finger protein 627 (79-88)
cugcucgaccccagccagaagaaccuuuac

SEQ ID NO: 57465 - RNA, 30 nt, Artificial Sequence
  Zinc finger protein 614 (24-33)
cugcucgacaccgcccagaagaaccuuuac

SEQ ID NO: 57466 - RNA, 30 nt, Artificial Sequence
  Zinc finger protein 324B (17-26)
cugcucgacaccgcccagagagcucuuuac

SEQ ID NO: 57467 - RNA, 36 nt, Artificial Sequence
  S100P-binding protein (91-102)
cugcucgacacccccagagagaagaacagcuccuac

SEQ ID NO: 57468 - RNA, 39 nt, Artificial Sequence
  Chromodomain-helicase-DNA-binding protein 4 (1078-1090)
cugcucgaggacuuccuugaacacgagggcuacaaguau

SEQ ID NO: 57469 - RNA, 27 nt, Artificial Sequence
  SWI/SNF-related matrix-associated actin-dependent regulator of chromatin subfamily A member 5 (784-792)
cugcucgagaaggaaauccuuuucuac

SEQ ID NO: 57470 - RNA, 30 nt, Artificial Sequence
  Early endosome antigen 1 (541-550)
cugcucgagaaggaaagagaggaccuuuac

SEQ ID NO: 57471 - RNA, 33 nt, Artificial Sequence
  E3 ubiquitin-protein ligase HUWE1 (982-992)
cugcucgagaacgacgugagcacccuuggcuac

SEQ ID NO: 57472 - RNA, 36 nt, Artificial Sequence
  Ankyrin repeat and LEM domain-containing protein 2 (110-121)
cugcucgagcagggcgggagacuuagcuccuucuac

SEQ ID NO: 57473 - RNA, 42 nt, Artificial Sequence
  Phospholipid scramblase 1 (116-129)
cugcucgaggugcuuaccggcuucgaaacaaacaauaaguac

SEQ ID NO: 57474 - RNA, 30 nt, Artificial Sequence
  Signal recognition particle subunit SRP68 (128-137)
cugauggacgccgagagagcuuggagcuac

SEQ ID NO: 57475 - RNA, 33 nt, Artificial Sequence
  Sialidase-1 (232-242)
cugagcgacgaucacggcgccuccuggagauac

SEQ ID NO: 57476 - RNA, 24 nt, Artificial Sequence
  Melanoma inhibitory activity protein 3 (136-143)
cugagcgacgaggccaucaaguac

SEQ ID NO: 57477 - RNA, 27 nt, Artificial Sequence
  FACT complex subunit SSRP1 (85-93)
cugagcgacuucuuuaagacccacuac

SEQ ID NO: 57478 - RNA, 30 nt, Artificial Sequence
  Inhibitor of nuclear factor kappa-B kinase subunit beta (67-76)
cugagcgacaucgccuccgcucucagauac

SEQ ID NO: 57479 - RNA, 27 nt, Artificial Sequence
  Deoxyribose-phosphate aldolase (312-320)
cugagcgacaucgagagacagauuuac

SEQ ID NO: 57480 - RNA, 30 nt, Artificial Sequence
  Inhibitor of nuclear factor kappa-B kinase subunit alpha (94-103)
cugagcgacaucggcuccgggauuagauac

SEQ ID NO: 57481 - RNA, 27 nt, Artificial Sequence
  Rho-related BTB domain-containing protein 3 (340-348)
cugagcgacauccucagauucauuuac

SEQ ID NO: 57482 - RNA, 39 nt, Artificial Sequence
  DnaJ homolog subfamily C member 11 (69-81)
cugagcgacccccagaccagagccaucuacgauauuuau

SEQ ID NO: 57483 - RNA, 30 nt, Artificial Sequence
  Ribosomal protein S6 kinase delta-1 (155-164)
cugagcgaccccuccggcccuaagucuuac

SEQ ID NO: 57484 - RNA, 36 nt, Artificial Sequence
  Nucleoporin NDC1 (58-69)
cugagcgacuccuucucugaucucuacucaaguuau

SEQ ID NO: 57485 - RNA, 33 nt, Artificial Sequence
  Importin-7 (681-691)
cugagcgacaccaaguaccucgagaugaucuau

SEQ ID NO: 57486 - RNA, 36 nt, Artificial Sequence
  DNA polymerase zeta catalytic subunit (2423-2434)
cugagcgacugguucgauaacaagaccgaccucuac

SEQ ID NO: 57487 - RNA, 33 nt, Artificial Sequence
  Cyclin-dependent kinase 2-associated protein 1 (39-49)
cugagcgacuacggccccccuucccucggguau

SEQ ID NO: 57488 - RNA, 27 nt, Artificial Sequence
  PAS domain-containing serine/threonine-protein kinase (64-72)
cugagcgaggacagaugguccucuuac

SEQ ID NO: 57489 - RNA, 27 nt, Artificial Sequence
  Vacuolar protein sorting-associated protein 18 homolog (306-314)
cugagcgaggaaagagugugggaguac

SEQ ID NO: 57490 - RNA, 27 nt, Artificial Sequence
  Transmembrane and TPR repeat-containing protein 3 (84-92)
cugagcgagcucaagcccauguccuac

SEQ ID NO: 57491 - RNA, 36 nt, Artificial Sequence
  DmX-like protein 1 (783-794)
cugagcgagcucuccaaccccgaaaucucuaaguac

SEQ ID NO: 57492 - RNA, 27 nt, Artificial Sequence
  Alpha/beta hydrolase domain-containing protein 17B (50-58)
cugagcgagagagccgacuggcaguac

SEQ ID NO: 57493 - RNA, 27 nt, Artificial Sequence
  Immediate early response gene 5-like protein (48-56)
cugagcgagagauacgccgaacucuau

SEQ ID NO: 57494 - RNA, 30 nt, Artificial Sequence; identical to SEQ ID NO: 33267
  Signal peptidase complex subunit 1 (5-14)

SEQ ID NO: 57495 - RNA, 45 nt, Artificial Sequence
  Coatomer subunit epsilon (43-57)
cugagcucccccgagagagacguggaaagggaugucuuccucuac

SEQ ID NO: 57496 - RNA, 33 nt, Artificial Sequence
  26S proteasome non-ATPase regulatory subunit 2 (391-401)
cugaccgacgauggcaacaaguggcucuacaaa

SEQ ID NO: 57497 - RNA, 27 nt, Artificial Sequence
  Casein kinase II subunit alpha' (129-137)
cugaccgacuucgauaucagauuuuac

SEQ ID NO: 57498 - RNA, 24 nt, Artificial Sequence
  Lysine-tRNA ligase (133-140)
cugaccgacuucauccagaaguac

SEQ ID NO: 57499 - RNA, 27 nt, Artificial Sequence
  DNA excision repair protein ERCC-6-like 2 (214-222)
cugaccgacuuccagaaggccguguac

SEQ ID NO: 57500 - RNA, 30 nt, Artificial Sequence; identical to SEQ ID NO: 33273
  Thyroid adenoma-associated protein (45-54)

SEQ ID NO: 57501 - RNA, 33 nt, Artificial Sequence; identical to SEQ ID NO: 33274
  3'(2'),5'-bisphosphate nucleotidase 1 (262-272)

SEQ ID NO: 57502 - RNA, 30 nt, Artificial Sequence
  Myotubularin-related protein 5 (70-79)
cugaccgacaucaacagcgagagacacuac

SEQ ID NO: 57503 - RNA, 36 nt, Artificial Sequence
  E3 ubiquitin-protein ligase UBR4 (278-289)
cugaccgacaaggccgugaaagauuacagcgcuuau

SEQ ID NO: 57504 - RNA, 33 nt, Artificial Sequence
  MAP kinase-activating death domain protein (81-91)
cugaccgacaaggauacaggcgugacuagauac

SEQ ID NO: 57505 - RNA, 30 nt, Artificial Sequence
  Dynactin subunit 2 (168-177)
cugaccgaccccgauggcgcccucgcuaag

SEQ ID NO: 57506 - RNA, 30 nt, Artificial Sequence
  Mucosa-associated lymphoid tissue lymphoma translocation protein 1 (876-885)
cugaccgaccccauccagggcacagaguac

SEQ ID NO: 57507 - RNA, 30 nt, Artificial Sequence
  Putative deoxyribonuclease TATDN1 (13-22)
cugaccgaccccauguucagaggcaucuac

SEQ ID NO: 57508 - RNA, 27 nt, Artificial Sequence
  Interferon regulatory factor 3 (252-260)
cugaccgacagaggcgugaugagcuac

SEQ ID NO: 57509 - RNA, 30 nt, Artificial Sequence
  Tubulin polyglutamylase complex subunit 2 (125-134)
cugaccgacacauucacugccuacuauaga

SEQ ID NO: 57510 - RNA, 39 nt, Artificial Sequence
  Peroxisomal multifunctional enzyme type 2 (493-505)
cugaccgacacaacuagccucaaccaggccgcucuuuac

SEQ ID NO: 57511 - RNA, 27 nt, Artificial Sequence
  DNA polymerase zeta catalytic subunit (928-936)
cugaccgaggaaaagauggagcucuac

SEQ ID NO: 57512 - RNA, 33 nt, Artificial Sequence
  Regulator of microtubule dynamics protein 3 (316-326)
cugaccgaggaagugagcgagaagaaauccuac

SEQ ID NO: 57513 - RNA, 33 nt, Artificial Sequence
  Protein FAM65B (122-132)
cugaccgagaucaacagaagcuucaaggaauac

SEQ ID NO: 57514 - RNA, 39 nt, Artificial Sequence
  Probable histidine-tRNA ligase, mitochondrial (104-116)
cugaccgagaaguacggcgaagacagcgggcucauguau

SEQ ID NO: 57515 - RNA, 30 nt, Artificial Sequence
  ATP synthase subunit alpha, mitochondrial (467-476)
cugaccgagcuccuuaagcagggccaauac

SEQ ID NO: 57516 - RNA, 27 nt, Artificial Sequence
  39S ribosomal protein L52, mitochondrial (43-51)
cugaccgagcuccccgacuggagcuac

SEQ ID NO: 57517 - RNA, 27 nt, Artificial Sequence
  Tectonin beta-propeller repeat-containing protein 2 (950-958)
cugaccgagcagagagcccuccuuuac

SEQ ID NO: 57518 - RNA, 30 nt, Artificial Sequence
  7SK snRNA methylphosphate capping enzyme (629-638)
cugaccgagacaaucuacaagaacuauuac

SEQ ID NO: 57519 - RNA, 39 nt, Artificial Sequence
  HLA class I histocompatibility antigen, B-8 alpha chain (19-31)
cugaccgagacaugggccggcagccacuccaugagauac

SEQ ID NO: 57520 - RNA, 30 nt, Artificial Sequence
  Proline-rich nuclear receptor coactivator 1 (270-279)
cugaccgaggugagccagaaggaaaacuac

SEQ ID NO: 57521 - RNA, 39 nt, Artificial Sequence
  TOX high mobility group box family member 4 (104-116)
cugaccauggaccucgaucacagcaucggcacacaguac

SEQ ID NO: 57522 - RNA, 33 nt, Artificial Sequence
  Ubiquinone biosynthesis protein COQ9, mitochondrial (105-115)
cugaccagcaugguggacgauauguggcacuac

SEQ ID NO: 57523 - RNA, 30 nt, Artificial Sequence
  Clustered mitochondria protein homolog (608-617)
cugguggacgccuucgucgagcacagauac

SEQ ID NO: 57524 - RNA, 36 nt, Artificial Sequence
  Poly (ADP-ribose) polymerase 1 (559-570)
cugguggacaucgucaagggcaccaacagcuacuau

SEQ ID NO: 57525 - RNA, 27 nt, Artificial Sequence
  Alsin (683-691)
cugguggacaagaacaucaugggcuac

SEQ ID NO: 57526 - RNA, 39 nt, Artificial Sequence
  Dexamethasone-induced protein (67-79)
cugguggaccucggcguccuuagcgaucccggguccgga

SEQ ID NO: 57527 - RNA, 45 nt, Artificial Sequence
  Dexamethasone-induced protein (67-81)
cugguggaccucggcguccuuagcgaucccggguccggacuguac

SEQ ID NO: 57528 - RNA, 27 nt, Artificial Sequence
  Zinc finger FYVE domain-containing protein 16 (1229-1237)
cugguggaccucagaaacuaccaguau

SEQ ID NO: 57529 - RNA, 30 nt, Artificial Sequence; identical to SEQ ID NO: 33302
  Semaphorin-4F (69-78)

SEQ ID NO: 57530 - RNA, 30 nt, Artificial Sequence
  Fatty acid-binding protein, epidermal (13-22)
cugguggacagcaagggcuucgaugaguac

SEQ ID NO: 57531 - RNA, 27 nt, Artificial Sequence
  Probable C-mannosyltransferase DPY19L1 (398-406)
auggagaaggaaaccccccugagauac

SEQ ID NO: 57532 - RNA, 30 nt, Artificial Sequence
  MICOS complex subunit MIC60 (261-270)
augaucgacgagaccagaaacagccuguac

SEQ ID NO: 57533 - RNA, 27 nt, Artificial Sequence
  SWI/SNF-related matrix-associated actin-dependent regulator of chromatin subfamily D member 2 (247-255)
augcuggaccaccagcccccucaauac

SEQ ID NO: 57534 - RNA, 27 nt, Artificial Sequence
  Acylamino-acid-releasing enzyme (544-552)
augcuggacaagagccccaucagauac

SEQ ID NO: 57535 - RNA, 27 nt, Artificial Sequence
  Cytoplasmic dynein 1 heavy chain 1 (3043-3051)
augcuggacagccacgaggaacucuac

SEQ ID NO: 57536 - RNA, 36 nt, Artificial Sequence
  Zinc finger MYM-type protein 4 (480-491)
augagcgacggcuccaucagaaacuucugcucuuac

SEQ ID NO: 57537 - RNA, 30 nt, Artificial Sequence
  YTH domain-containing family protein 3 (52-61)
augagcgaccccuacaugccuuccuauuac

SEQ ID NO: 57538 - RNA, 24 nt, Artificial Sequence
  trabeculin-alpha (2316-2323)
augagcgacgugaaccugaaguac

SEQ ID NO: 57539 - RNA, 30 nt, Artificial Sequence
  A-kinase anchor protein 6 (990-999)
augagcgaggaacagcaacagcaccuguac

SEQ ID NO: 57540 - RNA, 27 nt, Artificial Sequence
  Lambda-crystallin homolog (224-232)
augagcgagggccuggggaugagauac

SEQ ID NO: 57541 - RNA, 30 nt, Artificial Sequence
  Talin-1 (289-298)
augagcgagaucgaagccaaggugagauac

SEQ ID NO: 57542 - RNA, 39 nt, Artificial Sequence
  Kelch-like protein 13 (423-435)
augagcgagccccacuacggccaugccgggaccguguau

SEQ ID NO: 57543 - RNA, 27 nt, Artificial Sequence
  Antigen KI-67 (1611-1619)
augaccgacgauaagaucacagaggug

SEQ ID NO: 57544 - RNA, 33 nt, Artificial Sequence
  Telomerase protein component 1 (365-375)
augaccgacaaguucgcccaguuugaugaguac

SEQ ID NO: 57545 - RNA, 36 nt, Artificial Sequence; identical to SEQ ID NO: 33318
  DNA helicase B (287-298)

SEQ ID NO: 57546 - RNA, 39 nt, Artificial Sequence
  TAR DNA-binding protein 43 (202-214)
augaccgaggacgaacugagagaguucuuuagccaguac

SEQ ID NO: 57547 - RNA, 39 nt, Artificial Sequence
  Muskelin (98-110)
augaccgagcugcucagcuccggccuuaagaacgacuac

SEQ ID NO: 57548 - RNA, 30 nt, Artificial Sequence
  Presenilin-1 (1-10)
augaccgagcugcccgccccucucagcuac

SEQ ID NO: 57549 - RNA, 30 nt, Artificial Sequence
  Prolyl endopeptidase (67-76)
augaccgagcuguacgacuaucccaaguac

SEQ ID NO: 57550 - RNA, 27 nt, Artificial Sequence
  E3 ubiquitin-protein ligase UBR5 (2723-2731)
augaccgagagacaggaccugguguac

SEQ ID NO: 57551 - RNA, 30 nt, Artificial Sequence
  Protein Spindly (51-60)
augaccgagagcuacgaacaggagaaguau

SEQ ID NO: 57552 - RNA, 39 nt, Artificial Sequence
  Zinc finger protein 428 (44-56)
augaccgagacaagagaacccgccgagacuggcggguac

SEQ ID NO: 57553 - RNA, 36 nt, Artificial Sequence
  NF-kappa-B-repressing factor (190-201)
augaccagcggcuccgacaagaucaacuacacauau

SEQ ID NO: 57554 - RNA, 27 nt, Artificial Sequence
  Probable ATP-dependent RNA helicase DHX35 (162-170)
augguggacccccugcucaccaaguac

SEQ ID NO: 57555 - RNA, 33 nt, Artificial Sequence
  Cytochrome c oxidase subunit 1 (484-494)
augguggaggaacccagcaugaaccuggagugg

SEQ ID NO: 57556 - RNA, 36 nt, Artificial Sequence
  Lysocardiolipin acyltransferase 1 (88-99)
aaccuggacgccgugcacgauaucaccgucgcuuac

SEQ ID NO: 57557 - RNA, 36 nt, Artificial Sequence
  Prolyl 3-hydroxylase OGFOD1 (84-95)
aaccuggacuuccacgagaaguacaaugaucucuau

SEQ ID NO: 57558 - RNA, 27 nt, Artificial Sequence
  Tubulin alpha-1C chain (181-189)
aaccuggacaucgagagacccaccuac

SEQ ID NO: 57559 - RNA, 36 nt, Artificial Sequence
  Splicing factor 3B subunit 4 (106-117)
aaccuggaccccgagaucgaugaaaagcuccuuuac

SEQ ID NO: 57560 - RNA, 27 nt, Artificial Sequence
  N-alpha-acetyltransferase 20 (7-15)
aaccuggacccccucaccgagacauac

SEQ ID NO: 57561 - RNA, 30 nt, Artificial Sequence
  E3 ubiquitin-protein ligase RNF135 (381-390)
aaccuggaggaaggcaagcucgccuucuac

SEQ ID NO: 57562 - RNA, 27 nt, Artificial Sequence
  Basigin (111-119)
aacauggaggccgaccccggccaguac

SEQ ID NO: 57563 - RNA, 42 nt, Artificial Sequence
  Ribonucleoside-diphosphate reductase large subunit (35-48)
aacagcgccaucauuuacgacagagauuucuccuauaauuac

SEQ ID NO: 57564 - RNA, 30 nt, Artificial Sequence; identical to SEQ ID NO: 33337
  Thrombospondin-3 (640-649)

SEQ ID NO: 57565 - RNA, 36 nt, Artificial Sequence
  NADH-ubiquinone oxidoreductase chain 5 (109-120)
aacagcgaccccaauaucaaccaguucuuuaaguac

SEQ ID NO: 57566 - RNA, 33 nt, Artificial Sequence
  52 kDa repressor of the inhibitor of the protein kinase (452-462)
aacagcgacaccaauaucagauggaacaauuac

SEQ ID NO: 57567 - RNA, 27 nt, Artificial Sequence
  Homeodomain-interacting protein kinase 1 (604-612)
aacagcgacgugucccugcucaauuac

SEQ ID NO: 57568 - RNA, 30 nt, Artificial Sequence
  Serine/threonine-protein kinase RIO3 (378-387)
aacagcgaggaaaugaaggaggccuacuau

SEQ ID NO: 57569 - RNA, 42 nt, Artificial Sequence
  Cerebellar degeneration-related protein 2 (286-299)
aacagcgagcuggaacagcaacucggcgccaccggggcuuac

SEQ ID NO: 57570 - RNA, 30 nt, Artificial Sequence
  YY1-associated protein 1 (320-329)
aacagcgagcugggcuccgaaaccagauac

SEQ ID NO: 57571 - RNA, 27 nt, Artificial Sequence
  Myosin-14 (29-37)
aacagcgagcugcucaaugacagauac

SEQ ID NO: 57572 - RNA, 27 nt, Artificial Sequence
  Thymidylate synthase (205-213)
aacagcgagcuguccugccagcucuac

SEQ ID NO: 57573 - RNA, 42 nt, Artificial Sequence
  Neuroblastoma-amplified sequence (1978-1991)
aacagcgagcaggaaacccugcaaaaguacucccaccucuau

SEQ ID NO: 57574 - RNA, 39 nt, Artificial Sequence
  Cytochrome c oxidase subunit 1 (360-372)
aacagcucccuggacaucgugcuccacgauaccuacuau

SEQ ID NO: 57575 - RNA, 33 nt, Artificial Sequence
  LIM domain and actin-binding protein 1 (82-92)
aacaccgacgccagcggcaagaucgagaaauac

SEQ ID NO: 57576 - RNA, 33 nt, Artificial Sequence
  Zinc finger protein 462 (265-275)
aacaccgacuucggcgauagcgggagacuguac

SEQ ID NO: 57577 - RNA, 36 nt, Artificial Sequence
  Zinc finger protein 462 (265-276)
aacaccgacuucggcgauagcgggagacuguacuau

SEQ ID NO: 57578 - RNA, 27 nt, Artificial Sequence
  Protein YIPF5 (8-16)
aacaccgacuucuaccagacaagcuau

SEQ ID NO: 57579 - RNA, 27 nt, Artificial Sequence
  2-oxoisovalerate dehydrogenase subunit alpha, mitochondrial (83-91)
aacaccgaccugguguucggccaguac

SEQ ID NO: 57580 - RNA, 33 nt, Artificial Sequence
  Protein TASOR (346-356)
aacaccgacagaaauaucgauaaguacaacuau

SEQ ID NO: 57581 - RNA, 36 nt, Artificial Sequence
  26S proteasome non-ATPase regulatory subunit 13 (227-238)
aacaccgacagacaguggcugaucgauacacucuac

SEQ ID NO: 57582 - RNA, 33 nt, Artificial Sequence
  Pericentriolar material 1 protein (1414-1424)
aacaccgacuaccugagacagagggcccucuau

SEQ ID NO: 57583 - RNA, 36 nt, Artificial Sequence
  DnaJ homolog subfamily C member 3 (221-232)
aacaccgaggccuucuacaagaucagcacacuguau

SEQ ID NO: 57584 - RNA, 39 nt, Artificial Sequence
  Polypyrimidine tract-binding protein 1 (102-114)
aacaccgaggaagccgcuaauacaauggugaacuacuau

SEQ ID NO: 57585 - RNA, 39 nt, Artificial Sequence
  DNA-directed RNA polymerase I subunit RPA1 (1579-1591)
aacaccgagggcaucaaucugcccgaacucuucaaguac

SEQ ID NO: 57586 - RNA, 27 nt, Artificial Sequence
  Putative SMEK homolog 3 (187-195)
aacaccgagggccugcaccaucucuac

SEQ ID NO: 57587 - RNA, 39 nt, Artificial Sequence
  Condensin complex subunit 1 (509-521)
aacaccgagacaacugaagacgugaagggcagaaucuac

SEQ ID NO: 57588 - RNA, 30 nt, Artificial Sequence
  Charged multivesicular body protein 4b (102-111)
aacaccgaggugcugaagaauaugggcuac

SEQ ID NO: 57589 - RNA, 39 nt, Artificial Sequence
  Solute carrier family 25 member 46 (374-386)
aacaccaucagacaggaggaaggcguguucggguuuuac

SEQ ID NO: 57590 - RNA, 39 nt, Artificial Sequence
  Microphthalmia-associated transcription factor (237-249)
aacacccugcccgugagcggcaaucucaucgaccuuuac

SEQ ID NO: 57591 - RNA, 33 nt, Artificial Sequence
  AT-rich interactive domain-containing protein 1A (858-868)
aacaccagcgacaugaugggcagaauguccuac

SEQ ID NO: 57592 - RNA, 39 nt, Artificial Sequence; identical to SEQ ID NO: 33365
  Lysine-specific demethylase 5A (460-472)

SEQ ID NO: 57593 - RNA, 36 nt, Artificial Sequence
  Anaphase-promoting complex subunit 7 (270-281)
aacguggaccugcucggcagccuugccgaucuguac

SEQ ID NO: 57594 - RNA, 27 nt, Artificial Sequence
  60S ribosomal protein L13a (184-192)
aacguggagaagaaaaucgacaaguac

SEQ ID NO: 57595 - RNA, 30 nt, Artificial Sequence
  Unhealthy ribosome biogenesis protein 2 homolog (1354-1363)
ccccuggaccaccucaagccucuugaguac

SEQ ID NO: 57596 - RNA, 30 nt, Artificial Sequence
  Nardilysin (107-116)
cccagcgacccuaagcaguacagauauauc

SEQ ID NO: 57597 - RNA, 33 nt, Artificial Sequence
  Probable 28S rRNA (cytosine-C(5))-methyltransferase (291-301)
cccagcgacccuagauaccacgaggugcauuau

SEQ ID NO: 57598 - RNA, 27 nt, Artificial Sequence
  Vesicle-associated membrane protein 7 (37-45)
cccagcgagaacaauaagcugaccuac

SEQ ID NO: 57599 - RNA, 36 nt, Artificial Sequence; identical to SEQ ID NO: 33372
  ELAV-like protein 1 (98-109)

SEQ ID NO: 57600 - RNA, 27 nt, Artificial Sequence
  Copine-1 (299-307)
cccagcuccccugacucucugcacuac

SEQ ID NO: 57601 - RNA, 27 nt, Artificial Sequence
  Leucyl-cystinyl aminopeptidase (155-163)
cccaccgccguggucccucugagauac

SEQ ID NO: 57602 - RNA, 36 nt, Artificial Sequence
  Mitogen-activated protein kinase kinase kinase kinase 2 (799-810)
cccaccgacaacccugaggcccacagcaaucuguac

SEQ ID NO: 57603 - RNA, 33 nt, Artificial Sequence
  GRAM domain-containing protein 4 (500-510)
cccaccgacuacaucagaaacggcgugcuguau

SEQ ID NO: 57604 - RNA, 30 nt, Artificial Sequence
  Vam6/Vps39-like protein (288-297)
cccaccgacuacagaaagcagcugcaauau

SEQ ID NO: 57605 - RNA, 27 nt, Artificial Sequence
  Syntaxin-binding protein 5 (645-653)
cccaccgagauccagagacugacauac

SEQ ID NO: 57606 - RNA, 36 nt, Artificial Sequence
  Mitochondrial import receptor subunit TOM70 (145-156)
cccaccgagaagaacguggaccugagcacauucuac

SEQ ID NO: 57607 - RNA, 36 nt, Artificial Sequence
  Nuclear factor erythroid 2-related factor 1 (309-320)
cccguggaggaauucaacgagcugcucagcaaguac

SEQ ID NO: 57608 - RNA, 33 nt, Artificial Sequence
  Uncharacterized protein KIAA2013 (534-544)
caggccgaccccgaugugcugcacaacagcuac

SEQ ID NO: 57609 - RNA, 30 nt, Artificial Sequence
  Lysophospholipid acyltransferase LPCAT4 (420-429)
caggccgagggccccaacagacugcucuac

SEQ ID NO: 57610 - RNA, 39 nt, Artificial Sequence
  Actin-related protein 6 (44-56)
cagaucgacgagauuaaggaucccagcggccuguucuac

SEQ ID NO: 57611 - RNA, 27 nt, Artificial Sequence
  Hepatocyte growth factor-regulated tyrosine kinase substrate (459-467)
cagcuggacgagagaaggcucuacuau

SEQ ID NO: 57612 - RNA, 27 nt, Artificial Sequence
  Speriolin-like protein (48-56)
cagcuggacagaaggauccucgccuac

SEQ ID NO: 57613 - RNA, 30 nt, Artificial Sequence
  Zinc finger protein 74 (59-68)
cagcuggacagcccccaaagagcccucuac

SEQ ID NO: 57614 - RNA, 27 nt, Artificial Sequence
  trabeculin-alpha (4357-4365)
cagcuggacacccacauggagcucuac

SEQ ID NO: 57615 - RNA, 33 nt, Artificial Sequence
  Phosphofurin acidic cluster sorting protein 1 (106-116)
cagcuggacguggccggcagagucaugcaauac

SEQ ID NO: 57616 - RNA, 33 nt, Artificial Sequence
  Ubiquitin-40S ribosomal protein S27a (69-79)
cagcuggaggacggcagaacccucagcgauuac

SEQ ID NO: 57617 - RNA, 36 nt, Artificial Sequence
  PH domain leucine-rich repeat-containing protein phosphatase 2 (23-34)
cagcuggagagacccggcgggcucgacacccuuuac

SEQ ID NO: 57618 - RNA, 27 nt, Artificial Sequence
  Transketolase (102-110)
cagagcgaccccgccccucugcaacac

SEQ ID NO: 57619 - RNA, 30 nt, Artificial Sequence
  HMG box-containing protein 1 (66-75)
cagagcgaccccacccaauccggcauguac

SEQ ID NO: 57620 - RNA, 30 nt, Artificial Sequence
  Aryl hydrocarbon receptor (150-159)
cagagcgacgugauccaccaauccgucuac

SEQ ID NO: 57621 - RNA, 39 nt, Artificial Sequence
  HLA class I histocompatibility antigen, A-1 alpha chain (86-98)
cagagcgaggacggcucccacaccauccaaauuauguac

SEQ ID NO: 57622 - RNA, 33 nt, Artificial Sequence
  Pre-mRNA-splicing factor ISY1 homolog (275-285)
cagagcgaggaagccagaaggcugcucggcuac

SEQ ID NO: 57623 - RNA, 30 nt, Artificial Sequence
  LIM and SH3 domain protein 1 (77-86)
cagagcgagcugcaaucccaggugagauac

SEQ ID NO: 57624 - RNA, 27 nt, Artificial Sequence
  Dynamin-1-like protein (672-680)
cagagcgagcuggugggccaacucuac

SEQ ID NO: 57625 - RNA, 36 nt, Artificial Sequence
  E3 ubiquitin-protein ligase synoviolin (163-174)
cagagcgagaaccccugggacaauaaggccguguac

SEQ ID NO: 57626 - RNA, 27 nt, Artificial Sequence
  Vacuolar protein sorting-associated protein 13D (1153-1161)
cagagcgagagagaauacaucagguau

SEQ ID NO: 57627 - RNA, 30 nt, Artificial Sequence
  Ubiquitin carboxyl-terminal hydrolase 25 (71-80)
cagaccgcccugcccggcaacgacagauac

SEQ ID NO: 57628 - RNA, 30 nt, Artificial Sequence
  Zinc finger MYM-type protein 2 (609-618)
cagaccgacgauacauggagaacugaguac

SEQ ID NO: 57629 - RNA, 27 nt, Artificial Sequence
  Disintegrin and metalloproteinase domain-containing protein 10 (227-235)
cagaccgaccaccuguucuuuaaguac

SEQ ID NO: 57630 - RNA, 33 nt, Artificial Sequence
  RNA polymerase-associated protein CTR9 homolog (424-434)
cagaccgacauccaaggcgcccugagcgcuuac

SEQ ID NO: 57631 - RNA, 36 nt, Artificial Sequence
  AP-1 complex subunit beta-1 (59-70)
cagaccgacaaccuggagcucaagaaacuuguguac

SEQ ID NO: 57632 - RNA, 30 nt, Artificial Sequence
  Charged multivesicular body protein 7 (274-283)
cagaccgaccaaaugguguucaacgccuac

SEQ ID NO: 57633 - RNA, 33 nt, Artificial Sequence; identical to SEQ ID NO: 33406
  Midasin (362-372)

SEQ ID NO: 57634 - RNA, 30 nt, Artificial Sequence
  RAB6A-GEF complex partner protein 2 (260-269)
cagaccgaggaaagagugcaacccgaguac

SEQ ID NO: 57635 - RNA, 33 nt, Artificial Sequence
  UDP-glucose:glycoprotein glucosyltransferase 1 (1328-1338)
cagaccgagaagcaaagaaucauuuggggcuac

SEQ ID NO: 57636 - RNA, 30 nt, Artificial Sequence
  Probable cation-transporting ATPase 13A3 (131-140)
cagaccgagagccaacagaucagauacuuc

SEQ ID NO: 57637 - RNA, 36 nt, Artificial Sequence
  Intraflagellar transport protein 81 homolog (447-458)
cagaccauggaggaaaagaaaggcaucagcggguac

SEQ ID NO: 57638 - RNA, 27 nt, Artificial Sequence
  Importin subunit alpha-5 (516-524)
cagguggaccugaaccaacagcaguac

SEQ ID NO: 57639 - RNA, 30 nt, Artificial Sequence; identical to SEQ ID NO: 33412
  Protein PRR14L (815-824)

SEQ ID NO: 57640 - RNA, 30 nt, Artificial Sequence
  DNA-directed RNA polymerase II subunit RPB9 (103-112)
agagccgaggacgcuaugaggcuguacuau

SEQ ID NO: 57641 - RNA, 27 nt, Artificial Sequence
  CDK5 regulatory subunit-associated protein 2 (1335-1343)
agaaucgaggaagacaaccugaccuac

SEQ ID NO: 57642 - RNA, 27 nt, Artificial Sequence
  Vacuole membrane protein 1 (105-113)
agaaucgagaagcaguuccugcucuac

SEQ ID NO: 57643 - RNA, 27 nt, Artificial Sequence
  Lanosterol 14-alpha demethylase (418-426)
agacuggacuucaaccccgauagguac

SEQ ID NO: 57644 - RNA, 30 nt, Artificial Sequence
  Tubulin alpha-1C chain (355-364)
agacuggaccacaaguucgaucucauguac

SEQ ID NO: 57645 - RNA, 36 nt, Artificial Sequence
  Nitric oxide synthase, endothelial (782-793)
agacuggacaccggcgggcaggagggacuccaauac

SEQ ID NO: 57646 - RNA, 33 nt, Artificial Sequence
  Transmembrane emp24 domain-containing protein 7 (68-78)
agacuggaggaccccgauggcaaggugcucuac

SEQ ID NO: 57647 - RNA, 30 nt, Artificial Sequence
  Peptidyl-prolyl cis-trans isomerase FKBP3 (189-198)
agacuggagaucgaacccgagugggccuac

SEQ ID NO: 57648 - RNA, 33 nt, Artificial Sequence
  Ubiquitin carboxyl-terminal hydrolase 15 (403-413)
agaauggacccccugaccaagccuaugcaguac

SEQ ID NO: 57649 - RNA, 36 nt, Artificial Sequence
  WASH complex subunit strumpellin (230-241)
agaagcgacgauaucuacaaccagguguccgccuau

SEQ ID NO: 57650 - RNA, 30 nt, Artificial Sequence
  Selenocysteine insertion sequence-binding protein 2-like (379-388)
agaagcgaccccaacuccgagucucuguac

SEQ ID NO: 57651 - RNA, 33 nt, Artificial Sequence
  Nuclear cap-binding protein subunit 2 (10-20)
agaagcgacuccuacguggagcugucucaguau

SEQ ID NO: 57652 - RNA, 36 nt, Artificial Sequence
  Methyltransferase-like protein 22 (16-27)
agaagcgacaccgugcuguccgauguccaccucuac

SEQ ID NO: 57653 - RNA, 45 nt, Artificial Sequence
  Eukaryotic translation initiation factor 3 subunit E (431-445)
agaagcgaggcccccaacugggcuacccaggacuccggcuucuac

SEQ ID NO: 57654 - RNA, 30 nt, Artificial Sequence
  F-box only protein 9 (210-219)
agaaccgacgccauccugcucggccacuac

SEQ ID NO: 57655 - RNA, 33 nt, Artificial Sequence
  General transcription factor II-I repeat domain-containing protein 2B (69-79)
agaaccgacuuccagaaggauuuugccaaauac

SEQ ID NO: 57656 - RNA, 27 nt, Artificial Sequence
  Cytoplasmic dynein 1 heavy chain 1 (3544-3552)
agaaccgacaucgccaggacagaguac

SEQ ID NO: 57657 - RNA, 36 nt, Artificial Sequence
  ERI1 exoribonuclease 3 (98-109)
agaaccauggagaucgaaagcacauuccacauguac

SEQ ID NO: 57658 - RNA, 30 nt, Artificial Sequence
  U5 small nuclear ribonucleoprotein 200 kDa helicase (666-675)
agaguggaccccgccaagggccuguucuac

SEQ ID NO: 57659 - RNA, 30 nt, Artificial Sequence
  DmX-like protein 2 (729-738)
agaguggaccccaucggcccucugagcuac

SEQ ID NO: 57660 - RNA, 27 nt, Artificial Sequence
  Serine/threonine-protein kinase SMG1 (32-40)
agcgccgaccccggcaaccugaaguac

SEQ ID NO: 57661 - RNA, 27 nt, Artificial Sequence
  DNA mismatch repair protein Msh6 (340-348)
agcgacucccuggugcagaagggcuac

SEQ ID NO: 57662 - RNA, 33 nt, Artificial Sequence
  GPI transamidase component PIG-T (52-62)
agcgagcugcagagagaaggcgugucccacuac

SEQ ID NO: 57663 - RNA, 33 nt, Artificial Sequence; identical to SEQ ID NO: 33436
  Ectonucleotide pyrophosphatase/phosphodiesterase family member 2 (308-318)

SEQ ID NO: 57664 - RNA, 30 nt, Artificial Sequence
  Protein YIPF5 (17-26)
agcaucgacgaucagucccaacagucuuac

SEQ ID NO: 57665 - RNA, 30 nt, Artificial Sequence
  E3 ubiquitin-protein ligase HECTD1 (532-541)
agcaucgagagacugccccuccaccuuuac

SEQ ID NO: 57666 - RNA, 33 nt, Artificial Sequence
  Creatine kinase B-type (164-174)
agccuggacggcgaucucgccgggagauacuau

SEQ ID NO: 57667 - RNA, 33 nt, Artificial Sequence
  Protein FAM91A1 (206-216)
agccuggacuacaacgugguccacucccucuau

SEQ ID NO: 57668 - RNA, 27 nt, Artificial Sequence
  Cytochrome c oxidase subunit 4 isoform 1, mitochondrial (36-44)
agcauggacgagaagguggaacuguac

SEQ ID NO: 57669 - RNA, 30 nt, Artificial Sequence
  Paired box protein Pax-3 (312-321)
agcauggaccccgugaccggcuaccaguau

SEQ ID NO: 57670 - RNA, 30 nt, Artificial Sequence
  Heat shock protein HSP 90-alpha (174-183)
agcuccgacgcccuggauaagaucagauac

SEQ ID NO: 57671 - RNA, 33 nt, Artificial Sequence
  Integrin beta-3 (536-546)
agcuccgacuucggcaagaucaccgggaaauac

SEQ ID NO: 57672 - RNA, 33 nt, Artificial Sequence
  Protein SEC13 homolog (124-134)
agcuccgacggcgccaucucucugcucaccuac

SEQ ID NO: 57673 - RNA, 30 nt, Artificial Sequence
  Nucleoporin GLE1 (16-25)
agcuccgacaagggcagacugugcuacuau

SEQ ID NO: 57674 - RNA, 27 nt, Artificial Sequence
  Histone-lysine N-methyltransferase SETDB2 (309-317)
agcuccgacaagaucaccacaggcuac

SEQ ID NO: 57675 - RNA, 30 nt, Artificial Sequence
  Scm-like with four MBT domains protein 1 (201-210)
agcuccgacaacuacgagcacuggcuguau

SEQ ID NO: 57676 - RNA, 30 nt, Artificial Sequence
  Forkhead box protein M1 (39-48)
agcuccgaccccgccucucagcugucauac

SEQ ID NO: 57677 - RNA, 33 nt, Artificial Sequence
  Protein kinase C and casein kinase substrate in neurons protein 2 (14-24)
agcuccgacucuuucugggaggugggcaacuac

SEQ ID NO: 57678 - RNA, 36 nt, Artificial Sequence
  Vacuolar protein sorting-associated protein 51 homolog (377-388)
agcuccgacucuucaaagagaaccuucaguguguac

SEQ ID NO: 57679 - RNA, 30 nt, Artificial Sequence
  Clathrin interactor 1 (163-172)
agcuccgacucugugggcggguucagauac

SEQ ID NO: 57680 - RNA, 33 nt, Artificial Sequence
  Protein FAM189B (167-177)
agcuccgacaccgccgauuucagagaccuguac

SEQ ID NO: 57681 - RNA, 33 nt, Artificial Sequence
  WD40 repeat-containing protein SMU1 (7-17)
agcuccgacgugaucagacugauuaugcaguac

SEQ ID NO: 57682 - RNA, 30 nt, Artificial Sequence
  Archaemetzincin-2 (168-177)
agcuccgacuacucuaucuucgauaacuau

SEQ ID NO: 57683 - RNA, 27 nt, Artificial Sequence
  Nuclear receptor-interacting protein 1 (271-279)
agcuccgaggcccaccugcagcaauac

SEQ ID NO: 57684 - RNA, 27 nt, Artificial Sequence
  KIF1-binding protein (164-172)
agcuccgaggcccuguacaaccaguau

SEQ ID NO: 57685 - RNA, 39 nt, Artificial Sequence
  DNA-dependent protein kinase catalytic subunit (3366-3378)
agcuccgaggacucugaaaaggugaucgccggccuguac

SEQ ID NO: 57686 - RNA, 30 nt, Artificial Sequence
  Protein C-ets-1 (192-201)
agcuccgaggaacugcucucucuuaaguac

SEQ ID NO: 57687 - RNA, 33 nt, Artificial Sequence
  UPF0769 protein C21orf59 (235-245)
agcuccgaggaacagaagcaacugaugcucuac

SEQ ID NO: 57688 - RNA, 33 nt, Artificial Sequence
  Protein-glutamate O-methyltransferase (271-281)
agcuccgagcuggccaccgaagugcacuucuac

SEQ ID NO: 57689 - RNA, 27 nt, Artificial Sequence
  Trafficking protein particle complex subunit 3 (15-23)
agcuccgagcuguucacccucacauac

SEQ ID NO: 57690 - RNA, 30 nt, Artificial Sequence
  Centriole, cilia and spindle-associated protein (253-262)
agcuccgagaaccccuggaugaccgaauac

SEQ ID NO: 57691 - RNA, 33 nt, Artificial Sequence
  Proline and serine-rich protein 1 (34-44)
agcuccgagcagguggucgaccugcucagauac

SEQ ID NO: 57692 - RNA, 30 nt, Artificial Sequence
  Ubiquitin carboxyl-terminal hydrolase 38 (207-216)
agcuccgagucuggccacuacuauucauac

SEQ ID NO: 57693 - RNA, 30 nt, Artificial Sequence
  DNA-dependent protein kinase catalytic subunit (556-565)
agcuccgagucucugaaccaccuccuuuac

SEQ ID NO: 57694 - RNA, 42 nt, Artificial Sequence
  Single Ig IL-1-related receptor (382-395)
agcuccgagguggacgucucugaucugggcucaagaaacuac

SEQ ID NO: 57695 - RNA, 33 nt, Artificial Sequence; identical to SEQ ID NO: 33468
  ELAV-like protein 1 (99-109)

SEQ ID NO: 57696 - RNA, 33 nt, Artificial Sequence
  Protein FAM65B (857-867)
agcuccgagguggucaccguuuuccaguacuau

SEQ ID NO: 57697 - RNA, 36 nt, Artificial Sequence
  Interferon-induced, double-stranded RNA-activated protein kinase (420-431)
agcucccaggacuacggcaaggagguggaucuguau

SEQ ID NO: 57698 - RNA, 36 nt, Artificial Sequence
  Histone-arginine methyltransferase CARM1 (405-416)
agcaccgcccccacagagccucugacucacugguac

SEQ ID NO: 57699 - RNA, 39 nt, Artificial Sequence
  Protein HIRA (392-404)
agcaccgccgugaucgagaaccccgaaaugcugaaguac

SEQ ID NO: 57700 - RNA, 33 nt, Artificial Sequence
  Nucleoprotein TPR (1876-1886)
agcaccgacggcgagguggaaacacaggucuac

SEQ ID NO: 57701 - RNA, 30 nt, Artificial Sequence
  Recombining binding protein suppressor of hairless (318-327)
agcaccgacaaggccgaguacacauucuau

SEQ ID NO: 57702 - RNA, 33 nt, Artificial Sequence
  Holliday junction recognition protein (523-533)
agcaccgacaaggccuccauggaggugagauac

SEQ ID NO: 57703 - RNA, 24 nt, Artificial Sequence
  Eukaryotic translation initiation factor 3 subunit I (111-118)
agcaccgacaagcagaugggcuac

SEQ ID NO: 57704 - RNA, 33 nt, Artificial Sequence
  Myocyte-specific enhancer factor 2A (59-69)
agcaccgacauggauaaggugcugcucaaauac

SEQ ID NO: 57705 - RNA, 33 nt, Artificial Sequence
  Integrin alpha-5 (179-189)
agcaccgacaacuucacaagaauccuggaguac

SEQ ID NO: 57706 - RNA, 30 nt, Artificial Sequence
  Nuclear pore complex protein Nup93 (541-550)
agcaccgaccccagagaggcccugcaguac

SEQ ID NO: 57707 - RNA, 30 nt, Artificial Sequence
  Immunoglobulin superfamily member 8 (131-140)
agcaccgacacaagauaccugggcuccuau

SEQ ID NO: 57708 - RNA, 45 nt, Artificial Sequence
  RNA-binding protein FUS (44-58)
agcaccgacacauccggcuacgggcagucuucauauaguagcuac

SEQ ID NO: 57709 - RNA, 30 nt, Artificial Sequence
  Signal-induced proliferation-associated 1-like protein 1 (909-918)
agcaccgacacaucccugaagaucuucuac

SEQ ID NO: 57710 - RNA, 36 nt, Artificial Sequence
  Eukaryotic translation initiation factor 2A (264-275)
agcaccgacguggauaagacaggcgccuccuacuau

SEQ ID NO: 57711 - RNA, 33 nt, Artificial Sequence
  26S proteasome non-ATPase regulatory subunit 8 (239-249)
agcaccgagcuggccaagcaggugaucgaauac

SEQ ID NO: 57712 - RNA, 27 nt, Artificial Sequence
  Asparagine-tRNA ligase, cytoplasmic (174-182)
agcaccgaguccucuguggccgucuac

SEQ ID NO: 57713 - RNA, 36 nt, Artificial Sequence
  Mitochondrial import inner membrane translocase subunit Tim17-A (156-167)
agcacccagcugcccuccucuccuuucggcgacuac

SEQ ID NO: 57714 - RNA, 27 nt, Artificial Sequence
  Zinc finger protein 106 (662-670)
agcaccuccgagaucggcacaagauac

SEQ ID NO: 57715 - RNA, 27 nt, Artificial Sequence
  Protein strawberry notch homolog 1 (1169-1177)
agcaccuccggccacguggagcuguac

SEQ ID NO: 57716 - RNA, 33 nt, Artificial Sequence
  T-complex protein 1 subunit epsilon (270-280)
agcguggaggacuacaaggcccugcagaaauau

SEQ ID NO: 57717 - RNA, 30 nt, Artificial Sequence
  Glutamine-fructose-6-phosphate aminotransferase (isomerizing) 1 (444-453)
accgccgacacacugaugggccucagauac

SEQ ID NO: 57718 - RNA, 36 nt, Artificial Sequence
  Splicing factor 3B subunit 6 (31-42)
accgccgaggaaauguacgacaucuucggcaaguau

SEQ ID NO: 57719 - RNA, 30 nt, Artificial Sequence
  Annexin A11 (431-440)
accgaccugcucgauaucagaagcgaguac

SEQ ID NO: 57720 - RNA, 30 nt, Artificial Sequence
  RNA binding motif protein 22 (244-253)
accgagacagaccugagaaaccacuucuac

SEQ ID NO: 57721 - RNA, 33 nt, Artificial Sequence
  Glutamine-tRNA ligase (47-57)
accaucgacaaggccacaggcauucugcucuac

SEQ ID NO: 57722 - RNA, 30 nt, Artificial Sequence; identical to SEQ ID NO: 33495
  Pre-mRNA-splicing factor ATP-dependent RNA helicase DHX15 (294-303)

SEQ ID NO: 57723 - RNA, 30 nt, Artificial Sequence; identical to SEQ ID NO: 33496
  ATP-dependent RNA helicase DHX8 (717-726)

SEQ ID NO: 57724 - RNA, 30 nt, Artificial Sequence
  BRCA2-interacting transcriptional repressor EMSY (945-954)
acccuggacccccagacaggccucuucuac

SEQ ID NO: 57725 - RNA, 39 nt, Artificial Sequence
  A-kinase anchor protein 11 (1443-1455)
acccuggaccccuacagaaacgaggugagccagcucuau

SEQ ID NO: 57726 - RNA, 27 nt, Artificial Sequence
  E3 SUMO-protein ligase NSE2 (70-78)
acccuggacagacagcucaaccacuac

SEQ ID NO: 57727 - RNA, 36 nt, Artificial Sequence
  TOX high mobility group box family member 4 (105-116)
accauggaccuggaucacagcaucggcacacaguac

SEQ ID NO: 57728 - RNA, 30 nt, Artificial Sequence
  Dynein light chain roadblock-type 1 (40-49)
accauggacaaccccacaacuacgcaguac

SEQ ID NO: 57729 - RNA, 33 nt, Artificial Sequence; identical to SEQ ID NO: 33502
  Retinal dehydrogenase 1 (105-115)

SEQ ID NO: 57730 - RNA, 42 nt, Artificial Sequence
  Alpha-N-acetylglucosaminidase (545-558)
accagcgcccccucccuggcuacaucuccugcauucagauac

SEQ ID NO: 57731 - RNA, 30 nt, Artificial Sequence
  Cytoplasmic dynein 1 heavy chain 1 (1163-1172)
accagcgacgccgugacauucaucacuuac

SEQ ID NO: 57732 - RNA, 30 nt, Artificial Sequence
  G1/S-specific cyclin-E2 (81-90)
accagcgacuucuccagauuuacaaacuac

SEQ ID NO: 57733 - RNA, 33 nt, Artificial Sequence
  E3 SUMO-protein ligase RanBP2 (1071-1081)
accagcgacaagccccugcagggcgauggguac

SEQ ID NO: 57734 - RNA, 33 nt, Artificial Sequence
  Endoplasmic reticulum metallopeptidase 1 (361-371)
accagcgacaugcuggccgcugcauccaaguac

SEQ ID NO: 57735 - RNA, 33 nt, Artificial Sequence
  Fizzy-related protein homolog (81-91)
accagcgacaacggcaaggaugggcuggccuac

SEQ ID NO: 57736 - RNA, 27 nt, Artificial Sequence
  Beta-hexosaminidase subunit alpha (32-40)
accagcgaccagagauacgugcuguau

SEQ ID NO: 57737 - RNA, 30 nt, Artificial Sequence
  Leucine-rich repeat flightless-interacting protein 1 (241-250)
accagcgacacacugaacaaugugggcuac

SEQ ID NO: 57738 - RNA, 33 nt, Artificial Sequence
  Protein SDE2 homolog (58-68)
accagcgacacagugcagcacggcgccgucuac

SEQ ID NO: 57739 - RNA, 36 nt, Artificial Sequence
  Uncharacterized protein C15orf41 (61-72)
accagcgaggccaucgaauccuacuaucagagauac

SEQ ID NO: 57740 - RNA, 27 nt, Artificial Sequence
  High affinity cAMP-specific and IBMX-insensitive 3',5'-cyclic phosphodiesterase 8A (115-123)
accagcgaggacagauucauccaguac

SEQ ID NO: 57741 - RNA, 36 nt, Artificial Sequence
  Caprin-1 (438-449)
accagcgagggcuacacagccucccagccccuguau

SEQ ID NO: 57742 - RNA, 39 nt, Artificial Sequence
  Endoplasmin (188-200)
accagcgagcugaucggccaguucggggugggauuuuac

SEQ ID NO: 57743 - RNA, 33 nt, Artificial Sequence
  Sodium/potassium-transporting ATPase subunit alpha-2 (19-29)
accagcgagcagcuggacgauauccucaaguac

SEQ ID NO: 57744 - RNA, 27 nt, Artificial Sequence
  Putative pre-mRNA-splicing factor ATP-dependent RNA helicase DHX16 (487-495)
accagcgagagaacagugcugagguac

SEQ ID NO: 57745 - RNA, 27 nt, Artificial Sequence
  Neuroplastin (57-65)
accagcuccucucacacacugacuuac

SEQ ID NO: 57746 - RNA, 36 nt, Artificial Sequence
  Unconventional myosin-Va (1775-1786)
accacagcccagaucgugaagguccugaaccucuac

SEQ ID NO: 57747 - RNA, 30 nt, Artificial Sequence
  Leukotriene A-4 hydrolase (421-430)
accacagacgauuggaaggacuuccuguac

SEQ ID NO: 57748 - RNA, 33 nt, Artificial Sequence
  DNA-directed RNA polymerases I and III subunit RPAC1 (26-36)
accacagacuuccccggcaacuacagcggguau

SEQ ID NO: 57749 - RNA, 27 nt, Artificial Sequence
  Mitotic spindle assembly checkpoint protein MAD2A (56-64)
accacagaccuggagcucaucaaguac

SEQ ID NO: 57750 - RNA, 30 nt, Artificial Sequence
  Ubiquitin-like modifier-activating enzyme 6 (145-154)
accacagaccugagcuuccucgauaaguac

SEQ ID NO: 57751 - RNA, 39 nt, Artificial Sequence
  Exosome complex component RRP4 (34-46)
accacagacacuggcuucaugagagggcacggaacguac

SEQ ID NO: 57752 - RNA, 27 nt, Artificial Sequence
  SET domain-containing protein 4 (60-68)
accacagacacugugaucagaagcuac

SEQ ID NO: 57753 - RNA, 30 nt, Artificial Sequence
  Transmembrane protein 70, mitochondrial (28-37)
accacagacacuuacaaggccaucacguau

SEQ ID NO: 57754 - RNA, 27 nt, Artificial Sequence
  Enhancer of filamentation 1 (432-440)
accacagacuggagaugcuacggcuau

SEQ ID NO: 57755 - RNA, 36 nt, Artificial Sequence
  Matrin-3 (444-455)
accacagaggacgcccaggcugcaguggauuacuau

SEQ ID NO: 57756 - RNA, 30 nt, Artificial Sequence
  Superkiller viralicidic activity 2-like 2 (229-238)
accacagagauccugagaagcaugcucuac

SEQ ID NO: 57757 - RNA, 36 nt, Artificial Sequence
  TBCC domain-containing protein 1 (479-490)
accacagagauccccggcgggcugccuagcguguac

SEQ ID NO: 57758 - RNA, 39 nt, Artificial Sequence
  DNA damage-binding protein 1 (894-906)
accacagagaaggaacugagaacugagugcaaccacuac

SEQ ID NO: 57759 - RNA, 36 nt, Artificial Sequence
  Mitotic spindle assembly checkpoint protein MAD1 (643-654)
accacagagaaccaguacagacugacuagccucuau

SEQ ID NO: 57760 - RNA, 39 nt, Artificial Sequence
  Akirin-2 (77-89)
accacagagcagauccuguacaacauuaagcaagaauau

SEQ ID NO: 57761 - RNA, 30 nt, Artificial Sequence
  vacuolar protein sorting-associated protein 26A isoform 3 (217-226)
accacagagacugaaacgaucgccaaguac

SEQ ID NO: 57762 - RNA, 39 nt, Artificial Sequence
  BCL2/adenovirus E1B 19 kDa protein-interacting protein 2 (168-180)
accacagaggugaucagaaagggcagcauuacugaauac

SEQ ID NO: 57763 - RNA, 27 nt, Artificial Sequence
  ADP-sugar pyrophosphatase (192-200)
accguggacgccagagucuacagcuau

SEQ ID NO: 57764 - RNA, 27 nt, Artificial Sequence
  U3 small nucleolar RNA-associated protein 15 homolog (108-116)
accguggacuucacagccgauaaguac

SEQ ID NO: 57765 - RNA, 30 nt, Artificial Sequence; identical to SEQ ID NO: 33538
  Fascin (484-493)

SEQ ID NO: 57766 - RNA, 30 nt, Artificial Sequence
  Proteasome subunit alpha type-7 (97-106)
accguggaggaccccgucacaguugaauac

SEQ ID NO: 57767 - RNA, 36 nt, Artificial Sequence
  14-3-3 protein epsilon (38-49)
accguggaggaaagaaaccugcucagcgucgccuac

SEQ ID NO: 57768 - RNA, 36 nt, Artificial Sequence
  Importin-11 (432-443)
accguggaggaaacaggcggggacagcuggaaguac

SEQ ID NO: 57769 - RNA, 36 nt, Artificial Sequence
  Nodal modulator 2 (271-282)
accgugagcagagaggacggcuccuucucuuuuuac

SEQ ID NO: 57770 - RNA, 33 nt, Artificial Sequence
  Tetratricopeptide repeat protein 13 (506-516)
guggccgacagacugggcagccucaugcaguac

SEQ ID NO: 57771 - RNA, 39 nt, Artificial Sequence
  Proteasome subunit beta type-4 (85-97)
gugaucgacgaggaacugcucggcgaugggcacagcuac

SEQ ID NO: 57772 - RNA, 30 nt, Artificial Sequence
  Tubulin alpha-1C chain (144-153)
gugaucgacgaggucagaaccggcacauac

SEQ ID NO: 57773 - RNA, 36 nt, Artificial Sequence
  Spindlin-3 (381-392)
gugaucgacagccuggucggcaagcagguugaguac

SEQ ID NO: 57774 - RNA, 30 nt, Artificial Sequence
  Protein HIRA (395-404)
gugaucgagaaccccgaaaugcugaaguac

SEQ ID NO: 57775 - RNA, 27 nt, Artificial Sequence
  Beta-hexosaminidase subunit alpha (60-68)
gugcuggacgaggccuuccagagauac

SEQ ID NO: 57776 - RNA, 27 nt, Artificial Sequence
  LETM1 and EF-hand domain-containing protein 1, mitochondrial (157-165)
gugcuggacgagcucaagcacuacuau

SEQ ID NO: 57777 - RNA, 27 nt, Artificial Sequence
  Activating signal cointegrator 1 complex subunit 2 (386-394)
gugcuggacgagaccagaacagccuac

SEQ ID NO: 57778 - RNA, 36 nt, Artificial Sequence
  DNA-directed RNA polymerase I subunit RPA1 (748-759)
gugcuggacaaggcccacuacggcagcuccgcuuau

SEQ ID NO: 57779 - RNA, 36 nt, Artificial Sequence
  Nucleolar protein 14 (322-333)
gugcuggacaaggaugacagaaggcuccuuagcuac

SEQ ID NO: 57780 - RNA, 30 nt, Artificial Sequence; identical to SEQ ID NO: 33553
  ATP-binding cassette sub-family B member 10, mitochondrial (194-203)

SEQ ID NO: 57781 - RNA, 27 nt, Artificial Sequence
  Kinesin-like protein KIF18B (102-110)
gugcuggacagcuuccuccagggcuac

SEQ ID NO: 57782 - RNA, 27 nt, Artificial Sequence
  Ubiquitin-conjugating enzyme E2 Z (270-278)
gugauggagaagagcuuccuggaauac

SEQ ID NO: 57783 - RNA, 27 nt, Artificial Sequence
  Elongator complex protein 1 (872-880)
gugagcgccgaggaagcucugaaguac

SEQ ID NO: 57784 - RNA, 36 nt, Artificial Sequence
  DNA repair protein XRCC4 (166-177)
gugagcgccaaggaggcucuggaaaccgaccucuac

SEQ ID NO: 57785 - RNA, 27 nt, Artificial Sequence
  FERM domain-containing protein 4A (924-932)
gugagcgacgagcugagacagugguac

SEQ ID NO: 57786 - RNA, 30 nt, Artificial Sequence; identical to SEQ ID NO: 33559
  Constitutive coactivator of peroxisome proliferator-activated receptor gamma (279-288)

SEQ ID NO: 57787 - RNA, 36 nt, Artificial Sequence
  Importin-5 (842-853)
gugagcgacauccugcacuccauuuucucuucauac

SEQ ID NO: 57788 - RNA, 36 nt, Artificial Sequence
  Splicing factor 1 (136-147)
gugagcgacaaggucaugaucccccaggaugaguac

SEQ ID NO: 57789 - RNA, 27 nt, Artificial Sequence
  Phosphatidylinositol 4-phosphate 3-kinase C2 domain-containing subunit beta (917-925)
gugagcgaccugagagucacccacuac

SEQ ID NO: 57790 - RNA, 30 nt, Artificial Sequence; identical to SEQ ID NO: 33563
  Acetyl-coenzyme A transporter 1 (439-448)

SEQ ID NO: 57791 - RNA, 39 nt, Artificial Sequence
  Zinc finger protein 275 (31-43)
gugagcgaccccuccccuaacaccgauccagccaaguac

SEQ ID NO: 57792 - RNA, 36 nt, Artificial Sequence
  Tripeptidyl-peptidase 1 (68-79)
gugagcgaccccuccucuccucaguacggcaaguau

SEQ ID NO: 57793 - RNA, 39 nt, Artificial Sequence
  Tripeptidyl-peptidase 1 (68-80)
gugagcgaccccuccucuccucaguacggcaaguaucug

SEQ ID NO: 57794 - RNA, 33 nt, Artificial Sequence
  Cleavage and polyadenylation specificity factor subunit 1 (1271-1281)
gugagcgacagagauaggaaccugauggucuac

SEQ ID NO: 57795 - RNA, 36 nt, Artificial Sequence
  TELO2-interacting protein 1 homolog (40-51)
gugagcgacuccgcccugcaggagcuccaacaguac

SEQ ID NO: 57796 - RNA, 30 nt, Artificial Sequence; identical to SEQ ID NO: 33569
  E3 ubiquitin-protein ligase HACE1 (749-758)

SEQ ID NO: 57797 - RNA, 27 nt, Artificial Sequence
  AT-rich interactive domain-containing protein 2 (138-146)
gugagcgacuaccugagacaguccuau

SEQ ID NO: 57798 - RNA, 33 nt, Artificial Sequence
  Dolichyl-diphosphooligosaccharide-proteinosyltransferase subunit 2 (116-126)
gugagcgaggacuccucugucacccagaucuac

SEQ ID NO: 57799 - RNA, 33 nt, Artificial Sequence
  Histone H2B type 1-A (113-123)
gugagcgagggcaccaaggccgucacaaaauac

SEQ ID NO: 57800 - RNA, 36 nt, Artificial Sequence
  Tetraspanin-33 (126-137)
gugagcgagaucauuaacaaugccauaguccacuac

SEQ ID NO: 57801 - RNA, 27 nt, Artificial Sequence
  Peroxisome assembly factor 2 (962-970)
gugagcgagcaggaacugcucagauac

SEQ ID NO: 57802 - RNA, 30 nt, Artificial Sequence
  TraB domain-containing protein (260-269)
gugagcgagagagacgucuaccugaccuau

SEQ ID NO: 57803 - RNA, 39 nt, Artificial Sequence
  Paired amphipathic helix protein Sin3a (44-56)
gugagcgagaccaugcaguccgccacaggcauccaauac

SEQ ID NO: 57804 - RNA, 45 nt, Artificial Sequence
  Nuclear pore complex protein Nup160 (1171-1185)
gugagcgaguacgucgacgccguucugggcaaggggcaccaguau

SEQ ID NO: 57805 - RNA, 36 nt, Artificial Sequence
  Oral-facial-digital syndrome 1 protein (787-798)
gugagcucccccccugagcagaaggucggccuguac

SEQ ID NO: 57806 - RNA, 33 nt, Artificial Sequence
  Zinc finger protein 106 (703-713)
gugagcuccaccucugagaucggcacaagauac

SEQ ID NO: 57807 - RNA, 39 nt, Artificial Sequence
  Nuclear factor of activated T-cells, cytoplasmic 1 (282-294)
gugaccgacgauagcuggcugggcaacacaacucaguac

SEQ ID NO: 57808 - RNA, 36 nt, Artificial Sequence
  Mediator of RNA polymerase II transcription subunit 27 (204-215)
gugaccgaccacgccacaacugcucugcuccauuac

SEQ ID NO: 57809 - RNA, 30 nt, Artificial Sequence
  DnaJ homolog subfamily B member 12 (287-296)
gugaccgaccaccugggcgucguuuacuau

SEQ ID NO: 57810 - RNA, 33 nt, Artificial Sequence
  Telomerase protein component 1 (1368-1378)
gugaccgaccaccugagacucuucacacuuuac

SEQ ID NO: 57811 - RNA, 36 nt, Artificial Sequence
  TBC1 domain family member 8 (757-768)
gugaccgacaucagcgaucugauuagagacuccuac

SEQ ID NO: 57812 - RNA, 30 nt, Artificial Sequence
  Protein MEF2BNB (13-22)
gugaccgacaaguucacagagagcgucuac

SEQ ID NO: 57813 - RNA, 36 nt, Artificial Sequence
  Complex I assembly factor TMEM126B, mitochondrial (46-57)
gugaccgacaagcuguucgucaucgaugcccucuac

SEQ ID NO: 57814 - RNA, 39 nt, Artificial Sequence
  Histone acetyltransferase type B catalytic subunit (339-351)
gugaccgacaugagcgaugccgagcaguacagauccuau

SEQ ID NO: 57815 - RNA, 36 nt, Artificial Sequence
  Afadin (762-773)
gugaccgaccccgauagcggccugugcucccacuac

SEQ ID NO: 57816 - RNA, 30 nt, Artificial Sequence
  Cation-independent mannose-6-phosphate receptor (769-778)
gugaccgaccccagcacacuggagcaguac

SEQ ID NO: 57817 - RNA, 30 nt, Artificial Sequence
  DNA polymerase delta subunit 3 (14-23)
gugaccgaccagaacaagaucgucacauac

SEQ ID NO: 57818 - RNA, 33 nt, Artificial Sequence
  Gamma-secretase subunit APH-1A (59-69)
gugaccgacagaagcgaugccaggcugcaguac

SEQ ID NO: 57819 - RNA, 30 nt, Artificial Sequence
  DNA topoisomerase 2-alpha (1118-1127)
gugaccgacagcggccccacauucaacuac

SEQ ID NO: 57820 - RNA, 30 nt, Artificial Sequence
  Bcl-2-modifying factor (88-97)
gugaccgaggaaccccagagacuguucuac

SEQ ID NO: 57821 - RNA, 33 nt, Artificial Sequence
  Protein SET (135-145)
gugaccgaguucgaagacaucaagagcggcuac

SEQ ID NO: 57822 - RNA, 27 nt, Artificial Sequence
  Epididymis-specific alpha-mannosidase (660-668)
gugaccgagaucagacaguacuucuau

SEQ ID NO: 57823 - RNA, 33 nt, Artificial Sequence
  Ras association domain-containing protein 3 (64-74)
gugaccgagagccccgccaaguucgcucuguac

SEQ ID NO: 57824 - RNA, 30 nt, Artificial Sequence
  WD repeat-containing protein 63 (174-183)
gugaccgagagcacaaagcagaucacuuac

SEQ ID NO: 57825 - RNA, 27 nt, Artificial Sequence
  Uncharacterized protein C15orf61 (132-140)
gugaccgagacaguccacacuagcuac

SEQ ID NO: 57826 - RNA, 36 nt, Artificial Sequence
  Nesprin-2 (266-277)
guggucgaccccgaugagaagagcaucaugaccuac

SEQ ID NO: 57827 - RNA, 36 nt, Artificial Sequence
  Spindlin-1 (194-205)
guggucgacagccugguuggcaagcagguggaguac

SEQ ID NO: 57828 - RNA, 39 nt, Artificial Sequence
  Protein transport protein Sec61 subunit alpha isoform 1 (324-336)
uggagcgacaccuccucuggcgggcccgccagagcuuac

SEQ ID NO: 57829 - RNA, 30 nt, Artificial Sequence
  Cholinesterase (404-413)
uggguggacgaucagagacccgagaacuac

SEQ ID NO: 57830 - RNA, 39 nt, Artificial Sequence
  Acetyl-CoA carboxylase 1 (1775-1787)
uggguggaccccgaggauccuuacaagggcuauagauac

SEQ ID NO: 57831 - RNA, 30 nt, Artificial Sequence
  Proteasome subunit beta type-4 (129-138)
uacgccgacggcgagagcuuccugggguau

SEQ ID NO: 57832 - RNA, 30 nt, Artificial Sequence
  DNA polymerase epsilon catalytic subunit A (1792-1801)
uacgccgacaaccaggugaugcacuucuau

SEQ ID NO: 57833 - RNA, 33 nt, Artificial Sequence
  Sorting nexin-4 (300-310)
uacgccgaccagcugaaggaguaucucuucuac

SEQ ID NO: 57834 - RNA, 33 nt, Artificial Sequence
  Cleavage stimulation factor subunit 3 (337-347)
uacgccgacuaugaggaaagcagaaugaaguac

SEQ ID NO: 57835 - RNA, 27 nt, Artificial Sequence
  Transmembrane protein 87A (216-224)
uacgccgaguuccagaacaucagauau

SEQ ID NO: 57836 - RNA, 27 nt, Artificial Sequence
  Transcription elongation factor SPT6 (993-1001)
uacggcgacaagcacaucacccuguau

SEQ ID NO: 57837 - RNA, 33 nt, Artificial Sequence
  Lysyl oxidase homolog 3 (543-553)
uacaucgaggacagaccccugcacaugcucuau

SEQ ID NO: 57838 - RNA, 36 nt, Artificial Sequence
  High mobility group protein 20A (39-50)
uaccuggacgaggccgauagagacaaggaaagguau

SEQ ID NO: 57839 - RNA, 36 nt, Artificial Sequence
  SWI/SNF-related matrix-associated actin-dependent regulator of chromatin subfamily E member 1-related (119-130)
uaccuggacgaggccgaaagagagaagcagcaauau

SEQ ID NO: 57840 - RNA, 27 nt, Artificial Sequence
  Prostamide/prostaglandin F synthase (122-130)
uaccuggacgagagcaagcagcucuau

SEQ ID NO: 57841 - RNA, 27 nt, Artificial Sequence
  putative RHO/RAC effector protein (1124-1132)
uaccuggacauccccaacccuagauau

SEQ ID NO: 57842 - RNA, 24 nt, Artificial Sequence
  Proteasome activator complex subunit 3 (188-195)
uaccuggaccagaucagcagauau

SEQ ID NO: 57843 - RNA, 36 nt, Artificial Sequence
  E3 ubiquitin-protein ligase TRIM4 (423-434)
uaccuggacagaggcaccgggaacgugagcuucuau

SEQ ID NO: 57844 - RNA, 33 nt, Artificial Sequence
  U3 small nucleolar RNA-associated protein 6 homolog (480-490)
uaccuggacugggccuauagaagcggcggguac

SEQ ID NO: 57845 - RNA, 33 nt, Artificial Sequence
  E3 ubiquitin-protein ligase UBR2 (1583-1593)
uaccuggagggcgaaagagacgccaucagguau

SEQ ID NO: 57846 - RNA, 36 nt, Artificial Sequence
  MAGUK p55 subfamily member 2 (440-451)
uaccuggagcacggcgaauaugaggggaaccucuac

SEQ ID NO: 57847 - RNA, 39 nt, Artificial Sequence
  DNA-directed RNA polymerase II subunit RPB1 (657-669)
uaccuggagaugggccacgacaucaccagacucuucuau

SEQ ID NO: 57848 - RNA, 36 nt, Artificial Sequence
  KIF1-binding protein (161-172)
uaccuggagagcuccgaagcccucuauaaccaguac

SEQ ID NO: 57849 - RNA, 30 nt, Artificial Sequence
  Immediate early response gene 5-like protein (47-56)
uaccugagcgagagauaugccgaacucuac

SEQ ID NO: 57850 - RNA, 27 nt, Artificial Sequence
  Cullin-1 (42-50)
uacauggagcuguauacccacguguac

SEQ ID NO: 57851 - RNA, 27 nt, Artificial Sequence
  Far upstream element-binding protein 1 (632-640)
uacagcgccgcuugggcagaguauuac

SEQ ID NO: 57852 - RNA, 39 nt, Artificial Sequence
  Nuclear factor erythroid 2-related factor 1 (12-24)
uacagcgcccccccuggcgacccacuguccaccaacuau

SEQ ID NO: 57853 - RNA, 39 nt, Artificial Sequence
  Cohesin subunit SA-2 (319-331)
uacagcgacgccuuccugaacgauuccuaucucaaguac

SEQ ID NO: 57854 - RNA, 30 nt, Artificial Sequence
  Dimethylaniline monooxygenase (N-oxide-forming) 4 (69-78)
uacagcgacuuccccuuucacgaggauuau

SEQ ID NO: 57855 - RNA, 36 nt, Artificial Sequence
  Dihydropyrimidine dehydrogenase (NADP(+)) (211-222)
uacagcgacaucaccauuuucgagaagcaggaauau

SEQ ID NO: 57856 - RNA, 36 nt, Artificial Sequence
  Cyclin-dependent kinases regulatory subunit 2 (8-19)
uacagcgacaaguauuucgaugagcacuacgaauau

SEQ ID NO: 57857 - RNA, 33 nt, Artificial Sequence
  Spermatogenesis-associated protein 20 (357-367)
uacagcgacguggccaagggcauccugcaguau

SEQ ID NO: 57858 - RNA, 33 nt, Artificial Sequence
  F-box only protein 3 (79-89)
uacagcgacgugggcagauauaucgaucacuac

SEQ ID NO: 57859 - RNA, 27 nt, Artificial Sequence
  AN1-type zinc finger protein 6 (175-183)
uacagcgacgugcacaacugcuccuau

SEQ ID NO: 57860 - RNA, 36 nt, Artificial Sequence
  YTH domain-containing family protein 1 (300-311)
uacagcgaggacgauauccacagauccauuaaguau

SEQ ID NO: 57861 - RNA, 30 nt, Artificial Sequence
  Intraflagellar transport protein 122 homolog (415-424)
uacagcgaggaccuguccgauaugcacuau

SEQ ID NO: 57862 - RNA, 33 nt, Artificial Sequence
  SUN domain-containing protein 2 (38-48)
uacagcgaggacagaaucggccuggccgauuau

SEQ ID NO: 57863 - RNA, 33 nt, Artificial Sequence
  MICOS complex subunit MIC60 (615-625)
uacagcgaggaaacccugagagccagguucuau

SEQ ID NO: 57864 - RNA, 39 nt, Artificial Sequence
  45 kDa calcium-binding protein (340-352)
uacagcgaguucuuuaccggcuccaagcugguggacuau

SEQ ID NO: 57865 - RNA, 30 nt, Artificial Sequence
  Protein artemis (322-331)
uacagcgagaucaaggacuuccuguccuau

SEQ ID NO: 57866 - RNA, 30 nt, Artificial Sequence
  Integrator complex subunit 6 (86-95)
uacagcgagcugggccaccccuucggguau

SEQ ID NO: 57867 - RNA, 33 nt, Artificial Sequence
  Plectin (1309-1319)
uacagcgagcugaccacacucacuucccaguau

SEQ ID NO: 57868 - RNA, 30 nt, Artificial Sequence
  Vacuolar protein sorting-associated protein 13C (3362-3371)
uacagcgagcaguuccugaagcaaauguau

SEQ ID NO: 57869 - RNA, 27 nt, Artificial Sequence
  Protein Lines homolog 1 (181-189)
uacagcgaguccaacaaggccaucuau

SEQ ID NO: 57870 - RNA, 36 nt, Artificial Sequence
  Proline-rich protein 7 (145-156)
uacagcgaggugcugaccgacacaagaggccucuau

SEQ ID NO: 57871 - RNA, 30 nt, Artificial Sequence
  Zinc finger MIZ domain-containing protein 2 (269-278)
uacagcgagguguaucccggccagcaauac

SEQ ID NO: 57872 - RNA, 36 nt, Artificial Sequence
  Annexin A4 (298-309)
uacagcuucaucaagggcgacaccuccggggauuau

SEQ ID NO: 57873 - RNA, 30 nt, Artificial Sequence
  Nucleoporin NUP188 homolog (239-248)
uacagcuuccuggacaagauguccuuuuau

SEQ ID NO: 57874 - RNA, 27 nt, Artificial Sequence
  RNA-binding protein 5 (374-382)
uacagccaggacuaucaacaguucuac

SEQ ID NO: 57875 - RNA, 36 nt, Artificial Sequence
  Serine/arginine-rich splicing factor 10 (105-116)
uacagcuccucuagauaugacgauuacgacagguau

SEQ ID NO: 57876 - RNA, 27 nt, Artificial Sequence
  Interferon-induced helicase C domain-containing protein 1 (5-13)
uacagcaccgacgagaacuucagauau

SEQ ID NO: 57877 - RNA, 27 nt, Artificial Sequence
  Filamin-A (1685-1693)
uacaccgccccccagccuggcaaguau

SEQ ID NO: 57878 - RNA, 36 nt, Artificial Sequence
  DAZ-associated protein 2 (35-46)
uacaccgacgcccccccugcuuauagcgagcuguac

SEQ ID NO: 57879 - RNA, 24 nt, Artificial Sequence
  Tetraspanin-4 (107-114)
uacaccgacaagaucgauagauau

SEQ ID NO: 57880 - RNA, 30 nt, Artificial Sequence
  Serine/threonine-protein phosphatase PP1-beta catalytic subunit (68-77)
uacaccgaccugcucagacuuuucgaguau

SEQ ID NO: 57881 - RNA, 36 nt, Artificial Sequence
  E3 ubiquitin-protein ligase HUWE1 (157-168)
uacaccgacauggagagcgaagauuaucacuucuac

SEQ ID NO: 57882 - RNA, 33 nt, Artificial Sequence
  Chromodomain-helicase-DNA-binding protein 8 (513-523)
uacaccgaggccgaagaguucuuugugaaguau

SEQ ID NO: 57883 - RNA, 30 nt, Artificial Sequence; identical to SEQ ID NO: 33656
  Protein transport protein Sec61 subunit beta (59-68)

SEQ ID NO: 57884 - RNA, 39 nt, Artificial Sequence
  DNA-directed RNA polymerases I, II, and III subunit RPABC5 (29-41)
uacaccgagggcgacgcccuggaugcucucgggcuuaag

SEQ ID NO: 57885 - RNA, 45 nt, Artificial Sequence
  DNA-directed RNA polymerases I, II, and III subunit RPABC5 (29-43)
uacaccgagggcgacgcccuggaugcucucgggcuuaagagauau

SEQ ID NO: 57886 - RNA, 33 nt, Artificial Sequence
  Ribosomal RNA small subunit methyltransferase NEP1 (207-217)
uacaccgagaagauggugagcaucuccaacuau

SEQ ID NO: 57887 - RNA, 30 nt, Artificial Sequence
  Presenilin-2 (112-121)
uacaccgagaagaacggccagcugaucuau

SEQ ID NO: 57888 - RNA, 33 nt, Artificial Sequence
  Exocyst complex component 4 (66-76)
uacaccgagcugacaacugccaucagaacguau

SEQ ID NO: 57889 - RNA, 30 nt, Artificial Sequence
  Prolyl 3-hydroxylase 2 (212-221)
uacaccgagcccaacuauuggaucagauac

SEQ ID NO: 57890 - RNA, 33 nt, Artificial Sequence
  Mitogen-activated protein kinase kinase kinase 1 (1349-1359)
uacaccgagcagcugcucagaggccuuagcuau

SEQ ID NO: 57891 - RNA, 36 nt, Artificial Sequence
  Coiled-coil domain-containing protein 121 (212-223)
uacaccgagcagcccgaaaagguguggaacagcuau

SEQ ID NO: 57892 - RNA, 30 nt, Artificial Sequence
  Gamma-secretase subunit PEN-2 (47-56)
uacaccgagcagagccaaaucaagggcuau

SEQ ID NO: 57893 - RNA, 27 nt, Artificial Sequence
  Vacuolar protein sorting-associated protein 18 homolog (381-389)
uacaccgagagagccguguucagguau

SEQ ID NO: 57894 - RNA, 36 nt, Artificial Sequence
  Osteoclast-stimulating factor 1 (21-32)
uacaccuucgagcccagaacaccugacgaacuguau

SEQ ID NO: 57895 - RNA, 30 nt, Artificial Sequence
  Cleavage and polyadenylation specificity factor subunit 5 (45-54)
uacaccuucggcacaaaggagccccuguau

SEQ ID NO: 57896 - RNA, 27 nt, Artificial Sequence
  Coatomer subunit alpha (543-551)
uacaccacaagcaaccacaucaaguau

SEQ ID NO: 57897 - RNA, 33 nt, Artificial Sequence
  Nodal modulator 2 (270-280)
uacaccgugagcagagaggacggcuccuucucu

SEQ ID NO: 57898 - RNA, 39 nt, Artificial Sequence
  Nodal modulator 2 (270-282)
uacaccgugagcagagaggacggcuccuucucuuuuuau

SEQ ID NO: 57899 - RNA, 36 nt, Artificial Sequence
  Nuclear pore complex protein Nup160 (1174-1185)
uacguggacgccguccugggcaaggggcaccaguau

SEQ ID NO: 57900 - RNA, 30 nt, Artificial Sequence
  General transcription factor 3C polypeptide 1 (627-636)
uacguggacgaugccagcuggaugagauau

SEQ ID NO: 57901 - RNA, 27 nt, Artificial Sequence
  39S ribosomal protein L35, mitochondrial (172-180)
uacguggacgaucccuaucagaaguac

SEQ ID NO: 57902 - RNA, 30 nt, Artificial Sequence
  UDP-N-acetylhexosamine pyrophosphorylase-like protein 1 (277-286)
uacguggacgaggaaggcaaccuggucaag

SEQ ID NO: 57903 - RNA, 36 nt, Artificial Sequence
  RNA-binding protein 39 (436-447)
uacguggacaagaacagcgcccagggcaaugucuau

SEQ ID NO: 57904 - RNA, 27 nt, Artificial Sequence
  Thioredoxin-like protein AAED1 (118-126)
uacguggaccccgagagagaaaucuau

SEQ ID NO: 57905 - RNA, 33 nt, Artificial Sequence
  Transmembrane emp24 domain-containing protein 3 (68-78)
uacguggaggacccccagggcaacaccaucuau

SEQ ID NO: 57906 - RNA, 27 nt, Artificial Sequence
  Vacuole membrane protein 1 (94-102)
uacguggagggcguccaccagcaauau

SEQ ID NO: 57907 - RNA, 33 nt, Artificial Sequence
  Eukaryotic translation initiation factor 3 subunit K (32-42)
uacguggagacccaggccaaggaaaacgcuuau

SEQ ID NO: 57908 - RNA, 30 nt, Artificial Sequence
  Serine/threonine-protein kinase mTOR (89-98)
gccaucgcuagccugauuggcguggagggg

SEQ ID NO: 57909 - RNA, 27 nt, Artificial Sequence
  Eukaryotic translation initiation factor 4 gamma 1 (1248-1256)
gccaucauugaggaauaccugcaccuc

SEQ ID NO: 57910 - RNA, 27 nt, Artificial Sequence
  Protein timeless homolog (848-856)
gccauccuggcucaccucaacaccgug

SEQ ID NO: 57911 - RNA, 27 nt, Artificial Sequence
  Zinc finger and BTB domain-containing protein 6 (396-404)
gcccugaagaaacaccucaccagcgug

SEQ ID NO: 57912 - RNA, 27 nt, Artificial Sequence
  Small subunit processome component 20 homolog (626-634)
gcccugauggagcucuuccccaagcuu

SEQ ID NO: 57913 - RNA, 27 nt, Artificial Sequence
  Ribosome-binding protein 1 (124-132)
gcccugcagaagagacucgacgaggug

SEQ ID NO: 57914 - RNA, 30 nt, Artificial Sequence
  Cytochrome c oxidase subunit 7A2, mitochondrial (74-83)
gccguggcuagcuuccccaagaaacaggag

SEQ ID NO: 57915 - RNA, 27 nt, Artificial Sequence
  DNA-dependent protein kinase catalytic subunit (145-153)
gacgaguucaagaucggcgaacuguuu

SEQ ID NO: 57916 - RNA, 27 nt, Artificial Sequence
  Exosome component 10 (58-66)
gacgaguacgauuucuauagaagcuuu

SEQ ID NO: 57917 - RNA, 42 nt, Artificial Sequence
  Peptidyl-prolyl cis-trans isomerase A (9-22)
gacaucgccguggauggcgagccccuggggagagucagcuuc

SEQ ID NO: 57918 - RNA, 63 nt, Artificial Sequence
  Endoplasmin (783-803)
gacgugggcaccgaugaggaagaggaaacagccaaggagagcacugcugaaaaagacgagcug

SEQ ID NO: 57919 - RNA, 27 nt, Artificial Sequence
  Zinc finger protein 638 (1756-1764)
gaggaagacgaggauagccuggccgac

SEQ ID NO: 57920 - RNA, 27 nt, Artificial Sequence
  Inner centromere protein (48-56)
gaguucagcaaggaacccgagcugaug

SEQ ID NO: 57921 - RNA, 27 nt, Artificial Sequence
  ATP-binding cassette sub-family A member 3 (1686-1694)
gagcagguguuccugagcuuugcccac

SEQ ID NO: 57922 - RNA, 30 nt, Artificial Sequence
  Vinculin (10-19)
gagagcauccuggaacccguggcccagcaa

SEQ ID NO: 57923 - RNA, 27 nt, Artificial Sequence
  Microtubule-associated protein 1A (806-814)
gagaccgaacugacauaccccacuaac

SEQ ID NO: 57924 - RNA, 30 nt, Artificial Sequence
  C-Jun-amino-terminal kinase-interacting protein 2 (683-692)
uucgacgugcaguuucugggcagcgucgag

SEQ ID NO: 57925 - RNA, 57 nt, Artificial Sequence
  Cytochrome c oxidase subunit 7C, mitochondrial (45-63)
uucggcagcgccuuugcuacccccuuccugguggucagacaccagcuccuuaagaca

SEQ ID NO: 57926 - RNA, 75 nt, Artificial Sequence
  Peptidyl-prolyl cis-trans isomerase A (88-112)
uucauccugaagcacaccggccccgggauucucagcauggccaacgcuggaccuaauacaaacgguucccaguuu

SEQ ID NO: 57927 - RNA, 30 nt, Artificial Sequence
  Elongation factor 1-alpha 1 (415-424)
uucagcgacuaccccccucugggcagauuu

SEQ ID NO: 57928 - RNA, 42 nt, Artificial Sequence
  Elongation factor 1-beta (2-15)
ggcuucggggaccugaagagccccgccggacuccaggugcuu

SEQ ID NO: 57929 - RNA, 69 nt, Artificial Sequence
  Elongation factor 1-beta (2-24)
ggcuucggggaccugaagagccccgccggacuccaggugcuuaacgauuaccuggcugacaaauccuau

SEQ ID NO: 57930 - RNA, 30 nt, Artificial Sequence; identical to SEQ ID NO: 33703
  Plakophilin-2 (581-590)

SEQ ID NO: 57931 - RNA, 45 nt, Artificial Sequence
  Peptidyl-prolyl cis-trans isomerase A (10-24)
aucgccguggacggcgagccccuggggagagucagcuucgaacuc

SEQ ID NO: 57932 - RNA, 27 nt, Artificial Sequence
  39S ribosomal protein L34, mitochondrial (58-66)
aucaagagaaaaaacaagcacggcugg

SEQ ID NO: 57933 - RNA, 27 nt, Artificial Sequence
  Centrosome-associated protein 350 (2297-2305)
auccugagcaagaaagaccucccccuu

SEQ ID NO: 57934 - RNA, 48 nt, Artificial Sequence
  Glyceraldehyde-3-phosphate dehydrogenase (269-284)
aucagcugguacgacaacgaguucggcuauuccaauagaguggucgau

SEQ ID NO: 57935 - RNA, 57 nt, Artificial Sequence
  Macrophage migration inhibitory factor (3-21)
aucgugaacaccaauguccccagagccagcguuccugacggcuuccuguccgagcuc

SEQ ID NO: 57936 - RNA, 27 nt, Artificial Sequence
  T-complex protein 1 subunit theta (234-242)
aaguacaacaucaugcuggugagacuc

SEQ ID NO: 57937 - RNA, 27 nt, Artificial Sequence
  Ras-related protein Rab-27A (178-186)
cuggaccucaucaugaagagaauggag

SEQ ID NO: 57938 - RNA, 27 nt, Artificial Sequence
  Uncharacterized protein C18orf8 (501-509)
cugcacgagcucgugaucaagacccuu

SEQ ID NO: 57939 - RNA, 27 nt, Artificial Sequence
  ER membrane protein complex subunit 1 (641-649)
cugcucaucgacgaugaguacaaggug

SEQ ID NO: 57940 - RNA, 27 nt, Artificial Sequence
  DNA-dependent protein kinase catalytic subunit (2836-2844)
cugcuccaggacuucaacagauuucuu

SEQ ID NO: 57941 - RNA, 27 nt, Artificial Sequence
  Acyl-CoA desaturase (132-140)
cugccccucagacuuuuccugaucauu

SEQ ID NO: 57942 - RNA, 27 nt, Artificial Sequence
  Serine/threonine-protein kinase tousled-like 1 (49-57)
auggacgagcuggccagccucgauccc

SEQ ID NO: 57943 - RNA, 42 nt, Artificial Sequence
  Protein S100-A4 (59-72)
augagcaaccuggacuccaauagagauaacgagguggacuuc

SEQ ID NO: 57944 - RNA, 27 nt, Artificial Sequence
  Centriolin (2174-2182)
aaccugaaucaguuccuccccgagcuu

SEQ ID NO: 57945 - RNA, 27 nt, Artificial Sequence
  Transcriptional repressor CTCF (102-110)
aacauggaggaacagcccaucaauauu

SEQ ID NO: 57946 - RNA, 27 nt, Artificial Sequence
  Golgin subfamily A member 3 (875-883)
agacuggacagcgagcucaaggaacuu

SEQ ID NO: 57947 - RNA, 66 nt, Artificial Sequence
  Cytochrome c oxidase subunit 7C, mitochondrial (17-38)
agccacuacgaggaaggccccgggaagaaccugccuuucuccguggagaauaaauggucucuccuu

SEQ ID NO: 57948 - RNA, 33 nt, Artificial Sequence
  Midasin (1471-1481)
agccuggccgacgauuccgugcucgagagacuu

SEQ ID NO: 57949 - RNA, 27 nt, Artificial Sequence
  Cullin-7 (999-1007)
agccugcacaccgagcucaacuccgug

SEQ ID NO: 57950 - RNA, 27 nt, Artificial Sequence
  Small subunit processome component 20 homolog (299-307)
agccugcucgaccuucacaccaaggug

SEQ ID NO: 57951 - RNA, 33 nt, Artificial Sequence
  Death-inducer obliterator 1 (941-951)
agcccccuggaggaccucuccccuugcccagcc

SEQ ID NO: 57952 - RNA, 33 nt, Artificial Sequence
  Glycogen debranching enzyme (980-990)
accaucgccgaggugggcaaguggcugcaggcu

SEQ ID NO: 57953 - RNA, 27 nt, Artificial Sequence
  Inositol 1,4,5-trisphosphate receptor type 3 (2354-2362)
acccuguucaacgugaucaagagcguc

SEQ ID NO: 57954 - RNA, 27 nt, Artificial Sequence
  Transmembrane protein 181 (304-312)
accuacaaccccgccuucagcagacug

SEQ ID NO: 57955 - RNA, 30 nt, Artificial Sequence
  A-kinase anchor protein 9 (1398-1407)
guggacagcgucguuaucaccgaguccgau

SEQ ID NO: 57956 - RNA, 27 nt, Artificial Sequence
  Signal peptidase complex catalytic subunit SEC11A (146-154)
gugcccuacaucggcauugucaccaua

SEQ ID NO: 57957 - RNA, 27 nt, Artificial Sequence
  E3 ubiquitin-protein ligase MYLIP (431-439)
guguaccugcccacccacacaagccuc

SEQ ID NO: 57958 - RNA, 27 nt, Artificial Sequence
  Guanine nucleotide-binding protein G(i) subunit alpha-2 (155-163)
uacuaucugaacgaccucgagagaauc

SEQ ID NO: 57959 - RNA, 27 nt, Artificial Sequence
  Peptidyl-prolyl cis-trans isomerase FKBP4 (372-380)
gccagagcugacuuccagaaggugcug

SEQ ID NO: 57960 - RNA, 27 nt, Artificial Sequence
  Metaxin-1 (300-308)
gccagagcucccggcaccaggacacug

SEQ ID NO: 57961 - RNA, 27 nt, Artificial Sequence
  Exosome component 10 (437-445)
gccagagacgauacccacuaccugcuc

SEQ ID NO: 57962 - RNA, 33 nt, Artificial Sequence
  Annexin A2 (195-205)
gccagagaccuguacgaugcuggcgugaagagg

SEQ ID NO: 57963 - RNA, 27 nt, Artificial Sequence
  Coronin-1C (333-341)
gccagauucuuuaagcugcacgagagg

SEQ ID NO: 57964 - RNA, 27 nt, Artificial Sequence
  Uncharacterized protein KIAA1143 (19-27)
gccagauucaaggagagggugggcuac

SEQ ID NO: 57965 - RNA, 30 nt, Artificial Sequence
  Disabled homolog 2 (41-50)
gccagauucaagggcgacggggugaaauac

SEQ ID NO: 57966 - RNA, 30 nt, Artificial Sequence
  Serine/threonine-protein kinase tousled-like 2 (17-26)
gccagauucaccggcgugggggucagcaag

SEQ ID NO: 57967 - RNA, 27 nt, Artificial Sequence
  ER degradation-enhancing alpha-mannosidase-like protein 1 (134-142)
gccagaggcauguucguguuuggguac

SEQ ID NO: 57968 - RNA, 36 nt, Artificial Sequence
  Lon protease homolog 2, peroxisomal (291-302)
gccagaauccugcucgacaacgaucacuacgcuaug

SEQ ID NO: 57969 - RNA, 27 nt, Artificial Sequence
  Chromodomain-helicase-DNA-binding protein 4 (1901-1909)
gccagaauccccccuguggcugucagg

SEQ ID NO: 57970 - RNA, 30 nt, Artificial Sequence
  Actin-related protein 2/3 complex subunit 4 (157-166)
gccagaaucguggcugaggaauuccugaag

SEQ ID NO: 57971 - RNA, 27 nt, Artificial Sequence
  Coiled-coil domain-containing protein 85B (34-42)
gccagacuggcugcacucgugcagagg

SEQ ID NO: 57972 - RNA, 33 nt, Artificial Sequence
  THO complex subunit 5 homolog (189-199)
gccagacuggacugggagcucgaacagaggaag

SEQ ID NO: 57973 - RNA, 30 nt, Artificial Sequence
  Squamous cell carcinoma antigen recognized by T-cells 3 (242-251)
gccagacuggagaaggugcacagccucuuc

SEQ ID NO: 57974 - RNA, 27 nt, Artificial Sequence
  G patch domain-containing protein 4 (161-169)
gccagacugggcaucaccaugaaggcu

SEQ ID NO: 57975 - RNA, 27 nt, Artificial Sequence
  Natural resistance-associated macrophage protein 2 (119-127)
gccagacugggcguggucaccgggcuc

SEQ ID NO: 57976 - RNA, 30 nt, Artificial Sequence
  WD repeat-containing protein 36 (93-102)
gccagaaacaaggagaucgugcacaccuuc

SEQ ID NO: 57977 - RNA, 27 nt, Artificial Sequence
  General transcription factor 3C polypeptide 1 (196-204)
gccagaagcgagcugcucaccacagug

SEQ ID NO: 57978 - RNA, 27 nt, Artificial Sequence
  Nucleolin (392-400)
gccagaacccugcucgcuaagaaccuu

SEQ ID NO: 57979 - RNA, 27 nt, Artificial Sequence
  S-adenosyl-L-methionine-dependent tRNA 4-demethylwyosine synthase (634-642)
gccagaaccccccacugggcucuguuc

SEQ ID NO: 57980 - RNA, 27 nt, Artificial Sequence
  Puromycin-sensitive aminopeptidase (236-244)
gccagaacccccgugaugagcacauac

SEQ ID NO: 57981 - RNA, 27 nt, Artificial Sequence
  Puromycin-sensitive aminopeptidase-like protein (236-244)
gccagaacccccgugacaagcacuuac

SEQ ID NO: 57982 - RNA, 27 nt, Artificial Sequence
  Protocadherin gamma-A11 (880-888)
gccagauacggcccccaguucacccug

SEQ ID NO: 57983 - RNA, 27 nt, Artificial Sequence
  Protein ELYS (743-751)
gagagaaucgaaaagcuguggaaaagg

SEQ ID NO: 57984 - RNA, 27 nt, Artificial Sequence
  Unconventional myosin-Ic (223-231)
gagagaaacccccagagcuaccuguau

SEQ ID NO: 57985 - RNA, 27 nt, Artificial Sequence
  TRPM8 channel-associated factor 1 (164-172)
uucagaggcccccuggugaucaacagg

SEQ ID NO: 57986 - RNA, 27 nt, Artificial Sequence
  Translocon-associated protein subunit alpha (124-132)
uucagauacccccaggacuaucaauuu

SEQ ID NO: 57987 - RNA, 30 nt, Artificial Sequence
  Protein DEK (128-137)
ggccaguucagcggguuucccuucgagaag

SEQ ID NO: 57988 - RNA, 27 nt, Artificial Sequence
  DAZ-associated protein 2 (5-13)
ggccaguaccccacccaaccuacauau

SEQ ID NO: 57989 - RNA, 30 nt, Artificial Sequence
  Sorting and assembly machinery component 50 homolog (154-163)
ggcagagccgagaaggugaccuuccaguuu

SEQ ID NO: 57990 - RNA, 30 nt, Artificial Sequence
  Replication protein A 32 kDa subunit (83-92)
ggcagagcccccaucagcaacccugggaug

SEQ ID NO: 57991 - RNA, 27 nt, Artificial Sequence
  Eukaryotic peptide chain release factor GTP-binding subunit ERF3A (142-150)
ggcagagccuacuucgagaccgaaaag

SEQ ID NO: 57992 - RNA, 27 nt, Artificial Sequence
  Actin, gamma-enteric smooth muscle (140-148)
ggcagagaccugaccgauuaccucaug

SEQ ID NO: 57993 - RNA, 27 nt, Artificial Sequence
  Protocadherin Fat 1 (1957-1965)
ggcagauucgccgggcugaccagcgug

SEQ ID NO: 57994 - RNA, 30 nt, Artificial Sequence
  H(+)/Cl(-) exchange transporter 7 (345-354)
ggcagauucgacagcgagaagauggccuac

SEQ ID NO: 57995 - RNA, 30 nt, Artificial Sequence
  Zinc finger protein 407 (271-280)
ggcagauucgacagcuccaucauuaggaua

SEQ ID NO: 57996 - RNA, 30 nt, Artificial Sequence
  U2 small nuclear ribonucleoprotein B'' (185-194)
ggcagacacgacaucgccuucguggaguuu

SEQ ID NO: 57997 - RNA, 33 nt, Artificial Sequence
  40S ribosomal protein S4, X isoform (171-181)
ggcagaaucggggugauuaccaacagggagcgg

SEQ ID NO: 57998 - RNA, 33 nt, Artificial Sequence
  40S ribosomal protein S11 (70-80)
ggcagaauccugagcgggguggucaccaagaug

SEQ ID NO: 57999 - RNA, 33 nt, Artificial Sequence
  Desmoplakin (1624-1634)
ggcagaaucagcaccgaggaagccauuaggaag

SEQ ID NO: 58000 - RNA, 27 nt, Artificial Sequence
  Protein PML (295-303)
ggcagacuggacgccgugcuccagagg

SEQ ID NO: 58001 - RNA, 30 nt, Artificial Sequence
  Plectin (581-590)
ggcagacuggaccuccaguacgccaagcuu

SEQ ID NO: 58002 - RNA, 27 nt, Artificial Sequence
  Kelch-like protein 7 (492-500)
ggcagacuggggcacauccucgaguac

SEQ ID NO: 58003 - RNA, 27 nt, Artificial Sequence
  H(+)/Cl(-) exchange transporter 3 (772-780)
ggcagacugcucgggaucauuaccaag

SEQ ID NO: 58004 - RNA, 33 nt, Artificial Sequence
  Heat shock cognate 71 kDa protein (508-518)
ggcagacugagcaaggaggacaucgaaaggaug

SEQ ID NO: 58005 - RNA, 30 nt, Artificial Sequence
  Protein phosphatase 1 regulatory subunit 3C (303-312)
ggcagaauggagaaccuggccagcuacagg

SEQ ID NO: 58006 - RNA, 27 nt, Artificial Sequence
  Integrin-linked protein kinase (45-53)
ggcagaagcgccguggucgagaugcug

SEQ ID NO: 58007 - RNA, 27 nt, Artificial Sequence
  Interleukin-17 receptor C (13-21)
ggcagaagccccgugguccugucccuc

SEQ ID NO: 58008 - RNA, 30 nt, Artificial Sequence
  Solute carrier family 22 member 18 (21-30)
ggcagaagcuccgugauccugcucaccuac

SEQ ID NO: 58009 - RNA, 33 nt, Artificial Sequence
  Insulin receptor substrate 2 (717-727)
ggcagaaccuuccccgccagcgggggagguuac

SEQ ID NO: 58010 - RNA, 27 nt, Artificial Sequence
  Sodium/potassium-transporting ATPase subunit beta-1 (26-34)
ggcagaaccgggggaagcugguucaag

SEQ ID NO: 58011 - RNA, 27 nt, Artificial Sequence
  ATP-binding cassette sub-family B member 8, mitochondrial (643-651)
ggcagaaccgugcuggucaucgcccac

SEQ ID NO: 58012 - RNA, 27 nt, Artificial Sequence
  ATP-dependent RNA helicase A (565-573)
ggcagaaccuaccccgugcaggaguau

SEQ ID NO: 58013 - RNA, 30 nt, Artificial Sequence
  Sorbin and SH3 domain-containing protein 2 (299-308)
ggcagaguggggaucuuccccauuagcuac

SEQ ID NO: 58014 - RNA, 33 nt, Artificial Sequence
  Poly (ADP-ribose) polymerase 1 (590-600)
ggcagaguggggaccgucaucggaagcaacaag

SEQ ID NO: 58015 - RNA, 27 nt, Artificial Sequence
  Intraflagellar transport protein 172 homolog (293-301)
ggcagaugggagcaggcccacaagcug

SEQ ID NO: 58016 - RNA, 27 nt, Artificial Sequence
  Histidine-tRNA ligase, cytoplasmic (247-255)
ggcagauacgacgggcuggugggaaug

SEQ ID NO: 58017 - RNA, 30 nt, Artificial Sequence
  DNA mismatch repair protein Msh6 (337-346)
ggcagauacagcgacucccuggugcagaag

SEQ ID NO: 58018 - RNA, 33 nt, Artificial Sequence
  Anion exchange protein 2 (262-272)
cacagauucgaggacgugcccggcgucaggcgg

SEQ ID NO: 58019 - RNA, 27 nt, Artificial Sequence
  Probable cation-transporting ATPase 13A2 (626-634)
cacagauuccccuuuagcuccgcccug

SEQ ID NO: 58020 - RNA, 27 nt, Artificial Sequence
  26S proteasome non-ATPase regulatory subunit 13 (23-31)
cacagacuggaggaacucuacaccaag

SEQ ID NO: 58021 - RNA, 30 nt, Artificial Sequence
  26S proteasome non-ATPase regulatory subunit 13 (23-32)
cacagacuggaggaacucuacaccaagaaa

SEQ ID NO: 58022 - RNA, 27 nt, Artificial Sequence
  40S ribosomal protein S16 (83-91)
aucagacagagcauuuccaaggcccug

SEQ ID NO: 58023 - RNA, 27 nt, Artificial Sequence
  RNA-binding motif protein 22 (258-266)
aucagaaccauuacagugguccagagg

SEQ ID NO: 58024 - RNA, 27 nt, Artificial Sequence
  Protein MCM10 homolog (426-434)
aagagagccgaccugcagagcaccuuc

SEQ ID NO: 58025 - RNA, 30 nt, Artificial Sequence
  Signal peptidase complex subunit 2 (164-173)
aagagauucgacgauaaauacacccugaag

SEQ ID NO: 58026 - RNA, 33 nt, Artificial Sequence
  Unconventional myosin-Ib (37-47)
aagagauucgaccacagcgagaucuacaccuau

SEQ ID NO: 58027 - RNA, 27 nt, Artificial Sequence
  Eukaryotic translation initiation factor 3 subunit C-like protein (55-63)
aagagauucgaggaacugaccaaccuc

SEQ ID NO: 58028 - RNA, 27 nt, Artificial Sequence
  KIF1-binding protein (201-209)
aagagauucgagaaaguguacacccac

SEQ ID NO: 58029 - RNA, 27 nt, Artificial Sequence
  NADH dehydrogenase (ubiquinone) iron-sulfur protein 5 (8-16)
aagagauucggccugaacaucgacagg

SEQ ID NO: 58030 - RNA, 27 nt, Artificial Sequence
  Peptidyl-prolyl cis-trans isomerase FKBP3 (70-78)
aagagauucaaaggcaccgagagcauc

SEQ ID NO: 58031 - RNA, 30 nt, Artificial Sequence
  Intron-binding protein aquarius (24-33)
aagagacacgaccuggugaaacucggcuuc

SEQ ID NO: 58032 - RNA, 27 nt, Artificial Sequence
  THO complex subunit 5 homolog (342-350)
aagagacacccccugagcgugaugcuc

SEQ ID NO: 58033 - RNA, 27 nt, Artificial Sequence
  MAP/microtubule affinity-regulating kinase 3 (330-338)
aagagaaucgacauuauggugggcaug

SEQ ID NO: 58034 - RNA, 30 nt, Artificial Sequence
  NADH dehydrogenase (ubiquinone) flavoprotein 2, mitochondrial (61-70)
aagagaaucgaggccauugugaaaaacuac

SEQ ID NO: 58035 - RNA, 27 nt, Artificial Sequence
  ATP-binding cassette sub-family F member 2 (275-283)
aagagaauccuggugcucgucagccac

SEQ ID NO: 58036 - RNA, 27 nt, Artificial Sequence
  Ceramide synthase 5 (210-218)
aagagaaaagacuuccugaucauguuu

SEQ ID NO: 58037 - RNA, 27 nt, Artificial Sequence
  Probable ATP-dependent RNA helicase DDX47 (296-304)
aagagacugggcagccucaacaaauuc

SEQ ID NO: 58038 - RNA, 27 nt, Artificial Sequence
  Transcription intermediary factor 1-beta (207-215)
aagagagugcaggucgacguuaaaaug

SEQ ID NO: 58039 - RNA, 27 nt, Artificial Sequence
  Arginine-tRNA ligase, cytoplasmic (579-587)
cugagauuccccgagauccuccagaag

SEQ ID NO: 58040 - RNA, 27 nt, Artificial Sequence
  Neurosecretory protein VGF (4-12)
cugagacucagcgccuccgcucuuuuc

SEQ ID NO: 58041 - RNA, 27 nt, Artificial Sequence
  Large proline-rich protein BAG6 (1102-1110)
cugagaagcgacauccagaagaggcuc

SEQ ID NO: 58042 - RNA, 33 nt, Artificial Sequence
  Ribonucleoside-diphosphate reductase subunit M2 (271-281)
cugagauggaucggcgacaaggaggccaccuac

SEQ ID NO: 58043 - RNA, 30 nt, Artificial Sequence
  T-complex protein 1 subunit gamma (305-314)
augagagccaacaucaccgcuauuaggcgg

SEQ ID NO: 58044 - RNA, 27 nt, Artificial Sequence
  U8 snoRNA-decapping enzyme (48-56)
augagauucgacggcaggcugggguuu

SEQ ID NO: 58045 - RNA, 27 nt, Artificial Sequence
  Epididymal secretory protein E1 (1-9)
augagauuccuggccgcuaccuuucuc

SEQ ID NO: 58046 - RNA, 27 nt, Artificial Sequence
  26S proteasome non-ATPase regulatory subunit 2 (477-485)
augagacugggcagcaucuucgggcuc

SEQ ID NO: 58047 - RNA, 27 nt, Artificial Sequence
  Translocon-associated protein subunit alpha (1-9)
augagacugcuccccaggcuucuguug

SEQ ID NO: 58048 - RNA, 30 nt, Artificial Sequence
  Phenylalanine-tRNA ligase alpha subunit (94-103)
augagacugcccagcggcaaggugggguuc

SEQ ID NO: 58049 - RNA, 27 nt, Artificial Sequence
  Dipeptidyl peptidase 8 (31-39)
aacagauucaagggcgugaaauacuuu

SEQ ID NO: 58050 - RNA, 27 nt, Artificial Sequence
  E3 ubiquitin-protein ligase UHRF1 (553-561)
aacagauacgacggcaucuauaaggug

SEQ ID NO: 58051 - RNA, 27 nt, Artificial Sequence
  ATP-dependent RNA helicase DDX19B (371-379)
cagagagccgcugugaucgagagguuc

SEQ ID NO: 58052 - RNA, 27 nt, Artificial Sequence
  V-type proton ATPase subunit H (106-114)
cagagagugagcaucuucuuugacuac

SEQ ID NO: 58053 - RNA, 27 nt, Artificial Sequence
  Zinc finger protein 536 (380-388)
agaagguucaaggagcccugguuucug

SEQ ID NO: 58054 - RNA, 27 nt, Artificial Sequence
  F-box only protein 25 (53-61)
agaagguucaacuacguggucaagcug

SEQ ID NO: 58055 - RNA, 27 nt, Artificial Sequence
  Myosin-9 (1209-1217)
agaaggggcgaccugcccuucgugguc

SEQ ID NO: 58056 - RNA, 33 nt, Artificial Sequence
  Plectin (1853-1863)
agaaggcuggccgaggacgaagcuuuccagcgg

SEQ ID NO: 58057 - RNA, 33 nt, Artificial Sequence
  60S ribosomal protein L15 (143-153)
agaaggaaccccgacacccaguggaucacaaag

SEQ ID NO: 58058 - RNA, 27 nt, Artificial Sequence
  E3 SUMO-protein ligase RanBP2 (1126-1134)
agaaggagcgacgauauguucaccuuu

SEQ ID NO: 58059 - RNA, 27 nt, Artificial Sequence
  F-box only protein 21 (295-303)
agaaggaccggcauccccauuagcaug

SEQ ID NO: 58060 - RNA, 27 nt, Artificial Sequence
  Prelamin-A/C (40-48)
agaaggguggacgccgagaaccggcug

SEQ ID NO: 58061 - RNA, 30 nt, Artificial Sequence
  Polymerase I and transcript release factor (137-146)
agaaggguggacgauuucaagaaagccuuu

SEQ ID NO: 58062 - RNA, 36 nt, Artificial Sequence
  Polymerase I and transcript release factor (137-148)
agaaggguggacgauuucaagaaagccuuuagcaag

SEQ ID NO: 58063 - RNA, 30 nt, Artificial Sequence
  Hsp90 co-chaperone Cdc37 (166-175)
agaaggugggacgauagccagaaguaccug

SEQ ID NO: 58064 - RNA, 27 nt, Artificial Sequence
  Vascular endothelial growth factor A (62-70)
agcagauucggcggggccguggucagg

SEQ ID NO: 58065 - RNA, 27 nt, Artificial Sequence
  Lysosomal protective protein (472-480)
agcagauuccugaacaagcagcccuac

SEQ ID NO: 58066 - RNA, 27 nt, Artificial Sequence
  Decapping and exoribonuclease protein (154-162)
agcagauuccagggcacccuguaccuc

SEQ ID NO: 58067 - RNA, 30 nt, Artificial Sequence
  Glia-derived nexin (207-216)
agcagauuccagcccgagaacaccaagaaa

SEQ ID NO: 58068 - RNA, 27 nt, Artificial Sequence
  Signal transducer and activator of transcription 1-alpha/beta (69-77)
agcagauucucccuggagaacaauuuu

SEQ ID NO: 58069 - RNA, 27 nt, Artificial Sequence
  PITH domain-containing protein 1 (143-151)
agcagauucuccaacguguaccaccug

SEQ ID NO: 58070 - RNA, 27 nt, Artificial Sequence
  Gamma-aminobutyric acid receptor subunit beta-3 (452-460)
agcagaaucguguuccccuuuaccuuc

SEQ ID NO: 58071 - RNA, 24 nt, Artificial Sequence
  Probable dolichyl pyrophosphate Glc1Man9GlcNAc2 alpha-1,3-glucosyltransferase (267-274)
agcagacuguuccccuuuaagagg

SEQ ID NO: 58072 - RNA, 27 nt, Artificial Sequence
  Lysine-specific demethylase 3B (1181-1189)
agcagacugcccuccuacuucgugagg

SEQ ID NO: 58073 - RNA, 27 nt, Artificial Sequence
  Arginine-tRNA ligase, cytoplasmic (78-86)
agcagacugcaggagguguucggccac

SEQ ID NO: 58074 - RNA, 30 nt, Artificial Sequence
  Myeloid leukemia factor 2 (28-37)
agcagaaugcuguccggcggguucggauac

SEQ ID NO: 58075 - RNA, 27 nt, Artificial Sequence
  Protein diaphanous homolog 2 (855-863)
agcagaaacgcccagucccugggcuuc

SEQ ID NO: 58076 - RNA, 27 nt, Artificial Sequence
  Catenin beta-1 (646-654)
agcagaaacgagggcguggccaccuac

SEQ ID NO: 58077 - RNA, 27 nt, Artificial Sequence
  Nuclear protein localization protein 4 homolog (328-336)
agcagaaacaaggacaccuacuuccug

SEQ ID NO: 58078 - RNA, 33 nt, Artificial Sequence
  TOX high mobility group box family member 4 (588-598)
agcagaaacuccaauaccguggucuucguuaag

SEQ ID NO: 58079 - RNA, 27 nt, Artificial Sequence
  Spectrin beta chain, non-erythrocytic 1 (903-911)
agcagaguggccgucguuaaccagauc

SEQ ID NO: 58080 - RNA, 30 nt, Artificial Sequence
  Aldehyde dehydrogenase family 1 member A3 (318-327)
agcagaguguucgucgaggaacagguuuac

SEQ ID NO: 58081 - RNA, 27 nt, Artificial Sequence
  Dystonin (6683-6691)
agcagaugggagaaggugguccagagg

SEQ ID NO: 58082 - RNA, 33 nt, Artificial Sequence
  Phosphatidylinositol-binding clathrin assembly protein (128-138)
agcagauaccugaacgagaaggccguguccuau

SEQ ID NO: 58083 - RNA, 30 nt, Artificial Sequence
  TRPM8 channel-associated factor 1 (46-55)
agcagauacaggcugcccguggccacccgg

SEQ ID NO: 58084 - RNA, 27 nt, Artificial Sequence
  Protein yippee-like 5 (33-41)
accagauucacaggcgccacugggagg

SEQ ID NO: 58085 - RNA, 27 nt, Artificial Sequence
  78 kDa glucose-regulated protein (364-372)
accagaauccccaagauucagcaacug

SEQ ID NO: 58086 - RNA, 27 nt, Artificial Sequence
  Ubiquitin-like protein 5 (37-45)
accagauggaacaagaucgugcugaaa

SEQ ID NO: 58087 - RNA, 27 nt, Artificial Sequence
  Zinc finger BED domain-containing protein 5 (574-582)
gugagaaaccccuucaccgucacaguu

SEQ ID NO: 58088 - RNA, 30 nt, Artificial Sequence
  Proteasome subunit beta type-4 (223-232)
uacagagacgccaggagcuauaaccgguuc

SEQ ID NO: 58089 - RNA, 30 nt, Artificial Sequence
  Proteasome subunit beta type-4 (22-31)
uacagaauccccagcaccccugacuccuuc

SEQ ID NO: 58090 - RNA, 30 nt, Artificial Sequence
  Rho GTPase-activating protein 5 (1010-1019)
uacagacuggaccucgagggcaacgaauau

SEQ ID NO: 58091 - RNA, 27 nt, Artificial Sequence
  Pre-mRNA-processing-splicing factor 8 (1786-1794)
uacagagugaccauccacaagacauuc

SEQ ID NO: 58092 - RNA, 27 nt, Artificial Sequence
  Arginine-glutamic acid dipeptide repeats protein (336-344)
gccgcugcauacccccacaccagccug

SEQ ID NO: 58093 - RNA, 30 nt, Artificial Sequence
  Lon protease homolog 2, peroxisomal (789-798)
gccgcuuucgacggcggguuuaccgugaag

SEQ ID NO: 58094 - RNA, 27 nt, Artificial Sequence
  Double-stranded RNA-binding protein Staufen homolog 2 (139-147)
gccgcuaugaaggcacugcaggcccuc

SEQ ID NO: 58095 - RNA, 30 nt, Artificial Sequence
  26S proteasome non-ATPase regulatory subunit 14 (301-310)
gccgcuaugcuggacaccguggucuucaag

SEQ ID NO: 58096 - RNA, 27 nt, Artificial Sequence
  40S ribosomal protein S17 (12-20)
gccgcuagagugaucauugagaaguac

SEQ ID NO: 58097 - RNA, 27 nt, Artificial Sequence
  Endoplasmic reticulum resident protein 29 (3-11)
gccgcugugcccagagcagccuuccug

SEQ ID NO: 58098 - RNA, 27 nt, Artificial Sequence
  Tyrosine-protein phosphatase non-receptor type 1 (264-272)
gccgaccagcugagauucagcuaccuc

SEQ ID NO: 58099 - RNA, 27 nt, Artificial Sequence
  ATP-dependent RNA helicase DDX18 (335-343)
gccgacagaauccuggaugugggcuuc

SEQ ID NO: 58100 - RNA, 27 nt, Artificial Sequence
  Spectrin alpha chain, non-erythrocytic 1 (781-789)
gccgacagccugagacuccagcaacuu

SEQ ID NO: 58101 - RNA, 24 nt, Artificial Sequence
  Exosome complex exonuclease RRP44 (753-760)
gccgacgugaucguccacagacug

SEQ ID NO: 58102 - RNA, 27 nt, Artificial Sequence
  Trafficking protein particle complex subunit 4 (26-34)
gccgaggcugaaaagaccuucagcuac

SEQ ID NO: 58103 - RNA, 27 nt, Artificial Sequence
  Plectin (2624-2632)
gccgaggcugaacccgagcacagcuuc

SEQ ID NO: 58104 - RNA, 30 nt, Artificial Sequence
  Spectrin beta chain, non-erythrocytic 1 (1181-1190)
gccgaggcuuuccugaacaaucaggaauac

SEQ ID NO: 58105 - RNA, 33 nt, Artificial Sequence
  Structural maintenance of chromosomes protein 2 (370-380)
gccgaggcucuggcagccgcgcagcaacacuuc

SEQ ID NO: 58106 - RNA, 27 nt, Artificial Sequence
  Coatomer subunit alpha (1048-1056)
gccgaggcucagcaacugaucaccauu

SEQ ID NO: 58107 - RNA, 33 nt, Artificial Sequence
  Dihydropyrimidinase-related protein 1 (233-243)
gccgaggcuguguucagagcaaucaccauugcc

SEQ ID NO: 58108 - RNA, 27 nt, Artificial Sequence
  Mitochondrial import receptor subunit TOM20 homolog (63-71)
gccgaggcugugcagaaguucuuucug

SEQ ID NO: 58109 - RNA, 33 nt, Artificial Sequence
  ADP-ribosylation factor 3 (112-122)
gccgaggacgaacugagagaugcugugcuccuu

SEQ ID NO: 58110 - RNA, 30 nt, Artificial Sequence
  WD repeat-containing protein 26 (246-255)
gccgaggaccugagagcuaaggcagaaugg

SEQ ID NO: 58111 - RNA, 27 nt, Artificial Sequence
  Mitogen-activated protein kinase kinase kinase 3 (613-621)
gccgaggaacugcucacccaccauuuc

SEQ ID NO: 58112 - RNA, 30 nt, Artificial Sequence
  LisH domain-containing protein ARMC9 (22-31)
gccgaguucgaagacacccugaagacauuu

SEQ ID NO: 58113 - RNA, 30 nt, Artificial Sequence
  RNA-binding protein 28 (545-554)
gccgaguuccaggaacacgagcaugcucug

SEQ ID NO: 58114 - RNA, 27 nt, Artificial Sequence
  Tubulin alpha-1C chain (243-251)
gccgagaaggcuuaccacgaacagcug

SEQ ID NO: 58115 - RNA, 27 nt, Artificial Sequence
  Junction plakoglobin (137-145)
gccgagcuggcuaccagagcacucccc

SEQ ID NO: 58116 - RNA, 27 nt, Artificial Sequence
  Zinc finger protein 579 (465-473)
gccgagcuggaaagagcugcagcccuc

SEQ ID NO: 58117 - RNA, 30 nt, Artificial Sequence
  Myosin-9 (780-789)
gccgagcuggaaagacucaacaagcaguuc

SEQ ID NO: 58118 - RNA, 27 nt, Artificial Sequence
  F-box/LRR-repeat protein 5 (165-173)
gccgagcugcucagaggccuuagccug

SEQ ID NO: 58119 - RNA, 33 nt, Artificial Sequence
  Cyclin-dependent kinase inhibitor 1C (51-61)
gccgagcugaacgcugaagaccagaauagaugg

SEQ ID NO: 58120 - RNA, 30 nt, Artificial Sequence
  Calmodulin (104-113)
gccgagcugagacacgugaugaccaaccuc

SEQ ID NO: 58121 - RNA, 27 nt, Artificial Sequence
  Uridine phosphorylase 1 (195-203)
gccgagcugagcgaauucaccacagug

SEQ ID NO: 58122 - RNA, 27 nt, Artificial Sequence
  U5 small nuclear ribonucleoprotein 200 kDa helicase (318-326)
gccgagcugaccggcgaccaccagcuc

SEQ ID NO: 58123 - RNA, 27 nt, Artificial Sequence
  E3 ubiquitin/ISG15 ligase TRIM25 (482-490)
gccgagaugccccagaacuacagaccu

SEQ ID NO: 58124 - RNA, 27 nt, Artificial Sequence
  Heterogeneous nuclear ribonucleoprotein U (399-407)
gccgagaaccccggcaaguacaauauc

SEQ ID NO: 58125 - RNA, 27 nt, Artificial Sequence
  Nuclear pore complex protein Nup160 (377-385)
gccgagaaccagaccguggucaaguac

SEQ ID NO: 58126 - RNA, 27 nt, Artificial Sequence
  MORF4 family-associated protein 1 (10-18)
gccgagcccgaagagguggaaguccug

SEQ ID NO: 58127 - RNA, 30 nt, Artificial Sequence
  Matrin-3 (229-238)
gccgagcccuacggcaagaucaaaaacuau

SEQ ID NO: 58128 - RNA, 27 nt, Artificial Sequence
  Exocyst complex component 1 (513-521)
gccgagcaggacuucaucagcaaguuu

SEQ ID NO: 58129 - RNA, 33 nt, Artificial Sequence
  Keratin, type I cytoskeletal 10 (133-143)
gccgagcagaacagaaaggacgcugaagcaugg

SEQ ID NO: 58130 - RNA, 30 nt, Artificial Sequence
  14 kDa phosphohistidine phosphatase (38-47)
gccgagagcaaggaaaucgugagaggcuac

SEQ ID NO: 58131 - RNA, 27 nt, Artificial Sequence
  Heterogeneous nuclear ribonucleoproteins A2/B1 (61-69)
gccgagguggacgcugcaauggccgcg

SEQ ID NO: 58132 - RNA, 27 nt, Artificial Sequence
  Rho GTPase-activating protein 18 (654-662)
gccgagugggugaucaagagcaaaccc

SEQ ID NO: 58133 - RNA, 27 nt, Artificial Sequence
  RNA-binding protein 8A (94-102)
gccgaguacggcgaaaucaagaacauu

SEQ ID NO: 58134 - RNA, 30 nt, Artificial Sequence; identical to SEQ ID NO: 33907
  Mitotic checkpoint serine/threonine-protein kinase BUB1 (76-85)

SEQ ID NO: 58135 - RNA, 33 nt, Artificial Sequence
  T-complex protein 1 subunit eta (249-259)
gccggcuucgacgcuaccaacauccugaauaag

SEQ ID NO: 58136 - RNA, 27 nt, Artificial Sequence
  Eukaryotic translation initiation factor 4 gamma 1 (1268-1276)
gccggccaccugagcaccgcucaguac

SEQ ID NO: 58137 - RNA, 36 nt, Artificial Sequence
  Cytoplasmic dynein 1 heavy chain 1 (3396-3407)
gccaucgcucagcugaacuacgcagacaugcucaag

SEQ ID NO: 58138 - RNA, 33 nt, Artificial Sequence; identical to SEQ ID NO: 33911
  Transmembrane protein 131 (804-814)

SEQ ID NO: 58139 - RNA, 27 nt, Artificial Sequence
  Mortality factor 4-like protein 1 (34-42)
gccaucaaggacaaacaggugaaguac

SEQ ID NO: 58140 - RNA, 27 nt, Artificial Sequence
  Endoribonuclease Dicer (608-616)
gccauccuggacuaccucauuaccaag

SEQ ID NO: 58141 - RNA, 27 nt, Artificial Sequence
  Ceramide synthase 6 (81-89)
gccauccuggagaagguguucaccgcu

SEQ ID NO: 58142 - RNA, 33 nt, Artificial Sequence
  Aryl hydrocarbon receptor (422-432)
gccaucauggacccccugccucucagaaccaag

SEQ ID NO: 58143 - RNA, 27 nt, Artificial Sequence
  MICOS complex subunit MIC25 (96-104)
gccauccaggacaagcuguuccaagug

SEQ ID NO: 58144 - RNA, 27 nt, Artificial Sequence
  DNA mismatch repair protein Msh2 (765-773)
gccaucagcgaguacauugcuaccaag

SEQ ID NO: 58145 - RNA, 30 nt, Artificial Sequence
  Cytochrome b-c1 complex subunit 9 (42-51)
gccaucuacgaccacauuaacgagggcaag

SEQ ID NO: 58146 - RNA, 36 nt, Artificial Sequence
  Cytochrome c oxidase subunit 7A2, mitochondrial (69-80)
gccaucuacgagcuggcuguggcaagcuuccccaag

SEQ ID NO: 58147 - RNA, 33 nt, Artificial Sequence
  BCL-6 corepressor (147-157)
gccaucuacaagacccccccuggcauucagaaa

SEQ ID NO: 58148 - RNA, 27 nt, Artificial Sequence
  Apolipoprotein L2 (101-109)
gcccuggcugaggaaguggagcagguc

SEQ ID NO: 58149 - RNA, 30 nt, Artificial Sequence
  Epidermal growth factor receptor substrate 15 (283-292)
gcccuggcuuuccaccucaucagccagaag

SEQ ID NO: 58150 - RNA, 27 nt, Artificial Sequence
  E3 ubiquitin-protein ligase RNF114 (70-78)
gcccuggcucccggcgugagagcaguc

SEQ ID NO: 58151 - RNA, 27 nt, Artificial Sequence
  Neudesin (124-132)
gcccuggacgagguguucaccaagguc

SEQ ID NO: 58152 - RNA, 27 nt, Artificial Sequence
  JNK1/MAPK8-associated membrane protein (109-117)
gcccuguuccagcacaucaccgcucuc

SEQ ID NO: 58153 - RNA, 27 nt, Artificial Sequence
  Set1/Ash2 histone methyltransferase complex subunit ASH2 (290-298)
gcccugcacgacagagcuccccagcuc

SEQ ID NO: 58154 - RNA, 27 nt, Artificial Sequence
  Coiled-coil domain-containing protein 14 (24-32)
gcccugaucgaggacgaacacaaccuc

SEQ ID NO: 58155 - RNA, 27 nt, Artificial Sequence
  Clustered mitochondria protein homolog (826-834)
gcccugcucgacaacaauaucggccuu

SEQ ID NO: 58156 - RNA, 30 nt, Artificial Sequence
  Lysine-specific demethylase 5C (683-692)
gcccugcucgagaagggcaucaccgaagcu

SEQ ID NO: 58157 - RNA, 27 nt, Artificial Sequence
  Cleft lip and palate transmembrane protein 1 (348-356)
gcccugcucgagaccaaccccuaccuu

SEQ ID NO: 58158 - RNA, 27 nt, Artificial Sequence
  S100P-binding protein (349-357)
gcccugauggaccaggugcaccauaug

SEQ ID NO: 58159 - RNA, 27 nt, Artificial Sequence
  Brefeldin A-inhibited guanine nucleotide-exchange protein 2 (869-877)
gcccugauggaggcugugagccacgca

SEQ ID NO: 58160 - RNA, 27 nt, Artificial Sequence
  Exosome complex component MTR3 (214-222)
gcccugaugcccgugcucaaccagguc

SEQ ID NO: 58161 - RNA, 33 nt, Artificial Sequence
  Endoplasmic reticulum resident protein 29 (38-48)
gcccugccccucgacaccgugacauucuacaag

SEQ ID NO: 58162 - RNA, 27 nt, Artificial Sequence
  Vimentin (268-276)
gcccugagagacgugaggcagcaauac

SEQ ID NO: 58163 - RNA, 27 nt, Artificial Sequence
  Interferon regulatory factor 2-binding protein 1 (300-308)
gcccugagagagcccggcaaggcucuc

SEQ ID NO: 58164 - RNA, 27 nt, Artificial Sequence
  PR domain zinc finger protein 4 (284-292)
gcccugagcgacuccauccacaccgug

SEQ ID NO: 58165 - RNA, 27 nt, Artificial Sequence
  Annexin A2 (108-116)
gcccugagcggccaccucgagaccgug

SEQ ID NO: 58166 - RNA, 27 nt, Artificial Sequence
  Protein CutA (89-97)
gcccugaccgacuucgugagaagcguc

SEQ ID NO: 58167 - RNA, 30 nt, Artificial Sequence
  Trafficking protein particle complex subunit 2-like protein (19-28)
gcccugguggaccagagagagcucuaccuu

SEQ ID NO: 58168 - RNA, 27 nt, Artificial Sequence
  Flap endonuclease 1 (165-173)
gcccuggugaaggcuggcaaagucuac

SEQ ID NO: 58169 - RNA, 30 nt, Artificial Sequence
  Cofilin-1 (83-92)
gcccuguacgacgcuaccuaugagacaaag

SEQ ID NO: 58170 - RNA, 27 nt, Artificial Sequence
  COP9 signalosome complex subunit 2 (216-224)
gcccuguacgagcagagccuccacauc

SEQ ID NO: 58171 - RNA, 39 nt, Artificial Sequence
  TGF-beta-activated kinase 1 and MAP3K7-binding protein 1 (311-323)
gccaugaucgacaccgaguucgcuaagcagacaagccug

SEQ ID NO: 58172 - RNA, 42 nt, Artificial Sequence
  Cyclin-dependent kinase 2-associated protein 2 (6-19)
gccaugaagcccccuggcgcucaggggagccaauccaccuac

SEQ ID NO: 58173 - RNA, 27 nt, Artificial Sequence
  Poly(rC)-binding protein 1 (249-257)
gccaugaugcacggcgggaccggauuc

SEQ ID NO: 58174 - RNA, 27 nt, Artificial Sequence
  Eyes absent homolog 3 (200-208)
gcccccgcuccugcagcccagagacug

SEQ ID NO: 58175 - RNA, 27 nt, Artificial Sequence
  Homocysteine-responsive endoplasmic reticulum-resident ubiquitin-like domain member 1 protein (211-219)
gcccccgcuccuauccacaaccaguuc

SEQ ID NO: 58176 - RNA, 27 nt, Artificial Sequence
  Wings apart-like protein homolog (598-606)
gcccccgcuccuccaagcaaggugauc

SEQ ID NO: 58177 - RNA, 27 nt, Artificial Sequence
  Pre-mRNA-splicing factor ATP-dependent RNA helicase PRP16 (41-49)
gcccccgcuccuagaccaagccugcuc

SEQ ID NO: 58178 - RNA, 27 nt, Artificial Sequence
  Two pore calcium channel protein 1 (59-67)
gcccccgcugugccugcacugagacuc

SEQ ID NO: 58179 - RNA, 27 nt, Artificial Sequence
  Structural maintenance of chromosomes protein 3 (150-158)
gcccccgacagccagagacugaagcuc

SEQ ID NO: 58180 - RNA, 27 nt, Artificial Sequence
  Integrator complex subunit 3 (30-38)
gcccccggcgggggaagacugcuccuu

SEQ ID NO: 58181 - RNA, 51 nt, Artificial Sequence
  Fructose-bisphosphate aldolase A (79-95)
gcccccggcaaggggauccuggcugcagacgagagcaccggauccauugcc

SEQ ID NO: 58182 - RNA, 27 nt, Artificial Sequence
  DNA/RNA-binding protein KIN17 (338-346)
gcccccggcaagagaauccuggugcuc

SEQ ID NO: 58183 - RNA, 30 nt, Artificial Sequence
  Ribonucleoprotein PTB-binding 1 (298-307)
gcccccggcccuccagggagaagcaugcug

SEQ ID NO: 58184 - RNA, 27 nt, Artificial Sequence
  Sterol regulatory element-binding protein 1 (1104-1112)
gcccccggccagagaguggggaugcug

SEQ ID NO: 58185 - RNA, 27 nt, Artificial Sequence
  E3 ubiquitin-protein ligase RNF114 (72-80)
gcccccggcgugagagcugucgagcug

SEQ ID NO: 58186 - RNA, 27 nt, Artificial Sequence
  LIM domain and actin-binding protein 1 (397-405)
gcccccaucgcuaaggugggcguccug

SEQ ID NO: 58187 - RNA, 27 nt, Artificial Sequence
  Destrin (109-117)
gccccccugaagagcaaaaugaucuac

SEQ ID NO: 58188 - RNA, 33 nt, Artificial Sequence
  Talin-1 (1688-1698)
gcccccagagagggcaucagccaggaagcucug

SEQ ID NO: 58189 - RNA, 30 nt, Artificial Sequence
  NADH dehydrogenase (ubiquinone) 1 alpha subcomplex assembly factor 4 (30-39)
gcccccagacacccuagcaccaacucccug

SEQ ID NO: 58190 - RNA, 33 nt, Artificial Sequence
  Proline-rich nuclear receptor coactivator 2 (5-15)
gcccccagacugaacagcgcugacaggccuaug

SEQ ID NO: 58191 - RNA, 27 nt, Artificial Sequence
  Zinc finger protein 526 (559-567)
gcccccagacugccuaucaccggccuc

SEQ ID NO: 58192 - RNA, 27 nt, Artificial Sequence
  Protein Wiz (126-134)
gcccccagaccuggccugcucagccuu

SEQ ID NO: 58193 - RNA, 33 nt, Artificial Sequence
  Coiled-coil-helix-coiled-coil-helix domain-containing protein 2 (49-59)
gcccccagacagccuggccugauggcucaaaug

SEQ ID NO: 58194 - RNA, 33 nt, Artificial Sequence
  PHD finger protein 23 (80-90)
gcccccagcgaccugagaaccauccagacauuc

SEQ ID NO: 58195 - RNA, 30 nt, Artificial Sequence
  Aladin (253-262)
gcccccagcggcgggagacugcucuccgcu

SEQ ID NO: 58196 - RNA, 27 nt, Artificial Sequence
  SWI/SNF-related matrix-associated actin-dependent regulator of chromatin subfamily A member 5 (16-24)
gcccccagcaagccugcugcauccauc

SEQ ID NO: 58197 - RNA, 27 nt, Artificial Sequence
  Pre-mRNA-processing-splicing factor 8 (2018-2026)
gcccccagccagcaaagacagcagauc

SEQ ID NO: 58198 - RNA, 30 nt, Artificial Sequence; identical to SEQ ID NO: 33971
  Dolichyl-diphosphooligosaccharide-proteinosyltransferase 48 kDa subunit (183-192)

SEQ ID NO: 58199 - RNA, 39 nt, Artificial Sequence
  Eukaryotic initiation factor 4A-II (75-87)
gcccaggcucaaagcggcaccgggaagacagcaacuuuc

SEQ ID NO: 58200 - RNA, 45 nt, Artificial Sequence
  Crooked neck-like protein 1 (704-718)
gcccaguucgagcugagcuccggcaaggaagggucucucaccaaa

SEQ ID NO: 58201 - RNA, 27 nt, Artificial Sequence
  Carboxymethylenebutenolidase homolog (123-131)
gcccagaagaucggcauugugggguuc

SEQ ID NO: 58202 - RNA, 27 nt, Artificial Sequence
  Suppressor of SWI4 1 homolog (17-25)
gcccagcugagaaaccucgaggcuuac

SEQ ID NO: 58203 - RNA, 30 nt, Artificial Sequence
  Hsc70-interacting protein (339-348)
gcccagaaccccgcuaauaugagcaaguac

SEQ ID NO: 58204 - RNA, 27 nt, Artificial Sequence
  Protein phosphatase 1 regulatory subunit 15B (54-62)
gcccagcccgagaccagagugagcuac

SEQ ID NO: 58205 - RNA, 36 nt, Artificial Sequence
  Putative PIP5K1A and PSMD4-like protein (282-293)
gcccagagagagccccugagcuccgaaacccaauac

SEQ ID NO: 58206 - RNA, 27 nt, Artificial Sequence
  Ras-related C3 botulinum toxin substrate 1 (44-52)
gccagcuucgagaacgugagagcuaag

SEQ ID NO: 58207 - RNA, 30 nt, Artificial Sequence; identical to SEQ ID NO: 33980
  Dynein light chain roadblock-type 1 (43-52)

SEQ ID NO: 58208 - RNA, 33 nt, Artificial Sequence
  Heterogeneous nuclear ribonucleoprotein H (160-170)
gccagccaggagaucgcugaaaaggcacugaaa

SEQ ID NO: 58209 - RNA, 27 nt, Artificial Sequence
  VPS53 protein (19-27)
gccagcuacaccaagaucguggucaaa

SEQ ID NO: 58210 - RNA, 33 nt, Artificial Sequence
  Catenin alpha-1 (826-836)
gccagcuacguggcuuccaccaaguaucagaaa

SEQ ID NO: 58211 - RNA, 27 nt, Artificial Sequence
  Acyl-protein thioesterase 1 (20-28)
gccaccgcugcagugaucuuccugcac

SEQ ID NO: 58212 - RNA, 36 nt, Artificial Sequence
  Prohibitin (229-240)
gccaccgcuggcgacgggcugaucgagcucagaaag

SEQ ID NO: 58213 - RNA, 30 nt, Artificial Sequence
  Major facilitator superfamily domain-containing protein 10 (72-81)
gccaccgcuaucggcaugcccguggagaag

SEQ ID NO: 58214 - RNA, 27 nt, Artificial Sequence
  Biogenesis of lysosome-related organelles complex 1 subunit 1 (109-117)
gccaccgcucuggaguacguguauaag

SEQ ID NO: 58215 - RNA, 39 nt, Artificial Sequence
  E3 ubiquitin-protein ligase BRE1A (84-96)
gccaccgacgaugcuagccugcucaucgugaacagauac

SEQ ID NO: 58216 - RNA, 27 nt, Artificial Sequence
  Alpha-1,2-mannosyltransferase ALG9 (450-458)
gccaccgaccccacaauccacacugug

SEQ ID NO: 58217 - RNA, 33 nt, Artificial Sequence
  Probable ATP-dependent RNA helicase DDX56 (198-208)
gccaccuucaacgaggacgugcaggcucugaag

SEQ ID NO: 58218 - RNA, 27 nt, Artificial Sequence
  Major facilitator superfamily domain-containing protein 10 (320-328)
gccaccauccagggcgcuuacgcaaga

SEQ ID NO: 58219 - RNA, 27 nt, Artificial Sequence
  E3 ubiquitin-protein ligase MYLIP (151-159)
gccacccugaacagcaucguggcuaag

SEQ ID NO: 58220 - RNA, 27 nt, Artificial Sequence
  Ankyrin repeat domain-containing protein 10 (82-90)
gccacccugaacgugagcacaacuaga

SEQ ID NO: 58221 - RNA, 30 nt, Artificial Sequence
  Filamin-A (829-838)
gccacccccacaagcccuaucagagugaag

SEQ ID NO: 58222 - RNA, 33 nt, Artificial Sequence
  Nucleolar protein 14 (841-851)
gccacccaggagggcgaauggaaggcucugaaa

SEQ ID NO: 58223 - RNA, 27 nt, Artificial Sequence
  Cullin-7 (1690-1698)
gccacccagagcuucuccacauuuaga

SEQ ID NO: 58224 - RNA, 30 nt, Artificial Sequence
  Gamma-interferon-inducible protein 16 (234-243)
gccacccagacacaauucuuucacgugaag

SEQ ID NO: 58225 - RNA, 27 nt, Artificial Sequence
  Vesicle transport protein SEC20 (257-265)
gccaccgugcuguacaucgucaagaaa

SEQ ID NO: 58226 - RNA, 36 nt, Artificial Sequence
  Glycerol-3-phosphate dehydrogenase, mitochondrial (373-384)
gccaccuacggcgacaaggcuuucgagguggcaaaa

SEQ ID NO: 58227 - RNA, 27 nt, Artificial Sequence
  DNA (cytosine-5)-methyltransferase 3A (168-176)
gccaccuacaacaagcagcccauguau

SEQ ID NO: 58228 - RNA, 27 nt, Artificial Sequence
  Cytoplasmic dynein 1 heavy chain 1 (156-164)
gccguggcucccuucuuuaagagcuac

SEQ ID NO: 58229 - RNA, 27 nt, Artificial Sequence
  Triple functional domain protein (2585-2593)
gccguggcuaccaaguucgucaacaaa

SEQ ID NO: 58230 - RNA, 27 nt, Artificial Sequence
  Cleavage stimulation factor subunit 1 (359-367)
gccguguucaaccacaccgaggacuac

SEQ ID NO: 58231 - RNA, 30 nt, Artificial Sequence
  Inositol hexakisphosphate and diphosphoinositol-pentakisphosphate kinase 1 (189-198)
gccguguuccccaagccuuuugucgagaaa

SEQ ID NO: 58232 - RNA, 33 nt, Artificial Sequence
  POTE ankyrin domain family member F (729-739)
gccguguuccccagcaucgucggcagaccuagg

SEQ ID NO: 58233 - RNA, 27 nt, Artificial Sequence
  Probable ATP-dependent RNA helicase DDX10 (63-71)
gccgugaucgagaaccugcccaagaaa

SEQ ID NO: 58234 - RNA, 33 nt, Artificial Sequence
  Zinc finger protein 292 (1897-1907)
gccgugauccccgagaagcagcuggucgaaaaa

SEQ ID NO: 58235 - RNA, 27 nt, Artificial Sequence
  Leucine-rich repeat and calponin homology domain-containing protein 3 (504-512)
gccgugcuggacuucgucaagcagaaa

SEQ ID NO: 58236 - RNA, 33 nt, Artificial Sequence
  Calcium-binding protein 39 (24-34)
gccgugcuggagaagcaggacaucagcgauaaa

SEQ ID NO: 58237 - RNA, 27 nt, Artificial Sequence
  Small integral membrane protein 15 (38-46)
gccgugcugagcuggaagcucgcuaaa

SEQ ID NO: 58238 - RNA, 33 nt, Artificial Sequence
  Cytoskeleton-associated protein 5 (403-413)
gccgugauggacaacaagaaucccaccaucaaa

SEQ ID NO: 58239 - RNA, 39 nt, Artificial Sequence
  MICOS complex subunit MIC60 (234-246)
gccgugcaggcugucaacgcacacagcaauauccugaag

SEQ ID NO: 58240 - RNA, 36 nt, Artificial Sequence
  Ran GTPase-activating protein 1 (489-500)
gccgugcaggacgcugucgaugcacugaugcaaaag

SEQ ID NO: 58241 - RNA, 27 nt, Artificial Sequence
  PRELI domain-containing protein 1, mitochondrial (142-150)
gccgugcaggaguucggccuggcuaga

SEQ ID NO: 58242 - RNA, 30 nt, Artificial Sequence
  V-type proton ATPase subunit E 1 (147-156)
gccgugcagaaggcuauccccauguacaaa

SEQ ID NO: 58243 - RNA, 27 nt, Artificial Sequence
  Lamin-B receptor (364-372)
gccguguacgacuucuuuaucggcaga

SEQ ID NO: 58244 - RNA, 39 nt, Artificial Sequence
  Protein phosphatase 1A (57-69)
gccguguacgacggccacgcugggagccaggucgcaaag

SEQ ID NO: 58245 - RNA, 27 nt, Artificial Sequence
  ATPase family AAA domain-containing protein 2 (1085-1093)
gccuacgcuaucauuaaggaggaacug

SEQ ID NO: 58246 - RNA, 27 nt, Artificial Sequence
  ATP-dependent RNA helicase DHX29 (855-863)
gccuaccuggacaagagcccccaguuc

SEQ ID NO: 58247 - RNA, 27 nt, Artificial Sequence
  Structural maintenance of chromosomes protein 6 (494-502)
gccuacagacagggccacuucaccuau

SEQ ID NO: 58248 - RNA, 27 nt, Artificial Sequence
  Protein PRRC2C (846-854)
gccuacagcguggagcacaaccagcug

SEQ ID NO: 58249 - RNA, 24 nt, Artificial Sequence
  Coatomer subunit alpha (194-201)
gacgccguggucaagcacguucug

SEQ ID NO: 58250 - RNA, 24 nt, Artificial Sequence
  Talin-1 (1943-1950)
gacgccuacaccaagaaagagcug

SEQ ID NO: 58251 - RNA, 24 nt, Artificial Sequence
  Spindlin-1 (249-256)
gacgauuuccacaucuacguguau

SEQ ID NO: 58252 - RNA, 27 nt, Artificial Sequence
  Caldesmon (92-100)
gacgaggccgcuuuccuggaaagacuc

SEQ ID NO: 58253 - RNA, 33 nt, Artificial Sequence
  E3 ubiquitin-protein ligase CHIP (39-49)
gacgaggccaucgcuaaccugcagagagcauac

SEQ ID NO: 58254 - RNA, 30 nt, Artificial Sequence
  REST corepressor 1 (472-481)
gacgaggcccccgugcuggaugucagauac

SEQ ID NO: 58255 - RNA, 27 nt, Artificial Sequence
  Peptidyl-prolyl cis-trans isomerase-like 2 (267-275)
gacgaggaugugcugagauaccaguuc

SEQ ID NO: 58256 - RNA, 27 nt, Artificial Sequence
  Annexin A5 (190-198)
gacgaggaaaaguucaucaccauuuuu

SEQ ID NO: 58257 - RNA, 27 nt, Artificial Sequence
  Coatomer subunit gamma-1 (781-789)
gacgaguucgaaaaggaggaaaccuuu

SEQ ID NO: 58258 - RNA, 27 nt, Artificial Sequence
  Pre-mRNA-splicing factor ATP-dependent RNA helicase PRP16 (334-342)
gacgaguuccacaacccccuggccuac

SEQ ID NO: 58259 - RNA, 27 nt, Artificial Sequence
  Calmodulin-like protein 4 (136-144)
gacgaguucauccacaagauuacccug

SEQ ID NO: 58260 - RNA, 24 nt, Artificial Sequence
  Coatomer subunit gamma-1 (373-380)
gacgaguucaagguggucguugug

SEQ ID NO: 58261 - RNA, 27 nt, Artificial Sequence
  Eukaryotic translation initiation factor 4 gamma 3 (1231-1239)
gacgaguuccugcacaucaacgauuuu

SEQ ID NO: 58262 - RNA, 27 nt, Artificial Sequence
  F-box/WD repeat-containing protein 5 (42-50)
gacgaguuccuguggagagaacaguuu

SEQ ID NO: 58263 - RNA, 27 nt, Artificial Sequence
  Calreticulin (166-174)
gacgaguucacccaccuguacacacuc

SEQ ID NO: 58264 - RNA, 24 nt, Artificial Sequence
  Zinc finger RNA-binding protein (575-582)
gacgagggcaaggugaucagauuc

SEQ ID NO: 58265 - RNA, 27 nt, Artificial Sequence
  Sterol O-acyltransferase 1 (163-171)
gacgagggcagacuggugcucgaauuc

SEQ ID NO: 58266 - RNA, 24 nt, Artificial Sequence
  L-aminoadipate-semialdehyde dehydrogenase-phosphopantetheinyl transferase (236-243)
gacgagcaccauuucguggccguc

SEQ ID NO: 58267 - RNA, 27 nt, Artificial Sequence
  Menin (320-328)
gacgagcacaucuaccccuauauguac

SEQ ID NO: 58268 - RNA, 24 nt, Artificial Sequence
  U5 small nuclear ribonucleoprotein 200 kDa helicase (1248-1255)
gacgagcaccugaucaccuucuuu

SEQ ID NO: 58269 - RNA, 24 nt, Artificial Sequence
  Oxysterol-binding protein-related protein 9 (560-567)
gacgagcacuacauccugaccuuc

SEQ ID NO: 58270 - RNA, 30 nt, Artificial Sequence
  Ras GTPase-activating-like protein IQGAP1 (124-133)
gacgagaucggccugcccaagauuuucuac

SEQ ID NO: 58271 - RNA, 27 nt, Artificial Sequence
  Hom s 5 (293-301)
gacgagaucaacuuccugagagcccuc

SEQ ID NO: 58272 - RNA, 30 nt, Artificial Sequence
  Hom s 5 (293-302)
gacgagaucaacuuccugagagcccucuac

SEQ ID NO: 58273 - RNA, 27 nt, Artificial Sequence
  Harmonin (132-140)
gacgagaucgugagaauuaacggcuac

SEQ ID NO: 58274 - RNA, 27 nt, Artificial Sequence
  Splicing factor 3B subunit 4 (112-120)
gacgagaagcugcucuacgauaccuuc

SEQ ID NO: 58275 - RNA, 24 nt, Artificial Sequence
  Plectin (380-387)
gacgagaagagcaucauuaccuac

SEQ ID NO: 58276 - RNA, 33 nt, Artificial Sequence
  60 kDa heat shock protein, mitochondrial (209-219)
gacgagcuggaaaucauugagggcaugaaguuc

SEQ ID NO: 58277 - RNA, 27 nt, Artificial Sequence
  tRNA selenocysteine 1-associated protein 1 (146-154)
gacgagcuggaacagaagagagcccuc

SEQ ID NO: 58278 - RNA, 27 nt, Artificial Sequence
  Vacuolar protein sorting-associated protein 35 (72-80)
gacgagcugcacuaccucgaaguguau

SEQ ID NO: 58279 - RNA, 24 nt, Artificial Sequence
  Exocyst complex component 4 (59-66)
gacgagcugaucgugcagcacuac

SEQ ID NO: 58280 - RNA, 27 nt, Artificial Sequence
  Signal transducer and activator of transcription 2 (704-712)
gacgagcugcagcaaccccucgaacuu

SEQ ID NO: 58281 - RNA, 24 nt, Artificial Sequence
  Spectrin beta chain, non-erythrocytic 1 (545-552)
gacgagaugaaggugcugguccuc

SEQ ID NO: 58282 - RNA, 24 nt, Artificial Sequence
  Eukaryotic initiation factor 4A-I (185-192)
gacgagaugcugagcagaggcuuc

SEQ ID NO: 58283 - RNA, 24 nt, Artificial Sequence
  Myosin light polypeptide 6 (58-65)
gacgagaugaacgugaagguccug

SEQ ID NO: 58284 - RNA, 27 nt, Artificial Sequence
  Ras GTPase-activating protein-binding protein 2 (343-351)
gacgagaacgaacugaaggaguucuuu

SEQ ID NO: 58285 - RNA, 27 nt, Artificial Sequence
  Pyruvate kinase PKM (153-161)
gacgagaacauccuguggcucgauuac

SEQ ID NO: 58286 - RNA, 27 nt, Artificial Sequence
  Argininosuccinate synthase (182-190)
gacgagaaccugaugcacaucagcuac

SEQ ID NO: 58287 - RNA, 30 nt, Artificial Sequence
  HLA class II histocompatibility antigen, DR alpha chain (196-205)
gacgagccccugcucaagcacugggaauuc

SEQ ID NO: 58288 - RNA, 27 nt, Artificial Sequence
  RNA-binding protein 3 (18-26)
gacgagcaggcccuggaagaucacuuc

SEQ ID NO: 58289 - RNA, 27 nt, Artificial Sequence
  40S ribosomal protein S6 (20-28)
gacgagagaaagcugaggaccuucuac

SEQ ID NO: 58290 - RNA, 27 nt, Artificial Sequence
  Myosin-11 (1867-1875)
gacgagagaaagauggccgaacaguac

SEQ ID NO: 58291 - RNA, 27 nt, Artificial Sequence
  Carbonic anhydrase 12 (281-289)
gacgagagacugguguacaccagcuuc

SEQ ID NO: 58292 - RNA, 27 nt, Artificial Sequence
  Myosin-10 (277-285)
gacgagagaaccuuccacaucuuuuac

SEQ ID NO: 58293 - RNA, 27 nt, Artificial Sequence
  Carboxy-terminal domain RNA polymerase II polypeptide A small phosphatase 2 (109-117)
gacgagacccuggugcacagcuccuuc

SEQ ID NO: 58294 - RNA, 33 nt, Artificial Sequence
  Alpha-ketoglutarate-dependent dioxygenase FTO (189-199)
gacgagguggauaucaagagcagagccgcuuac

SEQ ID NO: 58295 - RNA, 24 nt, Artificial Sequence
  FACT complex subunit SPT16 (838-845)
gacgagguggaacugauccacuuc

SEQ ID NO: 58296 - RNA, 27 nt, Artificial Sequence
  Electrogenic sodium bicarbonate cotransporter 1 (306-314)
gacgagguguuccacgauaucgccuac

SEQ ID NO: 58297 - RNA, 24 nt, Artificial Sequence
  Annexin A4 (191-198)
gacgaggugaaguuccugaccguc

SEQ ID NO: 58298 - RNA, 27 nt, Artificial Sequence
  Annexin A4 (191-199)
gacgaggugaaguuccugaccguccuc

SEQ ID NO: 58299 - RNA, 27 nt, Artificial Sequence
  Polymerase I and transcript release factor (158-166)
gacgaggugaagcugcccgccaaacuc

SEQ ID NO: 58300 - RNA, 24 nt, Artificial Sequence
  Protein arginine N-methyltransferase 1 (69-76)
gacgaggugagaacccugacauac

SEQ ID NO: 58301 - RNA, 42 nt, Artificial Sequence
  Annexin A2 (52-65)
gacgaggugaccaucgucaacauucugacaaauagaagcaac

SEQ ID NO: 58302 - RNA, 27 nt, Artificial Sequence
  Deoxyribose-phosphate aldolase (278-286)
gacgaguggcugaagcccgaacucuuc

SEQ ID NO: 58303 - RNA, 27 nt, Artificial Sequence
  Cell cycle progression protein 1 (726-734)
gacgaguacaucuauagacacuucuuu

SEQ ID NO: 58304 - RNA, 30 nt, Artificial Sequence
  Epidermal growth factor receptor (1014-1023)
gacgaguaccugaucccccagcaaggcuuc

SEQ ID NO: 58305 - RNA, 27 nt, Artificial Sequence
  39S ribosomal protein L49, mitochondrial (43-51)
gacgaguaccaguucguggaaagacug

SEQ ID NO: 58306 - RNA, 27 nt, Artificial Sequence
  Talin-1 (125-133)
gacgaguacagccuggugagagaacuc

SEQ ID NO: 58307 - RNA, 45 nt, Artificial Sequence
  Peptidyl-prolyl cis-trans isomerase A (9-23)
gacaucgccguggauggcgagccccuggggagagucagcuucgaa

SEQ ID NO: 58308 - RNA, 27 nt, Artificial Sequence
  DNA (cytosine-5)-methyltransferase 1 (811-819)
gaccuggauagcagagugcucuacuau

SEQ ID NO: 58309 - RNA, 27 nt, Artificial Sequence
  ELKS/Rab6-interacting/CAST family member 1 (356-364)
gaccugaaggagaaagugagccuccuu

SEQ ID NO: 58310 - RNA, 27 nt, Artificial Sequence
  Alpha-taxilin (480-488)
gaccugaacaagagagugcaggaucuc

SEQ ID NO: 58311 - RNA, 24 nt, Artificial Sequence
  DnaJ homolog subfamily A member 1 (244-251)
gaccagaaggaucacgccguguuc

SEQ ID NO: 58312 - RNA, 27 nt, Artificial Sequence
  Statherin (20-28)
gacagcuccgaggaaaaguuccugaga

SEQ ID NO: 58313 - RNA, 30 nt, Artificial Sequence
  Protein S100-A9 (67-76)
gacaccaacgccgauaagcagcugagcuuc

SEQ ID NO: 58314 - RNA, 24 nt, Artificial Sequence
  Myosin light polypeptide 6 (148-155)
gaggccuucgugagacacauccug

SEQ ID NO: 58315 - RNA, 30 nt, Artificial Sequence
  ATP-dependent RNA helicase DDX1 (481-490)
gaggccaucaagauucugaaaggcgaauac

SEQ ID NO: 58316 - RNA, 27 nt, Artificial Sequence
  6-phosphofructo-2-kinase/fructose-2,6-bisphosphatase 3 (57-65)
gaggccgugaagcaguacagcuccuau

SEQ ID NO: 58317 - RNA, 27 nt, Artificial Sequence
  Formin-like protein 3 (893-901)
gaggccuacaacgcuguggucagauau

SEQ ID NO: 58318 - RNA, 27 nt, Artificial Sequence
  Elongator complex protein 2 (246-254)
gaggacuggaucagaggcguggaaugg

SEQ ID NO: 58319 - RNA, 30 nt, Artificial Sequence
  Vimentin (197-206)
gaggaagccgagaacacccugcagagcuuc

SEQ ID NO: 58320 - RNA, 27 nt, Artificial Sequence
  X-ray repair cross-complementing protein 5 (699-707)
gaggaagccaagaaauuccuggcuccc

SEQ ID NO: 58321 - RNA, 27 nt, Artificial Sequence
  Prostaglandin G/H synthase 1 (266-274)
gaggaagcccccgugcugaugcacuac

SEQ ID NO: 58322 - RNA, 30 nt, Artificial Sequence
  ATP-dependent DNA helicase Q5 (961-970)
gaggaagcccagaaccugaucagacacuuc

SEQ ID NO: 58323 - RNA, 30 nt, Artificial Sequence
  Chromodomain-helicase-DNA-binding protein 4 (166-175)
gaggaagacuacagaacccugacaaacuau

SEQ ID NO: 58324 - RNA, 30 nt, Artificial Sequence
  Nucleolar protein 10 (434-443)
gaggaagaggaaaagcagaaaagcaccugg

SEQ ID NO: 58325 - RNA, 27 nt, Artificial Sequence
  Thioredoxin-like protein 1 (254-262)
gaggaagagaccacaagaaucagcuac

SEQ ID NO: 58326 - RNA, 27 nt, Artificial Sequence
  ETS translocation variant 3 (48-56)
gaggaauucagacacgugaucgccugg

SEQ ID NO: 58327 - RNA, 30 nt, Artificial Sequence
  Pre-mRNA-processing-splicing factor 8 (1205-1214)
gaggaauucacccacaaggacggcgugugg

SEQ ID NO: 58328 - RNA, 24 nt, Artificial Sequence
  Interferon-induced transmembrane protein 1 (4-11)
gaggaacacgagguggccguccug

SEQ ID NO: 58329 - RNA, 30 nt, Artificial Sequence
  Actin, alpha skeletal muscle (101-110)
gaggaacaccccacccugcucacagaggcc

SEQ ID NO: 58330 - RNA, 27 nt, Artificial Sequence
  KAT8 regulatory NSL complex subunit 3 (37-45)
gaggaacacgugaacagaaccggcugg

SEQ ID NO: 58331 - RNA, 24 nt, Artificial Sequence
  General transcription factor II-I (535-542)
gaggaaaucuucaaccugaaguuu

SEQ ID NO: 58332 - RNA, 27 nt, Artificial Sequence
  Neutral and basic amino acid transport protein rBAT (294-302)
gaggaaaucaaggagauucugagauuc

SEQ ID NO: 58333 - RNA, 30 nt, Artificial Sequence
  Calmodulin (87-96)
gaggaaaucagagaggccuucaggguguuu

SEQ ID NO: 58334 - RNA, 27 nt, Artificial Sequence
  Protein PRR14L (198-206)
gaggaaaucuacaccaacaagaauuau

SEQ ID NO: 58335 - RNA, 33 nt, Artificial Sequence
  Choline-phosphate cytidylyltransferase A (268-278)
gaggaaaagagcaucgaccugauucagaaaugg

SEQ ID NO: 58336 - RNA, 27 nt, Artificial Sequence
  Myotubularin-related protein 2 (253-261)
gaggaacugaagagaguggccagcuuc

SEQ ID NO: 58337 - RNA, 30 nt, Artificial Sequence
  Glutathione S-transferase Mu 4 (129-138)
gaggaacugcccaccaugaugcagcacuuc

SEQ ID NO: 58338 - RNA, 24 nt, Artificial Sequence
  DNA polymerase epsilon subunit 3 (74-81)
gaggaaauggaguuccagagauuu

SEQ ID NO: 58339 - RNA, 27 nt, Artificial Sequence
  DNA replication licensing factor MCM3 (760-768)
gaggaaaugccccaggugcacaccccu

SEQ ID NO: 58340 - RNA, 27 nt, Artificial Sequence
  Serine hydroxymethyltransferase, cytosolic (187-195)
gaggaaaacgccagacuguuccacccc

SEQ ID NO: 58341 - RNA, 24 nt, Artificial Sequence
  Vimentin (348-355)
gaggaaaacuucgccguggaggcu

SEQ ID NO: 58342 - RNA, 27 nt, Artificial Sequence
  ADP-ribosylation factor-like protein 2-binding protein (56-64)
gaggaaaacaagcugaucuacaccccc

SEQ ID NO: 58343 - RNA, 24 nt, Artificial Sequence
  Signal transducer and activator of transcription 3 (306-313)
gaggaaagaaucguggagcuguuc

SEQ ID NO: 58344 - RNA, 27 nt, Artificial Sequence
  A-kinase-interacting protein 1 (76-84)
gaggaaagacccccuacccugagcgcc

SEQ ID NO: 58345 - RNA, 27 nt, Artificial Sequence
  Calnexin (478-486)
gaggaaagacccuggcugugggugguc

SEQ ID NO: 58346 - RNA, 27 nt, Artificial Sequence
  WASH complex subunit strumpellin (506-514)
gaggaagugcaggaguuccaccaacug

SEQ ID NO: 58347 - RNA, 27 nt, Artificial Sequence
  Cytoplasmic FMR1-interacting protein 2 (432-440)
gaggaauacgagagagccaccagguau

SEQ ID NO: 58348 - RNA, 33 nt, Artificial Sequence
  Sorting nexin-7 (294-304)
gagcuggacagcaagguggaaguccucaccuac

SEQ ID NO: 58349 - RNA, 27 nt, Artificial Sequence
  Serine-protein kinase ATM (744-752)
gagcuguuccagaaggccaaaagccuc

SEQ ID NO: 58350 - RNA, 45 nt, Artificial Sequence
  Heat shock cognate 71 kDa protein (446-460)
gagagagccaugaccaaggacaacaaucugcucggcaaauucgaa

SEQ ID NO: 58351 - RNA, 60 nt, Artificial Sequence
  Heat shock protein beta-1 (186-205)
gagagcagagcccagcugggcgggcccgaagcugcaaaguccgacgagaccgccgcgaaa

SEQ ID NO: 58352 - RNA, 27 nt, Artificial Sequence
  40S ribosomal protein S7 (169-177)
gagaccuucagcggcguguacaagaaa

SEQ ID NO: 58353 - RNA, 27 nt, Artificial Sequence
  Kelch-like protein 15 (308-316)
gagaccuucuacagcacagaaagauau

SEQ ID NO: 58354 - RNA, 27 nt, Artificial Sequence
  Poly (ADP-ribose) polymerase (202-210)
gaguacaacaccaucaaggacaaauuc

SEQ ID NO: 58355 - RNA, 27 nt, Artificial Sequence
  Dynamin-like 120 kDa protein, mitochondrial (717-725)
uucgccgaggacagccugagagugauc

SEQ ID NO: 58356 - RNA, 27 nt, Artificial Sequence
  Transcription factor AP-1 (110-118)
uucgccgagggcuuugugagagcucug

SEQ ID NO: 58357 - RNA, 27 nt, Artificial Sequence
  Piezo-type mechanosensitive ion channel component 1 (1665-1673)
uucgccgagggccaggggagagcucug

SEQ ID NO: 58358 - RNA, 27 nt, Artificial Sequence
  Sister chromatid cohesion protein PDS5 homolog A (273-281)
uucgccaucgacccccaccugcuccuu

SEQ ID NO: 58359 - RNA, 27 nt, Artificial Sequence
  Spermatid perinuclear RNA-binding protein (7-15)
uucgccaacgacgauagacacgugaug

SEQ ID NO: 58360 - RNA, 27 nt, Artificial Sequence
  Multidrug resistance-associated protein 1 (1201-1209)
uucgccgugaucagcagacacucccug

SEQ ID NO: 58361 - RNA, 30 nt, Artificial Sequence
  Glutathione-specific gamma-glutamylcyclotransferase 1 (89-98)
uucgccuacagcgacuccagagugggcuuu

SEQ ID NO: 58362 - RNA, 45 nt, Artificial Sequence
  Peptidyl-prolyl cis-trans isomerase A (8-22)
uucgacaucgccguggauggcgagccccuggggagagucagcuuu

SEQ ID NO: 58363 - RNA, 51 nt, Artificial Sequence
  Peptidyl-prolyl cis-trans isomerase A (8-24)
uucgacaucgccguggauggcgagccccuggggagagucagcuuugaacuc

SEQ ID NO: 58364 - RNA, 30 nt, Artificial Sequence
  Probable ATP-dependent RNA helicase DDX56 (464-473)
uucgaggacaaccccagagaucugcagcuc

SEQ ID NO: 58365 - RNA, 27 nt, Artificial Sequence
  Inhibitor of growth protein 4 (19-27)
uucgagcugcagagaaacuuucaacuc

SEQ ID NO: 58366 - RNA, 30 nt, Artificial Sequence
  Macrophage metalloelastase (449-458)
uucgaguacgacuuucugcuccagagaauc

SEQ ID NO: 58367 - RNA, 27 nt, Artificial Sequence
  SURP and G-patch domain-containing protein 1 (604-612)
uucggcaucgacagacccgccgagcug

SEQ ID NO: 58368 - RNA, 27 nt, Artificial Sequence
  Signal-induced proliferation-associated 1-like protein 2 (760-768)
uucggccccccuaucccaaagggggug

SEQ ID NO: 58369 - RNA, 24 nt, Artificial Sequence
  Factor VIII intron 22 protein (50-57)
uucggccagcuggggagagagcuc

SEQ ID NO: 58370 - RNA, 27 nt, Artificial Sequence
  Disintegrin and metalloproteinase domain-containing protein 10 (19-27)
uucauccagaccagaggcgggacauuu

SEQ ID NO: 58371 - RNA, 27 nt, Artificial Sequence
  2'-5'-oligoadenylate synthase 1 (278-286)
uucaagaaccccaucauugagaaauac

SEQ ID NO: 58372 - RNA, 57 nt, Artificial Sequence
  Alpha-enolase (261-279)
uucaagagccccgacgauccuuccagauacaucucuccagaccagcuggccgaucuc

SEQ ID NO: 58373 - RNA, 27 nt, Artificial Sequence
  Sacsin (89-97)
uuccuggccgacaucgugcagaagcuc

SEQ ID NO: 58374 - RNA, 27 nt, Artificial Sequence
  Serine-protein kinase ATM (1077-1085)
uuccuggccgacaaccaccaucaggug

SEQ ID NO: 58375 - RNA, 30 nt, Artificial Sequence
  Epithelial discoidin domain-containing receptor 1 (885-894)
uuccuggccgaggacgcucucaacaccgug

SEQ ID NO: 58376 - RNA, 27 nt, Artificial Sequence
  T-complex protein 1 subunit theta (105-113)
uuccuggccaagcucaucgcucaggca

SEQ ID NO: 58377 - RNA, 30 nt, Artificial Sequence
  Phospholipid transfer protein (8-17)
uuccuggcccuccuugcuggcgcacacgcc

SEQ ID NO: 58378 - RNA, 27 nt, Artificial Sequence
  Pseudouridylate synthase 7 homolog-like protein (128-136)
uuccuggacgagaagacccacgaacuc

SEQ ID NO: 58379 - RNA, 33 nt, Artificial Sequence
  RuvB-like 2 (433-443)
uuccuggacgagagcagauccacccaguacaug

SEQ ID NO: 58380 - RNA, 30 nt, Artificial Sequence
  La-related protein 1 (530-539)
uuccuguuugacgaggaaauggagcagaug

SEQ ID NO: 58381 - RNA, 27 nt, Artificial Sequence
  Alpha-2-macroglobulin receptor-associated protein (22-30)
uuccugggccccuggccugccgcuagc

SEQ ID NO: 58382 - RNA, 27 nt, Artificial Sequence
  Sterol regulatory element-binding protein 2 (1033-1041)
uuccugcacgaggccaccgugagacuc

SEQ ID NO: 58383 - RNA, 30 nt, Artificial Sequence
  Adenylate kinase 2, mitochondrial (96-105)
uuccugcucgacggcuuucccagaaccgug

SEQ ID NO: 58384 - RNA, 33 nt, Artificial Sequence
  ATR-interacting protein (164-174)
uuccugcucgagcaggaaaagacccaagcccuu

SEQ ID NO: 58385 - RNA, 27 nt, Artificial Sequence
  YY1-associated protein 1 (323-331)
uuccugaacccccucaucagcaaguac

SEQ ID NO: 58386 - RNA, 33 nt, Artificial Sequence
  BRCA1-A complex subunit BRE (92-102)
uuccugcccgacccuagcgcccuccagaaccuu

SEQ ID NO: 58387 - RNA, 27 nt, Artificial Sequence
  Nesprin-2 (5714-5722)
uuccugaccgacacaagccaccuccuu

SEQ ID NO: 58388 - RNA, 27 nt, Artificial Sequence
  Transmembrane protein 41B (141-149)
uuccuguaccccuuuccucucgcccuu

SEQ ID NO: 58389 - RNA, 27 nt, Artificial Sequence
  Zinc finger RNA-binding protein (569-577)
uucaacgaccccaaugccaaggagaug

SEQ ID NO: 58390 - RNA, 27 nt, Artificial Sequence
  Fc receptor-like A (169-177)
uuccccgccccuauccugagagcugug

SEQ ID NO: 58391 - RNA, 27 nt, Artificial Sequence
  Sphingolipid delta(4)-desaturase DES1 (265-273)
uuccccaacaucccuggcaagagccug

SEQ ID NO: 58392 - RNA, 33 nt, Artificial Sequence
  Protein SZT2 (903-913)
uuccccagaagcccuggccagccauccucucug

SEQ ID NO: 58393 - RNA, 30 nt, Artificial Sequence; identical to SEQ ID NO: 34166
  Dipeptidyl peptidase 8 (180-189)

SEQ ID NO: 58394 - RNA, 27 nt, Artificial Sequence
  Transient receptor potential cation channel subfamily V member 2 (517-525)
uuccagcacaccggcaucuacagcgug

SEQ ID NO: 58395 - RNA, 24 nt, Artificial Sequence
  Elongation factor 1-gamma (423-430)
uuccagcacgugggcaaggccuuu

SEQ ID NO: 58396 - RNA, 27 nt, Artificial Sequence
  Phosphatidylcholine translocator ABCB4 (241-249)
uucagcgacaaggagcuggccgcuuac

SEQ ID NO: 58397 - RNA, 24 nt, Artificial Sequence
  Ras GTPase-activating-like protein IQGAP2 (196-203)
uucagcaagaucggcgggauucug

SEQ ID NO: 58398 - RNA, 27 nt, Artificial Sequence
  RNA-binding protein 4B (186-194)
uucaccgagcaguacaacgaacaauau

SEQ ID NO: 58399 - RNA, 27 nt, Artificial Sequence
  F-box DNA helicase 1 (553-561)
uucaccgugccccacacacaugucuuu

SEQ ID NO: 58400 - RNA, 30 nt, Artificial Sequence
  Fas apoptotic inhibitory molecule 1 (167-176)
uucguggacgauggcaccgagacacacuuu

SEQ ID NO: 58401 - RNA, 27 nt, Artificial Sequence
  DNA damage-binding protein 1 (451-459)
uucguggacgaucagcaaaccuuuuuc

SEQ ID NO: 58402 - RNA, 27 nt, Artificial Sequence
  Interferon regulatory factor 2-binding protein 2 (51-59)
uucgugaucgagaccgccagacagcug

SEQ ID NO: 58403 - RNA, 27 nt, Artificial Sequence
  Inactive serine/threonine-protein kinase VRK3 (37-45)
uucgugaacccccacgucagcuccuuu

SEQ ID NO: 58404 - RNA, 27 nt, Artificial Sequence
  DNA polymerase epsilon catalytic subunit A (732-740)
uucuacguggacaccgucagagccuuu

SEQ ID NO: 58405 - RNA, 33 nt, Artificial Sequence
  NADH dehydrogenase (ubiquinone) flavoprotein 2, mitochondrial (33-43)
ggcgccgggggagcucuguucgugcacagagac

SEQ ID NO: 58406 - RNA, 27 nt, Artificial Sequence
  Complement C1q tumor necrosis factor-related protein 3 (229-237)
ggcgaccaccagagauucagcaccuuu

SEQ ID NO: 58407 - RNA, 27 nt, Artificial Sequence
  Deoxyribose-phosphate aldolase (201-209)
ggcgaggcccaccugaagaccauccuc

SEQ ID NO: 58408 - RNA, 33 nt, Artificial Sequence
  ATPase family AAA domain-containing protein 2 (286-296)
ggcgaggaagagaaccagaagagauacuaucug

SEQ ID NO: 58409 - RNA, 27 nt, Artificial Sequence
  Interferon regulatory factor 2-binding protein-like (561-569)
ggcgaggaacagcaaagacagcagugg

SEQ ID NO: 58410 - RNA, 27 nt, Artificial Sequence
  NADPH-cytochrome P450 reductase (240-248)
ggcgaggaaagcuccaucagacaguac

SEQ ID NO: 58411 - RNA, 30 nt, Artificial Sequence
  Coiled-coil domain-containing protein 106 (234-243)
ggcgaguucgaccccagcaaggaaagacug

SEQ ID NO: 58412 - RNA, 27 nt, Artificial Sequence
  LIM and senescent cell antigen-like-containing domain protein 1 (75-83)
ggcgaguucaucauugggagagugaua

SEQ ID NO: 58413 - RNA, 33 nt, Artificial Sequence
  Thioredoxin (66-76)
ggcgaguucagcggggccaacaaggaaaaacug

SEQ ID NO: 58414 - RNA, 36 nt, Artificial Sequence
  Fibrinogen alpha chain (23-34)
ggcgagggggacuuccuggccgaaggagguggcgug

SEQ ID NO: 58415 - RNA, 27 nt, Artificial Sequence
  Cytospin-B (579-587)
ggcgagaucaagcacgugagcucccug

SEQ ID NO: 58416 - RNA, 27 nt, Artificial Sequence
  Filamin-B (1758-1766)
ggcgagaucaccggggaagugcacaug

SEQ ID NO: 58417 - RNA, 27 nt, Artificial Sequence
  DNA-directed RNA polymerase III subunit RPC7 (24-32)
ggcgagaagcugcccgacgugguccuc

SEQ ID NO: 58418 - RNA, 33 nt, Artificial Sequence
  Regulator of nonsense transcripts 1 (585-595)
ggcgagcugagcuccgccgacgaaaagagauac

SEQ ID NO: 58419 - RNA, 36 nt, Artificial Sequence
  Heat shock protein HSP 90-beta (172-183)
ggcgagcccaucgggagaggaaccaaggugauucug

SEQ ID NO: 58420 - RNA, 30 nt, Artificial Sequence; identical to SEQ ID NO: 34193
  60S ribosomal protein L4 (15-24)

SEQ ID NO: 58421 - RNA, 27 nt, Artificial Sequence
  Prefoldin subunit 6 (11-19)
ggcgagguggaaaaguaccagcaacug

SEQ ID NO: 58422 - RNA, 30 nt, Artificial Sequence; identical to SEQ ID NO: 34195
  60S ribosomal protein L3 (319-328)

SEQ ID NO: 58423 - RNA, 27 nt, Artificial Sequence
  Eukaryotic translation initiation factor 3 subunit L (258-266)
ggcgaguacgggagacacagccuguau

SEQ ID NO: 58424 - RNA, 48 nt, Artificial Sequence
  Keratin, type II cytoskeletal 2 epidermal (142-157)
ggcgggcccggagguuucggcccugggggauacccaggcgguauccac

SEQ ID NO: 58425 - RNA, 33 nt, Artificial Sequence
  Actin, cytoplasmic 2 (12-22)
ggcauccacgagaccacauucaacagcauuaug

SEQ ID NO: 58426 - RNA, 33 nt, Artificial Sequence
  Glyceraldehyde-3-phosphate dehydrogenase (2-12)
ggcaaggugaaagucgggguuaacggauucggu

SEQ ID NO: 58427 - RNA, 27 nt, Artificial Sequence
  E3 ubiquitin-protein ligase RNF213 (2847-2855)
ggccuggccgaggacagccccaagaug

SEQ ID NO: 58428 - RNA, 27 nt, Artificial Sequence
  Gem-associated protein 4 (541-549)
ggccuggccaaggcuguggcaagcguc

SEQ ID NO: 58429 - RNA, 27 nt, Artificial Sequence
  Histone-lysine N-methyltransferase ASH1L (2026-2034)
ggccuguuccccgccccuauccacgug

SEQ ID NO: 58430 - RNA, 27 nt, Artificial Sequence
  Signal-induced proliferation-associated 1-like protein 2 (957-965)
ggccuggggcagcucggauuccacgug

SEQ ID NO: 58431 - RNA, 27 nt, Artificial Sequence
  Plectin (4147-4155)
ggccugaucgaccaccagaccuaccuc

SEQ ID NO: 58432 - RNA, 30 nt, Artificial Sequence
  Protein strawberry notch homolog 1 (1078-1087)
ggccugaucggggugggacucauuaacguc

SEQ ID NO: 58433 - RNA, 27 nt, Artificial Sequence
  Elongation factor 2 (343-351)
ggccugaaggaggggauccccgcccuc

SEQ ID NO: 58434 - RNA, 27 nt, Artificial Sequence
  Coatomer subunit alpha (991-999)
ggccugaagaacggggugcccgccguc

SEQ ID NO: 58435 - RNA, 27 nt, Artificial Sequence
  Serine/threonine-protein kinase 17A (41-49)
ggccugcucaccgagaucagagccgug

SEQ ID NO: 58436 - RNA, 27 nt, Artificial Sequence
  Nuclear receptor corepressor 2 (413-421)
ggccugauggccgaccccaugaaggug

SEQ ID NO: 58437 - RNA, 27 nt, Artificial Sequence
  Serine/threonine-protein kinase Sgk1 (62-70)
ggccugaacgacuucauccagaagauu

SEQ ID NO: 58438 - RNA, 27 nt, Artificial Sequence
  MORC family CW-type zinc finger protein 4 (519-527)
ggccugaacaauaagaccaucggguac

SEQ ID NO: 58439 - RNA, 33 nt, Artificial Sequence
  DNA polymerase alpha subunit B (470-480)
ggccugaccagcacagaccuccuuuuccaccug

SEQ ID NO: 58440 - RNA, 33 nt, Artificial Sequence
  C-terminal-binding protein 2 (814-824)
ggccugguggacgagaaggcccucgcucaggca

SEQ ID NO: 58441 - RNA, 30 nt, Artificial Sequence
  Staphylococcal nuclease domain-containing protein 1 (829-838)
ggccuggugaaggaggggcucgucaugguu

SEQ ID NO: 58442 - RNA, 30 nt, Artificial Sequence
  Basic salivary proline-rich protein 2 (70-79)
ggccccccuccaccgcccgggaagccucag

SEQ ID NO: 58443 - RNA, 33 nt, Artificial Sequence
  Salivary acidic proline-rich phosphoprotein 1/2 (137-147)
ggccccccuccaccgcccccugggaagccacag

SEQ ID NO: 58444 - RNA, 36 nt, Artificial Sequence
  Salivary acidic proline-rich phosphoprotein 1/2 (110-121)
ggccccccucagcaagggggacacccaagaccgccc

SEQ ID NO: 58445 - RNA, 27 nt, Artificial Sequence
  Nuclear receptor corepressor 1 (1455-1463)
ggccccagcgugcugagauccacccuc

SEQ ID NO: 58446 - RNA, 27 nt, Artificial Sequence
  Histone chaperone ASF1A (103-111)
ggccaggaguucaucagagugggguac

SEQ ID NO: 58447 - RNA, 27 nt, Artificial Sequence
  Beclin-1 (280-288)
ggccaguucgggaccaucaacaauuuu

SEQ ID NO: 58448 - RNA, 36 nt, Artificial Sequence
  Putative methyltransferase-like protein 15P1 (77-88)
ggccaguucagccaagccgaggcucugcucaugaag

SEQ ID NO: 58449 - RNA, 27 nt, Artificial Sequence
  Dual specificity tyrosine-phosphorylation-regulated kinase 1A (32-40)
ggccagaugccccacagccaucaauac

SEQ ID NO: 58450 - RNA, 33 nt, Artificial Sequence
  Myosin light polypeptide 6 (46-56)
ggccagaaccccaccaaugccgaggugcugaag

SEQ ID NO: 58451 - RNA, 36 nt, Artificial Sequence
  RNA-binding protein EWS (221-232)
ggccagcaaagcuccuacgggcagcagucuucauau

SEQ ID NO: 58452 - RNA, 27 nt, Artificial Sequence
  Putative peripheral benzodiazepine receptor-related protein (21-29)
ggccagugggggggagguagccacuac

SEQ ID NO: 58453 - RNA, 33 nt, Artificial Sequence
  Store-operated calcium entry-associated regulatory factor (197-207)
ggccaguacagccccccuccauauuccgaguac

SEQ ID NO: 58454 - RNA, 30 nt, Artificial Sequence
  EH domain-containing protein 1 (65-74)
ggccaguacagcaccgggaagacaacuuuc

SEQ ID NO: 58455 - RNA, 27 nt, Artificial Sequence
  Protein FAM216A (60-68)
ggcagcgacagaaucaaggauggguac

SEQ ID NO: 58456 - RNA, 27 nt, Artificial Sequence
  Splicing factor 3B subunit 1 (46-54)
ggcagcgacuccagauucgccggguac

SEQ ID NO: 58457 - RNA, 27 nt, Artificial Sequence
  AP-2 complex subunit beta (568-576)
ggcagccuggccuccguguaccacaag

SEQ ID NO: 58458 - RNA, 27 nt, Artificial Sequence
  L-lactate dehydrogenase A chain (68-76)
ggcagccuguuccucagaacccccaag

SEQ ID NO: 58459 - RNA, 27 nt, Artificial Sequence
  PHD and RING finger domain-containing protein 1 (519-527)
ggcagcuccgacgugaucauucacaga

SEQ ID NO: 58460 - RNA, 30 nt, Artificial Sequence
  E3 ubiquitin-protein ligase TRAF7 (378-387)
ggcagcuacgacccccagcaaaucuucaag

SEQ ID NO: 58461 - RNA, 33 nt, Artificial Sequence
  Voltage-dependent anion-selective channel protein 3 (187-197)
ggcaccgaguucgggggaagcaucuaccagaag

SEQ ID NO: 58462 - RNA, 33 nt, Artificial Sequence
  Iron-responsive element-binding protein 2 (740-750)
ggcaccuucgccaacaucaagcuguuuaauaaa

SEQ ID NO: 58463 - RNA, 33 nt, Artificial Sequence
  Cyclin-dependent kinase 1 (191-201)
ggcaccaucuucgccgagcuggcuacaaagaaa

SEQ ID NO: 58464 - RNA, 27 nt, Artificial Sequence
  AP-1 complex subunit beta-1 (568-576)
ggcacccuggccagcguguaccacaag

SEQ ID NO: 58465 - RNA, 27 nt, Artificial Sequence
  Alpha-ketoglutarate-dependent dioxygenase FTO (329-337)
ggcacccuggacuacauccuccagaga

SEQ ID NO: 58466 - RNA, 36 nt, Artificial Sequence
  Structural maintenance of chromosomes protein 4 (663-674)
ggcaccaugacagggggagguagcaaggugaugaaa

SEQ ID NO: 58467 - RNA, 27 nt, Artificial Sequence
  Sigma non-opioid intracellular receptor 1 (31-39)
ggcacccagagcuucguguuucaaaga

SEQ ID NO: 58468 - RNA, 27 nt, Artificial Sequence
  F-box/WD repeat-containing protein 11 (19-27)
ggcaccagcuccgugaucgucucuaga

SEQ ID NO: 58469 - RNA, 33 nt, Artificial Sequence
  Protein O-GlcNAcase (729-739)
ggcaccguggacgucacacccuucaucaagaaa

SEQ ID NO: 58470 - RNA, 30 nt, Artificial Sequence
  Transcription factor BTF3 (75-84)
ggcaccgugauccacuucaacaaucccaag

SEQ ID NO: 58471 - RNA, 27 nt, Artificial Sequence
  Peptidyl-prolyl cis-trans isomerase FKBP4 (277-285)
ggcaccguguacuucaaggaggggaaa

SEQ ID NO: 58472 - RNA, 27 nt, Artificial Sequence
  Tubulin-folding cofactor B (7-15)
ggcguggacgauaaguucuacagcaaa

SEQ ID NO: 58473 - RNA, 33 nt, Artificial Sequence; identical to SEQ ID NO: 34246
  Activating signal cointegrator 1 complex subunit 1 (166-176)

SEQ ID NO: 58474 - RNA, 27 nt, Artificial Sequence
  Eukaryotic translation initiation factor 4 gamma 1 (757-765)
ggcgugaucgaccugauuuucgagaag

SEQ ID NO: 58475 - RNA, 27 nt, Artificial Sequence
  40S ribosomal protein S19 (86-94)
ggcgugaugcccagccacuucuccaga

SEQ ID NO: 58476 - RNA, 27 nt, Artificial Sequence
  Heat shock cognate 71 kDa protein (408-416)
ggcgugaugaccguccugaucaagaga

SEQ ID NO: 58477 - RNA, 27 nt, Artificial Sequence
  Polypyrimidine tract-binding protein 3 (285-293)
ggcguguacggggacguccacagaguu

SEQ ID NO: 58478 - RNA, 30 nt, Artificial Sequence
  Polypyrimidine tract-binding protein 2 (308-317)
ggcguguacggggacguccagagaguuaag

SEQ ID NO: 58479 - RNA, 27 nt, Artificial Sequence
  Mitochondrial genome maintenance exonuclease 1 (204-212)
ggcuacaucgagagcgugcagcacauu

SEQ ID NO: 58480 - RNA, 27 nt, Artificial Sequence
  Catenin beta-1 (186-194)
cacgccaucaugagaagcccccagaug

SEQ ID NO: 58481 - RNA, 27 nt, Artificial Sequence
  Adenylyl cyclase-associated protein 1 (417-425)
cacgccuaccugagcaagaacucccuc

SEQ ID NO: 58482 - RNA, 27 nt, Artificial Sequence
  Surfeit locus protein 4 (232-240)
cacgacuuccugaaguacgauuuuuuc

SEQ ID NO: 58483 - RNA, 27 nt, Artificial Sequence
  NEDD4-binding protein 2-like 1 (64-72)
cacgacuuccccagagcccugaucuuu

SEQ ID NO: 58484 - RNA, 27 nt, Artificial Sequence
  Cold shock domain-containing protein E1 (507-515)
cacgacaaggagaucuucuuucauuac

SEQ ID NO: 58485 - RNA, 27 nt, Artificial Sequence
  Protein Niban (200-208)
cacgacuacaugaagcagaugaccuuc

SEQ ID NO: 58486 - RNA, 27 nt, Artificial Sequence
  Zinc finger and BTB domain-containing protein 38 (210-218)
cacgaggccgaacccgugagaacccug

SEQ ID NO: 58487 - RNA, 30 nt, Artificial Sequence
  Synaptic vesicle membrane protein VAT-1 homolog (222-231)
cacgaggcccugaaggaaaacggcgugacc

SEQ ID NO: 58488 - RNA, 27 nt, Artificial Sequence
  Protein sel-1 homolog 3 (891-899)
cacgaggcccugcucuacuaugugcuu

SEQ ID NO: 58489 - RNA, 30 nt, Artificial Sequence; identical to SEQ ID NO: 34262
  Nuclear migration protein nudC (79-88)

SEQ ID NO: 58490 - RNA, 27 nt, Artificial Sequence
  EH domain-containing protein 1 (210-218)
cacgaggacaagaucagagugguccug

SEQ ID NO: 58491 - RNA, 27 nt, Artificial Sequence
  Exosome complex exonuclease RRP44 (679-687)
cacgaggaauucagcgagcaugcccug

SEQ ID NO: 58492 - RNA, 27 nt, Artificial Sequence
  Repressor of RNA polymerase III transcription MAF1 homolog (116-124)
cacgaguucagcagagaacccucccug

SEQ ID NO: 58493 - RNA, 27 nt, Artificial Sequence
  Versican core protein (1534-1542)
cacgagcauaccgaacccgugagccug

SEQ ID NO: 58494 - RNA, 27 nt, Artificial Sequence
  Sphingolipid delta(4)-desaturase DES1 (89-97)
cacgagaucgcccauaacgcugcauuc

SEQ ID NO: 58495 - RNA, 30 nt, Artificial Sequence
  Histone-lysine N-methyltransferase 2E (353-362)
cacgagauccaggacggcaccauucaucug

SEQ ID NO: 58496 - RNA, 27 nt, Artificial Sequence
  Endothelial PAS domain-containing protein 1 (39-47)
cacgagcugccccucccucauagcgug

SEQ ID NO: 58497 - RNA, 30 nt, Artificial Sequence
  ATP-dependent RNA helicase DHX8 (1152-1161)
cacgagcuggugcucaccacaaaggaauac

SEQ ID NO: 58498 - RNA, 24 nt, Artificial Sequence
  E3 ubiquitin-protein ligase RNF213 (1247-1254)
cacgagaugaucauucugaagcuc

SEQ ID NO: 58499 - RNA, 27 nt, Artificial Sequence
  Histone-lysine N-methyltransferase NSD2 (449-457)
cacgagaacgacaucacccauuucuac

SEQ ID NO: 58500 - RNA, 27 nt, Artificial Sequence
  Sorting nexin-6 (212-220)
cacgagagaaccuuccugcucgaauac

SEQ ID NO: 58501 - RNA, 27 nt, Artificial Sequence
  Heterogeneous nuclear ribonucleoprotein K (415-423)
cacgagagcggcgccuccaucaagauu

SEQ ID NO: 58502 - RNA, 27 nt, Artificial Sequence
  Amyloid-like protein 2 (692-700)
cacggcuacgagaaccccaccuauaag

SEQ ID NO: 58503 - RNA, 27 nt, Artificial Sequence
  Transcription initiation factor TFIID subunit 4 (42-50)
caccuggcccccagaaccccugaggug

SEQ ID NO: 58504 - RNA, 27 nt, Artificial Sequence
  Cysteine and histidine-rich protein 1 (106-114)
caccugggccccgaggggagaagcgug

SEQ ID NO: 58505 - RNA, 30 nt, Artificial Sequence
  Formin-like protein 2 (244-253)
cacccccaugccgugaacgagaucgcucug

SEQ ID NO: 58506 - RNA, 27 nt, Artificial Sequence
  KRR1 small subunit processome component homolog (214-222)
caccccaucuacaacauuaagagccug

SEQ ID NO: 58507 - RNA, 30 nt, Artificial Sequence
  HLA class I histocompatibility antigen, Cw-7 alpha chain (216-225)
cacccccugagcgaccaugaggccacccuc

SEQ ID NO: 58508 - RNA, 27 nt, Artificial Sequence
  V-type proton ATPase 116 kDa subunit a isoform 3 (715-723)
caccaggccauccauaccauugaguuc

SEQ ID NO: 58509 - RNA, 27 nt, Artificial Sequence
  Dymeclin (278-286)
caccagaacagcaauaucagaaccuac

SEQ ID NO: 58510 - RNA, 24 nt, Artificial Sequence
  WD repeat-containing protein 1 (59-66)
caccagguggucguugccaaguac

SEQ ID NO: 58511 - RNA, 27 nt, Artificial Sequence
  HLA class I histocompatibility antigen, A-2 alpha chain (73-81)
cacagaguggaccugggcacccucagg

SEQ ID NO: 58512 - RNA, 24 nt, Artificial Sequence
  Endoplasmic reticulum resident protein 44 (95-102)
cacagcgacaucgcccagagauac

SEQ ID NO: 58513 - RNA, 27 nt, Artificial Sequence
  Histone deacetylase 4 (715-723)
cacagcgaggcccauacccugcucuac

SEQ ID NO: 58514 - RNA, 27 nt, Artificial Sequence
  Nucleolar protein 10 (122-130)
cacagccaguccggcuucuacuauaag

SEQ ID NO: 58515 - RNA, 24 nt, Artificial Sequence
  Eukaryotic translation initiation factor 3 subunit F (182-189)
cacagcgugcugauccaugaguac

SEQ ID NO: 58516 - RNA, 27 nt, Artificial Sequence
  Dual specificity protein phosphatase 5 (234-242)
cacaccgccgacaucagcucccauuuc

SEQ ID NO: 58517 - RNA, 30 nt, Artificial Sequence
  AP-3 complex subunit delta-1 (383-392)
cacguggacaaggccgagggcaccacauac

SEQ ID NO: 58518 - RNA, 27 nt, Artificial Sequence
  Rac GTPase-activating protein 1 (480-488)
cacgugaucgagaacagcaaugccuuc

SEQ ID NO: 58519 - RNA, 27 nt, Artificial Sequence
  T-complex protein 1 subunit epsilon (135-143)
cacgugaucgagacccugauuggcaag

SEQ ID NO: 58520 - RNA, 27 nt, Artificial Sequence
  Triple functional domain protein (477-485)
cacgugcuggacgucauccaugagguu

SEQ ID NO: 58521 - RNA, 27 nt, Artificial Sequence
  Manganese-transporting ATPase 13A1 (956-964)
aucgccgcucccuucaccagcaagcug

SEQ ID NO: 58522 - RNA, 45 nt, Artificial Sequence
  Solute carrier family 2, facilitated glucose transporter member 1 (21-35)
aucgcccagguguucggccuggacagcauuauggggaacaaggau

SEQ ID NO: 58523 - RNA, 24 nt, Artificial Sequence
  Insulin receptor substrate 2 (1323-1330)
aucgacuuccugagccaccaucuc

SEQ ID NO: 58524 - RNA, 24 nt, Artificial Sequence
  Neuroblast differentiation-associated protein AHNAK (4419-4426)
aucgacauuaagggccccagccug

SEQ ID NO: 58525 - RNA, 27 nt, Artificial Sequence
  Tripeptidyl-peptidase 2 (1087-1095)
aucgaccagaccgcccuggcuguguac

SEQ ID NO: 58526 - RNA, 33 nt, Artificial Sequence
  U5 small nuclear ribonucleoprotein 200 kDa helicase (803-813)
aucgaggaacccagcgccaagauuaacgugcug

SEQ ID NO: 58527 - RNA, 27 nt, Artificial Sequence
  Structural maintenance of chromosomes protein 1A (7-15)
aucgagauugaaaacuucaagagcuac

SEQ ID NO: 58528 - RNA, 24 nt, Artificial Sequence
  Casein kinase I isoform delta (51-58)
aucgagagcaagauuuacaaaaug

SEQ ID NO: 58529 - RNA, 24 nt, Artificial Sequence
  Protein S100-A9 (12-19)
aucgagaccauuauaaacacauuc

SEQ ID NO: 58530 - RNA, 30 nt, Artificial Sequence
  Probable UDP-sugar transporter protein SLC35A5 (264-273)
aucuucauucagaacagcaagcuguacuuu

SEQ ID NO: 58531 - RNA, 30 nt, Artificial Sequence
  Pre-mRNA-processing-splicing factor 8 (1809-1818)
aucuucaaccccagaaccggccagcuguuu

SEQ ID NO: 58532 - RNA, 39 nt, Artificial Sequence
  ATP synthase-coupling factor 6, mitochondrial (25-37)
aucggcgugaccgccgucgcuuucaacaaggagcuggac

SEQ ID NO: 58533 - RNA, 27 nt, Artificial Sequence
  DNA damage-binding protein 1 (793-801)
aucauugaccagcacaccuucgaggug

SEQ ID NO: 58534 - RNA, 27 nt, Artificial Sequence
  26S proteasome non-ATPase regulatory subunit 2 (809-817)
aucauucugggcaagagccacuacgug

SEQ ID NO: 58535 - RNA, 36 nt, Artificial Sequence
  Elongation factor 1-alpha 1 (178-189)
aucaagaaaauuggcuacaaccccgacaccguggcc

SEQ ID NO: 58536 - RNA, 33 nt, Artificial Sequence
  Probable ATP-dependent RNA helicase DDX60-like (1497-1507)
auccuggccgagcuccccgaagacuucaaggcu

SEQ ID NO: 58537 - RNA, 27 nt, Artificial Sequence
  Interferon-induced GTP-binding protein Mx2 (436-444)
auccuggccaccaacacacagaaggug

SEQ ID NO: 58538 - RNA, 33 nt, Artificial Sequence
  Eukaryotic translation initiation factor 4 gamma 3 (389-399)
auccuggagaaccccccugaagagaugaagcuc

SEQ ID NO: 58539 - RNA, 27 nt, Artificial Sequence
  ATP-dependent RNA helicase DDX42 (333-341)
auccugauugaccccauaagagugguc

SEQ ID NO: 58540 - RNA, 27 nt, Artificial Sequence
  Phosphorylated CTD-interacting factor 1 (267-275)
aucaugaacgacauucccauaagacug

SEQ ID NO: 58541 - RNA, 27 nt, Artificial Sequence
  RNA polymerase-associated protein CTR9 homolog (124-132)
aucauguacgaccagaaccaccugcuc

SEQ ID NO: 58542 - RNA, 51 nt, Artificial Sequence
  Cystatin-A (2-18)
auccccggcgggcugagcgaggccaagccugcuaccccagaaauucaggag

SEQ ID NO: 58543 - RNA, 30 nt, Artificial Sequence
  Splicing factor U2AF 65 kDa subunit (413-422)
auccccagaccuguggacggcgucgagguu

SEQ ID NO: 58544 - RNA, 27 nt, Artificial Sequence
  Membrane-bound transcription factor site-1 protease (189-197)
auccccagacagguggcccaaacccug

SEQ ID NO: 58545 - RNA, 33 nt, Artificial Sequence
  Cytospin-A (862-872)
auccccagaaccccucugagcccauccccgaug

SEQ ID NO: 58546 - RNA, 33 nt, Artificial Sequence
  Filamin-A (1569-1579)
auccaggacaaccacgauggcaccuacacagug

SEQ ID NO: 58547 - RNA, 33 nt, Artificial Sequence
  UBX domain-containing protein 4 (322-332)
auccaguucagacugcccgacggcagcuccuuu

SEQ ID NO: 58548 - RNA, 30 nt, Artificial Sequence
  Thyroid receptor-interacting protein 11 (87-96)
auccagauuaagcaacagagcaccuccuac

SEQ ID NO: 58549 - RNA, 27 nt, Artificial Sequence
  Coatomer subunit delta (393-401)
auccaggugaccaaggucacacaaguu

SEQ ID NO: 58550 - RNA, 27 nt, Artificial Sequence
  Kinesin-like protein KIF11 (400-408)
aucagcgaggaaaacuucagagugaug

SEQ ID NO: 58551 - RNA, 42 nt, Artificial Sequence
  FAST kinase domain-containing protein 2 (542-555)
aucagcgagcugcucaccuccgacgauaugaagaacgccuac

SEQ ID NO: 58552 - RNA, 27 nt, Artificial Sequence
  LEM domain-containing protein 2 (23-31)
aucaccgacacaacuagagauguguac

SEQ ID NO: 58553 - RNA, 48 nt, Artificial Sequence
  Galectin-3 (132-147)
aucaccauucugggcacagugaagcccaacgccaauagaauagcucuc

SEQ ID NO: 58554 - RNA, 27 nt, Artificial Sequence
  NADH dehydrogenase (ubiquinone) 1 beta subcomplex subunit 10 (34-42)
aucguggacagacccgucacccugguu

SEQ ID NO: 58555 - RNA, 27 nt, Artificial Sequence
  Cell division cycle protein 27 homolog (695-703)
aucgugauugaccccaagaacccucug

SEQ ID NO: 58556 - RNA, 42 nt, Artificial Sequence
  Macrophage migration inhibitory factor (3-16)
aucgugaacaccaauguccccagagccagcguuccugacggc

SEQ ID NO: 58557 - RNA, 30 nt, Artificial Sequence
  Solute carrier family 12 member 6 (219-228)
aucuacgccggcgcuauuaagagcuccuuc

SEQ ID NO: 58558 - RNA, 27 nt, Artificial Sequence
  ATP-dependent RNA helicase DHX29 (1317-1325)
aucuacuuccaggcccccgugaagauu

SEQ ID NO: 58559 - RNA, 27 nt, Artificial Sequence
  Tripeptidyl-peptidase 2 (478-486)
aucuaccugagagaccccgugcagguc

SEQ ID NO: 58560 - RNA, 27 nt, Artificial Sequence
  BCL2/adenovirus E1B 19 kDa protein-interacting protein 3 (38-46)
aucuacaacggcgacauggagaagauu

SEQ ID NO: 58561 - RNA, 27 nt, Artificial Sequence
  Serine/threonine-protein phosphatase 2A 56 kDa regulatory subunit gamma isoform (91-99)
aucuaccccgaggugguccacauguuc

SEQ ID NO: 58562 - RNA, 33 nt, Artificial Sequence
  Flotillin-2 (104-114)
aucuaccaggacagagaucaauucgccaagcug

SEQ ID NO: 58563 - RNA, 27 nt, Artificial Sequence
  Bardet-Biedl syndrome 4 protein (45-53)
aucuaccagaaggccuucgagcaccug

SEQ ID NO: 58564 - RNA, 27 nt, Artificial Sequence
  Signal transducer and activator of transcription 6 (87-95)
aucuaccagagagacccccugaagcuc

SEQ ID NO: 58565 - RNA, 27 nt, Artificial Sequence
  Progestin and adipoQ receptor family member 4 (52-60)
aucuacacccacggccuggcccuccuu

SEQ ID NO: 58566 - RNA, 24 nt, Artificial Sequence
  40S ribosomal protein S23 (29-36)
aaggcccaccugggcaccgcucuc

SEQ ID NO: 58567 - RNA, 27 nt, Artificial Sequence
  Peroxisomal membrane protein PMP34 (213-221)
aaggccaucgcuaccacagugacuuac

SEQ ID NO: 58568 - RNA, 27 nt, Artificial Sequence
  Protein PRRC2C (2255-2263)
aaggccugggagaacagccccaaugug

SEQ ID NO: 58569 - RNA, 30 nt, Artificial Sequence
  Polycystic kidney disease and receptor for egg jelly-related protein (701-710)
aaggacuuccugcccgccggcuaccuccuu

SEQ ID NO: 58570 - RNA, 27 nt, Artificial Sequence
  FERM domain-containing protein 6 (545-553)
aaggacuuccugagaaucgccggccuc

SEQ ID NO: 58571 - RNA, 33 nt, Artificial Sequence
  Microtubule-actin cross-linking factor 1, isoforms 1/2/3/5 (2405-2415)
aaggacaaacugaaggaugccaccgagagauac

SEQ ID NO: 58572 - RNA, 27 nt, Artificial Sequence
  Calcium-binding protein 39 (189-197)
aaggaccugcucaccagacacaaacuu

SEQ ID NO: 58573 - RNA, 27 nt, Artificial Sequence
  Ribonucleoside-diphosphate reductase subunit M2 B (73-81)
aaggaccugccccacuggaacaaacuc

SEQ ID NO: 58574 - RNA, 27 nt, Artificial Sequence
  Spectrin beta chain, non-erythrocytic 1 (655-663)
aaggaccugaccagcgugaugagacuc

SEQ ID NO: 58575 - RNA, 27 nt, Artificial Sequence
  Plastin-3 (18-26)
aaggaggccuucgcuaaaguggaccug

SEQ ID NO: 58576 - RNA, 27 nt, Artificial Sequence
  Protein Red (496-504)
aaggaggcccugcccaaagcugcauuc

SEQ ID NO: 58577 - RNA, 30 nt, Artificial Sequence; identical to SEQ ID NO: 34350
  Protein KHNYN (158-167)

SEQ ID NO: 58578 - RNA, 27 nt, Artificial Sequence
  40S ribosomal protein S15 (65-73)
aaggaggcccccccuauggaaaaacca

SEQ ID NO: 58579 - RNA, 27 nt, Artificial Sequence
  Protein transport protein Sec23B (564-572)
aaggaggaccccaccagcuucagacug

SEQ ID NO: 58580 - RNA, 33 nt, Artificial Sequence
  Tropomyosin alpha-4 chain (228-238)
aaggaggaaaacgugggccugcaccagacccuc

SEQ ID NO: 58581 - RNA, 30 nt, Artificial Sequence
  Putative methyltransferase NSUN6 (163-172)
aaggaguucgacggcaccaaaguguuucug

SEQ ID NO: 58582 - RNA, 30 nt, Artificial Sequence
  Sin3 histone deacetylase corepressor complex component SDS3 (137-146)
aaggaguucgaagacaaaaagguggagcug

SEQ ID NO: 58583 - RNA, 27 nt, Artificial Sequence
  Heat shock protein HSP 90-alpha (656-664)
aaggaguucgaaggcaaaacccuggug

SEQ ID NO: 58584 - RNA, 27 nt, Artificial Sequence
  Protein S100-A10 (37-45)
aaggaguuccccggcuuucuggaaaac

SEQ ID NO: 58585 - RNA, 36 nt, Artificial Sequence
  Serine palmitoyltransferase 2 (526-537)
aaggagaucgacgaagugggcgaucugcuccagcuu

SEQ ID NO: 58586 - RNA, 27 nt, Artificial Sequence
  Melanoma-associated antigen D4 (471-479)
aaggagaucgacaaagaagagcaccug

SEQ ID NO: 58587 - RNA, 39 nt, Artificial Sequence
  Spectrin beta chain, non-erythrocytic 1 (1434-1446)
aaggagaucgaagagcugcagagccaagcccaggcucuc

SEQ ID NO: 58588 - RNA, 36 nt, Artificial Sequence
  Calcium/calmodulin-dependent protein kinase type IV (135-146)
aaggagaucuucgaaacccccacagagauuagccug

SEQ ID NO: 58589 - RNA, 27 nt, Artificial Sequence
  E3 ubiquitin-protein ligase RNF19B (187-195)
aaggagaucagcgaccugcacuaccuc

SEQ ID NO: 58590 - RNA, 27 nt, Artificial Sequence
  Centromere protein F (392-400)
aaggagaaagaauuccaggaggaacug

SEQ ID NO: 58591 - RNA, 30 nt, Artificial Sequence
  Girdin (728-737)
aaggagcuggaaagcgagaaagaacagcuc

SEQ ID NO: 58592 - RNA, 30 nt, Artificial Sequence
  Testin (173-182)
aaggagauggaacaguucgugaaaaaguac

SEQ ID NO: 58593 - RNA, 30 nt, Artificial Sequence; identical to SEQ ID NO: 34366
  Leucine-tRNA ligase, cytoplasmic (775-784)

SEQ ID NO: 58594 - RNA, 30 nt, Artificial Sequence
  SWI/SNF-related matrix-associated actin-dependent regulator of chromatin subfamily B member 1 (277-286)
aaggagaacagccccgaaaaauucgcccug

SEQ ID NO: 58595 - RNA, 33 nt, Artificial Sequence
  Squalene monooxygenase (157-167)
aaggagcccgacagaaucgugggcgaauuccug

SEQ ID NO: 58596 - RNA, 27 nt, Artificial Sequence
  Calcium uptake protein 2, mitochondrial (204-212)
aaggagcccgaaaucaacaccacacug

SEQ ID NO: 58597 - RNA, 27 nt, Artificial Sequence
  Farnesyl pyrophosphate synthase (39-47)
aaggaggugcuggaauacaacgccauc

SEQ ID NO: 58598 - RNA, 24 nt, Artificial Sequence
  Tetratricopeptide repeat protein 25 (351-358)
aaggaguacgaccugcccgaugcc

SEQ ID NO: 58599 - RNA, 30 nt, Artificial Sequence
  Inhibitor of growth protein 5 (76-85)
aaggaguacagcgacgauaaagugcagcug

SEQ ID NO: 58600 - RNA, 27 nt, Artificial Sequence
  Son of sevenless homolog 2 (677-685)
aaggaguacgugcagcccguccaacug

SEQ ID NO: 58601 - RNA, 27 nt, Artificial Sequence
  Nodal modulator 2 (392-400)
aagaucgcccccaacaccccucagcug

SEQ ID NO: 58602 - RNA, 30 nt, Artificial Sequence
  Trans-Golgi network integral membrane protein 2 (408-417)
aagaucauugccuucgugcuggagggcaaa

SEQ ID NO: 58603 - RNA, 27 nt, Artificial Sequence
  Interleukin enhancer-binding factor 2 (127-135)
aagauccugcccacccucgaggccgug

SEQ ID NO: 58604 - RNA, 27 nt, Artificial Sequence
  Insulin-like growth factor 2 mRNA-binding protein 3 (552-560)
aagauccaggagauucugacccaagug

SEQ ID NO: 58605 - RNA, 30 nt, Artificial Sequence
  WD repeat-containing protein 1 (119-128)
aagaucugggacgugagcgucaacuccguu

SEQ ID NO: 58606 - RNA, 27 nt, Artificial Sequence
  Transcription factor SOX-8 (1-9)
aagcuggccgaccaguacccccaccuc

SEQ ID NO: 58607 - RNA, 27 nt, Artificial Sequence
  14-3-3 protein theta (11-19)
aagcuggccgagcaggcugaaagauac

SEQ ID NO: 58608 - RNA, 27 nt, Artificial Sequence
  Akirin-1 (163-171)
aagcuggccgagcaguacgaaagcuuc

SEQ ID NO: 58609 - RNA, 33 nt, Artificial Sequence
  Akirin-1 (163-173)
aagcuggccgagcaguacgaaagcuucgugaaa

SEQ ID NO: 58610 - RNA, 27 nt, Artificial Sequence
  V-type proton ATPase subunit C 1 (25-33)
aagcuggacgccuucguggagggcguc

SEQ ID NO: 58611 - RNA, 27 nt, Artificial Sequence
  Kinetochore-associated protein 1 (1298-1306)
aagcuguucggcgagaccacacucgug

SEQ ID NO: 58612 - RNA, 27 nt, Artificial Sequence
  Heterogeneous nuclear ribonucleoprotein A0 (8-16)
aagcuguucaucggcgggcucaacgug

SEQ ID NO: 58613 - RNA, 27 nt, Artificial Sequence
  Heterogeneous nuclear ribonucleoprotein A1 (15-23)
aagcuguucaucggcgggcucagcuuu

SEQ ID NO: 58614 - RNA, 30 nt, Artificial Sequence; identical to SEQ ID NO: 34387
  Serine/threonine-protein kinase DCLK2 (534-543)

SEQ ID NO: 58615 - RNA, 27 nt, Artificial Sequence
  TRPM8 channel-associated factor 1 (199-207)
aagcugggcagcgugcccgucaccguu

SEQ ID NO: 58616 - RNA, 27 nt, Artificial Sequence
  Transformation/transcription domain-associated protein (911-919)
aagcugcacuacguggucaccgagguu

SEQ ID NO: 58617 - RNA, 33 nt, Artificial Sequence
  E3 ubiquitin-protein ligase UBR4 (1375-1385)
aagcugaucgacgagacccaggauaugcuccuu

SEQ ID NO: 58618 - RNA, 27 nt, Artificial Sequence
  Pericentriolar material 1 protein (412-420)
aagcugcucggcgagcuucacacccug

SEQ ID NO: 58619 - RNA, 27 nt, Artificial Sequence
  Peptidyl-prolyl cis-trans isomerase FKBP3 (42-50)
aagcugcucggcaacaucaaaaaugug

SEQ ID NO: 58620 - RNA, 27 nt, Artificial Sequence
  Calnexin (166-174)
aagcugcucagcaaaacccccgagcuu

SEQ ID NO: 58621 - RNA, 27 nt, Artificial Sequence
  Golgin subfamily A member 5 (484-492)
aagcugaugggccagauccaccaacuc

SEQ ID NO: 58622 - RNA, 27 nt, Artificial Sequence
  TBC1 domain family member 13 (39-47)
aagcugaaccccggcaucgccuacgug

SEQ ID NO: 58623 - RNA, 27 nt, Artificial Sequence
  E3 ubiquitin-protein ligase TRIP12 (912-920)
aagcugcccgacaucuucagcguguac

SEQ ID NO: 58624 - RNA, 30 nt, Artificial Sequence
  Kelch-like protein 24 (347-356)
aagcugcccgaguucaccaaaagcgaauac

SEQ ID NO: 58625 - RNA, 27 nt, Artificial Sequence
  Transmembrane and coiled-coil domain-containing protein 1 (116-124)
aagcugcccuucaccccucucagcuac

SEQ ID NO: 58626 - RNA, 30 nt, Artificial Sequence
  HLA class II histocompatibility antigen, DR beta 5 chain (5-14)
aagcugcccggcgggagcuacauggccaaa

SEQ ID NO: 58627 - RNA, 27 nt, Artificial Sequence
  Fanconi anemia group I protein (16-24)
aagcugcaggaguuccuccaaacccuu

SEQ ID NO: 58628 - RNA, 27 nt, Artificial Sequence
  Tyrosine-protein kinase BAZ1B (379-387)
aagcugagcgagaucccccucacccuu

SEQ ID NO: 58629 - RNA, 27 nt, Artificial Sequence
  E3 SUMO-protein ligase CBX4 (347-355)
aagcugagccccaccaaagaggccuuc

SEQ ID NO: 58630 - RNA, 27 nt, Artificial Sequence
  PWWP domain-containing protein MUM1 (574-582)
aagcugguggaguacaucgucaaagcc

SEQ ID NO: 58631 - RNA, 27 nt, Artificial Sequence
  Minor histocompatibility protein HA-1 (532-540)
aagcuguacgaccccggccagcaauau

SEQ ID NO: 58632 - RNA, 27 nt, Artificial Sequence
  Replication factor C subunit 5 (304-312)
aagauggccgacaucgaguacagacug

SEQ ID NO: 58633 - RNA, 36 nt, Artificial Sequence
  Interferon-induced transmembrane protein 2 (87-98)
aagauggugggcgacgucaccggggcccaggcuuac

SEQ ID NO: 58634 - RNA, 33 nt, Artificial Sequence
  U1 small nuclear ribonucleoprotein 70 kDa (87-97)
aagaugugggacccccacaacgauccuaaugcc

SEQ ID NO: 58635 - RNA, 33 nt, Artificial Sequence
  Myosin-9 (517-527)
aagcccgccggcccuccagggauccuggcucuc

SEQ ID NO: 58636 - RNA, 30 nt, Artificial Sequence
  Transketolase (6-15)
aagcccgaccagcaaaaacugcaggcccuc

SEQ ID NO: 58637 - RNA, 30 nt, Artificial Sequence
  Calponin-3 (156-165)
aagcccuucgaccagaccacaaucagccug

SEQ ID NO: 58638 - RNA, 33 nt, Artificial Sequence; identical to SEQ ID NO: 34411
  DNA polymerase kappa (36-46)

SEQ ID NO: 58639 - RNA, 27 nt, Artificial Sequence
  Elongation factor 2 (445-453)
aagcccauccagagaaccauucugaug

SEQ ID NO: 58640 - RNA, 27 nt, Artificial Sequence
  Galectin-3 (139-147)
aagcccaacgccaauagaaucgcucug

SEQ ID NO: 58641 - RNA, 33 nt, Artificial Sequence
  Spectrin beta chain, non-erythrocytic 1 (1939-1949)
aagcccagagacgugagcuccgucgagcugcuc

SEQ ID NO: 58642 - RNA, 30 nt, Artificial Sequence
  Methionine synthase (342-351)
aagcccagagugccuccagccaccgcuuuc

SEQ ID NO: 58643 - RNA, 27 nt, Artificial Sequence
  Peroxisomal multifunctional enzyme type 2 (565-573)
aagcccguguacccuggccagacccug

SEQ ID NO: 58644 - RNA, 24 nt, Artificial Sequence
  SWI/SNF-related matrix-associated actin-dependent regulator of chromatin subfamily A containing DEAD/H box 1 (68-75)
aagcccuaccagaaagugggccug

SEQ ID NO: 58645 - RNA, 27 nt, Artificial Sequence
  Programmed cell death protein 6 (116-124)
aagcaggcccugagcggcuucggguac

SEQ ID NO: 58646 - RNA, 27 nt, Artificial Sequence
  Ubiquitin-associated protein 2-like (939-947)
aagcagcacggcgugaacgucagcguu

SEQ ID NO: 58647 - RNA, 27 nt, Artificial Sequence
  DnaJ homolog subfamily A member 1 (46-54)
aagcagaucagccaagccuacgaggug

SEQ ID NO: 58648 - RNA, 27 nt, Artificial Sequence
  E3 ubiquitin-protein ligase MGRN1 (240-248)
aagcagaucguggacagagucagcuac

SEQ ID NO: 58649 - RNA, 30 nt, Artificial Sequence
  MICOS complex subunit MIC60 (724-733)
aagcagaucguggagauucugaccgccuac

SEQ ID NO: 58650 - RNA, 27 nt, Artificial Sequence
  Transgelin-2 (88-96)
aagcagauggagcaaaucagccaguuc

SEQ ID NO: 58651 - RNA, 30 nt, Artificial Sequence
  Transgelin-2 (88-97)
aagcagauggagcaaaucagccaguuccug

SEQ ID NO: 58652 - RNA, 27 nt, Artificial Sequence
  Zinc finger MIZ domain-containing protein 2 (174-182)
aagcagagccaagagcugucccaguac

SEQ ID NO: 58653 - RNA, 27 nt, Artificial Sequence
  Heat shock cognate 71 kDa protein (423-431)
aagcagacccaaacauucacuacguac

SEQ ID NO: 58654 - RNA, 27 nt, Artificial Sequence
  Heterogeneous nuclear ribonucleoprotein K (456-464)
aagcaguacgccgacguggagggcuuc

SEQ ID NO: 58655 - RNA, 27 nt, Artificial Sequence
  T-complex protein 1 subunit theta (98-106)
aagcaguacggcaacgagguguuccug

SEQ ID NO: 58656 - RNA, 27 nt, Artificial Sequence
  Coatomer subunit beta' (386-394)
aagagcuucggcuccgcccaggaguuu

SEQ ID NO: 58657 - RNA, 33 nt, Artificial Sequence
  Elongation factor 1-alpha 1 (20-30)
aagagcaccacaacuggccaccugaucuacaaa

SEQ ID NO: 58658 - RNA, 27 nt, Artificial Sequence
  Translocation protein SEC63 homolog (95-103)
aagaccgacagagaguaccaggaauau

SEQ ID NO: 58659 - RNA, 27 nt, Artificial Sequence
  E3 ubiquitin-protein ligase RBBP6 (1474-1482)
aagaccgacuacgauacaagagaguau

SEQ ID NO: 58660 - RNA, 33 nt, Artificial Sequence
  Probable ATP-dependent RNA helicase DDX47 (195-205)
aagaccuuccuguuuagcgccacaaugacuaaa

SEQ ID NO: 58661 - RNA, 27 nt, Artificial Sequence
  Cytoplasmic dynein 1 heavy chain 1 (872-880)
aagaccuucagcgagauccugaacaga

SEQ ID NO: 58662 - RNA, 27 nt, Artificial Sequence
  Chromodomain Y-like protein (93-101)
aagaccagccccaaagcccuggugauc

SEQ ID NO: 58663 - RNA, 36 nt, Artificial Sequence
  Protein polybromo-1 (260-271)
aagaccuacaacgagcccggcagccagguguucaaa

SEQ ID NO: 58664 - RNA, 27 nt, Artificial Sequence
  60S ribosomal protein L7a (11-19)
aagguggcccccgcuccugcagucguu

SEQ ID NO: 58665 - RNA, 27 nt, Artificial Sequence
  Procollagen-lysine,2-oxoglutarate 5-dioxygenase 2 (109-117)
aagguguucgccggcuacuauaccaaa

SEQ ID NO: 58666 - RNA, 27 nt, Artificial Sequence
  Nucleolin (370-378)
aagguguucggcaacgagaucaaacug

SEQ ID NO: 58667 - RNA, 27 nt, Artificial Sequence
  F-box only protein 28 (103-111)
aaggugaucgacgagauuuacagaguc

SEQ ID NO: 58668 - RNA, 27 nt, Artificial Sequence
  Trafficking protein particle complex subunit 5 (81-89)
aaggugcugggcgcccuccuuuucguc

SEQ ID NO: 58669 - RNA, 30 nt, Artificial Sequence
  Long-chain-fatty-acid-CoA ligase 4 (347-356)
aaggugcaggagaugaacuacauccaaaaa

SEQ ID NO: 58670 - RNA, 27 nt, Artificial Sequence
  78 kDa glucose-regulated protein (146-154)
aaggugacccacgccgucguuacagug

SEQ ID NO: 58671 - RNA, 27 nt, Artificial Sequence
  26S proteasome non-ATPase regulatory subunit 11 (409-417)
aagguggucgacagccuguacaacaaa

SEQ ID NO: 58672 - RNA, 27 nt, Artificial Sequence
  Tripartite motif-containing protein 34 (162-170)
aaguacggcguguucgaggaaagccug

SEQ ID NO: 58673 - RNA, 27 nt, Artificial Sequence
  Tubulin-tyrosine ligase (184-192)
aaguaccuggagcacccccuccuucug

SEQ ID NO: 58674 - RNA, 27 nt, Artificial Sequence
  DNA topoisomerase 3-beta-1 (425-433)
aaguaccugcagagcaccaucuccuuc

SEQ ID NO: 58675 - RNA, 27 nt, Artificial Sequence
  Lysine-specific demethylase 2A (48-56)
aaguacaacgccaauuucgugaccuuu

SEQ ID NO: 58676 - RNA, 27 nt, Artificial Sequence
  Hermansky-Pudlak syndrome 3 protein (16-24)
aaguaccagaucauuaacgaggaauuc

SEQ ID NO: 58677 - RNA, 27 nt, Artificial Sequence
  G/T mismatch-specific thymine DNAosylase (221-229)
aaguaccagcccagaaucgccguguuc

SEQ ID NO: 58678 - RNA, 27 nt, Artificial Sequence
  Casein kinase II subunit alpha (49-57)
aaguacagcgagguguucgaagccauc

SEQ ID NO: 58679 - RNA, 36 nt, Artificial Sequence
  Eukaryotic translation initiation factor 3 subunit D (58-69)
aaguacagcucccaguucggcgggggaucucaauau

SEQ ID NO: 58680 - RNA, 27 nt, Artificial Sequence
  E3 ubiquitin-protein ligase listerin (1408-1416)
aaguacgugagcuccguccugucuuuc

SEQ ID NO: 58681 - RNA, 51 nt, Artificial Sequence
  Glutathione S-transferase P (194-210)
cuggccagccccgaguacgugaaccucccuaucaauggcaacgggaagcag

SEQ ID NO: 58682 - RNA, 27 nt, Artificial Sequence
  Msx2-interacting protein (2085-2093)
cuggccguggacaagagcgcuucccuc

SEQ ID NO: 58683 - RNA, 24 nt, Artificial Sequence
  Transducin beta-like protein 3 (781-788)
cuggacuuccucuggcacaacaug

SEQ ID NO: 58684 - RNA, 27 nt, Artificial Sequence
  Negative regulator of reactive oxygen species (186-194)
cuggaccuccagagaaacuacaucuuc

SEQ ID NO: 58685 - RNA, 27 nt, Artificial Sequence
  Protein S100-A9 (66-74)
cuggacaccaacgccgauaagcagcuc

SEQ ID NO: 58686 - RNA, 30 nt, Artificial Sequence
  Ubiquitin-60S ribosomal protein L40 (55-64)
cuggaggacggcagaacccucagcgauuac

SEQ ID NO: 58687 - RNA, 27 nt, Artificial Sequence
  Microtubule-actin cross-linking factor 1 isoform X1 (2426-2434)
cuggaggaagacagcgccagagagauc

SEQ ID NO: 58688 - RNA, 24 nt, Artificial Sequence
  Coatomer subunit zeta-1 (62-69)
cuggagggccucaccguggucuac

SEQ ID NO: 58689 - RNA, 27 nt, Artificial Sequence
  Phosphatidylinositol 4-kinase alpha (113-121)
cuggagauccaggacaaggaauaccuc

SEQ ID NO: 58690 - RNA, 24 nt, Artificial Sequence
  Vimentin (220-227)
cuggagagaaagguggaaagccuc

SEQ ID NO: 58691 - RNA, 27 nt, Artificial Sequence
  BAG family molecular chaperone regulator 2 (29-37)
cuggagagccucgaccagcuugaacug

SEQ ID NO: 58692 - RNA, 27 nt, Artificial Sequence
  Ubiquitin carboxyl-terminal hydrolase 11 (266-274)
cuggagaccggccagcucaucauuaug

SEQ ID NO: 58693 - RNA, 27 nt, Artificial Sequence
  ATP-dependent RNA helicase DDX1 (284-292)
cugaucguggagcccagcagagaacuc

SEQ ID NO: 58694 - RNA, 27 nt, Artificial Sequence
  60S acidic ribosomal protein P0 (102-110)
cugcucgccaacaaggugcccgcugca

SEQ ID NO: 58695 - RNA, 27 nt, Artificial Sequence
  Ras GTPase-activating-like protein IQGAP2 (984-992)
cugcucgcccccguggucaaggagauc

SEQ ID NO: 58696 - RNA, 27 nt, Artificial Sequence
  Nucleolar complex protein 4 homolog (333-341)
cugcucgaccccagcguguuccacguc

SEQ ID NO: 58697 - RNA, 27 nt, Artificial Sequence
  Inositol hexakisphosphate kinase 2 (76-84)
cugcucgagcccuucgugcaccagguc

SEQ ID NO: 58698 - RNA, 27 nt, Artificial Sequence
  TBC1 domain family member 9B (211-219)
cugcucuuccccgagagcaucagagug

SEQ ID NO: 58699 - RNA, 27 nt, Artificial Sequence
  Ganglioside GM2 activator (15-23)
cugcuccuugccgcucccgcacaggcc

SEQ ID NO: 58700 - RNA, 27 nt, Artificial Sequence
  DNA damage-binding protein 1 (1050-1058)
cugcuccuugacaugcagaacagacug

SEQ ID NO: 58701 - RNA, 27 nt, Artificial Sequence
  Retinoblastoma-associated protein (476-484)
cugcucaacgacaauaucuuccacaug

SEQ ID NO: 58702 - RNA, 30 nt, Artificial Sequence
  RNA-binding protein 12B (432-441)
cugcucuacgacgauaagggcguggggcuu

SEQ ID NO: 58703 - RNA, 27 nt, Artificial Sequence
  Beta-galactoside alpha-2,6-sialyltransferase 1 (371-379)
cugcucuacgagaagaaccuugugaaa

SEQ ID NO: 58704 - RNA, 33 nt, Artificial Sequence
  Junction plakoglobin (16-26)
cugcucuaccaggagggcgccaagauggcugug

SEQ ID NO: 58705 - RNA, 36 nt, Artificial Sequence
  General transcription factor IIH subunit 5 (60-71)
cugauggaccagaacgccuucagccucacccaaaag

SEQ ID NO: 58706 - RNA, 30 nt, Artificial Sequence
  Dynactin subunit 5 (164-173)
cugaugaucgacgugaccaagagcuacuau

SEQ ID NO: 58707 - RNA, 27 nt, Artificial Sequence
  Protein SSXT (79-87)
cugcccgccccuccaacccagaacaug

SEQ ID NO: 58708 - RNA, 27 nt, Artificial Sequence
  N-terminal Xaa-Pro-Lys N-methyltransferase 1 (211-219)
cugcccgacgagaucuaccacguguau

SEQ ID NO: 58709 - RNA, 27 nt, Artificial Sequence
  Ran-binding protein 9 (350-358)
cugcccaagcagccuccacucgcccuu

SEQ ID NO: 58710 - RNA, 27 nt, Artificial Sequence
  E3 ubiquitin-protein ligase RNF216 (406-414)
cugcccagaccugugccacagaaccuc

SEQ ID NO: 58711 - RNA, 30 nt, Artificial Sequence
  SET domain-containing protein 5 (1382-1391)
cugcccagcgaccucagaaccaucucccuu

SEQ ID NO: 58712 - RNA, 27 nt, Artificial Sequence
  Anaphase-promoting complex subunit 7 (132-140)
cugcccagcgagaucgaagugaaguac

SEQ ID NO: 58713 - RNA, 27 nt, Artificial Sequence
  F-box/WD repeat-containing protein 7 (467-475)
cugcaguucgacggcauccacgugguc

SEQ ID NO: 58714 - RNA, 39 nt, Artificial Sequence
  Keratin, type I cytoskeletal 10 (222-234)
cugcagaucgacaacgccagacucgcugcagaugacuuc

SEQ ID NO: 58715 - RNA, 30 nt, Artificial Sequence
  Double-stranded RNA-binding protein Staufen homolog 1 (119-128)
cugcagaacgagccccucccugaaagacuu

SEQ ID NO: 58716 - RNA, 45 nt, Artificial Sequence
  HLA class I histocompatibility antigen, Cw-3 alpha chain (296-310)
cugagaugggagcccagcucccagccuaccaucccaauugugggc

SEQ ID NO: 58717 - RNA, 24 nt, Artificial Sequence
  TRIO and F-actin-binding protein (42-49)
cugaccgacagcucccucaaguac

SEQ ID NO: 58718 - RNA, 27 nt, Artificial Sequence
  Pleckstrin homology domain-containing family A member 2 (315-323)
cugaccagacccggcagcuccucucuc

SEQ ID NO: 58719 - RNA, 27 nt, Artificial Sequence
  DNA topoisomerase 2-beta (566-574)
cugaccuacaacgacuucaucaauaag

SEQ ID NO: 58720 - RNA, 27 nt, Artificial Sequence
  Suppressor of SWI4 1 homolog (117-125)
cuggugagagacgucguuagcucccuc

SEQ ID NO: 58721 - RNA, 30 nt, Artificial Sequence
  Leucine-rich repeat-containing protein 20 (34-43)
cuggugagcuuccccaucggcauuuacaag

SEQ ID NO: 58722 - RNA, 33 nt, Artificial Sequence; identical to SEQ ID NO: 34495
  Beta-actin-like protein 2 (9-19)

SEQ ID NO: 58723 - RNA, 27 nt, Artificial Sequence
  Peptidyl-prolyl cis-trans isomerase FKBP4 (410-418)
cuguacgccaacauguucgagagacuc

SEQ ID NO: 58724 - RNA, 27 nt, Artificial Sequence
  AKT-interacting protein (201-209)
cuguacgagaaggacauccagcucuuc

SEQ ID NO: 58725 - RNA, 27 nt, Artificial Sequence
  Serine palmitoyltransferase 2 (282-290)
cuguaccucgacgaggcccacagcauc

SEQ ID NO: 58726 - RNA, 27 nt, Artificial Sequence
  DNA-dependent protein kinase catalytic subunit (3377-3385)
cuguaccagagagccuuccaacaccuc

SEQ ID NO: 58727 - RNA, 27 nt, Artificial Sequence
  Stimulator of interferon genes protein (214-222)
auggccgaccccaacaucagauuccug

SEQ ID NO: 58728 - RNA, 24 nt, Artificial Sequence
  Putative V-set and immunoglobulin domain-containing-like protein IGHV4OR15-8 (1-8)
auggaccugcuccacaagaacaug

SEQ ID NO: 58729 - RNA, 27 nt, Artificial Sequence
  Ig kappa chain V-I region HK102 (1-9)
auggacaugagagugcccgcccagcug

SEQ ID NO: 58730 - RNA, 27 nt, Artificial Sequence
  Hypoxia-inducible factor 1-alpha (632-640)
auggaggacaucaagauucugauagcc

SEQ ID NO: 58731 - RNA, 24 nt, Artificial Sequence
  Ras GTPase-activating protein-binding protein 1 (183-190)
auggaggaacaccuggaggaaccc

SEQ ID NO: 58732 - RNA, 27 nt, Artificial Sequence
  Vimentin (347-355)
auggaggaaaacuucgccguggaggcu

SEQ ID NO: 58733 - RNA, 30 nt, Artificial Sequence
  Protein S100-A10 (5-14)
auggagcacgccauggaaaccaugauguuc

SEQ ID NO: 58734 - RNA, 27 nt, Artificial Sequence
  Actin, alpha skeletal muscle (84-92)
auggagaagaucuggcaccauaccuuc

SEQ ID NO: 58735 - RNA, 27 nt, Artificial Sequence
  Arachidonate 5-lipoxygenase (186-194)
auggagaaccuguucaucaauagauuu

SEQ ID NO: 58736 - RNA, 27 nt, Artificial Sequence
  Protein diaphanous homolog 1 (496-504)
auggagagcgacuucgaacagaagcug

SEQ ID NO: 58737 - RNA, 27 nt, Artificial Sequence
  Cytochrome c oxidase subunit 2 (20-28)
auggagaccguguggacaauccugccc

SEQ ID NO: 58738 - RNA, 27 nt, Artificial Sequence
  Poly(A)-specific ribonuclease PARN (243-251)
augcugcucgacgugaugcacaccguc

SEQ ID NO: 58739 - RNA, 27 nt, Artificial Sequence
  DNA ligase 1 (393-401)
augcugcccccuccaccgcucaccgcc

SEQ ID NO: 58740 - RNA, 30 nt, Artificial Sequence
  Eukaryotic translation initiation factor 3 subunit A (514-523)
augcccagcgagcagaucagaaaccaacug

SEQ ID NO: 58741 - RNA, 27 nt, Artificial Sequence
  U2 snRNP-associated SURP motif-containing protein (392-400)
augaccgagagcaaguucuccaaauac

SEQ ID NO: 58742 - RNA, 27 nt, Artificial Sequence
  Probable ATP-dependent RNA helicase DDX6 (168-176)
auggugaucguccccaccagagagcug

SEQ ID NO: 58743 - RNA, 27 nt, Artificial Sequence
  Staphylococcal nuclease domain-containing protein 1 (327-335)
aacgccgacgcuaucguggucaagcug

SEQ ID NO: 58744 - RNA, 30 nt, Artificial Sequence; identical to SEQ ID NO: 34517
  Ceruloplasmin (651-660)

SEQ ID NO: 58745 - RNA, 27 nt, Artificial Sequence
  HLA class I histocompatibility antigen, A-3 alpha chain (151-159)
aacgaggaccugagaagcuggaccgcc

SEQ ID NO: 58746 - RNA, 33 nt, Artificial Sequence
  Nuclear pore complex protein Nup50 (371-381)
aacgaguucaaggaaaaaggcaucgggacccug

SEQ ID NO: 58747 - RNA, 24 nt, Artificial Sequence
  40S ribosomal protein S3 (22-29)
aacgaguuccugaccagagaacuc

SEQ ID NO: 58748 - RNA, 27 nt, Artificial Sequence
  Adenylyl cyclase-associated protein 1 (449-457)
aacgaguuccccgugccugaacaguuu

SEQ ID NO: 58749 - RNA, 30 nt, Artificial Sequence
  Protein C-ets-1 (86-95)
aacgaguucagccugaagggcguggacuuu

SEQ ID NO: 58750 - RNA, 27 nt, Artificial Sequence
  Midasin (329-337)
aacgagauccugggcagccucagaugg

SEQ ID NO: 58751 - RNA, 24 nt, Artificial Sequence
  Guanine nucleotide-binding protein-like 3-like protein (192-199)
aacgagcugcccaccguggccuuc

SEQ ID NO: 58752 - RNA, 30 nt, Artificial Sequence
  Trinucleotide repeat-containing gene 6B protein (723-732)
aacgagaaucccagcaaggaccagggcugg

SEQ ID NO: 58753 - RNA, 30 nt, Artificial Sequence
  DNA dC-dU-editing enzyme APOBEC-3B (23-32)
aacgagcccauccuguacggcagaagcuau

SEQ ID NO: 58754 - RNA, 27 nt, Artificial Sequence
  Catenin alpha-1 (169-177)
aacgagcaggaccugggcauccaauac

SEQ ID NO: 58755 - RNA, 30 nt, Artificial Sequence
  Cytoplasmic FMR1-interacting protein 2 (99-108)
aacgagcagcccaauagaguggaaaucuac

SEQ ID NO: 58756 - RNA, 27 nt, Artificial Sequence
  Four and a half LIM domains protein 2 (121-129)
aacgagagccuguucggcaagaaauac

SEQ ID NO: 58757 - RNA, 24 nt, Artificial Sequence
  Protein disulfide-isomerase (430-437)
aacgagguggaagccgucaagguu

SEQ ID NO: 58758 - RNA, 27 nt, Artificial Sequence
  Radial spoke head protein 3 homolog (440-448)
aacgagguggaaaagaccauggaguac

SEQ ID NO: 58759 - RNA, 24 nt, Artificial Sequence
  Nucleosome assembly protein 1-like 1 (226-233)
aacgaggugcugaccaagacauac

SEQ ID NO: 58760 - RNA, 27 nt, Artificial Sequence
  Collagen alpha-3(VI) chain (2246-2254)
aacgaggugaccacagaaaucagauuc

SEQ ID NO: 58761 - RNA, 24 nt, Artificial Sequence
  60S ribosomal protein L31 (18-25)
aacgagguggucaccagagaauac

SEQ ID NO: 58762 - RNA, 27 nt, Artificial Sequence
  Synaptobrevin homolog YKT6 (83-91)
aacgaguaccccagcagaguggccuuc

SEQ ID NO: 58763 - RNA, 27 nt, Artificial Sequence
  26S proteasome non-ATPase regulatory subunit 4 (18-26)
aacggcgacuuccugcccaccagacuc

SEQ ID NO: 58764 - RNA, 39 nt, Artificial Sequence
  Eukaryotic translation initiation factor 3 subunit D (57-69)
aacaaguacagcucccaguucggcgggggaucucaauau

SEQ ID NO: 58765 - RNA, 30 nt, Artificial Sequence
  Structural maintenance of chromosomes protein 4 (634-643)
aaccuggaccaggccaccagaguggcuuac

SEQ ID NO: 58766 - RNA, 27 nt, Artificial Sequence
  Heterogeneous nuclear ribonucleoprotein U-like protein 2 (358-366)
aaccccgagaagagauacaaugugcug

SEQ ID NO: 58767 - RNA, 27 nt, Artificial Sequence
  2'-5'-oligoadenylate synthase 1 (128-136)
aaccccagagcccugagcuucgugcuc

SEQ ID NO: 58768 - RNA, 30 nt, Artificial Sequence
  Cleavage and polyadenylation specificity factor subunit 3 (308-317)
aaccccagaaauaccgaggccgugacacug

SEQ ID NO: 58769 - RNA, 27 nt, Artificial Sequence
  ETS translocation variant 5 (210-218)
aaccaguaccccagcgagcaaagauuc

SEQ ID NO: 58770 - RNA, 27 nt, Artificial Sequence
  Protein TASOR (346-354)
aacaccgacagaaauaucgauaaguac

SEQ ID NO: 58771 - RNA, 51 nt, Artificial Sequence
  Actin, cytoplasmic 2 (35-51)
aacaccgugcugagcggcgggacaacuauguaccccggaaucgccgacaga

SEQ ID NO: 58772 - RNA, 27 nt, Artificial Sequence
  ORM1-like protein 2 (53-61)
aacgugauccacaaucuggccaccuac

SEQ ID NO: 58773 - RNA, 27 nt, Artificial Sequence
  Unconventional myosin-Ic (852-860)
aacuacccccagagcgugccuagacug

SEQ ID NO: 58774 - RNA, 27 nt, Artificial Sequence
  Myotubularin-related protein 6 (104-112)
aacuacagcaauaucagauuccaguuu

SEQ ID NO: 58775 - RNA, 27 nt, Artificial Sequence
  Actin-related protein 2/3 complex subunit 3 (2-10)
cccgccuaccacagcucccugauggac

SEQ ID NO: 58776 - RNA, 30 nt, Artificial Sequence
  NADH dehydrogenase (ubiquinone) 1 beta subcomplex subunit 11, mitochondrial (144-153)
cccagcaagauccagcugccugaggacgaa

SEQ ID NO: 58777 - RNA, 27 nt, Artificial Sequence
  Probable helicase with zinc finger domain (955-963)
cccuacgccgaccagguguucagaauc

SEQ ID NO: 58778 - RNA, 27 nt, Artificial Sequence
  Polypeptide N-acetylgalactosaminyltransferase 2 (407-415)
cccuacggcaacauccagagcagacug

SEQ ID NO: 58779 - RNA, 27 nt, Artificial Sequence
  Nucleolin (401-409)
cccuacaaggugacccaggacgagcug

SEQ ID NO: 58780 - RNA, 48 nt, Artificial Sequence
  Cytochrome c oxidase subunit 5B, mitochondrial (61-76)
cccuacaacgugcuggccccuaagggcgcuagcgggaccagagaggac

SEQ ID NO: 58781 - RNA, 27 nt, Artificial Sequence
  Dol-P-Man:Man(7)GlcNAc(2)-PP-Dol alpha-1,6-mannosyltransferase (29-37)
cccuacaccaagguggaggaaagcuuc

SEQ ID NO: 58782 - RNA, 27 nt, Artificial Sequence
  Serglycin (81-89)
caggaccugaacagaaucuucccccuc

SEQ ID NO: 58783 - RNA, 27 nt, Artificial Sequence
  Paraneoplastic antigen Ma1 (117-125)
caggacguggccagaguccugggcuuc

SEQ ID NO: 58784 - RNA, 27 nt, Artificial Sequence
  UDP-glucuronic acid decarboxylase 1 (248-256)
caggagggcguggaagucagaguugcc

SEQ ID NO: 58785 - RNA, 27 nt, Artificial Sequence
  Talin-1 (1707-1715)
caggagaucagccaccugauugaaccc

SEQ ID NO: 58786 - RNA, 27 nt, Artificial Sequence
  Integrin beta-2 (422-430)
caggagcaaagcuucgugaucagagcc

SEQ ID NO: 58787 - RNA, 27 nt, Artificial Sequence
  Forkhead-associated domain-containing protein 1 (519-527)
cagcugaucgagaagauuacccaagug

SEQ ID NO: 58788 - RNA, 27 nt, Artificial Sequence
  Integrin alpha-V (217-225)
cagguggccgagaucgucagcaaguac

SEQ ID NO: 58789 - RNA, 27 nt, Artificial Sequence
  Biogenesis of lysosome-related organelles complex 1 subunit 1 (64-72)
caggugcaagccgcucaguucgcaaag

SEQ ID NO: 58790 - RNA, 27 nt, Artificial Sequence
  CCR4-NOT transcription complex subunit 1 (465-473)
caguacgagcaagugaagcagcuguuc

SEQ ID NO: 58791 - RNA, 27 nt, Artificial Sequence
  Phosphatidylinositol 3,4,5-trisphosphate-dependent Rac exchanger 1 protein (1095-1103)
caguacgugacccaaaucaacagacug

SEQ ID NO: 58792 - RNA, 36 nt, Artificial Sequence
  Non-POU domain-containing octamer-binding protein (367-378)
agagccgcucccggcgcagaguucgccccuaacaag

SEQ ID NO: 58793 - RNA, 27 nt, Artificial Sequence
  SWI/SNF-related matrix-associated actin-dependent regulator of chromatin subfamily E member 1-related (135-143)
agagccuaccagcaaagcgaggcuuau

SEQ ID NO: 58794 - RNA, 24 nt, Artificial Sequence
  Zinc finger protein 36, C3H1 type-like 2 (239-246)
agagacgcccugcaccucggcuuc

SEQ ID NO: 58795 - RNA, 27 nt, Artificial Sequence
  Chloride intracellular channel protein 6 (640-648)
agagacuucgaguuucccagcgaaaug

SEQ ID NO: 58796 - RNA, 24 nt, Artificial Sequence
  Rab3 GTPase-activating protein non-catalytic subunit (18-25)
agagacuuccuguuuccccaccuc

SEQ ID NO: 58797 - RNA, 24 nt, Artificial Sequence
  60S ribosomal protein L9 (36-43)
agagacuucaaccacaucaaugug

SEQ ID NO: 58798 - RNA, 27 nt, Artificial Sequence
  Guanylate-binding protein 4 (196-204)
agagacuucacccuggagcucaagcuu

SEQ ID NO: 58799 - RNA, 27 nt, Artificial Sequence
  Alkyldihydroxyacetonephosphate synthase, peroxisomal (515-523)
agagaccuggcccucgaguacuaugug

SEQ ID NO: 58800 - RNA, 24 nt, Artificial Sequence
  Cell division control protein 42 homolog (147-154)
agagaccugaaggccgugaaauac

SEQ ID NO: 58801 - RNA, 24 nt, Artificial Sequence
  40S ribosomal protein S27-like (5-12)
agagaccugcuccaccccagccuu

SEQ ID NO: 58802 - RNA, 27 nt, Artificial Sequence
  Septin-9 (519-527)
agagaccugcucaucaggacccacaug

SEQ ID NO: 58803 - RNA, 27 nt, Artificial Sequence
  Eukaryotic translation initiation factor 3 subunit C (586-594)
agagaccugaugcucaugagccaccuu

SEQ ID NO: 58804 - RNA, 33 nt, Artificial Sequence
  Macrosialin (238-248)
agagaccugcaggccccccucggccaaagcuuc

SEQ ID NO: 58805 - RNA, 27 nt, Artificial Sequence
  E3 ubiquitin-protein ligase RNF213 (160-168)
agagaccugagccacauccucggcauu

SEQ ID NO: 58806 - RNA, 27 nt, Artificial Sequence
  Serine/threonine-protein kinase RIO1 (201-209)
agagacauggauaucauuaugaagcug

SEQ ID NO: 58807 - RNA, 27 nt, Artificial Sequence
  Transcription factor 25 (650-658)
agagacaugauggccaacuuccaccug

SEQ ID NO: 58808 - RNA, 24 nt, Artificial Sequence
  Transcription elongation factor A protein 1 (123-130)
agagacaccuacgugagcuccuuc

SEQ ID NO: 58809 - RNA, 27 nt, Artificial Sequence
  Growth arrest and DNA damage-inducible protein GADD45 alpha (67-75)
agagacguggcccugcagauccacuuc

SEQ ID NO: 58810 - RNA, 24 nt, Artificial Sequence
  Transmembrane protein 14A (51-58)
agagacgugaaggucagccuguuc

SEQ ID NO: 58811 - RNA, 27 nt, Artificial Sequence
  TraB domain-containing protein (259-267)
agagacguguaccugaccuauaugcuc

SEQ ID NO: 58812 - RNA, 30 nt, Artificial Sequence
  Pyruvate kinase PKM (383-392)
agagaggccgaagcugcaaucuaccaccug

SEQ ID NO: 58813 - RNA, 27 nt, Artificial Sequence
  Protein nepro homolog (226-234)
agagaggccgaaagcuucacccagcug

SEQ ID NO: 58814 - RNA, 30 nt, Artificial Sequence
  40S ribosomal protein S4, X isoform (39-48)
agagagugccugccccucaucauuuuccuu

SEQ ID NO: 58815 - RNA, 27 nt, Artificial Sequence
  T-complex protein 1 subunit gamma (260-268)
agagaggaagacuucaccaggauccug

SEQ ID NO: 58816 - RNA, 33 nt, Artificial Sequence
  Transcription factor E2F7 (433-443)
agagaggaacagggcagcgggggauacucccug

SEQ ID NO: 58817 - RNA, 24 nt, Artificial Sequence
  Ribonucleoside-diphosphate reductase subunit M2 (190-197)
agagaguuccuguuuaacgccauc

SEQ ID NO: 58818 - RNA, 27 nt, Artificial Sequence
  DNA-dependent protein kinase catalytic subunit (1087-1095)
agagaguucagggaagaggaaagccug

SEQ ID NO: 58819 - RNA, 24 nt, Artificial Sequence
  Vacuolar protein sorting-associated protein 51 homolog (490-497)
agagagggccugaucgugggguuc

SEQ ID NO: 58820 - RNA, 27 nt, Artificial Sequence
  Torsin-4A (350-358)
agagagcacccccuguggcaggccgcu

SEQ ID NO: 58821 - RNA, 27 nt, Artificial Sequence
  Vimentin (186-194)
agagagaagcugcaggaagagaugcuc

SEQ ID NO: 58822 - RNA, 27 nt, Artificial Sequence
  Protein CEBPZOS (68-76)
agagagcuggaccagaagaccuggcuc

SEQ ID NO: 58823 - RNA, 27 nt, Artificial Sequence
  Extended synaptotagmin-1 (125-133)
agagagcugcccgccugggugagcuuc

SEQ ID NO: 58824 - RNA, 27 nt, Artificial Sequence
  DNA-directed RNA polymerase II subunit RPB1 (1380-1388)
agagagcuguaccacgugaucagcuuc

SEQ ID NO: 58825 - RNA, 24 nt, Artificial Sequence
  HLA class I histocompatibility antigen, B-57 alpha chain (99-106)
agagagaaccugaggaucgcccuc

SEQ ID NO: 58826 - RNA, 27 nt, Artificial Sequence
  Ras-related protein M-Ras (116-124)
agagagagcuuccccaugauccuggug

SEQ ID NO: 58827 - RNA, 27 nt, Artificial Sequence
  Large proline-rich protein BAG6 (814-822)
agagagagcuucucccuggugcagguc

SEQ ID NO: 58828 - RNA, 27 nt, Artificial Sequence
  Vimentin (424-432)
agagagaccaaccuggacagccucccc

SEQ ID NO: 58829 - RNA, 30 nt, Artificial Sequence
  DNA polymerase delta subunit 2 (109-118)
agagaggugagcgaagagcacaaccugcuc

SEQ ID NO: 58830 - RNA, 27 nt, Artificial Sequence
  Zinc finger protein 343 (243-251)
agagaguacgaacccgaccacaaccug

SEQ ID NO: 58831 - RNA, 27 nt, Artificial Sequence
  Desmin (386-394)
agagaguaccaggaccugcucaacgug

SEQ ID NO: 58832 - RNA, 27 nt, Artificial Sequence
  ADP-ribosylation factor 6 (95-103)
agaaucgacgaggccaggcaggaacug

SEQ ID NO: 58833 - RNA, 42 nt, Artificial Sequence
  Heat shock 70 kDa protein 1-like (173-186)
agaaucauuaacgagcccaccgccgcugcaauagccuacggc

SEQ ID NO: 58834 - RNA, 27 nt, Artificial Sequence
  Chromobox protein homolog 6 (91-99)
agaaucagcgacgugcacuucuccguc

SEQ ID NO: 58835 - RNA, 27 nt, Artificial Sequence
  Vimentin (410-418)
agaaucagccugccccucccuaacuuc

SEQ ID NO: 58836 - RNA, 30 nt, Artificial Sequence
  Discoidin, CUB and LCCL domain-containing protein 2 (86-95)
agaaucuacaacggcauuggggugagcagg

SEQ ID NO: 58837 - RNA, 27 nt, Artificial Sequence
  Polyribonucleotide 5'-hydroxyl-kinase Clp1 (206-214)
agacuggccgacguguucaaccagagg

SEQ ID NO: 58838 - RNA, 27 nt, Artificial Sequence
  Clathrin heavy chain 1 (1226-1234)
agacuggccagcacccucgugcaccuu

SEQ ID NO: 58839 - RNA, 27 nt, Artificial Sequence
  Transcription elongation factor SPT6 (292-300)
agacuguucgagaagaugcaggccuac

SEQ ID NO: 58840 - RNA, 33 nt, Artificial Sequence
  Deoxyhypusine synthase (263-273)
agacugaucaacacccaggccauuuucgcuaag

SEQ ID NO: 58841 - RNA, 27 nt, Artificial Sequence
  Lysophospholipid acyltransferase 5 (293-301)
agacugauccaggagagccccacccuc

SEQ ID NO: 58842 - RNA, 27 nt, Artificial Sequence
  trabeculin-alpha (476-484)
agacugcaggacgagcucgugacccuu

SEQ ID NO: 58843 - RNA, 27 nt, Artificial Sequence
  Gamma-tubulin complex component 5 (326-334)
agacugcaggaguucaucgacgaagug

SEQ ID NO: 58844 - RNA, 27 nt, Artificial Sequence
  Nuclear cap-binding protein subunit 1 (694-702)
agacugcaggagaagguggaaagcgcc

SEQ ID NO: 58845 - RNA, 27 nt, Artificial Sequence
  Integrin beta-7 (181-189)
agacugcaggaggugacccacagcguc

SEQ ID NO: 58846 - RNA, 27 nt, Artificial Sequence
  40S ribosomal protein S27 (87-95)
agacuggugcagagccccaacuccuac

SEQ ID NO: 58847 - RNA, 30 nt, Artificial Sequence
  Serpin H1 (133-142)
agacuguacggccccagcuccgugucuuuc

SEQ ID NO: 58848 - RNA, 27 nt, Artificial Sequence
  Tetratricopeptide repeat protein 30A (82-90)
agacuguaccaggcccaagcucucuau

SEQ ID NO: 58849 - RNA, 27 nt, Artificial Sequence
  DNA mismatch repair protein Msh2 (406-414)
agacuguaccagggcaucaaccaacuc

SEQ ID NO: 58850 - RNA, 27 nt, Artificial Sequence
  Probable 18S rRNA (guanine-N(7))-methyltransferase (31-39)
agaaugaucgacauucagaccaggaug

SEQ ID NO: 58851 - RNA, 27 nt, Artificial Sequence
  26S protease regulatory subunit 4 (411-419)
agaaugaaggugaccaacgaggacuuc

SEQ ID NO: 58852 - RNA, 27 nt, Artificial Sequence
  A-kinase anchor protein 8-like (199-207)
agaaugugggaggaccccaugggcgcc

SEQ ID NO: 58853 - RNA, 33 nt, Artificial Sequence
  Keratin, type I cytoskeletal 10 (99-109)
agaaacgugagcaccggcgacgucaauguugag

SEQ ID NO: 58854 - RNA, 27 nt, Artificial Sequence
  Ubiquitin-like modifier-activating enzyme 1 (325-333)
agacccgcccagcugcacaucggcuuc

SEQ ID NO: 58855 - RNA, 33 nt, Artificial Sequence
  Eukaryotic translation initiation factor 4 gamma 1 (191-201)
agacccgacgauaggagccagggcgccaucauu

SEQ ID NO: 58856 - RNA, 27 nt, Artificial Sequence
  Microtubule-associated protein 4 (670-678)
agacccgaggaaggcaggccugugguc

SEQ ID NO: 58857 - RNA, 27 nt, Artificial Sequence
  Syntenin-1 (193-201)
agacccuucgagaggaccaucacaaug

SEQ ID NO: 58858 - RNA, 27 nt, Artificial Sequence
  Cellular tumor antigen p53 (25-33)
agacccauccugaccauuauaacacuc

SEQ ID NO: 58859 - RNA, 27 nt, Artificial Sequence
  Methionine adenosyltransferase 2 subunit beta (277-285)
agacccaucaccgacagcccugugcug

SEQ ID NO: 58860 - RNA, 27 nt, Artificial Sequence
  U2 snRNP-associated SURP motif-containing protein (430-438)
agacccaagaaaccuggccagagcuuc

SEQ ID NO: 58861 - RNA, 27 nt, Artificial Sequence
  Methionine-tRNA ligase, cytoplasmic (45-53)
agacccaaggugccuguccugcagcuc

SEQ ID NO: 58862 - RNA, 27 nt, Artificial Sequence
  Actin-related protein 3 (262-270)
agaccccuguacaagaacaucgugcuc

SEQ ID NO: 58863 - RNA, 24 nt, Artificial Sequence
  Proline-rich nuclear receptor coactivator 2 (13-20)
agacccaugaagaccagcgugcug

SEQ ID NO: 58864 - RNA, 27 nt, Artificial Sequence
  DNA damage-binding protein 1 (753-761)
agacccagcgccuccacccaggcucug

SEQ ID NO: 58865 - RNA, 30 nt, Artificial Sequence
  Inositol-tetrakisphosphate 1-kinase (256-265)
agacccagcgacgaggugaucagggaacug

SEQ ID NO: 58866 - RNA, 27 nt, Artificial Sequence
  Nucleoprotein TPR (1808-1816)
agacccagcaccuccacagccguguuc

SEQ ID NO: 58867 - RNA, 30 nt, Artificial Sequence
  Nuclear pore complex protein Nup214 (1284-1293)
agacccguggccccuagcggcaccgcucug

SEQ ID NO: 58868 - RNA, 27 nt, Artificial Sequence
  60S ribosomal protein L15 (73-81)
agacccgugccuaagggcgccaccuac

SEQ ID NO: 58869 - RNA, 27 nt, Artificial Sequence
  STE20-related kinase adapter protein alpha (358-366)
agacccgugaccccuaucacaaacuuc

SEQ ID NO: 58870 - RNA, 27 nt, Artificial Sequence
  Grancalcin (145-153)
agacaggccaucggccugaugggguac

SEQ ID NO: 58871 - RNA, 30 nt, Artificial Sequence
  Transcriptional repressor p66-beta (415-424)
agacaggccccccaaccucagagcucccug

SEQ ID NO: 58872 - RNA, 36 nt, Artificial Sequence
  UBX domain-containing protein 4 (346-357)
agacaguucgccgcucaaaccgugggcaacacauac

SEQ ID NO: 58873 - RNA, 27 nt, Artificial Sequence
  Spectrin alpha chain, non-erythrocytic 1 (1012-1020)
agacagggcuucgugcccgccgcuuac

SEQ ID NO: 58874 - RNA, 24 nt, Artificial Sequence
  Fragile X mental retardation syndrome-related protein 1 (376-383)
agacagaucggcagcagguccuac

SEQ ID NO: 58875 - RNA, 27 nt, Artificial Sequence
  Sialidase-1 (69-77)
agacagaucggcagcguggacaccuuc

SEQ ID NO: 58876 - RNA, 27 nt, Artificial Sequence
  Cytochrome b-245 heavy chain (92-100)
agacagcuggacaggaaccucaccuuc

SEQ ID NO: 58877 - RNA, 27 nt, Artificial Sequence
  Vacuole membrane protein 1 (48-56)
agacagccccugaucacccuccaauac

SEQ ID NO: 58878 - RNA, 27 nt, Artificial Sequence
  Lanosterol synthase (234-242)
agacagguguaccugcccaugagcuau

SEQ ID NO: 58879 - RNA, 24 nt, Artificial Sequence
  Eukaryotic translation initiation factor 3 subunit L (38-45)
agacaguacgagcaacagaccuau

SEQ ID NO: 58880 - RNA, 27 nt, Artificial Sequence
  Protein CDV3 homolog (7-15)
agaagccuggacaacuucuuugccaag

SEQ ID NO: 58881 - RNA, 33 nt, Artificial Sequence
  Cation-independent mannose-6-phosphate receptor (2345-2355)
agaagcuccaacgugucuuacaaguauucaaaa

SEQ ID NO: 58882 - RNA, 27 nt, Artificial Sequence
  Protein phosphatase 1 regulatory subunit 12A (704-712)
agaaccuacgacgagacauaucagagg

SEQ ID NO: 58883 - RNA, 33 nt, Artificial Sequence
  Protein FAM168A (83-93)
agaaccuaccaggccagcuccgcugcauucagg

SEQ ID NO: 58884 - RNA, 27 nt, Artificial Sequence
  Manganese-transporting ATPase 13A1 (839-847)
agaguggcccccaagcagaaagaguuc

SEQ ID NO: 58885 - RNA, 27 nt, Artificial Sequence
  Alpha-adducin (27-35)
agaguggacgagaacaaucccgaauac

SEQ ID NO: 58886 - RNA, 27 nt, Artificial Sequence
  DNA damage-binding protein 1 (263-271)
agaguggaccccaacggcagcagguac

SEQ ID NO: 58887 - RNA, 30 nt, Artificial Sequence
  Eukaryotic translation initiation factor 3 subunit C-like protein (873-882)
agaguguucgaccacaagcagggcaccuac

SEQ ID NO: 58888 - RNA, 39 nt, Artificial Sequence
  LIM and senescent cell antigen-like-containing domain protein 1 (319-331)
agagugaucgagggcgacgucguuagcgcccugaacaag

SEQ ID NO: 58889 - RNA, 27 nt, Artificial Sequence
  Ran GTPase-activating protein 1 (205-213)
agagugaucggcacccuggaggaaguc

SEQ ID NO: 58890 - RNA, 27 nt, Artificial Sequence
  HLA class II histocompatibility antigen, DRB1-16 beta chain (89-97)
agagugcagcccaaggucaccguuuac

SEQ ID NO: 58891 - RNA, 33 nt, Artificial Sequence
  Glucose-6-phosphate 1-dehydrogenase (240-250)
agagugcagcccaacgaggccgucuacaccaag

SEQ ID NO: 58892 - RNA, 27 nt, Artificial Sequence
  Rotatin (803-811)
agagugaccgaccuguucaucggcaag

SEQ ID NO: 58893 - RNA, 45 nt, Artificial Sequence
  Histone H2A type 1-B/E (100-114)
agagugaccaucgcccagggcgggguccugcccaacauucaagcu

SEQ ID NO: 58894 - RNA, 42 nt, Artificial Sequence
  SH3 domain-binding glutamic acid-rich-like protein (4-17)
agaguguacaucgccagcuccucuggcucaaccgcuauuaag

SEQ ID NO: 58895 - RNA, 33 nt, Artificial Sequence
  WD repeat domain phosphoinositide-interacting protein 3 (34-44)
agaguguacaacaccgacccccugaaggagaaa

SEQ ID NO: 58896 - RNA, 30 nt, Artificial Sequence
  Serine/arginine-rich splicing factor 9 (181-190)
agaguguaccccgagaggagcaccuccuau

SEQ ID NO: 58897 - RNA, 27 nt, Artificial Sequence
  Lysine-specific demethylase 6B (135-143)
agauacggcgggagcuucgccgagcug

SEQ ID NO: 58898 - RNA, 27 nt, Artificial Sequence
  Ras GTPase-activating protein-binding protein 2 (293-301)
agauaccccgacagccaccagcuguuc

SEQ ID NO: 58899 - RNA, 27 nt, Artificial Sequence
  Eukaryotic translation initiation factor 3 subunit L (328-336)
agauaccaggacgccaucaggguguuc

SEQ ID NO: 58900 - RNA, 27 nt, Artificial Sequence
  Poly (ADP-ribose) polymerase 8 (33-41)
agauacagcgacuccaccuucacauuu

SEQ ID NO: 58901 - RNA, 33 nt, Artificial Sequence
  ATPase family AAA domain-containing protein 2 (163-173)
agauacagcggcgugaaccaguccaugcuguuc

SEQ ID NO: 58902 - RNA, 27 nt, Artificial Sequence
  Heterogeneous nuclear ribonucleoprotein H (23-31)
agcgccgacgaggugcagagauucuuu

SEQ ID NO: 58903 - RNA, 27 nt, Artificial Sequence
  Intraflagellar transport protein 25 homolog (121-129)
agcgccuucgaccacuuugcuuccgug

SEQ ID NO: 58904 - RNA, 27 nt, Artificial Sequence
  Histone-lysine N-methyltransferase setd3 (403-411)
agcgccaucgacagaauuuucacccug

SEQ ID NO: 58905 - RNA, 27 nt, Artificial Sequence
  Rho guanine nucleotide exchange factor 12 (613-621)
agcgccaucggcagagcuauggagcug

SEQ ID NO: 58906 - RNA, 27 nt, Artificial Sequence
  Cell division cycle protein 16 homolog (483-491)
agcgccaucggcuacauucacucccug

SEQ ID NO: 58907 - RNA, 27 nt, Artificial Sequence
  Transient receptor potential cation channel subfamily V member 2 (165-173)
agcgcccugcacaucgcuauugagaag

SEQ ID NO: 58908 - RNA, 27 nt, Artificial Sequence
  ATP-dependent zinc metalloprotease YME1L1 (158-166)
agcgcccaguccuucuuugagaacaag

SEQ ID NO: 58909 - RNA, 27 nt, Artificial Sequence
  Putative annexin A2-like protein (22-30)
agcgccuacggcuccgugaaggcuuau

SEQ ID NO: 58910 - RNA, 27 nt, Artificial Sequence
  Guanine nucleotide-binding protein G(I)/G(S)/G(T) subunit beta-1 (245-253)
agcgacgaugccaccugcagacuguuc

SEQ ID NO: 58911 - RNA, 27 nt, Artificial Sequence
  Ubiquitin thioesterase OTUB1 (215-223)
agcgaccacauccauauuauagcccug

SEQ ID NO: 58912 - RNA, 27 nt, Artificial Sequence
  Homeobox-containing protein 1 (316-324)
agcgaccuggagagagugaccucccuc

SEQ ID NO: 58913 - RNA, 27 nt, Artificial Sequence
  Protein FAM162A (32-40)
agcgaccugaagagaaucaacggcuuc

SEQ ID NO: 58914 - RNA, 27 nt, Artificial Sequence
  Group XIIB secretory phospholipase A2-like protein (142-150)
agcgaccugaagagaucccucggcuuc

SEQ ID NO: 58915 - RNA, 27 nt, Artificial Sequence
  SH3 domain-binding protein 2 (218-226)
agcgacaugcccagagcccacuccuuc

SEQ ID NO: 58916 - RNA, 33 nt, Artificial Sequence
  Vimentin (299-309)
agcgaggccgcuaacagaaauaacgacgcacug

SEQ ID NO: 58917 - RNA, 27 nt, Artificial Sequence
  14-3-3 protein eta (80-88)
agcgaggccgcuuacaaggaagcauuc

SEQ ID NO: 58918 - RNA, 27 nt, Artificial Sequence
  WD repeat-containing protein 6 (1032-1040)
agcgaggacggcucccugcacguguuc

SEQ ID NO: 58919 - RNA, 30 nt, Artificial Sequence
  60S ribosomal protein L7a (85-94)
agcgaggacaagggcgcccuggcuaaacuc

SEQ ID NO: 58920 - RNA, 27 nt, Artificial Sequence
  Cofilin-1 (41-49)
agcgaggacaagaaaaacaucauucug

SEQ ID NO: 58921 - RNA, 27 nt, Artificial Sequence
  Coatomer subunit alpha (268-276)
agcgaggacaaguccaucagagugugg

SEQ ID NO: 58922 - RNA, 33 nt, Artificial Sequence; identical to SEQ ID NO: 34695
  26S proteasome non-ATPase regulatory subunit 2 (436-446)

SEQ ID NO: 58923 - RNA, 27 nt, Artificial Sequence
  Calmodulin (82-90)
agcgaggaagagaucagagaagccuuc

SEQ ID NO: 58924 - RNA, 30 nt, Artificial Sequence
  Nucleolar transcription factor 1 (115-124)
agcgaggaaggcaucaccaaguccacacug

SEQ ID NO: 58925 - RNA, 27 nt, Artificial Sequence
  Nucleoside diphosphate kinase 3 (61-69)
agcgaggaacugcucagagagcacuac

SEQ ID NO: 58926 - RNA, 27 nt, Artificial Sequence
  A-kinase anchor protein 6 (991-999)
agcgaggaacagcaacagcaccuguac

SEQ ID NO: 58927 - RNA, 30 nt, Artificial Sequence
  14-3-3 protein zeta/delta (227-236)
agcgaggaauccuacaaggacucuacccug

SEQ ID NO: 58928 - RNA, 30 nt, Artificial Sequence
  CTTNBP2 N-terminal-like protein (259-268)
agcgaguucgacaucgaaagagagcagcug

SEQ ID NO: 58929 - RNA, 27 nt, Artificial Sequence
  Alpha-enolase (79-87)
agcgaguucuuuagauccggcaaguac

SEQ ID NO: 58930 - RNA, 27 nt, Artificial Sequence
  Dynamin-like 120 kDa protein, mitochondrial (351-359)
agcgagggcccccaccauguggcccug

SEQ ID NO: 58931 - RNA, 30 nt, Artificial Sequence
  Cyclic AMP-dependent transcription factor ATF-6 beta (8-17)
agcgagaucgccgaccccaccagauucuuu

SEQ ID NO: 58932 - RNA, 27 nt, Artificial Sequence
  Claspin (704-712)
agcgagaucggcaaggccgugggguuc

SEQ ID NO: 58933 - RNA, 27 nt, Artificial Sequence
  ATP-dependent zinc metalloprotease YME1L1 (695-703)
agcgagaagcugggcgugaugaccuac

SEQ ID NO: 58934 - RNA, 24 nt, Artificial Sequence
  Protein yippee-like 5 (28-35)
agcgagcugaucuccaccagauuc

SEQ ID NO: 58935 - RNA, 27 nt, Artificial Sequence
  Ubiquitin carboxyl-terminal hydrolase 7 (778-786)
agcgagcugcccaccgccaaggaauac

SEQ ID NO: 58936 - RNA, 27 nt, Artificial Sequence
  Mitochondrial import receptor subunit TOM70 (577-585)
agcgagauggaaauggcccaccuguac

SEQ ID NO: 58937 - RNA, 27 nt, Artificial Sequence
  ADP-ribosylation factor 4 (137-145)
agcgagaugaccgacaagcugggccuc

SEQ ID NO: 58938 - RNA, 27 nt, Artificial Sequence
  Geranylgeranyl transferase type-1 subunit beta (168-176)
agcgagaacgacaugagauucguguac

SEQ ID NO: 58939 - RNA, 27 nt, Artificial Sequence
  Nuclear pore complex protein Nup153 (1194-1202)
agcgagcagcccgccaaggcuaccuuc

SEQ ID NO: 58940 - RNA, 27 nt, Artificial Sequence
  Coatomer subunit gamma-1 (353-361)
agcgaguccucuaucgacagacugaug

SEQ ID NO: 58941 - RNA, 24 nt, Artificial Sequence
  T-complex protein 1 subunit zeta (155-162)
agcgagaccgacacaucccugauc

SEQ ID NO: 58942 - RNA, 24 nt, Artificial Sequence
  Caprin-1 (287-294)
agcgagguggaauccaccgaguac

SEQ ID NO: 58943 - RNA, 27 nt, Artificial Sequence
  Galectin-2 (80-88)
agcgaggugaaguucaccgucacauuu

SEQ ID NO: 58944 - RNA, 30 nt, Artificial Sequence
  Serpin B8 (75-84)
agcgaggugaacagaaccggcacacaguac

SEQ ID NO: 58945 - RNA, 27 nt, Artificial Sequence
  Protein yippee-like 5 (54-62)
agcgaggugcaggacagagucaugcug

SEQ ID NO: 58946 - RNA, 39 nt, Artificial Sequence
  Heterogeneous nuclear ribonucleoproteins A2/B1 (266-278)
agcggcaacuucgggggauccagaaauauggguggcccc

SEQ ID NO: 58947 - RNA, 27 nt, Artificial Sequence
  Protein PRRC2C (661-669)
agcggcuacuucaagcaguuucaaaaa

SEQ ID NO: 58948 - RNA, 27 nt, Artificial Sequence
  CAAX prenyl protease 1 homolog (244-252)
agcaucgacuucccccugaccaaggug

SEQ ID NO: 58949 - RNA, 27 nt, Artificial Sequence
  Signal transducer and activator of transcription 2 (358-366)
agcaucgacagaaaccccccucagcug

SEQ ID NO: 58950 - RNA, 36 nt, Artificial Sequence
  Phospholipase D1 (579-590)
agcaucgacuccaccucuucauacuucaaccacuau

SEQ ID NO: 58951 - RNA, 33 nt, Artificial Sequence
  Double-stranded RNA-specific adenosine deaminase (938-948)
agcaucuucgagcccgccaagggcggggaaaaa

SEQ ID NO: 58952 - RNA, 36 nt, Artificial Sequence
  DNA-directed RNA polymerase III subunit RPC4 (107-118)
agcaucuucgagcagggccccgccgaaaugaugaag

SEQ ID NO: 58953 - RNA, 27 nt, Artificial Sequence
  Serine/threonine-protein kinase MARK2 (578-586)
agcaucuucuccaaguuuaccucuaaa

SEQ ID NO: 58954 - RNA, 30 nt, Artificial Sequence
  Mortality factor 4-like protein 1 (192-201)
agcauccuggaggacuacgccaacuauaag

SEQ ID NO: 58955 - RNA, 27 nt, Artificial Sequence
  Transmembrane protein 41B (276-284)
agcauccugcccgccauuuuccagaag

SEQ ID NO: 58956 - RNA, 27 nt, Artificial Sequence
  DNA polymerase delta subunit 3 (419-427)
agcaucaccggcuucuuucagagaaag

SEQ ID NO: 58957 - RNA, 36 nt, Artificial Sequence
  Double-stranded RNA-specific adenosine deaminase (134-145)
agcaucuaccaggaccaagagcagagaauucugaag

SEQ ID NO: 58958 - RNA, 27 nt, Artificial Sequence
  Histone H2B type 2-E (14-22)
agcaucuacguguauaagguccugaaa

SEQ ID NO: 58959 - RNA, 27 nt, Artificial Sequence
  Serine/threonine-protein kinase Nek6 (66-74)
agccuggccgacuuccagaucgagaag

SEQ ID NO: 58960 - RNA, 27 nt, Artificial Sequence
  Poly(rC)-binding protein 2 (315-323)
agccuggcccaguaccucaucaacgug

SEQ ID NO: 58961 - RNA, 27 nt, Artificial Sequence
  Eukaryotic translation initiation factor 3 subunit C-like protein (835-843)
agccuggaccagcccacccaaacagug

SEQ ID NO: 58962 - RNA, 27 nt, Artificial Sequence
  FGFR1 oncogene partner 2 (28-36)
agccugaucgagcagaccacagcccuc

SEQ ID NO: 58963 - RNA, 27 nt, Artificial Sequence
  60S ribosomal protein L10a (115-123)
agccugaucaagcagauucccagaaua

SEQ ID NO: 58964 - RNA, 27 nt, Artificial Sequence
  Protein zyg-11 homolog B (362-370)
agccugcucgacgaucuucacuccgcc

SEQ ID NO: 58965 - RNA, 33 nt, Artificial Sequence
  4F2 cell-surface antigen heavy chain (289-299)
agccugcucgaguccaacaaggaccuucuguug

SEQ ID NO: 58966 - RNA, 30 nt, Artificial Sequence
  Homocysteine-responsive endoplasmic reticulum-resident ubiquitin-like domain member 1 protein (221-230)
agccugcuccccgagggcccuccagccauc

SEQ ID NO: 58967 - RNA, 27 nt, Artificial Sequence
  Bromodomain-containing protein 8 (139-147)
agccugcuccccaccuccccuagacuu

SEQ ID NO: 58968 - RNA, 39 nt, Artificial Sequence
  Mitochondrial coenzyme A transporter SLC25A42 (36-48)
agccugcucuccggcgcccuugcuggggcacuggccaag

SEQ ID NO: 58969 - RNA, 27 nt, Artificial Sequence
  Mediator of RNA polymerase II transcription subunit 12 (1321-1329)
agccugcucucccagcaacccuuccuu

SEQ ID NO: 58970 - RNA, 30 nt, Artificial Sequence
  Ganglioside GM2 activator (3-12)
agccugaugcaggccccccuccuuaucgcu

SEQ ID NO: 58971 - RNA, 27 nt, Artificial Sequence
  Terminal uridylyltransferase 7 (826-834)
agccugaaccacuucacccauuccgug

SEQ ID NO: 58972 - RNA, 27 nt, Artificial Sequence
  Signal transducer and activator of transcription 6 (256-264)
agccugaccggcagacucgacgaggug

SEQ ID NO: 58973 - RNA, 27 nt, Artificial Sequence
  Hyccin (36-44)
agccugguguccucucucuacaagguc

SEQ ID NO: 58974 - RNA, 30 nt, Artificial Sequence
  Keratin, type II cytoskeletal 2 epidermal (342-351)
agcauggacaacuccagaaaucuggaucuc

SEQ ID NO: 58975 - RNA, 30 nt, Artificial Sequence
  Serine/threonine-protein phosphatase 2B catalytic subunit beta isoform (116-125)
agccccgccaacaccagauaccuguuccuc

SEQ ID NO: 58976 - RNA, 27 nt, Artificial Sequence
  Treacle protein (700-708)
agccccgcccaggugaagaccuccguc

SEQ ID NO: 58977 - RNA, 51 nt, Artificial Sequence
  Alpha-enolase (263-279)
agccccgacgauccuuccagauacaucucuccagaccagcuggccgaucuc

SEQ ID NO: 58978 - RNA, 27 nt, Artificial Sequence
  LIM domain and actin-binding protein 1 (264-272)
agccccgacuccagagccucuucacug

SEQ ID NO: 58979 - RNA, 27 nt, Artificial Sequence
  Sterol regulatory element-binding protein 2 (1098-1106)
agccccggccagagagccgugcugcuc

SEQ ID NO: 58980 - RNA, 27 nt, Artificial Sequence
  Midasin (1754-1762)
agccccggcguggggaagaccucccug

SEQ ID NO: 58981 - RNA, 30 nt, Artificial Sequence
  Nucleophosmin (70-79)
agccccaucaaggugacccuggccacacuc

SEQ ID NO: 58982 - RNA, 33 nt, Artificial Sequence
  Cation-independent mannose-6-phosphate receptor (554-564)
agccccaugaaggagaaaggcaacauccagcug

SEQ ID NO: 58983 - RNA, 27 nt, Artificial Sequence
  Transcription factor SOX-9 (199-207)
agccccaacgccaucuucaaggcucug

SEQ ID NO: 58984 - RNA, 27 nt, Artificial Sequence
  F-box/LRR-repeat protein 6 (377-385)
agccccaaccugagacuccuugaccug

SEQ ID NO: 58985 - RNA, 27 nt, Artificial Sequence
  Adiponectin receptor protein 1 (231-239)
agcccccagccuagacugaucuaccuc

SEQ ID NO: 58986 - RNA, 33 nt, Artificial Sequence
  Ribosomal protein S6 kinase beta-1 (418-428)
agccccagaaccccuguguccccagucaaguuc

SEQ ID NO: 58987 - RNA, 27 nt, Artificial Sequence
  Zinc finger protein 655 (12-20)
agccccagagugcaguuccaaucccug

SEQ ID NO: 58988 - RNA, 33 nt, Artificial Sequence
  Probable aminopeptidase NPEPL1 (88-98)
agccccuccgccgcucacuucaucaccagacug

SEQ ID NO: 58989 - RNA, 33 nt, Artificial Sequence
  Activating transcription factor 7-interacting protein 1 (907-917)
agccccuccaccaacagaggcccuauccagaug

SEQ ID NO: 58990 - RNA, 30 nt, Artificial Sequence
  Protein transport protein Sec24A (613-622)
agccccaccggcgggagaauguccguguuc

SEQ ID NO: 58991 - RNA, 24 nt, Artificial Sequence
  Exportin-5 (826-833)
agccccguguucaagaccguccug

SEQ ID NO: 58992 - RNA, 33 nt, Artificial Sequence
  Vacuolar protein sorting-associated protein 41 homolog (371-381)
agccccuaccugccuagaggcgacccagugcuc

SEQ ID NO: 58993 - RNA, 30 nt, Artificial Sequence
  Dolichyl-diphosphooligosaccharide-proteinosyltransferase subunit 1 (164-173)
agccccuacccuaccaagacacagacuaug

SEQ ID NO: 58994 - RNA, 33 nt, Artificial Sequence
  Cell division control protein 6 homolog (6-16)
agccaggcccaagcuaccaucuccuuccccaag

SEQ ID NO: 58995 - RNA, 30 nt, Artificial Sequence
  Nuclear transcription factor Y subunit gamma (290-299)
agccaguucaccgacggccaacagcuguac

SEQ ID NO: 58996 - RNA, 27 nt, Artificial Sequence
  Inactive serine/threonine-protein kinase VRK3 (34-42)
agccagaccuucgugaacccccacguc

SEQ ID NO: 58997 - RNA, 27 nt, Artificial Sequence
  Vacuolar protein sorting-associated protein 13B (2936-2944)
agccagugggacucccccaugagagug

SEQ ID NO: 58998 - RNA, 36 nt, Artificial Sequence
  Zinc finger MIZ domain-containing protein 2 (180-191)
agccaguacggcgccaugggggcuggacaauccuuc

SEQ ID NO: 58999 - RNA, 27 nt, Artificial Sequence
  Methylsterol monooxygenase 1 (145-153)
agccaguacaacgccuauaaugagaag

SEQ ID NO: 59000 - RNA, 30 nt, Artificial Sequence
  COUP transcription factor 2 (198-207)
agccaguaccccaaccaaccuaccagauuc

SEQ ID NO: 59001 - RNA, 27 nt, Artificial Sequence
  SUN domain-containing protein 2 (62-70)
agcuccgacgcccacaccucuuacuau

SEQ ID NO: 59002 - RNA, 27 nt, Artificial Sequence
  E3 ISG15-protein ligase HERC5 (113-121)
agcuccgacggcaagcccuucgaguac

SEQ ID NO: 59003 - RNA, 27 nt, Artificial Sequence
  Serrate RNA effector molecule homolog (88-96)
agcuccgaccccuaccacucuggcuau

SEQ ID NO: 59004 - RNA, 27 nt, Artificial Sequence
  Chromodomain-helicase-DNA-binding protein 1 (1545-1553)
agcuccgacagacaccugacccaguac

SEQ ID NO: 59005 - RNA, 27 nt, Artificial Sequence
  Glycogen phosphorylase, brain form (813-821)
agcuccgacagaaccaucacagaguac

SEQ ID NO: 59006 - RNA, 27 nt, Artificial Sequence
  HMG box-containing protein 1 (78-86)
agcuccgacgugucucaccaggaguac

SEQ ID NO: 59007 - RNA, 27 nt, Artificial Sequence
  Disintegrin and metalloproteinase domain-containing protein 23 (174-182)
agcuccgacuacguggagauccacuau

SEQ ID NO: 59008 - RNA, 27 nt, Artificial Sequence
  Insulin-like growth factor I (5-13)
agcucccugcccacccagcucuucaag

SEQ ID NO: 59009 - RNA, 33 nt, Artificial Sequence
  Keratin, type I cytoskeletal 10 (37-47)
agcuccucuaagggcucacuggggggagguuuc

SEQ ID NO: 59010 - RNA, 63 nt, Artificial Sequence
  Keratin, type I cytoskeletal 10 (37-57)
agcuccucuaagggcucacuggggggagguuucaguagcggcggguuuuccggaggcucuuuc

SEQ ID NO: 59011 - RNA, 45 nt, Artificial Sequence
  Keratin, type I cytoskeletal 10 (568-582)
agcuccucuucaggcagugugggggagagcuccucuaagggaccc

SEQ ID NO: 59012 - RNA, 27 nt, Artificial Sequence
  40S ribosomal protein S19 (59-67)
agcaccgccagacaccuguaccucagg

SEQ ID NO: 59013 - RNA, 27 nt, Artificial Sequence
  Putative elongation factor 1-alpha-like 3 (157-165)
agcaccgagcccccuuacucccagaag

SEQ ID NO: 59014 - RNA, 30 nt, Artificial Sequence
  DNA-dependent protein kinase catalytic subunit (1861-1870)
agcaccuucgacacacagaucacuaagaaa

SEQ ID NO: 59015 - RNA, 27 nt, Artificial Sequence
  Sentrin-specific protease 2 (440-448)
agcaccuucuuuuaccccaagcugaaa

SEQ ID NO: 59016 - RNA, 30 nt, Artificial Sequence
  Actin, alpha cardiac muscle 1 (22-31)
agcaccuuccagcaaauguggaucuccaag

SEQ ID NO: 59017 - RNA, 27 nt, Artificial Sequence
  Transketolase (258-266)
agcaccuucuccgagaucuuuaagaaa

SEQ ID NO: 59018 - RNA, 30 nt, Artificial Sequence
  Syntenin-1 (205-214)
agcaccggccacgugggguucaucuuuaag

SEQ ID NO: 59019 - RNA, 27 nt, Artificial Sequence
  E3 ubiquitin-protein ligase HECTD1 (455-463)
agcaccaucuucuacuaugugcagaag

SEQ ID NO: 59020 - RNA, 33 nt, Artificial Sequence; identical to SEQ ID NO: 34793
  Hexokinase-2 (408-418)

SEQ ID NO: 59021 - RNA, 27 nt, Artificial Sequence
  Heat shock protein HSP 90-beta (541-549)
agcaccaugggcuacaugauggccaag

SEQ ID NO: 59022 - RNA, 33 nt, Artificial Sequence
  Actin-related protein 2 (307-317)
agcaccauguaccccggccugccuuccagacuc

SEQ ID NO: 59023 - RNA, 36 nt, Artificial Sequence
  Adenosylhomocysteinase (85-96)
agcacccaggaccacgccgcugcagccaucgcgaag

SEQ ID NO: 59024 - RNA, 33 nt, Artificial Sequence
  Apoptosis-inducing factor 1, mitochondrial (76-86)
agcaccgugggcgccggggcuuacgcauauaag

SEQ ID NO: 59025 - RNA, 27 nt, Artificial Sequence
  Denticleless protein homolog (404-412)
agcaccgugggcugggccucccagaag

SEQ ID NO: 59026 - RNA, 27 nt, Artificial Sequence
  WD repeat-containing protein 48 (319-327)
agcaccgugaacaaguggacacugaaa

SEQ ID NO: 59027 - RNA, 33 nt, Artificial Sequence; identical to SEQ ID NO: 34800
  Sarcoplasmic/endoplasmic reticulum calcium ATPase 2 (387-397)

SEQ ID NO: 59028 - RNA, 33 nt, Artificial Sequence
  Integrator complex subunit 11 (175-185)
agcaccuacgccacaacuaucagagacuccaag

SEQ ID NO: 59029 - RNA, 33 nt, Artificial Sequence; identical to SEQ ID NO: 34802
  Nucleolar RNA helicase 2 (324-334)

SEQ ID NO: 59030 - RNA, 30 nt, Artificial Sequence
  Eukaryotic translation initiation factor 3 subunit H (119-128)
agcaccuacuauggcuccuucgugacaaga

SEQ ID NO: 59031 - RNA, 27 nt, Artificial Sequence
  Heterogeneous nuclear ribonucleoprotein A1-like 2 (5-13)
agcguggacaagaucgucauucagaaa

SEQ ID NO: 59032 - RNA, 30 nt, Artificial Sequence; identical to SEQ ID NO: 34805
  Mitochondrial import inner membrane translocase subunit TIM50 (213-222)

SEQ ID NO: 59033 - RNA, 27 nt, Artificial Sequence
  Lysine-tRNA ligase (98-106)
agcguggaccccaaccaguacuauaag

SEQ ID NO: 59034 - RNA, 33 nt, Artificial Sequence
  39S ribosomal protein L43, mitochondrial (93-103)
agcguggaggaaaucuccacccugguccagaag

SEQ ID NO: 59035 - RNA, 33 nt, Artificial Sequence
  Chromodomain-helicase-DNA-binding protein 3 (1189-1199)
agcguggaggaaagaaucacccaggucgccaag

SEQ ID NO: 59036 - RNA, 39 nt, Artificial Sequence
  Cirhin (180-192)
agcguguucgacgucaaguccggcucugccguucacaaa

SEQ ID NO: 59037 - RNA, 36 nt, Artificial Sequence
  Histone-lysine N-methyltransferase EHMT1 (87-98)
agcgugaucggcuccaacggguacauucugaauaag

SEQ ID NO: 59038 - RNA, 30 nt, Artificial Sequence
  Integrin alpha-4 (81-90)
agcgugaucaaccccggcgccauuuacaga

SEQ ID NO: 59039 - RNA, 48 nt, Artificial Sequence
  Protein S100-A9 (23-38)
agcgugaagcugggccaccccgacacccucaaccagggggaguucaaa

SEQ ID NO: 59040 - RNA, 27 nt, Artificial Sequence
  Mediator of RNA polymerase II transcription subunit 6 (28-36)
agcgugcuggacuacuucuccgagaga

SEQ ID NO: 59041 - RNA, 39 nt, Artificial Sequence
  Gelsolin (378-390)
agcgugcugcccgagggcggggaaaccccucucuucaag

SEQ ID NO: 59042 - RNA, 33 nt, Artificial Sequence
  Heat shock 70 kDa protein 14 (206-216)
agcgugauggaggucaacuccggcaucuacaga

SEQ ID NO: 59043 - RNA, 30 nt, Artificial Sequence; identical to SEQ ID NO: 34816
  Basic leucine zipper and W2 domain-containing protein 1 (215-224)

SEQ ID NO: 59044 - RNA, 27 nt, Artificial Sequence
  60S ribosomal protein L7 (149-157)
agcgugaacgagcugaucuacaagaga

SEQ ID NO: 59045 - RNA, 36 nt, Artificial Sequence
  Chromatin complexes subunit BAP18 (122-133)
agcgugcccgaggccggcgggccuccaaucaagaaa

SEQ ID NO: 59046 - RNA, 27 nt, Artificial Sequence
  ADP/ATP translocase 2 (180-188)
agcgugcagggcaucauuauauacaga

SEQ ID NO: 59047 - RNA, 27 nt, Artificial Sequence
  Anaphase-promoting complex subunit 16 (24-32)
agcguguccgaccuggcccccccuaga

SEQ ID NO: 59048 - RNA, 27 nt, Artificial Sequence
  Nesprin-2 (1819-1827)
agcguguccgaccuguucaacaccaag

SEQ ID NO: 59049 - RNA, 36 nt, Artificial Sequence
  A-kinase anchor protein 1, mitochondrial (874-885)
agcguggucggcgacgagguugugcugaucaacaga

SEQ ID NO: 59050 - RNA, 36 nt, Artificial Sequence
  Exocyst complex component 6 (35-46)
agcguguacgacgaucagcccaacgcccacaagaaa

SEQ ID NO: 59051 - RNA, 30 nt, Artificial Sequence; identical to SEQ ID NO: 34824
  Dehydrodolichyl diphosphate syntase complex subunit NUS1 (133-142)

SEQ ID NO: 59052 - RNA, 33 nt, Artificial Sequence
  Dehydrodolichyl diphosphate syntase complex subunit NUS1 (133-143)
agcguguacgaccaccagggcaucuucaagaga

SEQ ID NO: 59053 - RNA, 48 nt, Artificial Sequence
  Actin, alpha skeletal muscle (35-50)
agcuacgagcugcccgacggccaggugaucaccauugggaacgaaaga

SEQ ID NO: 59054 - RNA, 30 nt, Artificial Sequence; identical to SEQ ID NO: 34827
  Tetratricopeptide repeat protein 27 (18-27)

SEQ ID NO: 59055 - RNA, 27 nt, Artificial Sequence
  U5 small nuclear ribonucleoprotein 200 kDa helicase (1958-1966)
agcuaccugaagcagcucccccacuuc

SEQ ID NO: 59056 - RNA, 27 nt, Artificial Sequence
  Intraflagellar transport protein 122 homolog (100-108)
agcuacaaccccaucacccaccagcug

SEQ ID NO: 59057 - RNA, 27 nt, Artificial Sequence
  Constitutive coactivator of peroxisome proliferator-activated receptor gamma (261-269)
agcuacaccuccgugaaggagaacuuc

SEQ ID NO: 59058 - RNA, 24 nt, Artificial Sequence
  60S ribosomal protein L24 (24-31)
accgacggcaagguguuccaguuu

SEQ ID NO: 59059 - RNA, 27 nt, Artificial Sequence
  DNA-directed RNA polymerase II subunit RPB11-b2 (113-121)
accgaccugaucagagagcucagccuu

SEQ ID NO: 59060 - RNA, 27 nt, Artificial Sequence
  WD repeat-containing protein (630-638)
accgaccugaugagacucaaggagauc

SEQ ID NO: 59061 - RNA, 27 nt, Artificial Sequence
  Protein disulfide-isomerase (296-304)
accgacaaccagagaauccuggaguuc

SEQ ID NO: 59062 - RNA, 27 nt, Artificial Sequence
  Tensin-1 (1649-1657)
accgacaaccagagaaagcuguucuuu

SEQ ID NO: 59063 - RNA, 27 nt, Artificial Sequence
  Keratin, type I cytoskeletal 19 (327-335)
accgaggccagauucggcgcucagcug

SEQ ID NO: 59064 - RNA, 27 nt, Artificial Sequence
  Nucleolin (584-592)
accgaggaaacacugaaggagagcuuc

SEQ ID NO: 59065 - RNA, 27 nt, Artificial Sequence
  UPF0568 protein C14orf166 (23-31)
accgaguucagaaacuuuaucgugugg

SEQ ID NO: 59066 - RNA, 27 nt, Artificial Sequence
  Cytoplasmic dynein 1 heavy chain 1 (1693-1701)
accgagcaccccaagaucaacgaaugg

SEQ ID NO: 59067 - RNA, 27 nt, Artificial Sequence
  Disheveled-associated activator of morphogenesis 1 (629-637)
accgagaucgacgauacaaagguguuc

SEQ ID NO: 59068 - RNA, 27 nt, Artificial Sequence
  Proteasome activator complex subunit 3 (207-215)
accgagaucgacgaaaaggaguacauu

SEQ ID NO: 59069 - RNA, 33 nt, Artificial Sequence
  Nucleolin (452-462)
accgagaucgacggcagaagcauuucccuguac

SEQ ID NO: 59070 - RNA, 30 nt, Artificial Sequence
  Coatomer subunit alpha (1207-1216)
accgagaucggcaaggacgugauugggcug

SEQ ID NO: 59071 - RNA, 27 nt, Artificial Sequence
  Thiopurine S-methyltransferase (113-121)
accgagauccccggcacaaagguguuc

SEQ ID NO: 59072 - RNA, 30 nt, Artificial Sequence
  Angiomotin (467-476)
accgagauccagagagugagcgaagccuac

SEQ ID NO: 59073 - RNA, 27 nt, Artificial Sequence
  Eukaryotic translation initiation factor 3 subunit C-like protein (323-331)
accgagaucacacacgccguggucauu

SEQ ID NO: 59074 - RNA, 27 nt, Artificial Sequence
  Fructose-bisphosphate aldolase A (206-214)
accgagaaggugcuggccgcugucuac

SEQ ID NO: 59075 - RNA, 27 nt, Artificial Sequence
  Staphylococcal nuclease domain-containing protein 1 (260-268)
accgagcugcuccuuaaggaaggcuuc

SEQ ID NO: 59076 - RNA, 27 nt, Artificial Sequence
  Sorting nexin-5 (292-300)
accgagcugcucagauacuauaugcuu

SEQ ID NO: 59077 - RNA, 27 nt, Artificial Sequence
  Tuftelin (365-373)
accgagaaccccggcagcaucagaauu

SEQ ID NO: 59078 - RNA, 27 nt, Artificial Sequence
  KN motif and ankyrin repeat domain-containing protein 2 (612-620)
accgagagagaacugaagguggccuac

SEQ ID NO: 59079 - RNA, 27 nt, Artificial Sequence
  Tensin-1 (19-27)
accgagagaaucauugccgugagcuuc

SEQ ID NO: 59080 - RNA, 30 nt, Artificial Sequence
  Microtubule-actin cross-linking factor 1, isoforms 1/2/3/5 (327-336)
accgagguggacagcagauggcaggaauac

SEQ ID NO: 59081 - RNA, 27 nt, Artificial Sequence
  Melanoma-associated antigen D2 (67-75)
accgaggugagcaagacacccgaagcc

SEQ ID NO: 59082 - RNA, 33 nt, Artificial Sequence
  Cytoplasmic dynein 1 heavy chain 1 (3550-3560)
accgaguaccugagcaacgccgacgaaagacuc

SEQ ID NO: 59083 - RNA, 30 nt, Artificial Sequence
  Autophagy-related protein 9A (6-15)
accgaguaccagagacuggaagccagcuau

SEQ ID NO: 59084 - RNA, 39 nt, Artificial Sequence
  Glyceraldehyde-3-phosphate dehydrogenase (3-15)
accuucgacgccggcgcugggaucgcacugaacgaucac

SEQ ID NO: 59085 - RNA, 27 nt, Artificial Sequence
  Hydroxymethylglutaryl-CoA synthase, cytoplasmic (131-139)
accaucauugacaagagcaaauccgug

SEQ ID NO: 59086 - RNA, 33 nt, Artificial Sequence
  Histone H3.3 (119-129)
accaucaugcccaaggacauucagcuggccaga

SEQ ID NO: 59087 - RNA, 30 nt, Artificial Sequence
  NADH dehydrogenase (ubiquinone) iron-sulfur protein 5 (19-28)
accauccagagcggcgagcaacccuacaag

SEQ ID NO: 59088 - RNA, 30 nt, Artificial Sequence
  T-complex protein 1 subunit zeta-2 (204-213)
accaaggaggugaacagcggcuucuuuuac

SEQ ID NO: 59089 - RNA, 27 nt, Artificial Sequence
  Serine/threonine-protein phosphatase 6 regulatory ankyrin repeat subunit C (603-611)
acccuggccgagacacucgugaaccuu

SEQ ID NO: 59090 - RNA, 27 nt, Artificial Sequence
  Leucine-rich repeat-containing protein 41 (19-27)
acccuggccagcucccuccacacacuu

SEQ ID NO: 59091 - RNA, 27 nt, Artificial Sequence
  MOB kinase activator 1A (130-138)
acccuguuccccagcaagaucggcgug

SEQ ID NO: 59092 - RNA, 27 nt, Artificial Sequence
  A-kinase anchor protein 11 (1555-1563)
acccugggcagcacaguguucagaguc

SEQ ID NO: 59093 - RNA, 27 nt, Artificial Sequence
  Nucleosome-remodeling factor subunit BPTF (281-289)
acccugauggccgagaugcacgugguc

SEQ ID NO: 59094 - RNA, 27 nt, Artificial Sequence
  WD repeat-containing protein 81 (157-165)
acccugauggacauccuccccagaauu

SEQ ID NO: 59095 - RNA, 27 nt, Artificial Sequence
  Exportin-1 (346-354)
acccugauggaggcccuccacuacaug

SEQ ID NO: 59096 - RNA, 27 nt, Artificial Sequence
  Splicing factor 3A subunit 1 (521-529)
acccugcaggagcaaaucgaagccauu

SEQ ID NO: 59097 - RNA, 27 nt, Artificial Sequence
  Replication protein A 32 kDa subunit (58-66)
acccugguggacgaggucuucagaauc

SEQ ID NO: 59098 - RNA, 27 nt, Artificial Sequence
  Elongator complex protein 2 (406-414)
acccuguggcccgaggugcagaagcuc

SEQ ID NO: 59099 - RNA, 27 nt, Artificial Sequence
  Exosome complex component RRP42 (108-116)
acccuguacagaaucuucaacaauaag

SEQ ID NO: 59100 - RNA, 27 nt, Artificial Sequence
  Transmembrane protein 50A (48-56)
accaugaaggacuucaaccacagcuac

SEQ ID NO: 59101 - RNA, 27 nt, Artificial Sequence
  snRNA-activating protein complex subunit 4 (1152-1160)
acccccgccccuccaacacacgcucug

SEQ ID NO: 59102 - RNA, 30 nt, Artificial Sequence
  Spectrin beta chain, non-erythrocytic 1 (2320-2329)
acccccgccagcuccagagcucagacacug

SEQ ID NO: 59103 - RNA, 33 nt, Artificial Sequence
  26S proteasome non-ATPase regulatory subunit 4 (65-75)
acccccgacacaggcagaauccugagcaagcuc

SEQ ID NO: 59104 - RNA, 27 nt, Artificial Sequence
  ATP-dependent zinc metalloprotease YME1L1 (25-33)
acccccaagaacacaagcgugucccug

SEQ ID NO: 59105 - RNA, 27 nt, Artificial Sequence
  Galectin-8 (193-201)
acccccaugggcccugggagaacagug

SEQ ID NO: 59106 - RNA, 27 nt, Artificial Sequence
  WAS/WASL-interacting protein family member 1 (331-339)
acccccagacugccucagaggaaccuc

SEQ ID NO: 59107 - RNA, 33 nt, Artificial Sequence
  ATP synthase F(0) complex subunit C2, mitochondrial (26-36)
acccccagccuggugaaguccacaucucagcuc

SEQ ID NO: 59108 - RNA, 27 nt, Artificial Sequence
  Ubiquitin carboxyl-terminal hydrolase 48 (860-868)
acccaggccacaaucuacgugcacaag

SEQ ID NO: 59109 - RNA, 33 nt, Artificial Sequence
  HLA class I histocompatibility antigen, B-13 alpha chain (63-73)
acccagaucagcaagacaaacacucaaacguac

SEQ ID NO: 59110 - RNA, 30 nt, Artificial Sequence
  rRNA-processing protein FCF1 homolog (61-70)
acccagcugggccccccuuaccacauccuc

SEQ ID NO: 59111 - RNA, 27 nt, Artificial Sequence
  14-3-3 protein gamma (115-123)
acccaguacgagagcaagguguucuau

SEQ ID NO: 59112 - RNA, 27 nt, Artificial Sequence
  Gamma-interferon-inducible protein 16 (419-427)
accacauuccccgagagccaccugaga

SEQ ID NO: 59113 - RNA, 27 nt, Artificial Sequence
  MIT domain-containing protein 1 (236-244)
accacaguggacaucuuccacaagaaa

SEQ ID NO: 59114 - RNA, 27 nt, Artificial Sequence
  Lys-63-specific deubiquitinase BRCC36 (66-74)
accguggccgagaaggucgacgcuguu

SEQ ID NO: 59115 - RNA, 27 nt, Artificial Sequence
  28S ribosomal protein S24, mitochondrial (78-86)
accguggaggacgucuuccugagaaag

SEQ ID NO: 59116 - RNA, 36 nt, Artificial Sequence
  Phosphatidylinositol-4,5-bisphosphate 4-phosphatase 2 (39-50)
accguggagagccccgaacugcaggucccuuacaag

SEQ ID NO: 59117 - RNA, 27 nt, Artificial Sequence
  Glycine-tRNA ligase (533-541)
accguguucgagcacacauuucauguc

SEQ ID NO: 59118 - RNA, 33 nt, Artificial Sequence
  Tubulin alpha-1C chain (38-48)
accgugaucgacgaggucagaacaggcacuuac

SEQ ID NO: 59119 - RNA, 27 nt, Artificial Sequence
  Transcription factor BTF3 (76-84)
accgugauccacuucaacaaucccaag

SEQ ID NO: 59120 - RNA, 33 nt, Artificial Sequence
  DNA replication licensing factor MCM6 (163-173)
accgugaucagagacgucgagcagcaauucaag

SEQ ID NO: 59121 - RNA, 33 nt, Artificial Sequence
  Dolichyl-diphosphooligosaccharide-proteinosyltransferase subunit 2 (165-175)
accgugcuggagagcagaucccucuucucuaag

SEQ ID NO: 59122 - RNA, 48 nt, Artificial Sequence
  Actin, cytoplasmic 2 (36-51)
accgugcugagcggcgggacaacuauguaccccggaaucgccgacaga

SEQ ID NO: 59123 - RNA, 27 nt, Artificial Sequence
  Ubiquitin-protein ligase E3A (325-333)
accuacaaggugaucagcaacgaguuc

SEQ ID NO: 59124 - RNA, 27 nt, Artificial Sequence
  Vacuolar protein sorting-associated protein 51 homolog (480-488)
guggccgacgaggaacugguccaccuc

SEQ ID NO: 59125 - RNA, 24 nt, Artificial Sequence
  Eukaryotic translation initiation factor 3 subunit H (221-228)
guggccgacaagcacgagcugcuc

SEQ ID NO: 59126 - RNA, 27 nt, Artificial Sequence
  Bifunctional polynucleotide phosphatase/kinase (54-62)
guggccgaccccgagaccagaacaguc

SEQ ID NO: 59127 - RNA, 27 nt, Artificial Sequence
  Serine/threonine-protein kinase PLK2 (471-479)
guggccgacaccgucgcuagaguucug

SEQ ID NO: 59128 - RNA, 27 nt, Artificial Sequence
  Ubiquitin carboxyl-terminal hydrolase 16 (733-741)
guggccgaggaaaacaccagaguccug

SEQ ID NO: 59129 - RNA, 27 nt, Artificial Sequence
  HLA class I histocompatibility antigen, B-8 alpha chain (151-159)
guggccgagcaggacagagcuuaccug

SEQ ID NO: 59130 - RNA, 27 nt, Artificial Sequence
  Mitochondrial import receptor subunit TOM5 homolog (35-43)
guggcccugcucagagucacccccuuc

SEQ ID NO: 59131 - RNA, 54 nt, Artificial Sequence
  Actin, cytoplasmic 1 (13-30)
guggcccccgaggaacacccuguccugcucaccgaggcuccacuuaacccgaag

SEQ ID NO: 59132 - RNA, 24 nt, Artificial Sequence
  Polymerase I and transcript release factor (229-236)
guggacgauuucaagaaagccuuu

SEQ ID NO: 59133 - RNA, 27 nt, Artificial Sequence
  Cholesteryl ester transfer protein (230-238)
guggacaucagccugaccggcgauccc

SEQ ID NO: 59134 - RNA, 24 nt, Artificial Sequence
  Heterogeneous nuclear ribonucleoproteins C1/C2 (33-40)
guggaggccaucuucagcaaguac

SEQ ID NO: 59135 - RNA, 27 nt, Artificial Sequence
  Sodium/potassium-transporting ATPase subunit alpha-1 (701-709)
guggaggacagcuacggccagcaaugg

SEQ ID NO: 59136 - RNA, 30 nt, Artificial Sequence
  116 kDa U5 small nuclear ribonucleoprotein component (621-630)
guggaggaaagcggcgagcacgucauccug

SEQ ID NO: 59137 - RNA, 33 nt, Artificial Sequence
  Adenosylhomocysteinase 2 (222-232)
guggaggaaagcgucaccggcguucacagacug

SEQ ID NO: 59138 - RNA, 36 nt, Artificial Sequence
  ATP synthase subunit alpha, mitochondrial (96-107)
guggaguucagcuccggccugaaggggaugucucuc

SEQ ID NO: 59139 - RNA, 27 nt, Artificial Sequence
  HLA class II histocompatibility antigen, DRB1-4 beta chain (204-212)
guggagcaccccagccugaccuccccu

SEQ ID NO: 59140 - RNA, 33 nt, Artificial Sequence
  Protein disulfide-isomerase A6 (411-421)
guggagcuggacgaucucggcaaggacgaacuu

SEQ ID NO: 59141 - RNA, 27 nt, Artificial Sequence
  Galectin-3 (204-212)
guggagcccgaccacuucaaggucgcc

SEQ ID NO: 59142 - RNA, 24 nt, Artificial Sequence
  SARM1 protein (269-276)
guggagagagaagucgagcagguu

SEQ ID NO: 59143 - RNA, 24 nt, Artificial Sequence
  N6-adenosine-methyltransferase 70 kDa subunit (116-123)
guggagagccugcuccagaaguuc

SEQ ID NO: 59144 - RNA, 27 nt, Artificial Sequence
  Protein RMD5 homolog B (280-288)
guggagagcccccuguccgucucuuuc

SEQ ID NO: 59145 - RNA, 33 nt, Artificial Sequence
  Nucleosome assembly protein 1-like 1 (60-70)
guggagacccccacaggcuacaucgaaagccug

SEQ ID NO: 59146 - RNA, 27 nt, Artificial Sequence
  Influenza virus NS1A-binding protein (83-91)
guggagguccugcucaacuacgccuau

SEQ ID NO: 59147 - RNA, 27 nt, Artificial Sequence
  Rho GDP-dissociation inhibitor 1 (108-116)
guggaguacagaaucaagauuagcuuc

SEQ ID NO: 59148 - RNA, 51 nt, Artificial Sequence
  40S ribosomal protein S3a (66-82)
guguucgaggucagccuggccgaccuccagaacgaugaaguugcuuuuaga

SEQ ID NO: 59149 - RNA, 27 nt, Artificial Sequence
  40S ribosomal protein S23 (112-120)
gugggcgacauccccggggucagauuc

SEQ ID NO: 59150 - RNA, 27 nt, Artificial Sequence
  AT-rich interactive domain-containing protein 1A (1378-1386)
gugggcgaccccgggcagagaacccug

SEQ ID NO: 59151 - RNA, 27 nt, Artificial Sequence
  Bromodomain-containing protein 8 (239-247)
gugggcgacccccacaccgucacaguu

SEQ ID NO: 59152 - RNA, 27 nt, Artificial Sequence
  F-box/LRR-repeat protein 19 (440-448)
gugggcgaccccagcguccaccugcuc

SEQ ID NO: 59153 - RNA, 27 nt, Artificial Sequence
  Nucleolar protein 56 (117-125)
gugaucgccgagauucugagaggcguc

SEQ ID NO: 59154 - RNA, 27 nt, Artificial Sequence
  Kelch-like ECH-associated protein 1 (420-428)
gugaucgacggccacauuuacgccguc

SEQ ID NO: 59155 - RNA, 27 nt, Artificial Sequence
  Eukaryotic translation initiation factor 3 subunit L (83-91)
gugaucgaccagaaggucuacgagauu

SEQ ID NO: 59156 - RNA, 27 nt, Artificial Sequence
  E3 ubiquitin-protein ligase RNF213 (1305-1313)
gugaucuucaaggacuuugucaacaaa

SEQ ID NO: 59157 - RNA, 27 nt, Artificial Sequence
  MICOS complex subunit MIC27 (158-166)
gugaucauugccaaggucaccgcuaaa

SEQ ID NO: 59158 - RNA, 39 nt, Artificial Sequence
  Elongation factor 1-alpha 1 (344-356)
gugaucauucugaaccaccccggccagauaagcgccggg

SEQ ID NO: 59159 - RNA, 27 nt, Artificial Sequence
  Plectin (1820-1828)
gugcuggccgagaagcucgcugcaauc

SEQ ID NO: 59160 - RNA, 24 nt, Artificial Sequence
  Lysine-specific demethylase 5A (1593-1600)
gugcuggacauccccagcaaguac

SEQ ID NO: 59161 - RNA, 27 nt, Artificial Sequence
  Integrin-linked protein kinase (219-227)
gugcugcacgagggcaccaacuucguc

SEQ ID NO: 59162 - RNA, 27 nt, Artificial Sequence
  Interleukin-12 subunit alpha (14-22)
gugcugcucgaccaccuuagccuggcc

SEQ ID NO: 59163 - RNA, 33 nt, Artificial Sequence
  Tumor necrosis factor receptor superfamily member 19 (5-15)
gugcugcucgagcaggaaaagaccuucuuuaca

SEQ ID NO: 59164 - RNA, 30 nt, Artificial Sequence
  Protein CNPPD1 (210-219)
gugcugcucgagcagcccaccuggcaacuu

SEQ ID NO: 59165 - RNA, 30 nt, Artificial Sequence; identical to SEQ ID NO: 34938
  Fatty acid synthase (2105-2114)

SEQ ID NO: 59166 - RNA, 27 nt, Artificial Sequence
  2'-deoxynucleoside 5'-phosphate N-hydrolase 1 (52-60)
gugcugaccgagcacgucgccgcugca

SEQ ID NO: 59167 - RNA, 30 nt, Artificial Sequence; identical to SEQ ID NO: 34940
  AKT-interacting protein (200-209)

SEQ ID NO: 59168 - RNA, 27 nt, Artificial Sequence
  Thioredoxin-like protein 4A (44-52)
gugcuguacagcaucgccgagaagguc

SEQ ID NO: 59169 - RNA, 33 nt, Artificial Sequence
  Putative PIP5K1A and PSMD4-like protein (813-823)
gugaugcaggaccccgaguuccugcaaagcguc

SEQ ID NO: 59170 - RNA, 48 nt, Artificial Sequence
  78 kDa glucose-regulated protein (177-192)
gugaugagaaucauuaacgagcccaccgccgcugcaauagccuacggc

SEQ ID NO: 59171 - RNA, 33 nt, Artificial Sequence
  Glutathione S-transferase P (200-210)
gugaaccugcccaucaauggcaacgggaagcag

SEQ ID NO: 59172 - RNA, 27 nt, Artificial Sequence
  Eukaryotic translation initiation factor 3 subunit E (109-117)
gugcccgccaccgacagaaacgcucug

SEQ ID NO: 59173 - RNA, 33 nt, Artificial Sequence
  Protein UXT (95-105)
gugcccgacaccagcagaaucuacgucgcccug

SEQ ID NO: 59174 - RNA, 33 nt, Artificial Sequence
  A-kinase-interacting protein 1 (107-117)
gugcccgaggaaggcggggccacccacgucuac

SEQ ID NO: 59175 - RNA, 27 nt, Artificial Sequence
  N-alpha-acetyltransferase 10 (67-75)
gugccccacggccauaucaccagccug

SEQ ID NO: 59176 - RNA, 27 nt, Artificial Sequence
  Tubulin beta chain (80-88)
gugcccagagccauccuggucgaccuc

SEQ ID NO: 59177 - RNA, 27 nt, Artificial Sequence
  Protein phosphatase 1 regulatory subunit 15A (126-134)
gugcccagaggccaggggagccaauuc

SEQ ID NO: 59178 - RNA, 27 nt, Artificial Sequence
  Protein Wiz (759-767)
gugcccagaccuccacagaccagccug

SEQ ID NO: 59179 - RNA, 24 nt, Artificial Sequence
  Transmembrane protein 140 (75-82)
gugcccagagucggccuggggcuc

SEQ ID NO: 59180 - RNA, 27 nt, Artificial Sequence
  Nucleolar transcription factor 1 (161-169)
gugcccagcaccgagagaaugguccug

SEQ ID NO: 59181 - RNA, 27 nt, Artificial Sequence
  Replication protein A 70 kDa DNA-binding subunit (383-391)
gugagcgacuucggcgggagaucccug

SEQ ID NO: 59182 - RNA, 27 nt, Artificial Sequence
  Cytosolic non-specific dipeptidase (386-394)
gugagcgacuucucccacccccauuac

SEQ ID NO: 59183 - RNA, 27 nt, Artificial Sequence
  Sister chromatid cohesion protein PDS5 homolog A (258-266)
gugagcgaccuguccgagcacgucuuc

SEQ ID NO: 59184 - RNA, 24 nt, Artificial Sequence
  DNA damage-inducible transcript 4 protein (124-131)
gugagccaggucggcaaggagcug

SEQ ID NO: 59185 - RNA, 30 nt, Artificial Sequence
  Tetratricopeptide repeat protein 28 (985-994)
gugaccgaccccacaggcuuccugagaaug

SEQ ID NO: 59186 - RNA, 27 nt, Artificial Sequence
  Beta-2-syntrophin (352-360)
gugaccgagaaggaccugcuccuuuac

SEQ ID NO: 59187 - RNA, 30 nt, Artificial Sequence
  T-complex protein 1 subunit epsilon (13-22)
gugaccaucuucauuagaggcgggaacaag

SEQ ID NO: 59188 - RNA, 30 nt, Artificial Sequence
  NHP2-like protein 1 (104-113)
gugaccaucaaggagggcagccagcugaaa

SEQ ID NO: 59189 - RNA, 36 nt, Artificial Sequence
  T-complex protein 1 subunit delta (68-79)
gugaccaucacaaacgacggcgccacuauucugaag

SEQ ID NO: 59190 - RNA, 27 nt, Artificial Sequence
  HLA class I histocompatibility antigen, alpha chain E (313-321)
guggucgccgcuguuaucuggagaaag

SEQ ID NO: 59191 - RNA, 27 nt, Artificial Sequence
  Jouberin (370-378)
guggucgacgagcacaccggccaguac

SEQ ID NO: 59192 - RNA, 27 nt, Artificial Sequence
  WASH complex subunit 7 (157-165)
guggucaugaacguugugcaccagcug

SEQ ID NO: 59193 - RNA, 33 nt, Artificial Sequence
  Cyclin-G-associated kinase (580-590)
guggucaugacccccguuccucuguucagcaag

SEQ ID NO: 59194 - RNA, 30 nt, Artificial Sequence
  Exportin-6 (715-724)
gugguccaggagcccggccaaguuuucaag

SEQ ID NO: 59195 - RNA, 27 nt, Artificial Sequence
  DNA damage-binding protein 1 (508-516)
guggucguugccgugggcagagcucug

SEQ ID NO: 59196 - RNA, 33 nt, Artificial Sequence
  rRNA 2'-O-methyltransferase fibrillarin (305-315)
guggucguuggcguguacagacccccuccaaag

SEQ ID NO: 59197 - RNA, 27 nt, Artificial Sequence
  Transmembrane protein 41B (174-182)
guggucuacaaguaucugaccgagaaa

SEQ ID NO: 59198 - RNA, 27 nt, Artificial Sequence
  Ribose-phosphate pyrophosphokinase 1 (40-48)
guguacgccauccugacccacggcauu

SEQ ID NO: 59199 - RNA, 30 nt, Artificial Sequence
  ATP synthase mitochondrial F1 complex assembly factor 1 (87-96)
guguacgccgucauccccgcugagaaguuc

SEQ ID NO: 59200 - RNA, 27 nt, Artificial Sequence
  Antizyme inhibitor 1 (320-328)
guguacggcagcuucgccuccaagcug

SEQ ID NO: 59201 - RNA, 30 nt, Artificial Sequence; identical to SEQ ID NO: 34974
  ATP-dependent RNA helicase DHX8 (1133-1142)

SEQ ID NO: 59202 - RNA, 27 nt, Artificial Sequence
  Adenosylhomocysteinase 2 (207-215)
guguacaagaaauaucccaacgucuuc

SEQ ID NO: 59203 - RNA, 27 nt, Artificial Sequence
  Inactive tyrosine-protein kinase 7 (955-963)
guguacaacagcgaguauuaccacuuc

SEQ ID NO: 59204 - RNA, 27 nt, Artificial Sequence
  2'-5'-oligoadenylate synthase 3 (865-873)
ugggagaaccccagagugcugagcuuc

SEQ ID NO: 59205 - RNA, 21 nt, Artificial Sequence
  Actin, aortic smooth muscle (358-364)
uggaucagcaagcaggaguac

SEQ ID NO: 59206 - RNA, 27 nt, Artificial Sequence
  Protein LYRIC (404-412)
uggguggacgaggaaagagccagccug

SEQ ID NO: 59207 - RNA, 30 nt, Artificial Sequence
  General transcription factor 3C polypeptide 5 (51-60)
uacgccgaccccaccaagagacuggagcuc

SEQ ID NO: 59208 - RNA, 27 nt, Artificial Sequence
  Translocon-associated protein subunit delta (67-75)
uacgccgacgugggcgggaagcaguuc

SEQ ID NO: 59209 - RNA, 30 nt, Artificial Sequence; identical to SEQ ID NO: 34982
  U5 small nuclear ribonucleoprotein 200 kDa helicase (1245-1254)

SEQ ID NO: 59210 - RNA, 33 nt, Artificial Sequence
  HLA class I histocompatibility antigen, alpha chain G (137-147)
uacgccuaugacggcaaggauuaccuggcucuc

SEQ ID NO: 59211 - RNA, 45 nt, Artificial Sequence
  Cofilin-1 (85-99)
uacgacgccaccuaugagacaaaggaaagcaaaaaggaggaucug

SEQ ID NO: 59212 - RNA, 27 nt, Artificial Sequence
  Transcriptional adapter 2-alpha (431-439)
uacgacuuccugaucagagagggcuau

SEQ ID NO: 59213 - RNA, 27 nt, Artificial Sequence
  Myeloid cell nuclear differentiation antigen (31-39)
uacgaccugggccucaccacaaagaug

SEQ ID NO: 59214 - RNA, 27 nt, Artificial Sequence
  Dual specificity tyrosine-phosphorylation-regulated kinase 1A (246-254)
uacgaccugcucagaaacaccaauuuc

SEQ ID NO: 59215 - RNA, 24 nt, Artificial Sequence
  Renin receptor (335-342)
uacgacagcaucauuuauagaaug

SEQ ID NO: 59216 - RNA, 27 nt, Artificial Sequence
  Integrin beta-1 (314-322)
uacgacuaucccagcaucgcccaccug

SEQ ID NO: 59217 - RNA, 27 nt, Artificial Sequence
  ATP-dependent RNA helicase DDX3X (283-291)
uacgaggaagccagaaaguucagcuau

SEQ ID NO: 59218 - RNA, 27 nt, Artificial Sequence
  Cytochrome c oxidase subunit 7C, mitochondrial (19-27)
uacgaggaaggccccgggaagaaccug

SEQ ID NO: 59219 - RNA, 27 nt, Artificial Sequence
  Spectrin beta chain, non-erythrocytic 1 (461-469)
uacgaggaaagagugcaggccgucguu

SEQ ID NO: 59220 - RNA, 33 nt, Artificial Sequence
  La-related protein 1 (633-643)
uacgagaucgacgauagagacgugaacaagauu

SEQ ID NO: 59221 - RNA, 30 nt, Artificial Sequence
  Nodal modulator 2 (181-190)
uacgagauccuggccacccaccccacaugg

SEQ ID NO: 59222 - RNA, 27 nt, Artificial Sequence
  Keratin, type I cytoskeletal 10 (42-50)
uacgagaacgaaguggcccugagacag

SEQ ID NO: 59223 - RNA, 27 nt, Artificial Sequence
  Ubiquitin carboxyl-terminal hydrolase 22 (258-266)
uacgagcagcaagacgcccacgaauuc

SEQ ID NO: 59224 - RNA, 30 nt, Artificial Sequence
  Regulator of microtubule dynamics protein 1 (94-103)
uacgagagcggcgaaaccgagaagcuguau

SEQ ID NO: 59225 - RNA, 27 nt, Artificial Sequence
  Thioredoxin-interacting protein (97-105)
uacgaguauaaguucggcuuugaacug

SEQ ID NO: 59226 - RNA, 33 nt, Artificial Sequence
  Hemoglobin subunit alpha (25-35)
uacggcgccgaggcucuggaaagaauguuccuc

SEQ ID NO: 59227 - RNA, 27 nt, Artificial Sequence
  Solute carrier family 25 member 43 (300-308)
uacauccugagcccccucuccuauaag

SEQ ID NO: 59228 - RNA, 30 nt, Artificial Sequence
  UDP-N-acetylglucosamine transporter (266-275)
uacaucuaugacggcgagcuggugagcaag

SEQ ID NO: 59229 - RNA, 30 nt, Artificial Sequence
  Zinc finger protein 573 (42-51)
uaccuggaccccaaccagagagaucucuau

SEQ ID NO: 59230 - RNA, 27 nt, Artificial Sequence
  Splicing factor 3A subunit 3 (192-200)
uaccugcaggacuauaccgauagagug

SEQ ID NO: 59231 - RNA, 33 nt, Artificial Sequence
  Regulator of microtubule dynamics protein 1 (92-102)
uaccuguaugagagcggcgaaaccgagaagcuc

SEQ ID NO: 59232 - RNA, 27 nt, Artificial Sequence
  Myc proto-oncogene protein (334-342)
uaccccgccgcuaagagagugaaacug

SEQ ID NO: 59233 - RNA, 27 nt, Artificial Sequence
  Exportin-T (608-616)
uaccccgccgagagaaagcaggcucug

SEQ ID NO: 59234 - RNA, 30 nt, Artificial Sequence
  Ubiquitin-conjugating enzyme E2 D2 (59-68)
uaccccuucaagccuccaaaaguggccuuu

SEQ ID NO: 59235 - RNA, 30 nt, Artificial Sequence
  Ubiquitin-conjugating enzyme E2 E1 (89-98)
uaccccuucaagccuccaaaagugaccuuu

SEQ ID NO: 59236 - RNA, 27 nt, Artificial Sequence
  ATP-dependent RNA helicase DDX24 (383-391)
uaccccaagagaccucugcucggccuu

SEQ ID NO: 59237 - RNA, 27 nt, Artificial Sequence
  All-trans-retinol 13,14-reductase (15-23)
uaccccagaggcgggagcuccgagauc

SEQ ID NO: 59238 - RNA, 27 nt, Artificial Sequence
  Laminin subunit gamma-1 (615-623)
uaccccagcgagaccacagugaaguau

SEQ ID NO: 59239 - RNA, 27 nt, Artificial Sequence
  Eukaryotic translation initiation factor 3 subunit E (62-70)
uacagcgacgauaucccccacgcccug

SEQ ID NO: 59240 - RNA, 36 nt, Artificial Sequence
  Bromodomain and WD repeat-containing protein 1 (854-865)
uacagcgaguccucuucagacaguagcuccagauau

SEQ ID NO: 59241 - RNA, 27 nt, Artificial Sequence
  Nuclear pore complex protein Nup160 (345-353)
uacagccuggaccacaucuccucucuc

SEQ ID NO: 59242 - RNA, 27 nt, Artificial Sequence
  ATP-dependent RNA helicase DDX51 (304-312)
uacaccgacgccacaccccugagagug

SEQ ID NO: 59243 - RNA, 24 nt, Artificial Sequence
  Cytosolic purine 5'-nucleotidase (255-262)
uacaccgacaagaucaugacauau

SEQ ID NO: 59244 - RNA, 30 nt, Artificial Sequence
  Sterol regulatory element-binding protein cleavage-activating protein (160-169)
uacaccgaccccgccggccugagaaacuau

SEQ ID NO: 59245 - RNA, 27 nt, Artificial Sequence
  General transcription factor 3C polypeptide 2 (787-795)
uacaccgagacagugaaccaccauuau

SEQ ID NO: 59246 - RNA, 27 nt, Artificial Sequence
  Cytochrome c oxidase subunit 1 (403-411)
uacacccuggaccagacauaugccaag

SEQ ID NO: 59247 - RNA, 27 nt, Artificial Sequence
  3-phosphoinositide-dependent protein kinase 1 (486-494)
uacguggaccccgucaacaagguucug

SEQ ID NO: 59248 - RNA, 30 nt, Artificial Sequence
  Alanine-tRNA ligase, cytoplasmic (497-506)
uacguguucgagaacaccgucgccacaguu

SEQ ID NO: 59249 - RNA, 42 nt, Artificial Sequence
  Actin, aortic smooth muscle (55-68)
uacgugggcgacgaggcccagagcaagagagggauccugacc

SEQ ID NO: 59250 - RNA, 27 nt, Artificial Sequence
  Exocyst complex component 2 (206-214)
uacuaugccgagguggaaaccagaauc

SEQ ID NO: 59251 - RNA, 27 nt, Artificial Sequence
  Nuclear receptor corepressor 2 (332-340)
uacuaugagaagcaguuccccgaaauc

SEQ ID NO: 59252 - RNA, 27 nt, Artificial Sequence
  Plexin-B2 (1-9)
uacuauaccgacaucaugcacacacug

SEQ ID NO: 59253 - RNA, 27 nt, Artificial Sequence
  Tankyrase-1 (100-108)
gccgcugcacccguggucccugccguu

SEQ ID NO: 59254 - RNA, 27 nt, Artificial Sequence
  Ubiquitin-conjugating enzyme E2 J2 (242-250)
gccgcuuucgcauacaccgugaaguau

SEQ ID NO: 59255 - RNA, 27 nt, Artificial Sequence
  DNA replication licensing factor MCM5 (326-334)
gccgcucugcccaacguguacgagguc

SEQ ID NO: 59256 - RNA, 27 nt, Artificial Sequence
  Heterogeneous nuclear ribonucleoprotein Q (215-223)
gccgcucaggaggcagugaagcuguac

SEQ ID NO: 59257 - RNA, 27 nt, Artificial Sequence
  Zinc finger protein 609 (360-368)
gccgaggcugacaagaucuacagcuuc

SEQ ID NO: 59258 - RNA, 27 nt, Artificial Sequence
  M-phase inducer phosphatase 2 (285-293)
gccgaggaacccaaggcuagagugcug

SEQ ID NO: 59259 - RNA, 30 nt, Artificial Sequence; identical to SEQ ID NO: 35032
  SHC SH2 domain-binding protein 1 (437-446)

SEQ ID NO: 59260 - RNA, 27 nt, Artificial Sequence
  Pre-mRNA-splicing factor ATP-dependent RNA helicase DHX15 (563-571)
gccgaguucccccuggacccucagcuc

SEQ ID NO: 59261 - RNA, 33 nt, Artificial Sequence
  Intraflagellar transport protein 81 homolog (43-53)
gccgagaucgaccccaagcagcugguggauauu

SEQ ID NO: 59262 - RNA, 27 nt, Artificial Sequence
  Clathrin heavy chain 1 (493-501)
gccgagaccggccaggugcaaaagauc

SEQ ID NO: 59263 - RNA, 27 nt, Artificial Sequence
  Uncharacterized protein C8orf59 (62-70)
gcccacuucgcuaagagcaucucccug

SEQ ID NO: 59264 - RNA, 27 nt, Artificial Sequence
  60S ribosomal protein L9 (97-105)
gcccacuuccccaucaacguggucauu

SEQ ID NO: 59265 - RNA, 27 nt, Artificial Sequence
  Intraflagellar transport protein 27 homolog (30-38)
gcccacuuccagaagagcuacacccug

SEQ ID NO: 59266 - RNA, 27 nt, Artificial Sequence
  Xaa-Pro aminopeptidase 1 (333-341)
gcccacaucaaggacgcuguggcacug

SEQ ID NO: 59267 - RNA, 27 nt, Artificial Sequence
  CCR4-NOT transcription complex subunit 1 (2246-2254)
gcccacauggacaucuuccagaaccug

SEQ ID NO: 59268 - RNA, 27 nt, Artificial Sequence
  NEDD8 ultimate buster 1 (148-156)
gcccacaacgugaaggcuaugguccug

SEQ ID NO: 59269 - RNA, 30 nt, Artificial Sequence
  Peptidyl-prolyl cis-trans isomerase FKBP8 (230-239)
gcccacuaccagagagcugacuucgugcug

SEQ ID NO: 59270 - RNA, 27 nt, Artificial Sequence
  Zinc phosphodiesterase ELAC protein 2 (230-238)
gccaucgcucccauuauagcagccgug

SEQ ID NO: 59271 - RNA, 30 nt, Artificial Sequence
  Sister chromatid cohesion protein PDS5 homolog A (274-283)
gccaucgacccccaccugcuccuuagcgug

SEQ ID NO: 59272 - RNA, 27 nt, Artificial Sequence
  RNA-binding motif, single-stranded-interacting protein 2 (87-95)
gccauccuggacaagaccacaaacaaa

SEQ ID NO: 59273 - RNA, 27 nt, Artificial Sequence
  S-phase kinase-associated protein 1 (53-61)
gccauccugaagaaagugauucagugg

SEQ ID NO: 59274 - RNA, 27 nt, Artificial Sequence
  Importin-11 (662-670)
gccauccugaccacacucauucaccuu

SEQ ID NO: 59275 - RNA, 27 nt, Artificial Sequence
  Probable ATP-dependent RNA helicase DDX5 (466-474)
gccaucaaccccaagcugcuccagcuu

SEQ ID NO: 59276 - RNA, 27 nt, Artificial Sequence
  Mitochondrial fission process protein 1 (94-102)
gccauccccggcuucaccauuaacaga

SEQ ID NO: 59277 - RNA, 33 nt, Artificial Sequence
  Rab GDP dissociation inhibitor beta (163-173)
gccaucuacggcgggaccuauaugcugaacaag

SEQ ID NO: 59278 - RNA, 27 nt, Artificial Sequence
  Protein SHQ1 homolog (400-408)
gcccuggcugaggcacucaaggaagug

SEQ ID NO: 59279 - RNA, 27 nt, Artificial Sequence
  DNA mismatch repair protein Msh2 (789-797)
gcccuggcuaaccagauccccaccgug

SEQ ID NO: 59280 - RNA, 27 nt, Artificial Sequence
  EH domain-containing protein 2 (507-515)
gcccuggcuagccaccucaucgaggca

SEQ ID NO: 59281 - RNA, 27 nt, Artificial Sequence
  Carboxypeptidase Q (122-130)
gcccuggcuagccucaucagauccgug

SEQ ID NO: 59282 - RNA, 27 nt, Artificial Sequence
  serine/threonine-protein phosphatase 2A 65 kDa regulatory subunit A beta isoform isoform e (229-237)
gcccuggcuagcgugaucaugggccuc

SEQ ID NO: 59283 - RNA, 27 nt, Artificial Sequence
  Fidgetin-like protein 1 (133-141)
gcccuggcuagcguggucauccacaag

SEQ ID NO: 59284 - RNA, 27 nt, Artificial Sequence
  Cleavage and polyadenylation specificity factor subunit 1 (195-203)
gcccuggacgagaagcuccuuaacauc

SEQ ID NO: 59285 - RNA, 30 nt, Artificial Sequence
  Serine/threonine-protein kinase 10 (901-910)
gcccuggacgagagccacaaccagaaucuc

SEQ ID NO: 59286 - RNA, 30 nt, Artificial Sequence
  Protein phosphatase 1 regulatory subunit 15B (166-175)
gcccuggaccccgcugcacaggccuuccuc

SEQ ID NO: 59287 - RNA, 33 nt, Artificial Sequence
  Cardiolipin synthase (CMP-forming) (167-177)
gcccuggacccccucgcugauaagauccuuauu

SEQ ID NO: 59288 - RNA, 27 nt, Artificial Sequence
  Splicing regulatory glutamine/lysine-rich protein 1 (152-160)
gcccuggaccccaacaucgcuacccuc

SEQ ID NO: 59289 - RNA, 27 nt, Artificial Sequence
  ATP-binding cassette sub-family A member 7 (273-281)
gcccuggacagccacccccucuccaga

SEQ ID NO: 59290 - RNA, 27 nt, Artificial Sequence
  Ras-related protein Rab-11A (155-163)
gcccuggacagcaccaacguggaggcu

SEQ ID NO: 59291 - RNA, 27 nt, Artificial Sequence
  AT-rich interactive domain-containing protein 1B (1641-1649)
gcccuggacaccaucaacauucuccuu

SEQ ID NO: 59292 - RNA, 30 nt, Artificial Sequence
  SWI/SNF-related matrix-associated actin-dependent regulator of chromatin subfamily A member 5 (920-929)
gcccuggacaccaagaucggcagauacaaa

SEQ ID NO: 59293 - RNA, 27 nt, Artificial Sequence
  Glutamate carboxypeptidase 2 (718-726)
gcccuguucgacaucgagagcaaggug

SEQ ID NO: 59294 - RNA, 33 nt, Artificial Sequence; identical to SEQ ID NO: 35067
  Sodium/potassium-transporting ATPase subunit beta-3 (132-142)

SEQ ID NO: 59295 - RNA, 30 nt, Artificial Sequence
  RING finger protein 214 (467-476)
gcccuguuccccgcuccucucgcacagauc

SEQ ID NO: 59296 - RNA, 27 nt, Artificial Sequence
  Protein disulfide-isomerase A3 (7-15)
gcccuguuccccggcguggcucuccuu

SEQ ID NO: 59297 - RNA, 33 nt, Artificial Sequence
  Exportin-2 (684-694)
gcccuguucccccaccuccuucagccugugcug

SEQ ID NO: 59298 - RNA, 27 nt, Artificial Sequence
  Zinc finger BED domain-containing protein 1 (596-604)
gcccuguucccccuccuuccuaaggug

SEQ ID NO: 59299 - RNA, 27 nt, Artificial Sequence
  UDP-glucuronosyltransferase 1-10 (322-330)
gcccugggcaagaucccccagaccgug

SEQ ID NO: 59300 - RNA, 30 nt, Artificial Sequence; identical to SEQ ID NO: 35073
  Developmentally-regulated GTP-binding protein 2 (66-75)

SEQ ID NO: 59301 - RNA, 27 nt, Artificial Sequence
  Transcription factor Maf (116-124)
gcccugaucagcaacucccaccagcuc

SEQ ID NO: 59302 - RNA, 24 nt, Artificial Sequence
  U3 small nucleolar ribonucleoprotein protein IMP3 (78-85)
gcccugcucgacaagcuuuacgcu

SEQ ID NO: 59303 - RNA, 27 nt, Artificial Sequence
  microtubule-actin cross-linking factor 1 isoform X2  (1652-1660)
gcccugcucgacugggugaccagcguc

SEQ ID NO: 59304 - RNA, 33 nt, Artificial Sequence
  Coatomer subunit zeta-1 (90-100)
gcccugcucgagaacauggaaggccuuuuccug

SEQ ID NO: 59305 - RNA, 30 nt, Artificial Sequence
  Serine/threonine-protein kinase 35 (192-201)
gcccugcucgagaaccccaagauggaacuu

SEQ ID NO: 59306 - RNA, 27 nt, Artificial Sequence
  GRIP and coiled-coil domain-containing protein 2 (277-285)
gcccugcucgagaccgugaacagacuu

SEQ ID NO: 59307 - RNA, 27 nt, Artificial Sequence
  Progestin and adipoQ receptor family member 4 (146-154)
gcccugcucggcgggcuugugaacguc

SEQ ID NO: 59308 - RNA, 33 nt, Artificial Sequence
  Elongation of very long chain fatty acids protein 5 (14-24)
gcccugcucggccccagagacaccagggugaag

SEQ ID NO: 59309 - RNA, 27 nt, Artificial Sequence
  Minor histocompatibility antigen H13 (43-51)
gcccugcuccccaucuucuuuggcgcu

SEQ ID NO: 59310 - RNA, 27 nt, Artificial Sequence
  Transcription factor IIIB 90 kDa subunit (582-590)
gcccugcuccccagcuccccuacccuu

SEQ ID NO: 59311 - RNA, 27 nt, Artificial Sequence
  TAF6-like RNA polymerase II p300/CBP-associated factor-associated factor 65 kDa subunit 6L (191-199)
gcccugcuccccuacuucguguauguc

SEQ ID NO: 59312 - RNA, 27 nt, Artificial Sequence
  Plectin (403-411)
gcccugcuccagagcgacgugagacuu

SEQ ID NO: 59313 - RNA, 27 nt, Artificial Sequence
  RNA-binding protein Raly (187-195)
gcccugcucagcagacuugagcagauc

SEQ ID NO: 59314 - RNA, 27 nt, Artificial Sequence
  Serine/threonine-protein phosphatase 6 regulatory ankyrin repeat subunit B (148-156)
gcccugaacggccacguggagaugguc

SEQ ID NO: 59315 - RNA, 27 nt, Artificial Sequence
  Ankyrin repeat domain-containing protein 27 (605-613)
gcccugaacagcaagauccucuccgug

SEQ ID NO: 59316 - RNA, 27 nt, Artificial Sequence
  Zinc finger protein 148 (107-115)
gcccugaacgugcccaucagcgucaag

SEQ ID NO: 59317 - RNA, 27 nt, Artificial Sequence
  Putative eukaryotic translation initiation factor 2 subunit 3-like protein (363-371)
gcccugcccgagaucuucaccgaacuc

SEQ ID NO: 59318 - RNA, 27 nt, Artificial Sequence
  La-related protein 1 (131-139)
gcccugcccccugugcucaccacaguc

SEQ ID NO: 59319 - RNA, 27 nt, Artificial Sequence
  Importin subunit alpha-5 (339-347)
gcccugcagagccuccuucaccuguug

SEQ ID NO: 59320 - RNA, 27 nt, Artificial Sequence
  Nuclear receptor-interacting protein 1 (745-753)
gcccugagcgagcagauccucauggug

SEQ ID NO: 59321 - RNA, 27 nt, Artificial Sequence
  Glutamate-rich WD repeat-containing protein 1 (434-442)
gcccugagcggcuucaccaucuuuaga

SEQ ID NO: 59322 - RNA, 27 nt, Artificial Sequence
  Fidgetin-like protein 1 (268-276)
gcccugagcaaccccauccucaauaag

SEQ ID NO: 59323 - RNA, 27 nt, Artificial Sequence
  TBC domain-containing protein kinase-like protein (116-124)
gcccugagcccccacaacauccuccuu

SEQ ID NO: 59324 - RNA, 27 nt, Artificial Sequence
  Enhancer of mRNA-decapping protein 4 (739-747)
gcccugagccaggacauccccgagauu

SEQ ID NO: 59325 - RNA, 27 nt, Artificial Sequence
  Quinone oxidoreductase-like protein 1 (41-49)
gcccugagccagaucaacaccaagcuc

SEQ ID NO: 59326 - RNA, 27 nt, Artificial Sequence
  Prelamin-A/C (147-155)
gcccugagcaccgcucucuccgagaag

SEQ ID NO: 59327 - RNA, 27 nt, Artificial Sequence
  Cyclin-dependent kinase 4 (96-104)
gcccugacccccguggucguuacacuc

SEQ ID NO: 59328 - RNA, 27 nt, Artificial Sequence
  Transcription initiation factor TFIID subunit 2 (948-956)
gcccugguggaccagcucuggaagcuu

SEQ ID NO: 59329 - RNA, 27 nt, Artificial Sequence
  Beta-hexosaminidase subunit beta (22-30)
gcccuggugguccagguugcugaggca

SEQ ID NO: 59330 - RNA, 27 nt, Artificial Sequence
  Nesprin-2 (1646-1654)
gcccugugggacaagcucuucaaccuu

SEQ ID NO: 59331 - RNA, 33 nt, Artificial Sequence
  Transmembrane protein 234 (16-26)
gcccuguggggcgggacccagccccuccuuaag

SEQ ID NO: 59332 - RNA, 27 nt, Artificial Sequence
  28S ribosomal protein S29, mitochondrial (267-275)
gcccuguggggcagaaccacacucaag

SEQ ID NO: 59333 - RNA, 27 nt, Artificial Sequence
  Lamin-B receptor (434-442)
gcccuguggaacgaggaagcucuccuu

SEQ ID NO: 59334 - RNA, 27 nt, Artificial Sequence
  CAS1 domain-containing protein 1 (533-541)
gcccuguggccccagaucauucaaaag

SEQ ID NO: 59335 - RNA, 33 nt, Artificial Sequence
  Tetratricopeptide repeat protein 14 (349-359)
gcccuguacgcuaccaagggcagccucaacaaa

SEQ ID NO: 59336 - RNA, 27 nt, Artificial Sequence
  Ubiquitin carboxyl-terminal hydrolase 4 (552-560)
gcccuguacggccagccccuccuucug

SEQ ID NO: 59337 - RNA, 27 nt, Artificial Sequence
  Tyrosine-protein kinase Fyn (383-391)
gcccuguacggcagauucaccaucaag

SEQ ID NO: 59338 - RNA, 27 nt, Artificial Sequence
  Putative ATP-dependent RNA helicase DHX57 (1220-1228)
gcccuguaccccaacgugguccagguu

SEQ ID NO: 59339 - RNA, 27 nt, Artificial Sequence
  Nuclear pore complex protein Nup155 (411-419)
gcccuguacagcaagggcauccuccuu

SEQ ID NO: 59340 - RNA, 27 nt, Artificial Sequence
  Heterogeneous nuclear ribonucleoprotein A0 (64-72)
gccauggcugcaagcccccacgccgug

SEQ ID NO: 59341 - RNA, 27 nt, Artificial Sequence
  Synemin (1524-1532)
gccauguucgacaagaaagugcagcug

SEQ ID NO: 59342 - RNA, 30 nt, Artificial Sequence
  DNA-dependent protein kinase catalytic subunit (1302-1311)
gccaugcacgacaucauugcugcagagaag

SEQ ID NO: 59343 - RNA, 27 nt, Artificial Sequence
  Methionine synthase (186-194)
gccaugcacggcguguuccuguaccau

SEQ ID NO: 59344 - RNA, 27 nt, Artificial Sequence
  Transformation/transcription domain-associated protein (2516-2524)
gccaugcugcccagcaucaccaacgug

SEQ ID NO: 59345 - RNA, 27 nt, Artificial Sequence
  Heterogeneous nuclear ribonucleoprotein A1 (71-79)
gccaugaacgcuagaccccacaaggug

SEQ ID NO: 59346 - RNA, 30 nt, Artificial Sequence
  Double-strand-break repair protein rad21 homolog (467-476)
gccaugcccccuccaccgccccagggcgug

SEQ ID NO: 59347 - RNA, 33 nt, Artificial Sequence
  Biogenesis of lysosome-related organelles complex 1 subunit 3 (99-109)
gcccccgcuccugcaccagccagaagccugcuc

SEQ ID NO: 59348 - RNA, 27 nt, Artificial Sequence
  Solute carrier family 23 member 2 (174-182)
gcccccgcuagagcaauccugagccuc

SEQ ID NO: 59349 - RNA, 27 nt, Artificial Sequence
  ATP-binding cassette sub-family F member 3 (303-311)
gcccccgcuagagcaagcgugauccug

SEQ ID NO: 59350 - RNA, 27 nt, Artificial Sequence
  Syndecan-4 (2-10)
gcccccgcuagacuguucgcacuccuu

SEQ ID NO: 59351 - RNA, 30 nt, Artificial Sequence
  Ankyrin repeat domain-containing protein 11 (1778-1787)
gcccccgcuagaccucugagcaccaaccuc

SEQ ID NO: 59352 - RNA, 27 nt, Artificial Sequence
  Solute carrier family 22 member 18 (145-153)
gcccccgaggaaagaccugcugcacug

SEQ ID NO: 59353 - RNA, 27 nt, Artificial Sequence
  Zinc fingers and homeoboxes protein 2 (415-423)
gcccccgagccuaagagaccacacauc

SEQ ID NO: 59354 - RNA, 30 nt, Artificial Sequence
  Hepatoma-derived growth factor (231-240)
gcccccggcaucagagaccacgagagccug

SEQ ID NO: 59355 - RNA, 30 nt, Artificial Sequence
  Heterogeneous nuclear ribonucleoprotein M (460-469)
gcccccaucgacagagugggccagaccauu

SEQ ID NO: 59356 - RNA, 30 nt, Artificial Sequence; identical to SEQ ID NO: 35129
  Gamma-interferon-inducible protein 16 (685-694)

SEQ ID NO: 59357 - RNA, 30 nt, Artificial Sequence
  Cancer/testis antigen 2 (114-123)
gccccccugccuagaccaggcgcugugcuc

SEQ ID NO: 59358 - RNA, 24 nt, Artificial Sequence
  Talin-1 (1328-1335)
gcccccaaccugaagagccagcuc

SEQ ID NO: 59359 - RNA, 30 nt, Artificial Sequence
  REST corepressor 1 (61-70)
gcccccaacaauggccagaacaagagccug

SEQ ID NO: 59360 - RNA, 27 nt, Artificial Sequence
  Histone deacetylase 6 (706-714)
gccccccagccugcuaagccaagacug

SEQ ID NO: 59361 - RNA, 27 nt, Artificial Sequence
  BAG family molecular chaperone regulator 3 (130-138)
gccccccagagaagccaauccccucug

SEQ ID NO: 59362 - RNA, 27 nt, Artificial Sequence
  Conserved oligomeric Golgi complex subunit 7 (287-295)
gcccccagagcugcacugaccaggcuc

SEQ ID NO: 59363 - RNA, 33 nt, Artificial Sequence
  Protein PRRC2B (1519-1529)
gcccccagagcuggcgagcagggggaagcaaug

SEQ ID NO: 59364 - RNA, 33 nt, Artificial Sequence
  Striatin-4 (219-229)
gcccccagagcuccuccaggcccggcagggcug

SEQ ID NO: 59365 - RNA, 33 nt, Artificial Sequence
  Tricarboxylate transport protein, mitochondrial (3-13)
gcccccagagcuccuagggcacuggccgcggcu

SEQ ID NO: 59366 - RNA, 27 nt, Artificial Sequence
  Actin, gamma-enteric smooth muscle (27-35)
gcccccagagcuguguucccuagcauc

SEQ ID NO: 59367 - RNA, 27 nt, Artificial Sequence
  General transcription factor IIF subunit 2 (77-85)
gcccccagagagcacccuuucgugcug

SEQ ID NO: 59368 - RNA, 33 nt, Artificial Sequence
  Proteasome subunit beta type-8 (9-19)
gcccccagaggccagaggccugagagcgcucug

SEQ ID NO: 59369 - RNA, 30 nt, Artificial Sequence
  40S ribosomal protein S2 (198-207)
gcccccagaggcaccgggaucgugagcgcu

SEQ ID NO: 59370 - RNA, 30 nt, Artificial Sequence
  General transcription factor 3C polypeptide 2 (702-711)
gcccccagaaagggcaccguguggagccug

SEQ ID NO: 59371 - RNA, 27 nt, Artificial Sequence
  Coiled-coil domain-containing protein 12 (108-116)
gcccccagaaagccugacugggaucug

SEQ ID NO: 59372 - RNA, 27 nt, Artificial Sequence
  RNA demethylase ALKBH5 (289-297)
gcccccagacuggagaccaagagccuc

SEQ ID NO: 59373 - RNA, 33 nt, Artificial Sequence
  Phosphatidylinositide phosphatase SAC2 (898-908)
gcccccagacugggcagcaggucccagucucuc

SEQ ID NO: 59374 - RNA, 27 nt, Artificial Sequence
  Structural maintenance of chromosomes protein 4 (79-87)
gcccccagacugaugaucacccacauu

SEQ ID NO: 59375 - RNA, 27 nt, Artificial Sequence
  IST1 homolog (107-115)
gcccccagacugcagagcgagguggcu

SEQ ID NO: 59376 - RNA, 33 nt, Artificial Sequence
  IST1 homolog (107-117)
gcccccagacugcagagcgagguggcugaacuc

SEQ ID NO: 59377 - RNA, 36 nt, Artificial Sequence
  60S ribosomal protein L13 (47-58)
gcccccagaccugcuagcggcccaaucaggccgauu

SEQ ID NO: 59378 - RNA, 33 nt, Artificial Sequence
  Cold shock domain-containing protein E1 (762-772)
gcccccagaccugacaggcuggugaaccggcuc

SEQ ID NO: 59379 - RNA, 33 nt, Artificial Sequence
  tRNA-splicing endonuclease subunit Sen34 (71-81)
gcccccagaccugacagcaggcaccauucccug

SEQ ID NO: 59380 - RNA, 27 nt, Artificial Sequence
  WAS/WASL-interacting protein family member 2 (122-130)
gcccccagaccuccagugagcgcugca

SEQ ID NO: 59381 - RNA, 27 nt, Artificial Sequence
  Rab GTPase-activating protein 1 (88-96)
gcccccagaagcgagguggaagcucug

SEQ ID NO: 59382 - RNA, 33 nt, Artificial Sequence
  HLA class II histocompatibility antigen, DP beta 1 chain (9-19)
gcccccagaaccguggcucugacagcacuccuu

SEQ ID NO: 59383 - RNA, 33 nt, Artificial Sequence
  Protocadherin gamma-C3 (257-267)
gcccccagcggcaccagagugguccagguucug

SEQ ID NO: 59384 - RNA, 30 nt, Artificial Sequence
  Rho GTPase-activating protein 7 (785-794)
gcccccagccuguuccaccucaacacccuu

SEQ ID NO: 59385 - RNA, 33 nt, Artificial Sequence
  Round spermatid basic protein 1-like protein (94-104)
gcccccagcccuuccucuucaagaaguagcuuc

SEQ ID NO: 59386 - RNA, 27 nt, Artificial Sequence
  intercellular adhesion molecule-1
gcccccagcuccccuagaccagcucug

SEQ ID NO: 59387 - RNA, 30 nt, Artificial Sequence
  intercellular adhesion molecule-1 (2-11)
gcccccagcuccccuagaccagcucugccg

SEQ ID NO: 59388 - RNA, 24 nt, Artificial Sequence
  Unconventional myosin-Ic (176-183)
gcccccgugggcgggcacauccug

SEQ ID NO: 59389 - RNA, 27 nt, Artificial Sequence
  Alpha-mannosidase 2C1 (660-668)
gcccccgugccuccaccgaccagccug

SEQ ID NO: 59390 - RNA, 27 nt, Artificial Sequence
  Transcription factor p65 (247-255)
gcccccgugagagucagcaugcagcug

SEQ ID NO: 59391 - RNA, 27 nt, Artificial Sequence
  Serine protease 23 (107-115)
gcccccuggaagccuaccuggccagcu

SEQ ID NO: 59392 - RNA, 27 nt, Artificial Sequence
  Splicing factor, arginine/serine-rich 15 (410-418)
gcccagaacgagccccugacccaaaag

SEQ ID NO: 59393 - RNA, 30 nt, Artificial Sequence
  GTP-binding nuclear protein Ran (215-224)
gcccaguacgagcacgaccuggaaguggcu

SEQ ID NO: 59394 - RNA, 27 nt, Artificial Sequence
  Neuropathy target esterase (279-287)
gccagagacagcaccgugcugaggcuc

SEQ ID NO: 59395 - RNA, 27 nt, Artificial Sequence
  Tubulin epsilon chain (273-281)
gccagauucgagggcagccugaacaug

SEQ ID NO: 59396 - RNA, 27 nt, Artificial Sequence
  Splicing factor 3A subunit 1 (306-314)
gccagaauccugauucaggagagguac

SEQ ID NO: 59397 - RNA, 27 nt, Artificial Sequence
  Dedicator of cytokinesis protein 7 (251-259)
gccagagugaagaugcaggucaccaug

SEQ ID NO: 59398 - RNA, 27 nt, Artificial Sequence
  MICOS complex subunit MIC13 (3-11)
gccagaguguggagccugaugagguuc

SEQ ID NO: 59399 - RNA, 27 nt, Artificial Sequence
  Endonuclease domain-containing 1 protein (4-12)
gccagauggcuggcucucggcagccuu

SEQ ID NO: 59400 - RNA, 27 nt, Artificial Sequence
  Sodium-dependent phosphate transport protein 4 (18-26)
gccagauacggcaucgcucuggugcuc

SEQ ID NO: 59401 - RNA, 33 nt, Artificial Sequence
  Deubiquitinating protein VCIP135 (28-38)
gccagcgcugcagccuccggcgggcugcucaag

SEQ ID NO: 59402 - RNA, 27 nt, Artificial Sequence
  Kinase D-interacting substrate of 220 kDa (763-771)
gccagcgacccccacaucauuauaaag

SEQ ID NO: 59403 - RNA, 30 nt, Artificial Sequence
  Multivesicular body subunit 12A (40-49)
gccagcuucggcaaguccuuugcucagaaa

SEQ ID NO: 59404 - RNA, 33 nt, Artificial Sequence
  Myosin-9 (366-376)
gccagcaugcccgacaacaccgcugcacagaag

SEQ ID NO: 59405 - RNA, 27 nt, Artificial Sequence
  Pro-interleukin-16 (1150-1158)
gccagccaggagggcaccauccaaaag

SEQ ID NO: 59406 - RNA, 27 nt, Artificial Sequence
  Cullin-4B (91-99)
gccagcucccacgugcccauccagaag

SEQ ID NO: 59407 - RNA, 33 nt, Artificial Sequence
  Vimentin (54-64)
gccagcucccccggcgggguguacgcuaccaga

SEQ ID NO: 59408 - RNA, 27 nt, Artificial Sequence
  Heterogeneous nuclear ribonucleoprotein D-like (81-89)
gccagcguggacaagguccuggagcuc

SEQ ID NO: 59409 - RNA, 27 nt, Artificial Sequence
  Gamma-adducin (236-244)
gccaccgcugcagugagcuccaugaag

SEQ ID NO: 59410 - RNA, 30 nt, Artificial Sequence
  Clathrin heavy chain 1 (311-320)
gccaccgcuggcaucauuggggugaacaga

SEQ ID NO: 59411 - RNA, 27 nt, Artificial Sequence
  WD repeat-containing protein 44 (93-101)
gccaccgcuagccccaucguggcaaga

SEQ ID NO: 59412 - RNA, 27 nt, Artificial Sequence
  Nucleotide exchange factor SIL1 (214-222)
gccaccgagcagccccugacagcuaag

SEQ ID NO: 59413 - RNA, 27 nt, Artificial Sequence
  Ankyrin repeat and KH domain-containing protein 1 (1541-1549)
gccaccuucacaaacguguuuggcaag

SEQ ID NO: 59414 - RNA, 30 nt, Artificial Sequence
  Protein artemis (555-564)
gccaccggcgagagcaucgcugugaagaaa

SEQ ID NO: 59415 - RNA, 30 nt, Artificial Sequence; identical to SEQ ID NO: 35188
  Guanine nucleotide-binding protein G(I)/G(S)/G(T) subunit beta-1 (228-237)

SEQ ID NO: 59416 - RNA, 27 nt, Artificial Sequence
  Serine/threonine-protein kinase mTOR (800-808)
gccaccaucggcgagcuggcucaggug

SEQ ID NO: 59417 - RNA, 33 nt, Artificial Sequence
  Interferon regulatory factor 2-binding protein-like (88-98)
gccaccauccuggcuggcgacgugaaggucaaa

SEQ ID NO: 59418 - RNA, 27 nt, Artificial Sequence
  Protein FAM76B (209-217)
gccaccauccagaacgagacacccaag

SEQ ID NO: 59419 - RNA, 33 nt, Artificial Sequence
  Paired amphipathic helix protein Sin3a (628-638)
gccaccaucagagugcuggaggcuauucagaag

SEQ ID NO: 59420 - RNA, 36 nt, Artificial Sequence
  T-complex protein 1 subunit eta (44-55)
gccaccaucagcaacgacggcgcuacaauucugaag

SEQ ID NO: 59421 - RNA, 27 nt, Artificial Sequence
  Hexokinase-1 (356-364)
gccacccugggcgcuauccucaacaga

SEQ ID NO: 59422 - RNA, 27 nt, Artificial Sequence
  Nuclear mitotic apparatus protein 1 (150-158)
gccacccugcaggaggcucucgcacac

SEQ ID NO: 59423 - RNA, 27 nt, Artificial Sequence
  Cytoplasmic dynein 1 heavy chain 1 (3080-3088)
gccaccagccccgcucuguucaacaga

SEQ ID NO: 59424 - RNA, 30 nt, Artificial Sequence
  Isoaspartyl peptidase/L-asparaginase (183-192)
gccaccagcacaggcgggaucgugaacaag

SEQ ID NO: 59425 - RNA, 27 nt, Artificial Sequence
  Ankyrin repeat domain-containing protein 17 (653-661)
gccaccacacugcccaucagaaacaag

SEQ ID NO: 59426 - RNA, 33 nt, Artificial Sequence
  Alsin (409-419)
gccaccuacgaggcuggcgcacugagccucaag

SEQ ID NO: 59427 - RNA, 30 nt, Artificial Sequence
  Chromobox protein homolog 2 (418-427)
gccguggcucccccuaccccagcaagcaag

SEQ ID NO: 59428 - RNA, 36 nt, Artificial Sequence
  Guanine nucleotide-binding protein G(I)/G(S)/G(T) subunit beta-2 (326-337)
gccguggcuaccggcagcugggacuccuuccugaag

SEQ ID NO: 59429 - RNA, 30 nt, Artificial Sequence
  Cilia- and flagella-associated protein 97 (505-514)
gccguggaccccagcuccggccacccuaga

SEQ ID NO: 59430 - RNA, 36 nt, Artificial Sequence; identical to SEQ ID NO: 35203
  Heme-binding protein 1 (85-96)

SEQ ID NO: 59431 - RNA, 27 nt, Artificial Sequence
  SCY1-like protein 2 (22-30)
gccgugaugggcaaccccgucaccaga

SEQ ID NO: 59432 - RNA, 27 nt, Artificial Sequence
  PH domain leucine-rich repeat-containing protein phosphatase 1 (285-293)
gccgugagaaacguccccgacgcucug

SEQ ID NO: 59433 - RNA, 33 nt, Artificial Sequence
  Histone H2B type 1-A (112-122)
gccgugagcgagggcaccaaggcugucacaaaa

SEQ ID NO: 59434 - RNA, 27 nt, Artificial Sequence
  E3 ubiquitin-protein ligase RNF123 (619-627)
gccgugaccggcauccugguccagcuc

SEQ ID NO: 59435 - RNA, 27 nt, Artificial Sequence
  Transcription termination factor 1 (809-817)
gccguguacguccccuucuggcagaag

SEQ ID NO: 59436 - RNA, 27 nt, Artificial Sequence
  Tyrosine-protein kinase Fyn (324-332)
gccuacaucgagagaaugaacuauauu

SEQ ID NO: 59437 - RNA, 27 nt, Artificial Sequence
  COP9 signalosome complex subunit 4 (165-173)
gccuacaucaacagagcuagccugcuc

SEQ ID NO: 59438 - RNA, 27 nt, Artificial Sequence
  UDP-N-acetylglucosamine-peptide N-acetylglucosaminyltransferase 110 kDa subunit (697-705)
gccuacaugccccacaccuucuuuauc

SEQ ID NO: 59439 - RNA, 27 nt, Artificial Sequence
  Translocating chain-associated membrane protein 1 (155-163)
gccuacccccacaaccugaugaccuuc

SEQ ID NO: 59440 - RNA, 27 nt, Artificial Sequence
  Dihydropyrimidine dehydrogenase (NADP(+)) (185-193)
gccuacagcgcuaagaucgcacuguuc

SEQ ID NO: 59441 - RNA, 27 nt, Artificial Sequence
  Double-stranded RNA-binding protein Staufen homolog 1 (70-78)
gacgccgcugcaaaggcccugagaauc

SEQ ID NO: 59442 - RNA, 24 nt, Artificial Sequence
  Minor histocompatibility antigen H13 (74-81)
gacgccgcuagauuccccaucauu

SEQ ID NO: 59443 - RNA, 27 nt, Artificial Sequence
  Conserved oligomeric Golgi complex subunit 2 (338-346)
gacgccuuccacgagaaguacaccauc

SEQ ID NO: 59444 - RNA, 24 nt, Artificial Sequence
  AP-2 complex subunit mu (30-37)
gacgccuucagagugaacgucauc

SEQ ID NO: 59445 - RNA, 27 nt, Artificial Sequence
  UDP-N-acetylglucosamine-peptide N-acetylglucosaminyltransferase 110 kDa subunit (430-438)
gacgcccacagcaaccuggcuuccauc

SEQ ID NO: 59446 - RNA, 24 nt, Artificial Sequence
  Neurobeachin-like protein 2 (378-385)
gacgccaucgcugugcacgucguu

SEQ ID NO: 59447 - RNA, 27 nt, Artificial Sequence
  Rho-associated protein kinase 2 (203-211)
gacgccauccacagcaugggccugauu

SEQ ID NO: 59448 - RNA, 27 nt, Artificial Sequence
  Ubiquitin carboxyl-terminal hydrolase 22 (496-504)
gacgccaucauuaccaaggcuagcaua

SEQ ID NO: 59449 - RNA, 27 nt, Artificial Sequence
  NF-kappa-B essential modulator (63-71)
gacgccaucagacagagcaaccaaauu

SEQ ID NO: 59450 - RNA, 24 nt, Artificial Sequence
  Uncharacterized protein C1orf43 (108-115)
gacgccaucagaaccagcgagauu

SEQ ID NO: 59451 - RNA, 27 nt, Artificial Sequence
  Enhancer of filamentation 1 (541-549)
gacgccaagcagcugaccacaacuauc

SEQ ID NO: 59452 - RNA, 27 nt, Artificial Sequence
  Endoplasmin (89-97)
gacgcccuggauaagaucagacucauu

SEQ ID NO: 59453 - RNA, 27 nt, Artificial Sequence
  60S ribosomal protein L23a (145-153)
gacgcccuggauguggcuaacaagauc

SEQ ID NO: 59454 - RNA, 27 nt, Artificial Sequence
  Peroxisome proliferator activated receptor interacting complex protein (2369-2377)
gacgcccugggcaagcucaucagcauu

SEQ ID NO: 59455 - RNA, 24 nt, Artificial Sequence
  S-adenosylmethionine synthase isoform type-2 (220-227)
gacgcccugaaggagaaagugauc

SEQ ID NO: 59456 - RNA, 27 nt, Artificial Sequence
  Microtubule-actin cross-linking factor 1, isoforms 1/2/3/5 (533-541)
gacgcccugaaggugaucaacaaaguc

SEQ ID NO: 59457 - RNA, 27 nt, Artificial Sequence
  Bax inhibitor 1 (57-65)
gacgcccugcucaaguucagccacauc

SEQ ID NO: 59458 - RNA, 27 nt, Artificial Sequence
  Spectrin beta chain, non-erythrocytic 1 (949-957)
gacgcccugcucagcgcucuuuccauc

SEQ ID NO: 59459 - RNA, 24 nt, Artificial Sequence
  Protein FAM179B (198-205)
gacgcccugcagauccuccacauu

SEQ ID NO: 59460 - RNA, 24 nt, Artificial Sequence
  Isoleucine-tRNA ligase, cytoplasmic (621-628)
gacgcccugagacucuaccuuauc

SEQ ID NO: 59461 - RNA, 27 nt, Artificial Sequence
  Programmed cell death protein 4 (72-80)
gacgcccugagaagcggccucaccgug

SEQ ID NO: 59462 - RNA, 27 nt, Artificial Sequence
  Methionine-tRNA ligase, cytoplasmic (281-289)
gacgcccugagaagcauccucaccauu

SEQ ID NO: 59463 - RNA, 27 nt, Artificial Sequence
  ATP synthase subunit alpha, mitochondrial (164-172)
gacgccaugaaguacaccaucgugguc

SEQ ID NO: 59464 - RNA, 27 nt, Artificial Sequence
  Plectin (246-254)
gacgccaugcccagagugccugauguc

SEQ ID NO: 59465 - RNA, 24 nt, Artificial Sequence
  Cyclic AMP-responsive element-binding protein 1 (144-151)
gacgcccccggcgugccuagaauc

SEQ ID NO: 59466 - RNA, 27 nt, Artificial Sequence
  Putative Polycomb group protein ASXL1 (26-34)
gacgcccccaugaccccuaagcagauc

SEQ ID NO: 59467 - RNA, 27 nt, Artificial Sequence
  NEDD4 family-interacting protein 1 (37-45)
gacgcccccccuccauacagcuccauc

SEQ ID NO: 59468 - RNA, 24 nt, Artificial Sequence
  E3 ubiquitin-protein ligase MGRN1 (127-134)
gacgccagaguggcuaucaccauu

SEQ ID NO: 59469 - RNA, 27 nt, Artificial Sequence
  HLA class I histocompatibility antigen, A-1 alpha chain (115-123)
gacgccuacgauggcaaggacuauauc

SEQ ID NO: 59470 - RNA, 24 nt, Artificial Sequence
  Probable ATP-dependent RNA helicase DDX49 (232-239)
gacgccuaccuggugcaccucauc

SEQ ID NO: 59471 - RNA, 27 nt, Artificial Sequence
  Endothelin-converting enzyme 1 (30-38)
gacgccuaccccaacggccugcaggug

SEQ ID NO: 59472 - RNA, 27 nt, Artificial Sequence
  Cohesin subunit SA-2 (683-691)
gacgccuaccaggugcugagcacccuc

SEQ ID NO: 59473 - RNA, 27 nt, Artificial Sequence
  Torsin-1A-interacting protein 1 (432-440)
gacgccuacagcuccuucagaucugug

SEQ ID NO: 59474 - RNA, 27 nt, Artificial Sequence
  ATP-binding cassette sub-family E member 1 (434-442)
gacgccuacacccacccccaguucgug

SEQ ID NO: 59475 - RNA, 27 nt, Artificial Sequence
  Talin-1 (1943-1951)
gacgccuacaccaagaaagagcugauc

SEQ ID NO: 59476 - RNA, 27 nt, Artificial Sequence
  Gelsolin (93-101)
gacgccuacgugauccugaagaccguc

SEQ ID NO: 59477 - RNA, 24 nt, Artificial Sequence
  40S ribosomal protein S26 (60-67)
gacgccuacgugcugcccaagcuc

SEQ ID NO: 59478 - RNA, 27 nt, Artificial Sequence
  40S ribosomal protein S26 (60-68)
gacgccuacgugcugcccaagcucuau

SEQ ID NO: 59479 - RNA, 27 nt, Artificial Sequence
  Intraflagellar transport protein 25 homolog (124-132)
gaccacuucgccagcgugcauuccguc

SEQ ID NO: 59480 - RNA, 27 nt, Artificial Sequence
  Vacuolar protein sorting-associated protein 13A (1926-1934)
gaccacuucaacgccaugaccagccug

SEQ ID NO: 59481 - RNA, 27 nt, Artificial Sequence
  Cytoplasmic FMR1-interacting protein 2 (355-363)
gaccacaucagauucauuagcgagcug

SEQ ID NO: 59482 - RNA, 27 nt, Artificial Sequence
  Protein zer-1 homolog (237-245)
gaccacaucagagugauuguccagcug

SEQ ID NO: 59483 - RNA, 27 nt, Artificial Sequence
  Cytoplasmic FMR1-interacting protein 1 (355-363)
gaccacaugagauucaucagcgagcug

SEQ ID NO: 59484 - RNA, 30 nt, Artificial Sequence
  60S ribosomal protein L9 (11-20)
gacauccccgagaacguggauauuacccug

SEQ ID NO: 59485 - RNA, 27 nt, Artificial Sequence
  5'-3' exoribonuclease 1 (835-843)
gacaucagagccuucgauagcagguuu

SEQ ID NO: 59486 - RNA, 30 nt, Artificial Sequence
  MAX gene-associated protein (126-135)
gacaucagccccguggauaaccacagauac

SEQ ID NO: 59487 - RNA, 30 nt, Artificial Sequence
  Protein MAK16 homolog (177-186)
gacaucuacaacuuccccauucacgccuuu

SEQ ID NO: 59488 - RNA, 27 nt, Artificial Sequence
  DNA-directed RNA polymerases I, II, and III subunit RPABC5 (54-62)
gaccugaucgagaagcuccuuaacuac

SEQ ID NO: 59489 - RNA, 27 nt, Artificial Sequence
  TAR DNA-binding protein 43 (128-136)
gaccugaucauuaagggcauaagcgug

SEQ ID NO: 59490 - RNA, 27 nt, Artificial Sequence
  Arf-GAP with Rho-GAP domain, ANK repeat and PH domain-containing protein 3 (271-279)
gaccugaucagccccuacgccuccuuc

SEQ ID NO: 59491 - RNA, 27 nt, Artificial Sequence
  V-type proton ATPase subunit C 1 (62-70)
gaccuggugaccuacaucacaagauuc

SEQ ID NO: 59492 - RNA, 27 nt, Artificial Sequence
  Lysine-specific demethylase 5B (44-52)
gaccccuucgccuuuauccacaagauu

SEQ ID NO: 59493 - RNA, 27 nt, Artificial Sequence
  116 kDa U5 small nuclear ribonucleoprotein component (910-918)
gacccccuggauaagagcaucgugauu

SEQ ID NO: 59494 - RNA, 27 nt, Artificial Sequence
  Signal recognition particle 9 kDa protein (21-29)
gaccccaugaaggccagagugguccug

SEQ ID NO: 59495 - RNA, 27 nt, Artificial Sequence
  Probable 28S rRNA (cytosine-C(5))-methyltransferase (223-231)
gaccccccuccaggcagccacgugauc

SEQ ID NO: 59496 - RNA, 27 nt, Artificial Sequence
  Protein BTG2 (105-113)
gaccccuacgaggugagcuauagaauc

SEQ ID NO: 59497 - RNA, 27 nt, Artificial Sequence
  Small integral membrane protein 15 (18-26)
gaccccuacggcuuccugaccacagug

SEQ ID NO: 59498 - RNA, 27 nt, Artificial Sequence
  Serine/threonine-protein kinase mTOR (895-903)
gaccccuacaagcacaaagugaacauc

SEQ ID NO: 59499 - RNA, 24 nt, Artificial Sequence
  Serine/threonine-protein kinase tousled-like 2 (715-722)
gaccccuaccugcucccucacauc

SEQ ID NO: 59500 - RNA, 24 nt, Artificial Sequence
  AP-3 complex subunit delta-1 isoform 3 (706-713)
gaccccuacagagcccuggauauc

SEQ ID NO: 59501 - RNA, 24 nt, Artificial Sequence
  DnaJ homolog subfamily C member 16 (29-36)
gaccccuacagagugcugggcguc

SEQ ID NO: 59502 - RNA, 30 nt, Artificial Sequence
  CSC1-like protein 1 (174-183)
gaccccuacagcuucggcagaaccacaauc

SEQ ID NO: 59503 - RNA, 27 nt, Artificial Sequence
  Nuclear pore membraneoprotein 210 (430-438)
gaccaggauggcggggugcacauccug

SEQ ID NO: 59504 - RNA, 27 nt, Artificial Sequence
  Ubiquitin carboxyl-terminal hydrolase 7 (365-373)
gacagauucgaguuucccgaacagcug

SEQ ID NO: 59505 - RNA, 30 nt, Artificial Sequence
  39S ribosomal protein L38, mitochondrial (371-380)
gacagccacgagcccaccuacggcaucuau

SEQ ID NO: 59506 - RNA, 30 nt, Artificial Sequence
  Golgin subfamily A member 2 (517-526)
gacaccaucggcgaguacauugcccuguau

SEQ ID NO: 59507 - RNA, 30 nt, Artificial Sequence
  N-alpha-acetyltransferase 25, NatB auxiliary subunit (540-549)
gacaccaucggcuaccugcucacaagauau

SEQ ID NO: 59508 - RNA, 27 nt, Artificial Sequence
  E3 ubiquitin-protein ligase RNF213 (545-553)
gacaccaucaaccugaauagcuucuuu

SEQ ID NO: 59509 - RNA, 27 nt, Artificial Sequence
  Gamma-interferon-inducible protein 16 (447-455)
gacaccaucagcaagaugaacgauuuc

SEQ ID NO: 59510 - RNA, 27 nt, Artificial Sequence
  ADP-ribosylation factor-like protein 2 (42-50)
gacaccaucagccccacacugggcuuc

SEQ ID NO: 59511 - RNA, 27 nt, Artificial Sequence
  Protein Asterix (74-82)
gacaccaagcagaugaugagcuccuuc

SEQ ID NO: 59512 - RNA, 27 nt, Artificial Sequence
  Long-chain-fatty-acid-CoA ligase 3 (86-94)
gacacccuggauaagguguucacauac

SEQ ID NO: 59513 - RNA, 33 nt, Artificial Sequence
  Heterogeneous nuclear ribonucleoprotein A3 (178-188)
gacaccguggauaagaucgucguucagaaauac

SEQ ID NO: 59514 - RNA, 27 nt, Artificial Sequence
  Protein SDE2 homolog (60-68)
gacaccgugcagcacggcgccgucuac

SEQ ID NO: 59515 - RNA, 33 nt, Artificial Sequence
  Heterogeneous nuclear ribonucleoprotein A0 (108-118)
gacguggccgagggcgaucugaucgaacacuuc

SEQ ID NO: 59516 - RNA, 33 nt, Artificial Sequence
  Small ubiquitin-related modifier 2 isoform b precursor (61-71)
gacguguuccagcaacagaccggcggggucuac

SEQ ID NO: 59517 - RNA, 30 nt, Artificial Sequence
  Dapper homolog 1 (245-254)
gacgugaucgccgaugucaaccccaaguac

SEQ ID NO: 59518 - RNA, 33 nt, Artificial Sequence; identical to SEQ ID NO: 35291
  Transmembrane protein 64 (301-311)

SEQ ID NO: 59519 - RNA, 30 nt, Artificial Sequence
  60S acidic ribosomal protein P2 (53-62)
gacgugaucgcccagggcauugggaagcug

SEQ ID NO: 59520 - RNA, 27 nt, Artificial Sequence
  Transcription factor EB (253-261)
gacgugaucgauaacauuaugagacug

SEQ ID NO: 59521 - RNA, 27 nt, Artificial Sequence
  Nipped-B-like protein (1331-1339)
gacgugaucgagagagucauucaguac

SEQ ID NO: 59522 - RNA, 27 nt, Artificial Sequence
  Magnesium transporter NIPA2 (278-286)
gacgugaucggcacccugagcggguuc

SEQ ID NO: 59523 - RNA, 27 nt, Artificial Sequence
  DnaJ homolog subfamily C member 8 (26-34)
gacgugauccaggccggcaaggaguac

SEQ ID NO: 59524 - RNA, 27 nt, Artificial Sequence
  Mitochondrial import receptor subunit TOM5 homolog (23-31)
gacgugaucagcuccauuagaaacuuc

SEQ ID NO: 59525 - RNA, 27 nt, Artificial Sequence
  Membrane-bound transcription factor site-2 protease (264-272)
gacgugaaggaucugaucggcuucuuu

SEQ ID NO: 59526 - RNA, 27 nt, Artificial Sequence
  E3 ubiquitin-protein ligase RNF213 (4145-4153)
gacgugaaggauuacauccaggaguau

SEQ ID NO: 59527 - RNA, 33 nt, Artificial Sequence
  Pre-mRNA-processing-splicing factor 8 (1650-1660)
gacgugauggauagcaccacaacucagaaguac

SEQ ID NO: 59528 - RNA, 27 nt, Artificial Sequence
  Coiled-coil domain-containing protein 134 (67-75)
gacgugaugcugaagggccucuucaaa

SEQ ID NO: 59529 - RNA, 30 nt, Artificial Sequence
  Dipeptidyl peptidase 9 (772-781)
gacgugcccgagaacaaucagcacggcuac

SEQ ID NO: 59530 - RNA, 27 nt, Artificial Sequence
  Vimentin (271-279)
gacgugagacagcaauacgagagcguc

SEQ ID NO: 59531 - RNA, 27 nt, Artificial Sequence
  Src substrate cortactin (289-297)
gacgugacccaggucagcuccgccuac

SEQ ID NO: 59532 - RNA, 27 nt, Artificial Sequence
  Kynurenine 3-monooxygenase (252-260)
gacguggucgauuucuuucagaaguac

SEQ ID NO: 59533 - RNA, 33 nt, Artificial Sequence
  Vigilin (521-531)
gacguggucgauagcgaggcccugcagguuuac

SEQ ID NO: 59534 - RNA, 27 nt, Artificial Sequence
  Clathrin heavy chain 1 (271-279)
gacguggucuuccugaucaccaaguac

SEQ ID NO: 59535 - RNA, 27 nt, Artificial Sequence
  Peptidyl-prolyl cis-trans isomerase F, mitochondrial (179-187)
gacguggucaagaaaaucgagagcuuc

SEQ ID NO: 59536 - RNA, 27 nt, Artificial Sequence
  GH3 domain-containing protein (366-374)
gacguggucagaguugugggcgccuac

SEQ ID NO: 59537 - RNA, 30 nt, Artificial Sequence
  MAP kinase-activated protein kinase 2 (122-131)
gacguguacgagaaccuguaugccggcaga

SEQ ID NO: 59538 - RNA, 30 nt, Artificial Sequence
  AF4/FMR2 family member 1 (32-41)
gaggccuuccccgaaaagaucccucuguuu

SEQ ID NO: 59539 - RNA, 27 nt, Artificial Sequence
  Protein SHQ1 homolog (207-215)
gaggccaucgaacagauucugaaguac

SEQ ID NO: 59540 - RNA, 27 nt, Artificial Sequence
  Condensin complex subunit 1 (636-644)
gaggccaucggcauuauaagcaagaug

SEQ ID NO: 59541 - RNA, 27 nt, Artificial Sequence
  Protein transport protein Sec16A (1405-1413)
gaggccauccagagaaccgaagcuuac

SEQ ID NO: 59542 - RNA, 27 nt, Artificial Sequence
  Trafficking protein particle complex subunit 9 (320-328)
gaggccaucagcuacuauuccaaguac

SEQ ID NO: 59543 - RNA, 24 nt, Artificial Sequence
  Heat shock cognate 71 kDa protein (88-95)
gaggccuaccugggcaagaccgug

SEQ ID NO: 59544 - RNA, 27 nt, Artificial Sequence
  Calcineurin B homologous protein 1 (15-23)
gaggaaaucaagaaagagaccggcuuc

SEQ ID NO: 59545 - RNA, 27 nt, Artificial Sequence
  Protein diaphanous homolog 1 (941-949)
gaggaacugagaaagagcgaguccuuc

SEQ ID NO: 59546 - RNA, 27 nt, Artificial Sequence
  Plectin (1635-1643)
gaggaaguggcccagcaaaagagccug

SEQ ID NO: 59547 - RNA, 27 nt, Artificial Sequence
  Poly(ADP-ribose)ohydrolase ARH3 (12-20)
gagggccuggccagaccccucccucuu

SEQ ID NO: 59548 - RNA, 27 nt, Artificial Sequence
  Mitochondrial enolase superfamily member 1 (393-401)
gagcacuucaaguaccccgugaugauc

SEQ ID NO: 59549 - RNA, 27 nt, Artificial Sequence
  TERF1-interacting nuclear factor 2 (29-37)
gagcacuuccccagagugcuggaauuu

SEQ ID NO: 59550 - RNA, 33 nt, Artificial Sequence
  Basigin (50-60)
gagcacaucaacgaaggcgagaccgccaugcug

SEQ ID NO: 59551 - RNA, 27 nt, Artificial Sequence
  Prefoldin subunit 2 (53-61)
gagcacagccuggugaucgacacccuc

SEQ ID NO: 59552 - RNA, 27 nt, Artificial Sequence
  Regulator of microtubule dynamics protein 3 (350-358)
gagcacguggacaaggccaucgcucug

SEQ ID NO: 59553 - RNA, 27 nt, Artificial Sequence
  E3 ubiquitin-protein ligase MARCH6 (288-296)
gagcacguguucugggucguuagccug

SEQ ID NO: 59554 - RNA, 27 nt, Artificial Sequence
  Early endosome antigen 1 (171-179)
gagaucgccgacauuaagagcaaauac

SEQ ID NO: 59555 - RNA, 27 nt, Artificial Sequence
  Heat shock 70 kDa protein 1B (129-137)
gagaucgccgaagcuuaccugggcuau

SEQ ID NO: 59556 - RNA, 27 nt, Artificial Sequence
  Pumilio homolog 1 (848-856)
gagaucgccggccacauuauggaauuc

SEQ ID NO: 59557 - RNA, 30 nt, Artificial Sequence
  GMP synthase (glutamine-hydrolyzing) (148-157)
gagaucuucccccuggaaaccccugccuuu

SEQ ID NO: 59558 - RNA, 33 nt, Artificial Sequence
  ATP synthase subunit g, mitochondrial (91-101)
gagaucauuggcaagagagggauaaucggauac

SEQ ID NO: 59559 - RNA, 27 nt, Artificial Sequence
  Serine/threonine-protein kinase 4 (69-77)
gagaucauuaaggaaauaagcaucaug

SEQ ID NO: 59560 - RNA, 27 nt, Artificial Sequence
  Protein furry homolog-like (472-480)
gagaucauuaagauaaucggcaaauac

SEQ ID NO: 59561 - RNA, 27 nt, Artificial Sequence
  Arf-GAP with SH3 domain, ANK repeat and PH domain-containing protein 2 (422-430)
gagaucauuagcgaagugcagagaaug

SEQ ID NO: 59562 - RNA, 27 nt, Artificial Sequence
  Structural maintenance of chromosomes flexible hinge domain-containing protein 1 (760-768)
gagaucauuagccacauaucccagcau

SEQ ID NO: 59563 - RNA, 27 nt, Artificial Sequence
  Vacuolar protein sorting-associated protein 13C (916-924)
gagaucaaggaagugauucuggaguuc

SEQ ID NO: 59564 - RNA, 27 nt, Artificial Sequence
  Pre-mRNA-processing-splicing factor 8 (2006-2014)
gagaucagagacauuauacugggcaug

SEQ ID NO: 59565 - RNA, 30 nt, Artificial Sequence
  Filamin A (106-115)
gagaucguggaaggcgagaaccacaccuac

SEQ ID NO: 59566 - RNA, 27 nt, Artificial Sequence
  Putative elongation factor 1-alpha-like 3 (169-177)
gagaucgugaaggaagucagcaccuac

SEQ ID NO: 59567 - RNA, 30 nt, Artificial Sequence
  Bifunctional 3'-phosphoadenosine 5'-phosphosulfate synthase 1 (555-564)
gagaucgugcccuucagagucgccgcuuac

SEQ ID NO: 59568 - RNA, 30 nt, Artificial Sequence
  Splicing factor 3B subunit 1 (42-51)
gagaucuacggcgggagcgacuccagauuc

SEQ ID NO: 59569 - RNA, 27 nt, Artificial Sequence
  Protein SET (73-81)
gagcugaucgccaagauucccaacuuc

SEQ ID NO: 59570 - RNA, 27 nt, Artificial Sequence
  Protein CMSS1 (152-160)
gagcugaucagaagcaugaccgccuuc

SEQ ID NO: 59571 - RNA, 24 nt, Artificial Sequence
  Beta-lactamase-like protein 2 (240-247)
gagcuggugaagaucauuuacaaa

SEQ ID NO: 59572 - RNA, 27 nt, Artificial Sequence
  Structural maintenance of chromosomes flexible hinge domain-containing protein 1 (1904-1912)
gagcagaucgaccugcuccaacaguac

SEQ ID NO: 59573 - RNA, 33 nt, Artificial Sequence
  Glutamine-fructose-6-phosphate aminotransferase (isomerizing) 1 (443-453)
gagaccgccgacacacugaugggccucagauac

SEQ ID NO: 59574 - RNA, 27 nt, Artificial Sequence
  Ezrin (109-117)
gagaccgccgugcugcucggcagcuac

SEQ ID NO: 59575 - RNA, 30 nt, Artificial Sequence
  Mediator of RNA polymerase II transcription subunit 13 (1609-1618)
gagaccuucggcgaagccgggcagaaguac

SEQ ID NO: 59576 - RNA, 33 nt, Artificial Sequence
  A-kinase anchor protein 13 (546-556)
gagaccuucggcggguuugacagccaccagaug

SEQ ID NO: 59577 - RNA, 30 nt, Artificial Sequence
  DnaJ homolog subfamily C member 7 (29-38)
gagaccuucaaggaacagggcaacgccuac

SEQ ID NO: 59578 - RNA, 27 nt, Artificial Sequence
  ERO1-like protein alpha (51-59)
gagaccaucgacagauucaacaauuac

SEQ ID NO: 59579 - RNA, 30 nt, Artificial Sequence
  Protein SLX4IP (47-56)
gagaccaucgacagcagagugcaggaauac

SEQ ID NO: 59580 - RNA, 27 nt, Artificial Sequence
  Pre-mRNA-processing-splicing factor 8 (1612-1620)
gagaccauccaccccagaaagagcuac

SEQ ID NO: 59581 - RNA, 27 nt, Artificial Sequence
  Far upstream element-binding protein 1 (396-404)
gagaccaucaagagcauuucccagcaa

SEQ ID NO: 59582 - RNA, 27 nt, Artificial Sequence
  Vacuolar protein sorting-associated protein 8 homolog (1056-1064)
gagaccauccagauuacacaaaaguac

SEQ ID NO: 59583 - RNA, 27 nt, Artificial Sequence
  RING finger protein 145 (166-174)
gagaccaucgugauuauaaacaaguuc

SEQ ID NO: 59584 - RNA, 30 nt, Artificial Sequence; identical to SEQ ID NO: 35357
  RNA polymerase-associated protein CTR9 homolog (376-385)

SEQ ID NO: 59585 - RNA, 30 nt, Artificial Sequence
  Protein phosphatase 1 regulatory subunit 12A (825-834)
gagacccagacagacagcaucuccagauac

SEQ ID NO: 59586 - RNA, 30 nt, Artificial Sequence
  WD repeat-containing protein 11 (1019-1028)
gagaccagcgccgacaaccagcacuacuau

SEQ ID NO: 59587 - RNA, 33 nt, Artificial Sequence
  Heterogeneous nuclear ribonucleoproteins A2/B1 (19-29)
gagaccacagaagagagccugagaaacuacuau

SEQ ID NO: 59588 - RNA, 33 nt, Artificial Sequence
  Constitutive coactivator of PPAR-gamma-like protein 1 (893-903)
gagaccguggccacaggccccuacagagcuuuc

SEQ ID NO: 59589 - RNA, 30 nt, Artificial Sequence
  Type II inositol 1,4,5-trisphosphate 5-phosphatase (190-199)
gagaccgugggcacagggaucaugggaaga

SEQ ID NO: 59590 - RNA, 27 nt, Artificial Sequence
  HLA class II histocompatibility antigen, DR alpha chain (35-43)
gagaccguguggagacuggaagaguuc

SEQ ID NO: 59591 - RNA, 27 nt, Artificial Sequence
  Spectrin alpha chain, non-erythrocytic 1 (648-656)
gagguggccgcuagaaugaacgaaguc

SEQ ID NO: 59592 - RNA, 27 nt, Artificial Sequence
  Heterogeneous nuclear ribonucleoprotein M (10-18)
gagguggccgcuaccgaaaucaagaug

SEQ ID NO: 59593 - RNA, 30 nt, Artificial Sequence
  Transmembrane anterior posterior transformation protein 1 homolog (204-213)
gagguggccgacagacuguucagcuccuuu

SEQ ID NO: 59594 - RNA, 27 nt, Artificial Sequence
  Tankyrase-2 (792-800)
gagguggccgaauaccugcuccagcac

SEQ ID NO: 59595 - RNA, 27 nt, Artificial Sequence
  Nuclear pore membraneoprotein 210 (776-784)
gagguggccggccaccugagaaccuac

SEQ ID NO: 59596 - RNA, 30 nt, Artificial Sequence
  Nucleoprotein TPR (1215-1224)
gagguggcccaggucgaaagccugagauac

SEQ ID NO: 59597 - RNA, 27 nt, Artificial Sequence
  Glutamyl-tRNA(Gln) amidotransferase subunit A, mitochondrial (334-342)
gagguggccagcaacauggcuagauuc

SEQ ID NO: 59598 - RNA, 30 nt, Artificial Sequence
  Rho guanine nucleotide exchange factor 1 (666-675)
gagguggccaccgaccacaaggcuuucuac

SEQ ID NO: 59599 - RNA, 30 nt, Artificial Sequence
  Disheveled-associated activator of morphogenesis 1 (1034-1043)
gagguguucgacaaggaucugagcaaacuc

SEQ ID NO: 59600 - RNA, 30 nt, Artificial Sequence; identical to SEQ ID NO: 35373
  Fatty acyl-CoA reductase 1 (146-155)

SEQ ID NO: 59601 - RNA, 30 nt, Artificial Sequence; identical to SEQ ID NO: 35374
  G1/S-specific cyclin-D2 (75-84)

SEQ ID NO: 59602 - RNA, 30 nt, Artificial Sequence
  Uncharacterized protein ZMYM6NB (45-54)
gagguguucccccugaaggucuuuggcuac

SEQ ID NO: 59603 - RNA, 30 nt, Artificial Sequence
  Mitotic spindle assembly checkpoint protein MAD1 (619-628)
gagguguuccagaccaagauccaagaauuu

SEQ ID NO: 59604 - RNA, 27 nt, Artificial Sequence
  Zinc finger and BTB domain-containing protein 38 (82-90)
gagguguucaccgaaauccugaacuac

SEQ ID NO: 59605 - RNA, 27 nt, Artificial Sequence
  Peroxisomal multifunctional enzyme type 2 (214-222)
gaggugggcgccggguggaucggaaag

SEQ ID NO: 59606 - RNA, 27 nt, Artificial Sequence
  Chromodomain-helicase-DNA-binding protein 1-like (232-240)
gaggugggcgacuucauccagagauac

SEQ ID NO: 59607 - RNA, 27 nt, Artificial Sequence
  PERQ amino acid-rich with GYF domain-containing protein 2 (1163-1171)
gaggugcacgacuacaucagagccuau

SEQ ID NO: 59608 - RNA, 30 nt, Artificial Sequence
  Centrosomal protein of 55 kDa (275-284)
gaggugcacaaccugaaucagcuccuuuac

SEQ ID NO: 59609 - RNA, 30 nt, Artificial Sequence
  Transcription termination factor 1, mitochondrial (99-108)
gaggugaucgccagcauuauauccagauac

SEQ ID NO: 59610 - RNA, 27 nt, Artificial Sequence
  Sterol 26-hydroxylase, mitochondrial (180-188)
gaggugaucgacgauuucaugaccaga

SEQ ID NO: 59611 - RNA, 27 nt, Artificial Sequence
  Alpha/beta hydrolase domain-containing protein 17C (277-285)
gaggugaucgacuucagccacggccug

SEQ ID NO: 59612 - RNA, 30 nt, Artificial Sequence
  PHD finger protein 10 (57-66)
gaggugaucgaccugaugauuaaggaauac

SEQ ID NO: 59613 - RNA, 30 nt, Artificial Sequence
  SNF-related serine/threonine-protein kinase (80-89)
gaggugaucgacacccagacaaagcuguac

SEQ ID NO: 59614 - RNA, 27 nt, Artificial Sequence
  Transcription initiation factor TFIID subunit 1-like (1043-1051)
gaggugaucgacgucguuagaaccaug

SEQ ID NO: 59615 - RNA, 27 nt, Artificial Sequence
  Shootin-1 (164-172)
gaggugaucgaagaggucaacaagguu

SEQ ID NO: 59616 - RNA, 36 nt, Artificial Sequence
  Glucocorticoid receptor (538-549)
gaggugaucgaacccgagguccuguacgccggcuau

SEQ ID NO: 59617 - RNA, 30 nt, Artificial Sequence
  Transformation/transcription domain-associated protein (3103-3112)
gaggugaucgaaagcaccaaccugaaguac

SEQ ID NO: 59618 - RNA, 30 nt, Artificial Sequence
  Serine/threonine-protein kinase MARK2 (117-126)
gaggugaucgaaaccgagaagacacuguac

SEQ ID NO: 59619 - RNA, 30 nt, Artificial Sequence
  Histone H2A deubiquitinase MYSM1 (495-504)
gaggugaucggccugcucgggggaagauac

SEQ ID NO: 59620 - RNA, 27 nt, Artificial Sequence
  CD9 antigen (116-124)
gaggugaucaaggaaguccaggaguuc

SEQ ID NO: 59621 - RNA, 27 nt, Artificial Sequence
  Eukaryotic translation initiation factor 3 subunit L (50-58)
gaggugaucaagaacuucauucaguac

SEQ ID NO: 59622 - RNA, 30 nt, Artificial Sequence
  Calcium signal-modulating cyclophilin ligand (207-216)
gaggugaucaacagaagcauggacaccuac

SEQ ID NO: 59623 - RNA, 27 nt, Artificial Sequence
  NADH dehydrogenase (ubiquinone) 1 beta subcomplex subunit 6 (115-123)
gaggugauccccccuaugaaggaauuc

SEQ ID NO: 59624 - RNA, 27 nt, Artificial Sequence
  Tyrosyl-DNA phosphodiesterase 2 (152-160)
gaggugauccccccuuacuauagcuac

SEQ ID NO: 59625 - RNA, 27 nt, Artificial Sequence
  60 kDa SS-A/Ro ribonucleoprotein (72-80)
gaggugauccaggaaauuaagagcuuc

SEQ ID NO: 59626 - RNA, 27 nt, Artificial Sequence
  Insulin-degrading enzyme (951-959)
gaggugauccagaacaugaccgaauuc

SEQ ID NO: 59627 - RNA, 27 nt, Artificial Sequence
  Cytosolic 5'-nucleotidase 3A (161-169)
gaggugaucagacaggccggcgucuac

SEQ ID NO: 59628 - RNA, 30 nt, Artificial Sequence; identical to SEQ ID NO: 35401
  Nucleoprotein TPR (531-540)

SEQ ID NO: 59629 - RNA, 27 nt, Artificial Sequence
  Mediator of RNA polymerase II transcription subunit 26 (33-41)
gaggugaucagcucccuggaaaaguac

SEQ ID NO: 59630 - RNA, 27 nt, Artificial Sequence
  Bloom syndrome protein (1277-1285)
gaggugaucagcguccugcagaaguac

SEQ ID NO: 59631 - RNA, 33 nt, Artificial Sequence
  Ribosomal protein S6 kinase alpha-3 (14-24)
gaggugaaggaagacaucggcgucgggagcuac

SEQ ID NO: 59632 - RNA, 36 nt, Artificial Sequence
  Farnesyl pyrophosphate synthase (40-51)
gaggugcuggaauacaacgccaucggcgggaaguau

SEQ ID NO: 59633 - RNA, 33 nt, Artificial Sequence
  Tight junction protein ZO-2 (118-128)
gaggugauggacgaauucgauggcagaagcuuu

SEQ ID NO: 59634 - RNA, 27 nt, Artificial Sequence
  DNA polymerase eta (98-106)
gaggugauggaaaucaugagcagauuc

SEQ ID NO: 59635 - RNA, 27 nt, Artificial Sequence
  2',3'-cyclic-nucleotide 3'-phosphodiesterase (369-377)
gaggugagagccaucuucaccggcuac

SEQ ID NO: 59636 - RNA, 30 nt, Artificial Sequence
  Fragile X mental retardation syndrome-related protein 1 (7-16)
gaggugagaggcagcaacggggccuucuac

SEQ ID NO: 59637 - RNA, 27 nt, Artificial Sequence
  Glycylpeptide N-tetradecanoyltransferase 1 (60-68)
gaggugaccgacuuccugagcuuuuac

SEQ ID NO: 59638 - RNA, 27 nt, Artificial Sequence
  A-kinase anchor protein 9 (664-672)
gaggugaccgaaaucauuagccaguuc

SEQ ID NO: 59639 - RNA, 27 nt, Artificial Sequence
  DNA-directed RNA polymerases I, II, and III subunit RPABC1 (155-163)
gaggugaccgaacugcucgccagauac

SEQ ID NO: 59640 - RNA, 27 nt, Artificial Sequence
  DNA topoisomerase 2-alpha (74-82)
gaggugaccuucguccccggccuguac

SEQ ID NO: 59641 - RNA, 27 nt, Artificial Sequence
  Volume-regulated anion channel subunit LRRC8D (74-82)
gaggugaccacaaacauccccaagaug

SEQ ID NO: 59642 - RNA, 27 nt, Artificial Sequence
  Vacuolar protein sorting-associated protein 13D (1985-1993)
gagguggucgccuucauccagcacuuu

SEQ ID NO: 59643 - RNA, 27 nt, Artificial Sequence
  Mortality factor 4-like protein 1 (216-224)
gagguggucgccggcaucaaggaauac

SEQ ID NO: 59644 - RNA, 30 nt, Artificial Sequence
  Mortality factor 4-like protein 1 (216-225)
gagguggucgccggcaucaaggaauacuuc

SEQ ID NO: 59645 - RNA, 27 nt, Artificial Sequence
  Nesprin-2 (1588-1596)
gagguggucgacaagaucaaccagguu

SEQ ID NO: 59646 - RNA, 27 nt, Artificial Sequence
  Peptide-N(4)-(N-acetyl-beta-glucosaminyl)asparagine amidase (383-391)
gagguggucgacguuaccuggagauac

SEQ ID NO: 59647 - RNA, 27 nt, Artificial Sequence
  GA-binding protein subunit beta-1 (118-126)
gagguggucgaacugcucaucaaguac

SEQ ID NO: 59648 - RNA, 27 nt, Artificial Sequence
  Glucocorticoid receptor (728-736)
gagguggucgaaaaccugcucaauuac

SEQ ID NO: 59649 - RNA, 27 nt, Artificial Sequence
  Inverted formin-2 (336-344)
gagguggucgaaagacugcucagcguu

SEQ ID NO: 59650 - RNA, 27 nt, Artificial Sequence
  F-box only protein 22 (27-35)
gagguggucgaaagaguucugaccuuc

SEQ ID NO: 59651 - RNA, 33 nt, Artificial Sequence
  Actin-binding protein IPP (418-428)
gagguggucggcaacauggccguuagcagauac

SEQ ID NO: 59652 - RNA, 30 nt, Artificial Sequence
  26S proteasome non-ATPase regulatory subunit 2 (581-590)
gagguggucagcgaacccuucagauccuuu

SEQ ID NO: 59653 - RNA, 30 nt, Artificial Sequence; identical to SEQ ID NO: 35426
  Cold shock domain-containing protein E1 (630-639)

SEQ ID NO: 59654 - RNA, 27 nt, Artificial Sequence
  Zinc finger MIZ domain-containing protein 2 (271-279)
gagguguaccccggccagcaauaucug

SEQ ID NO: 59655 - RNA, 27 nt, Artificial Sequence
  Uncharacterized protein C18orf8 (437-445)
gaguacaucagaagccugaaccaguuc

SEQ ID NO: 59656 - RNA, 27 nt, Artificial Sequence
  Oxysterol-binding protein (17-25)
gaguacauggaacacguguaucugauc

SEQ ID NO: 59657 - RNA, 27 nt, Artificial Sequence
  Insulin receptor substrate 2 (597-605)
gaguacacccugaugagagccacauuc

SEQ ID NO: 59658 - RNA, 27 nt, Artificial Sequence
  Striatin-interacting protein 2 (594-602)
gaguacgugagccagcaccuggucuuc

SEQ ID NO: 59659 - RNA, 27 nt, Artificial Sequence
  Phospholipid hydroperoxide glutathione peroxidase, mitochondrial (119-127)
uucgccgcuggcuacaacgugaaguuu

SEQ ID NO: 59660 - RNA, 24 nt, Artificial Sequence
  Tuftelin-interacting protein 11 (132-139)
uucgccggcgggaccaagagcuuu

SEQ ID NO: 59661 - RNA, 33 nt, Artificial Sequence
  Sister chromatid cohesion protein PDS5 homolog A (273-283)
uucgccaucgacccccaccugcuccuuagcgug

SEQ ID NO: 59662 - RNA, 27 nt, Artificial Sequence
  ATP-dependent RNA helicase DDX24 (247-255)
uucgccauccccaugauucacgcugug

SEQ ID NO: 59663 - RNA, 27 nt, Artificial Sequence
  Clathrin heavy chain 1 (1594-1602)
uucgccaugcccuacuuuauccaggug

SEQ ID NO: 59664 - RNA, 27 nt, Artificial Sequence
  Splicing factor, proline- and glutamine-rich (486-494)
uucgaguacgaauauagccagagaugg

SEQ ID NO: 59665 - RNA, 27 nt, Artificial Sequence
  Serine/threonine-protein phosphatase PP1-beta catalytic subunit (226-234)
uucggcgccgacguggucagcaaguuu

SEQ ID NO: 59666 - RNA, 27 nt, Artificial Sequence
  Chromatin assembly factor 1 subunit B (228-236)
uuccacgacgauagcaugaaguccuuu

SEQ ID NO: 59667 - RNA, 27 nt, Artificial Sequence
  Endoplasmin (422-430)
uuccacgacaugaugcccaaguaccug

SEQ ID NO: 59668 - RNA, 27 nt, Artificial Sequence
  Protein transport protein Sec23B (630-638)
uuccacggccccccugagccagugcug

SEQ ID NO: 59669 - RNA, 27 nt, Artificial Sequence
  Coatomer subunit alpha (101-109)
uuccaccaugaguaccccuggauccug

SEQ ID NO: 59670 - RNA, 27 nt, Artificial Sequence
  Putative heat shock protein HSP 90-alpha A5 (3-11)
uuccaccaugugggccaggccgggcug

SEQ ID NO: 59671 - RNA, 27 nt, Artificial Sequence
  Phosphatidylinositol 4,5-bisphosphate 3-kinase catalytic subunit gamma isoform (961-969)
uuccacaucgacuuuggccauauucug

SEQ ID NO: 59672 - RNA, 27 nt, Artificial Sequence
  Fas apoptotic inhibitory molecule 3 (252-260)
uuccacauccugauucccaccauacuc

SEQ ID NO: 59673 - RNA, 27 nt, Artificial Sequence
  Rho GTPase-activating protein 4 (276-284)
uuccaccuggcccucggccaggugcuu

SEQ ID NO: 59674 - RNA, 30 nt, Artificial Sequence
  Proteasome subunit alpha type-5 (154-163)
uuccacauggaccccagcggcaccuuugug

SEQ ID NO: 59675 - RNA, 27 nt, Artificial Sequence
  Anaphase-promoting complex subunit 1 (1137-1145)
uuccacaacggcguggccgcugggcug

SEQ ID NO: 59676 - RNA, 27 nt, Artificial Sequence
  Ubiquitin-conjugating enzyme E2 J1 (237-245)
uuccaccagcccacccaaccuguggcc

SEQ ID NO: 59677 - RNA, 27 nt, Artificial Sequence
  Mitotic checkpoint serine/threonine-protein kinase BUB1 (438-446)
uuccacaccacacccaacacuagccug

SEQ ID NO: 59678 - RNA, 27 nt, Artificial Sequence
  WD repeat-containing protein 47 (348-356)
uuccacuaccccggcgugcagaaccug

SEQ ID NO: 59679 - RNA, 30 nt, Artificial Sequence
  Probable ubiquitin carboxyl-terminal hydrolase FAF-X (1466-1475)
uucaucuuucccgccagcaacguguaccug

SEQ ID NO: 59680 - RNA, 27 nt, Artificial Sequence
  Endoplasmic reticulum aminopeptidase 1 (249-257)
uucaucauuagcgacuuugaguccgug

SEQ ID NO: 59681 - RNA, 27 nt, Artificial Sequence
  Protein kinase C-binding protein 1 (213-221)
uuccuggccgacgcuaaguggauccuc

SEQ ID NO: 59682 - RNA, 27 nt, Artificial Sequence
  Unconventional myosin-Ic (773-781)
uuccuggaccacgugagaaccagcuuu

SEQ ID NO: 59683 - RNA, 27 nt, Artificial Sequence
  E3 ubiquitin-protein ligase RNF216 (134-142)
uuccuggaccucggccccccugggauc

SEQ ID NO: 59684 - RNA, 27 nt, Artificial Sequence
  UDP-glucose:glycoprotein glucosyltransferase 2 (97-105)
uuccuggacaaccuccacaucaaucuu

SEQ ID NO: 59685 - RNA, 27 nt, Artificial Sequence
  Proteasome-associated protein ECM29 homolog (801-809)
uuccuggacagcaccuccccccuccuu

SEQ ID NO: 59686 - RNA, 27 nt, Artificial Sequence
  Eukaryotic translation initiation factor 3 subunit M (218-226)
uuccuguuugaccaccuccuuacccug

SEQ ID NO: 59687 - RNA, 27 nt, Artificial Sequence
  HEAT repeat-containing protein 1 (2003-2011)
uuccuguuugacacccagcacuucauc

SEQ ID NO: 59688 - RNA, 30 nt, Artificial Sequence
  Apolipoprotein L1 (239-248)
uuccugggcgagaacaucagcaauuuucuc

SEQ ID NO: 59689 - RNA, 27 nt, Artificial Sequence
  WASH complex subunit strumpellin (1046-1054)
uuccugaucgcccagcuccccaagcuu

SEQ ID NO: 59690 - RNA, 30 nt, Artificial Sequence
  Tensin-1 (1527-1536)
uuccugaucgagaccggccccagaggggug

SEQ ID NO: 59691 - RNA, 27 nt, Artificial Sequence
  Plexin-B2 (395-403)
uuccugaucaacuuuauucacacccuc

SEQ ID NO: 59692 - RNA, 27 nt, Artificial Sequence
  cAMP-specific 3',5'-cyclic phosphodiesterase 4B (382-390)
uuccugaucaacaccaauagcgagcuc

SEQ ID NO: 59693 - RNA, 30 nt, Artificial Sequence
  Serine/threonine-protein kinase 11-interacting protein (316-325)
uuccugcucgacggcaaggugcuuagccug

SEQ ID NO: 59694 - RNA, 33 nt, Artificial Sequence
  Tyrosine-protein kinase BAZ1B (291-301)
uuccugcucgaccccuacaaguauaugacccuu

SEQ ID NO: 59695 - RNA, 30 nt, Artificial Sequence
  Transmembrane emp24 domain-containing protein 10 (22-31)
uuccugcucggccccagacuugugcuggcc

SEQ ID NO: 59696 - RNA, 27 nt, Artificial Sequence
  TBC1 domain family member 13 (329-337)
uuccugcuccccgacgugaucagaauu

SEQ ID NO: 59697 - RNA, 30 nt, Artificial Sequence
  Atlastin-3 (263-272)
uuccugcucccccacccuggccuucaggug

SEQ ID NO: 59698 - RNA, 27 nt, Artificial Sequence
  Glycerol-3-phosphate acyltransferase 4 (174-182)
uuccugcucccccuuagaaucgcccug

SEQ ID NO: 59699 - RNA, 30 nt, Artificial Sequence
  ATP-dependent RNA helicase DDX24 (582-591)
uuccugaugcaguaccccggcagaagccuc

SEQ ID NO: 59700 - RNA, 27 nt, Artificial Sequence
  Quinone oxidoreductase-like protein 1 (284-292)
uuccugaacgacgagguguggaaucuc

SEQ ID NO: 59701 - RNA, 27 nt, Artificial Sequence
  Spectrin beta chain, non-erythrocytic 1 (1184-1192)
uuccugaacaaucaggaguacgugcuc

SEQ ID NO: 59702 - RNA, 27 nt, Artificial Sequence
  Bifunctional coenzyme A synthase (125-133)
uuccugcccccucucccaaccagcgug

SEQ ID NO: 59703 - RNA, 27 nt, Artificial Sequence
  RNA-binding protein EWS (550-558)
uuccugcccccuccauuuccgcccccu

SEQ ID NO: 59704 - RNA, 27 nt, Artificial Sequence
  Arginyl aminopeptidase-like 1 (87-95)
uuccugcccccuagcuuuccaaucgug

SEQ ID NO: 59705 - RNA, 30 nt, Artificial Sequence; identical to SEQ ID NO: 35478
  Exosome complex component RRP4 (134-143)

SEQ ID NO: 59706 - RNA, 30 nt, Artificial Sequence
  Cirhin (214-223)
uuccugagcgacggcaccaucauuuccgug

SEQ ID NO: 59707 - RNA, 27 nt, Artificial Sequence
  26S proteasome non-ATPase regulatory subunit 1 (260-268)
uuccugagcuccgugauccagaaccuc

SEQ ID NO: 59708 - RNA, 27 nt, Artificial Sequence
  Acidic leucine-rich nuclear phosphoprotein 32 family member A (46-54)
uuccugagcaccaucaacgugggccuc

SEQ ID NO: 59709 - RNA, 30 nt, Artificial Sequence
  Mannosyl-oligosaccharide glucosidase (448-457)
uuccugugggacgagggcuuucaccagcuc

SEQ ID NO: 59710 - RNA, 27 nt, Artificial Sequence
  rRNA methyltransferase 1, mitochondrial (246-254)
uuccugugggagagacccacccuccuu

SEQ ID NO: 59711 - RNA, 24 nt, Artificial Sequence
  Transmembrane protein 41B (141-148)
uuccuguaccccuuuccucucgcc

SEQ ID NO: 59712 - RNA, 27 nt, Artificial Sequence
  tRNA-splicing endonuclease subunit Sen15 (185-193)
uucaugcugcccgacccucagaacauc

SEQ ID NO: 59713 - RNA, 33 nt, Artificial Sequence
  tRNA-splicing endonuclease subunit Sen15 (185-195)
uucaugcugcccgacccucagaacaucagccuc

SEQ ID NO: 59714 - RNA, 27 nt, Artificial Sequence
  Intraflagellar transport protein 172 homolog (435-443)
uucaugaacccccaccugaucagcgug

SEQ ID NO: 59715 - RNA, 27 nt, Artificial Sequence
  Ecto-NOX disulfide-thiol exchanger 1 (187-195)
uucaugguggacaaggccaucuaccug

SEQ ID NO: 59716 - RNA, 27 nt, Artificial Sequence
  Integrin alpha-4 (949-957)
uuccccgagccuaacccaagagugauc

SEQ ID NO: 59717 - RNA, 27 nt, Artificial Sequence
  Protein RRP5 homolog (1250-1258)
uuccccuuuggcaagaucgggaccgug

SEQ ID NO: 59718 - RNA, 27 nt, Artificial Sequence
  Zinc finger protein 662 (74-82)
uuccccuuuccuaagccagcccugauc

SEQ ID NO: 59719 - RNA, 30 nt, Artificial Sequence
  U2 small nuclear ribonucleoprotein B'' (72-81)
uuccccuuuuacggcaagccuaugagaauc

SEQ ID NO: 59720 - RNA, 27 nt, Artificial Sequence
  Cyclin-dependent kinase 9 (59-67)
uuccccaucaccgcccugagagagauu

SEQ ID NO: 59721 - RNA, 24 nt, Artificial Sequence
  HLA class II histocompatibility antigen, DP alpha 1 chain (123-130)
uuccccaaggagccuguggaacug

SEQ ID NO: 59722 - RNA, 27 nt, Artificial Sequence
  Poly(A)-specific ribonuclease PARN (273-281)
uuccccagacugcucgacaccaagcuu

SEQ ID NO: 59723 - RNA, 27 nt, Artificial Sequence
  Glutamine-fructose-6-phosphate aminotransferase (isomerizing) 2 (671-679)
uuccccagaaaccuggccaagagcgug

SEQ ID NO: 59724 - RNA, 27 nt, Artificial Sequence
  AT-rich interactive domain-containing protein 2 (669-677)
uuccccgugcagggcguccacaccguu

SEQ ID NO: 59725 - RNA, 27 nt, Artificial Sequence
  Putative heat shock protein HSP 90-beta 2 (17-25)
uuccaggccgagaucgcucaacugaug

SEQ ID NO: 59726 - RNA, 27 nt, Artificial Sequence
  Transcription intermediary factor 1-alpha (890-898)
uuccaggaccccgugccucugaccguc

SEQ ID NO: 59727 - RNA, 27 nt, Artificial Sequence
  Integrin beta-7 (790-798)
uuccaggaggccgacagccccacccug

SEQ ID NO: 59728 - RNA, 27 nt, Artificial Sequence
  Nicotinate phosphoribosyltransferase (342-350)
uuccaggugcccuggcuggagagcguc

SEQ ID NO: 59729 - RNA, 27 nt, Artificial Sequence
  5-aminolevulinate synthase, nonspecific, mitochondrial (214-222)
uuccaguacgacagauuuuucgagaag

SEQ ID NO: 59730 - RNA, 27 nt, Artificial Sequence
  Asparagine synthetase (glutamine-hydrolyzing) (11-19)
uucagauuugagaacgugaauggcuac

SEQ ID NO: 59731 - RNA, 30 nt, Artificial Sequence
  Probable ATP-dependent RNA helicase DDX5 (558-567)
uucagaaccggcaaccccacagggacuuac

SEQ ID NO: 59732 - RNA, 30 nt, Artificial Sequence
  Protein transport protein Sec31A (398-407)
uucagcuuuggcgggaagcuggugaccuuc

SEQ ID NO: 59733 - RNA, 27 nt, Artificial Sequence
  Polymeric immunoglobulin receptor (132-140)
uucagcguggucaucaaccagcugaga

SEQ ID NO: 59734 - RNA, 27 nt, Artificial Sequence
  Neutral amino acid transporter B(0) (89-97)
uucguguuucccggcgagcugcuccuu

SEQ ID NO: 59735 - RNA, 27 nt, Artificial Sequence
  Clathrin heavy chain 1 (783-791)
uucgugcacgaccugguccucuaccuu

SEQ ID NO: 59736 - RNA, 27 nt, Artificial Sequence
  Actin-binding protein anillin (958-966)
uucgugcuggacaagguccccuuucuc

SEQ ID NO: 59737 - RNA, 24 nt, Artificial Sequence
  Myosin light polypeptide 6 (150-157)
uucgugagacacauccugagcggc

SEQ ID NO: 59738 - RNA, 33 nt, Artificial Sequence
  Alkyldihydroxyacetonephosphate synthase, peroxisomal (497-507)
ggcgaggacaacgggcagagaggauaccugcuc

SEQ ID NO: 59739 - RNA, 27 nt, Artificial Sequence
  Putative deoxyribonuclease TATDN3 (48-56)
ggcgaguucgaaaagaucaugcagcug

SEQ ID NO: 59740 - RNA, 27 nt, Artificial Sequence
  Zinc finger protein 428 (174-182)
ggcgagcugcacgggcauuucaugcuc

SEQ ID NO: 59741 - RNA, 27 nt, Artificial Sequence
  Patatin-like phospholipase domain-containing protein 2 (124-132)
ggcgagaacgugaucauuagccacuuc

SEQ ID NO: 59742 - RNA, 27 nt, Artificial Sequence
  DAZ-associated protein 1 (125-133)
ggcgagaccgaacugagagaguacuuc

SEQ ID NO: 59743 - RNA, 33 nt, Artificial Sequence
  Nuclear pore complex protein Nup93 (311-321)
ggcgagguggaagggcaccccgucugggcccug

SEQ ID NO: 59744 - RNA, 27 nt, Artificial Sequence
  Elongation factor 2 (120-128)
ggcgaggugagcgccagacaggaacug

SEQ ID NO: 59745 - RNA, 27 nt, Artificial Sequence
  WD repeat-containing protein 61 (188-196)
ggccacgccaugcccaucagaagccug

SEQ ID NO: 59746 - RNA, 27 nt, Artificial Sequence
  Elongator complex protein 2 (237-245)
ggccacuucgacggggugcaggaucug

SEQ ID NO: 59747 - RNA, 27 nt, Artificial Sequence
  Neuropathy target esterase (188-196)
ggccacuucgagaagccccuguuucuc

SEQ ID NO: 59748 - RNA, 30 nt, Artificial Sequence
  Protein SCAF8 (919-928)
ggcauccuggggauucagcccccuagcgug

SEQ ID NO: 59749 - RNA, 30 nt, Artificial Sequence
  MKL/myocardin-like protein 2 (440-449)
ggccuggccgcugggggaaucguggcaguc

SEQ ID NO: 59750 - RNA, 30 nt, Artificial Sequence
  TRPM8 channel-associated factor 2 (73-82)
ggccuggcccccuuccuccuuaacgcugug

SEQ ID NO: 59751 - RNA, 27 nt, Artificial Sequence
  Neurobeachin-like protein 2 (789-797)
ggccuggcccccaagccugugcagguc

SEQ ID NO: 59752 - RNA, 27 nt, Artificial Sequence
  Rapamycin-insensitive companion of mTOR (711-719)
ggccuggccagagugauccucagcaag

SEQ ID NO: 59753 - RNA, 33 nt, Artificial Sequence
  Nuclear pore complex protein Nup107 (915-925)
ggccuggacccccucggguacgagauccagcuu

SEQ ID NO: 59754 - RNA, 27 nt, Artificial Sequence
  Elongation factor 2 (217-225)
ggccugcacgggugggccuucacccuc

SEQ ID NO: 59755 - RNA, 27 nt, Artificial Sequence
  CCR4-NOT transcription complex subunit 1 (373-381)
ggccugcacaacguggucuacgggauc

SEQ ID NO: 59756 - RNA, 27 nt, Artificial Sequence
  DNA-dependent protein kinase catalytic subunit (2509-2517)
ggccugaucgacgagaaccccgggcuc

SEQ ID NO: 59757 - RNA, 27 nt, Artificial Sequence
  Structural maintenance of chromosomes flexible hinge domain-containing protein 1 (829-837)
ggccugcucgaccuucccuucagagug

SEQ ID NO: 59758 - RNA, 30 nt, Artificial Sequence
  F-box only protein 22 (210-219)
ggccugcucgacaaccccgagcuuagagug

SEQ ID NO: 59759 - RNA, 33 nt, Artificial Sequence
  Nuclear receptor subfamily 2 group C member 2 (238-248)
ggccugcucgaccccgggaugcuugugaacauc

SEQ ID NO: 59760 - RNA, 27 nt, Artificial Sequence
  Protein zer-1 homolog (593-601)
ggccugcucgggaacguggccgagguc

SEQ ID NO: 59761 - RNA, 27 nt, Artificial Sequence
  Protein zyg-11 homolog B (299-307)
ggccugcucaacaauaucgccgaggug

SEQ ID NO: 59762 - RNA, 27 nt, Artificial Sequence
  Lysophospholipid acyltransferase 7 (141-149)
ggccugcuccccgacgugccuagccuu

SEQ ID NO: 59763 - RNA, 27 nt, Artificial Sequence
  E3 ubiquitin-protein ligase UBR4 (1708-1716)
ggccugcucagaaucauucccuaccuu

SEQ ID NO: 59764 - RNA, 27 nt, Artificial Sequence
  Protein ELYS (929-937)
ggccugauggaggaccuccuuaagcug

SEQ ID NO: 59765 - RNA, 27 nt, Artificial Sequence
  Exocyst complex component 4 (173-181)
ggccugagcgaccucagacuugagcug

SEQ ID NO: 59766 - RNA, 27 nt, Artificial Sequence
  Nuclear pore complex protein Nup155 (139-147)
ggccugagcgagaccauccucgccgug

SEQ ID NO: 59767 - RNA, 27 nt, Artificial Sequence
  Leucine-rich repeat and calponin homology domain-containing protein 3 (750-758)
ggccugagccagguggccgucaccguu

SEQ ID NO: 59768 - RNA, 27 nt, Artificial Sequence
  Glucocorticoid modulatory element-binding protein 1 (503-511)
ggccugaccagcgccauccaggcugug

SEQ ID NO: 59769 - RNA, 30 nt, Artificial Sequence
  Complex I assembly factor TIMMDC1, mitochondrial (187-196)
ggccugguggccgggggaaucauuggugcu

SEQ ID NO: 59770 - RNA, 27 nt, Artificial Sequence
  Serine-tRNA ligase, cytoplasmic (31-39)
ggccugguggaccagcucgucaaggcc

SEQ ID NO: 59771 - RNA, 27 nt, Artificial Sequence
  KATNB1-like protein 1 (274-282)
ggccugugggagcaggaaaaccaccuc

SEQ ID NO: 59772 - RNA, 27 nt, Artificial Sequence
  Rotatin (1413-1421)
ggccugugggggaccguggucaacauc

SEQ ID NO: 59773 - RNA, 30 nt, Artificial Sequence; identical to SEQ ID NO: 35546
  Melanoma-associated antigen 10 (254-263)

SEQ ID NO: 59774 - RNA, 27 nt, Artificial Sequence
  tRNA (adenine(58)-N(1))-methyltransferase non-catalytic subunit TRM6 (83-91)
ggccuguacgaguucccccucaacaag

SEQ ID NO: 59775 - RNA, 27 nt, Artificial Sequence
  Putative ATP-dependent RNA helicase DHX30 (983-991)
ggccuguaccccaaccucauccaggug

SEQ ID NO: 59776 - RNA, 30 nt, Artificial Sequence
  Catenin alpha-1 (725-734)
ggcauggccagccugaaccuccccgcugug

SEQ ID NO: 59777 - RNA, 27 nt, Artificial Sequence
  RNA-binding protein 12 (509-517)
ggcaugcuggagaagaucgacaugauu

SEQ ID NO: 59778 - RNA, 27 nt, Artificial Sequence
  Probable ATP-dependent RNA helicase YTHDC2 (978-986)
ggcauguaccccaaccuggugcacguc

SEQ ID NO: 59779 - RNA, 27 nt, Artificial Sequence
  Heterogeneous nuclear ribonucleoprotein M (480-488)
ggccccgccaucgagagaauggggcug

SEQ ID NO: 59780 - RNA, 27 nt, Artificial Sequence
  ETS translocation variant 5 (173-181)
ggccccgccccugcuccacacagccug

SEQ ID NO: 59781 - RNA, 33 nt, Artificial Sequence
  Filamin-A (852-862)
ggccccgggcugagcagaaccggaguggagcuc

SEQ ID NO: 59782 - RNA, 30 nt, Artificial Sequence
  Splicing factor, proline- and glutamine-rich (215-224)
ggccccaagccugggggagguccaggccug

SEQ ID NO: 59783 - RNA, 27 nt, Artificial Sequence
  Peptidyl-prolyl cis-trans isomerase-like 2 (134-142)
ggccccaacagcaauagaucccaguuc

SEQ ID NO: 59784 - RNA, 30 nt, Artificial Sequence
  RuvB-like 1 (70-79)
ggccccccugggaccggaaagacagcccug

SEQ ID NO: 59785 - RNA, 27 nt, Artificial Sequence
  Transmembrane protein 214 (461-469)
ggccccagacugccuuggaccaggcuc

SEQ ID NO: 59786 - RNA, 27 nt, Artificial Sequence
  PHD finger protein 3 (205-213)
ggccagaucgaggugguccccgaaguu

SEQ ID NO: 59787 - RNA, 27 nt, Artificial Sequence
  Nucleolar RNA helicase 2 (190-198)
ggcagagccccccaggugcugguccuc

SEQ ID NO: 59788 - RNA, 30 nt, Artificial Sequence
  Ran-binding protein 9 (76-85)
ggcagagacggguacaugggaaucggucug

SEQ ID NO: 59789 - RNA, 27 nt, Artificial Sequence
  COP9 signalosome complex subunit 5 (281-289)
ggcagagggagcuucaugcugggacuc

SEQ ID NO: 59790 - RNA, 27 nt, Artificial Sequence
  WD repeat-containing protein 81 (717-725)
ggcagaauccugcuccccgagggguuc

SEQ ID NO: 59791 - RNA, 30 nt, Artificial Sequence
  Neutral amino acid transporter A (111-120)
ggcagacuggggggaaucgccguggcuuac

SEQ ID NO: 59792 - RNA, 30 nt, Artificial Sequence
  Spectrin beta chain, non-erythrocytic 1 (822-831)
ggcagacugagcgggaucgaggaaagguac

SEQ ID NO: 59793 - RNA, 33 nt, Artificial Sequence
  ATP-binding cassette sub-family F member 3 (595-605)
ggcagauacgggaucagcggagagcuggccaug

SEQ ID NO: 59794 - RNA, 27 nt, Artificial Sequence
  Stathmin 1/oncoprotein 18 (118-126)
ggcagccacuucaucucccaucugucu

SEQ ID NO: 59795 - RNA, 27 nt, Artificial Sequence
  AP-5 complex subunit beta-1 (317-325)
ggcaccgcccagcugacacuccuucac

SEQ ID NO: 59796 - RNA, 27 nt, Artificial Sequence
  UPF0428 protein CXorf56 (73-81)
ggcacccugaucgacaaccaguucaag

SEQ ID NO: 59797 - RNA, 27 nt, Artificial Sequence
  PX domain-containing protein kinase-like protein (149-157)
ggcacccugaaggaccucaucuacaaa

SEQ ID NO: 59798 - RNA, 27 nt, Artificial Sequence
  Putative inactive carbonic anhydrase 5B-like protein (13-21)
ggcacccugagcuccuggaaccucaag

SEQ ID NO: 59799 - RNA, 27 nt, Artificial Sequence
  Small integral membrane protein 4 (34-42)
ggcaccauggaguggaucaugauuaag

SEQ ID NO: 59800 - RNA, 27 nt, Artificial Sequence
  Arf-GAP with SH3 domain, ANK repeat and PH domain-containing protein 2 (482-490)
ggcaccagcgagcugcuccuugccaag

SEQ ID NO: 59801 - RNA, 27 nt, Artificial Sequence
  DNA cross-link repair 1A protein (877-885)
ggcaccuacagcaucgggaaggagaaa

SEQ ID NO: 59802 - RNA, 27 nt, Artificial Sequence
  Proteasome subunit beta type-3 (184-192)
ggcgugaucguccacauuauagagaag

SEQ ID NO: 59803 - RNA, 27 nt, Artificial Sequence
  Tensin-1 (71-79)
cacgccaaggugcuggaguucggcugg

SEQ ID NO: 59804 - RNA, 27 nt, Artificial Sequence
  Mothers against decapentaplegic homolog 2 (291-299)
cacgccagccagcccucccugaccgug

SEQ ID NO: 59805 - RNA, 27 nt, Artificial Sequence
  TIP41-like protein (203-211)
cacgaggccgacaagaccuacaugcug

SEQ ID NO: 59806 - RNA, 27 nt, Artificial Sequence
  Zinc finger protein 655 (167-175)
cacgagcccgaaaagagcuucucccug

SEQ ID NO: 59807 - RNA, 24 nt, Artificial Sequence
  Retinol dehydrogenase 10 (221-228)
cacgagagccugucccaugaacuc

SEQ ID NO: 59808 - RNA, 27 nt, Artificial Sequence
  Hippocampus abundant transcript-like protein 1 (50-58)
cacgagaccuucagccagcauacauuu

SEQ ID NO: 59809 - RNA, 27 nt, Artificial Sequence
  N-acetyltransferase 9 (4-12)
cacgaguggaugaagagcgaagagcug

SEQ ID NO: 59810 - RNA, 27 nt, Artificial Sequence
  Tubulin beta-4B chain (28-36)
cacggcaucgaccccaccgggacauac

SEQ ID NO: 59811 - RNA, 27 nt, Artificial Sequence
  MOB kinase activator 3A (169-177)
caccauuucgacagaaucgcccagaug

SEQ ID NO: 59812 - RNA, 27 nt, Artificial Sequence
  Fanconi anemia group I protein (98-106)
caccauuuccccggcccucugcucgug

SEQ ID NO: 59813 - RNA, 27 nt, Artificial Sequence
  Transcriptional repressor protein YY1 (78-86)
caccaucaccccccuaugaucgcccug

SEQ ID NO: 59814 - RNA, 27 nt, Artificial Sequence
  Myotubularin-related protein 6 (51-59)
caccauaucgccagcguggagaagcug

SEQ ID NO: 59815 - RNA, 27 nt, Artificial Sequence
  Kelch-like protein 6 (219-227)
caccauauccugaagagcgacgaucuc

SEQ ID NO: 59816 - RNA, 30 nt, Artificial Sequence
  Squalene synthase (268-277)
caccauauccccgacgugauuaccuaccug

SEQ ID NO: 59817 - RNA, 24 nt, Artificial Sequence
  N-alpha-acetyltransferase 38, NatC auxiliary subunit (107-114)
caccauaucgugagcauugagguc

SEQ ID NO: 59818 - RNA, 30 nt, Artificial Sequence
  Fructose-bisphosphate aldolase A (220-229)
caccauaucuaccuggagggcacccuccuu

SEQ ID NO: 59819 - RNA, 27 nt, Artificial Sequence
  Signal recognition particle 54 kDa protein (472-480)
caccauaugggcgggauggccggacug

SEQ ID NO: 59820 - RNA, 30 nt, Artificial Sequence
  U1 small nuclear ribonucleoprotein A (155-164)
caccauaugcccggccagccuccauacaug

SEQ ID NO: 59821 - RNA, 24 nt, Artificial Sequence
  DNA topoisomerase 2-alpha (558-565)
caccauaacuggcccagccugcuc

SEQ ID NO: 59822 - RNA, 27 nt, Artificial Sequence
  Ubiquitin-associated protein 2-like (890-898)
caccauaccacacagcaaacuuuccug

SEQ ID NO: 59823 - RNA, 30 nt, Artificial Sequence
  Dedicator of cytokinesis protein 2 (573-582)
caccauguggagaacaagggcgccacccug

SEQ ID NO: 59824 - RNA, 27 nt, Artificial Sequence
  Oxidative stress-induced growth inhibitor 2 (114-122)
caccauuacaucccccacgugguccug

SEQ ID NO: 59825 - RNA, 30 nt, Artificial Sequence
  60S ribosomal protein L30 (72-81)
caccauuacagcggcaacaauaucgagcug

SEQ ID NO: 59826 - RNA, 27 nt, Artificial Sequence
  Ribosomal L1 domain-containing protein 1 (227-235)
cacaucauugagaacauaguggccguc

SEQ ID NO: 59827 - RNA, 27 nt, Artificial Sequence
  E3 ubiquitin-protein ligase TRIM11 (224-232)
caccuggccgagcucaucgcugaacuu

SEQ ID NO: 59828 - RNA, 27 nt, Artificial Sequence
  Probable E3 ubiquitin-protein ligase HERC1 (1903-1911)
caccugggcgacuuccucguguuucuu

SEQ ID NO: 59829 - RNA, 27 nt, Artificial Sequence
  Talin-1 (1711-1719)
caccugaucgagccccucgccaacgcu

SEQ ID NO: 59830 - RNA, 27 nt, Artificial Sequence
  Transmembrane protein 41B (196-204)
caccugaucaacuacauuauauuccuc

SEQ ID NO: 59831 - RNA, 27 nt, Artificial Sequence
  tRNA-specific adenosine deaminase 1 (169-177)
caccugcucgaggaacccaucuaccuu

SEQ ID NO: 59832 - RNA, 27 nt, Artificial Sequence
  Nuclear pore complex protein Nup205 (808-816)
caccugcucaacgagagccccaugcuu

SEQ ID NO: 59833 - RNA, 30 nt, Artificial Sequence
  Activating transcription factor 7-interacting protein 1 (1036-1045)
caccugcuccccaccgccccuacaacugug

SEQ ID NO: 59834 - RNA, 27 nt, Artificial Sequence
  Ras GTPase-activating-like protein IQGAP1 (1247-1255)
caccugagcaucauuaacgaguaccuc

SEQ ID NO: 59835 - RNA, 27 nt, Artificial Sequence
  Nucleoprotein TPR (907-915)
caccugagcaacauggaggugcagguc

SEQ ID NO: 59836 - RNA, 27 nt, Artificial Sequence
  Next to BRCA1 gene 1 protein (330-338)
caccuguggaacagcauccauggccuc

SEQ ID NO: 59837 - RNA, 33 nt, Artificial Sequence
  E3 ubiquitin-protein ligase HUWE1 (111-121)
caccuguacagcuccaucgagcaucucaccaca

SEQ ID NO: 59838 - RNA, 27 nt, Artificial Sequence
  Transmembrane protein 248 (135-143)
caccuguacagcaccauccucggccau

SEQ ID NO: 59839 - RNA, 27 nt, Artificial Sequence
  E3 ubiquitin-protein ligase RNF167 (2-10)
caccccgccgcuuucccucugccagug

SEQ ID NO: 59840 - RNA, 27 nt, Artificial Sequence
  T-complex protein 1 subunit theta (7-15)
caccccgccgcuaagaugaucgugaug

SEQ ID NO: 59841 - RNA, 27 nt, Artificial Sequence
  Ras GTPase-activating protein-binding protein 1 (336-344)
caccccgacagccaucagcuguucauc

SEQ ID NO: 59842 - RNA, 33 nt, Artificial Sequence
  Sterol regulatory element-binding protein 2 (512-522)
cacccccauagcggcuccgggagaucugugcug

SEQ ID NO: 59843 - RNA, 27 nt, Artificial Sequence
  AP-2 complex subunit beta (191-199)
caccccaacagcaaucugcucgaccuu

SEQ ID NO: 59844 - RNA, 27 nt, Artificial Sequence
  Catenin beta-1 (499-507)
caccccccuagccauuggccacugauc

SEQ ID NO: 59845 - RNA, 30 nt, Artificial Sequence
  Uncharacterized protein C20orf196 (108-117)
cacccccagccuggcagcgccaacucccug

SEQ ID NO: 59846 - RNA, 27 nt, Artificial Sequence
  Polycomb protein EED (185-193)
caccccagagacccuaaccugcuccuu

SEQ ID NO: 59847 - RNA, 30 nt, Artificial Sequence
  Hypoxia-inducible factor 1-alpha (708-717)
caccccagaagcccuaacgugcuguccguc

SEQ ID NO: 59848 - RNA, 27 nt, Artificial Sequence
  Exosome complex component RRP46 (111-119)
caccccagaaccagcaucacagugguc

SEQ ID NO: 59849 - RNA, 27 nt, Artificial Sequence
  Kelch-like protein 11 (343-351)
caccccaccagccaugugucccugcuc

SEQ ID NO: 59850 - RNA, 27 nt, Artificial Sequence
  Cytoplasmic dynein 1 heavy chain 1 (331-339)
cacagacugcuccuuauccaggccuuc

SEQ ID NO: 59851 - RNA, 27 nt, Artificial Sequence
  Chromodomain-helicase-DNA-binding protein 3 (1077-1085)
cacagagugcugaucuucagccagaug

SEQ ID NO: 59852 - RNA, 27 nt, Artificial Sequence
  Helicase SRCAP (1801-1809)
cacagagugcugaucuucacccagaug

SEQ ID NO: 59853 - RNA, 27 nt, Artificial Sequence
  Endothelial PAS domain-containing protein 1 (15-23)
cacagcauggacaugaaguucaccuac

SEQ ID NO: 59854 - RNA, 30 nt, Artificial Sequence; identical to SEQ ID NO: 35627
  Histone-binding protein RBBP7 (375-384)

SEQ ID NO: 59855 - RNA, 27 nt, Artificial Sequence
  Adenylyl cyclase-associated protein 1 (23-31)
cacaccagcgacaugcauagaggcuac

SEQ ID NO: 59856 - RNA, 27 nt, Artificial Sequence
  POTE ankyrin domain family member I (78-86)
cacaccgugcccaucuacgagggcuau

SEQ ID NO: 59857 - RNA, 30 nt, Artificial Sequence
  Thioredoxin-interacting protein (164-173)
cacaccuaccuggccaacggccagacaaag

SEQ ID NO: 59858 - RNA, 27 nt, Artificial Sequence
  Activity-dependent neuroprotector homeobox protein (162-170)
cacguggccgcucccuacaucgcaaag

SEQ ID NO: 59859 - RNA, 27 nt, Artificial Sequence
  DNA-binding protein inhibitor ID-4 (93-101)
cacgugaucgacuacauucuggaucuc

SEQ ID NO: 59860 - RNA, 30 nt, Artificial Sequence
  Secernin-2 (133-142)
cacgugaucaccggccugcucgagcauuac

SEQ ID NO: 59861 - RNA, 33 nt, Artificial Sequence; identical to SEQ ID NO: 35634
  ETS-related transcription factor Elf-1 (38-48)

SEQ ID NO: 59862 - RNA, 30 nt, Artificial Sequence
  Cholinesterase (154-163)
cacguguacgacggcaaguuccuggccaga

SEQ ID NO: 59863 - RNA, 27 nt, Artificial Sequence
  TCDD-inducible poly (ADP-ribose) polymerase (387-395)
cacuacauccugcauaacagcuucuuu

SEQ ID NO: 59864 - RNA, 27 nt, Artificial Sequence
  Proliferation-associated protein 2G4 (20-28)
aucgccuuccccaccagcauuuccgug

SEQ ID NO: 59865 - RNA, 27 nt, Artificial Sequence
  Growth hormone-inducible transmembrane protein (143-151)
aucgccauuagcagaacccccgugcug

SEQ ID NO: 59866 - RNA, 30 nt, Artificial Sequence
  TRPM8 channel-associated factor 1 (376-385)
aucgcccuguggcccccugugagagagaag

SEQ ID NO: 59867 - RNA, 27 nt, Artificial Sequence
  Kinesin-like protein KIF18B (388-396)
aucgccagacugcccagcuccacccuc

SEQ ID NO: 59868 - RNA, 27 nt, Artificial Sequence
  Eukaryotic initiation factor 4A-II (97-105)
aucgaguucaaggaaacccaggcccug

SEQ ID NO: 59869 - RNA, 33 nt, Artificial Sequence
  Casein kinase II subunit alpha (263-273)
aucgagcuggaccccagauucaacgauauucuc

SEQ ID NO: 59870 - RNA, 27 nt, Artificial Sequence
  Methionine adenosyltransferase 2 subunit beta (82-90)
auccacgacuuccagccccaugugauu

SEQ ID NO: 59871 - RNA, 27 nt, Artificial Sequence
  Ubiquitin-like protein 5 (62-70)
auccacgacggcaugaaccuggagcuc

SEQ ID NO: 59872 - RNA, 33 nt, Artificial Sequence
  NudC domain-containing protein 1 (119-129)
auccacuucagcuccucuaccugggugacacug

SEQ ID NO: 59873 - RNA, 27 nt, Artificial Sequence
  DNA topoisomerase 2-alpha (557-565)
auccaccauaacuggcccagccugcuc

SEQ ID NO: 59874 - RNA, 30 nt, Artificial Sequence
  Probable ATP-dependent RNA helicase DDX5 (298-307)
auccacauuaacauaggcgcccuggagcuc

SEQ ID NO: 59875 - RNA, 27 nt, Artificial Sequence
  Nucleolar protein 58 (107-115)
auccacagccccguggucaacgagcug

SEQ ID NO: 59876 - RNA, 27 nt, Artificial Sequence
  ATPase family AAA domain-containing protein 2B (521-529)
auccacagcuccauugugucuacccug

SEQ ID NO: 59877 - RNA, 27 nt, Artificial Sequence
  RNA polymerase II-associated protein 3 (126-134)
auccacguggacagccagaaggcccug

SEQ ID NO: 59878 - RNA, 27 nt, Artificial Sequence
  Cytochrome c oxidase subunit 1 (311-319)
aucauugccauacccaccggcgugaag

SEQ ID NO: 59879 - RNA, 27 nt, Artificial Sequence
  40S ribosomal protein S7 (59-67)
aucauuuucgugcccgucccucagcug

SEQ ID NO: 59880 - RNA, 27 nt, Artificial Sequence
  Zinc fingers and homeoboxes protein 3 (566-574)
aucauuauagacagcgugcccgagguc

SEQ ID NO: 59881 - RNA, 27 nt, Artificial Sequence
  Dedicator of cytokinesis protein 7 (1109-1117)
aucauuauggagaccgugccccagcug

SEQ ID NO: 59882 - RNA, 27 nt, Artificial Sequence
  Ras GTPase-activating-like protein IQGAP1 (1302-1310)
aucauuaacacccacacacugcuccuu

SEQ ID NO: 59883 - RNA, 27 nt, Artificial Sequence
  Intron-binding protein aquarius (273-281)
auccuggacgauagccaccuccuugug

SEQ ID NO: 59884 - RNA, 27 nt, Artificial Sequence
  Coatomer subunit zeta-1 (5-13)
auccuggagcccagccucuacaccgug

SEQ ID NO: 59885 - RNA, 30 nt, Artificial Sequence
  Methylmalonyl-CoA mutase, mitochondrial (172-181)
auccuguucgacggcauuccccucgagaag

SEQ ID NO: 59886 - RNA, 27 nt, Artificial Sequence
  Asparagine synthetase (glutamine-hydrolyzing) (154-162)
auccuguucaacaaugccgugaagaaa

SEQ ID NO: 59887 - RNA, 27 nt, Artificial Sequence
  Protein SCAF8 (920-928)
auccugggcauucagcccccuagcgug

SEQ ID NO: 59888 - RNA, 27 nt, Artificial Sequence
  CREB-binding protein (26-34)
auccugauuggcuaccucgaguaugug

SEQ ID NO: 59889 - RNA, 27 nt, Artificial Sequence
  Protein RRNAD1 (424-432)
auccugcucgacagacuucuguacuug

SEQ ID NO: 59890 - RNA, 24 nt, Artificial Sequence
  MAU2 chromatid cohesion factor homolog (246-253)
auccugcucgagcacauuauaaug

SEQ ID NO: 59891 - RNA, 27 nt, Artificial Sequence
  Phospholipase A-2-activating protein (517-525)
auccugcucgagaagauucuuagccug

SEQ ID NO: 59892 - RNA, 27 nt, Artificial Sequence
  Serine-protein kinase ATM (144-152)
auccugcucaaggacauucuuagcgug

SEQ ID NO: 59893 - RNA, 27 nt, Artificial Sequence
  Glycerol-3-phosphate acyltransferase 3 (22-30)
auccugcuccccagcguguucggcguc

SEQ ID NO: 59894 - RNA, 27 nt, Artificial Sequence
  Protein FAM122B (239-247)
auccugauggacgaucucagccccaag

SEQ ID NO: 59895 - RNA, 30 nt, Artificial Sequence
  DNA (cytosine-5)-methyltransferase 1 (382-391)
auccugauggaccccagcccugaguacgcc

SEQ ID NO: 59896 - RNA, 27 nt, Artificial Sequence
  A-kinase anchor protein 8-like (529-537)
auccugaacaauaagcucauuagcaaa

SEQ ID NO: 59897 - RNA, 27 nt, Artificial Sequence
  Protein TASOR (898-906)
auccugaaccccgagguggucaccguu

SEQ ID NO: 59898 - RNA, 30 nt, Artificial Sequence; identical to SEQ ID NO: 35671
  Anaphase-promoting complex subunit 1 (57-66)

SEQ ID NO: 59899 - RNA, 27 nt, Artificial Sequence
  Uncharacterized protein KIAA1109 (858-866)
auccugagcccccucaacguguucguc

SEQ ID NO: 59900 - RNA, 27 nt, Artificial Sequence
  General vesicular transport factor p115 (329-337)
auccugaccgagacaauuaacacugug

SEQ ID NO: 59901 - RNA, 27 nt, Artificial Sequence
  ORM1-like protein 2 (28-36)
auccuggugggccuccuucacaugguc

SEQ ID NO: 59902 - RNA, 27 nt, Artificial Sequence
  Fibronectin type III domain-containing protein 3B (1072-1080)
auccugugggagaccgugcccagcaug

SEQ ID NO: 59903 - RNA, 30 nt, Artificial Sequence
  Phenylalanine-tRNA ligase, mitochondrial (215-224)
auccuguacgacauucccgauauaagacuc

SEQ ID NO: 59904 - RNA, 27 nt, Artificial Sequence
  Serine/threonine-protein phosphatase 2B catalytic subunit alpha isoform (138-146)
auccuguaccccaagacccucuuccuu

SEQ ID NO: 59905 - RNA, 27 nt, Artificial Sequence
  Serine/threonine-protein phosphatase 2B catalytic subunit beta isoform (165-173)
auccuguaccccagcacccucuuccuu

SEQ ID NO: 59906 - RNA, 27 nt, Artificial Sequence
  Proteasome activator complex subunit 4 (38-46)
auccuguacagcaagaccgagcaccuc

SEQ ID NO: 59907 - RNA, 27 nt, Artificial Sequence
  Vigilin (627-635)
auccccgccaagcugcacaacagccuc

SEQ ID NO: 59908 - RNA, 27 nt, Artificial Sequence
  Thioredoxin domain-containing protein 11 (92-100)
auccccgccaagccuccagugagcuuc

SEQ ID NO: 59909 - RNA, 27 nt, Artificial Sequence
  RNA-binding protein 12B (28-36)
auccccgacggcggggugcacauuaua

SEQ ID NO: 59910 - RNA, 27 nt, Artificial Sequence
  Bifunctional glutamate/proline-tRNA ligase (709-717)
auccccgacggccacaccaaggagaug

SEQ ID NO: 59911 - RNA, 27 nt, Artificial Sequence
  Plectin (3582-3590)
auccccgaggaacagagagcccaacug

SEQ ID NO: 59912 - RNA, 24 nt, Artificial Sequence
  Filamin-A (1600-1607)
auccccuucagcccuuacagagug

SEQ ID NO: 59913 - RNA, 27 nt, Artificial Sequence
  Coatomer subunit beta' (567-575)
auccccaaggacaacagacuguaccuc

SEQ ID NO: 59914 - RNA, 27 nt, Artificial Sequence
  Bladder cancer-associated protein (13-21)
auccccaagccucugaacccagcccuc

SEQ ID NO: 59915 - RNA, 27 nt, Artificial Sequence
  Integrin beta-1 (92-100)
auccccaagagcgccgugggcacccug

SEQ ID NO: 59916 - RNA, 30 nt, Artificial Sequence
  Sodium/potassium-transporting ATPase subunit alpha-1 (601-610)
aucccccugccucucggcaccgugacaauu

SEQ ID NO: 59917 - RNA, 27 nt, Artificial Sequence
  Tubulin beta chain (365-373)
auccccaacaaugugaagaccgccguc

SEQ ID NO: 59918 - RNA, 27 nt, Artificial Sequence
  Membrane cofactor protein (71-79)
auccccccucuggccacccacacaauu

SEQ ID NO: 59919 - RNA, 24 nt, Artificial Sequence
  Chromodomain-helicase-DNA-binding protein 4 (1903-1910)
auccccccuguggccgucagacug

SEQ ID NO: 59920 - RNA, 30 nt, Artificial Sequence
  V-type proton ATPase catalytic subunit A (118-127)
auccccagaggcgugaacgucagcgcccug

SEQ ID NO: 59921 - RNA, 27 nt, Artificial Sequence
  Ubiquitin-associated domain-containing protein 2 (32-40)
auccccagagugcaggucgcccaaauu

SEQ ID NO: 59922 - RNA, 27 nt, Artificial Sequence
  Probable ubiquitin carboxyl-terminal hydrolase FAF-X (1578-1586)
auccccagcauuagaaacggcauacug

SEQ ID NO: 59923 - RNA, 27 nt, Artificial Sequence
  Patatin-like phospholipase domain-containing protein 2 (212-220)
auccaguucaaccugagaaaucucuac

SEQ ID NO: 59924 - RNA, 27 nt, Artificial Sequence
  Hypoxia-inducible factor 1-alpha (370-378)
auccagcacgaccugauuuucagccuc

SEQ ID NO: 59925 - RNA, 27 nt, Artificial Sequence
  AN1-type zinc finger protein 5 (198-206)
aucagaaaggagaaccccguggucguu

SEQ ID NO: 59926 - RNA, 27 nt, Artificial Sequence
  Plectin (3944-3952)
aucagacccggcaccgccuucgagcug

SEQ ID NO: 59927 - RNA, 27 nt, Artificial Sequence
  Nuclear factor of activated T-cells, cytoplasmic 2 (431-439)
aucagaacccccgugaaggucaacuuc

SEQ ID NO: 59928 - RNA, 27 nt, Artificial Sequence
  Cytospin-A (888-896)
aucagcggccccauuuccaccucuaag

SEQ ID NO: 59929 - RNA, 33 nt, Artificial Sequence
  Endothelin-converting enzyme 1 (719-729)
aucaccgacccccacagcccuuccagauucagg

SEQ ID NO: 59930 - RNA, 27 nt, Artificial Sequence
  TRAF2 and NCK-interacting protein kinase (425-433)
aucaccaaggacgugguccugcagugg

SEQ ID NO: 59931 - RNA, 30 nt, Artificial Sequence
  Heat shock protein HSP 90-alpha (91-100)
aucguggacaccggcauugggaugacaaag

SEQ ID NO: 59932 - RNA, 27 nt, Artificial Sequence
  Smith-Magenis syndrome chromosomal region candidate gene 8 protein (742-750)
aucgugagaaagcuggucaccgcccuc

SEQ ID NO: 59933 - RNA, 30 nt, Artificial Sequence
  Actin, cytoplasmic 2 (75-84)
aucgugaccaacugggacgauauggagaag

SEQ ID NO: 59934 - RNA, 27 nt, Artificial Sequence
  Importin subunit alpha-5 (492-500)
aucuaccagaaggccuucgaccugauu

SEQ ID NO: 59935 - RNA, 30 nt, Artificial Sequence
  Krueppel-like factor 3 (37-46)
aucuacagcaccccccugccugagaaguuc

SEQ ID NO: 59936 - RNA, 27 nt, Artificial Sequence
  Butyrophilin subfamily 3 member A3 secreted isoform (315-323)
aucuacaccuucccccacgccagcuuu

SEQ ID NO: 59937 - RNA, 27 nt, Artificial Sequence
  Probable C-mannosyltransferase DPY19L1 (119-127)
aucuacaccaagauuauggaccugaua

SEQ ID NO: 59938 - RNA, 27 nt, Artificial Sequence
  Basic leucine zipper and W2 domain-containing protein 2 (358-366)
aaggccuuccagaaaaucgugguccug

SEQ ID NO: 59939 - RNA, 27 nt, Artificial Sequence
  Structural maintenance of chromosomes protein 1A (1026-1034)
aaggccauggagaaacuggaaagcgug

SEQ ID NO: 59940 - RNA, 27 nt, Artificial Sequence
  Histone H2B type 1-K (58-66)
aaggccaugggcaucaugaacagcuuc

SEQ ID NO: 59941 - RNA, 27 nt, Artificial Sequence
  Replication protein A 70 kDa DNA-binding subunit (157-165)
aaggccuacggcgcuagcaaaaccuuc

SEQ ID NO: 59942 - RNA, 27 nt, Artificial Sequence
  Protein arginine N-methyltransferase 3 (98-106)
aaggaggaauaccugaaacccgugcuc

SEQ ID NO: 59943 - RNA, 33 nt, Artificial Sequence
  Heat shock protein HSP 90-alpha (656-666)
aaggaguucgaaggcaaaacccuggugagcguc

SEQ ID NO: 59944 - RNA, 30 nt, Artificial Sequence
  Nuclear autoantigenic sperm protein (298-307)
aaggagaucgaagagcugaaagaacuccuu

SEQ ID NO: 59945 - RNA, 30 nt, Artificial Sequence
  Nucleoporin GLE1 (442-451)
aaggagaucuucgacaaaauucacagccug

SEQ ID NO: 59946 - RNA, 33 nt, Artificial Sequence
  CDK5 and ABL1 enzyme substrate 1 (180-190)
aaggagaucauuggccuggaagggguggagcuc

SEQ ID NO: 59947 - RNA, 33 nt, Artificial Sequence
  40S ribosomal protein S14 (7-17)
aaggagaaaaaggaagagcaggugaucagccug

SEQ ID NO: 59948 - RNA, 33 nt, Artificial Sequence
  14-3-3 protein theta (158-168)
aaggagaugcagcccacccacccuaucagacug

SEQ ID NO: 59949 - RNA, 30 nt, Artificial Sequence
  Store-operated calcium entry-associated regulatory factor (86-95)
aagggcugggacggguacgaugugcagugg

SEQ ID NO: 59950 - RNA, 27 nt, Artificial Sequence
  Midasin (3076-3084)
aagaucgcccaguuccuggagagcgug

SEQ ID NO: 59951 - RNA, 27 nt, Artificial Sequence
  Heme oxygenase 1 (149-157)
aagaucgcccagaaagcucuggaccuc

SEQ ID NO: 59952 - RNA, 27 nt, Artificial Sequence
  WD repeat-containing protein 82 (84-92)
aagaucgacgauaccauuagauaccug

SEQ ID NO: 59953 - RNA, 33 nt, Artificial Sequence
  Cytochrome c oxidase subunit 2 (217-227)
aagaucuucgagaugggccccguguuuacccug

SEQ ID NO: 59954 - RNA, 27 nt, Artificial Sequence
  Poly (ADP-ribose) polymerase 14 (1060-1068)
aagaucggcagcauuauauuccaggug

SEQ ID NO: 59955 - RNA, 33 nt, Artificial Sequence
  KH domain-containing, RNA-binding, signal transduction-associated protein 1 (175-185)
aagauccugggcccccaggggaacaccauuaaa

SEQ ID NO: 59956 - RNA, 27 nt, Artificial Sequence
  Nucleolar pre-ribosomal-associated protein 1 (278-286)
aagauccugcccgaccucaacaccgug

SEQ ID NO: 59957 - RNA, 27 nt, Artificial Sequence
  Protein SON (1565-1573)
aagauccugcccaccagcgagacaaaa

SEQ ID NO: 59958 - RNA, 27 nt, Artificial Sequence
  Phosphatidylinositol 4-phosphate 5-kinase type-1 beta (263-271)
aagaucauggacuacagccugcuccuu

SEQ ID NO: 59959 - RNA, 30 nt, Artificial Sequence
  Heat shock protein HSP 90-alpha (389-398)
aagaucaugaaagacauucuggagaagaaa

SEQ ID NO: 59960 - RNA, 27 nt, Artificial Sequence
  Mitotic checkpoint serine/threonine-protein kinase BUB1 beta (908-916)
aagaucguggacuucagcuacuccguc

SEQ ID NO: 59961 - RNA, 27 nt, Artificial Sequence
  Tripeptidyl-peptidase 2 (81-89)
aagaucugggaccccgugcacagaguc

SEQ ID NO: 59962 - RNA, 33 nt, Artificial Sequence
  Cyclin-dependent kinase 16 (375-385)
aagcuggccgacuucggccucgcuagagcaaaa

SEQ ID NO: 59963 - RNA, 30 nt, Artificial Sequence
  Probable RNA-binding protein 23 (357-366)
aagcuggccgagggcgcugggauccagcuc

SEQ ID NO: 59964 - RNA, 30 nt, Artificial Sequence
  SAP domain-containing ribonucleoprotein (19-28)
aagcuggccgagcucaaacaggaaugccuu

SEQ ID NO: 59965 - RNA, 27 nt, Artificial Sequence
  LIM and senescent cell antigen-like-containing domain protein 1 (317-325)
aagcuggccgagacccucggcagaaaa

SEQ ID NO: 59966 - RNA, 27 nt, Artificial Sequence
  Protein NDRG1 (209-217)
aagcuggaccccaccaaaacaacucuc

SEQ ID NO: 59967 - RNA, 33 nt, Artificial Sequence
  SEC14-like protein 1 (60-70)
aagcuggacguggaugcccccagacuccuuaaa

SEQ ID NO: 59968 - RNA, 27 nt, Artificial Sequence
  B-cell receptor-associated protein 31 (167-175)
aagcuggacgugggcaacgccgagguc

SEQ ID NO: 59969 - RNA, 27 nt, Artificial Sequence
  WAS protein family homolog 1 (210-218)
aagcuguucgacgccccccucagcauc

SEQ ID NO: 59970 - RNA, 33 nt, Artificial Sequence
  Putative WAS protein family homolog 3 (208-218)
aagcuguucgacgccccccucagcaucuccaaa

SEQ ID NO: 59971 - RNA, 30 nt, Artificial Sequence
  Oxysterol-binding protein-related protein 9 (138-147)
aagcuguucgacgauaaacuccagaacugc

SEQ ID NO: 59972 - RNA, 30 nt, Artificial Sequence
  FACT complex subunit SSRP1 (413-422)
aagcuguucgacuuugugaacgccaaaaag

SEQ ID NO: 59973 - RNA, 36 nt, Artificial Sequence
  Eukaryotic translation initiation factor 3 subunit I (213-224)
aagcuguucgacagcaccacacucgagcaccagaaa

SEQ ID NO: 59974 - RNA, 27 nt, Artificial Sequence
  Interferon regulatory factor 4 (356-364)
aagcuguucgacacccagcaauuucuc

SEQ ID NO: 59975 - RNA, 27 nt, Artificial Sequence
  Protein transport protein Sec61 subunit alpha isoform 2 (95-103)
aagcuguucggcaugaucauuaccaua

SEQ ID NO: 59976 - RNA, 27 nt, Artificial Sequence
  Vacuolar fusion protein CCZ1 homolog (146-154)
aagcuguucaacggcaccuuucucaaa

SEQ ID NO: 59977 - RNA, 27 nt, Artificial Sequence
  Iron-responsive element-binding protein 2 (746-754)
aagcuguucaacaaauuuaucggcaag

SEQ ID NO: 59978 - RNA, 30 nt, Artificial Sequence
  Interleukin enhancer-binding factor 3 (591-600)
aagcuguuccccgacaccccucucgcccuu

SEQ ID NO: 59979 - RNA, 27 nt, Artificial Sequence
  DNA-directed DNA/RNA polymerase mu (238-246)
aagcuguucacccagaucuuuggcgug

SEQ ID NO: 59980 - RNA, 33 nt, Artificial Sequence
  Serine/threonine-protein phosphatase 2A 65 kDa regulatory subunit A alpha isoform (188-198)
aagcugggcgaguucgccaaagugcucgaacuu

SEQ ID NO: 59981 - RNA, 27 nt, Artificial Sequence
  ADP-ribosylation factor 5 (38-46)
aagcugggcgagaucgugaccacaauu

SEQ ID NO: 59982 - RNA, 24 nt, Artificial Sequence
  Ras GTPase-activating-like protein IQGAP2 (158-165)
aagcugggcaucgccccccagauu

SEQ ID NO: 59983 - RNA, 27 nt, Artificial Sequence
  Actin-like protein 6A (337-345)
aagcugaucgccaacaauaccacagug

SEQ ID NO: 59984 - RNA, 33 nt, Artificial Sequence
  Serine/threonine-protein kinase pim-2 (179-189)
aagcugaucgacuucggcagcggggcccuccuu

SEQ ID NO: 59985 - RNA, 36 nt, Artificial Sequence
  Serine/threonine-protein kinase pim-1 (274-285)
aagcugaucgacuucggcagcggggcccuccuuaaa

SEQ ID NO: 59986 - RNA, 27 nt, Artificial Sequence
  Dedicator of cytokinesis protein 4 (165-173)
aagcugaucgacaaacucgauagccuu

SEQ ID NO: 59987 - RNA, 27 nt, Artificial Sequence
  Protein furry homolog (375-383)
aagcugaucggccaggugcacgagguc

SEQ ID NO: 59988 - RNA, 27 nt, Artificial Sequence
  Nodal modulator 3 (764-772)
aagcugaucccccuccuucugcaguug

SEQ ID NO: 59989 - RNA, 30 nt, Artificial Sequence
  Nucleolar pre-ribosomal-associated protein 1 (172-181)
aagcugauccagcuccccguggucuacguu

SEQ ID NO: 59990 - RNA, 27 nt, Artificial Sequence
  Telomere-associated protein RIF1 (232-240)
aagcugaucagcgagcuccagaaacuu

SEQ ID NO: 59991 - RNA, 30 nt, Artificial Sequence
  26S protease regulatory subunit 6A (109-118)
aagcugaaacccggcgaccucguggggguc

SEQ ID NO: 59992 - RNA, 33 nt, Artificial Sequence
  Ras association domain-containing protein 1 (139-149)
aagcugcucgacgaugagcagccccuuagacug

SEQ ID NO: 59993 - RNA, 27 nt, Artificial Sequence
  Cytochrome P450 2J2 (182-190)
aagcugcucgacgaggugaccuaccuu

SEQ ID NO: 59994 - RNA, 30 nt, Artificial Sequence
  Phosphopantothenoylcysteine decarboxylase (39-48)
aagcugcucgacauccccggccuugaggug

SEQ ID NO: 59995 - RNA, 30 nt, Artificial Sequence
  Protein scribble homolog (779-788)
aagcugcucgaggugaacggcgucgcccuu

SEQ ID NO: 59996 - RNA, 27 nt, Artificial Sequence
  Integrator complex subunit 4-like protein 2 isoform X2 (94-102)
aagcugcucggcagcauggagcaggug

SEQ ID NO: 59997 - RNA, 27 nt, Artificial Sequence
  Nucleolar pre-ribosomal-associated protein 1 (170-178)
aagcugcucaacaaaaucuacgaggcc

SEQ ID NO: 59998 - RNA, 27 nt, Artificial Sequence
  Acidic leucine-rich nuclear phosphoprotein 32 family member A (137-145)
aagcugcucccccagcuuaccuaccug

SEQ ID NO: 59999 - RNA, 27 nt, Artificial Sequence
  Proheparin-binding EGF-like growth factor (2-10)
aagcugcuccccagcgugguccuuaaa

SEQ ID NO: 60000 - RNA, 30 nt, Artificial Sequence; identical to SEQ ID NO: 35773
  Transmembrane protein 43 (13-22)

SEQ ID NO: 60001 - RNA, 27 nt, Artificial Sequence
  Ubiquitin carboxyl-terminal hydrolase 48 (231-239)
aagcugcucagcaaauucuacgagcuu

SEQ ID NO: 60002 - RNA, 33 nt, Artificial Sequence
  Cytosolic acyl coenzyme A thioester hydrolase (210-220)
aagcugauggacgagguggccggcaucgucgcu

SEQ ID NO: 60003 - RNA, 27 nt, Artificial Sequence
  N-alpha-acetyltransferase 20 (79-87)
aagcugauggagcuccuugaagagauc

SEQ ID NO: 60004 - RNA, 27 nt, Artificial Sequence
  Transcription intermediary factor 1-alpha (341-349)
aagcugaugcagcaacagcaggaggug

SEQ ID NO: 60005 - RNA, 27 nt, Artificial Sequence
  Cohesin subunit SA-1 (228-236)
aagcugaugaccgcccucgugaacguc

SEQ ID NO: 60006 - RNA, 27 nt, Artificial Sequence
  Proteasome subunit alpha type-5 (151-159)
aagcugaacgccaccaauaucgagcuc

SEQ ID NO: 60007 - RNA, 27 nt, Artificial Sequence
  Myomegalin (424-432)
aagcugaacgagaugagcuacgaacuc

SEQ ID NO: 60008 - RNA, 27 nt, Artificial Sequence
  Twinfilin-1 (192-200)
aagcugaacaauagacagcucaacuac

SEQ ID NO: 60009 - RNA, 30 nt, Artificial Sequence
  Stromal interaction molecule 1 (571-580)
aagcugcccgacagcccugcccucgcuaaa

SEQ ID NO: 60010 - RNA, 27 nt, Artificial Sequence
  Probable U3 small nucleolar RNA-associated protein 11 (5-13)
aagcugcaggacggcgugcacaucauu

SEQ ID NO: 60011 - RNA, 27 nt, Artificial Sequence
  Hyaluronan mediated motility receptor (672-680)
aagcugcaggaggaacucaacaaagug

SEQ ID NO: 60012 - RNA, 27 nt, Artificial Sequence
  Centromere-associated protein E (1817-1825)
aagcugcaggagaaaauccaagaacuc

SEQ ID NO: 60013 - RNA, 27 nt, Artificial Sequence
  Zinc finger C3H1 domain-containing protein (891-899)
aagcugcaggagcaaauccacagagug

SEQ ID NO: 60014 - RNA, 30 nt, Artificial Sequence
  Transmembrane protein 131 (929-938)
aagcugagagagcccaacuucacccucaaa

SEQ ID NO: 60015 - RNA, 27 nt, Artificial Sequence
  EF-hand domain-containing protein D1 (174-182)
aagcugagcgagaucgacguggcccuc

SEQ ID NO: 60016 - RNA, 27 nt, Artificial Sequence
  Keratin, type II cytoskeletal 8 (148-156)
aagcugagcgagcucgaagccgcucuu

SEQ ID NO: 60017 - RNA, 27 nt, Artificial Sequence
  78 kDa glucose-regulated protein (2-10)
aagcugagccucguggccgcuaugcuu

SEQ ID NO: 60018 - RNA, 27 nt, Artificial Sequence
  Retrotransposon-derived protein PEG10 (112-120)
aagcugaccgaggaaaacacaacucuc

SEQ ID NO: 60019 - RNA, 27 nt, Artificial Sequence
  Zinc finger MYM-type protein 2 (166-174)
aagcugaccgagaucagacacgaagug

SEQ ID NO: 60020 - RNA, 30 nt, Artificial Sequence
  Cyclin-dependent kinase 2 (24-33)
aagcugaccggcgagguggucgcccucaaa

SEQ ID NO: 60021 - RNA, 30 nt, Artificial Sequence
  Transforming acidic coiled-coil-containing protein 3 (599-608)
aagcugguggaguucgacuuucucggcgcc

SEQ ID NO: 60022 - RNA, 27 nt, Artificial Sequence
  Adenylyl cyclase-associated protein 1 (465-473)
aagcuggugaccacagucacugagauc

SEQ ID NO: 60023 - RNA, 27 nt, Artificial Sequence
  Inactive hydroxysteroid dehydrogenase-like protein 1 (148-156)
aagcugugggacaucauuaacgugaau

SEQ ID NO: 60024 - RNA, 27 nt, Artificial Sequence
  UBX domain-containing protein 11 (82-90)
aagcugugggaccucgagcagcaagug

SEQ ID NO: 60025 - RNA, 27 nt, Artificial Sequence
  Pecanex-like protein 3 (1234-1242)
aagcugugggaccuccuuuacaaacug

SEQ ID NO: 60026 - RNA, 27 nt, Artificial Sequence
  MORF4 family-associated protein 1-like 1 (56-64)
aagcugugggagauggacaacaugcuc

SEQ ID NO: 60027 - RNA, 30 nt, Artificial Sequence; identical to SEQ ID NO: 35800
  MORF4 family-associated protein 1-like 1 (56-65)

SEQ ID NO: 60028 - RNA, 33 nt, Artificial Sequence; identical to SEQ ID NO: 35801
  MORF4 family-associated protein 1-like 1 (56-66)

SEQ ID NO: 60029 - RNA, 27 nt, Artificial Sequence
  Rho guanine nucleotide exchange factor 3 (108-116)
aagcuguggagcgagaccuucgacgug

SEQ ID NO: 60030 - RNA, 27 nt, Artificial Sequence
  ADP-ribosylation factor-like protein 4C (157-165)
aagcuguacgagaugauccucaaaaga

SEQ ID NO: 60031 - RNA, 27 nt, Artificial Sequence
  Splicing factor 3B subunit 4 (78-86)
aagcuguacggcaaacccaucagagug

SEQ ID NO: 60032 - RNA, 27 nt, Artificial Sequence
  Tuberin (574-582)
aagcuguacacccuccccgccagccac

SEQ ID NO: 60033 - RNA, 33 nt, Artificial Sequence
  E3 ubiquitin-protein ligase BRE1A (694-704)
aagauggccgacgaggaugcucugagaaaaauc

SEQ ID NO: 60034 - RNA, 27 nt, Artificial Sequence
  Melanoma-associated antigen 12 (112-120)
aagauggccgagcuggugcacuuccuc

SEQ ID NO: 60035 - RNA, 33 nt, Artificial Sequence
  Ribosome biogenesis protein BOP1 (115-125)
aagauggacgaucccgacuacuggagaaccgug

SEQ ID NO: 60036 - RNA, 27 nt, Artificial Sequence
  Talin-1 (535-543)
aagauggacgagagcaaacacgaaauc

SEQ ID NO: 60037 - RNA, 27 nt, Artificial Sequence
  KDEL motif-containing protein 2 (215-223)
aagauguucagcgacgagauccugcuc

SEQ ID NO: 60038 - RNA, 30 nt, Artificial Sequence
  Structural maintenance of chromosomes protein 5 (378-387)
aagaugaucgaggaccugcagaacgaacuc

SEQ ID NO: 60039 - RNA, 36 nt, Artificial Sequence
  UPF0428 protein CXorf56 (70-81)
aagaugaaaggcacccugaucgacaaccaguucaag

SEQ ID NO: 60040 - RNA, 33 nt, Artificial Sequence
  Tropomodulin-3 (307-317)
aagaugcuggaggaaaacaccaauauccucaaa

SEQ ID NO: 60041 - RNA, 27 nt, Artificial Sequence
  HEAT repeat-containing protein 1 (682-690)
aagaugguggaggaccugaucagcguc

SEQ ID NO: 60042 - RNA, 27 nt, Artificial Sequence
  cAMP-dependent protein kinase type I-beta regulatory subunit (244-252)
aagauguacgaggaauuccugagcaaa

SEQ ID NO: 60043 - RNA, 30 nt, Artificial Sequence
  La-related protein 4B (374-383)
aagcccgccgcuagcccucugaccucccuc

SEQ ID NO: 60044 - RNA, 27 nt, Artificial Sequence
  Myosin-9 (517-525)
aagcccgccggcccuccagggauccug

SEQ ID NO: 60045 - RNA, 27 nt, Artificial Sequence
  Serine/threonine-protein kinase Nek6 (199-207)
aagcccgccaacguguucaucaccgcu

SEQ ID NO: 60046 - RNA, 27 nt, Artificial Sequence
  Acid ceramidase (209-217)
aagcccggccuguucagccucacccuu

SEQ ID NO: 60047 - RNA, 27 nt, Artificial Sequence
  BAG family molecular chaperone regulator 3 (324-332)
aagcccggcccuguggggccagagcug

SEQ ID NO: 60048 - RNA, 27 nt, Artificial Sequence
  Proteasome assembly chaperone 1 (230-238)
aagcccauccugagcaccagaucccuc

SEQ ID NO: 60049 - RNA, 30 nt, Artificial Sequence
  Radixin (3-12)
aagcccaucaacgugagagucaccacaaug

SEQ ID NO: 60050 - RNA, 27 nt, Artificial Sequence
  Retinoblastoma-binding protein 5 (324-332)
aagcccaaaaccacaaacaucgagcug

SEQ ID NO: 60051 - RNA, 27 nt, Artificial Sequence
  Transketolase (451-459)
aagccccuggacagaaaacucauccuu

SEQ ID NO: 60052 - RNA, 27 nt, Artificial Sequence
  Forkhead box protein N2 (170-178)
aagccccugccucucaaaaccgcccuu

SEQ ID NO: 60053 - RNA, 33 nt, Artificial Sequence
  Galectin-3 (139-149)
aagcccaacgccaauagaaucgcucuggacuuc

SEQ ID NO: 60054 - RNA, 27 nt, Artificial Sequence
  Catenin beta-1 (666-674)
aagccccaggacuacaaaaagagacug

SEQ ID NO: 60055 - RNA, 33 nt, Artificial Sequence
  Catenin beta-1 (666-676)
aagccccaggacuacaaaaagagacugagcgug

SEQ ID NO: 60056 - RNA, 27 nt, Artificial Sequence
  Serine/threonine-protein kinase tousled-like 2 (155-163)
aagcccagacuggacaccgagcagcuc

SEQ ID NO: 60057 - RNA, 27 nt, Artificial Sequence
  Retrotransposon-derived protein PEG10 (325-333)
aagcccagaagcccuccaagggcccug

SEQ ID NO: 60058 - RNA, 33 nt, Artificial Sequence
  Retrotransposon-derived protein PEG10 (325-335)
aagcccagaagcccuccaagggcccuggugcuc

SEQ ID NO: 60059 - RNA, 27 nt, Artificial Sequence
  rRNA-processing protein UTP23 homolog (149-157)
aagcccagcccuaaaaccaucgccuuc

SEQ ID NO: 60060 - RNA, 27 nt, Artificial Sequence
  60S ribosomal protein L13a (130-138)
aagcccaccagaaaauucgccuaccug

SEQ ID NO: 60061 - RNA, 30 nt, Artificial Sequence; identical to SEQ ID NO: 35834
  U3 small nucleolar ribonucleoprotein protein IMP3 (14-23)

SEQ ID NO: 60062 - RNA, 27 nt, Artificial Sequence
  Src kinase-associated phosphoprotein 2 (319-327)
aagagaggcgacgugaucuacauucug

SEQ ID NO: 60063 - RNA, 30 nt, Artificial Sequence
  Guanylate-binding protein 4 (305-314)
aagagacugggcacccucguggucacauac

SEQ ID NO: 60064 - RNA, 33 nt, Artificial Sequence
  Eukaryotic translation initiation factor 4 gamma 1 (570-580)
aagagauacgacagggaguuccugcucggcuuu

SEQ ID NO: 60065 - RNA, 30 nt, Artificial Sequence
  Hom s 1 (791-800)
aagagcaugaacgccaauaccaucacaaaa

SEQ ID NO: 60066 - RNA, 33 nt, Artificial Sequence
  Prefoldin subunit 5 (107-117)
aagaccgccgaggacgcuaaagauuucuuuaag

SEQ ID NO: 60067 - RNA, 33 nt, Artificial Sequence
  Death-inducer obliterator 1 (585-595)
aagaccgcccccccuggcagcgcuguggggaaa

SEQ ID NO: 60068 - RNA, 27 nt, Artificial Sequence
  Volume-regulated anion channel subunit LRRC8C (100-108)
aagaccgaccuggaucuccagcaauac

SEQ ID NO: 60069 - RNA, 27 nt, Artificial Sequence
  Activating transcription factor 7-interacting protein 1 (394-402)
aagaccaucgacgccagcguguccaaa

SEQ ID NO: 60070 - RNA, 30 nt, Artificial Sequence
  Arfaptin-1 (216-225)
aagaccaucgaggacacacugaugacugug

SEQ ID NO: 60071 - RNA, 36 nt, Artificial Sequence
  UPF0769 protein C21orf59 (114-125)
aagaccaucgaggaagccaaagcuauuauaagcaag

SEQ ID NO: 60072 - RNA, 33 nt, Artificial Sequence
  Acyl-CoA dehydrogenase family member 9, mitochondrial (521-531)
aagaccaucauggaggaacagcuggugcucaaa

SEQ ID NO: 60073 - RNA, 27 nt, Artificial Sequence
  Beta-synuclein (32-40)
aagaccaaagagggcgugcuguacguc

SEQ ID NO: 60074 - RNA, 27 nt, Artificial Sequence
  Transcriptional repressor protein YY1 (213-221)
aagacccuggagggcgaauucagcgug

SEQ ID NO: 60075 - RNA, 30 nt, Artificial Sequence
  SWI/SNF-related matrix-associated actin-dependent regulator of chromatin subfamily A member 5 (112-121)
aagacccccacaagcccucugaaaaugaag

SEQ ID NO: 60076 - RNA, 27 nt, Artificial Sequence
  Short coiled-coil protein (97-105)
aagaccagacugaucaaccaggugcuc

SEQ ID NO: 60077 - RNA, 27 nt, Artificial Sequence
  Collagen alpha-2(VI) chain (132-140)
aagaccagaguguucgccgucguuauc

SEQ ID NO: 60078 - RNA, 27 nt, Artificial Sequence
  Ubinuclein-2 (526-534)
aagaccagcgacaaaccccugauguac

SEQ ID NO: 60079 - RNA, 27 nt, Artificial Sequence
  26S proteasome non-ATPase regulatory subunit 6 (126-134)
aagaccuacgacaaaacaguggcccug

SEQ ID NO: 60080 - RNA, 30 nt, Artificial Sequence
  Coiled-coil domain-containing protein 14 (522-531)
aagaccuacgagaacgugcugagcuccaga

SEQ ID NO: 60081 - RNA, 30 nt, Artificial Sequence
  Heterogeneous nuclear ribonucleoprotein L-like (486-495)
aagguguucgacgccaaacccagcgcuaag

SEQ ID NO: 60082 - RNA, 27 nt, Artificial Sequence
  Dihydroxyacetone phosphate acyltransferase (128-136)
aagguguucaaacagaucuuuagcaag

SEQ ID NO: 60083 - RNA, 30 nt, Artificial Sequence
  Ubiquitin carboxyl-terminal hydrolase 11 (139-148)
aaggugaucgagcugcccaacauucagaaa

SEQ ID NO: 60084 - RNA, 27 nt, Artificial Sequence
  Syntenin-1 (14-22)
aaggugauccaggcccaaaccgcuuuc

SEQ ID NO: 60085 - RNA, 27 nt, Artificial Sequence
  Plasmalemma vesicle-associated protein (164-172)
aaggugaaaacccuggaggucgaaauc

SEQ ID NO: 60086 - RNA, 27 nt, Artificial Sequence
  Mitofusin-2 (84-92)
aaggugagaggcaucagcgagguccug

SEQ ID NO: 60087 - RNA, 27 nt, Artificial Sequence
  Heterogeneous nuclear ribonucleoprotein R isoform 7 (155-163)
aagguguggggcaacgucguuaccgug

SEQ ID NO: 60088 - RNA, 30 nt, Artificial Sequence
  Small integral membrane protein 20 (58-67)
aagguguggagcgaccccuucggcagaaaa

SEQ ID NO: 60089 - RNA, 27 nt, Artificial Sequence
  Stromal interaction molecule 2 (478-486)
aagguguacaacggcauccuggagaaa

SEQ ID NO: 60090 - RNA, 27 nt, Artificial Sequence
  Homeobox-containing protein 1 (325-333)
aagguguacaacugguucgccaauaga

SEQ ID NO: 60091 - RNA, 27 nt, Artificial Sequence
  Threonylcarbamoyladenosine tRNA methylthiotransferase (405-413)
aagguguacacccccagcaucuccaaa

SEQ ID NO: 60092 - RNA, 27 nt, Artificial Sequence
  WD repeat-containing protein 1 (65-73)
aaguacgcccccagcggcuucuauauc

SEQ ID NO: 60093 - RNA, 27 nt, Artificial Sequence
  Alpha-soluble NSF attachment protein (227-235)
aaguacgaggaacuguuccccgccuuu

SEQ ID NO: 60094 - RNA, 27 nt, Artificial Sequence
  Putative E3 ubiquitin-protein ligase UBR7 (125-133)
aaguacaacgacaauuucuuuggccug

SEQ ID NO: 60095 - RNA, 27 nt, Artificial Sequence
  Rho guanine nucleotide exchange factor 1 (516-524)
aaguacccccugcuccuucagagcauc

SEQ ID NO: 60096 - RNA, 27 nt, Artificial Sequence
  Zinc finger MYND domain-containing protein 11 (415-423)
aaguacaccaaaaucuucaacgacuuu

SEQ ID NO: 60097 - RNA, 24 nt, Artificial Sequence
  Transformation/transcription domain-associated protein (379-386)
cuggccgaccucgugcaccauguc

SEQ ID NO: 60098 - RNA, 24 nt, Artificial Sequence
  Ras GTPase-activating-like protein IQGAP1 (1072-1079)
cuggcccccguggucaaggagauc

SEQ ID NO: 60099 - RNA, 27 nt, Artificial Sequence
  Vimentin (124-132)
cuggagcagcaaaacaagauccuccuu

SEQ ID NO: 60100 - RNA, 27 nt, Artificial Sequence
  HLA class II histocompatibility antigen, DRB1-15 beta chain (48-56)
cugggcagacccgacgccgaguacugg

SEQ ID NO: 60101 - RNA, 27 nt, Artificial Sequence
  U5 small nuclear ribonucleoprotein 200 kDa helicase (620-628)
cugcacgacgauagaggccccgugcuc

SEQ ID NO: 60102 - RNA, 24 nt, Artificial Sequence
  Elongation factor 2 (218-225)
cugcacggcugggccuucacccuc

SEQ ID NO: 60103 - RNA, 27 nt, Artificial Sequence
  Importin subunit alpha-1 (260-268)
cugcaccaugacgaucccgaggugcuc

SEQ ID NO: 60104 - RNA, 27 nt, Artificial Sequence
  Protein kinase C delta type (286-294)
cugcucgccgaggcucuuaaccaggug

SEQ ID NO: 60105 - RNA, 27 nt, Artificial Sequence
  Protein sel-1 homolog 1 (580-588)
cugcucgccgagcagggcuacgaagug

SEQ ID NO: 60106 - RNA, 27 nt, Artificial Sequence
  BRCA1-associated ATM activator 1 (541-549)
cugcucgccagcgaggugccccagcuu

SEQ ID NO: 60107 - RNA, 27 nt, Artificial Sequence
  15 kDa selenoprotein (21-29)
cugcucgccaccgugcuucaggcuguc

SEQ ID NO: 60108 - RNA, 27 nt, Artificial Sequence
  Talin-1 (2250-2258)
cugcucgaccacgugcuucugaccuug

SEQ ID NO: 60109 - RNA, 24 nt, Artificial Sequence
  Annexin A11 (433-440)
cugcucgacaucagaagcgaguac

SEQ ID NO: 60110 - RNA, 24 nt, Artificial Sequence
  U3 small nucleolar ribonucleoprotein protein IMP3 (79-86)
cugcucgacaagcuuuacgcccug

SEQ ID NO: 60111 - RNA, 27 nt, Artificial Sequence
  WD repeat-containing protein 36 (605-613)
cugcucgacagcgccccccuuaacgug

SEQ ID NO: 60112 - RNA, 27 nt, Artificial Sequence
  Group XIIA secretory phospholipase A2 (158-166)
cugcucuucgacagcgugauccaccuu

SEQ ID NO: 60113 - RNA, 27 nt, Artificial Sequence
  Ras-related GTP-binding protein A (204-212)
cugcucuucgagagagccaccuuucuu

SEQ ID NO: 60114 - RNA, 27 nt, Artificial Sequence
  Transcription factor 20 (837-845)
cugcuccacgaggaaaacuucagcgug

SEQ ID NO: 60115 - RNA, 27 nt, Artificial Sequence
  NADH dehydrogenase (ubiquinone) 1 alpha subcomplex subunit 1 (16-24)
cugcucauccccggccuugccaccgcu

SEQ ID NO: 60116 - RNA, 27 nt, Artificial Sequence
  ERO1-like protein alpha (260-268)
cugcuccuugagauccugcacgaaauu

SEQ ID NO: 60117 - RNA, 27 nt, Artificial Sequence
  Staphylococcal nuclease domain-containing protein 1 (186-194)
cugcuccuucccgacuacuaucuggug

SEQ ID NO: 60118 - RNA, 33 nt, Artificial Sequence
  Staphylococcal nuclease domain-containing protein 1 (186-196)
cugcuccuucccgacuacuaucuggugaccguc

SEQ ID NO: 60119 - RNA, 27 nt, Artificial Sequence
  Histone H2B type 2-F (101-109)
cugcuccuucccggcgagcuggccaag

SEQ ID NO: 60120 - RNA, 27 nt, Artificial Sequence
  Clathrin heavy chain 1 (1422-1430)
cugcucauggugcuuagccccagacug

SEQ ID NO: 60121 - RNA, 27 nt, Artificial Sequence
  DNA-dependent protein kinase catalytic subunit (2454-2462)
cugcucaaccccguggucgaguucguu

SEQ ID NO: 60122 - RNA, 27 nt, Artificial Sequence
  Superkiller viralicidic activity 2-like 2 (273-281)
cugcuccccgacaacgugcacuacguc

SEQ ID NO: 60123 - RNA, 27 nt, Artificial Sequence
  Homocysteine-responsive endoplasmic reticulum-resident ubiquitin-like domain member 1 protein (222-230)
cugcuccccgagggcccuccagccauc

SEQ ID NO: 60124 - RNA, 27 nt, Artificial Sequence
  Potassium channel subfamily K member 4 (365-373)
cugcuccccccuccaccgugccccgcc

SEQ ID NO: 60125 - RNA, 27 nt, Artificial Sequence
  Casein kinase I isoform alpha (57-65)
cugcucuacgagagcaagcuuuauaaa

SEQ ID NO: 60126 - RNA, 27 nt, Artificial Sequence
  Syntenin-1 (290-298)
cugauggaccacaccauccccgaggug

SEQ ID NO: 60127 - RNA, 27 nt, Artificial Sequence
  Bombesin receptor-activated protein C6orf89 (120-128)
cugaugagccuccccaucgccaagaaa

SEQ ID NO: 60128 - RNA, 27 nt, Artificial Sequence
  Constitutive coactivator of PPAR-gamma-like protein 1 (567-575)
cugauguaccccuauaucuuccacgug

SEQ ID NO: 60129 - RNA, 27 nt, Artificial Sequence
  Peripheral plasma membrane protein CASK (705-713)
cugcccgccuucaagagaaaaacccuc

SEQ ID NO: 60130 - RNA, 27 nt, Artificial Sequence
  Butyrophilin subfamily 3 member A3 secreted isoform (388-396)
cugcccgcccacccuggcgcugaggug

SEQ ID NO: 60131 - RNA, 27 nt, Artificial Sequence
  FERM domain-containing protein 4A (166-174)
cugcccgcccucccuacccaggcucuu

SEQ ID NO: 60132 - RNA, 27 nt, Artificial Sequence
  Proline-rich protein PRCC (42-50)
cugcccgccccuaagggcccagcucuc

SEQ ID NO: 60133 - RNA, 27 nt, Artificial Sequence
  Serine/threonine-protein kinase SIK2 (446-454)
cugcccgccagcgugcacccucagcuc

SEQ ID NO: 60134 - RNA, 33 nt, Artificial Sequence
  Host cell factor 1 (1377-1387)
cugcccgacgccaccagcucccacagaacagug

SEQ ID NO: 60135 - RNA, 27 nt, Artificial Sequence
  Actin-related protein 2 (246-254)
cugcccgacggcagaaucauuaaggug

SEQ ID NO: 60136 - RNA, 27 nt, Artificial Sequence
  Transducin-like enhancer protein 4 (517-525)
cugcccgacggcagaacccucaucgug

SEQ ID NO: 60137 - RNA, 33 nt, Artificial Sequence
  Biogenesis of lysosome-related organelles complex 1 subunit 6 (61-71)
cugcccgaccuccagagaagcaagcaagcccuu

SEQ ID NO: 60138 - RNA, 27 nt, Artificial Sequence
  Integrator complex subunit 11 (441-449)
cugcccgaggccaagaaaccuagacuc

SEQ ID NO: 60139 - RNA, 27 nt, Artificial Sequence
  Queuine tRNA-ribosyltransferase subunit QTRTD1 (120-128)
cugcccgaggacaagccuagacucauc

SEQ ID NO: 60140 - RNA, 27 nt, Artificial Sequence
  Tyrosine-protein phosphatase non-receptor type 11 (283-291)
cugcccuucgaccacaccagagugguc

SEQ ID NO: 60141 - RNA, 27 nt, Artificial Sequence
  Polypyrimidine tract-binding protein 2 (91-99)
cugcccuucggcaaggugaccaacauc

SEQ ID NO: 60142 - RNA, 27 nt, Artificial Sequence
  Nodal modulator 3 (615-623)
cugccccaccauagagugaucgagguc

SEQ ID NO: 60143 - RNA, 27 nt, Artificial Sequence
  RNA-binding protein 33 (711-719)
cugcccaucgccccuagccacgugauu

SEQ ID NO: 60144 - RNA, 27 nt, Artificial Sequence
  Leucine-rich repeat-containing protein 59 (38-46)
cugcccaaggccaccauccucgaccuu

SEQ ID NO: 60145 - RNA, 27 nt, Artificial Sequence
  26S proteasome non-ATPase regulatory subunit 6 (11-19)
cugcccaagaacccugaccucagaauc

SEQ ID NO: 60146 - RNA, 27 nt, Artificial Sequence
  Telomerase protein component 1 (671-679)
cugccccuccuuccuggcagaaccgug

SEQ ID NO: 60147 - RNA, 27 nt, Artificial Sequence
  Transcription factor Sp3 (515-523)
cugcccaaccuccagaccgugacaguc

SEQ ID NO: 60148 - RNA, 27 nt, Artificial Sequence
  Eukaryotic initiation factor 4A-III (354-362)
cugcccaacaauagagagcucuacauc

SEQ ID NO: 60149 - RNA, 24 nt, Artificial Sequence
  eIF-2-alpha kinase activator GCN1 (1363-1370)
cugcccccucucgugccagccauc

SEQ ID NO: 60150 - RNA, 27 nt, Artificial Sequence
  E3 ubiquitin-protein ligase RNF181 (50-58)
cugcccccuccagccgcuaagaccgug

SEQ ID NO: 60151 - RNA, 27 nt, Artificial Sequence
  Mediator of RNA polymerase II transcription subunit 7 (10-18)
cugcccccuccaccgaugcaguacauc

SEQ ID NO: 60152 - RNA, 27 nt, Artificial Sequence
  Crooked neck-like protein 1 (45-53)
cugcccccuccaccgcagcaaaagauc

SEQ ID NO: 60153 - RNA, 27 nt, Artificial Sequence
  Terminal uridylyltransferase 7 (284-292)
cugcccccuccaaccccgagccagauc

SEQ ID NO: 60154 - RNA, 27 nt, Artificial Sequence
  Transcription elongation factor SPT4 (93-101)
cugccccagggcaucgugagagagcuc

SEQ ID NO: 60155 - RNA, 30 nt, Artificial Sequence
  Homeobox protein TGIF2 (105-114)
cugcccagaggcagcuccccuucugugcuc

SEQ ID NO: 60156 - RNA, 27 nt, Artificial Sequence
  ATP-dependent RNA helicase DHX36 (300-308)
cugcccagaaagcagggcagcauccuc

SEQ ID NO: 60157 - RNA, 27 nt, Artificial Sequence
  Carnitine O-palmitoyltransferase 1, liver isoform (171-179)
cugcccagacucccugugccagccguc

SEQ ID NO: 60158 - RNA, 30 nt, Artificial Sequence
  Beta-hexosaminidase subunit beta (8-17)
cugcccagaccuccaaugcuccuugcccug

SEQ ID NO: 60159 - RNA, 27 nt, Artificial Sequence
  cGMP-inhibited 3',5'-cyclic phosphodiesterase B (240-248)
cugcccagcgcccucagaccucuucug

SEQ ID NO: 60160 - RNA, 30 nt, Artificial Sequence
  Polymerase delta-interacting protein 3 (241-250)
cugcccagcuccaucagaaccaaggcccuc

SEQ ID NO: 60161 - RNA, 24 nt, Artificial Sequence
  Runt-related transcription factor 2 (116-123)
cugcccguggccuucaaggucguu

SEQ ID NO: 60162 - RNA, 27 nt, Artificial Sequence
  THUMP domain-containing protein 3 (124-132)
cugcccuggagcaacccucucaaggug

SEQ ID NO: 60163 - RNA, 27 nt, Artificial Sequence
  Peptidyl-prolyl cis-trans isomerase FKBP4 (200-208)
cugcccuacggccucgagagagccauc

SEQ ID NO: 60164 - RNA, 24 nt, Artificial Sequence
  eIF-2-alpha kinase activator GCN1 (2077-2084)
cugcccuaccucgugccuaagcuu

SEQ ID NO: 60165 - RNA, 24 nt, Artificial Sequence
  E3 ubiquitin-protein ligase UBR4 (260-267)
cugcccuaccagaucaagaaaauu

SEQ ID NO: 60166 - RNA, 30 nt, Artificial Sequence
  Lysyl oxidase homolog 3 (408-417)
cugcccuacaccggcgccgagacaagaauc

SEQ ID NO: 60167 - RNA, 27 nt, Artificial Sequence
  Histone acetyltransferase KAT6B (711-719)
cugagcgaccucggcagacuuuccuac

SEQ ID NO: 60168 - RNA, 27 nt, Artificial Sequence
  Phosphatidylinositide phosphatase SAC2 (667-675)
cugagccucgagaaccuugaaaagauc

SEQ ID NO: 60169 - RNA, 33 nt, Artificial Sequence
  Serpin B6 (76-86)
cugaccgaggugaacaagacaggcacucaguac

SEQ ID NO: 60170 - RNA, 30 nt, Artificial Sequence
  Heat shock-related 70 kDa protein 2 (213-222)
cugaccaucgaggacggcauuuucgaagug

SEQ ID NO: 60171 - RNA, 30 nt, Artificial Sequence
  Heat shock protein HSP 90-beta (36-45)
cugguggacaccggcaucgggaugacaaag

SEQ ID NO: 60172 - RNA, 27 nt, Artificial Sequence
  Interleukin-32 (97-105)
cuggugcacgccguccaggcucucugg

SEQ ID NO: 60173 - RNA, 27 nt, Artificial Sequence
  Protein diaphanous homolog 1 (1090-1098)
cuguacaaggagcucggcgaauauuuc

SEQ ID NO: 60174 - RNA, 27 nt, Artificial Sequence
  AKT-interacting protein (116-124)
cuguaccaggacggcguguucaaguuu

SEQ ID NO: 60175 - RNA, 24 nt, Artificial Sequence
  HLA class I histocompatibility antigen, Cw-3 alpha chain (4-11)
auggcccccagaacccugauccuc

SEQ ID NO: 60176 - RNA, 27 nt, Artificial Sequence
  Charged multivesicular body protein 2a (127-135)
auggaguucgaaagacaggccgagauc

SEQ ID NO: 60177 - RNA, 27 nt, Artificial Sequence
  Bifunctional glutamate/proline-tRNA ligase (487-495)
auggagugggacaagaucugggccuuc

SEQ ID NO: 60178 - RNA, 27 nt, Artificial Sequence
  Sodium-coupled neutral amino acid transporter 1 (2-10)
augcacuucaagagcggccuggagcuc

SEQ ID NO: 60179 - RNA, 27 nt, Artificial Sequence
  Nucleoside diphosphate kinase A (68-76)
augcacagcggccccguggucgccaug

SEQ ID NO: 60180 - RNA, 33 nt, Artificial Sequence
  Cytochrome b (53-63)
augcacuacagccccgacgccuccaccgcuuuc

SEQ ID NO: 60181 - RNA, 27 nt, Artificial Sequence
  Lysosomal protective protein (1-9)
augaucagagccgcucccccuccacug

SEQ ID NO: 60182 - RNA, 27 nt, Artificial Sequence
  78 kDa glucose-regulated protein (1-9)
augaagcugagccucguggccgcuaug

SEQ ID NO: 60183 - RNA, 27 nt, Artificial Sequence
  Putative uncharacterized protein ZNF436-AS1 (1-9)
augcuggccgugcccgucagacucaag

SEQ ID NO: 60184 - RNA, 27 nt, Artificial Sequence
  Transformation/transcription domain-associated protein (1824-1832)
augcuggacagccucagaaucuaccuu

SEQ ID NO: 60185 - RNA, 33 nt, Artificial Sequence
  Ubiquitin carboxyl-terminal hydrolase 11 (568-578)
augcuguucggccacccccuccuugugagcguc

SEQ ID NO: 60186 - RNA, 24 nt, Artificial Sequence
  Beta-1-syntrophin (41-48)
augcccauccugauuagcaagaua

SEQ ID NO: 60187 - RNA, 27 nt, Artificial Sequence
  Neuroblast differentiation-associated protein AHNAK (882-890)
augcccaaguucagcaugccuggcuuu

SEQ ID NO: 60188 - RNA, 27 nt, Artificial Sequence
  Neuroblast differentiation-associated protein AHNAK (2766-2774)
augcccaagaucaaaaugccuaagauu

SEQ ID NO: 60189 - RNA, 27 nt, Artificial Sequence
  Synergin gamma (422-430)
augccccugccuggcaccaaggcccuc

SEQ ID NO: 60190 - RNA, 27 nt, Artificial Sequence
  Cyclin-dependent kinase 6 (54-62)
augccccugagcaccaucagagaggug

SEQ ID NO: 60191 - RNA, 27 nt, Artificial Sequence
  Type II inositol 3,4-bisphosphate 4-phosphatase (788-796)
augcccccugacuacaucagccacuuc

SEQ ID NO: 60192 - RNA, 27 nt, Artificial Sequence
  Double-strand-break repair protein rad21 homolog (468-476)
augcccccuccaccgccccagggcgug

SEQ ID NO: 60193 - RNA, 27 nt, Artificial Sequence
  Eukaryotic initiation factor 4A-III (311-319)
augccccagaaggagagagaaagcauc

SEQ ID NO: 60194 - RNA, 30 nt, Artificial Sequence
  Mitotic-spindle organizing protein 2A (99-108)
augcccagacagccuagcgccaccaggcug

SEQ ID NO: 60195 - RNA, 27 nt, Artificial Sequence
  UDP-N-acetylglucosamine-peptide N-acetylglucosaminyltransferase 110 kDa subunit (774-782)
augcccgugaucccuaugaacaccauu

SEQ ID NO: 60196 - RNA, 27 nt, Artificial Sequence
  Protein diaphanous homolog 1 (845-853)
augcccuaccaggagaucaagaacgug

SEQ ID NO: 60197 - RNA, 27 nt, Artificial Sequence
  Prelamin-A/C (199-207)
augagagccaggaugcagcaacagcug

SEQ ID NO: 60198 - RNA, 27 nt, Artificial Sequence
  Transcobalamin-2 (1-9)
augagacaccugggcgccuuccucuuu

SEQ ID NO: 60199 - RNA, 27 nt, Artificial Sequence
  Suppressor of SWI4 1 homolog (100-108)
augagacugcccggcgggccuacccuc

SEQ ID NO: 60200 - RNA, 27 nt, Artificial Sequence
  Calcium/calmodulin-dependent protein kinase II inhibitor 1 (17-25)
augaccgacaaggcccccccuggcgug

SEQ ID NO: 60201 - RNA, 27 nt, Artificial Sequence
  Insulin receptor substrate 2 (543-551)
augaccauggacagaccccugagccac

SEQ ID NO: 60202 - RNA, 27 nt, Artificial Sequence
  Necdin (58-66)
auggugaaggacgucaucggcagcuac

SEQ ID NO: 60203 - RNA, 36 nt, Artificial Sequence
  ATP-citrate synthase (529-540)
augguguaccccuucaccggcgaccacaagcagaaa

SEQ ID NO: 60204 - RNA, 27 nt, Artificial Sequence
  Melanoma-associated antigen D2 (110-118)
aacgccgacccccaggcugugaccaug

SEQ ID NO: 60205 - RNA, 27 nt, Artificial Sequence
  FERM domain-containing protein 8 (198-206)
aacgccuacagacaggugcaagagguc

SEQ ID NO: 60206 - RNA, 27 nt, Artificial Sequence
  Rapamycin-insensitive companion of mTOR (139-147)
aacgagguggaaagaacccaggcccug

SEQ ID NO: 60207 - RNA, 27 nt, Artificial Sequence
  26S protease regulatory subunit 4 (119-127)
aaccacgccaucgugagcaccuccguc

SEQ ID NO: 60208 - RNA, 24 nt, Artificial Sequence
  Serine/threonine-protein phosphatase 2A catalytic subunit beta isoform (229-236)
aaccacgccaauggccugacccuc

SEQ ID NO: 60209 - RNA, 30 nt, Artificial Sequence
  Transcription factor 4 (402-411)
aaccacgccgugggccccagcaccgcuaug

SEQ ID NO: 60210 - RNA, 27 nt, Artificial Sequence
  Translationally-controlled tumor protein (75-83)
aaccaccaucugcaggagaccagcuuc

SEQ ID NO: 60211 - RNA, 27 nt, Artificial Sequence
  SHC-transforming protein 4 (284-292)
aaccaccauaugcagagcaucuccuuc

SEQ ID NO: 60212 - RNA, 27 nt, Artificial Sequence
  E3 ubiquitin-protein ligase synoviolin (308-316)
aaccacaucuuccauaccagcugccug

SEQ ID NO: 60213 - RNA, 27 nt, Artificial Sequence
  Dedicator of cytokinesis protein 8 (737-745)
aaccaccuggagaaguucuuuacccuc

SEQ ID NO: 60214 - RNA, 27 nt, Artificial Sequence
  Cytochrome c oxidase subunit 6C (21-29)
aaccacauggccguggcuuucguccug

SEQ ID NO: 60215 - RNA, 27 nt, Artificial Sequence
  Ankyrin repeat domain-containing protein 54 (187-195)
aaccacgugcccgucaucaccacacug

SEQ ID NO: 60216 - RNA, 30 nt, Artificial Sequence
  Transcription factor jun-B (150-159)
aaccacgugacccccccuaaugucagccug

SEQ ID NO: 60217 - RNA, 27 nt, Artificial Sequence
  Periodic tryptophan protein 2 homolog (866-874)
aaccacuacaauaugcaguaugcccug

SEQ ID NO: 60218 - RNA, 27 nt, Artificial Sequence
  Alpha-2-macroglobulin receptor-associated protein (292-300)
aaccacuaccagaagcaacuggagauc

SEQ ID NO: 60219 - RNA, 27 nt, Artificial Sequence
  Protein SCAF11 (912-920)
aacaucuuccccuacccugugggcguc

SEQ ID NO: 60220 - RNA, 27 nt, Artificial Sequence
  RUS1 family protein C16orf58 (197-205)
aaccuggccaagugcaucgugagcguc

SEQ ID NO: 60221 - RNA, 27 nt, Artificial Sequence
  Pterin-4-alpha-carbinolamine dehydratase (19-27)
aaccuggccagcuucaucgagcaggug

SEQ ID NO: 60222 - RNA, 27 nt, Artificial Sequence
  E3 ubiquitin-protein ligase RNF123 (595-603)
aaccuguucgacagaguggucacccuc

SEQ ID NO: 60223 - RNA, 27 nt, Artificial Sequence
  Plastin-3 (327-335)
aaccuguucaauaaguaccccgcccuc

SEQ ID NO: 60224 - RNA, 30 nt, Artificial Sequence
  THO complex subunit 2 (162-171)
aaccugaucgaccucgaugaccuuuacgug

SEQ ID NO: 60225 - RNA, 27 nt, Artificial Sequence
  Tyrosine-protein phosphatase non-receptor type 13 (472-480)
aaccugaucaaucaggagauuaugcuc

SEQ ID NO: 60226 - RNA, 27 nt, Artificial Sequence
  Trifunctional purine biosynthetic protein adenosine-3 (39-47)
aaccugaucagcgcccucgaggaagcu

SEQ ID NO: 60227 - RNA, 27 nt, Artificial Sequence
  Protein virilizer homolog (623-631)
aaccugcucgaggaaguguuccaccuu

SEQ ID NO: 60228 - RNA, 27 nt, Artificial Sequence
  Chloride intracellular channel protein 5 (187-195)
aaccugcuccccaagcuucacgugguc

SEQ ID NO: 60229 - RNA, 27 nt, Artificial Sequence
  PHD finger protein 20-like protein 1 (210-218)
aaccugcucacccacaucgagaaugug

SEQ ID NO: 60230 - RNA, 27 nt, Artificial Sequence
  AP-3 complex subunit mu-2 (268-276)
aaccugguggccauccccgucuacguu

SEQ ID NO: 60231 - RNA, 30 nt, Artificial Sequence
  55 kDa erythrocyte membrane protein (337-346)
aacauguucggcaccaaguuugagacagug

SEQ ID NO: 60232 - RNA, 27 nt, Artificial Sequence
  Tetratricopeptide repeat protein 4 (260-268)
aacccccacggcgccagacugagccuc

SEQ ID NO: 60233 - RNA, 27 nt, Artificial Sequence
  General transcription factor 3C polypeptide 1 (336-344)
aaccccaaggagagcuccucuucacug

SEQ ID NO: 60234 - RNA, 33 nt, Artificial Sequence
  Talin-1 (1623-1633)
aaccccagagacccuccaagcugguccgugcug

SEQ ID NO: 60235 - RNA, 33 nt, Artificial Sequence
  Roundabout homolog 1 (1497-1507)
aaccccagagacccuagcuccucuucaaguaug

SEQ ID NO: 60236 - RNA, 27 nt, Artificial Sequence
  Clathrin interactor 1 (379-387)
aaccaggcccccagcggcccuguggcu

SEQ ID NO: 60237 - RNA, 27 nt, Artificial Sequence
  Coiled-coil domain-containing protein 134 (154-162)
aaccagggcccccacagcccuauccug

SEQ ID NO: 60238 - RNA, 27 nt, Artificial Sequence
  Transcription factor p65 (186-194)
aacagagcccccaauaccgcugagcug

SEQ ID NO: 60239 - RNA, 27 nt, Artificial Sequence
  Putative methyltransferase NSUN3 (57-65)
aacagauucaauuaccccuuugagcug

SEQ ID NO: 60240 - RNA, 27 nt, Artificial Sequence
  Toll-like receptor 9 (425-433)
aacagaaucagcggcgccuccgagcug

SEQ ID NO: 60241 - RNA, 27 nt, Artificial Sequence
  Dolichyl-diphosphooligosaccharide-proteinosyltransferase subunit 2 (618-626)
aacagaaugcuggcccagcaagcugug

SEQ ID NO: 60242 - RNA, 27 nt, Artificial Sequence
  Dolichyl-diphosphooligosaccharide-proteinosyltransferase subunit 2 (358-366)
aacguggccgacgucguuaucaaguuc

SEQ ID NO: 60243 - RNA, 27 nt, Artificial Sequence
  Calcium homeostasis endoplasmic reticulum protein (14-22)
aacgugaucgacaagcuggcccaguuc

SEQ ID NO: 60244 - RNA, 30 nt, Artificial Sequence; identical to SEQ ID NO: 36017
  E3 ubiquitin-protein ligase DTX3L (376-385)

SEQ ID NO: 60245 - RNA, 27 nt, Artificial Sequence
  U5 small nuclear ribonucleoprotein 200 kDa helicase (1517-1525)
aacgugagacccgucccucuggagcuc

SEQ ID NO: 60246 - RNA, 27 nt, Artificial Sequence
  Arf-GAP with SH3 domain, ANK repeat and PH domain-containing protein 1 (87-95)
aacuacgcccaggugcuggacaaguuc

SEQ ID NO: 60247 - RNA, 27 nt, Artificial Sequence
  GRB2-related adapter protein (100-108)
aacuacggcgaccaggugcaacacuuc

SEQ ID NO: 60248 - RNA, 27 nt, Artificial Sequence
  Heat shock protein HSP 90-alpha (249-257)
aacuacaagaaauucuaugagcaguuu

SEQ ID NO: 60249 - RNA, 27 nt, Artificial Sequence
  Fructosamine-3-kinase (284-292)
aacuaccugaaucacuggaaccauuuc

SEQ ID NO: 60250 - RNA, 33 nt, Artificial Sequence
  SEC14-like protein 1 (424-434)
aacuaccccgagacccugggcagacuccuuauc

SEQ ID NO: 60251 - RNA, 30 nt, Artificial Sequence
  TATA element modulatory factor (751-760)
caggaggccgaaaacagaaaucaagagcug

SEQ ID NO: 60252 - RNA, 27 nt, Artificial Sequence
  Threonine-tRNA ligase, cytoplasmic (318-326)
caggagcuguacuucuuucacgaacuc

SEQ ID NO: 60253 - RNA, 30 nt, Artificial Sequence
  Nuclear autoantigen Sp-100 (132-141)
caggaguaccccgaccugauccacauuuau

SEQ ID NO: 60254 - RNA, 27 nt, Artificial Sequence
  Myosin-9 (709-717)
cagggcuuccccaacagaguggucuuu

SEQ ID NO: 60255 - RNA, 27 nt, Artificial Sequence
  MOB kinase activator 1A (165-173)
cagcacuucgacagcgugaugcaacug

SEQ ID NO: 60256 - RNA, 27 nt, Artificial Sequence
  ATP-citrate synthase (996-1004)
cagcacuuccccgccaccccucugcuc

SEQ ID NO: 60257 - RNA, 30 nt, Artificial Sequence
  Cullin-3 (489-498)
cagcaccugcaagccaccggcgugagccuc

SEQ ID NO: 60258 - RNA, 27 nt, Artificial Sequence
  Angio-associated migratory cell protein (356-364)
cagcaccaaagcggcaucgugcagcug

SEQ ID NO: 60259 - RNA, 27 nt, Artificial Sequence
  Protein PML (767-775)
cagcacguguaccccuucagcucccug

SEQ ID NO: 60260 - RNA, 27 nt, Artificial Sequence
  Solute carrier family 41 member 3 (91-99)
cagcacuggcccguguucgucgagguu

SEQ ID NO: 60261 - RNA, 27 nt, Artificial Sequence
  Putative Polycomb group protein ASXL2 (1383-1391)
cagauccugcccaagccucucaccaaa

SEQ ID NO: 60262 - RNA, 27 nt, Artificial Sequence
  Programmed cell death 6-interacting protein (435-443)
cagcugaucaaggagcuccccgaacuu

SEQ ID NO: 60263 - RNA, 27 nt, Artificial Sequence
  Dynactin subunit 1 (1167-1175)
cagcugauggagcaaguggcccagcuc

SEQ ID NO: 60264 - RNA, 27 nt, Artificial Sequence
  E3 ubiquitin-protein ligase DTX3L (447-455)
cagcugaugagagaggugcuccuucug

SEQ ID NO: 60265 - RNA, 27 nt, Artificial Sequence
  Non-specific lipid-transfer protein (539-547)
cagcugcaacccggcaacgccaagcuc

SEQ ID NO: 60266 - RNA, 27 nt, Artificial Sequence
  Poly (ADP-ribose) polymerase 14 (218-226)
cagcugagccccagacuccuugaggug

SEQ ID NO: 60267 - RNA, 27 nt, Artificial Sequence
  Protein ZGRF1 (2047-2055)
cagcuguggggcagagugauccaacac

SEQ ID NO: 60268 - RNA, 27 nt, Artificial Sequence
  Myosin-10 (655-663)
cagcuguacaaggagagccucaccaaa

SEQ ID NO: 60269 - RNA, 27 nt, Artificial Sequence
  Signal recognition particle subunit SRP72 (247-255)
cagcuguacaaccaaaucauuaagcuc

SEQ ID NO: 60270 - RNA, 27 nt, Artificial Sequence
  Casein kinase I isoform alpha (119-127)
cagaugaucagcagaauugaguacgug

SEQ ID NO: 60271 - RNA, 30 nt, Artificial Sequence
  rRNA 2'-O-methyltransferase fibrillarin (236-245)
cagcccgaccaaaccagaaucguggcccug

SEQ ID NO: 60272 - RNA, 27 nt, Artificial Sequence
  Eukaryotic translation initiation factor 4 gamma 3 (664-672)
cagcccaagcugccuaugagaacccuc

SEQ ID NO: 60273 - RNA, 27 nt, Artificial Sequence
  Activating transcription factor 7-interacting protein 1 (787-795)
cagccccugccugugauccuccacguc

SEQ ID NO: 60274 - RNA, 27 nt, Artificial Sequence
  Transmembrane emp24 domain-containing protein 5 (50-58)
cagcccaugccucugaaggccagccuc

SEQ ID NO: 60275 - RNA, 27 nt, Artificial Sequence
  E3 ubiquitin-protein ligase RNF31 (125-133)
cagcccagaccucaaagcaccucccug

SEQ ID NO: 60276 - RNA, 30 nt, Artificial Sequence
  Nuclear factor of activated T-cells, cytoplasmic 2 (486-495)
cagcccuacuauccucaacacccaauggug

SEQ ID NO: 60277 - RNA, 27 nt, Artificial Sequence
  Threonylcarbamoyladenosine tRNA methylthiotransferase (88-96)
cagcaaaucgacagaguggucgagguu

SEQ ID NO: 60278 - RNA, 27 nt, Artificial Sequence
  60S ribosomal protein L26 (65-73)
cagcaaaucggcaaggugguccagguu

SEQ ID NO: 60279 - RNA, 27 nt, Artificial Sequence
  Long-chain-fatty-acid-CoA ligase 3 (405-413)
cagagaaaccuguucauccucgccuac

SEQ ID NO: 60280 - RNA, 27 nt, Artificial Sequence
  B-cell receptor-associated protein 29 (101-109)
cagagaaaccuguacaucagcggcuuc

SEQ ID NO: 60281 - RNA, 33 nt, Artificial Sequence
  Nucleolar RNA helicase 2 (558-568)
cagagaagccugaucaacuccaaugugggcuuc

SEQ ID NO: 60282 - RNA, 27 nt, Artificial Sequence
  GPI transamidase component PIG-T (351-359)
cagagauacgugagcggcuaugggcug

SEQ ID NO: 60283 - RNA, 36 nt, Artificial Sequence
  Zinc finger protein 143 (64-75)
caggugauccaacuggaggacggcagcgccgcuuac

SEQ ID NO: 60284 - RNA, 27 nt, Artificial Sequence
  mRNA cap guanine-N7 methyltransferase (448-456)
caggugagacugccccucggcacccuu

SEQ ID NO: 60285 - RNA, 27 nt, Artificial Sequence
  Elongation of very long chain fatty acids protein 1 (201-209)
caguaccccgugaucauucaccugaua

SEQ ID NO: 60286 - RNA, 27 nt, Artificial Sequence
  Arf-GAP with SH3 domain, ANK repeat and PH domain-containing protein 2 (74-82)
caguacacccaagcccuggagaaguuc

SEQ ID NO: 60287 - RNA, 27 nt, Artificial Sequence
  Telomerase protein component 1 (820-828)
agagccgcuccccacaggaucagccug

SEQ ID NO: 60288 - RNA, 27 nt, Artificial Sequence
  MICOS complex subunit MIC60 (432-440)
agagccuucgacagcgcuguggcaaag

SEQ ID NO: 60289 - RNA, 30 nt, Artificial Sequence
  Uromodulin (615-624)
agagccuucagcucccugggccuccuuaag

SEQ ID NO: 60290 - RNA, 27 nt, Artificial Sequence
  Signal transducer CD24 (3-11)
agagccaugguggcuaggcugggccuc

SEQ ID NO: 60291 - RNA, 27 nt, Artificial Sequence
  Eukaryotic translation initiation factor 4H (185-193)
agagcccagaggccccggcugcaacuc

SEQ ID NO: 60292 - RNA, 27 nt, Artificial Sequence
  Cytochrome b-c1 complex subunit 8 (25-33)
agagccuacccccacguguucaccaag

SEQ ID NO: 60293 - RNA, 30 nt, Artificial Sequence
  CLIP-associating protein 1 (519-528)
agagaggccgaacaccuguaccauacccuc

SEQ ID NO: 60294 - RNA, 27 nt, Artificial Sequence
  Integrin alpha-6 (29-37)
agagaggacaacgugaucaggaaguac

SEQ ID NO: 60295 - RNA, 27 nt, Artificial Sequence
  Eukaryotic initiation factor 4A-III (260-268)
agagaggaauggaaguucgacacccug

SEQ ID NO: 60296 - RNA, 33 nt, Artificial Sequence
  TCF3 fusion partner (90-100)
agagagaucgaacaggugaacgagaggguccug

SEQ ID NO: 60297 - RNA, 33 nt, Artificial Sequence
  Ataxin-2-like protein (324-334)
agagagaucgaaagcuccccccaguacaggcug

SEQ ID NO: 60298 - RNA, 33 nt, Artificial Sequence
  NF-kappa-B essential modulator (319-329)
agagagaagcuggccgaaaaaaaggagcuccuu

SEQ ID NO: 60299 - RNA, 30 nt, Artificial Sequence
  ER membrane protein complex subunit 7 (192-201)
agagagauggaacagagcaugaacaugcug

SEQ ID NO: 60300 - RNA, 33 nt, Artificial Sequence
  HMG box-containing protein 1 (104-114)
agagagaacgaaguggacuggcugaccgagcuc

SEQ ID NO: 60301 - RNA, 30 nt, Artificial Sequence
  Kinesin-like protein KIFC1 (639-648)
agagagacccaggccaucaacagcucccug

SEQ ID NO: 60302 - RNA, 27 nt, Artificial Sequence
  Translation machinery-associated protein 16 (109-117)
agagagaccgugaucaagcagacaaug

SEQ ID NO: 60303 - RNA, 30 nt, Artificial Sequence
  Protein timeless homolog (623-632)
agagagguguggcccgaaggcgacgucuuc

SEQ ID NO: 60304 - RNA, 27 nt, Artificial Sequence
  E3 SUMO-protein ligase PIAS3 (145-153)
agauucgaggaagcccacuuuaccuuc

SEQ ID NO: 60305 - RNA, 27 nt, Artificial Sequence
  Tubulin alpha-1C chain (334-342)
agaauccacuucccccuggccaccuac

SEQ ID NO: 60306 - RNA, 27 nt, Artificial Sequence
  Poly (ADP-ribose) polymerase 4 (631-639)
agaaucauugacaccguggcccagguc

SEQ ID NO: 60307 - RNA, 27 nt, Artificial Sequence
  Moesin (275-283)
agaaucaacaagaggauucuggcccuc

SEQ ID NO: 60308 - RNA, 27 nt, Artificial Sequence
  Valine-tRNA ligase (530-538)
agaauccccgccuacuucgugaccguc

SEQ ID NO: 60309 - RNA, 36 nt, Artificial Sequence
  COMM domain-containing protein 9 (145-156)
agaaucagggaccagcugagcgccguggcuuccaag

SEQ ID NO: 60310 - RNA, 27 nt, Artificial Sequence
  SUN domain-containing protein 2 (117-125)
agaaucaggcccaccgccgugacacug

SEQ ID NO: 60311 - RNA, 30 nt, Artificial Sequence
  28S ribosomal protein S21, mitochondrial (50-59)
agaaucuacaacauggagauggccaggaag

SEQ ID NO: 60312 - RNA, 30 nt, Artificial Sequence
  Heterogeneous nuclear ribonucleoprotein A1 (14-23)
agaaagcuguucaucggcgggcucagcuuu

SEQ ID NO: 60313 - RNA, 30 nt, Artificial Sequence
  Catenin beta-1 (124-133)
agacuggccgagcccagccagaugcucaag

SEQ ID NO: 60314 - RNA, 27 nt, Artificial Sequence
  Kalirin (2002-2010)
agacuggcccagcucuucaucaagcac

SEQ ID NO: 60315 - RNA, 27 nt, Artificial Sequence
  Thyroid adenoma-associated protein (345-353)
agacuggccagcaaggugaucucccac

SEQ ID NO: 60316 - RNA, 27 nt, Artificial Sequence
  Prostaglandin F2 receptor negative regulator (3-11)
agacuggccagcaggccccuccuucug

SEQ ID NO: 60317 - RNA, 27 nt, Artificial Sequence
  Transcription factor 4 (368-376)
agacuggacgaugccauccacgugcuc

SEQ ID NO: 60318 - RNA, 27 nt, Artificial Sequence
  Fanconi anemia group D2 protein (253-261)
agacuggaccccaacuuccuccuuaag

SEQ ID NO: 60319 - RNA, 33 nt, Artificial Sequence
  Ubiquitin carboxyl-terminal hydrolase 19 (1354-1364)
agacuguucgacgauagcaccgugacaacuguc

SEQ ID NO: 60320 - RNA, 33 nt, Artificial Sequence
  BTB/POZ domain-containing protein 2 (2-12)
agacuguucgacgagccccagcucgccagccuu

SEQ ID NO: 60321 - RNA, 27 nt, Artificial Sequence
  Heat shock protein beta-1 (27-35)
agacuguucgaccaggccuuuggccuc

SEQ ID NO: 60322 - RNA, 27 nt, Artificial Sequence
  V-type proton ATPase subunit S1 (315-323)
agacuguucggcaccacagugacuuuu

SEQ ID NO: 60323 - RNA, 30 nt, Artificial Sequence
  V-type proton ATPase subunit S1 (225-234)
agacuguucggcaccacagugacuuuuaag

SEQ ID NO: 60324 - RNA, 30 nt, Artificial Sequence
  Dol-P-Man:Man(5)GlcNAc(2)-PP-Dol alpha-1,3-mannosyltransferase (123-132)
agacuguucaacgaccccguggccaugguc

SEQ ID NO: 60325 - RNA, 27 nt, Artificial Sequence
  tRNA-dihydrouridine(20) synthase (NAD(P)+)-like (362-370)
agacuguucagcuccaucgugaccguc

SEQ ID NO: 60326 - RNA, 27 nt, Artificial Sequence
  Surfeit locus protein 6 (121-129)
agacugcacgagaagauccaggaagcc

SEQ ID NO: 60327 - RNA, 27 nt, Artificial Sequence
  Proteasome subunit alpha type-4 (20-28)
agacugaucgcccagagguaccuccuu

SEQ ID NO: 60328 - RNA, 27 nt, Artificial Sequence
  Lysine-specific demethylase 5B (975-983)
agacugaucgaccucggcguggggcuu

SEQ ID NO: 60329 - RNA, 30 nt, Artificial Sequence
  Rho GTPase-activating protein 19 (65-74)
agacugaucgaccuccccggcaccgagcuu

SEQ ID NO: 60330 - RNA, 27 nt, Artificial Sequence
  General transcription factor 3C polypeptide 1 (377-385)
agacugaucgagagccucuucaccauu

SEQ ID NO: 60331 - RNA, 33 nt, Artificial Sequence
  Heat shock 70 kDa protein 1-like (51-61)
agacugaucggcgacgccgcuaagaaccaggug

SEQ ID NO: 60332 - RNA, 27 nt, Artificial Sequence
  Short coiled-coil protein (55-63)
agacugaucaaccaggugcucgagcuu

SEQ ID NO: 60333 - RNA, 27 nt, Artificial Sequence
  Importin-9 (241-249)
agacugauccccacccucgugagcauu

SEQ ID NO: 60334 - RNA, 27 nt, Artificial Sequence
  Eukaryotic translation initiation factor 4E (61-69)
agacugaucagcaaguucgacaccgug

SEQ ID NO: 60335 - RNA, 27 nt, Artificial Sequence
  C-X-C motif chemokine 14 (14-22)
agacugcucgccgcugcacuucuguug

SEQ ID NO: 60336 - RNA, 30 nt, Artificial Sequence
  Engulfment and cell motility protein 1 (697-706)
agacugcucgaccuugagaacauccagauu

SEQ ID NO: 60337 - RNA, 27 nt, Artificial Sequence
  PX domain-containing protein kinase-like protein (219-227)
agacugcucgaccuugagaacagccug

SEQ ID NO: 60338 - RNA, 27 nt, Artificial Sequence
  Collagen alpha-1(XVIII) chain (14-22)
agacugcucgacgugcuugccccccug

SEQ ID NO: 60339 - RNA, 27 nt, Artificial Sequence
  Baculoviral IAP repeat-containing protein 6 (2177-2185)
agacugcucgacuacguggccaccguc

SEQ ID NO: 60340 - RNA, 27 nt, Artificial Sequence
  Lysine-specific histone demethylase 1A (180-188)
agacugcucgaggccaccagcuaccuu

SEQ ID NO: 60341 - RNA, 27 nt, Artificial Sequence
  Isochorismatase domain-containing protein 2 (49-57)
agacugcucgaggugcccgucaugcuu

SEQ ID NO: 60342 - RNA, 36 nt, Artificial Sequence
  Histone H2B type 1-K (100-111)
agacugcuccuucccggcgagcuggccaagcacgcu

SEQ ID NO: 60343 - RNA, 30 nt, Artificial Sequence
  Attractin (51-60)
agacugcucagccccccucuuaggccacgg

SEQ ID NO: 60344 - RNA, 27 nt, Artificial Sequence
  Heat shock protein 105 kDa (183-191)
agacugaugaacgacaugaccgccgug

SEQ ID NO: 60345 - RNA, 27 nt, Artificial Sequence
  Heat shock 70 kDa protein 4L (128-136)
agacugaugaacgagaccacagccgug

SEQ ID NO: 60346 - RNA, 33 nt, Artificial Sequence
  Heat shock 70 kDa protein 4L (128-138)
agacugaugaacgagaccacagccguggcucuc

SEQ ID NO: 60347 - RNA, 27 nt, Artificial Sequence
  Cyclin-D1-binding protein 1 (55-63)
agacugaacgaggccgcugugaccguc

SEQ ID NO: 60348 - RNA, 30 nt, Artificial Sequence
  Coatomer subunit gamma-2 (708-717)
agacugcccgacgaugacccuaccgccgug

SEQ ID NO: 60349 - RNA, 27 nt, Artificial Sequence
  Glyoxylate reductase/hydroxypyruvate reductase (125-133)
agacugcccgaggccaucgaagaggug

SEQ ID NO: 60350 - RNA, 27 nt, Artificial Sequence
  EH domain-containing protein 4 (337-345)
agacugcccgagaucuacauucagcuc

SEQ ID NO: 60351 - RNA, 27 nt, Artificial Sequence
  Sorting nexin-1 (13-21)
agacugcccccuccauucccgggccuc

SEQ ID NO: 60352 - RNA, 27 nt, Artificial Sequence
  DNA-directed RNA polymerase III subunit RPC1 (218-226)
agacugcccccuccaaccauccucaag

SEQ ID NO: 60353 - RNA, 27 nt, Artificial Sequence
  Kazrin (78-86)
agacugcaggaggaagugcaccuccuu

SEQ ID NO: 60354 - RNA, 33 nt, Artificial Sequence
  Synaptojanin-2-binding protein (58-68)
agacugcaggagggcgacaagauccucagcgug

SEQ ID NO: 60355 - RNA, 27 nt, Artificial Sequence
  Centrosomal protein of 85 kDa (243-251)
agacugcagauggagcaaaugcagcuc

SEQ ID NO: 60356 - RNA, 36 nt, Artificial Sequence
  KIF1-binding protein (494-505)
agacugagggaccccgauagccacaucgugaagaaa

SEQ ID NO: 60357 - RNA, 27 nt, Artificial Sequence
  Transmembrane protein 69 (146-154)
agacugagcgaggccaucgugaccguc

SEQ ID NO: 60358 - RNA, 30 nt, Artificial Sequence
  WASH complex subunit strumpellin (31-40)
agacugagcgaguucauccccgccguguuu

SEQ ID NO: 60359 - RNA, 27 nt, Artificial Sequence
  COP9 signalosome complex subunit 8 (199-207)
agacugaccgacuacguggccuuccuc

SEQ ID NO: 60360 - RNA, 27 nt, Artificial Sequence
  Proliferating cell nuclear antigen (5-13)
agacuggugcagggcagcauccucaag

SEQ ID NO: 60361 - RNA, 33 nt, Artificial Sequence
  Serine-threonine kinase receptor-associated protein (167-177)
agacugugggaccacgccaccaugacagaggug

SEQ ID NO: 60362 - RNA, 27 nt, Artificial Sequence
  Probable ubiquitin carboxyl-terminal hydrolase FAF-Y (1674-1682)
agacuguggggcgagcccgugaaccuc

SEQ ID NO: 60363 - RNA, 33 nt, Artificial Sequence
  Lariat debranching enzyme (301-311)
agacuguggaacaugcccgagaauaacggccuc

SEQ ID NO: 60364 - RNA, 27 nt, Artificial Sequence
  DNA damage-inducible transcript 4 protein (184-192)
agacuguggcccaagauccagggccuc

SEQ ID NO: 60365 - RNA, 30 nt, Artificial Sequence
  Serine/threonine-protein kinase mTOR (2035-2044)
agacuguacuucggcgagaggaacgugaag

SEQ ID NO: 60366 - RNA, 30 nt, Artificial Sequence
  Filamin-A (142-151)
agacuguacagcguguccuaucuccuuaag

SEQ ID NO: 60367 - RNA, 27 nt, Artificial Sequence
  C-1-tetrahydrofolate synthase, cytoplasmic (746-754)
agaauguucggcauccccguggucguu

SEQ ID NO: 60368 - RNA, 30 nt, Artificial Sequence
  Hemoglobin subunit alpha (3-12)
agaauguuccugagcuuucccaccacaaag

SEQ ID NO: 60369 - RNA, 27 nt, Artificial Sequence
  Transaldolase (28-36)
agaauguucaacgccgagaauggcaag

SEQ ID NO: 60370 - RNA, 27 nt, Artificial Sequence
  Receptor activity-modifying protein 2 (21-29)
agacccgccgcucugaggcuccuucug

SEQ ID NO: 60371 - RNA, 33 nt, Artificial Sequence
  Nucleolar protein 11 (53-63)
agacccgccgacccugagaagaaccagagccug

SEQ ID NO: 60372 - RNA, 27 nt, Artificial Sequence
  F-box only protein 32 (160-168)
agacccgccuucaagggccugaccuuu

SEQ ID NO: 60373 - RNA, 27 nt, Artificial Sequence
  Transcription cofactor vestigial-like protein 4 (144-152)
agacccgccggccugagcccuacccuc

SEQ ID NO: 60374 - RNA, 30 nt, Artificial Sequence
  26S proteasome non-ATPase regulatory subunit 13 (284-293)
agacccgccaaccacaggcagcugaccuuc

SEQ ID NO: 60375 - RNA, 27 nt, Artificial Sequence
  SH3 domain-binding protein 1 (567-575)
agacccgccccugcuaggccaaccaug

SEQ ID NO: 60376 - RNA, 27 nt, Artificial Sequence
  Epsin-2 (471-479)
agacccgccccuccagcucagagccug

SEQ ID NO: 60377 - RNA, 27 nt, Artificial Sequence
  Sterol regulatory element-binding protein 2 (1026-1034)
agacccgccuacaggaagguguuccug

SEQ ID NO: 60378 - RNA, 30 nt, Artificial Sequence
  Protein O-GlcNAcase (828-837)
agacccgacgauaagaggauccuggaguuc

SEQ ID NO: 60379 - RNA, 27 nt, Artificial Sequence
  Transcription factor 25 (211-219)
agacccgagaacaggagcuucuaccug

SEQ ID NO: 60380 - RNA, 27 nt, Artificial Sequence
  NFX1-type zinc finger-containing protein 1 (350-358)
agacccuuccugaggccuaacaucauu

SEQ ID NO: 60381 - RNA, 27 nt, Artificial Sequence
  Procollagen-lysine,2-oxoglutarate 5-dioxygenase 2 (137-145)
agaccccaccaugacgccagcaccuuc

SEQ ID NO: 60382 - RNA, 27 nt, Artificial Sequence
  Transducin beta-like protein 3 (564-572)
agaccccacaccgugcugacagucauc

SEQ ID NO: 60383 - RNA, 30 nt, Artificial Sequence
  Mitogen-activated protein kinase 3 (229-238)
agacccaucuucccuggcaagcacuaccug

SEQ ID NO: 60384 - RNA, 27 nt, Artificial Sequence
  Ragulator complex protein LAMTOR2 (3-11)
agacccaaggcccugacccaggugcuc

SEQ ID NO: 60385 - RNA, 30 nt, Artificial Sequence
  Pre-mRNA-processing factor 19 (62-71)
agacccaagccuccaagcgccaccuccauc

SEQ ID NO: 60386 - RNA, 30 nt, Artificial Sequence
  Poly(rC)-binding protein 2 (183-192)
agacccaagccuagcuccucuccagugauc

SEQ ID NO: 60387 - RNA, 27 nt, Artificial Sequence
  Mitogen-activated protein kinase 9 (263-271)
agacccaaguacccuggcaucaaauuc

SEQ ID NO: 60388 - RNA, 27 nt, Artificial Sequence
  Probable ATP-dependent RNA helicase DDX27 (196-204)
agaccccugcucaaggccaucaccgcu

SEQ ID NO: 60389 - RNA, 30 nt, Artificial Sequence
  Protein transport protein Sec23B (243-252)
agaccccugaggagcaccggcguggcccuc

SEQ ID NO: 60390 - RNA, 27 nt, Artificial Sequence
  RNA-binding protein 39 (297-305)
agacccaugaaggugggccacgucacc

SEQ ID NO: 60391 - RNA, 27 nt, Artificial Sequence
  UAP56-interacting factor (71-79)
agacccaacggcgugaucaccgggcug

SEQ ID NO: 60392 - RNA, 27 nt, Artificial Sequence
  Adipocyte plasma membrane-associated protein (337-345)
agacccaacccuggcuucagcaugcug

SEQ ID NO: 60393 - RNA, 27 nt, Artificial Sequence
  Induced myeloid leukemia cell differentiation protein Mcl-1 (78-86)
agacccccuccaaucggcgccgaggug

SEQ ID NO: 60394 - RNA, 27 nt, Artificial Sequence
  Sterol regulatory element-binding protein 1 (1003-1011)
agaccccaggccagcgcucuggagcuc

SEQ ID NO: 60395 - RNA, 27 nt, Artificial Sequence
  (Pyruvate dehydrogenase (acetyl-transferring))-phosphatase 1, mitochondrial (443-451)
agaccccaggacaaguuccuggugcuc

SEQ ID NO: 60396 - RNA, 27 nt, Artificial Sequence
  RuvB-like 1 (249-257)
agaccccagggcgggcaagacauccug

SEQ ID NO: 60397 - RNA, 27 nt, Artificial Sequence
  28S ribosomal protein S12, mitochondrial (55-63)
agaccccagcugaagggcgugguccuc

SEQ ID NO: 60398 - RNA, 30 nt, Artificial Sequence
  WD repeat and FYVE domain-containing protein 1 (8-17)
agaccccagagcuccaggccugugcugcuc

SEQ ID NO: 60399 - RNA, 27 nt, Artificial Sequence
  Renin receptor (59-67)
agacccagggccaccgugauggucaug

SEQ ID NO: 60400 - RNA, 30 nt, Artificial Sequence
  Protein OS-9 (186-195)
agacccagggaggccgaagugcgguuccug

SEQ ID NO: 60401 - RNA, 24 nt, Artificial Sequence
  Protein disulfide-isomerase A4 (2-9)
agacccaggaaggccuuccugcuc

SEQ ID NO: 60402 - RNA, 30 nt, Artificial Sequence
  Protein disulfide-isomerase A4 (2-11)
agacccaggaaggccuuccugcuccuucug

SEQ ID NO: 60403 - RNA, 33 nt, Artificial Sequence
  Glycogen synthase kinase-3 beta (306-316)
agacccaggaccccuccagaggccaucgcucug

SEQ ID NO: 60404 - RNA, 30 nt, Artificial Sequence
  Apolipoprotein L1 (285-294)
agacccagggugaccgagccuaucagcgcc

SEQ ID NO: 60405 - RNA, 27 nt, Artificial Sequence
  ATP-dependent RNA helicase A (272-280)
agacccagcgccgcuggcaucaaccug

SEQ ID NO: 60406 - RNA, 27 nt, Artificial Sequence
  Protein DEPP (195-203)
agacccagcuccgugcugaggacccuc

SEQ ID NO: 60407 - RNA, 27 nt, Artificial Sequence
  Filamin-B (69-77)
agacccaccuucaggcagaugcaacug

SEQ ID NO: 60408 - RNA, 27 nt, Artificial Sequence
  Antigen peptide transporter 2 (168-176)
agacccgugcugaagggccucaccuuc

SEQ ID NO: 60409 - RNA, 27 nt, Artificial Sequence
  FAS-associated factor 1 (77-85)
agacccgugaugccuagcaggcagauc

SEQ ID NO: 60410 - RNA, 27 nt, Artificial Sequence
  CDC42 small effector protein 1 (69-77)
agacccuggagcaacuccaggggccug

SEQ ID NO: 60411 - RNA, 30 nt, Artificial Sequence
  Cyclin-dependent kinase 13 (254-263)
agacccuacaccaacaaggugaucacacug

SEQ ID NO: 60412 - RNA, 36 nt, Artificial Sequence
  Rac GTPase-activating protein 1 (547-558)
agacagggcaacuucuuugccagccccaugcugaag

SEQ ID NO: 60413 - RNA, 33 nt, Artificial Sequence
  SEC14-like protein 1 (168-178)
agacagcuggaggaagagggcaucaccuucgug

SEQ ID NO: 60414 - RNA, 30 nt, Artificial Sequence
  Ubiquitin carboxyl-terminal hydrolase 22 (419-428)
agaaggaagaucaccacauacgugagcuuc

SEQ ID NO: 60415 - RNA, 27 nt, Artificial Sequence
  MICOS complex subunit MIC10 (38-46)
agaaggauguggccccuggccuucggc

SEQ ID NO: 60416 - RNA, 27 nt, Artificial Sequence
  Protein transport protein Sec23B (569-577)
agaaggagccccuuccugcagguguuu

SEQ ID NO: 60417 - RNA, 27 nt, Artificial Sequence
  Protein transport protein Sec23A (585-593)
agaaggagcuccuuccugcagguguuu

SEQ ID NO: 60418 - RNA, 27 nt, Artificial Sequence
  Nicastrin (225-233)
agaaggagcuccauccagucuaccuuc

SEQ ID NO: 60419 - RNA, 27 nt, Artificial Sequence
  Protein FAM73A (222-230)
agaaggugggagcaggcccugaccuuc

SEQ ID NO: 60420 - RNA, 27 nt, Artificial Sequence
  Complement C1q subcomponent subunit C (184-192)
agaagcggcgugaaggucguuaccuuc

SEQ ID NO: 60421 - RNA, 33 nt, Artificial Sequence
  RNA polymerase II subunit A C-terminal domain phosphatase SSU72 (18-28)
agaagcauggaggcccacaacauccuguccaag

SEQ ID NO: 60422 - RNA, 30 nt, Artificial Sequence
  Heterogeneous nuclear ribonucleoproteins A2/B1 (60-69)
agaagcaggggcuucggguuugugaccuuc

SEQ ID NO: 60423 - RNA, 27 nt, Artificial Sequence
  Dynamin-2 (199-207)
agaaccaucggcgugauuacaaagcug

SEQ ID NO: 60424 - RNA, 33 nt, Artificial Sequence
  Profilin-1 (87-97)
agaaccaagagcacaggcggggcccccacuuuc

SEQ ID NO: 60425 - RNA, 33 nt, Artificial Sequence
  28S ribosomal protein S7, mitochondrial (198-208)
agaacccugaugcccgagaagcucagccacaaa

SEQ ID NO: 60426 - RNA, 30 nt, Artificial Sequence
  Protein SDA1 homolog (403-412)
agaacccugaacccccagaugcuccaaaag

SEQ ID NO: 60427 - RNA, 27 nt, Artificial Sequence
  Serine/threonine-protein kinase TAO1 (49-57)
agaaccaacgagguggucgccaucaag

SEQ ID NO: 60428 - RNA, 30 nt, Artificial Sequence
  Serine/threonine-protein kinase TAO1 (49-58)
agaaccaacgagguggucgccaucaagaaa

SEQ ID NO: 60429 - RNA, 30 nt, Artificial Sequence
  Ras GTPase-activating protein 3 (360-369)
agaacccaggaccccaacacaaucuucagg

SEQ ID NO: 60430 - RNA, 33 nt, Artificial Sequence
  Zinc finger protein 706 (45-55)
agaacccagaugcccgacccuaagacauucaaa

SEQ ID NO: 60431 - RNA, 36 nt, Artificial Sequence
  Fructose-bisphosphate aldolase A (259-270)
agaaccgugcccccugccgucacaggcaucacuuuc

SEQ ID NO: 60432 - RNA, 27 nt, Artificial Sequence
  Protein LDOC1L (175-183)
agaaccuacaagagcccccugaggcac

SEQ ID NO: 60433 - RNA, 33 nt, Artificial Sequence
  Sorting nexin-4 (243-253)
agaguggccgacaggcuguacggcgucuauaag

SEQ ID NO: 60434 - RNA, 27 nt, Artificial Sequence
  Cell division cycle and apoptosis regulator protein 1 (148-156)
agaguguucaccggcgucguuacaaag

SEQ ID NO: 60435 - RNA, 30 nt, Artificial Sequence
  Centrosomal protein of 57 kDa (325-334)
agagugaucaacagcauuccccuggccaag

SEQ ID NO: 60436 - RNA, 27 nt, Artificial Sequence
  Hom s 1 (22-30)
agagugaaggcccccaacaaaagccug

SEQ ID NO: 60437 - RNA, 27 nt, Artificial Sequence
  Cytosolic 10-formyltetrahydrofolate dehydrogenase (894-902)
agagugaagaccgucacauucgaguac

SEQ ID NO: 60438 - RNA, 30 nt, Artificial Sequence
  E3 ubiquitin-protein ligase HUWE1 (812-821)
agagugcuggacuucgaugucaagaggaaa

SEQ ID NO: 60439 - RNA, 30 nt, Artificial Sequence
  Eukaryotic translation initiation factor 4 gamma 3 (1045-1054)
agagugcuggaccccagcaaguuccucaaa

SEQ ID NO: 60440 - RNA, 27 nt, Artificial Sequence
  Paired amphipathic helix protein Sin3a (631-639)
agagugcuggaggccauccagaagaaa

SEQ ID NO: 60441 - RNA, 30 nt, Artificial Sequence
  Smoothelin (476-485)
agagugcugcuccccaccggcaaccagagg

SEQ ID NO: 60442 - RNA, 36 nt, Artificial Sequence
  40S ribosomal protein S18 (14-25)
agagugcugaacaccaauaucgacggcaggcggaag

SEQ ID NO: 60443 - RNA, 27 nt, Artificial Sequence
  WASH complex subunit strumpellin (573-581)
agagugaaccccagcauggucaccaag

SEQ ID NO: 60444 - RNA, 27 nt, Artificial Sequence
  Transcription factor 4 (552-560)
agagugagggacaucaacgaggccuuc

SEQ ID NO: 60445 - RNA, 27 nt, Artificial Sequence
  WW domain-binding protein 5 (82-90)
agagugaggaacaagcugaucgucaug

SEQ ID NO: 60446 - RNA, 33 nt, Artificial Sequence
  Phosphatidylinositide phosphatase SAC1 (35-45)
agagugagcaccgaggucacacuggccguuaag

SEQ ID NO: 60447 - RNA, 33 nt, Artificial Sequence
  Periodic tryptophan protein 1 homolog (244-254)
agagugugggacaucagcaccgucuccucuguu

SEQ ID NO: 60448 - RNA, 33 nt, Artificial Sequence
  39S ribosomal protein L3, mitochondrial (250-260)
agaguguggcccggcaccaagaugccugggaaa

SEQ ID NO: 60449 - RNA, 27 nt, Artificial Sequence
  Inositol-trisphosphate 3-kinase B (33-41)
agaguguggcagggcaccauggagaag

SEQ ID NO: 60450 - RNA, 30 nt, Artificial Sequence
  Guanine nucleotide-binding protein subunit beta-2-like 1 (308-317)
agaguguggcaggucaccaucggcacaagg

SEQ ID NO: 60451 - RNA, 27 nt, Artificial Sequence
  Cip1-interacting zinc finger protein (591-599)
agauacuucaagacccccaggaaauuu

SEQ ID NO: 60452 - RNA, 27 nt, Artificial Sequence
  Signal transducer and activator of transcription 3 (93-101)
agauaccuggagaagcccauggaaauc

SEQ ID NO: 60453 - RNA, 27 nt, Artificial Sequence
  Erythrocyte band 7 integral membrane protein (251-259)
agauaccugcagacccucacaacuauc

SEQ ID NO: 60454 - RNA, 27 nt, Artificial Sequence
  Telomerase protein component 1 (464-472)
agauaccccagcaaccugcagcucuuc

SEQ ID NO: 60455 - RNA, 27 nt, Artificial Sequence
  Histone H3.1 (41-49)
agauacaggcccggcaccguggcccug

SEQ ID NO: 60456 - RNA, 27 nt, Artificial Sequence
  26S proteasome non-ATPase regulatory subunit 6 (267-275)
agauacagcguguucuuucagucccug

SEQ ID NO: 60457 - RNA, 27 nt, Artificial Sequence
  G1/S-specific cyclin-D3 (37-45)
agauacgugcccagggccagcuauuuc

SEQ ID NO: 60458 - RNA, 24 nt, Artificial Sequence
  Heterogeneous nuclear ribonucleoprotein H (23-30)
agcgccgacgaggugcagagauuc

SEQ ID NO: 60459 - RNA, 27 nt, Artificial Sequence
  Solute carrier family 35 member E1 (53-61)
agcgccuuccccuuuccugugaccguc

SEQ ID NO: 60460 - RNA, 33 nt, Artificial Sequence
  Probable 28S rRNA (cytosine(4447)-C(5))-methyltransferase (511-521)
agcgccaucgacuccgugaacgcuaccucuaag

SEQ ID NO: 60461 - RNA, 27 nt, Artificial Sequence
  Catenin alpha-2 (667-675)
agcgccagagcuaucauggcacagcug

SEQ ID NO: 60462 - RNA, 27 nt, Artificial Sequence
  Large proline-rich protein BAG6 (145-153)
agcgccguggacguccacaucaacaug

SEQ ID NO: 60463 - RNA, 27 nt, Artificial Sequence
  Gamma-interferon-inducible protein 16 (280-288)
agcgaggccggccccaaccagaccuuc

SEQ ID NO: 60464 - RNA, 27 nt, Artificial Sequence
  Y-box-binding protein 3 (149-157)
agcgaggacgccgaaaagaaagugcug

SEQ ID NO: 60465 - RNA, 27 nt, Artificial Sequence
  Proline-, glutamic acid- and leucine-rich protein 1 (231-239)
agcgaggacggcgaugcccacgugcug

SEQ ID NO: 60466 - RNA, 33 nt, Artificial Sequence
  Vacuolar protein sorting-associated protein 35 (500-510)
agcgaggaccccgaucagcaauaccugauccuc

SEQ ID NO: 60467 - RNA, 36 nt, Artificial Sequence
  Actin-binding protein anillin (796-807)
agcgaguucaugcccuccaagggcucugugacccug

SEQ ID NO: 60468 - RNA, 27 nt, Artificial Sequence
  Actin-related protein 2 (295-303)
agcgaguucuacaagcacaucgugcug

SEQ ID NO: 60469 - RNA, 30 nt, Artificial Sequence
  Neutral amino acid transporter A (22-31)
agcgagggcgaagaccugaucagauucuuu

SEQ ID NO: 60470 - RNA, 30 nt, Artificial Sequence
  HCLS1-binding protein 3 (72-81)
agcgagaucgaagaguucuaccagaagcug

SEQ ID NO: 60471 - RNA, 27 nt, Artificial Sequence
  Poly (ADP-ribose) polymerase 1 (25-33)
agcgaguccauccccaaggacucucug

SEQ ID NO: 60472 - RNA, 33 nt, Artificial Sequence
  ATP-citrate synthase (769-779)
agcgagaccgccguggcuaagaaccaggcacug

SEQ ID NO: 60473 - RNA, 33 nt, Artificial Sequence
  Antigen KI-67 (2326-2336)
agcgagaccuccggccacacacaggaaucucug

SEQ ID NO: 60474 - RNA, 24 nt, Artificial Sequence
  40S ribosomal protein S23 (45-52)
agccacgccaagggcaucgugcug

SEQ ID NO: 60475 - RNA, 27 nt, Artificial Sequence
  Mitogen-activated protein kinase kinase kinase 1 (497-505)
agccacgacuucuacucccaugagcug

SEQ ID NO: 60476 - RNA, 33 nt, Artificial Sequence
  Bax inhibitor 1 (17-27)
agccacaucacccccuccacacagcaacaucug

SEQ ID NO: 60477 - RNA, 27 nt, Artificial Sequence
  Hypoxia-inducible factor 1-alpha (52-60)
agccaccuggacaaggccuccgugaug

SEQ ID NO: 60478 - RNA, 27 nt, Artificial Sequence
  Ubiquitin carboxyl-terminal hydrolase 37 (54-62)
agccacaacaucaagaaugugguccug

SEQ ID NO: 60479 - RNA, 27 nt, Artificial Sequence
  Protein-L-isoaspartate(D-aspartate) O-methyltransferase (9-17)
agccacuccgagcugauccauaaccuc

SEQ ID NO: 60480 - RNA, 27 nt, Artificial Sequence
  Cyclin-T1 (431-439)
agccacuccucugugauccugaagaug

SEQ ID NO: 60481 - RNA, 27 nt, Artificial Sequence
  Transcriptional activator Myb (257-265)
agccacgugcccuacccugucgcccug

SEQ ID NO: 60482 - RNA, 27 nt, Artificial Sequence
  Ubiquitin carboxyl-terminal hydrolase 22 (354-362)
agccacguguccggcaccacaacucug

SEQ ID NO: 60483 - RNA, 27 nt, Artificial Sequence
  MAP kinase-activating death domain protein (181-189)
agccacuaccccuucuuuuccaccuuc

SEQ ID NO: 60484 - RNA, 27 nt, Artificial Sequence
  Abnormal spindle-like microcephaly-associated protein (532-540)
agcaucuucagaacccccauuuccaag

SEQ ID NO: 60485 - RNA, 27 nt, Artificial Sequence
  ATPase family AAA domain-containing protein 5 (1793-1801)
agcaucauugaguaccugcccacccuc

SEQ ID NO: 60486 - RNA, 27 nt, Artificial Sequence
  Exportin-4 (345-353)
agcaucauuuccaaccugauaaccgug

SEQ ID NO: 60487 - RNA, 27 nt, Artificial Sequence
  LIM domain and actin-binding protein 1 (168-176)
agcaucaaggacagaauggccaaauac

SEQ ID NO: 60488 - RNA, 27 nt, Artificial Sequence
  GMP reductase 1 (115-123)
agcauccuggaggccgugccccagguc

SEQ ID NO: 60489 - RNA, 27 nt, Artificial Sequence
  DNA replication licensing factor MCM4 (252-260)
agcauccuggagcaccagauucaagug

SEQ ID NO: 60490 - RNA, 27 nt, Artificial Sequence
  Sperm-associated antigen 7 (79-87)
agcauccugcacgacguggucgagguu

SEQ ID NO: 60491 - RNA, 27 nt, Artificial Sequence
  Regulation of nuclear pre-mRNA domain-containing protein 2 (432-440)
agcauccuguccucucucaccucagug

SEQ ID NO: 60492 - RNA, 27 nt, Artificial Sequence
  E3 ubiquitin-protein ligase TRIP12 (580-588)
agcaucaacgcccagagaaaugcucug

SEQ ID NO: 60493 - RNA, 27 nt, Artificial Sequence
  Pre-mRNA-processing-splicing factor 8 (1693-1701)
agcaucuaccccuccccuaccggcgug

SEQ ID NO: 60494 - RNA, 30 nt, Artificial Sequence
  40S ribosomal protein S3a (70-79)
agccuggccgaccuccagaacgaugaggug

SEQ ID NO: 60495 - RNA, 27 nt, Artificial Sequence
  All-trans-retinol 13,14-reductase (241-249)
agccuggccgaggugcuccagcaacuu

SEQ ID NO: 60496 - RNA, 33 nt, Artificial Sequence
  Condensin complex subunit 1 (928-938)
agccuggccggcgacguggcucuccagcaacuu

SEQ ID NO: 60497 - RNA, 27 nt, Artificial Sequence
  AP-3 complex subunit delta-1 (220-228)
agccuggccccccucuucuuuaagcuu

SEQ ID NO: 60498 - RNA, 27 nt, Artificial Sequence
  Poly(rC)-binding protein 1 (337-345)
agccuggcccaguaccucaucaacgcu

SEQ ID NO: 60499 - RNA, 33 nt, Artificial Sequence
  Tyrosine-protein kinase Fer (665-675)
agccuggacgccgcugcaggcaugcucuaccuu

SEQ ID NO: 60500 - RNA, 27 nt, Artificial Sequence
  Hemoglobin subunit alpha (29-37)
agccuggacaaguuccucgccuccgug

SEQ ID NO: 60501 - RNA, 27 nt, Artificial Sequence
  General transcription factor 3C polypeptide 1 (202-210)
agccuggacaagaccucccacucugug

SEQ ID NO: 60502 - RNA, 27 nt, Artificial Sequence
  Regulator of nonsense transcripts 1 (683-691)
agccuguucgagagacucgugguccuu

SEQ ID NO: 60503 - RNA, 27 nt, Artificial Sequence
  MKL/myocardin-like protein 2 (820-828)
agccuguucggcucccccguggccaag

SEQ ID NO: 60504 - RNA, 30 nt, Artificial Sequence; identical to SEQ ID NO: 36277
  Protein flightless-1 homolog (1009-1018)

SEQ ID NO: 60505 - RNA, 30 nt, Artificial Sequence; identical to SEQ ID NO: 36278
  Cip1-interacting zinc finger protein (720-729)

SEQ ID NO: 60506 - RNA, 27 nt, Artificial Sequence
  T-complex protein 1 subunit eta (301-309)
agccugcacgacgccaucaugauugug

SEQ ID NO: 60507 - RNA, 30 nt, Artificial Sequence; identical to SEQ ID NO: 36280
  Coronin-1B (173-182)

SEQ ID NO: 60508 - RNA, 27 nt, Artificial Sequence
  T-complex protein 1 subunit zeta-2 (75-83)
agccugaucgccaagguggcuaccgca

SEQ ID NO: 60509 - RNA, 27 nt, Artificial Sequence
  Tyrosine-protein kinase JAK2 (367-375)
agccugaucgacggcuacuauagacuc

SEQ ID NO: 60510 - RNA, 30 nt, Artificial Sequence
  Acidic leucine-rich nuclear phosphoprotein 32 family member B (48-57)
agccugaucaacgugggccucauuuccguc

SEQ ID NO: 60511 - RNA, 27 nt, Artificial Sequence
  Protein Smaug homolog 2 (238-246)
agccugauccccaccuccccucaggug

SEQ ID NO: 60512 - RNA, 27 nt, Artificial Sequence
  Syntaxin-binding protein 2 (433-441)
agccugaucagaaaccucgagcagcuu

SEQ ID NO: 60513 - RNA, 27 nt, Artificial Sequence
  Phospholipase A-2-activating protein (670-678)
agccugaucuccaccauucucgaggug

SEQ ID NO: 60514 - RNA, 27 nt, Artificial Sequence
  Serine/threonine-protein phosphatase PP1-beta catalytic subunit (10-18)
agccugaucaccagacuccuugaggug

SEQ ID NO: 60515 - RNA, 27 nt, Artificial Sequence
  Schlafen family member 5 (473-481)
agccugaagcagaaacucgugaacaag

SEQ ID NO: 60516 - RNA, 27 nt, Artificial Sequence
  Caprin-1 (184-192)
agccugcucgacgaguucuacaagcuu

SEQ ID NO: 60517 - RNA, 30 nt, Artificial Sequence
  Macrophage erythroblast attacher (64-73)
agccugcucgacggcguggucgagaagcuu

SEQ ID NO: 60518 - RNA, 24 nt, Artificial Sequence
  Cyclin-I (71-78)
agccugcucgacagauuccuugcc

SEQ ID NO: 60519 - RNA, 30 nt, Artificial Sequence
  Cyclin-I (71-80)
agccugcucgacagauuccuugccaccgug

SEQ ID NO: 60520 - RNA, 33 nt, Artificial Sequence
  Splicing factor 3B subunit 3 (509-519)
agccugcucggcgacgaugcccuugugcagguc

SEQ ID NO: 60521 - RNA, 27 nt, Artificial Sequence
  Histidine triad nucleotide-binding protein 1 (72-80)
agccugcucggccaccuuaugaucgug

SEQ ID NO: 60522 - RNA, 33 nt, Artificial Sequence
  Acyl-CoA desaturase (80-90)
agccugcuccaccuuggcgcccuguacgggauc

SEQ ID NO: 60523 - RNA, 27 nt, Artificial Sequence
  Splicing factor 3B subunit 1 (643-651)
agccugcuccccuuccuuaaggccgug

SEQ ID NO: 60524 - RNA, 27 nt, Artificial Sequence
  Transformation/transcription domain-associated protein (819-827)
agccugcuccccuaccuuccuaugcug

SEQ ID NO: 60525 - RNA, 27 nt, Artificial Sequence
  Histone acetyltransferase KAT2A (320-328)
agccugcucagauccaucuucaccgug

SEQ ID NO: 60526 - RNA, 27 nt, Artificial Sequence
  Mitotic spindle assembly checkpoint protein MAD2B (114-122)
agccugcucucccacguggagcagcuu

SEQ ID NO: 60527 - RNA, 27 nt, Artificial Sequence
  Gamma-secretase C-terminal fragment 59 (436-444)
agccugcucuacaacgugcccgccguc

SEQ ID NO: 60528 - RNA, 30 nt, Artificial Sequence; identical to SEQ ID NO: 36301
  Syntenin-1 (289-298)

SEQ ID NO: 60529 - RNA, 27 nt, Artificial Sequence
  DNA topoisomerase 2-alpha (763-771)
agccugaugaugaccaucauuaaccuc

SEQ ID NO: 60530 - RNA, 27 nt, Artificial Sequence
  Phospholipase A-2-activating protein (625-633)
agccugaugucccacgccaucgagcuc

SEQ ID NO: 60531 - RNA, 27 nt, Artificial Sequence
  RecQ-mediated genome instability protein 1 (437-445)
agccugaacaauaagauccucaacaga

SEQ ID NO: 60532 - RNA, 30 nt, Artificial Sequence
  A-kinase anchor protein 13 (131-140)
agccugcccaccgugaucaugagaaacaag

SEQ ID NO: 60533 - RNA, 27 nt, Artificial Sequence
  Lon protease homolog 2, peroxisomal (51-59)
agccugcaguccaccauccucggcgug

SEQ ID NO: 60534 - RNA, 27 nt, Artificial Sequence
  Up-regulator of cell proliferation (550-558)
agccuguccgagaagcaguacuuccuc

SEQ ID NO: 60535 - RNA, 27 nt, Artificial Sequence
  Pleiotropic regulator 1 (232-240)
agccugaccggccacaucuccacagug

SEQ ID NO: 60536 - RNA, 27 nt, Artificial Sequence
  Tyrosine-protein kinase JAK1 (405-413)
agccugguggacggcuacuucagacuc

SEQ ID NO: 60537 - RNA, 27 nt, Artificial Sequence
  Long-chain-fatty-acid-CoA ligase 1 (410-418)
agccugugggacagacucaucuuccac

SEQ ID NO: 60538 - RNA, 27 nt, Artificial Sequence
  Nucleoside diphosphate kinase (246-254)
agccugugguucaagcccgaggaacuc

SEQ ID NO: 60539 - RNA, 27 nt, Artificial Sequence
  Eukaryotic translation initiation factor 3 subunit C-like protein (382-390)
agccuguacgacuauaaccccaaucuc

SEQ ID NO: 60540 - RNA, 27 nt, Artificial Sequence
  DNA repair and recombination protein RAD54B (618-626)
agccuguacaagggccuccuuuccgug

SEQ ID NO: 60541 - RNA, 27 nt, Artificial Sequence
  C-myc promoter-binding protein (1841-1849)
agccuguacagagagauccucuuccuu

SEQ ID NO: 60542 - RNA, 27 nt, Artificial Sequence
  Molybdate-anion transporter (297-305)
agccuguacagaaucgccaccuccaag

SEQ ID NO: 60543 - RNA, 33 nt, Artificial Sequence; identical to SEQ ID NO: 36316
  60S ribosome subunit biogenesis protein NIP7 homolog (135-145)

SEQ ID NO: 60544 - RNA, 27 nt, Artificial Sequence
  Eukaryotic translation initiation factor 3 subunit L (348-356)
agcauguuccagagaaccacauacaag

SEQ ID NO: 60545 - RNA, 27 nt, Artificial Sequence
  Probable ATP-dependent RNA helicase DDX6 (451-459)
agcaacaucgacaagucccuguacgug

SEQ ID NO: 60546 - RNA, 27 nt, Artificial Sequence
  Integrator complex subunit 5 (495-503)
agccccgccggccugaaggcugugcuc

SEQ ID NO: 60547 - RNA, 27 nt, Artificial Sequence
  Centrosomal protein of 170 kDa (1260-1268)
agccccgcccugaagaccacaagacuc

SEQ ID NO: 60548 - RNA, 24 nt, Artificial Sequence
  Cellular tumor antigen p53 (2-9)
agccccgcccugaacaagauguuc

SEQ ID NO: 60549 - RNA, 27 nt, Artificial Sequence
  E3 ubiquitin-protein ligase HUWE1 (376-384)
agccccgccccuaccaucacaucccug

SEQ ID NO: 60550 - RNA, 27 nt, Artificial Sequence
  Type II inositol 3,4-bisphosphate 4-phosphatase (439-447)
agccccgacucccugaagaacucucuc

SEQ ID NO: 60551 - RNA, 27 nt, Artificial Sequence
  N6-adenosine-methyltransferase 70 kDa subunit (525-533)
agccccggcaccagaaagaucgagcug

SEQ ID NO: 60552 - RNA, 27 nt, Artificial Sequence
  Integrator complex subunit 1 (254-262)
agcccccacggcggggcccuggugaug

SEQ ID NO: 60553 - RNA, 27 nt, Artificial Sequence
  Protein CASC5 (837-845)
agccccaucgagaaguccggcgugcug

SEQ ID NO: 60554 - RNA, 27 nt, Artificial Sequence
  Ephrin-A4 (18-26)
agcccccugagaggcggguccucucuc

SEQ ID NO: 60555 - RNA, 27 nt, Artificial Sequence
  Cullin-7 (801-809)
agccccaacaccgacagagaggugcug

SEQ ID NO: 60556 - RNA, 27 nt, Artificial Sequence
  Tumor suppressor p53-binding protein 1 (1028-1036)
agcccccagaagaccauguccgugcug

SEQ ID NO: 60557 - RNA, 27 nt, Artificial Sequence
  Stromal interaction molecule 2 (531-539)
agcccccagccucaaagagcccagcug

SEQ ID NO: 60558 - RNA, 30 nt, Artificial Sequence
  Polyadenylate-binding protein-interacting protein 1 (120-129)
agcccccaguccggcaacuucagacaacug

SEQ ID NO: 60559 - RNA, 27 nt, Artificial Sequence
  Proteasomal ATPase-associated factor 1 (195-203)
agccccagagccccugugcaggucauc

SEQ ID NO: 60560 - RNA, 30 nt, Artificial Sequence
  Gephyrin (270-279)
agccccagagcccaggcuaccuccaggcug

SEQ ID NO: 60561 - RNA, 27 nt, Artificial Sequence
  Tumor suppressor p53-binding protein 1 (1656-1664)
agccccagagccuccaugggcgugcug

SEQ ID NO: 60562 - RNA, 30 nt, Artificial Sequence
  Ras-related protein Rab-7a (111-120)
agccccagagacccugagaacuucccauuu

SEQ ID NO: 60563 - RNA, 27 nt, Artificial Sequence
  Ankyrin repeat and LEM domain-containing protein 2 (512-520)
agccccagagacccugugcugacccuc

SEQ ID NO: 60564 - RNA, 27 nt, Artificial Sequence
  Helicase SKI2W (1016-1024)
agccccagauucccugcccaguaccug

SEQ ID NO: 60565 - RNA, 33 nt, Artificial Sequence
  Pleckstrin homology domain-containing family G member 2 (45-55)
agccccagaggcuccgggucuucaaccagucug

SEQ ID NO: 60566 - RNA, 27 nt, Artificial Sequence
  Serine/threonine-protein kinase receptor R3 (5-13)
agccccagaaagggccugcucaugcuu

SEQ ID NO: 60567 - RNA, 27 nt, Artificial Sequence
  Procollagen-lysine,2-oxoglutarate 5-dioxygenase 2 (174-182)
agccccagaaagggcugguccuucaug

SEQ ID NO: 60568 - RNA, 27 nt, Artificial Sequence
  Tyrosine-protein kinase BAZ1B (197-205)
agccccagaaagcugccuaccucccuc

SEQ ID NO: 60569 - RNA, 27 nt, Artificial Sequence
  Mitochondrial carrier homolog 1 (89-97)
agccccagacugauguccaacgcccuc

SEQ ID NO: 60570 - RNA, 30 nt, Artificial Sequence
  Intercellular adhesion molecule 1 (5-14)
agccccagaccugcccugccagcucuccuu

SEQ ID NO: 60571 - RNA, 27 nt, Artificial Sequence
  AP-5 complex subunit mu-1 (117-125)
agccccagaccuccacugaucuccgug

SEQ ID NO: 60572 - RNA, 27 nt, Artificial Sequence
  Integrator complex subunit 1 (211-219)
agccccagaccuguggcccuggcucuc

SEQ ID NO: 60573 - RNA, 33 nt, Artificial Sequence
  Nuclear receptor subfamily 1 group D member 1 (405-415)
agccccagacagggcaacuccaagaaugugcug

SEQ ID NO: 60574 - RNA, 27 nt, Artificial Sequence
  Sorbin and SH3 domain-containing protein 2 (230-238)
agccccagauccuacucuucaacccug

SEQ ID NO: 60575 - RNA, 27 nt, Artificial Sequence
  Baculoviral IAP repeat-containing protein 6 (4258-4266)
agccccagagugccuaacuccucuguc

SEQ ID NO: 60576 - RNA, 33 nt, Artificial Sequence
  Thymidine kinase, cytosolic (13-23)
agccccuccaagaccagaggccagauccaagug

SEQ ID NO: 60577 - RNA, 27 nt, Artificial Sequence
  Histone deacetylase 9 (322-330)
agccccucccugccuaacaucacccuc

SEQ ID NO: 60578 - RNA, 24 nt, Artificial Sequence
  Nucleolin (67-74)
agccccaccaagaaaguggccguc

SEQ ID NO: 60579 - RNA, 27 nt, Artificial Sequence
  Nucleolar protein 11 (166-174)
agccaggaccccggcacccacgugguc

SEQ ID NO: 60580 - RNA, 27 nt, Artificial Sequence
  Unconventional myosin-If (124-132)
agcagauucggcaaguacuuugagauc

SEQ ID NO: 60581 - RNA, 30 nt, Artificial Sequence
  DnaJ homolog subfamily B member 2 (131-140)
agcagacacuccggccccuucuuuaccuuc

SEQ ID NO: 60582 - RNA, 27 nt, Artificial Sequence
  Hyccin (228-236)
agcagaauccccguguccucuggcuuc

SEQ ID NO: 60583 - RNA, 27 nt, Artificial Sequence
  Merlin (587-595)
agcagaguggccuucuuugaggaacug

SEQ ID NO: 60584 - RNA, 27 nt, Artificial Sequence
  Catenin beta-1 (341-349)
agcagagugcugaagguccucuccguu

SEQ ID NO: 60585 - RNA, 33 nt, Artificial Sequence
  Stomatin-like protein 2, mitochondrial (29-39)
agcuccggccugcccagaaacaccgugguccuc

SEQ ID NO: 60586 - RNA, 27 nt, Artificial Sequence
  General transcription factor 3C polypeptide 2 (775-783)
agcuccggcgugcccaacccuccaaag

SEQ ID NO: 60587 - RNA, 30 nt, Artificial Sequence
  60S ribosomal protein L10a (2-11)
agcuccaaggugucuagagacacccuguac

SEQ ID NO: 60588 - RNA, 27 nt, Artificial Sequence
  Ashwin (155-163)
agcuccaaccugcccgugaauaacaag

SEQ ID NO: 60589 - RNA, 27 nt, Artificial Sequence
  Transmembrane protein 176A (50-58)
agcuccagacugcucguggccucuugg

SEQ ID NO: 60590 - RNA, 27 nt, Artificial Sequence
  Vimentin (72-80)
agcuccgugcccggcgucagacugcuc

SEQ ID NO: 60591 - RNA, 27 nt, Artificial Sequence
  Synaptotagmin-like protein 2 (282-290)
agcaccgacuccgagacacugagauac

SEQ ID NO: 60592 - RNA, 27 nt, Artificial Sequence
  Ribosomal protein S6 kinase alpha-3 (327-335)
agcaccaucgacuggaacaagcuguac

SEQ ID NO: 60593 - RNA, 33 nt, Artificial Sequence
  Serine/threonine-protein kinase RIO2 (494-504)
agcaccauccccccugagcuggugaagcagaaa

SEQ ID NO: 60594 - RNA, 36 nt, Artificial Sequence
  AP-3 complex subunit beta-1 (26-37)
agcaccaucucccccucuggcgccuucgggcuguuu

SEQ ID NO: 60595 - RNA, 33 nt, Artificial Sequence
  Forkhead box protein O1 (544-554)
agcaccaugccccacacauccggcaugaacaga

SEQ ID NO: 60596 - RNA, 27 nt, Artificial Sequence
  ATP-dependent RNA helicase DDX3X (410-418)
agcaccuccgagaacaucacacagaag

SEQ ID NO: 60597 - RNA, 30 nt, Artificial Sequence
  Elongation factor 1-alpha 1 (21-30)
agcaccacaacuggccaccugaucuacaag

SEQ ID NO: 60598 - RNA, 27 nt, Artificial Sequence
  Protein STON1-GTF2A1L (339-347)
agcguggccggcaagauccacaccguc

SEQ ID NO: 60599 - RNA, 30 nt, Artificial Sequence
  Lysine-specific demethylase 7A (208-217)
agcguguuccccaagccuuuuguccagaaa

SEQ ID NO: 60600 - RNA, 30 nt, Artificial Sequence
  Round spermatid basic protein 1-like protein (733-742)
agcguguucuccgacaagcugcacucuaaa

SEQ ID NO: 60601 - RNA, 30 nt, Artificial Sequence
  Disintegrin and metalloproteinase domain-containing protein 10 (118-127)
agcgugaucgacggcagauucgagggguuu

SEQ ID NO: 60602 - RNA, 27 nt, Artificial Sequence
  Inactive phospholipase C-like protein 2 (372-380)
agcgugaucgacauuauaaacaaguac

SEQ ID NO: 60603 - RNA, 27 nt, Artificial Sequence
  E3 ubiquitin-protein ligase UBR2 (812-820)
agcgugaucgaggccgucgcucacuuc

SEQ ID NO: 60604 - RNA, 27 nt, Artificial Sequence
  Transcription factor MafG (149-157)
agcgugaucaccauugucaaguccaaa

SEQ ID NO: 60605 - RNA, 30 nt, Artificial Sequence
  Probable E3 ubiquitin-protein ligase HERC4 (549-558)
agcgugcuggagcccccucucuuccuuaag

SEQ ID NO: 60606 - RNA, 30 nt, Artificial Sequence
  40S ribosomal protein S6 (105-114)
agcgugcugaaccucgucaucguuaagaaa

SEQ ID NO: 60607 - RNA, 30 nt, Artificial Sequence
  Pumilio homolog 1 (183-192)
agcgugucccagcccaucaugguccaaaga

SEQ ID NO: 60608 - RNA, 27 nt, Artificial Sequence
  Phosphatidylinositol 3-kinase regulatory subunit gamma (51-59)
agcguggucgagcugaucaaccacuac

SEQ ID NO: 60609 - RNA, 27 nt, Artificial Sequence
  Dolichyl-diphosphooligosaccharide-proteinosyltransferase subunit DAD1 (4-12)
agcguggucuccguuaucucuagauuc

SEQ ID NO: 60610 - RNA, 27 nt, Artificial Sequence
  Protein TBRG4 (151-159)
agcguguggcacggcacccuguccaag

SEQ ID NO: 60611 - RNA, 27 nt, Artificial Sequence
  Nesprin-1 (4541-4549)
agcguguacgacuccguccugcagaag

SEQ ID NO: 60612 - RNA, 33 nt, Artificial Sequence
  Protein ELYS (1415-1425)
agcguguacgagggcaagaucuucacccagaaa

SEQ ID NO: 60613 - RNA, 30 nt, Artificial Sequence; identical to SEQ ID NO: 36386
  ATPase family AAA domain-containing protein 2 (757-766)

SEQ ID NO: 60614 - RNA, 27 nt, Artificial Sequence
  Type I inositol 1,4,5-trisphosphate 5-phosphatase (94-102)
agcguguacuccggcaucagacacaag

SEQ ID NO: 60615 - RNA, 27 nt, Artificial Sequence
  Disks large homolog 3 (45-53)
agcuacggcgacauccugcacgugauu

SEQ ID NO: 60616 - RNA, 27 nt, Artificial Sequence
  Long-chain-fatty-acid-CoA ligase 5 (359-367)
agcuaccugccccucgcccacauguuc

SEQ ID NO: 60617 - RNA, 27 nt, Artificial Sequence
  Trafficking protein particle complex subunit 1 (132-140)
agcuacgugagaucccugcccuucuuu

SEQ ID NO: 60618 - RNA, 27 nt, Artificial Sequence
  HLA class I histocompatibility antigen, B-15 alpha chain (158-166)
accgccgcugacacagcagcccagauc

SEQ ID NO: 60619 - RNA, 27 nt, Artificial Sequence
  Bromodomain testis-specific protein (144-152)
accgccgcucccccugcacagccacug

SEQ ID NO: 60620 - RNA, 24 nt, Artificial Sequence
  Heterochromatin protein 1-binding protein 3 (363-370)
accgcccugaagaaauacgugcuc

SEQ ID NO: 60621 - RNA, 24 nt, Artificial Sequence
  Probable E3 ubiquitin-protein ligase HERC4 (592-599)
accgcccugaaggugcucgagauc

SEQ ID NO: 60622 - RNA, 24 nt, Artificial Sequence
  Histone H1.3 (4-11)
accgccccccuggcuccuacaauc

SEQ ID NO: 60623 - RNA, 27 nt, Artificial Sequence
  Malectin (10-18)
accgccguggcucugcucagacuucug

SEQ ID NO: 60624 - RNA, 27 nt, Artificial Sequence
  Glyoxalase domain-containing protein 4 (117-125)
accgaggcccccggcggguacaaguuc

SEQ ID NO: 60625 - RNA, 27 nt, Artificial Sequence
  SRSF protein kinase 2 (529-537)
accgaggacauccagacaagacaauac

SEQ ID NO: 60626 - RNA, 36 nt, Artificial Sequence
  Twinfilin-2 (164-175)
accgagaucagcguggaauccaagcaccagacacug

SEQ ID NO: 60627 - RNA, 27 nt, Artificial Sequence
  Nucleolar protein 14 (741-749)
accgagauggaaagccagaagcaacug

SEQ ID NO: 60628 - RNA, 27 nt, Artificial Sequence
  ATPase WRNIP1 (477-485)
accgagaacgacgugaaggaaggccug

SEQ ID NO: 60629 - RNA, 30 nt, Artificial Sequence
  4F2 cell-surface antigen heavy chain (5-14)
accgagguggacaugaaggaagucgagcug

SEQ ID NO: 60630 - RNA, 27 nt, Artificial Sequence
  Transgelin (191-199)
accggcuacgggagacccaggcagauc

SEQ ID NO: 60631 - RNA, 27 nt, Artificial Sequence
  Splicing factor 3A subunit 3 (238-246)
acccacgccggcgcucaucuggaccuc

SEQ ID NO: 60632 - RNA, 27 nt, Artificial Sequence
  Histone-binding protein RBBP4 (37-45)
acccacgcccuggaguggcccagccuc

SEQ ID NO: 60633 - RNA, 27 nt, Artificial Sequence
  Bifunctional glutamate/proline-tRNA ligase (614-622)
acccacgcccugcccaucccugugauu

SEQ ID NO: 60634 - RNA, 27 nt, Artificial Sequence
  Activator of 90 kDa heat shock protein ATPase homolog 1 (236-244)
acccacgcccccgcuacacuggaggca

SEQ ID NO: 60635 - RNA, 27 nt, Artificial Sequence
  Integrin beta-7 (446-454)
acccacugccugcccgagccucaucuc

SEQ ID NO: 60636 - RNA, 30 nt, Artificial Sequence
  Echinoderm microtubule-associated protein-like 3 (848-857)
acccacgacgauagccaucuggugucccuc

SEQ ID NO: 60637 - RNA, 27 nt, Artificial Sequence
  Double-stranded RNA-specific adenosine deaminase (1054-1062)
acccacuuccugcagcccaucuaccuc

SEQ ID NO: 60638 - RNA, 27 nt, Artificial Sequence
  Histone deacetylase complex subunit SAP18 (85-93)
acccacuucaacuuugccaucguguuc

SEQ ID NO: 60639 - RNA, 27 nt, Artificial Sequence
  Ubiquitin carboxyl-terminal hydrolase 34 (2105-2113)
acccacuucagcuuuccccugagacuc

SEQ ID NO: 60640 - RNA, 27 nt, Artificial Sequence
  Syntaxin-binding protein 1 (570-578)
acccacauccugacaccccagaagcuc

SEQ ID NO: 60641 - RNA, 30 nt, Artificial Sequence
  Telomere-associated protein RIF1 (62-71)
acccacaucagcucccagaacucugagcug

SEQ ID NO: 60642 - RNA, 30 nt, Artificial Sequence
  RE1-silencing transcription factor (917-926)
acccacaucagcuccucuggccagaaccug

SEQ ID NO: 60643 - RNA, 27 nt, Artificial Sequence
  Microtubule-actin cross-linking factor 1, isoforms 1/2/3/5 (6374-6382)
acccacauggagcuguacagccagcuc

SEQ ID NO: 60644 - RNA, 27 nt, Artificial Sequence
  ATP-citrate synthase (409-417)
acccacaugacagccaucgugggcaug

SEQ ID NO: 60645 - RNA, 27 nt, Artificial Sequence
  Protein tyrosine phosphatase type IVA 1 (22-30)
acccacaaccccacaaaugccacucug

SEQ ID NO: 60646 - RNA, 27 nt, Artificial Sequence
  Phospholipase D3 (389-397)
acccacagcgacauccaggugaagcug

SEQ ID NO: 60647 - RNA, 27 nt, Artificial Sequence
  General transcription factor IIH subunit 5 (41-49)
acccacguguucgucaucgccgagcug

SEQ ID NO: 60648 - RNA, 30 nt, Artificial Sequence
  DNA replication licensing factor MCM6 (781-790)
acccacuacgaccaugugcugaucgagcuc

SEQ ID NO: 60649 - RNA, 27 nt, Artificial Sequence
  Microfibrillar-associated protein 1 (372-380)
accauccugcccaaggugaugcagguc

SEQ ID NO: 60650 - RNA, 27 nt, Artificial Sequence
  Putative protein arginine N-methyltransferase 9 (164-172)
accaucuacaacgccgcuauucagaag

SEQ ID NO: 60651 - RNA, 27 nt, Artificial Sequence
  Protein NYNRIN (1487-1495)
acccuggccgacaucauugcuagacuc

SEQ ID NO: 60652 - RNA, 27 nt, Artificial Sequence
  Ankyrin repeat and KH domain-containing protein 1 (1028-1036)
acccuggacgaucucaucgccgcugug

SEQ ID NO: 60653 - RNA, 27 nt, Artificial Sequence
  TGF-beta-activated kinase 1 and MAP3K7-binding protein 1 (426-434)
acccuggacgaggccacacccacucuc

SEQ ID NO: 60654 - RNA, 27 nt, Artificial Sequence
  Exocyst complex component 1 (91-99)
acccugggcaacgugcucgucacaguu

SEQ ID NO: 60655 - RNA, 30 nt, Artificial Sequence
  Spliceosome RNA helicase DDX39B (114-123)
acccugcacggccuccagcaauacuaugug

SEQ ID NO: 60656 - RNA, 27 nt, Artificial Sequence
  Hexokinase-1 (35-43)
acccugaucgacauuaugacaagauuc

SEQ ID NO: 60657 - RNA, 27 nt, Artificial Sequence
  Short transient receptor potential channel 4-associated protein (209-217)
acccugaucgaggacauucucggcgug

SEQ ID NO: 60658 - RNA, 27 nt, Artificial Sequence
  Cullin-7 (386-394)
acccugaucagcgagcucgugcaggcc

SEQ ID NO: 60659 - RNA, 33 nt, Artificial Sequence
  T-complex protein 1 subunit eta (11-21)
acccugcucgccgcugaguuccuuaagcaggug

SEQ ID NO: 60660 - RNA, 33 nt, Artificial Sequence
  NADH-cytochrome b5 reductase 1 (39-49)
acccugcucgaccccaacgagaaguaccuucug

SEQ ID NO: 60661 - RNA, 27 nt, Artificial Sequence
  Centrosomal protein POC5 (254-262)
acccugcucaagaaaguguggaagguc

SEQ ID NO: 60662 - RNA, 27 nt, Artificial Sequence
  Protrudin (88-96)
acccugcucaacagcacacuuuuccug

SEQ ID NO: 60663 - RNA, 27 nt, Artificial Sequence
  Eukaryotic translation initiation factor 3 subunit M (163-171)
acccugcucagacuucuguacgaggcc

SEQ ID NO: 60664 - RNA, 27 nt, Artificial Sequence
  DNA mismatch repair protein Msh6 (739-747)
acccugaacaaucucgagaucuuccuu

SEQ ID NO: 60665 - RNA, 27 nt, Artificial Sequence
  Protein SDA1 homolog (404-412)
acccugaacccccagaugcuccaaaag

SEQ ID NO: 60666 - RNA, 27 nt, Artificial Sequence
  Testis-expressed sequence 10 protein (436-444)
acccugagcgacaucauggugucccuc

SEQ ID NO: 60667 - RNA, 27 nt, Artificial Sequence
  Transcription initiation factor TFIID subunit 8 (89-97)
acccugagcgacaucguggucacacuc

SEQ ID NO: 60668 - RNA, 27 nt, Artificial Sequence
  Serine/threonine-protein kinase SIK2 (269-277)
acccugagcgaggugacaaaccagcuc

SEQ ID NO: 60669 - RNA, 27 nt, Artificial Sequence
  MAP kinase-activating death domain protein (291-299)
acccugguggacuucccccuccaccuu

SEQ ID NO: 60670 - RNA, 33 nt, Artificial Sequence
  Motile sperm domain-containing protein 1 (39-49)
acccuguacaaccccuaugaguucgcccucaag

SEQ ID NO: 60671 - RNA, 27 nt, Artificial Sequence
  Chondroitin sulfate proteoglycan 4 (21-29)
accaugcuggccagacucgcuagcgca

SEQ ID NO: 60672 - RNA, 27 nt, Artificial Sequence
  Poly (ADP-ribose) polymerase 14 (1511-1519)
accaugaacgagaagcagcuguuccac

SEQ ID NO: 60673 - RNA, 27 nt, Artificial Sequence
  ATP-binding cassette sub-family F member 2 (218-226)
acccccgccaugcagagaaagaaacug

SEQ ID NO: 60674 - RNA, 27 nt, Artificial Sequence
  Splicing factor, arginine/serine-rich 19 (1147-1155)
acccccgccccugugccaacaagccug

SEQ ID NO: 60675 - RNA, 27 nt, Artificial Sequence
  SCAN domain-containing protein 1 (132-140)
acccccggcccugccgggagcagacug

SEQ ID NO: 60676 - RNA, 27 nt, Artificial Sequence
  Dolichyl-diphosphooligosaccharide-proteinosyltransferase subunit 2 (291-299)
accccccaccagacauucgugagacug

SEQ ID NO: 60677 - RNA, 27 nt, Artificial Sequence
  Protein ELYS (1773-1781)
acccccaagaugccuggccagagcgug

SEQ ID NO: 60678 - RNA, 27 nt, Artificial Sequence
  Microtubule-associated protein 4 (892-900)
acccccaugccuagcagaccauccaca

SEQ ID NO: 60679 - RNA, 24 nt, Artificial Sequence
  Nucleophosmin (95-102)
acccccccugugguccugagacuc

SEQ ID NO: 60680 - RNA, 33 nt, Artificial Sequence
  Filamin-A (812-822)
acccccagaggcgccgggagcuacacaaucaug

SEQ ID NO: 60681 - RNA, 33 nt, Artificial Sequence
  40S ribosomal protein S9 (15-25)
acccccagaaggccuuucgagaagagccggcug

SEQ ID NO: 60682 - RNA, 27 nt, Artificial Sequence
  BTB/POZ domain-containing adapter for CUL3-mediated RhoA degradation protein 2 (290-298)
acccccagagugccugacaacagccug

SEQ ID NO: 60683 - RNA, 27 nt, Artificial Sequence
  Sentrin-specific protease 3 (353-361)
acccccagcagaaagggccuggugcuc

SEQ ID NO: 60684 - RNA, 24 nt, Artificial Sequence
  Interferon regulatory factor 1 (54-61)
acccccgugagacugccuagcauc

SEQ ID NO: 60685 - RNA, 27 nt, Artificial Sequence
  Replication protein A 70 kDa DNA-binding subunit (191-199)
acccccuaccagagcaaguggacaauc

SEQ ID NO: 60686 - RNA, 27 nt, Artificial Sequence
  Splicing factor U2AF 65 kDa subunit (179-187)
acccaggcccccggcaacccugugcug

SEQ ID NO: 60687 - RNA, 27 nt, Artificial Sequence
  GPN-loop GTPase 1 (88-96)
accagauucgaccaggugaugaaguuu

SEQ ID NO: 60688 - RNA, 27 nt, Artificial Sequence
  RuvB-like 2 (391-399)
accagaaucggccuggagacaagccuc

SEQ ID NO: 60689 - RNA, 27 nt, Artificial Sequence
  40S ribosomal protein S4, Y isoform 2 (220-228)
accagaaucagcaacauuuucgugaua

SEQ ID NO: 60690 - RNA, 27 nt, Artificial Sequence
  40S ribosomal protein S4, X isoform (201-209)
accagacugagcaacaucuucgugauu

SEQ ID NO: 60691 - RNA, 27 nt, Artificial Sequence
  Transmembrane protein 147 (157-165)
accagauacgaccuguaucacacauuc

SEQ ID NO: 60692 - RNA, 30 nt, Artificial Sequence; identical to SEQ ID NO: 36465
  Transcriptional regulator Kaiso (365-374)

SEQ ID NO: 60693 - RNA, 24 nt, Artificial Sequence
  HCG2043421, isoform CRA_c (58-65)
accagcaagcagcccgugggcuuc

SEQ ID NO: 60694 - RNA, 27 nt, Artificial Sequence
  WD repeat-containing protein 78 (675-683)
accagcguggucuacgacguugccugg

SEQ ID NO: 60695 - RNA, 27 nt, Artificial Sequence
  Non-POU domain-containing octamer-binding protein (127-135)
accacauuccccagaccugugacuguc

SEQ ID NO: 60696 - RNA, 33 nt, Artificial Sequence
  Nicotinamide phosphoribosyltransferase (220-230)
accguggccggccuggcucucaucaagaaauac

SEQ ID NO: 60697 - RNA, 27 nt, Artificial Sequence
  1,2-dihydroxy-3-keto-5-methylthiopentene dioxygenase (150-158)
accguggacgagaagaacuacacaaaa

SEQ ID NO: 60698 - RNA, 30 nt, Artificial Sequence
  Aldehyde dehydrogenase family 16 member A1 (661-670)
accguguuccccgccggccuggcuaacguc

SEQ ID NO: 60699 - RNA, 27 nt, Artificial Sequence
  Protein phosphatase 1D (261-269)
accgugaucgaccagauucccuuccug

SEQ ID NO: 60700 - RNA, 27 nt, Artificial Sequence
  Integrin beta-7 (200-208)
accgugcugcccuucgucagcacaguu

SEQ ID NO: 60701 - RNA, 27 nt, Artificial Sequence
  Caspase-1 (49-57)
accgugauggacaagacaagagcccug

SEQ ID NO: 60702 - RNA, 27 nt, Artificial Sequence
  Kelch-like protein 8 (200-208)
accgugaugggcaagaucuucgccguc

SEQ ID NO: 60703 - RNA, 27 nt, Artificial Sequence
  CMP-N-acetylneuraminate-beta-galactosamide-alpha-2,3-sialyltransf erase 1 (229-237)
accuacauccccgugccugccaagauu

SEQ ID NO: 60704 - RNA, 27 nt, Artificial Sequence
  Vacuolar protein sorting-associated protein 13C (2564-2572)
accuacaucagcuggaaggaggaacug

SEQ ID NO: 60705 - RNA, 27 nt, Artificial Sequence
  Rho GTPase-activating protein 18 (597-605)
accuacaugaaggaccuguaucagcuc

SEQ ID NO: 60706 - RNA, 27 nt, Artificial Sequence
  Plexin-B2 (1279-1287)
accuacacagacagaguguucuuucug

SEQ ID NO: 60707 - RNA, 27 nt, Artificial Sequence
  Poly (ADP-ribose) polymerase 14 (1544-1552)
guggccuacggcaaggggaccuauuuc

SEQ ID NO: 60708 - RNA, 27 nt, Artificial Sequence
  Zinc finger SWIM domain-containing protein 1 (322-330)
guggagagccacauccagcauucccug

SEQ ID NO: 60709 - RNA, 27 nt, Artificial Sequence
  Putative 40S ribosomal protein S10-like (27-35)
gugcacaugcccaagcauccugagcug

SEQ ID NO: 60710 - RNA, 30 nt, Artificial Sequence
  Inosine-5'-monophosphate dehydrogenase 2 (361-370)
gugaucgccgacggcgggauucagaacguc

SEQ ID NO: 60711 - RNA, 27 nt, Artificial Sequence
  Protein DENND6A (261-269)
gugauccugcccaccguccacgagguu

SEQ ID NO: 60712 - RNA, 27 nt, Artificial Sequence
  N-glycosylase/DNA lyase (58-66)
gugcuggccgaccaggucuggacccuc

SEQ ID NO: 60713 - RNA, 27 nt, Artificial Sequence
  CREB-binding protein (238-246)
gugcuggccgagacccucacacagguc

SEQ ID NO: 60714 - RNA, 27 nt, Artificial Sequence
  Transmembrane protein 209 (29-37)
gugcuggccuggggccuccuuaacguc

SEQ ID NO: 60715 - RNA, 27 nt, Artificial Sequence
  Kelch-like protein 5 (324-332)
gugcuggacgauaagcucuacgucguu

SEQ ID NO: 60716 - RNA, 27 nt, Artificial Sequence
  RNA-binding protein 40 (490-498)
gugcuguucggcaagcccauggucguu

SEQ ID NO: 60717 - RNA, 27 nt, Artificial Sequence
  Pre-mRNA-splicing factor ATP-dependent RNA helicase PRP16 (663-671)
gugcuguucggccuccuuagagagguc

SEQ ID NO: 60718 - RNA, 36 nt, Artificial Sequence
  Translocon-associated protein subunit alpha (19-30)
gugcuguucagaggcgggcccaggggacuccuugcc

SEQ ID NO: 60719 - RNA, 36 nt, Artificial Sequence
  Translocon-associated protein subunit alpha (19-30)
gugcuguucagaggcgggcccaggggaagccucgcc

SEQ ID NO: 60720 - RNA, 33 nt, Artificial Sequence
  Major prion protein (226-236)
gugcuguucagcucccccccugucauccuccuu

SEQ ID NO: 60721 - RNA, 27 nt, Artificial Sequence
  Fibroblast growth factor receptor substrate 2 (252-260)
gugcugggccccaccccuguccagaag

SEQ ID NO: 60722 - RNA, 30 nt, Artificial Sequence
  Actin-related protein 2/3 complex subunit 4 (61-70)
gugcugaucgagggcagcauuaacuccguc

SEQ ID NO: 60723 - RNA, 30 nt, Artificial Sequence
  mRNA cap guanine-N7 methyltransferase (182-191)
gugcugaucggcgaguuccucgaaaagguc

SEQ ID NO: 60724 - RNA, 30 nt, Artificial Sequence
  Trabeculin-alpha (4505-4514)
gugcugaucaagaaccuccuugucagcguu

SEQ ID NO: 60725 - RNA, 27 nt, Artificial Sequence
  ATP-binding cassette sub-family F member 3 (85-93)
gugcugcucgacgcccccauccagcuu

SEQ ID NO: 60726 - RNA, 27 nt, Artificial Sequence
  Vacuolar protein sorting-associated protein 8 homolog (414-422)
gugcugcucgacagcgucgagaagcuu

SEQ ID NO: 60727 - RNA, 30 nt, Artificial Sequence
  Fragile X mental retardation protein 1 (19-28)
gugcugcucgacuaccaccuuaacuaucug

SEQ ID NO: 60728 - RNA, 27 nt, Artificial Sequence
  Signal recognition particle 14 kDa protein (2-10)
gugcugcucgagagcgaacaguuccuu

SEQ ID NO: 60729 - RNA, 36 nt, Artificial Sequence
  Signal recognition particle 14 kDa protein (2-13)
gugcugcucgagagcgaacaguuccuuaccgagcug

SEQ ID NO: 60730 - RNA, 27 nt, Artificial Sequence
  Leucine-tRNA ligase, cytoplasmic (328-336)
gugcugauggagaacaucgucuaccuc

SEQ ID NO: 60731 - RNA, 30 nt, Artificial Sequence
  E3 ubiquitin-protein ligase MARCH6 (457-466)
gugcugcccaacuuccucccuuacaauguc

SEQ ID NO: 60732 - RNA, 27 nt, Artificial Sequence
  DNA replication licensing factor MCM5 (120-128)
gugcugcaggacauccaagucaugcuc

SEQ ID NO: 60733 - RNA, 27 nt, Artificial Sequence
  Sarcolemmal membrane-associated protein (140-148)
gugcugcaggagaagaucgaagucguu

SEQ ID NO: 60734 - RNA, 27 nt, Artificial Sequence
  Trabeculin-alpha (2088-2096)
gugcugcagggcaagcucgccgagguc

SEQ ID NO: 60735 - RNA, 27 nt, Artificial Sequence
  Cytoplasmic dynein 1 heavy chain 1 (1781-1789)
gugcugagcaacgucgagguuacccuc

SEQ ID NO: 60736 - RNA, 27 nt, Artificial Sequence
  5-formyltetrahydrofolate cyclo-ligase (35-43)
gugcugagccagaaggucaucgcccac

SEQ ID NO: 60737 - RNA, 24 nt, Artificial Sequence
  Signal transducer and activator of transcription 1-alpha/beta (300-307)
gugcugugggacagaaccuucagc

SEQ ID NO: 60738 - RNA, 30 nt, Artificial Sequence
  Signal transducer and activator of transcription 1-alpha/beta (300-309)
gugcugugggacagaaccuucagccucuuu

SEQ ID NO: 60739 - RNA, 27 nt, Artificial Sequence
  Pre-rRNA-processing protein TSR1 homolog (678-686)
gugcugugguucaagcccgucgagcuc

SEQ ID NO: 60740 - RNA, 27 nt, Artificial Sequence
  Dolichol-phosphate mannosyltransferase subunit 3 (58-66)
gugcuguggccccucccugccuaccuu

SEQ ID NO: 60741 - RNA, 33 nt, Artificial Sequence
  Msx2-interacting protein (557-567)
gugcuguacaacgagaucgaauaugcccaggcu

SEQ ID NO: 60742 - RNA, 27 nt, Artificial Sequence
  2',5'-phosphodiesterase 12 (419-427)
gugcuguaccccagcgcccaggagaag

SEQ ID NO: 60743 - RNA, 27 nt, Artificial Sequence
  Serine/threonine-protein kinase ATR (2265-2273)
gugaugauccccacccugccuagcauu

SEQ ID NO: 60744 - RNA, 27 nt, Artificial Sequence
  Receptor-type tyrosine-protein phosphatase U (975-983)
gugaugaucaccaagcuggucgagguu

SEQ ID NO: 60745 - RNA, 27 nt, Artificial Sequence
  Translocon-associated protein subunit gamma (64-72)
gugaugacccuggucagcacauaccuc

SEQ ID NO: 60746 - RNA, 24 nt, Artificial Sequence
  60S ribosomal protein L13a (120-127)
gugcccgccgcucugaaggucguu

SEQ ID NO: 60747 - RNA, 27 nt, Artificial Sequence
  Ankyrin repeat and KH domain-containing protein 1 (1721-1729)
gugcccgccagcgucguuuccagaauc

SEQ ID NO: 60748 - RNA, 27 nt, Artificial Sequence
  Protein UXT (95-103)
gugcccgacaccagcagaaucuacguc

SEQ ID NO: 60749 - RNA, 27 nt, Artificial Sequence
  Guanine nucleotide-binding protein-like 3 (295-303)
gugccccuggacaagcagaucaccauu

SEQ ID NO: 60750 - RNA, 27 nt, Artificial Sequence
  Pumilio homolog 1 (345-353)
gugccccuggacccuauggagcacguc

SEQ ID NO: 60751 - RNA, 27 nt, Artificial Sequence
  Myotubularin (85-93)
gugccccugggcgucaucagcagaauu

SEQ ID NO: 60752 - RNA, 24 nt, Artificial Sequence
  Ran-binding protein 6 (956-963)
gugccccugcucgucaagguuauc

SEQ ID NO: 60753 - RNA, 27 nt, Artificial Sequence
  Cytoplasmic dynein 1 heavy chain 1 (2524-2532)
gugccccugccuaccgccccaaacauc

SEQ ID NO: 60754 - RNA, 27 nt, Artificial Sequence
  Transcriptional regulator Kaiso (118-126)
gugccccugagccaggucaaguccauc

SEQ ID NO: 60755 - RNA, 27 nt, Artificial Sequence
  Transcription factor Sp4 (217-225)
gugcccaaccugcagaccgucagcguu

SEQ ID NO: 60756 - RNA, 27 nt, Artificial Sequence
  L-lactate dehydrogenase B chain (19-27)
gugcccaacaauaagaucaccgucguu

SEQ ID NO: 60757 - RNA, 27 nt, Artificial Sequence
  Histone deacetylase complex subunit SAP130 (800-808)
gugcccccucuggccaccaacacaguc

SEQ ID NO: 60758 - RNA, 30 nt, Artificial Sequence
  Endoplasmic reticulum resident protein 29 (5-14)
gugcccagagccgcuuuccugagcccucuc

SEQ ID NO: 60759 - RNA, 27 nt, Artificial Sequence
  Myotubularin (35-43)
gugcccagacugccuggcgagacccuc

SEQ ID NO: 60760 - RNA, 27 nt, Artificial Sequence
  Adapter protein CIKS (387-395)
gugcccagaccuccaagcaacccgccc

SEQ ID NO: 60761 - RNA, 27 nt, Artificial Sequence
  Histone H2A deubiquitinase MYSM1 (446-454)
gugcccagaccuaccaagagcuccuuc

SEQ ID NO: 60762 - RNA, 30 nt, Artificial Sequence
  PDZ and LIM domain protein 5 (203-212)
gugcccagacagccuaccgucacaagcguu

SEQ ID NO: 60763 - RNA, 33 nt, Artificial Sequence
  Filamin-A (1503-1513)
gugcccagaagcccuuucaaggucaaaguucug

SEQ ID NO: 60764 - RNA, 27 nt, Artificial Sequence
  Ankyrin repeat domain-containing protein 40 (223-231)
gugcccagcaagccuccaaugucccug

SEQ ID NO: 60765 - RNA, 27 nt, Artificial Sequence
  Uroporphyrinogen decarboxylase (106-114)
gugcccuaccuggucggccagguugug

SEQ ID NO: 60766 - RNA, 24 nt, Artificial Sequence
  Puromycin-sensitive aminopeptidase-like protein (298-305)
gugcccuacccucugccaaagauc

SEQ ID NO: 60767 - RNA, 36 nt, Artificial Sequence
  Elongation factor 1-beta (214-225)
gugcagagcauggacgucgccgcuuucaacaagauc

SEQ ID NO: 60768 - RNA, 30 nt, Artificial Sequence
  DNA repair protein RAD51 homolog 3 (23-32)
gugagagucaagcugguuagcgccggcuuc

SEQ ID NO: 60769 - RNA, 27 nt, Artificial Sequence
  CGG triplet repeat-binding protein 1 (6-14)
gugaccgcccccccugcuagaaacagg

SEQ ID NO: 60770 - RNA, 27 nt, Artificial Sequence
  UDP-N-acetylhexosamine pyrophosphorylase-like protein 1 (35-43)
gugaccuaccccaagggcauguauaga

SEQ ID NO: 60771 - RNA, 27 nt, Artificial Sequence
  Transformation/transcription domain-associated protein (246-254)
guggucgccgaguucguuccccugauc

SEQ ID NO: 60772 - RNA, 27 nt, Artificial Sequence
  Ubiquitin carboxyl-terminal hydrolase BAP1 (172-180)
guggucaagcccccuggcagcucccug

SEQ ID NO: 60773 - RNA, 27 nt, Artificial Sequence
  Ran-binding protein 9 (33-41)
gugguccugcccgccccuccagcuguu

SEQ ID NO: 60774 - RNA, 30 nt, Artificial Sequence
  ATP-dependent DNA helicase Q1 (430-439)
guggucauggagaacguuggccagcaaaag

SEQ ID NO: 60775 - RNA, 27 nt, Artificial Sequence
  Heterogeneous nuclear ribonucleoprotein A1 (44-52)
guggucaugagagaccccaacaccaag

SEQ ID NO: 60776 - RNA, 30 nt, Artificial Sequence
  G2/mitotic-specific cyclin-B1 (387-396)
guggucaugguuaaccagggccugaccaag

SEQ ID NO: 60777 - RNA, 27 nt, Artificial Sequence
  Ral GTPase-activating protein subunit beta (37-45)
guggucagaccccugggccagguucuc

SEQ ID NO: 60778 - RNA, 27 nt, Artificial Sequence
  CTD small phosphatase-like protein 2 (354-362)
guguacgccgacaagcugcucaacauc

SEQ ID NO: 60779 - RNA, 27 nt, Artificial Sequence
  Sorting nexin-8 (400-408)
guguaccugccccucaccagccacauc

SEQ ID NO: 60780 - RNA, 27 nt, Artificial Sequence
  Tuftelin-interacting protein 11 (428-436)
guguacccccugaugaaggaguauuuc

SEQ ID NO: 60781 - RNA, 27 nt, Artificial Sequence
  Syntaxin-binding protein 6 (92-100)
uggaugcuggagcagcucagacaagug

SEQ ID NO: 60782 - RNA, 27 nt, Artificial Sequence
  Protein syndesmos (33-41)
uacgccgcuaaccccggccagcuguuc

SEQ ID NO: 60783 - RNA, 27 nt, Artificial Sequence
  Heat shock cognate 71 kDa protein (545-553)
uacgccuucaacaugaaggcuaccgug

SEQ ID NO: 60784 - RNA, 27 nt, Artificial Sequence
  HLA class I histocompatibility antigen, alpha chain G (115-123)
uacgccuaugacggcaaggauuaccug

SEQ ID NO: 60785 - RNA, 30 nt, Artificial Sequence
  RHO/RAC effector protein (1011-1020)
uacgagaucgacaugaagcaguauacccug

SEQ ID NO: 60786 - RNA, 27 nt, Artificial Sequence
  Actin, alpha skeletal muscle (36-44)
uacgagcugcccgacggccaggugauc

SEQ ID NO: 60787 - RNA, 36 nt, Artificial Sequence
  Mitogen-activated protein kinase kinase kinase 6 (112-123)
uacgaguauaccgaaacaggcgagagacuggugcuc

SEQ ID NO: 60788 - RNA, 27 nt, Artificial Sequence
  Gametogenetin-binding protein 2 (25-33)
uacaucgacgauacccugacaauggug

SEQ ID NO: 60789 - RNA, 27 nt, Artificial Sequence
  ATP-dependent 6-phosphofructokinase, muscle type (292-300)
uacaucuucgaggaacccuuuaccauu

SEQ ID NO: 60790 - RNA, 27 nt, Artificial Sequence
  Sphingomyelin phosphodiesterase 4 (105-113)
uacaaguucgacuuucccgugagcuau

SEQ ID NO: 60791 - RNA, 27 nt, Artificial Sequence
  Microsomal glutathione S-transferase 3 (36-44)
uacaagguggaguaucccaucauguac

SEQ ID NO: 60792 - RNA, 27 nt, Artificial Sequence
  Zinc finger BED domain-containing protein 5 (476-484)
uaccuggccgacaucuucaccaagcuc

SEQ ID NO: 60793 - RNA, 27 nt, Artificial Sequence
  SH3 domain-binding protein 1 (145-153)
uaccuggccgaccucuaucacuucgug

SEQ ID NO: 60794 - RNA, 27 nt, Artificial Sequence
  E3 ubiquitin-protein ligase UBR4 (824-832)
uaccuggccgacgugaccaacgcucuc

SEQ ID NO: 60795 - RNA, 27 nt, Artificial Sequence
  Exportin-4 (318-326)
uaccuggcccacuucaucgagggccuc

SEQ ID NO: 60796 - RNA, 27 nt, Artificial Sequence
  ATP-dependent RNA helicase DHX8 (756-764)
uaccuggacgccagccucaucaccgug

SEQ ID NO: 60797 - RNA, 30 nt, Artificial Sequence; identical to SEQ ID NO: 36570
  ADP-ribosylation factor-like protein 6-interacting protein 1 (32-41)

SEQ ID NO: 60798 - RNA, 33 nt, Artificial Sequence
  Protein dpy-30 homolog (56-66)
uaccuggaccagaccgugguccccauccuccuu

SEQ ID NO: 60799 - RNA, 30 nt, Artificial Sequence
  Trafficking protein particle complex subunit 1 (7-16)
uaccuguucgacagaaacggcgugugccuc

SEQ ID NO: 60800 - RNA, 24 nt, Artificial Sequence
  Sphingomyelin phosphodiesterase 2 (372-379)
uaccuguuccacgugcaggagguc

SEQ ID NO: 60801 - RNA, 27 nt, Artificial Sequence
  Protein yippee-like 1 (49-57)
uaccuguucaacagcguggucaauguu

SEQ ID NO: 60802 - RNA, 27 nt, Artificial Sequence
  Coatomer subunit alpha (738-746)
uaccugggcgacgugagcgagagaguc

SEQ ID NO: 60803 - RNA, 27 nt, Artificial Sequence
  26S protease regulatory subunit 6B (239-247)
uaccugggcgaggggcccagaauggug

SEQ ID NO: 60804 - RNA, 27 nt, Artificial Sequence
  U2 snRNP-associated SURP motif-containing protein (276-284)
uaccugggcaacaucaauccccagaug

SEQ ID NO: 60805 - RNA, 27 nt, Artificial Sequence
  Mortality factor 4-like protein 1 (290-298)
uaccugcacgacuuccucaaguaucuu

SEQ ID NO: 60806 - RNA, 33 nt, Artificial Sequence
  Coatomer subunit epsilon (127-137)
uaccugcacgaccagaaccccgaugccgcucuc

SEQ ID NO: 60807 - RNA, 27 nt, Artificial Sequence
  Antigen peptide transporter 2 (25-33)
uaccugcacagccagguggucuccguu

SEQ ID NO: 60808 - RNA, 27 nt, Artificial Sequence
  Signal recognition particle subunit SRP68 (347-355)
uaccugcacagcuaucucaccuacauc

SEQ ID NO: 60809 - RNA, 30 nt, Artificial Sequence
  ATP-binding cassette sub-family E member 1 (483-492)
uaccugaucgacgagcccagcgccuaucuc

SEQ ID NO: 60810 - RNA, 27 nt, Artificial Sequence
  Probable ATP-dependent RNA helicase DDX6 (139-147)
uaccugaucccccuccuugagagacug

SEQ ID NO: 60811 - RNA, 27 nt, Artificial Sequence
  Mitotic checkpoint serine/threonine-protein kinase BUB1 (44-52)
uaccugaucacccuccuugagcaccug

SEQ ID NO: 60812 - RNA, 27 nt, Artificial Sequence
  60S ribosomal protein L19 (105-113)
uaccugaaggugaaaggcaacgucuuc

SEQ ID NO: 60813 - RNA, 27 nt, Artificial Sequence
  E3 ubiquitin-protein ligase MARCH6 (514-522)
uaccugcucgaccuucacagcuaucug

SEQ ID NO: 60814 - RNA, 27 nt, Artificial Sequence
  Ras-like protein family member 11A (22-30)
uaccugcuccccaaggacaucaaacuu

SEQ ID NO: 60815 - RNA, 27 nt, Artificial Sequence
  Nuclear pore complex protein Nup160 (542-550)
uaccugcuccccuaugagaaccuucug

SEQ ID NO: 60816 - RNA, 27 nt, Artificial Sequence
  E3 ubiquitin-protein ligase MGRN1 (248-256)
uaccugcuccaggagaucuauggcauu

SEQ ID NO: 60817 - RNA, 27 nt, Artificial Sequence
  Eukaryotic initiation factor 4A-III (207-215)
uaccugcccccugccacccaggugguc

SEQ ID NO: 60818 - RNA, 27 nt, Artificial Sequence
  COP9 signalosome complex subunit 1 (211-219)
uaccugcagaacuggagccacgugcuc

SEQ ID NO: 60819 - RNA, 33 nt, Artificial Sequence; identical to SEQ ID NO: 36592
  Leucyl-cystinyl aminopeptidase (548-558)

SEQ ID NO: 60820 - RNA, 27 nt, Artificial Sequence
  Core histone macro-H2A.1 (55-63)
uaccugaccgccgagauccucgaacuu

SEQ ID NO: 60821 - RNA, 27 nt, Artificial Sequence
  U1 small nuclear ribonucleoprotein C (12-20)
uaccugacccacgacagccccuccgug

SEQ ID NO: 60822 - RNA, 27 nt, Artificial Sequence
  Cohesin subunit SA-2 (775-783)
uaccugaccaacgugaauacaacuguc

SEQ ID NO: 60823 - RNA, 27 nt, Artificial Sequence
  Vacuolar protein sorting-associated protein 16 homolog (308-316)
uaccuggugcccgagcucgacggcguc

SEQ ID NO: 60824 - RNA, 27 nt, Artificial Sequence
  Lamin-B receptor (474-482)
uaccuggugagccaccccaacgagguc

SEQ ID NO: 60825 - RNA, 30 nt, Artificial Sequence
  DNA topoisomerase 2-alpha (684-693)
uaccuguauggccagaccacaacuuaccuc

SEQ ID NO: 60826 - RNA, 27 nt, Artificial Sequence
  ER lumen protein-retaining receptor 2 (196-204)
uaccuguauaucaccaaggugcucaaa

SEQ ID NO: 60827 - RNA, 27 nt, Artificial Sequence
  V-type proton ATPase subunit d 1 (27-35)
uacaugaucgacaacgugauucugcuc

SEQ ID NO: 60828 - RNA, 27 nt, Artificial Sequence
  Ras GTPase-activating protein-binding protein 2 (294-302)
uaccccgacagccaccagcuguucgug

SEQ ID NO: 60829 - RNA, 27 nt, Artificial Sequence
  Transcription factor p65 (479-487)
uaccccgaggccaucaccagacuggug

SEQ ID NO: 60830 - RNA, 27 nt, Artificial Sequence
  Neuropathy target esterase (299-307)
uaccccgagagccuggugagagucguu

SEQ ID NO: 60831 - RNA, 27 nt, Artificial Sequence
  Ral GTPase-activating protein subunit beta (25-33)
uaccccgagagcgugggcagagaaguc

SEQ ID NO: 60832 - RNA, 24 nt, Artificial Sequence
  Ubiquitin-conjugating enzyme E2 L3 (61-68)
uaccccuucaagccuccaaaaauc

SEQ ID NO: 60833 - RNA, 24 nt, Artificial Sequence
  Phosphatidate cytidylyltransferase 1 (350-357)
uaccccuuccagauccacagcauu

SEQ ID NO: 60834 - RNA, 27 nt, Artificial Sequence
  LIM and SH3 domain protein 1 (57-65)
uaccccaagcagagcuucaccauggug

SEQ ID NO: 60835 - RNA, 27 nt, Artificial Sequence
  Pumilio homolog 1 (841-849)
uaccccaaccugcagcucagagagauc

SEQ ID NO: 60836 - RNA, 27 nt, Artificial Sequence
  Ubiquitin-associated protein 2-like (268-276)
uaccccccugccccauucaugcacauc

SEQ ID NO: 60837 - RNA, 27 nt, Artificial Sequence
  Splicing factor 3A subunit 1 (44-52)
uaccccccuccagaggugagaaacauc

SEQ ID NO: 60838 - RNA, 27 nt, Artificial Sequence
  Putative oxidoreductase GLYR1 (19-27)
uaccccccuuggccaggcaagaucgug

SEQ ID NO: 60839 - RNA, 27 nt, Artificial Sequence
  ETS-related transcription factor Elf-1 (354-362)
uaccccacccagcuguucagaacagug

SEQ ID NO: 60840 - RNA, 27 nt, Artificial Sequence
  39S ribosomal protein L37, mitochondrial (283-291)
uaccccuauccuuacccacacacccug

SEQ ID NO: 60841 - RNA, 27 nt, Artificial Sequence
  LEM domain-containing protein 2 (134-142)
uaccccuaugugggcauccugcacguc

SEQ ID NO: 60842 - RNA, 27 nt, Artificial Sequence
  HLA class II histocompatibility antigen, DQ beta 1 chain (78-86)
uaccagcuggagcucagaaccacacuu

SEQ ID NO: 60843 - RNA, 27 nt, Artificial Sequence
  Farnesyl pyrophosphate synthase (158-166)
uaccagaccgagaucggccaaacacug

SEQ ID NO: 60844 - RNA, 24 nt, Artificial Sequence
  Mitogen-activated protein kinase 14 (188-195)
uacagagcccccgagaucaugcug

SEQ ID NO: 60845 - RNA, 24 nt, Artificial Sequence
  Mitogen-activated protein kinase 7 (227-234)
uacagagcccccgagcugaugcuc

SEQ ID NO: 60846 - RNA, 27 nt, Artificial Sequence
  Endoplasmic reticulum lectin 1 (115-123)
uacagaaucgagagcuauuggaccuac

SEQ ID NO: 60847 - RNA, 27 nt, Artificial Sequence
  Transmembrane protein 258 (9-17)
uacaccagccccgugaacccugccguc

SEQ ID NO: 60848 - RNA, 27 nt, Artificial Sequence
  Protein SZT2 (2368-2376)
uacguggccgaccacgcuagcuccuau

SEQ ID NO: 60849 - RNA, 30 nt, Artificial Sequence
  DDB1- and CUL4-associated factor 8 (338-347)
uacgugaaccccgccaauacccaccaguuc

SEQ ID NO: 60850 - RNA, 24 nt, Artificial Sequence
  Tubulin beta chain (79-86)
uacgugcccagagccauccugguc

SEQ ID NO: 60851 - RNA, 27 nt, Artificial Sequence
  E3 ubiquitin-protein ligase MARCH7 (172-180)
uacgugcaggacagaguccccagcuau

SEQ ID NO: 60852 - RNA, 27 nt, Artificial Sequence
  Single-stranded DNA-binding protein 2 (25-33)
uacguguaugaguaccugcuccacguc

SEQ ID NO: 60853 - RNA, 27 nt, Artificial Sequence
  Tyrosine-protein kinase Fyn (213-221)
uacuauaucaccacaagagcccaguuc

SEQ ID NO: 60854 - RNA, 27 nt, Artificial Sequence
  Heat shock cognate 71 kDa protein (16-24)
gccaugaaccccaccaauacaguguuc

SEQ ID NO: 60855 - RNA, 27 nt, Artificial Sequence
  HLA class II histocompatibility antigen, DP alpha 1 chain (32-40)
aucaaggccgaccacgugagcaccuac

SEQ ID NO: 60856 - RNA, 27 nt, Artificial Sequence
  Protein SSX2 (41-49)
aaggccagcgagaaaaucuucuacgug

SEQ ID NO: 60857 - RNA, 27 nt, Artificial Sequence
  Paired amphipathic helix protein Sin3a (790-798)
gccgcugcacugaucauucaccaugug

SEQ ID NO: 60858 - RNA, 27 nt, Artificial Sequence
  Rho GTPase-activating protein 17 (420-428)
gccgcugcaaccagcgugcacgucguu

SEQ ID NO: 60859 - RNA, 33 nt, Artificial Sequence
  Abhydrolase domain-containing protein 2 (342-352)
gccgcugacgauccccuggugcacgagagccuc

SEQ ID NO: 60860 - RNA, 27 nt, Artificial Sequence
  Pre-mRNA-processing factor 19 (410-418)
gccgcugacgauagcuccgugaagcug

SEQ ID NO: 60861 - RNA, 27 nt, Artificial Sequence
  Ubiquitin carboxyl-terminal hydrolase 4 (677-685)
gccgcugacggcaagcugcucaaacuu

SEQ ID NO: 60862 - RNA, 33 nt, Artificial Sequence
  EP300-interacting inhibitor of differentiation 1 (69-79)
gccgcucuggaggaagcagacaagauguuccuc

SEQ ID NO: 60863 - RNA, 27 nt, Artificial Sequence
  Vacuolar protein sorting-associated protein 51 homolog (131-139)
gccgcuaccgagaucguggaaagaguc

SEQ ID NO: 60864 - RNA, 30 nt, Artificial Sequence
  Codanin-1 (412-421)
gccgcuuacgagggcagcguggcaaagguc

SEQ ID NO: 60865 - RNA, 27 nt, Artificial Sequence
  Tetratricopeptide repeat protein 19, mitochondrial (92-100)
gccgaggcugaaaucauucagcugcuc

SEQ ID NO: 60866 - RNA, 33 nt, Artificial Sequence
  40S ribosomal protein S10 (140-150)
gccgaggcuggcgcagggagcgccaccgaauuc

SEQ ID NO: 60867 - RNA, 27 nt, Artificial Sequence
  A-kinase anchor protein 11 (1199-1207)
gccgaggcucuggcaacccacauccuc

SEQ ID NO: 60868 - RNA, 27 nt, Artificial Sequence
  Staphylococcal nuclease domain-containing protein 1 (426-434)
gccgaggcucuggugagcaagggccuc

SEQ ID NO: 60869 - RNA, 27 nt, Artificial Sequence
  DnaJ homolog subfamily C member 3 (124-132)
gccgaggacgauuucaagaaagugcug

SEQ ID NO: 60870 - RNA, 27 nt, Artificial Sequence
  Cyclin-dependent kinase 11B (701-709)
gccgaggacggccugaagcacgaauac

SEQ ID NO: 60871 - RNA, 30 nt, Artificial Sequence
  High affinity cationic amino acid transporter 1 (354-363)
gccgaggacggccugcucuucaaguuucuu

SEQ ID NO: 60872 - RNA, 30 nt, Artificial Sequence
  Protein strawberry notch homolog 2 (92-101)
gccgaggaacugggccacaccgagacauac

SEQ ID NO: 60873 - RNA, 30 nt, Artificial Sequence
  Casein kinase II subunit alpha (179-188)
gccgaguucuaccaccccggccaggaauau

SEQ ID NO: 60874 - RNA, 30 nt, Artificial Sequence
  Probable E3 ubiquitin-protein ligase HERC4 (886-895)
gccgagcaccccaccaucaagauuuucugg

SEQ ID NO: 60875 - RNA, 24 nt, Artificial Sequence
  Rabankyrin-5 (229-236)
gccgagaucauugcuagccacugg

SEQ ID NO: 60876 - RNA, 30 nt, Artificial Sequence
  26S proteasome non-ATPase regulatory subunit 6 (244-253)
gccgagauccuggaagugcuccacagccuu

SEQ ID NO: 60877 - RNA, 30 nt, Artificial Sequence
  Son of sevenless homolog 2 (963-972)
gccgagaucaccggcgaaauucagcaauac

SEQ ID NO: 60878 - RNA, 27 nt, Artificial Sequence
  Leucine-rich repeat and calponin homology domain-containing protein 3 (340-348)
gccgagaucaccaaggaacagagacug

SEQ ID NO: 60879 - RNA, 30 nt, Artificial Sequence
  HEAT repeat-containing protein 6 (209-218)
gccgagaaggacggcgugagcuccucuuuc

SEQ ID NO: 60880 - RNA, 27 nt, Artificial Sequence
  Transformation/transcription domain-associated protein (2625-2633)
gccgagaagaccugggugcagcuguuc

SEQ ID NO: 60881 - RNA, 33 nt, Artificial Sequence
  Glycerol-3-phosphate acyltransferase 3 (4-14)
gccgagcuggcuggcaagauccucagcaccugg

SEQ ID NO: 60882 - RNA, 27 nt, Artificial Sequence
  Hom s 1 (495-503)
gccgagcuggaacuccagaagcaacuu

SEQ ID NO: 60883 - RNA, 27 nt, Artificial Sequence
  HEAT repeat-containing protein 1 (617-625)
gccgagaugaagaucgcuauuuaccug

SEQ ID NO: 60884 - RNA, 27 nt, Artificial Sequence
  Mitochondrial antiviral-signaling protein (471-479)
gccgagaaccccagcauccagcugcuc

SEQ ID NO: 60885 - RNA, 30 nt, Artificial Sequence
  Exocyst complex component 1 (513-522)
gccgagcaggacuucaucagcaaguuuuuc

SEQ ID NO: 60886 - RNA, 27 nt, Artificial Sequence
  Liprin-alpha-1 (374-382)
gccgagcagaagcugcaacagacccuc

SEQ ID NO: 60887 - RNA, 27 nt, Artificial Sequence
  Chromodomain-helicase-DNA-binding protein 9 (618-626)
gccgagcagaugccccaacacacccug

SEQ ID NO: 60888 - RNA, 30 nt, Artificial Sequence
  F-box DNA helicase 1 (868-877)
gccgagcagagaaucggcccccuggcuuuc

SEQ ID NO: 60889 - RNA, 33 nt, Artificial Sequence
  Nuclear cap-binding protein subunit 1 (577-587)
gccgagagcgacgaaggcaagcugcacgugcuc

SEQ ID NO: 60890 - RNA, 33 nt, Artificial Sequence
  Ras-specific guanine nucleotide-releasing factor RalGPS2 (418-428)
gccgagagcgaagaccuggcugugcaccucuac

SEQ ID NO: 60891 - RNA, 27 nt, Artificial Sequence
  Transmembrane 9 superfamily member 1 (89-97)
gccgagagccuguacgaaaucagauuc

SEQ ID NO: 60892 - RNA, 30 nt, Artificial Sequence
  Glycerol-3-phosphate dehydrogenase, mitochondrial (535-544)
gccgaggugaaguacggcaucaaagaauau

SEQ ID NO: 60893 - RNA, 30 nt, Artificial Sequence
  Protein PRRC2C (2815-2824)
gccgaggugcugcagagcacccaaagauuc

SEQ ID NO: 60894 - RNA, 24 nt, Artificial Sequence
  Eukaryotic translation initiation factor 3 subunit D (442-449)
gccggcagcgaguaccugaagcuc

SEQ ID NO: 60895 - RNA, 27 nt, Artificial Sequence
  Coatomer subunit gamma-2 (147-155)
gccaucguggacaaggucagcuccguu

SEQ ID NO: 60896 - RNA, 33 nt, Artificial Sequence
  Dipeptidyl peptidase 2 (134-144)
gcccuggcugacuucgcagagcuccuuagagcc

SEQ ID NO: 60897 - RNA, 27 nt, Artificial Sequence
  Mediator of RNA polymerase II transcription subunit 23 (388-396)
gcccuggcugacuuccuccccgugaug

SEQ ID NO: 60898 - RNA, 30 nt, Artificial Sequence
  Coatomer subunit gamma-2 (844-853)
gcccuggcugacggcgugaccaugcagguc

SEQ ID NO: 60899 - RNA, 27 nt, Artificial Sequence
  Nicastrin (466-474)
gcccuggcugacguggcaaccguccuc

SEQ ID NO: 60900 - RNA, 27 nt, Artificial Sequence
  Lysophosphatidylcholine acyltransferase 1 (178-186)
gcccuggcugagggccagcucagacuu

SEQ ID NO: 60901 - RNA, 27 nt, Artificial Sequence
  Filamin-A (1713-1721)
gcccuggcuggcgaccagcccagcgug

SEQ ID NO: 60902 - RNA, 27 nt, Artificial Sequence
  CAD protein (1492-1500)
gcccuggcuggcgggaucaccauggug

SEQ ID NO: 60903 - RNA, 27 nt, Artificial Sequence
  Microtubule-associated protein 4 (259-267)
gcccuggcuaaggacauggcacucgcc

SEQ ID NO: 60904 - RNA, 30 nt, Artificial Sequence
  E1A-binding protein p400 (910-919)
gcccuggcuaagcccccuguggucagcguu

SEQ ID NO: 60905 - RNA, 27 nt, Artificial Sequence
  Transcription factor p65 (361-369)
gcccuggcucccgcaccuccacaggug

SEQ ID NO: 60906 - RNA, 27 nt, Artificial Sequence
  HEAT repeat-containing protein 2 (159-167)
gcccuggcuccccaccucgacgaugca

SEQ ID NO: 60907 - RNA, 27 nt, Artificial Sequence
  DNA fragmentation factor subunit alpha (236-244)
gcccuggcuagccacauccucaccgca

SEQ ID NO: 60908 - RNA, 27 nt, Artificial Sequence
  DNA mismatch repair protein Mlh1 (103-111)
gcccuggcuagcaucucccacguggca

SEQ ID NO: 60909 - RNA, 27 nt, Artificial Sequence
  Intraflagellar transport protein 81 homolog (503-511)
gcccuggcuagcgugaucaaggagcuc

SEQ ID NO: 60910 - RNA, 27 nt, Artificial Sequence
  T-complex protein 1 subunit zeta (19-27)
gcccuggcugugaacaucagcgcagcc

SEQ ID NO: 60911 - RNA, 30 nt, Artificial Sequence
  Elongation factor 2 (191-200)
gcccugugcgaggaaaacaugagaggcgug

SEQ ID NO: 60912 - RNA, 27 nt, Artificial Sequence
  DNA repair protein RAD50 (1090-1098)
gcccuggacgagcccaccacaaaccuc

SEQ ID NO: 60913 - RNA, 27 nt, Artificial Sequence
  Perilipin-3 (400-408)
gcccuggaccacaugguggaguacguc

SEQ ID NO: 60914 - RNA, 33 nt, Artificial Sequence
  Receptor-interacting serine/threonine-protein kinase 4 (482-492)
gcccuggacagcggcgcuucccuccuucaccug

SEQ ID NO: 60915 - RNA, 27 nt, Artificial Sequence
  Centrosomal protein of 104 kDa (617-625)
gcccuggagcacagaguguacgaaguc

SEQ ID NO: 60916 - RNA, 27 nt, Artificial Sequence
  Alpha-tubulin N-acetyltransferase 1 (9-17)
gcccuguuccccgagagaaucaccgug

SEQ ID NO: 60917 - RNA, 33 nt, Artificial Sequence
  SEC14-like protein 1 (357-367)
gcccugggcgaggaagcucuccuuagauacgug

SEQ ID NO: 60918 - RNA, 33 nt, Artificial Sequence
  HLA class I histocompatibility antigen, B-40 alpha chain (204-214)
gcccugggcuucuaccccgcugagaucacccuc

SEQ ID NO: 60919 - RNA, 30 nt, Artificial Sequence
  Dystonin (3724-3733)
gcccugaucgagcagaagcucaacgaagcu

SEQ ID NO: 60920 - RNA, 27 nt, Artificial Sequence
  RILP-like protein 1 (221-229)
gcccugaucgagcagaagguggaacuc

SEQ ID NO: 60921 - RNA, 33 nt, Artificial Sequence
  Aminopeptidase B (193-203)
gcccugaucgaggugcccgacggcuucaccgcu

SEQ ID NO: 60922 - RNA, 33 nt, Artificial Sequence
  Coatomer subunit zeta-1 (3-13)
gcccugauccucgagcccagccuuuacaccgug

SEQ ID NO: 60923 - RNA, 33 nt, Artificial Sequence
  Protein fem-1 homolog A (362-372)
gcccugaucaccgaccccgaugagaugagaaug

SEQ ID NO: 60924 - RNA, 27 nt, Artificial Sequence
  Rapamycin-insensitive companion of mTOR (226-234)
gcccugaucaccacaauucuccaccuu

SEQ ID NO: 60925 - RNA, 27 nt, Artificial Sequence
  DNA polymerase alpha catalytic subunit (520-528)
gcccugaagcccgaccucgugaacguc

SEQ ID NO: 60926 - RNA, 27 nt, Artificial Sequence
  Agrin (1405-1413)
gcccugcucgacggcagagugcagcuu

SEQ ID NO: 60927 - RNA, 30 nt, Artificial Sequence; identical to SEQ ID NO: 36700
  Protein DGCR6L (54-63)

SEQ ID NO: 60928 - RNA, 30 nt, Artificial Sequence
  Trabeculin-alpha (3432-3441)
gcccugcucgaccaggcucuuagcaacgca

SEQ ID NO: 60929 - RNA, 27 nt, Artificial Sequence
  Talin-1 (1760-1768)
gcccugcucgaccagaccaagacacuu

SEQ ID NO: 60930 - RNA, 33 nt, Artificial Sequence
  Histone deacetylase 10 (587-597)
gcccugcucgaggaaaacagcaccccccagcuu

SEQ ID NO: 60931 - RNA, 27 nt, Artificial Sequence
  LEM domain-containing protein 2 (268-276)
gcccugcucgagcuucugcacgaauug

SEQ ID NO: 60932 - RNA, 30 nt, Artificial Sequence
  Dystonin (5785-5794)
gcccugcucgagcuugugcccuggagagcu

SEQ ID NO: 60933 - RNA, 33 nt, Artificial Sequence
  Telomerase protein component 1 (281-291)
gcccugcucgagcccgaauucauccuuaaggcu

SEQ ID NO: 60934 - RNA, 33 nt, Artificial Sequence
  Midasin (2257-2267)
gcccugcucgagcccggcggggugcuuaccauc

SEQ ID NO: 60935 - RNA, 30 nt, Artificial Sequence
  DENN domain-containing protein 4B (1391-1400)
gcccugcucgagagcgugcuuagacacguc

SEQ ID NO: 60936 - RNA, 27 nt, Artificial Sequence
  Transmembrane protein 102 (468-476)
gcccugcucggcgagcuugcuagacug

SEQ ID NO: 60937 - RNA, 27 nt, Artificial Sequence
  Inhibitor of growth protein 4 (58-66)
gcccugcucaagcagauccaagaggcu

SEQ ID NO: 60938 - RNA, 27 nt, Artificial Sequence
  Sorting and assembly machinery component 50 homolog (277-285)
gcccugcucaaggugaaccaggagcuu

SEQ ID NO: 60939 - RNA, 27 nt, Artificial Sequence
  ATP-dependent RNA helicase A (638-646)
gcccugcucaaguacaucgagacccuu

SEQ ID NO: 60940 - RNA, 30 nt, Artificial Sequence
  Nucleolar protein 11 (404-413)
gcccugcucaacgcuauccuucacagcgca

SEQ ID NO: 60941 - RNA, 27 nt, Artificial Sequence
  Rapamycin-insensitive companion of mTOR (91-99)
gcccugcucaacgaggcuaaggaagug

SEQ ID NO: 60942 - RNA, 27 nt, Artificial Sequence
  Lysosomal alpha-glucosidase (501-509)
gcccugcucccccaccuuuacacccug

SEQ ID NO: 60943 - RNA, 27 nt, Artificial Sequence
  Coiled-coil domain-containing protein 189 isoform 2 (146-154)
gcccugcuccaggaccuucacaaggcu

SEQ ID NO: 60944 - RNA, 27 nt, Artificial Sequence
  Cell differentiation protein RCD1 homolog (65-73)
gcccugcuccaggagaucgugaacauu

SEQ ID NO: 60945 - RNA, 27 nt, Artificial Sequence
  GSK3-beta interaction protein (125-133)
gcccugcuccagagacuugaggcucug

SEQ ID NO: 60946 - RNA, 27 nt, Artificial Sequence
  Mitochondrial import receptor subunit TOM5 homolog (36-44)
gcccugcucagagugacccccuucauc

SEQ ID NO: 60947 - RNA, 27 nt, Artificial Sequence
  Catenin alpha-1 (130-138)
gcccugcucagcgcugugaccagacuu

SEQ ID NO: 60948 - RNA, 30 nt, Artificial Sequence
  DNA-dependent protein kinase catalytic subunit (2867-2876)
gcccugcucagccuugaccccgcugcagug

SEQ ID NO: 60949 - RNA, 27 nt, Artificial Sequence
  Multiple inositol polyphosphate phosphatase 1 (26-34)
gcccugcucagcucccuugcuagaugc

SEQ ID NO: 60950 - RNA, 27 nt, Artificial Sequence
  DNA-directed RNA polymerase I subunit RPA1 (343-351)
gcccugauggcucaggagcaaaagcuc

SEQ ID NO: 60951 - RNA, 27 nt, Artificial Sequence
  Brefeldin A-inhibited guanine nucleotide-exchange protein 1 (924-932)
gcccugauggaggcugugagccacguc

SEQ ID NO: 60952 - RNA, 30 nt, Artificial Sequence
  THAP domain-containing protein 11 (268-277)
gcccugauggaggugaagaugaaagaaaug

SEQ ID NO: 60953 - RNA, 27 nt, Artificial Sequence
  Junction plakoglobin (178-186)
gcccugaugggcagcccccagcucgug

SEQ ID NO: 60954 - RNA, 27 nt, Artificial Sequence
  Probable E3 ubiquitin-protein ligase HECTD4 (327-335)
gcccugaugccccagcucgugcaacuu

SEQ ID NO: 60955 - RNA, 33 nt, Artificial Sequence
  Synaptosomal-associated protein 29 (65-75)
gcccugauguacgagagcgaaaaggugggcguc

SEQ ID NO: 60956 - RNA, 27 nt, Artificial Sequence
  F-box only protein 21 (284-292)
gcccugaaccucuacaugcaccaggug

SEQ ID NO: 60957 - RNA, 30 nt, Artificial Sequence
  Immunoglobulin-binding protein 1 (279-288)
gcccugcccgaccagggcaucgcuaaggca

SEQ ID NO: 60958 - RNA, 30 nt, Artificial Sequence
  Coatomer subunit gamma-1 (711-720)
gcccugcccaaggaggacccuaccgcugug

SEQ ID NO: 60959 - RNA, 27 nt, Artificial Sequence
  EVI5-like protein (617-625)
gcccugcaggagaagcuccaauaccuu

SEQ ID NO: 60960 - RNA, 27 nt, Artificial Sequence
  Signal recognition particle receptor subunit alpha (360-368)
gcccugcaggagagccucgugcaaauc

SEQ ID NO: 60961 - RNA, 27 nt, Artificial Sequence
  Dolichyl-diphosphooligosaccharide-proteinosyltransferase subunit 2 (5-13)
gcccugagcgcucucaccgcaagacuu

SEQ ID NO: 60962 - RNA, 27 nt, Artificial Sequence
  Fas apoptotic inhibitory molecule 1 (45-53)
gcccugagcgacggcgugcacaagauc

SEQ ID NO: 60963 - RNA, 30 nt, Artificial Sequence
  T-complex protein 1 subunit delta (308-317)
gcccugagcgaccucgcucuucacuuccug

SEQ ID NO: 60964 - RNA, 27 nt, Artificial Sequence
  Coiled-coil domain-containing protein 93 (85-93)
gcccugagcgagaagaucguguccguc

SEQ ID NO: 60965 - RNA, 27 nt, Artificial Sequence
  Uncharacterized protein C1orf43 (148-156)
gcccugagcgagcucgcuaccgcagug

SEQ ID NO: 60966 - RNA, 27 nt, Artificial Sequence
  Lanosterol 14-alpha demethylase (197-205)
gcccugagcgagcucaucauucuuacc

SEQ ID NO: 60967 - RNA, 27 nt, Artificial Sequence
  26S proteasome non-ATPase regulatory subunit 14 (135-143)
gcccugagcgagagagcuguggcaguc

SEQ ID NO: 60968 - RNA, 27 nt, Artificial Sequence
  Inversin (365-373)
gcccugagcggccacguguccaccguc

SEQ ID NO: 60969 - RNA, 27 nt, Artificial Sequence
  Small integral membrane protein 10 (21-29)
gcccugagcggccucgcugugagacuu

SEQ ID NO: 60970 - RNA, 27 nt, Artificial Sequence
  Kinesin light chain 1 (87-95)
gcccugagcaaccaccucaaugcugug

SEQ ID NO: 60971 - RNA, 27 nt, Artificial Sequence
  tRNA-splicing endonuclease subunit Sen2 (347-355)
gcccugagcagaguguccgucaacguu

SEQ ID NO: 60972 - RNA, 27 nt, Artificial Sequence
  FAST kinase domain-containing protein 2 (485-493)
gcccugaccggcuaccuccacacaauc

SEQ ID NO: 60973 - RNA, 27 nt, Artificial Sequence
  Putative phospholipase B-like 2 (16-24)
gcccugaccagagcucucgcacuugcc

SEQ ID NO: 60974 - RNA, 27 nt, Artificial Sequence
  AP-1 complex subunit gamma-1 (331-339)
gcccugaccagccuccuuaagacagug

SEQ ID NO: 60975 - RNA, 30 nt, Artificial Sequence
  E3 ubiquitin-protein ligase RFWD2 (46-55)
gcccuggugagcggcggggucgcucaggca

SEQ ID NO: 60976 - RNA, 27 nt, Artificial Sequence
  Nesprin-2 (3479-3487)
gcccugugggagaaguggcucagccuu

SEQ ID NO: 60977 - RNA, 27 nt, Artificial Sequence
  Integrin alpha-X (412-420)
gcccuguggaagggcgugcagagccuc

SEQ ID NO: 60978 - RNA, 27 nt, Artificial Sequence
  Helicase with zinc finger domain 2 (1826-1834)
gcccuguggaagcagcuccuugagcug

SEQ ID NO: 60979 - RNA, 27 nt, Artificial Sequence
  Rabankyrin-5 (638-646)
gcccuguggaccggcaugcacacaauc

SEQ ID NO: 60980 - RNA, 30 nt, Artificial Sequence
  CDK5 regulatory subunit-associated protein 3 (102-111)
gcccuguacgagaaggacaacaccuaucuc

SEQ ID NO: 60981 - RNA, 27 nt, Artificial Sequence
  Small subunit processome component 20 homolog (799-807)
gcccuguaccacgagcagcucgcucuu

SEQ ID NO: 60982 - RNA, 33 nt, Artificial Sequence
  Prohibitin (26-36)
gcccuguacaacguggacgcuggccacagagca

SEQ ID NO: 60983 - RNA, 27 nt, Artificial Sequence
  Receptor expression-enhancing protein 3 (46-54)
gcccuguacaccgugaucgagacaguc

SEQ ID NO: 60984 - RNA, 27 nt, Artificial Sequence
  Heterogeneous nuclear ribonucleoproteins A2/B1 (66-74)
gccauggcugcaagaccccacagcauc

SEQ ID NO: 60985 - RNA, 30 nt, Artificial Sequence
  Leucine-tRNA ligase, cytoplasmic (67-76)
gccauggcugacgcaggcauccugagacuc

SEQ ID NO: 60986 - RNA, 33 nt, Artificial Sequence
  Translocon-associated protein subunit delta (3-13)
gccauggcuagccugggcgcacucgcccuucug

SEQ ID NO: 60987 - RNA, 33 nt, Artificial Sequence
  Phosphatidylinositol 4-kinase alpha (1043-1053)
gccauggcuaccgagagcauccugcacuucgca

SEQ ID NO: 60988 - RNA, 27 nt, Artificial Sequence
  Nuclear cap-binding protein subunit 1 (147-155)
gccauguucgagaacuuugugagcguc

SEQ ID NO: 60989 - RNA, 30 nt, Artificial Sequence
  Eukaryotic translation initiation factor 3 subunit K (2-11)
gccauguucgagcagaugagagcuaacgug

SEQ ID NO: 60990 - RNA, 27 nt, Artificial Sequence
  U4/U6 small nuclear ribonucleoprotein Prp3 (237-245)
gccaugggcaucgcucccccuaaggug

SEQ ID NO: 60991 - RNA, 27 nt, Artificial Sequence
  Chitobiosyldiphosphodolichol beta-mannosyltransferase (57-65)
gccaugcacggcuucagcgugacccug

SEQ ID NO: 60992 - RNA, 27 nt, Artificial Sequence
  Tripartite motif-containing protein 44 (233-241)
gccaugaucgagcugguggaaagacuc

SEQ ID NO: 60993 - RNA, 27 nt, Artificial Sequence
  Importin subunit beta-1 (122-130)
gccaugaagagcgacaucgaugaggug

SEQ ID NO: 60994 - RNA, 27 nt, Artificial Sequence
  Intraflagellar transport protein 172 homolog (30-38)
gccaugcuggagaagaacuacaaacuc

SEQ ID NO: 60995 - RNA, 27 nt, Artificial Sequence
  E3 ubiquitin-protein ligase RNF31 (159-167)
gccaugcugaacgagcccugggcugug

SEQ ID NO: 60996 - RNA, 30 nt, Artificial Sequence
  HLA class II histocompatibility antigen, DQ beta 1 chain (23-32)
gccaugcugagcacccccguggcugagggc

SEQ ID NO: 60997 - RNA, 27 nt, Artificial Sequence
  AP-1 complex subunit gamma-1 (266-274)
gccaugaacgacauccuggcucaggug

SEQ ID NO: 60998 - RNA, 27 nt, Artificial Sequence
  Splicing factor 3A subunit 3 (45-53)
gccaugcaggacagauacauggaggug

SEQ ID NO: 60999 - RNA, 33 nt, Artificial Sequence
  Guanine nucleotide-binding protein G(s) subunit alpha isoforms short (95-105)
gccaugagcaaccuggugcccccugucgagcuc

SEQ ID NO: 61000 - RNA, 27 nt, Artificial Sequence
  Heat shock 70 kDa protein 1-like (450-458)
gccaugaccaaggacaacaaucugcuc

SEQ ID NO: 61001 - RNA, 27 nt, Artificial Sequence
  F-box only protein 21 (416-424)
gccauguaccccgaccaggugcaacug

SEQ ID NO: 61002 - RNA, 30 nt, Artificial Sequence
  Vascular endothelial growth factor A (130-139)
gcccccgcugcaagagccccucaggcgcug

SEQ ID NO: 61003 - RNA, 27 nt, Artificial Sequence
  Sister chromatid cohesion protein PDS5 homolog A (368-376)
gcccccgcugagagacagaucgaccug

SEQ ID NO: 61004 - RNA, 27 nt, Artificial Sequence
  Host cell factor 1 (810-818)
gcccccgcuaagaucauuaccgcagug

SEQ ID NO: 61005 - RNA, 30 nt, Artificial Sequence
  Histone H1.4 (11-20)
gcccccgcuccugcagagaagaccccagug

SEQ ID NO: 61006 - RNA, 27 nt, Artificial Sequence
  Zinc finger protein 428 (123-131)
gcccccgcuccugagggcagagcacug

SEQ ID NO: 61007 - RNA, 30 nt, Artificial Sequence
  Pleckstrin homology domain-containing family B member 2 (137-146)
gcccccgcuccugaggugggcagaacccug

SEQ ID NO: 61008 - RNA, 33 nt, Artificial Sequence
  Cathepsin D (16-26)
gcccccgcuagcgcacuggugagaaucccucuc

SEQ ID NO: 61009 - RNA, 27 nt, Artificial Sequence
  Liprin-beta-1 (819-827)
gcccccaaccugagaggcagcggggug

SEQ ID NO: 61010 - RNA, 33 nt, Artificial Sequence
  Double-stranded RNA-binding protein Staufen homolog 1 (362-372)
gcccccaacccugcuaaggcaaccgugacagcc

SEQ ID NO: 61011 - RNA, 30 nt, Artificial Sequence
  Zinc finger HIT domain-containing protein 2 (59-68)
gcccccccuagcagacuggcuuccgcacuc

SEQ ID NO: 61012 - RNA, 33 nt, Artificial Sequence
  Putative sodium-coupled neutral amino acid transporter 10 (841-851)
gcccccagagcugcaggcaccgugaaggagcug

SEQ ID NO: 61013 - RNA, 33 nt, Artificial Sequence
  RELT-like protein 1 (2-12)
gcccccagagcucugccuggcagcgcagugcuc

SEQ ID NO: 61014 - RNA, 27 nt, Artificial Sequence
  Rhotekin (385-393)
gcccccagaaagccuccacaggcucug

SEQ ID NO: 61015 - RNA, 27 nt, Artificial Sequence
  Long-chain fatty acid transport protein 1 (264-272)
gcccccuacgcuagaccuaucuuccug

SEQ ID NO: 61016 - RNA, 27 nt, Artificial Sequence
  Coiled-coil domain-containing protein 50 (69-77)
gcccaggcucaacugcagaagagauac

SEQ ID NO: 61017 - RNA, 27 nt, Artificial Sequence
  Pumilio homolog 2 (180-188)
gcccagcaaccccacaucgcuggcgug

SEQ ID NO: 61018 - RNA, 27 nt, Artificial Sequence
  E3 ubiquitin-protein ligase HUWE1 (1181-1189)
gcccagguggcucuggucaacgagguu

SEQ ID NO: 61019 - RNA, 27 nt, Artificial Sequence
  Unconventional myosin-If (36-44)
gcccaguacgagaaccccccucacauc

SEQ ID NO: 61020 - RNA, 33 nt, Artificial Sequence
  Alpha-actinin-1 (231-241)
gccagacccgacgagaaggcuaucaugaccuac

SEQ ID NO: 61021 - RNA, 27 nt, Artificial Sequence
  Vacuolar protein sorting-associated protein 54 (467-475)
gccacccugaacaucauucacagcgug

SEQ ID NO: 61022 - RNA, 30 nt, Artificial Sequence
  Cullin-2 (577-586)
gccguggacgaggauagaaagauguaccug

SEQ ID NO: 61023 - RNA, 33 nt, Artificial Sequence
  Erlin-1 (214-224)
gccgugaucgaggcugaaaagauugcacagguc

SEQ ID NO: 61024 - RNA, 27 nt, Artificial Sequence
  Ubiquitin carboxyl-terminal hydrolase 28 (743-751)
gccgugauggagagcauccagggcguc

SEQ ID NO: 61025 - RNA, 27 nt, Artificial Sequence
  40S ribosomal protein S5 (172-180)
ugccuggccgacgagcucaucaacgcu

SEQ ID NO: 61026 - RNA, 30 nt, Artificial Sequence
  Protein transport protein Sec23B (288-297)
gacgagcugaagauccccauuagaagcugg

SEQ ID NO: 61027 - RNA, 30 nt, Artificial Sequence
  Serine/threonine-protein kinase 11-interacting protein (963-972)
gacgaggugagcagacuggaauccuucugg

SEQ ID NO: 61028 - RNA, 27 nt, Artificial Sequence
  Guanine nucleotide-binding protein G(I)/G(S)/G(T) subunit beta-2 (170-178)
gacaucgagaccggccagcaaacagug

SEQ ID NO: 61029 - RNA, 24 nt, Artificial Sequence
  Tuberin (529-536)
gacaucauugagaaggugauggcc

SEQ ID NO: 61030 - RNA, 24 nt, Artificial Sequence
  E3 ubiquitin-protein ligase RNF213 (2081-2088)
gacaucaacggcaagauguggcug

SEQ ID NO: 61031 - RNA, 27 nt, Artificial Sequence
  Echinoderm microtubule-associated protein-like 5 (1134-1142)
gacaucagaggcaagcugcuccaggug

SEQ ID NO: 61032 - RNA, 24 nt, Artificial Sequence
  Negative elongation factor A (258-265)
gacaucagcgagcuggauauggug

SEQ ID NO: 61033 - RNA, 27 nt, Artificial Sequence
  Golgin subfamily A member 4 (852-860)
gaccuggagaccgaaagaauccuccuu

SEQ ID NO: 61034 - RNA, 30 nt, Artificial Sequence
  GRB2-associated-binding protein 1 (123-132)
gaccccgugaagccuccaggcagcucccug

SEQ ID NO: 61035 - RNA, 27 nt, Artificial Sequence
  Signal recognition particle 54 kDa protein (388-396)
gacagcaccgauggcgccaagguguuc

SEQ ID NO: 61036 - RNA, 27 nt, Artificial Sequence
  Protein BANP (72-80)
gaggccaagcugcaggcucucgaagca

SEQ ID NO: 61037 - RNA, 27 nt, Artificial Sequence
  Endothelial differentiation-related factor 1 (36-44)
gaggacguggaaaccagcaagaaaugg

SEQ ID NO: 61038 - RNA, 30 nt, Artificial Sequence
  Clathrin heavy chain 1 (1066-1075)
gaggaagccuucgcuaucuuuagaaaguuc

SEQ ID NO: 61039 - RNA, 30 nt, Artificial Sequence
  DNA excision repair protein ERCC-1 (203-212)
gaggaagccggcagauaccuggagaccuau

SEQ ID NO: 61040 - RNA, 27 nt, Artificial Sequence
  cAMP-dependent protein kinase type I-alpha regulatory subunit (60-68)
gaggaagccaagcagauccaaaaccug

SEQ ID NO: 61041 - RNA, 27 nt, Artificial Sequence
  Zinc finger protein 548 (56-64)
gaggaagcccccagccagcaaggcuuc

SEQ ID NO: 61042 - RNA, 30 nt, Artificial Sequence
  Zinc finger and BTB domain-containing protein 17 (715-724)
gaggaagaccccaacacccacauccuguac

SEQ ID NO: 61043 - RNA, 30 nt, Artificial Sequence
  Cullin-4A (268-277)
gaggaagagggcgacagagugaucaccuac

SEQ ID NO: 61044 - RNA, 27 nt, Artificial Sequence
  S-phase kinase-associated protein 1 (120-128)
gaggaaaucagaaagaccuucaacauu

SEQ ID NO: 61045 - RNA, 24 nt, Artificial Sequence
  Nuclear transcription factor Y subunit gamma (28-35)
gaggaaaucagaaaccugaccgug

SEQ ID NO: 61046 - RNA, 30 nt, Artificial Sequence
  Flotillin-1 (118-127)
gaggaaaucuacaaggacagacagaaauuc

SEQ ID NO: 61047 - RNA, 27 nt, Artificial Sequence
  Microtubule-associated protein 4 (105-113)
gaggaaaagauggccuaccaggaguau

SEQ ID NO: 61048 - RNA, 27 nt, Artificial Sequence
  Eukaryotic translation initiation factor 3 subunit D (172-180)
gaggaaauggacuucccccagcugaug

SEQ ID NO: 61049 - RNA, 30 nt, Artificial Sequence
  HEAT repeat-containing protein 1 (411-420)
gaggaaauggacagcaacaaggugucccug

SEQ ID NO: 61050 - RNA, 27 nt, Artificial Sequence
  BRISC and BRCA1-A complex member 1 (257-265)
gaggaaaugagcuggaaggacauguuc

SEQ ID NO: 61051 - RNA, 30 nt, Artificial Sequence
  Mitotic checkpoint serine/threonine-protein kinase BUB1 (35-44)
gaggaaaacuuccccgagaauaaggaauac

SEQ ID NO: 61052 - RNA, 30 nt, Artificial Sequence
  Autophagy-related protein 16-1 (158-167)
gaggaaaaccaggagcuggugaccagaugg

SEQ ID NO: 61053 - RNA, 27 nt, Artificial Sequence
  Eukaryotic translation initiation factor 3 subunit C-like protein (786-794)
gaggaaagccugagaaccuaccucuuc

SEQ ID NO: 61054 - RNA, 27 nt, Artificial Sequence
  Segment polarity protein dishevelled homolog DVL-2 (23-31)
gaggaaacccccuaccuggugaagauc

SEQ ID NO: 61055 - RNA, 30 nt, Artificial Sequence
  GRIP1-associated protein 1 (706-715)
gaggaaguggccgagcuguuccagagacuc

SEQ ID NO: 61056 - RNA, 27 nt, Artificial Sequence
  Glutaredoxin-3 (9-17)
gagcuggccaaggaacucccccaggug

SEQ ID NO: 61057 - RNA, 27 nt, Artificial Sequence
  Nuclear factor of activated T-cells 5 (953-961)
gagcuguucagcucccccccugccgug

SEQ ID NO: 61058 - RNA, 24 nt, Artificial Sequence
  Cyclin-J-like protein (62-69)
gagcagcugagacuccaagaacuu

SEQ ID NO: 61059 - RNA, 27 nt, Artificial Sequence
  Nucleolar RNA helicase 2 (172-180)
uucgccaucccccugauugagaagcuc

SEQ ID NO: 61060 - RNA, 27 nt, Artificial Sequence
  Tristetraprolin (304-312)
uucgcccccccucagccaguggcugca

SEQ ID NO: 61061 - RNA, 30 nt, Artificial Sequence
  Laminin subunit gamma-1 (1227-1236)
uucgagaucgaagagcugaacagaaaguac

SEQ ID NO: 61062 - RNA, 27 nt, Artificial Sequence
  Nucleolar pre-ribosomal-associated protein 1 (1554-1562)
uucgagcagaagaccgaacaaaaaugg

SEQ ID NO: 61063 - RNA, 27 nt, Artificial Sequence
  Non-POU domain-containing octamer-binding protein (174-182)
uucgaguacgaauaugccaugagaugg

SEQ ID NO: 61064 - RNA, 27 nt, Artificial Sequence
  Antizyme inhibitor 1 (4-12)
uucaucgacgaugccaacuacagcgug

SEQ ID NO: 61065 - RNA, 30 nt, Artificial Sequence
  Activator of 90 kDa heat shock protein ATPase homolog 1 (215-224)
uucaucgacaagaacggcgagaccgaacug

SEQ ID NO: 61066 - RNA, 27 nt, Artificial Sequence
  Ral GTPase-activating protein subunit alpha-1 (86-94)
uucaucuuugagaagauucugcagcuc

SEQ ID NO: 61067 - RNA, 27 nt, Artificial Sequence
  DENN domain-containing protein 5B (1150-1158)
uucaucugggacuuuauugagaaggug

SEQ ID NO: 61068 - RNA, 30 nt, Artificial Sequence
  Dipeptidyl peptidase 8 (19-28)
uucaucuacggcgggccccaggugcaacug

SEQ ID NO: 61069 - RNA, 27 nt, Artificial Sequence
  Caspase recruitment domain-containing protein 19 (155-163)
uuccuggccgacgaucucggcgggcuu

SEQ ID NO: 61070 - RNA, 33 nt, Artificial Sequence
  Protein YIF1B (55-65)
uuccuggccgaccccgugagcaacauggcuaug

SEQ ID NO: 61071 - RNA, 27 nt, Artificial Sequence
  Interferon-induced GTP-binding protein Mx2 (30-38)
uuccuggccaaggacuuuaacuuccuc

SEQ ID NO: 61072 - RNA, 27 nt, Artificial Sequence
  Eukaryotic translation initiation factor 4 gamma 2 (315-323)
uuccuggacaacggccccaagaccauc

SEQ ID NO: 61073 - RNA, 27 nt, Artificial Sequence
  Phospholipase DDHD1 (681-689)
uuccuggacagcgccuacuuuagacuc

SEQ ID NO: 61074 - RNA, 27 nt, Artificial Sequence
  Condensin complex subunit 3 (699-707)
uuccuggacagcgagguguccgaacuc

SEQ ID NO: 61075 - RNA, 27 nt, Artificial Sequence
  Microtubule-associated protein 1B (32-40)
uuccuggacagcaaguuuuaccuccuu

SEQ ID NO: 61076 - RNA, 27 nt, Artificial Sequence
  Catenin alpha-2 (392-400)
uuccuggagaccaacgugccccuccuu

SEQ ID NO: 61077 - RNA, 30 nt, Artificial Sequence
  Calnexin (139-148)
uuccuguuugacaccaagccccucaucgug

SEQ ID NO: 61078 - RNA, 27 nt, Artificial Sequence
  Vacuolar protein sorting-associated protein 51 homolog (106-114)
uuccuguuugagcuccccagcagacuu

SEQ ID NO: 61079 - RNA, 30 nt, Artificial Sequence
  Ankyrin repeat and LEM domain-containing protein 2 (825-834)
uuccuguuuggcgaggaacccagcaagcuc

SEQ ID NO: 61080 - RNA, 27 nt, Artificial Sequence
  Cullin-4B (289-297)
uuccuguuucucgacagaaccuacgug

SEQ ID NO: 61081 - RNA, 27 nt, Artificial Sequence
  Elongation of very long chain fatty acids protein 1 (87-95)
uuccuguuuagcaaguucaucgagcuc

SEQ ID NO: 61082 - RNA, 24 nt, Artificial Sequence
  Sacsin (645-652)
uuccugggcaagaucuaccagauu

SEQ ID NO: 61083 - RNA, 27 nt, Artificial Sequence
  UDP-N-acetylglucosamine-dolichyl-phosphate N-acetylglucosaminephosphotransferase (221-229)
uuccugggcaccuuuauccucaaggug

SEQ ID NO: 61084 - RNA, 27 nt, Artificial Sequence
  DNA ligase 3 (616-624)
uuccugcacgacaacaugguggagauc

SEQ ID NO: 61085 - RNA, 27 nt, Artificial Sequence
  Major facilitator superfamily domain-containing protein 1 (150-158)
uuccugaucgacagaguguuuggcauu

SEQ ID NO: 61086 - RNA, 27 nt, Artificial Sequence
  ATP-dependent RNA helicase DHX36 (519-527)
uuccugaucauuccccuccacagccuu

SEQ ID NO: 61087 - RNA, 30 nt, Artificial Sequence
  Beta-glucuronidase (117-126)
uuccugaucaacggcaagcccuuuuacuuc

SEQ ID NO: 61088 - RNA, 27 nt, Artificial Sequence
  Isoleucine-tRNA ligase, cytoplasmic (662-670)
uuccugauccagaacgugcucagacuu

SEQ ID NO: 61089 - RNA, 27 nt, Artificial Sequence
  Puromycin-sensitive aminopeptidase (846-854)
uuccugaucagcagacucauuaagcuu

SEQ ID NO: 61090 - RNA, 27 nt, Artificial Sequence
  Myotubularin-related protein 2 (121-129)
uuccugaucaccauucucgaccaccuu

SEQ ID NO: 61091 - RNA, 27 nt, Artificial Sequence
  Putative protein PLEKHA9 (298-306)
uuccugaagggcuuucucaccgaggug

SEQ ID NO: 61092 - RNA, 30 nt, Artificial Sequence
  Regulator of nonsense transcripts 1 (192-201)
uuccugcucggcuuuauccccgccaaggcu

SEQ ID NO: 61093 - RNA, 30 nt, Artificial Sequence
  Alpha-N-acetylglucosaminidase (616-625)
uuccugcucggcagcuggcuugagcaggcc

SEQ ID NO: 61094 - RNA, 27 nt, Artificial Sequence
  Probable ATP-dependent RNA helicase DDX59 (257-265)
uuccugcuccccgugaucaugagagcc

SEQ ID NO: 61095 - RNA, 30 nt, Artificial Sequence
  HLA class II histocompatibility antigen, DP alpha 1 chain (22-31)
uuccugcucagccuuagaggcgccggggcu

SEQ ID NO: 61096 - RNA, 27 nt, Artificial Sequence
  Putative histone H2B type 2-D (86-94)
uuccugaacgacaucuuugagagaauu

SEQ ID NO: 61097 - RNA, 27 nt, Artificial Sequence
  A-kinase anchor protein 9 (956-964)
uuccugaacgaggaagugaagagccuc

SEQ ID NO: 61098 - RNA, 27 nt, Artificial Sequence
  Osteopetrosis-associated transmembrane protein 1 (171-179)
uuccugaaccucuuuaaucacacccuu

SEQ ID NO: 61099 - RNA, 30 nt, Artificial Sequence
  Structure-specific endonuclease subunit SLX1 (220-229)
uuccugcaggaggaacccggccaacuccuu

SEQ ID NO: 61100 - RNA, 27 nt, Artificial Sequence
  Golgin subfamily A member 4 (1152-1160)
uuccugcaggagcaacucguggaacuu

SEQ ID NO: 61101 - RNA, 27 nt, Artificial Sequence
  Endoplasmic reticulum-Golgi intermediate compartment protein 3 (5-13)
uuccugagcgagcuccaguacuaucuu

SEQ ID NO: 61102 - RNA, 27 nt, Artificial Sequence
  Nicalin (262-270)
uuccugagcacccucgagcaccaucuu

SEQ ID NO: 61103 - RNA, 27 nt, Artificial Sequence
  Uncharacterized protein KIAA1109 (19-27)
uuccugaccgagcacaacagcaaugug

SEQ ID NO: 61104 - RNA, 27 nt, Artificial Sequence
  Zinc finger BED domain-containing protein 5 (533-541)
uuccugaccgagaucaacagcacagug

SEQ ID NO: 61105 - RNA, 30 nt, Artificial Sequence
  Signal transducer and activator of transcription 6 (163-172)
uuccugguggagaagcagcccccucaaguc

SEQ ID NO: 61106 - RNA, 30 nt, Artificial Sequence
  Phospholipase D3 (58-67)
uuccugugggaguacggcgaccuccaccuu

SEQ ID NO: 61107 - RNA, 27 nt, Artificial Sequence
  Transcription factor 25 (382-390)
uuccuguggaaggagcccgccaccaug

SEQ ID NO: 61108 - RNA, 27 nt, Artificial Sequence
  Cytochrome b (107-115)
uuccuguacagcgagaccuggaacauc

SEQ ID NO: 61109 - RNA, 30 nt, Artificial Sequence
  E3 ubiquitin-protein ligase XIAP (52-61)
uuccuguacaccggcgagggggacacagug

SEQ ID NO: 61110 - RNA, 27 nt, Artificial Sequence
  Putative oxidoreductase GLYR1 (382-390)
uucauggccaccaucgcugagggccug

SEQ ID NO: 61111 - RNA, 27 nt, Artificial Sequence
  Probable helicase senataxin (266-274)
uucaugcagagcauccugcacaccaug

SEQ ID NO: 61112 - RNA, 27 nt, Artificial Sequence
  Alpha-adducin (97-105)
uucaugaccacaaacgugcccaauguc

SEQ ID NO: 61113 - RNA, 27 nt, Artificial Sequence
  Ubiquitin carboxyl-terminal hydrolase 11 (94-102)
uuccaggacgagaucaacuggagacug

SEQ ID NO: 61114 - RNA, 33 nt, Artificial Sequence
  E3 ubiquitin-protein ligase TRIP12 (633-643)
uuccagcacgaggaaaaccugcuccaacaggug

SEQ ID NO: 61115 - RNA, 27 nt, Artificial Sequence
  Threonine-tRNA ligase, cytoplasmic (598-606)
uuccagcugcccaucagauuuaaccuc

SEQ ID NO: 61116 - RNA, 27 nt, Artificial Sequence
  RNA-binding protein EWS (267-275)
uucagacaggaccaccccagcuccaug

SEQ ID NO: 61117 - RNA, 24 nt, Artificial Sequence
  Spliceosome RNA helicase DDX39B (106-113)
uucguggacgaugagaccaagcug

SEQ ID NO: 61118 - RNA, 27 nt, Artificial Sequence
  Cytoplasmic dynein 1 heavy chain 1 (4145-4153)
uucguguuugagcccccuccaggcguc

SEQ ID NO: 61119 - RNA, 27 nt, Artificial Sequence
  General transcription factor IIH subunit 5 (44-52)
uucgugaucgccgagcuggucaacguu

SEQ ID NO: 61120 - RNA, 27 nt, Artificial Sequence
  Transmembrane protein 147 (181-189)
uucgugauggagaccuuuguccaccug

SEQ ID NO: 61121 - RNA, 27 nt, Artificial Sequence
  Rhomboid domain-containing protein 2 (68-76)
uucguguacgagaaccccaucagccug

SEQ ID NO: 61122 - RNA, 27 nt, Artificial Sequence
  ER degradation-enhancing alpha-mannosidase-like protein 1 (33-41)
uucuaccagagauuuccccugagcuuc

SEQ ID NO: 61123 - RNA, 27 nt, Artificial Sequence
  Filamin-A (998-1006)
ggcgccgacaacagcguggucagauuc

SEQ ID NO: 61124 - RNA, 27 nt, Artificial Sequence
  FACT complex subunit SPT16 (233-241)
ggcgccgaccccagcaccguggagaug

SEQ ID NO: 61125 - RNA, 30 nt, Artificial Sequence
  Telomere length regulation protein TEL2 homolog (189-198)
ggcgaggaaguggucagaguucugcaggcc

SEQ ID NO: 61126 - RNA, 30 nt, Artificial Sequence
  Leucine-rich repeat serine/threonine-protein kinase 2 (1802-1811)
ggcgagggggaaacccugcucaagaaaugg

SEQ ID NO: 61127 - RNA, 30 nt, Artificial Sequence
  Nuclear factor erythroid 2-related factor 2 (521-530)
ggcgagaacgacaagagccugcaccuccuu

SEQ ID NO: 61128 - RNA, 27 nt, Artificial Sequence
  AT-rich interactive domain-containing protein 2 (80-88)
ggcgagagcucccugaucaagcagcuc

SEQ ID NO: 61129 - RNA, 30 nt, Artificial Sequence
  Acetyl-CoA carboxylase 1 (1979-1988)
ggcgggauccccgugggagucguugccgug

SEQ ID NO: 61130 - RNA, 24 nt, Artificial Sequence
  DNA damage-binding protein 1 (59-66)
ggcaagaucgccgugauggagcug

SEQ ID NO: 61131 - RNA, 27 nt, Artificial Sequence
  Cyclin-dependent kinase 12 (1103-1111)
ggccuggccgacaucacccagcaacuc

SEQ ID NO: 61132 - RNA, 33 nt, Artificial Sequence
  ATPase WRNIP1 (548-558)
ggccuggccgaccccagcgcucucacccaggca

SEQ ID NO: 61133 - RNA, 30 nt, Artificial Sequence
  Negative regulator of reactive oxygen species (203-212)
ggccuggccgagcucagacaccuuaaccug

SEQ ID NO: 61134 - RNA, 27 nt, Artificial Sequence
  Flap endonuclease 1 (5-13)
ggccuggccaagcucaucgcugacgug

SEQ ID NO: 61135 - RNA, 27 nt, Artificial Sequence
  GPN-loop GTPase 1 (234-242)
ggccuggacgagcucuucgugcagguc

SEQ ID NO: 61136 - RNA, 30 nt, Artificial Sequence; identical to SEQ ID NO: 36909
  Probable ATP-dependent RNA helicase DDX27 (497-506)

SEQ ID NO: 61137 - RNA, 33 nt, Artificial Sequence; identical to SEQ ID NO: 36910
  U3 small nucleolar RNA-associated protein 18 homolog (107-117)

SEQ ID NO: 61138 - RNA, 27 nt, Artificial Sequence
  26S protease regulatory subunit 4 (189-197)
ggccuggacaaccagauccaagagauu

SEQ ID NO: 61139 - RNA, 30 nt, Artificial Sequence
  DNA mismatch repair protein Msh2 (438-447)
ggccuggaccccgggaagcagaucaaacuc

SEQ ID NO: 61140 - RNA, 27 nt, Artificial Sequence
  CAP-Gly domain-containing linker protein 1 (270-278)
ggccuguucgcccccgugcacaagguc

SEQ ID NO: 61141 - RNA, 33 nt, Artificial Sequence
  Ras suppressor protein 1 (35-45)
ggccuguucacccucagccacaucacacagcuu

SEQ ID NO: 61142 - RNA, 33 nt, Artificial Sequence
  Autophagy-related protein 13 (84-94)
ggccugggggagggauuccagaccgugagaguc

SEQ ID NO: 61143 - RNA, 33 nt, Artificial Sequence
  WD repeat and FYVE domain-containing protein 3 (1077-1087)
ggccugaucgacggggccguggucagcggaauu

SEQ ID NO: 61144 - RNA, 33 nt, Artificial Sequence
  Structural maintenance of chromosomes flexible hinge domain-containing protein 1 (829-839)
ggccugcucgaccuucccuucagaguggggguc

SEQ ID NO: 61145 - RNA, 30 nt, Artificial Sequence; identical to SEQ ID NO: 36918
  Nucleolar complex protein 4 homolog (332-341)

SEQ ID NO: 61146 - RNA, 27 nt, Artificial Sequence
  Transcription initiation factor TFIID subunit 4B (694-702)
ggccugcucgagaagcuuaccgccauc

SEQ ID NO: 61147 - RNA, 27 nt, Artificial Sequence
  Vigilin (1000-1008)
ggccugcucgagagagugaaggaacuu

SEQ ID NO: 61148 - RNA, 33 nt, Artificial Sequence
  Vigilin (354-364)
ggccugcucgagagagugaaggaacuucaggcc

SEQ ID NO: 61149 - RNA, 27 nt, Artificial Sequence
  Phosphatidylinositol N-acetylglucosaminyltransferase subunit H (75-83)
ggccugcucggguaccuucacuucgug

SEQ ID NO: 61150 - RNA, 27 nt, Artificial Sequence
  Thyroid adenoma-associated protein (229-237)
ggccugcucagcaucuucaccaaggug

SEQ ID NO: 61151 - RNA, 33 nt, Artificial Sequence
  Trafficking protein particle complex subunit 2-like protein (29-39)
ggccugcucuaccccaccgaggacuauaaggug

SEQ ID NO: 61152 - RNA, 27 nt, Artificial Sequence
  Nuclear receptor corepressor 1 (313-321)
ggccugauggaggaccccaugaaggug

SEQ ID NO: 61153 - RNA, 33 nt, Artificial Sequence
  Importin-4 (301-311)
ggccugaugggggagggacucgccccccaccuu

SEQ ID NO: 61154 - RNA, 27 nt, Artificial Sequence
  Adiponectin receptor protein 2 (286-294)
ggccugagcgggaucauucccacccuc

SEQ ID NO: 61155 - RNA, 27 nt, Artificial Sequence
  Protein GPR107 (398-406)
ggccuguggaaggacagccucuuccuu

SEQ ID NO: 61156 - RNA, 27 nt, Artificial Sequence
  Chromodomain-helicase-DNA-binding protein 8 (115-123)
ggcauggacgagaaggaauucaccgug

SEQ ID NO: 61157 - RNA, 27 nt, Artificial Sequence
  DnaJ homolog subfamily A member 1 (168-176)
ggcauggugcagcaaauccagagcguc

SEQ ID NO: 61158 - RNA, 30 nt, Artificial Sequence
  Cysteine and histidine-rich protein 1 (139-148)
ggcaugugggggggagccaugcugggugug

SEQ ID NO: 61159 - RNA, 33 nt, Artificial Sequence
  Rab GTPase-activating protein 1-like (35-45)
ggcauguggaaccccaaugccccuguguuccug

SEQ ID NO: 61160 - RNA, 27 nt, Artificial Sequence
  Tumor protein p53-inducible protein 13 (212-220)
ggcccccagccuaccagaagcgcccug

SEQ ID NO: 61161 - RNA, 27 nt, Artificial Sequence
  Ubiquitin carboxyl-terminal hydrolase 48 (545-553)
ggccccagacugaccgugaaggcccuc

SEQ ID NO: 61162 - RNA, 30 nt, Artificial Sequence
  Filamin-A (2186-2195)
ggccccagacuggugagcaaccacucccuc

SEQ ID NO: 61163 - RNA, 27 nt, Artificial Sequence
  Apoptosis-stimulating of p53 protein 2 (99-107)
ggccccagaagccaggacccuucccug

SEQ ID NO: 61164 - RNA, 27 nt, Artificial Sequence
  Interleukin-6 receptor subunit beta (849-857)
ggccagguggagagauucgaaaccguc

SEQ ID NO: 61165 - RNA, 30 nt, Artificial Sequence
  HLA class I histocompatibility antigen, B-15 alpha chain (25-34)
ggcagccacuccaugagauacuucuauacc

SEQ ID NO: 61166 - RNA, 30 nt, Artificial Sequence
  Nucleolar protein 56 (116-125)
ggcgugaucgccgagauucugagagggguc

SEQ ID NO: 61167 - RNA, 30 nt, Artificial Sequence; identical to SEQ ID NO: 36940
  Perilipin-2 (347-356)

SEQ ID NO: 61168 - RNA, 33 nt, Artificial Sequence
  Golgi resident protein GCP60 (488-498)
cacgaggaaguguacgccggcagccaucaguau

SEQ ID NO: 61169 - RNA, 27 nt, Artificial Sequence
  Small subunit processome component 20 homolog (748-756)
cacgagauggaaaacaagcaguucugg

SEQ ID NO: 61170 - RNA, 27 nt, Artificial Sequence
  Kelch domain-containing protein 3 (196-204)
cacauccuggacuucagccccucccuc

SEQ ID NO: 61171 - RNA, 33 nt, Artificial Sequence
  Leucine-rich repeat and calponin homology domain-containing protein 3 (744-754)
cacauccuggaggaaaagggccucagccaggug

SEQ ID NO: 61172 - RNA, 33 nt, Artificial Sequence
  Leucine-rich repeat and calponin homology domain-containing protein 1 (668-678)
cacauccuggaggaaaagggccucgugaaaguc

SEQ ID NO: 61173 - RNA, 30 nt, Artificial Sequence
  Vascular endothelial growth factor receptor 1 (327-336)
cacaucuacgacaaggccuucauuaccgug

SEQ ID NO: 61174 - RNA, 33 nt, Artificial Sequence
  Phenylalanine-tRNA ligase alpha subunit (365-375)
caccuggccgaguuccaucagaucgaaggcgug

SEQ ID NO: 61175 - RNA, 27 nt, Artificial Sequence
  ZW10 interactor (166-174)
caccuggccgaggugagcgcugaaguc

SEQ ID NO: 61176 - RNA, 27 nt, Artificial Sequence
  Gamma-adducin (155-163)
caccuggccaacaccuacaucagcgug

SEQ ID NO: 61177 - RNA, 27 nt, Artificial Sequence
  Transcription factor E2-alpha (182-190)
caccuggacgaggccauccaugugcuc

SEQ ID NO: 61178 - RNA, 27 nt, Artificial Sequence
  Pre-mRNA-processing factor 17 (71-79)
caccuggaccccgccgugaaggagguc

SEQ ID NO: 61179 - RNA, 27 nt, Artificial Sequence
  Membrane-associated tyrosine- and threonine-specific cdc2-inhibitory kinase (162-170)
caccuggacgugaagcccgccaacauc

SEQ ID NO: 61180 - RNA, 27 nt, Artificial Sequence
  DEP domain-containing protein 1B (290-298)
caccuguucgacgccuuugugagcguc

SEQ ID NO: 61181 - RNA, 27 nt, Artificial Sequence
  Clathrin heavy chain 1 (1233-1241)
caccugggcgaguaccaggccgcugug

SEQ ID NO: 61182 - RNA, 27 nt, Artificial Sequence
  Neutral alpha-glucosidase AB (77-85)
caccugauccaugaggugaccaagguc

SEQ ID NO: 61183 - RNA, 30 nt, Artificial Sequence
  Heat shock protein HSP 90-beta (110-119)
caccugaaggaggaccagaccgaauaccuc

SEQ ID NO: 61184 - RNA, 27 nt, Artificial Sequence
  Centromere protein F (2031-2039)
caccugcaggagaagcuccaaagccuu

SEQ ID NO: 61185 - RNA, 27 nt, Artificial Sequence
  Late secretory pathway protein AVL9 homolog (517-525)
caccugagcgacgccaucguggagguc

SEQ ID NO: 61186 - RNA, 27 nt, Artificial Sequence
  Leupaxin (99-107)
caccugaccgagaugcaggccaaggug

SEQ ID NO: 61187 - RNA, 33 nt, Artificial Sequence; identical to SEQ ID NO: 36960
  Transmembrane protein 2 (1314-1324)

SEQ ID NO: 61188 - RNA, 27 nt, Artificial Sequence
  Huntingtin-interacting protein 1 (192-200)
caccuguacgacuauaccgugaagcuc

SEQ ID NO: 61189 - RNA, 27 nt, Artificial Sequence
  Beta-lactamase-like protein 2 (145-153)
cacaccgacgaucauauggcccugcuc

SEQ ID NO: 61190 - RNA, 24 nt, Artificial Sequence
  DNA topoisomerase 2-beta (834-841)
cacaccgacacaacugugaaguuc

SEQ ID NO: 61191 - RNA, 27 nt, Artificial Sequence
  NIPA-like protein 3 (122-130)
aucgccauuaccgcuggcgcaauauuc

SEQ ID NO: 61192 - RNA, 27 nt, Artificial Sequence
  Cyclin-dependent kinase 1 (136-144)
aucgacgauaagggcaccauuaaacug

SEQ ID NO: 61193 - RNA, 27 nt, Artificial Sequence
  Glucosamine-6-phosphate isomerase 2 (146-154)
aucgaggaaggcgugaaccacaugugg

SEQ ID NO: 61194 - RNA, 30 nt, Artificial Sequence
  Zinc finger protein ZPR1 (195-204)
aucauugacgaucccagcggcaacuccuuc

SEQ ID NO: 61195 - RNA, 27 nt, Artificial Sequence
  U5 small nuclear ribonucleoprotein 200 kDa helicase (612-620)
aucauucuggacgagauacaccuccuu

SEQ ID NO: 61196 - RNA, 27 nt, Artificial Sequence
  ATP-dependent RNA helicase DDX1 (707-715)
auccuggcccccaccgugcaggagcuc

SEQ ID NO: 61197 - RNA, 30 nt, Artificial Sequence
  Prohibitin (164-173)
auccuggacgaugugagccucacccaccuu

SEQ ID NO: 61198 - RNA, 27 nt, Artificial Sequence
  Dihydroxyacetone phosphate acyltransferase (106-114)
auccuggacgagaugagccacaagcuc

SEQ ID NO: 61199 - RNA, 27 nt, Artificial Sequence
  ATP-binding cassette sub-family F member 3 (633-641)
auccuggacgagcccaccaaccaccuc

SEQ ID NO: 61200 - RNA, 27 nt, Artificial Sequence
  ATP-binding cassette sub-family F member 1 (765-773)
auccuggacgagcccaccaacaaucuc

SEQ ID NO: 61201 - RNA, 27 nt, Artificial Sequence
  U6 snRNA-associated Sm-like protein LSm8 (16-24)
auccuggacgagagccacgaaagagug

SEQ ID NO: 61202 - RNA, 27 nt, Artificial Sequence
  Coiled-coil domain-containing protein 66 (307-315)
auccuggaccagagcagagagaccgug

SEQ ID NO: 61203 - RNA, 27 nt, Artificial Sequence
  Heterogeneous nuclear ribonucleoprotein U (458-466)
auccuggaccagaccaacgugagcgcc

SEQ ID NO: 61204 - RNA, 30 nt, Artificial Sequence
  Actin-like protein 6A (127-136)
auccuggacagcggcgccacccacacaacu

SEQ ID NO: 61205 - RNA, 27 nt, Artificial Sequence
  Putative pre-mRNA-splicing factor ATP-dependent RNA helicase DHX16 (531-539)
auccuguucggccucauuaaggacgug

SEQ ID NO: 61206 - RNA, 27 nt, Artificial Sequence
  Pecanex-like protein 1 (1442-1450)
auccuguucaacaagcucugggagcuu

SEQ ID NO: 61207 - RNA, 33 nt, Artificial Sequence
  Copper chaperone for superoxide dismutase (92-102)
auccugggcgggcccggaaccgugcaggguguc

SEQ ID NO: 61208 - RNA, 27 nt, Artificial Sequence
  Major facilitator superfamily domain-containing protein 8 (444-452)
auccugggccccaagccucagggggug

SEQ ID NO: 61209 - RNA, 33 nt, Artificial Sequence
  Matrin-3 (67-77)
auccugggccccccuccaccgagcuuccaccuc

SEQ ID NO: 61210 - RNA, 27 nt, Artificial Sequence
  Integrator complex subunit 7 (849-857)
auccugggcacccacaacauuacagug

SEQ ID NO: 61211 - RNA, 27 nt, Artificial Sequence
  Cytoplasmic dynein 1 light intermediate chain 2 (245-253)
auccugcacgagaacuucaccacagug

SEQ ID NO: 61212 - RNA, 33 nt, Artificial Sequence
  Adenosylhomocysteinase (339-349)
auccugcucgccgagggcagacuugugaaccug

SEQ ID NO: 61213 - RNA, 27 nt, Artificial Sequence
  Protein angel homolog 1 (409-417)
auccugcucgccgagguggacaagguc

SEQ ID NO: 61214 - RNA, 33 nt, Artificial Sequence
  Arginine-tRNA ligase, cytoplasmic (564-574)
auccugcucgaccacgagaaggaauggaaacuu

SEQ ID NO: 61215 - RNA, 27 nt, Artificial Sequence
  MAP kinase-activating death domain protein (316-324)
auccugcucgagcacaaggugguccuu

SEQ ID NO: 61216 - RNA, 27 nt, Artificial Sequence
  Eukaryotic translation initiation factor 3 subunit K (69-77)
auccugcucaaggcccuuaccaaccug

SEQ ID NO: 61217 - RNA, 33 nt, Artificial Sequence
  Serine/threonine-protein kinase TAO1 (157-167)
auccugcucaccgagcccggccaggugaagcuu

SEQ ID NO: 61218 - RNA, 27 nt, Artificial Sequence
  Ubiquitin carboxyl-terminal hydrolase 34 (46-54)
auccugauggacgagagaaccuuccuc

SEQ ID NO: 61219 - RNA, 30 nt, Artificial Sequence; identical to SEQ ID NO: 36992
  Protein BIVM-ERCC5 (1331-1340)

SEQ ID NO: 61220 - RNA, 30 nt, Artificial Sequence; identical to SEQ ID NO: 36993
  Unconventional myosin-Ic (579-588)

SEQ ID NO: 61221 - RNA, 27 nt, Artificial Sequence
  Cohesin subunit SA-2 (1002-1010)
auccugagcgaguucuccucuaagcuc

SEQ ID NO: 61222 - RNA, 27 nt, Artificial Sequence
  TELO2-interacting protein 1 homolog (373-381)
auccugagcgagucccuccacucucuu

SEQ ID NO: 61223 - RNA, 27 nt, Artificial Sequence
  Nuclear pore complex protein Nup153 (39-47)
auccugagcagagugaccgaguccguc

SEQ ID NO: 61224 - RNA, 27 nt, Artificial Sequence
  XAGE1D protein (105-113)
auccugaccagcauucagucccuccuu

SEQ ID NO: 61225 - RNA, 27 nt, Artificial Sequence
  Importin-11 (663-671)
auccugaccacacucauucaccuugug

SEQ ID NO: 61226 - RNA, 27 nt, Artificial Sequence
  A-kinase anchor protein 10, mitochondrial (437-445)
auccuguacgacaaguauuucagccuc

SEQ ID NO: 61227 - RNA, 27 nt, Artificial Sequence
  Signal transducer and activator of transcription 3 (96-104)
aucauggacgccaccaacauucuggug

SEQ ID NO: 61228 - RNA, 27 nt, Artificial Sequence
  Long-chain-fatty-acid-CoA ligase 3 (386-394)
aucauggacagaauuuacaagaacgug

SEQ ID NO: 61229 - RNA, 33 nt, Artificial Sequence
  Syntaxin-binding protein 6 (160-170)
aucaugggcgggaacagcauucugcacuccgcc

SEQ ID NO: 61230 - RNA, 30 nt, Artificial Sequence
  Small nuclear ribonucleoprotein E (64-73)
aucaugcugaagggcgacaacauuacccuc

SEQ ID NO: 61231 - RNA, 27 nt, Artificial Sequence
  Talin-1 (100-108)
aucaugguggacgauagcaagaccguc

SEQ ID NO: 61232 - RNA, 27 nt, Artificial Sequence
  Zinc finger MIZ domain-containing protein 1 (736-744)
auccagcacagcgaguucgaagaggug

SEQ ID NO: 61233 - RNA, 27 nt, Artificial Sequence
  L-lactate dehydrogenase A chain (329-337)
aucagcgaccuggugaaggucacccuc

SEQ ID NO: 61234 - RNA, 27 nt, Artificial Sequence
  Protein cramped-like (737-745)
aucagcaccgaggugaaccccaagcug

SEQ ID NO: 61235 - RNA, 27 nt, Artificial Sequence
  Transmembrane protein 261 (13-21)
aucaccgcccccccuggcacagcugca

SEQ ID NO: 61236 - RNA, 30 nt, Artificial Sequence; identical to SEQ ID NO: 37009
  Apoptosis-resistant E3 ubiquitin protein ligase 1 (140-149)

SEQ ID NO: 61237 - RNA, 27 nt, Artificial Sequence
  Alpha-adducin (206-214)
aucguggacagaggcagcaccaaccug

SEQ ID NO: 61238 - RNA, 24 nt, Artificial Sequence
  NADH dehydrogenase (ubiquinone) 1 beta subcomplex subunit 10 (34-41)
aucguggacagacccgucacccug

SEQ ID NO: 61239 - RNA, 27 nt, Artificial Sequence
  1-phosphatidylinositol 3-phosphate 5-kinase (742-750)
aucguggacgucagacccacccugguu

SEQ ID NO: 61240 - RNA, 27 nt, Artificial Sequence
  Cytoplasmic dynein 1 heavy chain 1 (132-140)
aucgugaugcaggaggucgaaaccguu

SEQ ID NO: 61241 - RNA, 27 nt, Artificial Sequence
  Eukaryotic translation initiation factor 3 subunit B (187-195)
aucguggucgacaacguuccccaggug

SEQ ID NO: 61242 - RNA, 27 nt, Artificial Sequence
  Trifunctional purine biosynthetic protein adenosine-3 (125-133)
aaggccuucaccaaacccgaggaagcu

SEQ ID NO: 61243 - RNA, 27 nt, Artificial Sequence
  T-complex protein 1 subunit zeta (84-92)
aaggcccugcaguuccucgaggaagug

SEQ ID NO: 61244 - RNA, 27 nt, Artificial Sequence
  Endonuclease G, mitochondrial (153-161)
aaggccauggacgauaccuucuaccug

SEQ ID NO: 61245 - RNA, 27 nt, Artificial Sequence
  Histone-lysine N-methyltransferase NSD2 (573-581)
aaggccauggaggcugcaagcucccug

SEQ ID NO: 61246 - RNA, 27 nt, Artificial Sequence
  Tubulin alpha-1C chain (350-358)
aaggccuaccacgagcagcugaccgug

SEQ ID NO: 61247 - RNA, 30 nt, Artificial Sequence; identical to SEQ ID NO: 37020
  Melanoma-associated antigen 1 (160-169)

SEQ ID NO: 61248 - RNA, 30 nt, Artificial Sequence
  Melanoma-associated antigen D2 (337-346)
aaggagaucgacaaaaacgaucaccuguac

SEQ ID NO: 61249 - RNA, 27 nt, Artificial Sequence
  Lysine-specific demethylase 5A (1136-1144)
aaggagaucgaagccaugcacagccug

SEQ ID NO: 61250 - RNA, 27 nt, Artificial Sequence
  Something about silencing protein 10 (380-388)
aaggagaucgaagacagacagaaacug

SEQ ID NO: 61251 - RNA, 30 nt, Artificial Sequence
  Plectin (705-714)
aaggagaacgccgcuuacuuccaguuuuuc

SEQ ID NO: 61252 - RNA, 27 nt, Artificial Sequence
  ATP-binding cassette sub-family F member 3 (472-480)
aaggagagcgaaguggucaugaaauuc

SEQ ID NO: 61253 - RNA, 27 nt, Artificial Sequence
  Kinetochore protein Nuf2 (447-455)
aagaucgacgagaaaaccgccgaacug

SEQ ID NO: 61254 - RNA, 33 nt, Artificial Sequence; identical to SEQ ID NO: 37027
  Interferon-induced, double-stranded RNA-activated protein kinase (388-398)

SEQ ID NO: 61255 - RNA, 27 nt, Artificial Sequence
  Cyclin-dependent kinase 1 (9-17)
aagaucggcgaggggaccuacggagug

SEQ ID NO: 61256 - RNA, 27 nt, Artificial Sequence
  DNA mismatch repair protein Msh6 (740-748)
aagaucauuggcauaauggaggaagug

SEQ ID NO: 61257 - RNA, 33 nt, Artificial Sequence
  Arginine-tRNA ligase, cytoplasmic (587-597)
aagauccuggacgaucucuuccuucacacccug

SEQ ID NO: 61258 - RNA, 30 nt, Artificial Sequence
  Vacuolar protein sorting-associated protein 41 homolog (318-327)
aagauccuggacauuggccucgccuacaua

SEQ ID NO: 61259 - RNA, 30 nt, Artificial Sequence
  Signal transducer and activator of transcription 3 (658-667)
aagaucauggacgccaccaacauucuggug

SEQ ID NO: 61260 - RNA, 27 nt, Artificial Sequence
  UPF0568 protein C14orf166 (218-226)
aagaucaacgaggccauuguggcuguc

SEQ ID NO: 61261 - RNA, 27 nt, Artificial Sequence
  Cell division cycle protein 27 homolog (380-388)
aagaucagcaccauuacaccccagaua

SEQ ID NO: 61262 - RNA, 27 nt, Artificial Sequence
  Calpain-7 (56-64)
aagaucaccgaguaccuggaaagagug

SEQ ID NO: 61263 - RNA, 33 nt, Artificial Sequence
  Pre-mRNA-processing factor 19 (375-385)
aagaucugggaccugaaagagagaaccaacgug

SEQ ID NO: 61264 - RNA, 33 nt, Artificial Sequence
  Probable ATP-dependent RNA helicase DDX60 (16-26)
aagcuggccgacaugaaccaggaguaccaacuc

SEQ ID NO: 61265 - RNA, 27 nt, Artificial Sequence
  WD repeat-containing protein 11 (1062-1070)
aagcuggccgagggcgugcagcuccuu

SEQ ID NO: 61266 - RNA, 27 nt, Artificial Sequence
  KAT8 regulatory NSL complex subunit 1 (21-29)
aagcuggcccccccuagcuccacccuc

SEQ ID NO: 61267 - RNA, 27 nt, Artificial Sequence
  Dolichol-phosphate mannosyltransferase subunit 3 (24-32)
aagcuggcccaguggcucuggggccuu

SEQ ID NO: 61268 - RNA, 27 nt, Artificial Sequence
  DnaJ homolog subfamily C member 7 (322-330)
aagcuggacgauaccuacaucaaagcc

SEQ ID NO: 61269 - RNA, 27 nt, Artificial Sequence
  Nuclear transcription factor Y subunit gamma (53-61)
aagcuggacgaggaugugaaaaugauc

SEQ ID NO: 61270 - RNA, 27 nt, Artificial Sequence
  Coronin-1C (493-501)
aagcuggacgagauccucaaagaaauu

SEQ ID NO: 61271 - RNA, 27 nt, Artificial Sequence
  Protein LAP2 (759-767)
aagcuggaccacaucaacaugaaucuc

SEQ ID NO: 61272 - RNA, 27 nt, Artificial Sequence
  Protein NPAT (88-96)
aagcuggaccacacccucagccagauc

SEQ ID NO: 61273 - RNA, 27 nt, Artificial Sequence
  Rab3 GTPase-activating protein catalytic subunit (784-792)
aagcuggaggaaaucauucaccagaua

SEQ ID NO: 61274 - RNA, 30 nt, Artificial Sequence
  Vacuolar protein sorting-associated protein 35 (323-332)
aagcuguucgacaucuuuagccagcaagug

SEQ ID NO: 61275 - RNA, 27 nt, Artificial Sequence
  Transmembrane protein 223 (189-197)
aagcuguucgacaacaccgugggcgcc

SEQ ID NO: 61276 - RNA, 27 nt, Artificial Sequence
  tRNA wybutosine-synthesizing protein 2 homolog (32-40)
aagcuguucgacacccagcacagagug

SEQ ID NO: 61277 - RNA, 33 nt, Artificial Sequence
  Testin (65-75)
aagcuguucgaggacaccaaauacacaacucuc

SEQ ID NO: 61278 - RNA, 27 nt, Artificial Sequence
  T-complex protein 11-like protein 2 (131-139)
aagcuguucgaggaaaucagagagauu

SEQ ID NO: 61279 - RNA, 27 nt, Artificial Sequence
  Exportin-1 (568-576)
aagcuguucgaguuuaugcacgaaacc

SEQ ID NO: 61280 - RNA, 27 nt, Artificial Sequence
  TATA box-binding protein-associated factor RNA polymerase I subunit B (312-320)
aagcuguucgagaaaaaguacagcgug

SEQ ID NO: 61281 - RNA, 33 nt, Artificial Sequence
  Retinoic acid-induced protein 1 (1841-1851)
aagcuguucggccuccaggaggccaugaaagug

SEQ ID NO: 61282 - RNA, 27 nt, Artificial Sequence
  Rab-like protein 2A (105-113)
aagcuguucaacgacgccaucagacuc

SEQ ID NO: 61283 - RNA, 27 nt, Artificial Sequence
  WD repeat-containing protein 3 (837-845)
aagcuguucaacgaguuuauccagcuc

SEQ ID NO: 61284 - RNA, 33 nt, Artificial Sequence
  Asparagine synthetase (glutamine-hydrolyzing) (138-148)
aagcuguuccccggcuuugagaucgaaaccgug

SEQ ID NO: 61285 - RNA, 27 nt, Artificial Sequence
  Splicing factor 3B subunit 3 (769-777)
aagcugggcgccguguucaaccagguc

SEQ ID NO: 61286 - RNA, 27 nt, Artificial Sequence
  Membrane-associated tyrosine- and threonine-specific cdc2-inhibitory kinase (179-187)
aagcugggcgacuucgggcuccuugug

SEQ ID NO: 61287 - RNA, 24 nt, Artificial Sequence
  Pre-mRNA-splicing factor ATP-dependent RNA helicase PRP16 (474-481)
aagcugggcgacaucaugggggug

SEQ ID NO: 61288 - RNA, 27 nt, Artificial Sequence
  Inactive ubiquitin carboxyl-terminal hydrolase 54 (272-280)
aagcugggcgaccucuucuuuagagug

SEQ ID NO: 61289 - RNA, 27 nt, Artificial Sequence
  Probable ATP-dependent RNA helicase DHX37 (678-686)
aagcugggcgaccucauggugcuucug

SEQ ID NO: 61290 - RNA, 24 nt, Artificial Sequence
  Ras GTPase-activating-like protein IQGAP1 (161-168)
aagcugggccucgccccccagauc

SEQ ID NO: 61291 - RNA, 27 nt, Artificial Sequence
  Neutral amino acid transporter B(0) (45-53)
aagcugggccccgagggggaacuccuu

SEQ ID NO: 61292 - RNA, 30 nt, Artificial Sequence
  Nicotinamide phosphoribosyltransferase (189-198)
aagcugcacgacuucggcuacagaggggug

SEQ ID NO: 61293 - RNA, 27 nt, Artificial Sequence
  AP-2 complex subunit beta (147-155)
aagcugcacgacaucaacgcccagaug

SEQ ID NO: 61294 - RNA, 27 nt, Artificial Sequence
  Inner nuclear membrane protein Man1 (532-540)
aagcugcacgacagacucgcccagcuu

SEQ ID NO: 61295 - RNA, 27 nt, Artificial Sequence
  Ribosomal protein S6 kinase alpha-4 (94-102)
aagcugcaccucauccuugacuacgug

SEQ ID NO: 61296 - RNA, 27 nt, Artificial Sequence
  E3 ubiquitin-protein ligase HECTD1 (525-533)
aagcugaucgccgugcucgagagcauu

SEQ ID NO: 61297 - RNA, 27 nt, Artificial Sequence
  Serine/threonine-protein phosphatase 6 regulatory subunit 3 (43-51)
aagcugaucgaguuccuccuuaaagcc

SEQ ID NO: 61298 - RNA, 27 nt, Artificial Sequence
  ATP-dependent RNA helicase DDX18 (507-515)
aagcugaucgagaaaaacuacuuccuc

SEQ ID NO: 61299 - RNA, 27 nt, Artificial Sequence
  Early endosome antigen 1 (1075-1083)
aagcugauccaggagcucaaaaccgcc

SEQ ID NO: 61300 - RNA, 27 nt, Artificial Sequence
  Centrosomal protein of 57 kDa (383-391)
aagcugauccaggagagccccaccgug

SEQ ID NO: 61301 - RNA, 27 nt, Artificial Sequence
  Transmembrane protein 209 (50-58)
aagcugaucagcuccuacuauaacgug

SEQ ID NO: 61302 - RNA, 27 nt, Artificial Sequence
  Kelch-like protein 7 (25-33)
aagcugcucgccggcuucaugggggug

SEQ ID NO: 61303 - RNA, 30 nt, Artificial Sequence
  Vacuolar protein sorting-associated protein 35 (14-23)
aagcugcucgacgaggccauccaggcugug

SEQ ID NO: 61304 - RNA, 33 nt, Artificial Sequence
  40S ribosomal protein S17 (107-117)
aagcugcucgacuucggcagccuuuccaaccug

SEQ ID NO: 61305 - RNA, 27 nt, Artificial Sequence
  Ligand of Numb protein X 2 (105-113)
aagcugcucgacaaacuucugguguug

SEQ ID NO: 61306 - RNA, 33 nt, Artificial Sequence
  DDB1- and CUL4-associated factor 16 (79-89)
aagcugcucgaccccagcaccccugugcacauc

SEQ ID NO: 61307 - RNA, 33 nt, Artificial Sequence
  HCG2044777 (36-46)
aagcugcucgacaccaugguggauacauuccuu

SEQ ID NO: 61308 - RNA, 33 nt, Artificial Sequence
  E3 ubiquitin-protein ligase DTX3L (386-396)
aagcugcucgagaccgaacuucugcaggagauc

SEQ ID NO: 61309 - RNA, 27 nt, Artificial Sequence
  GRIP and coiled-coil domain-containing protein 2 (1083-1091)
aagcugcucgaggugcagauccuugaa

SEQ ID NO: 61310 - RNA, 30 nt, Artificial Sequence
  GRIP and coiled-coil domain-containing protein 2 (1083-1092)
aagcugcucgaggugcagauccuugaaguc

SEQ ID NO: 61311 - RNA, 33 nt, Artificial Sequence
  V-type proton ATPase subunit H (396-406)
aagcugcucgaggugagcgacgauccccagguc

SEQ ID NO: 61312 - RNA, 27 nt, Artificial Sequence
  TELO2-interacting protein 2 (122-130)
aagcugcucggcaaaguggagaccgcc

SEQ ID NO: 61313 - RNA, 30 nt, Artificial Sequence
  TELO2-interacting protein 1 homolog (409-418)
aagcugcucggccccaaaaucaacuucgug

SEQ ID NO: 61314 - RNA, 27 nt, Artificial Sequence
  Bromodomain-containing protein 9 (476-484)
aagcugcuccaggaccuucacgaggcc

SEQ ID NO: 61315 - RNA, 27 nt, Artificial Sequence
  Zinc finger protein 644 (475-483)
aagcugauggaggaaaucagagagcuc

SEQ ID NO: 61316 - RNA, 27 nt, Artificial Sequence
  ATP-binding cassette sub-family F member 2 (188-196)
aagcugauggagcucuacgaaagacuu

SEQ ID NO: 61317 - RNA, 27 nt, Artificial Sequence
  Dual specificity protein phosphatase 10 (474-482)
aagcugaugggcguggagaccgucguu

SEQ ID NO: 61318 - RNA, 27 nt, Artificial Sequence
  Tax1-binding protein 1 (296-304)
aagcugaugagcgaggugcagacccuc

SEQ ID NO: 61319 - RNA, 27 nt, Artificial Sequence
  S-adenosylmethionine synthase isoform type-2 (159-167)
aagcugaacgccaaacucgcugagcuu

SEQ ID NO: 61320 - RNA, 27 nt, Artificial Sequence
  Coatomer subunit alpha (1002-1010)
aagcugaacgaccucauccagagacuu

SEQ ID NO: 61321 - RNA, 27 nt, Artificial Sequence
  THAP domain-containing protein 4 (389-397)
aagcugcaggagaaacucgacgaacuu

SEQ ID NO: 61322 - RNA, 27 nt, Artificial Sequence
  E3 ubiquitin-protein ligase BRE1A (194-202)
aagcugcaggagaaaguggaacuccuu

SEQ ID NO: 61323 - RNA, 27 nt, Artificial Sequence
  DNA topoisomerase I, mitochondrial (529-537)
aagcugcaggagcaacucgcccagcuu

SEQ ID NO: 61324 - RNA, 33 nt, Artificial Sequence
  Ectopic P granules protein 5 homolog (535-545)
aagcugcagcccaccccuggcauccaaaaagug

SEQ ID NO: 61325 - RNA, 27 nt, Artificial Sequence
  Unconventional myosin-Id (406-414)
aagcugcagcaacucuucauccagcuu

SEQ ID NO: 61326 - RNA, 27 nt, Artificial Sequence
  NFATC2-interacting protein (17-25)
aagcugagcgaggugaacaaaagacuc

SEQ ID NO: 61327 - RNA, 27 nt, Artificial Sequence
  ATPase family AAA domain-containing protein 1 (68-76)
aagcugagcgaguacgaaauguccauc

SEQ ID NO: 61328 - RNA, 27 nt, Artificial Sequence
  Serpin H1 (262-270)
aagcugagcucccucaucauucuuaug

SEQ ID NO: 61329 - RNA, 27 nt, Artificial Sequence
  Coiled-coil domain-containing protein 93 (26-34)
aagcugaccgagauccucgaacuucug

SEQ ID NO: 61330 - RNA, 27 nt, Artificial Sequence
  Protein Hook homolog 1 (556-564)
aagcugaccgaggugcacgaagagcuc

SEQ ID NO: 61331 - RNA, 27 nt, Artificial Sequence
  Polypeptide N-acetylgalactosaminyltransferase 18 (204-212)
aagcugaccgaguacguggacaaaguc

SEQ ID NO: 61332 - RNA, 27 nt, Artificial Sequence
  Kinesin-like protein KIF1C (839-847)
aagcugaccggcauccuccaggaggug

SEQ ID NO: 61333 - RNA, 27 nt, Artificial Sequence
  Actin-related protein 2/3 complex subunit 4 (130-138)
aagcugguggacuucgucauccacuuu

SEQ ID NO: 61334 - RNA, 33 nt, Artificial Sequence
  Caprin-1 (191-201)
aagcugguggaccccgagagagauaugagccuc

SEQ ID NO: 61335 - RNA, 27 nt, Artificial Sequence
  Lysine-tRNA ligase (474-482)
aagcuggugggcgaguuccucgaaguc

SEQ ID NO: 61336 - RNA, 27 nt, Artificial Sequence
  Baculoviral IAP repeat-containing protein 6 (860-868)
aagcuggugaacauccucguccagcuu

SEQ ID NO: 61337 - RNA, 27 nt, Artificial Sequence
  Eukaryotic peptide chain release factor GTP-binding subunit ERF3A (239-247)
aagcuggugcccuuccucaaaaagguc

SEQ ID NO: 61338 - RNA, 27 nt, Artificial Sequence
  Trafficking protein particle complex subunit 11 (245-253)
aagcugugggccgacagaaucagccuc

SEQ ID NO: 61339 - RNA, 27 nt, Artificial Sequence
  Pecanex-like protein 1 (1446-1454)
aagcugugggagcuccuuuacaaacug

SEQ ID NO: 61340 - RNA, 27 nt, Artificial Sequence
  Intraflagellar transport protein 27 homolog (77-85)
aagcugugggagagccccaacgugcuc

SEQ ID NO: 61341 - RNA, 33 nt, Artificial Sequence
  Transducin-like enhancer protein 4 (308-318)
aagcuguggaccggcgggcucgacaacacagug

SEQ ID NO: 61342 - RNA, 30 nt, Artificial Sequence
  Cytochrome P450 4V2 (91-100)
aagcugugggugggccccgucccuaugguu

SEQ ID NO: 61343 - RNA, 27 nt, Artificial Sequence
  Intraflagellar transport protein 172 homolog (352-360)
aagcuguacgacgauaugaucagacuc

SEQ ID NO: 61344 - RNA, 27 nt, Artificial Sequence
  General transcription factor II-I repeat domain-containing protein 2B (841-849)
aagcuguacgagagcgaacucacccuu

SEQ ID NO: 61345 - RNA, 27 nt, Artificial Sequence
  DNA-directed RNA polymerase I subunit RPA1 (386-394)
aagcuguacaacaucuggauuagacuc

SEQ ID NO: 61346 - RNA, 33 nt, Artificial Sequence
  Regulator of nonsense transcripts 1 (816-826)
aagcuguaccaggagguggaaaucgccagcguc

SEQ ID NO: 61347 - RNA, 27 nt, Artificial Sequence
  Glutamine-tRNA ligase (401-409)
aagauggaccccguggccuacagaguc

SEQ ID NO: 61348 - RNA, 27 nt, Artificial Sequence
  Adiponectin receptor protein 1 (79-87)
aagauggaggaauucguguacaaaguc

SEQ ID NO: 61349 - RNA, 27 nt, Artificial Sequence
  NADH dehydrogenase (ubiquinone) iron-sulfur protein 2, mitochondrial (1-9)
aagauguucgaguuuuacgaaagagug

SEQ ID NO: 61350 - RNA, 30 nt, Artificial Sequence
  cAMP-dependent protein kinase type II-alpha regulatory subunit (222-231)
aagauguucgagagcuuuaucgaauccgug

SEQ ID NO: 61351 - RNA, 30 nt, Artificial Sequence
  3-hydroxy-3-methylglutaryl-coenzyme A reductase (314-323)
aagaugaucagcauggacauugagcaggug

SEQ ID NO: 61352 - RNA, 33 nt, Artificial Sequence
  Serine/threonine-protein kinase SIK2 (72-82)
aagaugcuggaccacccccauaucauuaaacuc

SEQ ID NO: 61353 - RNA, 27 nt, Artificial Sequence
  Transmembrane protein 245 (455-463)
aagaugcuggacaaaaucauuagcaua

SEQ ID NO: 61354 - RNA, 30 nt, Artificial Sequence
  Acetyl-CoA acetyltransferase, mitochondrial (365-374)
aagaugcuggagaucgacccccagaaagug

SEQ ID NO: 61355 - RNA, 33 nt, Artificial Sequence
  HLA class II histocompatibility antigen, DQ beta 1 chain (229-239)
aagaugcugagcggcaucgggggauucgugcuc

SEQ ID NO: 61356 - RNA, 33 nt, Artificial Sequence
  HLA class II histocompatibility antigen, DRB1-11 beta chain (227-237)
aagaugcugagcggcguggggggauucguccuc

SEQ ID NO: 61357 - RNA, 27 nt, Artificial Sequence
  DNA replication licensing factor MCM4 (578-586)
aagaugaacgagagcaccagauccgug

SEQ ID NO: 61358 - RNA, 27 nt, Artificial Sequence
  MAP kinase-activating death domain protein (389-397)
aagaugcccgacgauguguggcugguc

SEQ ID NO: 61359 - RNA, 27 nt, Artificial Sequence
  Mitotic spindle assembly checkpoint protein MAD1 (294-302)
aagaugcaggagacccuggugggccuc

SEQ ID NO: 61360 - RNA, 27 nt, Artificial Sequence
  Rho GTPase-activating protein 5 (514-522)
aagaugagcgagauccacaccgugcug

SEQ ID NO: 61361 - RNA, 27 nt, Artificial Sequence
  Centromere protein F (1431-1439)
aagaugagcgagcugcagaccuacgug

SEQ ID NO: 61362 - RNA, 27 nt, Artificial Sequence
  Nucleolar protein 56 (288-296)
aagaugagccagguggcccccucccug

SEQ ID NO: 61363 - RNA, 27 nt, Artificial Sequence
  AP-1 complex subunit sigma-1A (29-37)
aagauggugagagagcugaugcagguc

SEQ ID NO: 61364 - RNA, 33 nt, Artificial Sequence; identical to SEQ ID NO: 37137
  mRNA export factor (111-121)

SEQ ID NO: 61365 - RNA, 27 nt, Artificial Sequence
  Ski oncogene (28-36)
aagcccagcuccuggcugagaacccuc

SEQ ID NO: 61366 - RNA, 27 nt, Artificial Sequence
  Breast cancer type 2 susceptibility protein (1180-1188)
aagcaguucgagggcaccguggaaauc

SEQ ID NO: 61367 - RNA, 27 nt, Artificial Sequence
  E3 UFM1-protein ligase 1 (402-410)
aagcagaucagcacccuggaguccgug

SEQ ID NO: 61368 - RNA, 27 nt, Artificial Sequence
  General transcription factor II-I (532-540)
aagcagguggaggaaaucuucaaccug

SEQ ID NO: 61369 - RNA, 27 nt, Artificial Sequence
  Ribonuclease H2 subunit B (295-303)
aagagcaucgacaccuucuuuggcgug

SEQ ID NO: 61370 - RNA, 27 nt, Artificial Sequence
  Zinc finger MYM-type protein 3 (414-422)
aagaccggcgaggugcugcacgaaguc

SEQ ID NO: 61371 - RNA, 33 nt, Artificial Sequence
  PRELI domain-containing protein 1, mitochondrial (157-167)
aagaccaugaaaggcuucgaguacauccuggcc

SEQ ID NO: 61372 - RNA, 27 nt, Artificial Sequence
  Sister chromatid cohesion protein PDS5 homolog A (1070-1078)
aagaccaacgagaaacuguacacagug

SEQ ID NO: 61373 - RNA, 27 nt, Artificial Sequence
  Pre-rRNA-processing protein TSR1 homolog (106-114)
aagguggccgacaccauccuguuccuc

SEQ ID NO: 61374 - RNA, 27 nt, Artificial Sequence
  TNFAIP3-interacting protein 2 (330-338)
aagguggccagccugcuccaccagguc

SEQ ID NO: 61375 - RNA, 27 nt, Artificial Sequence
  Polyadenylate-binding protein 4 (602-610)
aagguggacgaggccgucgcuguucug

SEQ ID NO: 61376 - RNA, 30 nt, Artificial Sequence
  Beta-secretase 2 (314-323)
aagguguucgacgccgucguugaggcugug

SEQ ID NO: 61377 - RNA, 27 nt, Artificial Sequence
  Melanoma inhibitory activity protein 3 (259-267)
aaggugcuggacaaagucuucagagcc

SEQ ID NO: 61378 - RNA, 27 nt, Artificial Sequence
  Lipopolysaccharide-responsive and beige-like anchor protein (136-144)
aaggugcugggcaaaaucgagaagguc

SEQ ID NO: 61379 - RNA, 27 nt, Artificial Sequence
  Protein SET (137-145)
aaggugcugagcaaagaguuccaccuc

SEQ ID NO: 61380 - RNA, 33 nt, Artificial Sequence
  E3 ubiquitin-protein ligase RNF213 (3249-3259)
aaggugagcgaggaagccaaauccauccugcuc

SEQ ID NO: 61381 - RNA, 30 nt, Artificial Sequence
  T-complex protein 1 subunit delta (232-241)
aaggugagcaacuccggcaucaccagaguc

SEQ ID NO: 61382 - RNA, 30 nt, Artificial Sequence
  Inhibitor of nuclear factor kappa-B kinase subunit alpha (394-403)
aaggugugggccgaggcuguccacuacguu

SEQ ID NO: 61383 - RNA, 27 nt, Artificial Sequence
  TRIO and F-actin-binding protein (548-556)
aaguaccaggacguguaugucgagcug

SEQ ID NO: 61384 - RNA, 27 nt, Artificial Sequence
  Growth arrest-specific protein 7 (317-325)
cuggccgacgaggcugaagugcaccuc

SEQ ID NO: 61385 - RNA, 24 nt, Artificial Sequence
  Heat shock protein HSP 90-beta (497-504)
cuggacaagaaaguggagaagguc

SEQ ID NO: 61386 - RNA, 27 nt, Artificial Sequence
  Glutamine-tRNA ligase (170-178)
cuggaggccgaccucgaaaagaaauuc

SEQ ID NO: 61387 - RNA, 27 nt, Artificial Sequence
  GRIP and coiled-coil domain-containing protein 2 (490-498)
cuggagaacgaacaggugcaaaagcuc

SEQ ID NO: 61388 - RNA, 27 nt, Artificial Sequence
  ERO1-like protein alpha (69-77)
cuggagagcgacuacuucagauauuac

SEQ ID NO: 61389 - RNA, 33 nt, Artificial Sequence
  Lethal(2) giant larvae protein homolog 2 (69-79)
cugcaccaggagaacaaugccgugacccaaauc

SEQ ID NO: 61390 - RNA, 27 nt, Artificial Sequence
  Beta-hexosaminidase subunit beta (194-202)
cugaucgacaccagcagacacuaccuc

SEQ ID NO: 61391 - RNA, 27 nt, Artificial Sequence
  mRNA cap guanine-N7 methyltransferase (183-191)
cugaucggcgaguuccucgaaaaggug

SEQ ID NO: 61392 - RNA, 27 nt, Artificial Sequence
  Activating signal cointegrator 1 complex subunit 3 (1174-1182)
cugaucauugacgagauacaccuccuu

SEQ ID NO: 61393 - RNA, 27 nt, Artificial Sequence
  Elongation factor 2 (292-300)
cugauccucgaccccauuuucaaggug

SEQ ID NO: 61394 - RNA, 27 nt, Artificial Sequence
  Zinc finger protein 532 (468-476)
cugaagcucgccaacaauaccacagug

SEQ ID NO: 61395 - RNA, 27 nt, Artificial Sequence
  Protein TBRG4 (214-222)
cugcucgccgagcuucugacccacuug

SEQ ID NO: 61396 - RNA, 27 nt, Artificial Sequence
  Cytoplasmic dynein 1 heavy chain 1 (1716-1724)
cugcucgccgagagcgugaccgaaguc

SEQ ID NO: 61397 - RNA, 27 nt, Artificial Sequence
  m7GpppX diphosphatase (297-305)
cugcucgccgaggugaucgaaaaccuu

SEQ ID NO: 61398 - RNA, 27 nt, Artificial Sequence
  E3 ubiquitin-protein ligase UBR2 (617-625)
cugcucgccggccuucacgugcuguug

SEQ ID NO: 61399 - RNA, 33 nt, Artificial Sequence
  MAP kinase-activating death domain protein (367-377)
cugcucgcccccaccccuuacaucauuggcgug

SEQ ID NO: 61400 - RNA, 27 nt, Artificial Sequence
  Peroxiredoxin-5, mitochondrial (164-172)
cugcucgacgauagccuuguguccauc

SEQ ID NO: 61401 - RNA, 30 nt, Artificial Sequence
  Beta-adrenergic receptor kinase 1 (324-333)
cugcucgacgagcacggccaugugagaauc

SEQ ID NO: 61402 - RNA, 27 nt, Artificial Sequence
  Lon protease homolog 2, peroxisomal (678-686)
cugcucgacaacaccgauauccaccuu

SEQ ID NO: 61403 - RNA, 27 nt, Artificial Sequence
  Coatomer subunit gamma-1 (848-856)
cugcucgacaccgugacaaugcagguc

SEQ ID NO: 61404 - RNA, 27 nt, Artificial Sequence
  Serine-protein kinase ATM (1590-1598)
cugcucgaggaaaucaaccacuuccuu

SEQ ID NO: 61405 - RNA, 33 nt, Artificial Sequence
  DNA-directed RNA polymerase II subunit RPB11-a (11-21)
cugcucuucgagggcgaaaagaaaaucaccauu

SEQ ID NO: 61406 - RNA, 27 nt, Artificial Sequence
  GCN1 general control of amino-acid synthesis 1-like 1 (1599-1607)
cugcucggcgaccuucuguuccacauc

SEQ ID NO: 61407 - RNA, 27 nt, Artificial Sequence
  Transport and Golgi organization protein 6 homolog (991-999)
cugcucggcagcgugguccacgagguu

SEQ ID NO: 61408 - RNA, 27 nt, Artificial Sequence
  Nucleoprotein TPR (1158-1166)
cugcuccacgaccagaucgagaagcuu

SEQ ID NO: 61409 - RNA, 27 nt, Artificial Sequence
  Sentrin-specific protease 5 (328-336)
cugcucauccccauucaccuugaggug

SEQ ID NO: 61410 - RNA, 27 nt, Artificial Sequence
  cAMP-dependent protein kinase type I-alpha regulatory subunit (30-38)
cugcucaaggacagcaucgugcagcuu

SEQ ID NO: 61411 - RNA, 30 nt, Artificial Sequence
  Coatomer subunit gamma-1 (847-856)
cugcuccuugacaccgugacaaugcagguc

SEQ ID NO: 61412 - RNA, 27 nt, Artificial Sequence
  ATP-binding cassette sub-family B member 8, mitochondrial (150-158)
cugcuccuuggccagcugguggagguc

SEQ ID NO: 61413 - RNA, 33 nt, Artificial Sequence
  Ubiquitin/ISG15-conjugating enzyme E2 L6 (38-48)
cugcuccuucccgaccagccuccauaccaccug

SEQ ID NO: 61414 - RNA, 33 nt, Artificial Sequence
  E3 ubiquitin-protein ligase listerin (646-656)
cugcucaugcccagcuccgaggaccuucuguug

SEQ ID NO: 61415 - RNA, 27 nt, Artificial Sequence
  Kelch-like protein 12 (470-478)
cugcucaacgaccacaucuacgugguc

SEQ ID NO: 61416 - RNA, 27 nt, Artificial Sequence
  Polyadenylate-binding protein 4 (162-170)
cugcucaacgacagaaagguguucguc

SEQ ID NO: 61417 - RNA, 30 nt, Artificial Sequence
  Staphylococcal nuclease domain-containing protein 1 (187-196)
cugcuccccgacuacuaucuugugaccguc

SEQ ID NO: 61418 - RNA, 30 nt, Artificial Sequence
  tRNA-dihydrouridine(47) synthase (NAD(P)(+))-like (208-217)
cugcuccccgagcuuagagacuggggcgug

SEQ ID NO: 61419 - RNA, 27 nt, Artificial Sequence
  Activating molecule in BECN1-regulated autophagy protein 1 (810-818)
cugcuccccgaguaccuuccuuaugcc

SEQ ID NO: 61420 - RNA, 27 nt, Artificial Sequence
  Transportin-1 (394-402)
cugcucccccacauccuuccucuguug

SEQ ID NO: 61421 - RNA, 27 nt, Artificial Sequence
  Angiomotin-like protein 1 (845-853)
cugcuccccccuccaccgaccagcgcc

SEQ ID NO: 61422 - RNA, 27 nt, Artificial Sequence
  ATP-citrate synthase (43-51)
cugcuccaggaccaccccuggcuucug

SEQ ID NO: 61423 - RNA, 27 nt, Artificial Sequence
  Pleckstrin homology domain-containing family A member 4 (400-408)
cugcuccaggacagacuugugagcguc

SEQ ID NO: 61424 - RNA, 27 nt, Artificial Sequence
  T-complex protein 1 subunit epsilon (314-322)
cugcuccagaacaaucuucccgccgug

SEQ ID NO: 61425 - RNA, 27 nt, Artificial Sequence
  Nuclear factor erythroid 2-related factor 1 (371-379)
cugcucagagagaagguggaauuccuu

SEQ ID NO: 61426 - RNA, 27 nt, Artificial Sequence
  Eukaryotic translation initiation factor 4 gamma 3 (1361-1369)
cugcucagcgagauccuucaccuguug

SEQ ID NO: 61427 - RNA, 27 nt, Artificial Sequence
  Liprin-alpha-3 (437-445)
cugcucagcgaguccaacgaaagacuu

SEQ ID NO: 61428 - RNA, 30 nt, Artificial Sequence
  Cyclin-dependent kinase 11B (556-565)
cugcucagccacgccggcauccuuaaggug

SEQ ID NO: 61429 - RNA, 27 nt, Artificial Sequence
  TATA-binding protein-associated factor 172 (43-51)
cugcucagcaaggugcuuaucuaccug

SEQ ID NO: 61430 - RNA, 27 nt, Artificial Sequence
  Ras GTPase-activating protein-binding protein 1 (97-105)
cugcucagcaacaauaaccaggcccuu

SEQ ID NO: 61431 - RNA, 27 nt, Artificial Sequence
  Fasciculation and elongation protein zeta-2 (365-373)
cugcucaccgacuacauccuuaaggug

SEQ ID NO: 61432 - RNA, 27 nt, Artificial Sequence
  5'-nucleotidase domain-containing protein 3 (276-284)
cugcucugggacaagauccacaaacuu

SEQ ID NO: 61433 - RNA, 30 nt, Artificial Sequence
  Cyclic AMP-dependent transcription factor ATF-6 beta (206-215)
cugcucugggacgugcccgccccuagccuu

SEQ ID NO: 61434 - RNA, 33 nt, Artificial Sequence
  Protein KIAA0100 (525-535)
cugcucuggagccccccugaccacauguaccuu

SEQ ID NO: 61435 - RNA, 27 nt, Artificial Sequence
  Growth arrest-specific protein 8 (22-30)
cugcucuacgagcaccagaacaaucuu

SEQ ID NO: 61436 - RNA, 30 nt, Artificial Sequence
  ATP-dependent RNA helicase DHX29 (149-158)
cugcucuacggcggggaccuucacagcgcc

SEQ ID NO: 61437 - RNA, 27 nt, Artificial Sequence
  Catenin alpha-1 (702-710)
cugaugaacgccgugguccagaccguu

SEQ ID NO: 61438 - RNA, 27 nt, Artificial Sequence
  Transient receptor potential cation channel subfamily V member 2 (644-652)
cugaugagcgagaccgugaacuccguc

SEQ ID NO: 61439 - RNA, 27 nt, Artificial Sequence
  5'-3' exoribonuclease 2 (347-355)
cugccccaccucccuagccuugagauc

SEQ ID NO: 61440 - RNA, 27 nt, Artificial Sequence
  Exosome component 10 (544-552)
cugcccaaggagccucagggcaucauu

SEQ ID NO: 61441 - RNA, 24 nt, Artificial Sequence
  Girdin (733-740)
cugcccagagccagcuccgugauc

SEQ ID NO: 61442 - RNA, 27 nt, Artificial Sequence
  Cytoskeleton-associated protein 5 (598-606)
cugcccuggaccgccgagcaggugguc

SEQ ID NO: 61443 - RNA, 27 nt, Artificial Sequence
  SLIT-ROBO Rho GTPase-activating protein 2 (519-527)
cugcagcacgagggcaucuucagagug

SEQ ID NO: 61444 - RNA, 33 nt, Artificial Sequence
  DNA dC-dU-editing enzyme APOBEC-3A (64-74)
cugcagcucgaccccgcccaaaucuacagagug

SEQ ID NO: 61445 - RNA, 27 nt, Artificial Sequence
  N-acetylgalactosamine kinase (236-244)
cugcagugggacaaggugcucagacuu

SEQ ID NO: 61446 - RNA, 27 nt, Artificial Sequence
  ATP-binding cassette sub-family A member 7 (407-415)
cugagccucgacaagcuugaggccgcu

SEQ ID NO: 61447 - RNA, 27 nt, Artificial Sequence
  U6 snRNA-associated Sm-like protein LSm4 (4-12)
cugagccuccuuaagaccgcccagaac

SEQ ID NO: 61448 - RNA, 27 nt, Artificial Sequence
  Pre-mRNA-processing-splicing factor 8 (249-257)
cugguggacgauaacuacuucuaucuc

SEQ ID NO: 61449 - RNA, 30 nt, Artificial Sequence
  Protein PRRC2B (148-157)
cugguguacgagggccagcucagccaagcc

SEQ ID NO: 61450 - RNA, 27 nt, Artificial Sequence
  E3 ubiquitin-protein ligase Hakai (268-276)
auggcccccccuccaccgagaagcgug

SEQ ID NO: 61451 - RNA, 27 nt, Artificial Sequence
  Eukaryotic translation initiation factor 4 gamma 1 (1290-1298)
auggagaucgacauuccccacgugugg

SEQ ID NO: 61452 - RNA, 30 nt, Artificial Sequence
  Keratinocyte-associated transmembrane protein 2 (176-185)
auggagaucgaacagagcgugaaguccuuc

SEQ ID NO: 61453 - RNA, 27 nt, Artificial Sequence
  E3 ubiquitin-protein ligase UBR1 (380-388)
auggagauggaauacaagaaacuguuc

SEQ ID NO: 61454 - RNA, 27 nt, Artificial Sequence
  Intron-binding protein aquarius (94-102)
auggagcagagccuguucaccagauuu

SEQ ID NO: 61455 - RNA, 27 nt, Artificial Sequence
  Riboflavin kinase (85-93)
auggagacccacaucaugcauacauuc

SEQ ID NO: 61456 - RNA, 27 nt, Artificial Sequence
  Adenosylhomocysteinase (210-218)
augaucgccggcaagguggcugucguu

SEQ ID NO: 61457 - RNA, 27 nt, Artificial Sequence
  TFIIH basal transcription factor complex helicase XPB subunit (438-446)
augauccuggacgaggugcacaccauu

SEQ ID NO: 61458 - RNA, 27 nt, Artificial Sequence
  GPN-loop GTPase 3 (162-170)
augaucagccuggagauuccccaggug

SEQ ID NO: 61459 - RNA, 27 nt, Artificial Sequence
  DNA replication licensing factor MCM5 (531-539)
augcuggccaagcacgugaucacccuc

SEQ ID NO: 61460 - RNA, 27 nt, Artificial Sequence
  Microtubule-associated protein RP/EB family member 1 (20-28)
augcuggccuggaucaacgagagccuc

SEQ ID NO: 61461 - RNA, 27 nt, Artificial Sequence
  Protein SSXT (28-36)
augcuggacgauaacaaucaccucauc

SEQ ID NO: 61462 - RNA, 27 nt, Artificial Sequence
  Nucleoporin NUP188 homolog (296-304)
augcuggacgauagagccuaccucgug

SEQ ID NO: 61463 - RNA, 27 nt, Artificial Sequence
  Nitrogen permease regulator 3-like protein (542-550)
augcuguucgacaaguuuagaagcgug

SEQ ID NO: 61464 - RNA, 33 nt, Artificial Sequence
  Protein zyg-11 homolog B (424-434)
augcugaucgaggaaggcgggcuccagcaccuu

SEQ ID NO: 61465 - RNA, 27 nt, Artificial Sequence
  AP-3 complex subunit beta-1 (138-146)
augcugaucgaggugauugaaaagcuc

SEQ ID NO: 61466 - RNA, 27 nt, Artificial Sequence
  1-phosphatidylinositol 3-phosphate 5-kinase (763-771)
augcugcucgagcacggcaucacccuu

SEQ ID NO: 61467 - RNA, 30 nt, Artificial Sequence
  Eukaryotic translation initiation factor 3 subunit C-like protein (692-701)
augcugcucgagauccccuacauggccgcu

SEQ ID NO: 61468 - RNA, 27 nt, Artificial Sequence
  Mitochondrial import receptor subunit TOM20 homolog (121-129)
augcugcucaccaagcuucccacaauc

SEQ ID NO: 61469 - RNA, 27 nt, Artificial Sequence
  Beta-2-syntrophin (451-459)
augcugaacggccaggaggugagacuc

SEQ ID NO: 61470 - RNA, 30 nt, Artificial Sequence; identical to SEQ ID NO: 37243
  SH3KBP1-binding protein 1 (437-446)

SEQ ID NO: 61471 - RNA, 27 nt, Artificial Sequence
  BRCA1-A complex subunit BRE (13-21)
augcugagccccuucaucuccucugug

SEQ ID NO: 61472 - RNA, 27 nt, Artificial Sequence
  Nesprin-2 (4298-4306)
augcugaccgagaucgaacacaaggug

SEQ ID NO: 61473 - RNA, 27 nt, Artificial Sequence
  T-complex protein 1 subunit eta (97-105)
augaugcuggacgaucuccuucagcug

SEQ ID NO: 61474 - RNA, 27 nt, Artificial Sequence
  ATP-dependent RNA helicase DDX18 (187-195)
augcccagaaacggcaccggggugcug

SEQ ID NO: 61475 - RNA, 33 nt, Artificial Sequence
  Abhydrolase domain-containing protein 2 (301-311)
augcagaucgacgauaacgugaugagaaaguuc

SEQ ID NO: 61476 - RNA, 27 nt, Artificial Sequence
  Bifunctional glutamate/proline-tRNA ligase (589-597)
aacgccgacggcaagaucauuagccug

SEQ ID NO: 61477 - RNA, 27 nt, Artificial Sequence
  HEAT repeat-containing protein 1 (1568-1576)
aacgccgacaagcugaccgugaaauuc

SEQ ID NO: 61478 - RNA, 24 nt, Artificial Sequence
  Eukaryotic translation initiation factor 3 subunit C-like protein (434-441)
aacgccgaccagccccugagagug

SEQ ID NO: 61479 - RNA, 27 nt, Artificial Sequence
  Inner centromere protein (178-186)
aacgccgagcagcacgugacccaacug

SEQ ID NO: 61480 - RNA, 27 nt, Artificial Sequence
  Serine/threonine-protein phosphatase 4 regulatory subunit 3B (168-176)
aacgagggcuacaucaagaaacugcuc

SEQ ID NO: 61481 - RNA, 24 nt, Artificial Sequence
  tRNA (cytosine(34)-C(5))-methyltransferase (262-269)
aacgagcugcccggccucaagugg

SEQ ID NO: 61482 - RNA, 27 nt, Artificial Sequence
  Nuclear factor erythroid 2-related factor 2 (459-467)
aacgagaugaugagcaaggaacaguuc

SEQ ID NO: 61483 - RNA, 30 nt, Artificial Sequence
  DDB1- and CUL4-associated factor 8 (367-376)
aacgagaauaacggcgugcugaagaaauuc

SEQ ID NO: 61484 - RNA, 27 nt, Artificial Sequence
  Syntaxin-binding protein 3 (434-442)
aacgagagcgacaugaucagaaauugg

SEQ ID NO: 61485 - RNA, 27 nt, Artificial Sequence
  Unconventional myosin-XVIIIa (417-425)
aacgagagcuccgugcugcacacccuc

SEQ ID NO: 61486 - RNA, 33 nt, Artificial Sequence
  FACT complex subunit SPT16 (585-595)
aacaucuuccccaauccugaggccaccuuugug

SEQ ID NO: 61487 - RNA, 27 nt, Artificial Sequence
  Ras GTPase-activating-like protein IQGAP3 (896-904)
aacaucauggacauuaagauaggccug

SEQ ID NO: 61488 - RNA, 27 nt, Artificial Sequence
  Protein TRIM6-TRIM34 (430-438)
aacaucguggagagacugaaggaaguc

SEQ ID NO: 61489 - RNA, 24 nt, Artificial Sequence
  Calponin-2 (7-14)
aacaagggccccagcuacgggcug

SEQ ID NO: 61490 - RNA, 27 nt, Artificial Sequence
  Developmentally-regulated GTP-binding protein 1 (83-91)
aaccuggccggcguguacagcgagguc

SEQ ID NO: 61491 - RNA, 27 nt, Artificial Sequence
  Nodal modulator 3 (667-675)
aaccuggacaaucccauccagaccgug

SEQ ID NO: 61492 - RNA, 27 nt, Artificial Sequence
  Ubiquitin-conjugating enzyme E2 J1 (44-52)
aaccuguucgaguggcacuuuaccgug

SEQ ID NO: 61493 - RNA, 27 nt, Artificial Sequence
  Transcription initiation factor TFIID subunit 1 (767-775)
aaccuguucagagcccccaucuaccuc

SEQ ID NO: 61494 - RNA, 27 nt, Artificial Sequence
  Vacuolar fusion protein CCZ1 homolog (460-468)
aaccugaucgaggugaaugaagagguc

SEQ ID NO: 61495 - RNA, 27 nt, Artificial Sequence
  GCN1 general control of amino-acid synthesis 1-like 1 (846-854)
aaccugcucagaaggcuuugggugguc

SEQ ID NO: 61496 - RNA, 27 nt, Artificial Sequence
  Ras GTPase-activating-like protein IQGAP2 (826-834)
aaccugauggacaucaagauuggccuc

SEQ ID NO: 61497 - RNA, 27 nt, Artificial Sequence
  Iron-responsive element-binding protein 2 (380-388)
aaccugaauagcaucgugcccuccguc

SEQ ID NO: 61498 - RNA, 27 nt, Artificial Sequence
  Phosphoserine aminotransferase (58-66)
aaccuggugagagagcuccuugccguc

SEQ ID NO: 61499 - RNA, 27 nt, Artificial Sequence
  Zinc finger BED domain-containing protein 4 (1063-1071)
aaccuguggagccucguggccaagguc

SEQ ID NO: 61500 - RNA, 27 nt, Artificial Sequence
  Ubiquitin-like modifier-activating enzyme 7 (733-741)
aaccuguacgcccagaugcacggccuc

SEQ ID NO: 61501 - RNA, 27 nt, Artificial Sequence
  Rho guanine nucleotide exchange factor 2 (717-725)
aaccuguacggccuccuucacgggcug

SEQ ID NO: 61502 - RNA, 27 nt, Artificial Sequence
  RRP12-like protein (634-642)
aaccuguacggccagcccguggccgcu

SEQ ID NO: 61503 - RNA, 33 nt, Artificial Sequence
  Splicing factor 3A subunit 1 (774-784)
aacauggccaauggcgcugugauccaccuggca

SEQ ID NO: 61504 - RNA, 27 nt, Artificial Sequence
  Protein C12orf4 (534-542)
aacaugcugccccagaucuucagagug

SEQ ID NO: 61505 - RNA, 27 nt, Artificial Sequence
  Casein kinase II subunit alpha (350-358)
aacaugaugagcggcaucuccucugug

SEQ ID NO: 61506 - RNA, 33 nt, Artificial Sequence
  Prefoldin subunit 1 (59-69)
aacauguacgagggcguggggagaauguucauc

SEQ ID NO: 61507 - RNA, 27 nt, Artificial Sequence
  Putative pre-mRNA-splicing factor ATP-dependent RNA helicase DHX16 (701-709)
aaccccagaaccggcauggagagccug

SEQ ID NO: 61508 - RNA, 27 nt, Artificial Sequence
  Histone acetyltransferase p300 (478-486)
aaccagaugcccacccaaccucaggug

SEQ ID NO: 61509 - RNA, 27 nt, Artificial Sequence
  Phosphatidate phosphatase LPIN1 (800-808)
aacagacccgccgacguguacagcuau

SEQ ID NO: 61510 - RNA, 33 nt, Artificial Sequence
  Nuclear valosin-containing protein-like isoform 4 (634-644)
aacagacccgacaucauugauccugccauacug

SEQ ID NO: 61511 - RNA, 27 nt, Artificial Sequence
  Glyceraldehyde-3-phosphate dehydrogenase (287-295)
aacagcgacacccacuccucuacauuc

SEQ ID NO: 61512 - RNA, 27 nt, Artificial Sequence
  Myosin regulatory light chain 12B (155-163)
aacuacaucgaguucaccagaauucug

SEQ ID NO: 61513 - RNA, 27 nt, Artificial Sequence
  N-acetyllactosaminide beta-1,3-N-acetylglucosaminyltransferase 2 (208-216)
aacuacagagacaccuucuuuaaucug

SEQ ID NO: 61514 - RNA, 24 nt, Artificial Sequence
  Vigilin (628-635)
cccgccaagcugcacaacagccuc

SEQ ID NO: 61515 - RNA, 27 nt, Artificial Sequence
  Leucine-rich repeat-containing protein 47 (93-101)
cccgagcugggcccucucccagcccuu

SEQ ID NO: 61516 - RNA, 27 nt, Artificial Sequence
  Mitochondrial fission regulator 1 (152-160)
ccccacccuccaccgcccccuccaccc

SEQ ID NO: 61517 - RNA, 27 nt, Artificial Sequence
  SCAN domain-containing protein 1 (113-121)
ccccugggcccugccccagugagcguc

SEQ ID NO: 61518 - RNA, 24 nt, Artificial Sequence
  Long-chain-fatty-acid-CoA ligase 4 (577-584)
cccaaccagaagagacugacccuc

SEQ ID NO: 61519 - RNA, 27 nt, Artificial Sequence
  Long-chain-fatty-acid-CoA ligase 4 (577-585)
cccaaccagaagagacugacccuccuu

SEQ ID NO: 61520 - RNA, 30 nt, Artificial Sequence
  Proline-rich nuclear receptor coactivator 2 (6-15)
cccagacugaacagcgccgacaggccuaug

SEQ ID NO: 61521 - RNA, 24 nt, Artificial Sequence
  Protein flightless-1 homolog (882-889)
cccagacagccuccaaugagccug

SEQ ID NO: 61522 - RNA, 24 nt, Artificial Sequence
  RHO/RAC effector protein (1130-1137)
cccagauaccugggcccugccauc

SEQ ID NO: 61523 - RNA, 27 nt, Artificial Sequence
  Palladin (86-94)
cccagcccuccaccgcccccuccaccc

SEQ ID NO: 61524 - RNA, 27 nt, Artificial Sequence
  Forkhead box protein J3 (438-446)
caggcccccccuccaccgcaacaggug

SEQ ID NO: 61525 - RNA, 30 nt, Artificial Sequence; identical to SEQ ID NO: 37298
  AT-rich interactive domain-containing protein 1A (1477-1486)

SEQ ID NO: 61526 - RNA, 30 nt, Artificial Sequence
  Rho GTPase-activating protein 35 (914-923)
caggagaucgacggcagauucaccagcauu

SEQ ID NO: 61527 - RNA, 33 nt, Artificial Sequence
  Translin-associated protein X (106-116)
caggagcugagcggcgaagacaugcaccaauuc

SEQ ID NO: 61528 - RNA, 27 nt, Artificial Sequence
  Acetyl-CoA carboxylase 1 (270-278)
caggagaacgacuucagcaagagaauc

SEQ ID NO: 61529 - RNA, 30 nt, Artificial Sequence
  Lamin-B receptor (157-166)
caggagagcuccuacaucgccacccaauau

SEQ ID NO: 61530 - RNA, 27 nt, Artificial Sequence
  Death-associated protein kinase 3 (122-130)
cagauccuggacggcgugcacuaccuc

SEQ ID NO: 61531 - RNA, 27 nt, Artificial Sequence
  Dynamin-like 120 kDa protein, mitochondrial (953-961)
cagcuggccgaggaccucaagaaagug

SEQ ID NO: 61532 - RNA, 27 nt, Artificial Sequence
  Epidermal growth factor receptor kinase substrate 8 (455-463)
cagcuggccgagagcguggcuaacguc

SEQ ID NO: 61533 - RNA, 30 nt, Artificial Sequence
  Transforming acidic coiled-coil-containing protein 3 (776-785)
cagcuggccaacgaggaaaucgcucaagug

SEQ ID NO: 61534 - RNA, 30 nt, Artificial Sequence
  E3 ubiquitin-protein ligase BRE1B (68-77)
cagcuggacgaggccagaggccuccuucug

SEQ ID NO: 61535 - RNA, 27 nt, Artificial Sequence
  Tyrosine-protein phosphatase non-receptor type 12 (162-170)
cagcuguucgagaagcaacuccagcuu

SEQ ID NO: 61536 - RNA, 30 nt, Artificial Sequence
  Phospholipase A1 member A (177-186)
cagcuguucggcgggcaacucggacagauc

SEQ ID NO: 61537 - RNA, 27 nt, Artificial Sequence
  CDK5 regulatory subunit-associated protein 2 (1222-1230)
cagcuguucagcgagauccacaaccuc

SEQ ID NO: 61538 - RNA, 27 nt, Artificial Sequence
  Trinucleotide repeat-containing gene 18 protein (900-908)
cagcuguucagccaacagcacuuucuc

SEQ ID NO: 61539 - RNA, 27 nt, Artificial Sequence
  Dual specificity protein phosphatase 14 (157-165)
cagcugaucgacuacgagagacaacuc

SEQ ID NO: 61540 - RNA, 27 nt, Artificial Sequence
  Eyes absent homolog 2 (420-428)
cagcugauccccgcccucgcuaaggug

SEQ ID NO: 61541 - RNA, 27 nt, Artificial Sequence
  Dual specificity protein phosphatase 6 (193-201)
cagcugcucgacuucgagagaacccuu

SEQ ID NO: 61542 - RNA, 30 nt, Artificial Sequence
  Circadian clock protein PASD1 (39-48)
cagcugcucgacggcuucaugaucacccuu

SEQ ID NO: 61543 - RNA, 27 nt, Artificial Sequence
  Transport and Golgi organization protein 6 homolog (720-728)
cagcugcucccccuucuggagaaggug

SEQ ID NO: 61544 - RNA, 27 nt, Artificial Sequence
  AP-1 complex subunit beta-1 (483-491)
cagcugcucaccgccaucgugaagcuu

SEQ ID NO: 61545 - RNA, 27 nt, Artificial Sequence
  tRNA (guanine(26)-N(2))-dimethyltransferase (198-206)
cagcugaacgacguggcccaccucguc

SEQ ID NO: 61546 - RNA, 27 nt, Artificial Sequence
  WD repeat-containing protein 36 (690-698)
cagcugaacgagcaacucgugacccuu

SEQ ID NO: 61547 - RNA, 27 nt, Artificial Sequence
  COMM domain-containing protein 8 (116-124)
cagcugcaagacuucgauuggcaggug

SEQ ID NO: 61548 - RNA, 27 nt, Artificial Sequence
  Thyroid receptor-interacting protein 11 (1241-1249)
cagcugcaagaggaacuccaccagcuu

SEQ ID NO: 61549 - RNA, 27 nt, Artificial Sequence
  Golgin subfamily A member 4 (1397-1405)
cagcugaccgaccucaacgugcaacuu

SEQ ID NO: 61550 - RNA, 27 nt, Artificial Sequence
  Eyes absent homolog 3 (439-447)
cagcuggugcccgcccucgcuaagguc

SEQ ID NO: 61551 - RNA, 27 nt, Artificial Sequence
  Nuclear factor NF-kappa-B p105 subunit (558-566)
cagcuggugagagaccuccuugagguc

SEQ ID NO: 61552 - RNA, 27 nt, Artificial Sequence
  Ketosamine-3-kinase (140-148)
cagcuguaccaacucuuccacuaucuu

SEQ ID NO: 61553 - RNA, 27 nt, Artificial Sequence
  T-complex protein 1 subunit epsilon (184-192)
cagauggccgagaucgcugugaacgca

SEQ ID NO: 61554 - RNA, 27 nt, Artificial Sequence
  Spectrin beta chain, non-erythrocytic 1 (1423-1431)
cagaugcuggagaaccaaauggaagug

SEQ ID NO: 61555 - RNA, 33 nt, Artificial Sequence
  Signal transducer and activator of transcription 1-alpha/beta (8-18)
cagcaacuggacagcaaguuccucgagcaggug

SEQ ID NO: 61556 - RNA, 33 nt, Artificial Sequence
  E1A-binding protein p400 (1051-1061)
cagcaaacccccguggccagcauccagcagguc

SEQ ID NO: 61557 - RNA, 24 nt, Artificial Sequence
  E3 ubiquitin-protein ligase RLIM (173-180)
cagagacccccuaccaucgugcug

SEQ ID NO: 61558 - RNA, 27 nt, Artificial Sequence
  Cell division cycle protein 27 homolog (580-588)
agagagcacgacaucgccauuaaguuc

SEQ ID NO: 61559 - RNA, 27 nt, Artificial Sequence
  Small nuclear ribonucleoprotein Sm D2 (102-110)
agaggcgacagcgugaucgucguucug

SEQ ID NO: 61560 - RNA, 33 nt, Artificial Sequence
  DNA topoisomerase 1 (376-386)
agaaucaugcccgaggacauuauaaucaacugc

SEQ ID NO: 61561 - RNA, 27 nt, Artificial Sequence
  Cyclin-L2 (140-148)
agaaucagggacgugauuaacgucuuc

SEQ ID NO: 61562 - RNA, 27 nt, Artificial Sequence
  Prelamin-A/C (91-99)
agacuggccgacgcucuccaggagcuu

SEQ ID NO: 61563 - RNA, 27 nt, Artificial Sequence
  Clathrin heavy chain 1 (1182-1190)
agacuggccgagcucgaagaguucauc

SEQ ID NO: 61564 - RNA, 30 nt, Artificial Sequence
  tRNA (cytosine(34)-C(5))-methyltransferase (514-523)
agacuggcccaggagggcaucuacacccuc

SEQ ID NO: 61565 - RNA, 30 nt, Artificial Sequence
  RUS1 family protein C16orf58 (165-174)
agacuguucgccgacauccucaacgaugug

SEQ ID NO: 61566 - RNA, 27 nt, Artificial Sequence
  HEAT repeat-containing protein 2 (253-261)
agacuguucgacgaugugccccagguc

SEQ ID NO: 61567 - RNA, 27 nt, Artificial Sequence
  BTB/POZ domain-containing protein 2 (2-10)
agacuguucgacgagccccagcucgcc

SEQ ID NO: 61568 - RNA, 33 nt, Artificial Sequence
  WD repeat domain phosphoinositide-interacting protein 4 (219-229)
agacuguucgacacccagagcaaggagaaacuc

SEQ ID NO: 61569 - RNA, 33 nt, Artificial Sequence
  DDB1- and CUL4-associated factor 4-like protein 1 (246-256)
agacuguuccacgacagcgccgugaccuccguc

SEQ ID NO: 61570 - RNA, 33 nt, Artificial Sequence
  Histone-lysine N-methyltransferase setd3 (468-478)
agacugggcgagaaggaaauccucgagaaagcc

SEQ ID NO: 61571 - RNA, 27 nt, Artificial Sequence
  Plectin (462-470)
agacugcacgagaggcucguggccauc

SEQ ID NO: 61572 - RNA, 27 nt, Artificial Sequence
  Probable ATP-dependent RNA helicase DDX47 (147-155)
agacugaucgaccaccucgagaacacc

SEQ ID NO: 61573 - RNA, 27 nt, Artificial Sequence
  Nuclear pore complex protein Nup160 (575-583)
agacugaucgaggaaagcgugaccguc

SEQ ID NO: 61574 - RNA, 30 nt, Artificial Sequence
  Partitioning defective 3 homolog (510-519)
agacugaucgaggugaacggcgucgaccuc

SEQ ID NO: 61575 - RNA, 27 nt, Artificial Sequence
  3-ketodihydrosphingosine reductase (236-244)
agacugaucagcgagaccacauccgug

SEQ ID NO: 61576 - RNA, 27 nt, Artificial Sequence
  Eukaryotic translation initiation factor 4 gamma 1 (840-848)
agacugaaggaggaacucgaggaagcc

SEQ ID NO: 61577 - RNA, 33 nt, Artificial Sequence
  Upstream-binding protein 1 (145-155)
agacugcucgaccuugauauccccaugagcgug

SEQ ID NO: 61578 - RNA, 33 nt, Artificial Sequence
  Cytochrome c oxidase subunit 2 (134-144)
agacugcucgacguggauaacagggucguucuu

SEQ ID NO: 61579 - RNA, 27 nt, Artificial Sequence
  Pyridoxal-dependent decarboxylase domain-containing protein 1 (603-611)
agacugcucgagaacaugaccgaagug

SEQ ID NO: 61580 - RNA, 33 nt, Artificial Sequence
  Xyloside xylosyltransferase 1 (295-305)
agacugcucgagcccgcccaggugcaacagcuu

SEQ ID NO: 61581 - RNA, 30 nt, Artificial Sequence
  Telomere length regulation protein TEL2 homolog (186-195)
agacugcucggcgaggaaguggucaggguu

SEQ ID NO: 61582 - RNA, 27 nt, Artificial Sequence
  Suppressor APC domain-containing protein 2 (290-298)
agacugcuccccaaggugcaggagguc

SEQ ID NO: 61583 - RNA, 27 nt, Artificial Sequence
  Translocon-associated protein subunit beta (2-10)
agacugcucagcuucgugguccuugcc

SEQ ID NO: 61584 - RNA, 27 nt, Artificial Sequence
  Vacuolar protein sorting-associated protein 33B (607-615)
agacugauggaggccaugagcgaagug

SEQ ID NO: 61585 - RNA, 33 nt, Artificial Sequence
  Probable inactiveosyltransferase 25 family member 3 (351-361)
agacugauggaggacguggaagccgagaagcuc

SEQ ID NO: 61586 - RNA, 33 nt, Artificial Sequence
  Vacuolar protein sorting-associated protein 13D (1845-1855)
agacugcccccugagggcauccuccacaacgug

SEQ ID NO: 61587 - RNA, 27 nt, Artificial Sequence
  Ribosome-binding protein 1 (569-577)
agacugcaggaggaacucgagaagcuu

SEQ ID NO: 61588 - RNA, 33 nt, Artificial Sequence
  HMG domain-containing protein 4 (432-442)
agacugcaggagaccgaaggcaugguggccguc

SEQ ID NO: 61589 - RNA, 27 nt, Artificial Sequence
  Protein orai-3 (287-295)
agacugcagggcgagcuccaagccgug

SEQ ID NO: 61590 - RNA, 27 nt, Artificial Sequence
  C-1-tetrahydrofolate synthase, cytoplasmic (478-486)
agacuggugcccagcgucaacggcguu

SEQ ID NO: 61591 - RNA, 33 nt, Artificial Sequence
  Guanine nucleotide-binding protein subunit beta-2-like 1 (88-98)
agacugugggaccucaccacaggcacuacgacc

SEQ ID NO: 61592 - RNA, 24 nt, Artificial Sequence
  Circadian clock protein PASD1 (691-698)
agacuguggcaggagcucagcgac

SEQ ID NO: 61593 - RNA, 27 nt, Artificial Sequence
  Ubiquitin carboxyl-terminal hydrolase 11 (210-218)
agacuguacgacacccacaucacagug

SEQ ID NO: 61594 - RNA, 33 nt, Artificial Sequence
  TIP41-like protein (200-210)
agacuguaccacgaggccgacaagaccuauaug

SEQ ID NO: 61595 - RNA, 27 nt, Artificial Sequence
  N-acetyllactosaminide beta-1,3-N-acetylglucosaminyltransferase 2 (314-322)
agacuguaccacaucaccgaccaggug

SEQ ID NO: 61596 - RNA, 33 nt, Artificial Sequence
  Heterogeneous nuclear ribonucleoprotein M (511-521)
agaauggccaccggccuggagaggaugggggcu

SEQ ID NO: 61597 - RNA, 33 nt, Artificial Sequence
  Eukaryotic translation initiation factor 3 subunit A (752-762)
agaaugcuggaggacagggaucucuucgugaug

SEQ ID NO: 61598 - RNA, 33 nt, Artificial Sequence
  N-alpha-acetyltransferase 38, NatC auxiliary subunit (104-114)
agaaugaccgacggcaggacacugguggggugc

SEQ ID NO: 61599 - RNA, 33 nt, Artificial Sequence
  Nucleophosmin (277-287)
agaaugaccgaccaggaggccauccaagaucug

SEQ ID NO: 61600 - RNA, 30 nt, Artificial Sequence
  Copine-3 (121-130)
agacccgccggcaaggggagcaucaccauu

SEQ ID NO: 61601 - RNA, 27 nt, Artificial Sequence
  Myeloid-derived growth factor (146-154)
agacccggcgccuucaaggcugagcug

SEQ ID NO: 61602 - RNA, 27 nt, Artificial Sequence
  BTB/POZ domain-containing adapter for CUL3-mediated RhoA degradation protein 1 (319-327)
agaccccacggccagcaaaucguguuc

SEQ ID NO: 61603 - RNA, 27 nt, Artificial Sequence
  Histone-lysine N-methyltransferase 2C (1906-1914)
agacccccuccagugggccacagcuuc

SEQ ID NO: 61604 - RNA, 27 nt, Artificial Sequence
  Calcium-independent phospholipase A2-gamma (321-329)
agacccaccgagggcgugcaggcccug

SEQ ID NO: 61605 - RNA, 27 nt, Artificial Sequence
  Sperm-specific antigen 2 (241-249)
agacagaucgaggugcugaccacaguc

SEQ ID NO: 61606 - RNA, 30 nt, Artificial Sequence
  Dolichyl-diphosphooligosaccharide-proteinosyltransferase subunit 1 (268-277)
agacagcccgacagcggcaucuccucuauu

SEQ ID NO: 61607 - RNA, 27 nt, Artificial Sequence
  DNA ligase 1 (294-302)
agaaccuucgagaagaucgaagaggug

SEQ ID NO: 61608 - RNA, 27 nt, Artificial Sequence
  Trifunctional enzyme subunit alpha, mitochondrial (235-243)
agaaccaucgaguaccuggaagaggug

SEQ ID NO: 61609 - RNA, 27 nt, Artificial Sequence
  Sorting nexin-4 (243-251)
agaguggccgacaggcuguacggcguc

SEQ ID NO: 61610 - RNA, 30 nt, Artificial Sequence
  THO complex subunit 2 (904-913)
agaguguucagcgacaucauuuacaccguc

SEQ ID NO: 61611 - RNA, 27 nt, Artificial Sequence
  Glycerol-3-phosphate acyltransferase 1, mitochondrial (138-146)
agagugcaggaggccaucgcugaaguc

SEQ ID NO: 61612 - RNA, 27 nt, Artificial Sequence
  Putative eukaryotic translation initiation factor 2 subunit 3-like protein (416-424)
agagugagcgccgucaaggcugaccug

SEQ ID NO: 61613 - RNA, 27 nt, Artificial Sequence
  Regulation of nuclear pre-mRNA domain-containing protein 1A (271-279)
agagugagccuggucaggaaggagcuc

SEQ ID NO: 61614 - RNA, 30 nt, Artificial Sequence
  Nuclear receptor corepressor 2 (2392-2401)
agagugugggaggacaggcccagcuccgcc

SEQ ID NO: 61615 - RNA, 27 nt, Artificial Sequence
  Replication initiator 1 (328-336)
agcgccgcugagcccaccccugcagug

SEQ ID NO: 61616 - RNA, 27 nt, Artificial Sequence
  DAZ-associated protein 2 (62-70)
agcgccgcuuuccccggcgcaucccug

SEQ ID NO: 61617 - RNA, 27 nt, Artificial Sequence
  Serine-threonine kinase receptor-associated protein (160-168)
agcgccgacgauaagaccgugagacug

SEQ ID NO: 61618 - RNA, 27 nt, Artificial Sequence
  Poly (ADP-ribose) polymerase 1 (385-393)
agcgccgacaagccccuguccaacaug

SEQ ID NO: 61619 - RNA, 27 nt, Artificial Sequence
  Uncharacterized protein C15orf39 (994-1002)
agcgccucccccccuggcccaacccug

SEQ ID NO: 61620 - RNA, 33 nt, Artificial Sequence
  Replication protein A 32 kDa subunit (93-103)
agcgaggccggcaacuucgggggaaauuccuuu

SEQ ID NO: 61621 - RNA, 27 nt, Artificial Sequence
  Kelch repeat and BTB domain-containing protein 6 (137-145)
agcgaggccaacguggaaagacuguac

SEQ ID NO: 61622 - RNA, 27 nt, Artificial Sequence
  Protein PRRC2C (867-875)
agcgaggcccaggugcaaaaguuccug

SEQ ID NO: 61623 - RNA, 30 nt, Artificial Sequence
  Non-POU domain-containing octamer-binding protein (120-129)
agcgagggcuccuuccugcucaccacauuu

SEQ ID NO: 61624 - RNA, 30 nt, Artificial Sequence
  Cyclin-dependent kinase 11B (629-638)
agcgagaucgaccagauuaacaagguguuc

SEQ ID NO: 61625 - RNA, 27 nt, Artificial Sequence
  Uncharacterized protein C5orf34 (564-572)
agcgagcuggaaaagauccagaaauuc

SEQ ID NO: 61626 - RNA, 30 nt, Artificial Sequence
  V-type proton ATPase subunit H (357-366)
agcgagcugaaguccggcagacucgaaugg

SEQ ID NO: 61627 - RNA, 27 nt, Artificial Sequence
  Myomegalin (838-846)
agcgagcugcaggcccucagacaauac

SEQ ID NO: 61628 - RNA, 30 nt, Artificial Sequence
  Small subunit processome component 20 homolog (777-786)
agcgagcaggacccccugcucaagaaccuu

SEQ ID NO: 61629 - RNA, 30 nt, Artificial Sequence
  ATP-citrate synthase (7-16)
agcgagcagaccggcaaggaacugcucuac

SEQ ID NO: 61630 - RNA, 27 nt, Artificial Sequence
  PERQ amino acid-rich with GYF domain-containing protein 2 (199-207)
agcgaguccgaaaacuggagaaucuuc

SEQ ID NO: 61631 - RNA, 27 nt, Artificial Sequence
  FACT complex subunit SSRP1 (657-665)
agcgaguccuucaagucuaaagaauuu

SEQ ID NO: 61632 - RNA, 27 nt, Artificial Sequence
  FAD synthase (193-201)
agcaucgcccccauucuggcugaggca

SEQ ID NO: 61633 - RNA, 33 nt, Artificial Sequence
  Coatomer subunit beta (249-259)
agcaucuucggcgaggacgcccuggcuaacgug

SEQ ID NO: 61634 - RNA, 27 nt, Artificial Sequence
  Inhibitor of Bruton tyrosine kinase (562-570)
agcauccacgacgugaccuuccagguc

SEQ ID NO: 61635 - RNA, 27 nt, Artificial Sequence
  Cell growth-regulating nucleolar protein (128-136)
agcauccuggaccagguguggaacauu

SEQ ID NO: 61636 - RNA, 27 nt, Artificial Sequence
  Poly (ADP-ribose) polymerase 1 (711-719)
agcauccuguccgaggugcagcaagcc

SEQ ID NO: 61637 - RNA, 24 nt, Artificial Sequence
  EF-hand domain-containing protein 1 (48-55)
agcaaggcccccgugcugaccuac

SEQ ID NO: 61638 - RNA, 27 nt, Artificial Sequence
  CCR4-NOT transcription complex subunit 1 (254-262)
agccuggccgacuucaugcaggaggug

SEQ ID NO: 61639 - RNA, 27 nt, Artificial Sequence
  DNA replication licensing factor MCM7 (208-216)
agccuggccgacuacaucaccgcugca

SEQ ID NO: 61640 - RNA, 27 nt, Artificial Sequence
  Ubiquitin carboxyl-terminal hydrolase 7 (543-551)
agccuggccgaguucgugcagucccuc

SEQ ID NO: 61641 - RNA, 30 nt, Artificial Sequence
  X-ray repair cross-complementing protein 5 (580-589)
agccuggccgagggcuccgugaccucuguc

SEQ ID NO: 61642 - RNA, 27 nt, Artificial Sequence
  Exosome complex exonuclease RRP44 (720-728)
agccuggccgagucccucgaccaggcu

SEQ ID NO: 61643 - RNA, 30 nt, Artificial Sequence
  Phosphatidylinositol 3,4,5-trisphosphate-dependent Rac exchanger 1 protein (655-664)
agccuggccgagguggcuggccuccagguc

SEQ ID NO: 61644 - RNA, 27 nt, Artificial Sequence
  Centrosome-associated protein CEP250 (112-120)
agccuggccgaggugaacacccagcuc

SEQ ID NO: 61645 - RNA, 27 nt, Artificial Sequence
  Apolipoprotein L1 (249-257)
agccuggccggcaacaccuaccagcuc

SEQ ID NO: 61646 - RNA, 27 nt, Artificial Sequence
  SH3 domain and tetratricopeptide repeat-containing protein 1 (740-748)
agccuggccggcucccucagaucugug

SEQ ID NO: 61647 - RNA, 33 nt, Artificial Sequence
  Kelch-like protein 21 (506-516)
agccuggccgugcucggcgggaagcuuuacguc

SEQ ID NO: 61648 - RNA, 30 nt, Artificial Sequence
  Insulin-degrading enzyme (224-233)
agccuggacgaucucaccaaccuugugguc

SEQ ID NO: 61649 - RNA, 27 nt, Artificial Sequence
  Bone morphogenetic protein receptor type-2 (221-229)
agccuggacgagagacccguggccguc

SEQ ID NO: 61650 - RNA, 30 nt, Artificial Sequence
  Glycogen debranching enzyme (835-844)
agccuggacccccacgcccagguggcuguc

SEQ ID NO: 61651 - RNA, 27 nt, Artificial Sequence
  Cullin-9 (676-684)
agccuggaccagcacguggccgcuguc

SEQ ID NO: 61652 - RNA, 27 nt, Artificial Sequence
  Protein RMD5 homolog B (28-36)
agccuggaggaacuccuucacuacgug

SEQ ID NO: 61653 - RNA, 27 nt, Artificial Sequence
  NAD(P)H dehydrogenase (quinone) 1 (155-163)
agccuguucgaccucaacuuucaggcc

SEQ ID NO: 61654 - RNA, 27 nt, Artificial Sequence
  Signal recognition particle 54 kDa protein (200-208)
agccuguucgaggaaaugcuccaggug

SEQ ID NO: 61655 - RNA, 30 nt, Artificial Sequence; identical to SEQ ID NO: 37428
  Zinc finger protein 451 (454-463)

SEQ ID NO: 61656 - RNA, 27 nt, Artificial Sequence
  Importin-8 (243-251)
agccuguucaaggaccagauggagcuc

SEQ ID NO: 61657 - RNA, 27 nt, Artificial Sequence
  Optineurin (302-310)
agccuguucaaggagcuccaggaagcc

SEQ ID NO: 61658 - RNA, 24 nt, Artificial Sequence
  Kelch domain-containing protein 10 (353-360)
agccuguucaagaucuggcucgug

SEQ ID NO: 61659 - RNA, 27 nt, Artificial Sequence
  Telomere-associated protein RIF1 (802-810)
agccuguucaagcucaucgugaaaguc

SEQ ID NO: 61660 - RNA, 27 nt, Artificial Sequence
  DNA polymerase alpha subunit B (295-303)
agccuguuccccggccagguggucauc

SEQ ID NO: 61661 - RNA, 33 nt, Artificial Sequence
  Lamin-B receptor (312-322)
agccuguuccagggcguggaguuucacuacguc

SEQ ID NO: 61662 - RNA, 33 nt, Artificial Sequence
  Renin receptor (103-113)
agccuguucuccgaggaaacccccgugguccuc

SEQ ID NO: 61663 - RNA, 30 nt, Artificial Sequence
  Ubiquitin-protein ligase E3C (505-514)
agccuguucucccacucucucaucucaauu

SEQ ID NO: 61664 - RNA, 27 nt, Artificial Sequence
  Cytoplasmic dynein 1 heavy chain 1 (2457-2465)
agccuguucuccaugcuccaccaggcc

SEQ ID NO: 61665 - RNA, 27 nt, Artificial Sequence
  Kelch-like protein 12 (364-372)
agccugcacgacagaaucuacgugauu

SEQ ID NO: 61666 - RNA, 27 nt, Artificial Sequence
  Cytochrome P450 20A1 (53-61)
agccugcacgaguuccucgugaaccuu

SEQ ID NO: 61667 - RNA, 27 nt, Artificial Sequence
  Ectopic P granules protein 5 homolog (837-845)
agccugcacuccgugaucauucagcuc

SEQ ID NO: 61668 - RNA, 27 nt, Artificial Sequence
  DNA-directed RNA polymerase I subunit RPA1 (382-390)
agccugaucgacaagcucuacaacauu

SEQ ID NO: 61669 - RNA, 33 nt, Artificial Sequence
  Structural maintenance of chromosomes protein 6 (601-611)
agccugaucgacaugagaggcauugagaccgug

SEQ ID NO: 61670 - RNA, 27 nt, Artificial Sequence
  Transmembrane protein 209 (11-19)
agccugaucgacagaaccauuaagaug

SEQ ID NO: 61671 - RNA, 27 nt, Artificial Sequence
  Cation channel sperm-associated protein 2 (33-41)
agccugaucgagcaccuccagggccuu

SEQ ID NO: 61672 - RNA, 27 nt, Artificial Sequence
  Mediator of RNA polymerase II transcription subunit 19 (129-137)
agccugaucgagaagcccccuauucuc

SEQ ID NO: 61673 - RNA, 27 nt, Artificial Sequence
  Nucleolar pre-ribosomal-associated protein 1 (1761-1769)
agccugaucgagagagaccucaagcuu

SEQ ID NO: 61674 - RNA, 27 nt, Artificial Sequence
  Solute carrier family 35 member C2 (14-22)
agccugaucuucaagcucgaggaacuu

SEQ ID NO: 61675 - RNA, 27 nt, Artificial Sequence
  Solute carrier family 35 member E1 (24-32)
agccugauccccauuauauccggcgug

SEQ ID NO: 61676 - RNA, 27 nt, Artificial Sequence
  Putative Polycomb group protein ASXL2 (835-843)
agccugaucagaauugugcccgucguu

SEQ ID NO: 61677 - RNA, 27 nt, Artificial Sequence
  Carboxypeptidase D (372-380)
agccugaucacccucauugagaaggug

SEQ ID NO: 61678 - RNA, 27 nt, Artificial Sequence
  Peroxisomal biogenesis factor 3 (201-209)
agccugcucgaccuugagcagaagcug

SEQ ID NO: 61679 - RNA, 27 nt, Artificial Sequence
  Zinc finger BED domain-containing protein 1 (280-288)
agccugcucgacguggccguccacaug

SEQ ID NO: 61680 - RNA, 27 nt, Artificial Sequence
  Kinesin-like protein KIF3A (470-478)
agccugcucgagaagcuuuccgcccug

SEQ ID NO: 61681 - RNA, 27 nt, Artificial Sequence
  Kinesin-like protein (557-565)
agccugcucaaggaccuugccgagauc

SEQ ID NO: 61682 - RNA, 27 nt, Artificial Sequence
  Phosphatidylinositol 4-phosphate 5-kinase type-1 alpha (312-320)
agccugcucauguccauccacaacauu

SEQ ID NO: 61683 - RNA, 27 nt, Artificial Sequence
  Claspin (1254-1262)
agccugcucaaccagcccaaggccgug

SEQ ID NO: 61684 - RNA, 33 nt, Artificial Sequence
  Sister chromatid cohesion protein PDS5 homolog A (36-46)
agccugcuccccgaguacguggucccuuauaug

SEQ ID NO: 61685 - RNA, 33 nt, Artificial Sequence
  Inositol 1,4,5-trisphosphate receptor type 1 (1393-1403)
agccugcucccccuugacgauaucgugagaguc

SEQ ID NO: 61686 - RNA, 27 nt, Artificial Sequence
  Lysosomal-trafficking regulator (78-86)
agccugcucccccuuguguggaagauc

SEQ ID NO: 61687 - RNA, 33 nt, Artificial Sequence
  Signal transducer and activator of transcription 2 (25-35)
agccugcuccccguggacaucagacaguaccuu

SEQ ID NO: 61688 - RNA, 27 nt, Artificial Sequence
  Cytoplasmic dynein 1 heavy chain 1 (3748-3756)
agccugcuccaggcccuuaacgaggug

SEQ ID NO: 61689 - RNA, 27 nt, Artificial Sequence
  Melanoma antigen preferentially expressed in tumors (425-433)
agccugcuccagcaccuuaucggccug

SEQ ID NO: 61690 - RNA, 30 nt, Artificial Sequence
  SH3KBP1-binding protein 1 (47-56)
agccugcucuccggcagaaucucuacccuu

SEQ ID NO: 61691 - RNA, 27 nt, Artificial Sequence
  Uncharacterized aarF domain-containing protein kinase 2 (132-140)
agccugcucuccucuguguucaagcuu

SEQ ID NO: 61692 - RNA, 27 nt, Artificial Sequence
  Transportin-3 (89-97)
agccugcucacccacauccagaaccuu

SEQ ID NO: 61693 - RNA, 27 nt, Artificial Sequence
  E3 ubiquitin-protein ligase TRIP12 (971-979)
agccugcucaccucccccccuaaggcc

SEQ ID NO: 61694 - RNA, 30 nt, Artificial Sequence
  Mediator of RNA polymerase II transcription subunit 24 (800-809)
agccugauggaccccccuggcaccgcccuc

SEQ ID NO: 61695 - RNA, 27 nt, Artificial Sequence
  CAP-Gly domain-containing linker protein 2 (873-881)
agccugaacgagcucagagugcuucug

SEQ ID NO: 61696 - RNA, 27 nt, Artificial Sequence
  Solute carrier family 35 member E4 (65-73)
agccugaacaaguggaucuucaccgug

SEQ ID NO: 61697 - RNA, 27 nt, Artificial Sequence
  Sestrin-3 (47-55)
agccugcccgagcucgugcacgccguc

SEQ ID NO: 61698 - RNA, 27 nt, Artificial Sequence
  Transmembrane protein 214 (435-443)
agccugcaggagaccauccaaucccuc

SEQ ID NO: 61699 - RNA, 27 nt, Artificial Sequence
  Centrosome-associated protein CEP250 (2189-2197)
agccugcaggagguggccauguuccuc

SEQ ID NO: 61700 - RNA, 27 nt, Artificial Sequence
  Heat shock protein HSP 90-beta (394-402)
agccuguccgaguacgugucuagaaug

SEQ ID NO: 61701 - RNA, 27 nt, Artificial Sequence
  Cell division cycle and apoptosis regulator protein 1 (1078-1086)
agccuguccggcgagcucagagaagug

SEQ ID NO: 61702 - RNA, 27 nt, Artificial Sequence
  RNA-binding protein 12B (105-113)
agccuguccaacuucaucgagucugug

SEQ ID NO: 61703 - RNA, 27 nt, Artificial Sequence
  Bromodomain adjacent to zinc finger domain protein 1A (1093-1101)
agccugucccagguguuccuccaccuu

SEQ ID NO: 61704 - RNA, 27 nt, Artificial Sequence
  Dehydrogenase/reductase SDR family member 1 (277-285)
agccuguccucugugcucucacacguc

SEQ ID NO: 61705 - RNA, 27 nt, Artificial Sequence
  Spectrin beta chain, erythrocytic (333-341)
agccugaccggcgugcagcaacagcuc

SEQ ID NO: 61706 - RNA, 30 nt, Artificial Sequence
  Conserved oligomeric Golgi complex subunit 4 (458-467)
agccugguggccgucgagcucgaaaagguu

SEQ ID NO: 61707 - RNA, 30 nt, Artificial Sequence
  Phospholipase A1 member A (341-350)
agccugguggaguuccaccucaaggaacuu

SEQ ID NO: 61708 - RNA, 27 nt, Artificial Sequence
  26S proteasome non-ATPase regulatory subunit 13 (75-83)
agccugguggagaucauucuccacguc

SEQ ID NO: 61709 - RNA, 27 nt, Artificial Sequence
  Cyclin-dependent-like kinase 5 (247-255)
agccuggugaacgucguucccaagcuc

SEQ ID NO: 61710 - RNA, 27 nt, Artificial Sequence
  Heat shock factor protein 2 (156-164)
agccuguggaaggagguguccgaacuc

SEQ ID NO: 61711 - RNA, 27 nt, Artificial Sequence
  GRIP and coiled-coil domain-containing protein 2 (689-697)
agccuguacgaggaaaacaauaagcuc

SEQ ID NO: 61712 - RNA, 27 nt, Artificial Sequence
  Centrosome-associated protein CEP250 (1184-1192)
agccuguacuccgcccuccagcaagcu

SEQ ID NO: 61713 - RNA, 27 nt, Artificial Sequence
  Serine/threonine-protein kinase TBK1 (413-421)
agcauggccaaggcuaucaccggcgug

SEQ ID NO: 61714 - RNA, 33 nt, Artificial Sequence
  Erlin-2 (158-168)
agcauggcccccggccuggugauccaggcuguc

SEQ ID NO: 61715 - RNA, 27 nt, Artificial Sequence
  SEC14-like protein 1 (203-211)
agcauggccguggucauccccgaggcu

SEQ ID NO: 61716 - RNA, 27 nt, Artificial Sequence
  Cullin-1 (79-87)
agcaugaucuccaagcugaaacaggcc

SEQ ID NO: 61717 - RNA, 27 nt, Artificial Sequence
  Ubiquitin conjugation factor E4 B (1278-1286)
agcaugcuggagcccgugccugaacuc

SEQ ID NO: 61718 - RNA, 27 nt, Artificial Sequence
  Antizyme inhibitor 1 (152-160)
agcaugaugaagaacuucuuuuucgug

SEQ ID NO: 61719 - RNA, 27 nt, Artificial Sequence
  Large proline-rich protein BAG6 (763-771)
agcaugguggacgucguuaugcugcuc

SEQ ID NO: 61720 - RNA, 30 nt, Artificial Sequence
  Band 4.1-like protein 3 (185-194)
agcauguacggcguggaccugcaccaugcc

SEQ ID NO: 61721 - RNA, 30 nt, Artificial Sequence; identical to SEQ ID NO: 37494
  Protein 4.1 (185-194)

SEQ ID NO: 61722 - RNA, 27 nt, Artificial Sequence
  A-kinase anchor protein 10, mitochondrial (278-286)
agccccgccuccccucugaaggagcuc

SEQ ID NO: 61723 - RNA, 30 nt, Artificial Sequence; identical to SEQ ID NO: 37496
  Beta-1-syntrophin (175-184)

SEQ ID NO: 61724 - RNA, 30 nt, Artificial Sequence
  Cytoplasmic dynein 1 heavy chain 1 (577-586)
agccccgacaagaucccuugguccgcccug

SEQ ID NO: 61725 - RNA, 27 nt, Artificial Sequence
  Ubiquitin carboxyl-terminal hydrolase 22 (237-245)
agcccccacaucccuuacaagcugcuc

SEQ ID NO: 61726 - RNA, 30 nt, Artificial Sequence
  ADNP homeobox protein 2 (336-345)
agcccccugccugugggccagaacucccuc

SEQ ID NO: 61727 - RNA, 33 nt, Artificial Sequence
  COUP transcription factor 2 (278-288)
agccccauguccgccgacagaguggucgcuuuc

SEQ ID NO: 61728 - RNA, 27 nt, Artificial Sequence
  Ubiquitin carboxyl-terminal hydrolase 6 (1192-1200)
agccccaacuccucuccuagaacccug

SEQ ID NO: 61729 - RNA, 27 nt, Artificial Sequence
  Ubiquitin-associated protein 2-like (477-485)
agcccccagccugcccaacagaagcug

SEQ ID NO: 61730 - RNA, 30 nt, Artificial Sequence
  Acyl-CoA desaturase (281-290)
agccccagagagaacauccuggugucccuc

SEQ ID NO: 61731 - RNA, 27 nt, Artificial Sequence
  U3 small nucleolar RNA-associated protein 18 homolog (367-375)
agccccagauccggcuacuucgcccug

SEQ ID NO: 61732 - RNA, 30 nt, Artificial Sequence
  Integrator complex subunit 7 (289-298)
agccccagauccucugaccuggugaagcuc

SEQ ID NO: 61733 - RNA, 27 nt, Artificial Sequence
  Protein Wiz (5-13)
agccccucccugccuaagaaaucucuc

SEQ ID NO: 61734 - RNA, 27 nt, Artificial Sequence
  Mediator of DNA damage checkpoint protein 1 (1786-1794)
agccagauccaaaagguggagcccgcc

SEQ ID NO: 61735 - RNA, 30 nt, Artificial Sequence
  DNA-directed RNA polymerases I, II, and III subunit RPABC3 (47-56)
agcagagccgaccaguucgaguacgugaug

SEQ ID NO: 61736 - RNA, 27 nt, Artificial Sequence
  Mitochondrial fission factor (5-13)
agcagaauccaguacgagauggaauau

SEQ ID NO: 61737 - RNA, 27 nt, Artificial Sequence
  Histone H2B type 2-F (33-41)
agcagaaaggaguccuacucuguguau

SEQ ID NO: 61738 - RNA, 33 nt, Artificial Sequence
  Solute carrier family 35 member E1 (251-261)
agcagacaguccuaccccaacucuuauucacug

SEQ ID NO: 61739 - RNA, 27 nt, Artificial Sequence
  Mucin-1 (950-958)
agcaccgcccccccugugcacaacguc

SEQ ID NO: 61740 - RNA, 33 nt, Artificial Sequence; identical to SEQ ID NO: 37513
  T-complex protein 1 subunit beta (333-343)

SEQ ID NO: 61741 - RNA, 27 nt, Artificial Sequence
  Exosome complex component RRP4 (55-63)
agcguggccggcuccgucgagagaguu

SEQ ID NO: 61742 - RNA, 27 nt, Artificial Sequence
  Rho guanine nucleotide exchange factor 18 (538-546)
agcguggacuccaagcccccugucauc

SEQ ID NO: 61743 - RNA, 27 nt, Artificial Sequence
  PDZ domain-containing protein GIPC1 (87-95)
agcgugaucgaccacauucaucugaua

SEQ ID NO: 61744 - RNA, 33 nt, Artificial Sequence
  Programmed cell death 6-interacting protein (423-433)
agcgugaucgagcagggcgggauucaaaccguc

SEQ ID NO: 61745 - RNA, 27 nt, Artificial Sequence
  Nucleolar pre-ribosomal-associated protein 1 (1313-1321)
agcgugcuggaccagaagauccuccuu

SEQ ID NO: 61746 - RNA, 27 nt, Artificial Sequence
  Serine incorporator 1 (244-252)
agcgugauguccauccugcccaagauu

SEQ ID NO: 61747 - RNA, 27 nt, Artificial Sequence
  Heterogeneous nuclear ribonucleoprotein K (372-380)
agcuacgccggcgggagaggauccuau

SEQ ID NO: 61748 - RNA, 27 nt, Artificial Sequence
  Nectin-2 (494-502)
agcuaccagggcaagggguucgugaug

SEQ ID NO: 61749 - RNA, 27 nt, Artificial Sequence
  Transcription intermediary factor 1-beta (33-41)
accgccgacagccagcccccuguguuc

SEQ ID NO: 61750 - RNA, 27 nt, Artificial Sequence
  Phosphatidylinositol 4-kinase alpha (299-307)
accgagaucgaaagacugauuacaugg

SEQ ID NO: 61751 - RNA, 30 nt, Artificial Sequence
  Phosphatidylinositol 4-kinase alpha (299-308)
accgagaucgaaagacugauuacaugguac

SEQ ID NO: 61752 - RNA, 33 nt, Artificial Sequence
  Putative oxidoreductase GLYR1 (385-395)
accaucgccgagggccugacacucgcucaggug

SEQ ID NO: 61753 - RNA, 27 nt, Artificial Sequence
  Phosphopantothenate-cysteine ligase (151-159)
acccuggccgacuaccuccaccuucug

SEQ ID NO: 61754 - RNA, 30 nt, Artificial Sequence
  Paraspeckle component 1 (128-137)
acccuggccgagaucgcuaaggcagaacuc

SEQ ID NO: 61755 - RNA, 27 nt, Artificial Sequence
  Tumor necrosis factor receptor superfamily member 6 (305-313)
acccuggccgagaagauccagacaauu

SEQ ID NO: 61756 - RNA, 27 nt, Artificial Sequence
  Vacuolar protein sorting-associated protein 29 (57-65)
acccuggccggcgacgugcacaucguc

SEQ ID NO: 61757 - RNA, 27 nt, Artificial Sequence
  Nuclear transcription factor Y subunit gamma (147-155)
acccuggcccagcaacccacagcugug

SEQ ID NO: 61758 - RNA, 30 nt, Artificial Sequence
  Pre-mRNA-splicing factor ATP-dependent RNA helicase DHX15 (266-275)
acccuggccacagacauccucaugggcgug

SEQ ID NO: 61759 - RNA, 27 nt, Artificial Sequence
  Heat shock cognate 71 kDa protein (313-321)
acccuggaccccguggagaaggcccuc

SEQ ID NO: 61760 - RNA, 27 nt, Artificial Sequence
  EMILIN-2 (411-419)
acccuggaccagaagaucgagagagug

SEQ ID NO: 61761 - RNA, 27 nt, Artificial Sequence
  Ubiquitin carboxyl-terminal hydrolase 33 (252-260)
acccuguuccagggcaucaagacagug

SEQ ID NO: 61762 - RNA, 27 nt, Artificial Sequence
  Cyclic AMP-responsive element-binding protein 1 (213-221)
acccugaucgaggaacucaaggcccuu

SEQ ID NO: 61763 - RNA, 30 nt, Artificial Sequence
  Mediator of RNA polymerase II transcription subunit 14 (53-62)
acccugaucgaguuccuccuucacagagcc

SEQ ID NO: 61764 - RNA, 27 nt, Artificial Sequence
  Histone-lysine N-methyltransferase 2B (517-525)
acccugaucgagaaggugcaggaagcc

SEQ ID NO: 61765 - RNA, 30 nt, Artificial Sequence
  Protein arginine N-methyltransferase 3 (288-297)
acccugaucaagggcaaaauugaggaagug

SEQ ID NO: 61766 - RNA, 27 nt, Artificial Sequence
  UDP-N-acetylglucosamine-dolichyl-phosphate N-acetylglucosaminephosphotransferase (255-263)
acccugaucaaccuccuucugaaggug

SEQ ID NO: 61767 - RNA, 33 nt, Artificial Sequence
  Peroxisomal acyl-coenzyme A oxidase 1 (597-607)
acccugaucagaagcgacgccguggcucucguc

SEQ ID NO: 61768 - RNA, 27 nt, Artificial Sequence
  Ubiquitin-like modifier-activating enzyme 6 (967-975)
acccugcucgacuucaucaacgccgug

SEQ ID NO: 61769 - RNA, 27 nt, Artificial Sequence
  Coronin (508-516)
acccugcucgaggaaaucaaggcccuu

SEQ ID NO: 61770 - RNA, 27 nt, Artificial Sequence
  Signal-induced proliferation-associated protein 1 (365-373)
acccugcucggcgacguggucagacuu

SEQ ID NO: 61771 - RNA, 27 nt, Artificial Sequence
  2-hydroxyacyl-CoA lyase 1 (238-246)
acccugcucggcaacauccacgccgug

SEQ ID NO: 61772 - RNA, 30 nt, Artificial Sequence
  Pecanex-like protein 1 (955-964)
acccugcucaucggcagcccccuuucccug

SEQ ID NO: 61773 - RNA, 27 nt, Artificial Sequence
  Kelch-like protein 22 (490-498)
acccugcucaacaagcuuuacgugauc

SEQ ID NO: 61774 - RNA, 27 nt, Artificial Sequence
  AP-2 complex subunit beta (483-491)
acccugcucacagccaucgugaagcuu

SEQ ID NO: 61775 - RNA, 27 nt, Artificial Sequence
  Vacuolar protein sorting-associated protein 11 homolog (911-919)
acccugcucacagaccccccuacugcc

SEQ ID NO: 61776 - RNA, 27 nt, Artificial Sequence
  Fanconi anemia group I protein (1140-1148)
acccugcucacauucuuucacgagcuu

SEQ ID NO: 61777 - RNA, 27 nt, Artificial Sequence
  1-phosphatidylinositol 4,5-bisphosphate phosphodiesterase gamma-1 (436-444)
acccugcucacaaagcccguggagauc

SEQ ID NO: 61778 - RNA, 30 nt, Artificial Sequence
  Pre-mRNA-processing factor 6 (249-258)
acccugauggacaugagacucagccaggug

SEQ ID NO: 61779 - RNA, 30 nt, Artificial Sequence
  Transgelin-2 (128-137)
acccugaugaaccucggcgggcuugccgug

SEQ ID NO: 61780 - RNA, 27 nt, Artificial Sequence
  Cleft lip and palate transmembrane protein 1 (101-109)
acccugaugaaccuccacguguacauc

SEQ ID NO: 61781 - RNA, 27 nt, Artificial Sequence
  Nuclear receptor-binding protein (524-532)
acccugaacagcgccgcugugacaguc

SEQ ID NO: 61782 - RNA, 27 nt, Artificial Sequence
  Acylglycerol kinase, mitochondrial (127-135)
acccugcaggagguggucacaggcguu

SEQ ID NO: 61783 - RNA, 27 nt, Artificial Sequence
  Baculoviral IAP repeat-containing protein 6 (1801-1809)
acccugagcgacgugcucgauagaguc

SEQ ID NO: 61784 - RNA, 27 nt, Artificial Sequence
  Lysine-specific demethylase 5C (849-857)
acccugacagagcucagagccuuccuu

SEQ ID NO: 61785 - RNA, 27 nt, Artificial Sequence
  Cytochrome b-c1 complex subunit 9 (5-13)
acccugacaagcaagcucuacucccuu

SEQ ID NO: 61786 - RNA, 27 nt, Artificial Sequence
  Putative helicase MOV-10 (131-139)
acccugguggaggccaucaagcagguc

SEQ ID NO: 61787 - RNA, 27 nt, Artificial Sequence
  Transmembrane protein 9B (3-11)
acccuguggggcgggcuccuuagacug

SEQ ID NO: 61788 - RNA, 27 nt, Artificial Sequence
  Trafficking protein particle complex subunit 9 (207-215)
acccuguacgacagcagacucuucgug

SEQ ID NO: 61789 - RNA, 30 nt, Artificial Sequence
  Transmembrane protein 214 (42-51)
acccuguacgagagaggcuucgaaaacauc

SEQ ID NO: 61790 - RNA, 27 nt, Artificial Sequence
  Exportin-6 (594-602)
acccuguacggcagccagaucaagcuc

SEQ ID NO: 61791 - RNA, 33 nt, Artificial Sequence
  Insulin-like growth factor 2 mRNA-binding protein 1 (319-329)
acccuguacaaccccgagagaacaaucacugug

SEQ ID NO: 61792 - RNA, 30 nt, Artificial Sequence
  AP-1 complex subunit beta-1 (827-836)
acccuguacccccuccacauccuuuucgug

SEQ ID NO: 61793 - RNA, 27 nt, Artificial Sequence
  Syntaxin-binding protein 3 (176-184)
accauggccgaccagaucgugacaguc

SEQ ID NO: 61794 - RNA, 27 nt, Artificial Sequence
  Actin-like protein 6A (279-287)
accaugcugggcgugagccacgucguu

SEQ ID NO: 61795 - RNA, 27 nt, Artificial Sequence
  Tartrate-resistant acid phosphatase type 5 (23-31)
acccccgcccugagauucguggcuguc

SEQ ID NO: 61796 - RNA, 30 nt, Artificial Sequence
  Eukaryotic translation initiation factor 2A (542-551)
acccccagaaacacagugagccaguccauc

SEQ ID NO: 61797 - RNA, 27 nt, Artificial Sequence
  Intron-binding protein aquarius (396-404)
accacauucgacaaggaguuucugcuc

SEQ ID NO: 61798 - RNA, 33 nt, Artificial Sequence
  Elongation factor 2 (486-496)
accacauucgagcacgcccauaacaugagagug

SEQ ID NO: 61799 - RNA, 27 nt, Artificial Sequence
  Nuclear factor of activated T-cells, cytoplasmic 1 (325-333)
accacacuggagcagcccccuagcgug

SEQ ID NO: 61800 - RNA, 27 nt, Artificial Sequence
  Chromatin complexes subunit BAP18 (72-80)
accguggcccagaucaaggcuacaguc

SEQ ID NO: 61801 - RNA, 27 nt, Artificial Sequence
  Kelch-like protein 18 (361-369)
accguguucgagggcagaaucuacguc

SEQ ID NO: 61802 - RNA, 27 nt, Artificial Sequence
  Ubiquitin carboxyl-terminal hydrolase 10 (731-739)
accuacagacuguucgccguggucuau

SEQ ID NO: 61803 - RNA, 27 nt, Artificial Sequence
  Dolichyl-diphosphooligosaccharide-proteinosyltransferase 48 kDa subunit (203-211)
guggccgaccccgauaacccucugguc

SEQ ID NO: 61804 - RNA, 30 nt, Artificial Sequence
  Chromodomain-helicase-DNA-binding protein 4 (243-252)
guggcccccccuccaccgcccgucgagguu

SEQ ID NO: 61805 - RNA, 30 nt, Artificial Sequence
  Glycogen phosphorylase, liver form (207-216)
guggagcacaccaacacaggcacuaagugg

SEQ ID NO: 61806 - RNA, 33 nt, Artificial Sequence
  Prelamin-A/C (78-88)
guggagaucgacaacggcaagcagagagaauuc

SEQ ID NO: 61807 - RNA, 27 nt, Artificial Sequence
  GPI transamidase component PIG-T (292-300)
gugcaccccccuccaaccacaacuuac

SEQ ID NO: 61808 - RNA, 27 nt, Artificial Sequence
  Probable ATP-dependent RNA helicase DDX60-like (866-874)
gugaucuucgacgagguccacuaccug

SEQ ID NO: 61809 - RNA, 27 nt, Artificial Sequence
  Platelet-activating factor acetylhydrolase IB subunit alpha (114-122)
gugaucuuccaccccgucuuuagcguu

SEQ ID NO: 61810 - RNA, 27 nt, Artificial Sequence
  ORM1-like protein 2 (54-62)
gugauccacaaccuggccaccuacguc

SEQ ID NO: 61811 - RNA, 27 nt, Artificial Sequence
  Mediator of RNA polymerase II transcription subunit 23 (140-148)
gugauccuggagaagauucucaccaua

SEQ ID NO: 61812 - RNA, 27 nt, Artificial Sequence
  Protein Mis18-beta (88-96)
gugcuggccgacagcguccaccucgcu

SEQ ID NO: 61813 - RNA, 33 nt, Artificial Sequence
  Guanine nucleotide-binding protein G(i) subunit alpha-1 (233-243)
gugcuggccgaggacgaagagaugaacagaaug

SEQ ID NO: 61814 - RNA, 27 nt, Artificial Sequence
  Bromodomain adjacent to zinc finger domain protein 2A (972-980)
gugcuggccuuccucguccacgagcuu

SEQ ID NO: 61815 - RNA, 33 nt, Artificial Sequence
  Disheveled-associated activator of morphogenesis 2 (194-204)
gugcuggcccagcccgaggcuaucagcaccauu

SEQ ID NO: 61816 - RNA, 27 nt, Artificial Sequence
  DNA repair protein RAD50 (1068-1076)
gugcuggccagccucaucauuagacuu

SEQ ID NO: 61817 - RNA, 30 nt, Artificial Sequence
  Cytoplasmic dynein 1 heavy chain 1 (2318-2327)
gugcuggacgauaacaagcuccuuacccug

SEQ ID NO: 61818 - RNA, 30 nt, Artificial Sequence
  Cytoplasmic FMR1-interacting protein 2 (170-179)
gugcuggacgagcucaagaacaugaaaugc

SEQ ID NO: 61819 - RNA, 27 nt, Artificial Sequence
  Serrate RNA effector molecule homolog (161-169)
gugcuggacaagcuccuucuguacuug

SEQ ID NO: 61820 - RNA, 27 nt, Artificial Sequence
  Protein transport protein Sec61 subunit alpha isoform 1 (354-362)
gugcuggaggaccccguccacgccguu

SEQ ID NO: 61821 - RNA, 30 nt, Artificial Sequence
  HLA class I histocompatibility antigen, A-2 alpha chain (291-300)
gugcuguucggcgccgucaucaccggggcu

SEQ ID NO: 61822 - RNA, 30 nt, Artificial Sequence; identical to SEQ ID NO: 37595
  Fatty acid synthase (743-752)

SEQ ID NO: 61823 - RNA, 27 nt, Artificial Sequence
  Protein VAC14 homolog (32-40)
gugcugggcgaguuccucaaggaaauc

SEQ ID NO: 61824 - RNA, 27 nt, Artificial Sequence
  Mediator of RNA polymerase II transcription subunit 23 (1163-1171)
gugcugcacgacagaaucgucagcguu

SEQ ID NO: 61825 - RNA, 33 nt, Artificial Sequence
  GPN-loop GTPase 1 (103-113)
gugcugaucgacacccccggccagauugagguc

SEQ ID NO: 61826 - RNA, 27 nt, Artificial Sequence
  Adenosylhomocysteinase (62-70)
gugcugaucgagacccucgucacacuu

SEQ ID NO: 61827 - RNA, 33 nt, Artificial Sequence
  Splicing factor 3B subunit 3 (959-969)
gugcugaucggcgucgggaagcuccuuagaguu

SEQ ID NO: 61828 - RNA, 30 nt, Artificial Sequence
  Membrane-bound transcription factor site-2 protease (164-173)
gugcugaucagcggcgucguucacgagauu

SEQ ID NO: 61829 - RNA, 27 nt, Artificial Sequence
  Cytoplasmic FMR1-interacting protein 2 (505-513)
gugcugaucagcguccuccaggccauu

SEQ ID NO: 61830 - RNA, 27 nt, Artificial Sequence
  Putative helicase MOV-10 (216-224)
gugcugaucaccacacucauuacugcc

SEQ ID NO: 61831 - RNA, 33 nt, Artificial Sequence
  Ubiquitin-like protein 4A (77-87)
gugcugcucgaggaaggcgaggcccagagacuu

SEQ ID NO: 61832 - RNA, 33 nt, Artificial Sequence
  Cleavage stimulation factor subunit 1 (368-378)
gugcugcuccccgacgagagaaccaucagccuu

SEQ ID NO: 61833 - RNA, 27 nt, Artificial Sequence
  Glycerol-3-phosphate acyltransferase 3 (155-163)
gugcugcucccccuuagagucacccug

SEQ ID NO: 61834 - RNA, 27 nt, Artificial Sequence
  Eukaryotic translation initiation factor 4 gamma 3 (1360-1368)
gugcugcucagcgagauccuucaccug

SEQ ID NO: 61835 - RNA, 27 nt, Artificial Sequence
  Vesicle-trafficking protein SEC22b (2-10)
gugcugcucaccaugaucgccagaguc

SEQ ID NO: 61836 - RNA, 27 nt, Artificial Sequence
  Probable ATP-dependent RNA helicase DDX41 (543-551)
gugcugauggaccucaaggcccuucug

SEQ ID NO: 61837 - RNA, 30 nt, Artificial Sequence
  Probable ATP-dependent RNA helicase DDX41 (543-552)
gugcugauggaccucaaggcccuucuguug

SEQ ID NO: 61838 - RNA, 30 nt, Artificial Sequence
  Sterol regulatory element-binding protein 1 (412-421)
gugcugauggagggcgucaagaccgaaguu

SEQ ID NO: 61839 - RNA, 27 nt, Artificial Sequence
  Cytoskeleton-associated protein 5 (1259-1267)
gugcugaugaaggcccucgaguaccuu

SEQ ID NO: 61840 - RNA, 27 nt, Artificial Sequence
  Eukaryotic translation initiation factor 4 gamma 1 (187-195)
gugcugaugaaccagcccccucaaauc

SEQ ID NO: 61841 - RNA, 30 nt, Artificial Sequence
  Ubiquitin-like protein 7 (159-168)
gugcugcaggacaaggaucucuucagcguc

SEQ ID NO: 61842 - RNA, 27 nt, Artificial Sequence
  Zinc finger CCCH-type antiviral protein 1 (112-120)
gugcugagcgaggaaaacuucaagguc

SEQ ID NO: 61843 - RNA, 27 nt, Artificial Sequence
  Probable ubiquitin carboxyl-terminal hydrolase FAF-X (2317-2325)
gugcugagcgagcuccuuuggcagguc

SEQ ID NO: 61844 - RNA, 27 nt, Artificial Sequence
  Phosphatidylinositol N-acetylglucosaminyltransferase subunit A (165-173)
gugcugaccaacaagcuccuuacaguc

SEQ ID NO: 61845 - RNA, 27 nt, Artificial Sequence
  UPF0505 protein C16orf62 (670-678)
gugcugguccagcucauccacagcguu

SEQ ID NO: 61846 - RNA, 30 nt, Artificial Sequence
  Coiled-coil domain-containing protein 84 (84-93)
gugcuguacggcgggcuccuugagcaccug

SEQ ID NO: 61847 - RNA, 30 nt, Artificial Sequence
  Signal recognition particle subunit SRP68 (231-240)
gugcuguacaaccagagagucgaggaaauc

SEQ ID NO: 61848 - RNA, 27 nt, Artificial Sequence
  BTB/POZ domain-containing protein 2 (212-220)
gugauguucaaggagcccgucgaaguu

SEQ ID NO: 61849 - RNA, 30 nt, Artificial Sequence; identical to SEQ ID NO: 37622
  Ligand-dependent nuclear receptor-interacting factor 1 (358-367)

SEQ ID NO: 61850 - RNA, 30 nt, Artificial Sequence
  Poly(rC)-binding protein 2 (165-174)
gugaugcuggagagccccccuaagggcguc

SEQ ID NO: 61851 - RNA, 27 nt, Artificial Sequence
  Vesicle-associated membrane protein 4 (66-74)
gugaugcaggagaacaucaccaagguc

SEQ ID NO: 61852 - RNA, 30 nt, Artificial Sequence
  Transient receptor potential cation channel subfamily V member 2 (730-739)
gugcccagaacccuggagaacccuguccuc

SEQ ID NO: 61853 - RNA, 27 nt, Artificial Sequence
  UPF0606 protein KIAA1549L (15-23)
gugcccagccugcacaucaccacacuc

SEQ ID NO: 61854 - RNA, 27 nt, Artificial Sequence
  Cholinesterase (308-316)
gugcccuacggcaccccucugagcguc

SEQ ID NO: 61855 - RNA, 27 nt, Artificial Sequence
  Phosphatidylglycerophosphatase and protein-tyrosine phosphatase 1 (6-14)
gugcaggacgagaacgucagaggcguu

SEQ ID NO: 61856 - RNA, 30 nt, Artificial Sequence
  Pre-mRNA-processing-splicing factor 8 (1168-1177)
gugcagugggagaacagcuucgucuccguu

SEQ ID NO: 61857 - RNA, 24 nt, Artificial Sequence
  Nucleoprotein TPR (1846-1853)
gugagcgacgauaccgucgagaug

SEQ ID NO: 61858 - RNA, 24 nt, Artificial Sequence
  Proliferating cell nuclear antigen (111-118)
gugagcgacuacgagaugaagcug

SEQ ID NO: 61859 - RNA, 27 nt, Artificial Sequence
  SHC-transforming protein 1 (77-85)
gugaccagagaggccaucagccugguc

SEQ ID NO: 61860 - RNA, 27 nt, Artificial Sequence
  Uncharacterized protein C11orf24 (396-404)
guggucgacaagacccugcuccuuguu

SEQ ID NO: 61861 - RNA, 27 nt, Artificial Sequence
  Protein SZT2 (1295-1303)
guggucuggggcaccguuaucagagug

SEQ ID NO: 61862 - RNA, 27 nt, Artificial Sequence
  N-alpha-acetyltransferase 20 (118-126)
guguacagaaccgucaucgaguauuac

SEQ ID NO: 61863 - RNA, 27 nt, Artificial Sequence
  E3 ubiquitin-protein ligase UBR5 (446-454)
uggguggacgagacccugagcuccguc

SEQ ID NO: 61864 - RNA, 27 nt, Artificial Sequence
  60S ribosomal protein L32 (95-103)
uacugcgccgagaucgcucacaacgug

SEQ ID NO: 61865 - RNA, 27 nt, Artificial Sequence
  EF-hand calcium-binding domain-containing protein 7 (548-556)
uacgagaacaucauugugcacaccuau

SEQ ID NO: 61866 - RNA, 27 nt, Artificial Sequence
  Catenin beta-1 (489-497)
uacggccugcccguggucguuaagcuc

SEQ ID NO: 61867 - RNA, 30 nt, Artificial Sequence
  Signal recognition particle subunit SRP68 (333-342)
uacauccuggagggcgaacccgggaaggug

SEQ ID NO: 61868 - RNA, 27 nt, Artificial Sequence
  Protein timeless homolog (772-780)
uacauccugggcaaguucuuugcccuc

SEQ ID NO: 61869 - RNA, 27 nt, Artificial Sequence
  Glucose-fructose oxidoreductase domain-containing protein 2 (181-189)
uacaucguggaccugcucacccaccuu

SEQ ID NO: 61870 - RNA, 27 nt, Artificial Sequence
  Kelch repeat and BTB domain-containing protein 4 (141-149)
uacaucuaucacggcaccgugaagcug

SEQ ID NO: 61871 - RNA, 27 nt, Artificial Sequence
  FACT complex subunit SSRP1 (232-240)
uacaagauccccuauaccacagugcug

SEQ ID NO: 61872 - RNA, 27 nt, Artificial Sequence
  Nucleolar protein 6 (206-214)
uaccuggcccaccucgcucaucaccuu

SEQ ID NO: 61873 - RNA, 30 nt, Artificial Sequence
  NAD kinase (302-311)
uaccuggacggccaccucaucaccacagug

SEQ ID NO: 61874 - RNA, 30 nt, Artificial Sequence
  S-phase kinase-associated protein 1 (33-42)
uaccuggacaucaagggccuccuugaugug

SEQ ID NO: 61875 - RNA, 27 nt, Artificial Sequence
  Transcription cofactor vestigial-like protein 4 (13-21)
uaccuggacaagaugaacaauaacauc

SEQ ID NO: 61876 - RNA, 27 nt, Artificial Sequence
  Zinc finger protein 655 (93-101)
uaccuggaccccgugcagagagaucuc

SEQ ID NO: 61877 - RNA, 30 nt, Artificial Sequence
  Methyltransferase-like protein 9 (41-50)
uaccuggaccagggcacccaaaucuuccuc

SEQ ID NO: 61878 - RNA, 27 nt, Artificial Sequence
  Ubiquitin-conjugating enzyme E2 variant 3 (132-140)
uaccuggacgugguccagagcaacguu

SEQ ID NO: 61879 - RNA, 27 nt, Artificial Sequence
  Nuclear factor erythroid 2-related factor 3 (299-307)
uaccuggaggacaccgauagaaaccuc

SEQ ID NO: 61880 - RNA, 27 nt, Artificial Sequence
  MKI67 FHA domain-interacting nucleolar phosphoprotein (43-51)
uaccuguucggcgagagacuccuugaa

SEQ ID NO: 61881 - RNA, 33 nt, Artificial Sequence
  Pyridoxal-dependent decarboxylase domain-containing protein 1 (347-357)
uaccugggccucgacggguucguggagagaauc

SEQ ID NO: 61882 - RNA, 30 nt, Artificial Sequence
  Unconventional myosin-Id (612-621)
uaccugggccuccuugagaacgugagaguc

SEQ ID NO: 61883 - RNA, 27 nt, Artificial Sequence
  60S ribosomal protein L13a (137-145)
uaccugggcagacucgcccacgaggug

SEQ ID NO: 61884 - RNA, 27 nt, Artificial Sequence
  Ubiquitin-like domain-containing CTD phosphatase 1 (165-173)
uaccugcacgaguuccucaccagcgcc

SEQ ID NO: 61885 - RNA, 27 nt, Artificial Sequence
  Vam6/Vps39-like protein (368-376)
uaccugcacaccaacguggcccucguc

SEQ ID NO: 61886 - RNA, 27 nt, Artificial Sequence
  GTP-binding protein 2 (227-235)
uaccugcacaccacaaucuucggccuc

SEQ ID NO: 61887 - RNA, 30 nt, Artificial Sequence
  Isoleucine-tRNA ligase, cytoplasmic (626-635)
uaccugaucaacagccccguggucagagcc

SEQ ID NO: 61888 - RNA, 30 nt, Artificial Sequence
  Pre-mRNA-processing-splicing factor 8 (794-803)
uaccugaaggacggccccuauaucaccgcc

SEQ ID NO: 61889 - RNA, 30 nt, Artificial Sequence
  E3 ubiquitin-protein ligase MARCH6 (514-523)
uaccugcucgaccuucacagcuaucuguug

SEQ ID NO: 61890 - RNA, 30 nt, Artificial Sequence
  Ninein (544-553)
uaccugcucgaggaaaagaucgccagccuu

SEQ ID NO: 61891 - RNA, 27 nt, Artificial Sequence
  Unconventional myosin-Va (242-250)
uaccugcucgagaagagcagagugguc

SEQ ID NO: 61892 - RNA, 30 nt, Artificial Sequence; identical to SEQ ID NO: 37665
  EH domain-containing protein 4 (80-89)

SEQ ID NO: 61893 - RNA, 27 nt, Artificial Sequence
  Protein fem-1 homolog A (168-176)
uaccugcucgagcagggcgcccaagug

SEQ ID NO: 61894 - RNA, 27 nt, Artificial Sequence
  PCI domain-containing protein 2 (252-260)
uaccugcuccccgugaagaugcuucug

SEQ ID NO: 61895 - RNA, 27 nt, Artificial Sequence
  Pecanex-like protein 3 (1380-1388)
uaccugaacgcccucgugcaccuuauc

SEQ ID NO: 61896 - RNA, 27 nt, Artificial Sequence
  Malignant T-cell-amplified sequence 1 (170-178)
uaccugaacgacggccucuggcacaug

SEQ ID NO: 61897 - RNA, 27 nt, Artificial Sequence
  Elongation factor 2 (171-179)
uaccugaacgagaucaaggacagcgug

SEQ ID NO: 61898 - RNA, 33 nt, Artificial Sequence
  H/ACA ribonucleoprotein complex subunit 3 (6-16)
uaccugaacgagcagggcgacagaguguauacc

SEQ ID NO: 61899 - RNA, 27 nt, Artificial Sequence
  Ferritin heavy chain (11-19)
uaccugaacgagcaggugaaggccauc

SEQ ID NO: 61900 - RNA, 30 nt, Artificial Sequence; identical to SEQ ID NO: 37673
  T-complex protein 1 subunit theta (278-287)

SEQ ID NO: 61901 - RNA, 27 nt, Artificial Sequence
  Probable C-mannosyltransferase DPY19L1 (356-364)
uaccugaccagcaagaucuucggcauu

SEQ ID NO: 61902 - RNA, 27 nt, Artificial Sequence
  Circadian clock protein PASD1 (168-176)
uaccuggugggcaacgucugcauccuc

SEQ ID NO: 61903 - RNA, 27 nt, Artificial Sequence
  Protocadherin beta-6 (446-454)
uaccuggugaccaaggucguugccgug

SEQ ID NO: 61904 - RNA, 27 nt, Artificial Sequence
  Myotubularin-related protein 4 (250-258)
uaccuggugaccagcaucgccaaggcu

SEQ ID NO: 61905 - RNA, 30 nt, Artificial Sequence
  F-actin-capping protein subunit beta (120-129)
uaccugugggaccucgaucacggcuucgcc

SEQ ID NO: 61906 - RNA, 27 nt, Artificial Sequence
  Growth arrest and DNA damage-inducible protein GADD45 alpha (118-126)
uacauggaccagugggugcccgucauc

SEQ ID NO: 61907 - RNA, 27 nt, Artificial Sequence
  Signal transducing adapter molecule 2 (404-412)
uacaugggccagagcauccaccaagug

SEQ ID NO: 61908 - RNA, 33 nt, Artificial Sequence
  SWI/SNF-related matrix-associated actin-dependent regulator of chromatin subfamily B member 1 (26-36)
uacaugaucggcagcgagguggggaacuaucug

SEQ ID NO: 61909 - RNA, 30 nt, Artificial Sequence
  Serine palmitoyltransferase small subunit A (24-33)
uacaugcuggagcccugggaaagaaccgug

SEQ ID NO: 61910 - RNA, 27 nt, Artificial Sequence
  Kinetochore protein Nuf2 (65-73)
uacaugaugcccgugaacagcgagguc

SEQ ID NO: 61911 - RNA, 27 nt, Artificial Sequence
  G patch domain-containing protein 11 (33-41)
uacaugagcgacuccuucaucaacgug

SEQ ID NO: 61912 - RNA, 27 nt, Artificial Sequence
  Transcription factor SOX-8 (6-14)
uacccccaccugcauaacgccgagcuc

SEQ ID NO: 61913 - RNA, 27 nt, Artificial Sequence
  Immunoglobulin-binding protein 1 (259-267)
uaccccagccugccuaccaugacagug

SEQ ID NO: 61914 - RNA, 33 nt, Artificial Sequence
  RNA-binding motif protein 22 (253-263)
uaccaguucggcgagaucagaaccauuacagug

SEQ ID NO: 61915 - RNA, 27 nt, Artificial Sequence
  NADH dehydrogenase (ubiquinone) iron-sulfur protein 2, mitochondrial (245-253)
uaccaguucagcaagaacuuuucccug

SEQ ID NO: 61916 - RNA, 27 nt, Artificial Sequence
  GRB2-associated-binding protein 2 (324-332)
uaccagauccccagaaccuucacacug

SEQ ID NO: 61917 - RNA, 27 nt, Artificial Sequence
  Copper-transporting ATPase 1 (1410-1418)
uacagaaagcccaccuaugagagcuac

SEQ ID NO: 61918 - RNA, 33 nt, Artificial Sequence
  Tuberin (602-612)
uacacccugcccaucgccagcuccauuagacuc

SEQ ID NO: 61919 - RNA, 27 nt, Artificial Sequence
  Heterogeneous nuclear ribonucleoprotein U-like protein 1 (797-805)
uacacccccccuccaccgcccacagcc

SEQ ID NO: 61920 - RNA, 27 nt, Artificial Sequence
  PAS domain-containing serine/threonine-protein kinase (890-898)
uacaccugggaggaaguguucagaguc

SEQ ID NO: 61921 - RNA, 48 nt, Artificial Sequence
  Selenoprotein H (51-66)
gccgcugcacugagccaggcccucagacuugaggcgcccgaacugccu

SEQ ID NO: 61922 - RNA, 45 nt, Artificial Sequence
  40S ribosomal protein S26 (47-61)
gccgcugcagugagagacaucagcgaggccuccgucuucgaugcg

SEQ ID NO: 61923 - RNA, 51 nt, Artificial Sequence
  Profilin-1 (33-49)
gccgcugugcccggcaagaccuucgucaacaucacaccugcagagguuggg

SEQ ID NO: 61924 - RNA, 39 nt, Artificial Sequence
  Calmodulin (58-70)
gccgacggcaacgggaccaucgauuuccccgaguuucug

SEQ ID NO: 61925 - RNA, 39 nt, Artificial Sequence
  Coiled-coil and C2 domain-containing protein 2A (1275-1287)
gccgagugcgcucugaaguuccccaacagacagugucuc

SEQ ID NO: 61926 - RNA, 30 nt, Artificial Sequence
  Helicase ARIP4 (881-890)
gccgagaagaaagcugcaaagaaaagcuac

SEQ ID NO: 61927 - RNA, 36 nt, Artificial Sequence
  NHP2-like protein 1 (60-71)
gccgagccccuggaaaucauucuccaccuuccucug

SEQ ID NO: 61928 - RNA, 42 nt, Artificial Sequence
  Uncharacterized protein C20orf144 (70-83)
gccggccuggggagccccgcugcaccuagacucaggggagcc

SEQ ID NO: 61929 - RNA, 39 nt, Artificial Sequence
  ATP synthase mitochondrial F1 complex assembly factor 1 (20-32)
gccggccuguacagagggcucugcgcugugaggagccgg

SEQ ID NO: 61930 - RNA, 60 nt, Artificial Sequence
  Gamma-soluble NSF attachment protein (267-286)
gccaagcugggccucagccuugugguccccgggggagguaucaaaaagaaauccccugcu

SEQ ID NO: 61931 - RNA, 54 nt, Artificial Sequence
  Deoxyuridine 5'-triphosphate nucleotidohydrolase, mitochondrial (124-141)
gcccuggacgauaccgagagaggcagcgggggauucgguuccacaggcaagaac

SEQ ID NO: 61932 - RNA, 30 nt, Artificial Sequence
  Lysine-specific demethylase 6A (1264-1273)
gcccugaucgcugcaggcaaggagauuaua

SEQ ID NO: 61933 - RNA, 30 nt, Artificial Sequence
  Protein S100-A6 (81-90)
gcccugaucuacaacgaggcucucaagggc

SEQ ID NO: 61934 - RNA, 42 nt, Artificial Sequence
  Collagen alpha-2(VIII) chain (568-581)
gcccuguacaagaacaaugugcccgcuaccuauacauacgac

SEQ ID NO: 61935 - RNA, 39 nt, Artificial Sequence
  Peroxiredoxin-5, mitochondrial (54-66)
gcccccaucaaggugggcgacgcuauuccugcagucgag

SEQ ID NO: 61936 - RNA, 33 nt, Artificial Sequence
  Neuroblast differentiation-associated protein AHNAK (105-115)
gcccccaagaucagcaugccugacauugaucug

SEQ ID NO: 61937 - RNA, 33 nt, Artificial Sequence
  Ephrin type-B receptor 1 (422-432)
gcccccagcaccgugccuaucaugcaccagguc

SEQ ID NO: 61938 - RNA, 51 nt, Artificial Sequence
  Fer-1-like protein 5 (176-192)
gccagacagcugaugggcaacaauaucaagcccguggucaaaguuagcauu

SEQ ID NO: 61939 - RNA, 39 nt, Artificial Sequence
  Molybdenum cofactor sulfurase (561-573)
gccagaacccagcccacaccuagcgagaaggcugcaggc

SEQ ID NO: 61940 - RNA, 48 nt, Artificial Sequence
  Protein LAP2 (1003-1018)
gccagcuuccccccucagcugcucccaagauccgagucuaccgaaaac

SEQ ID NO: 61941 - RNA, 45 nt, Artificial Sequence
  Cysteine-rich protein 2 (59-73)
gccacccuguucggccccaagggggugaacaucggaggugcuggc

SEQ ID NO: 61942 - RNA, 48 nt, Artificial Sequence
  Sodium channel and clathrin linker 1 (424-439)
gccguggaggaagagcuggaaaagaucuacagagagggcagggggaac

SEQ ID NO: 61943 - RNA, 36 nt, Artificial Sequence
  Interferon-induced protein with tetratricopeptide repeats 2 (285-296)
ugccagaucggcuguugcuacagagccaagguguuc

SEQ ID NO: 61944 - RNA, 75 nt, Artificial Sequence
  Fas-binding factor 1 (99-123)
gacgccgauauccugggccucaagaaaagcaacuccgcucccucuaagaaagcagccaaggacccugggaaagga

SEQ ID NO: 61945 - RNA, 51 nt, Artificial Sequence
  IQ motif and SEC7 domain-containing protein 2 (977-993)
gacuucaucaagaaccugagaggcguggauaauggggaggacauucccagg

SEQ ID NO: 61946 - RNA, 39 nt, Artificial Sequence
  Peptidyl-prolyl cis-trans isomerase A (9-21)
gacaucgccguggauggcgagccccuggggagagucagc

SEQ ID NO: 61947 - RNA, 48 nt, Artificial Sequence
  Peptidyl-prolyl cis-trans isomerase A (9-24)
gacaucgccguggauggcgagccccuggggagagucagcuucgaacuc

SEQ ID NO: 61948 - RNA, 45 nt, Artificial Sequence
  Beta-secretase 1 (93-107)
gacaccggcagcuccaacuucgccgugggggcugcaccccacccu

SEQ ID NO: 61949 - RNA, 42 nt, Artificial Sequence
  Elongation factor 1-alpha 1 (252-265)
gacguguacaagaucggcgggauuggaaccguccccguuggu

SEQ ID NO: 61950 - RNA, 42 nt, Artificial Sequence
  GDNF family receptor alpha-1 (117-130)
gaggacagccccuacgaaccugugaacuccagacugucugau

SEQ ID NO: 61951 - RNA, 30 nt, Artificial Sequence
  H/ACA ribonucleoprotein complex subunit 2 (144-153)
gaggaagugcagagccugccccucccucuu

SEQ ID NO: 61952 - RNA, 42 nt, Artificial Sequence
  Rho guanine nucleotide exchange factor 17 (425-438)
gagggccugcucagaagccaggccaggacccgggcuaagggg

SEQ ID NO: 61953 - RNA, 42 nt, Artificial Sequence
  Uncharacterized protein C2orf15 (95-108)
gagggcaccgggacaggaagccuguccgguaaggcccucggc

SEQ ID NO: 61954 - RNA, 36 nt, Artificial Sequence
  Nesprin-3 (221-232)
gagcacgaagaguaccaggccggcguggacgaauuc

SEQ ID NO: 61955 - RNA, 45 nt, Artificial Sequence
  Ankyrin repeat domain-containing protein 35 (351-365)
gagcccagagccagcggcaagcagggguccucucugaggccugga

SEQ ID NO: 61956 - RNA, 36 nt, Artificial Sequence
  Probable ATP-dependent RNA helicase DDX53 (502-513)
gagcagagcgaccaagaaagagccguggaggauuuc

SEQ ID NO: 61957 - RNA, 54 nt, Artificial Sequence
  DNA-binding protein RFX6 (414-431)
gagagaguggaccugaacagcaucggcucccaggcccuccuuaccauuucuggg

SEQ ID NO: 61958 - RNA, 39 nt, Artificial Sequence
  Annexin A2 (242-254)
gagagcaucagaaaggaagugaaaggcgaccuggagaac

SEQ ID NO: 61959 - RNA, 42 nt, Artificial Sequence
  Annexin A2 (242-255)
gagagcaucagaaaggaagugaaaggcgaccuggagaacgcc

SEQ ID NO: 61960 - RNA, 33 nt, Artificial Sequence
  Elongation factor 1-alpha 1 (280-290)
uucgcccccgugaacgucaccacagagguuaag

SEQ ID NO: 61961 - RNA, 33 nt, Artificial Sequence
  Plasminogen activator inhibitor 1 RNA-binding protein (21-31)
uucgacgaugagagcgaccccuuugaagugcug

SEQ ID NO: 61962 - RNA, 42 nt, Artificial Sequence
  Peptidyl-prolyl cis-trans isomerase A (8-21)
uucgacaucgccguggauggcgagccccuggggagagucagc

SEQ ID NO: 61963 - RNA, 48 nt, Artificial Sequence
  Peptidyl-prolyl cis-trans isomerase A (8-23)
uucgacaucgccguggauggcgagccccuggggagagucagcuuugaa

SEQ ID NO: 61964 - RNA, 27 nt, Artificial Sequence
  Alpha-2-macroglobulin receptor-associated protein (252-260)
uucgaggaacccagagugaucgaccug

SEQ ID NO: 61965 - RNA, 45 nt, Artificial Sequence
  BTB/POZ domain-containing protein KCTD7 (96-110)
uucaucgacagagauggcacccacuuuggggacgugcugaacuuc

SEQ ID NO: 61966 - RNA, 33 nt, Artificial Sequence
  Small nuclear ribonucleoprotein Sm D1 (74-84)
uucauccugcccgacagccucccucuugauacc

SEQ ID NO: 61967 - RNA, 27 nt, Artificial Sequence
  Proteasome activator complex subunit 2 (35-43)
uuccugccccagaagaucauuuaccuc

SEQ ID NO: 61968 - RNA, 36 nt, Artificial Sequence
  Triosephosphate isomerase (230-241)
uuccuggugggcggggccagccucaagcccgaguuu

SEQ ID NO: 61969 - RNA, 36 nt, Artificial Sequence
  Protein FAM208B (156-167)
uucagaagcccccuguccaccggcgugaaggaccuc

SEQ ID NO: 61970 - RNA, 72 nt, Artificial Sequence
  Elongation factor 1-alpha 1 (190-213)
uucgugcccaucagcggcuggaacggggacaauaugcuggagccuuccgccaacaugccaugguuuaaggga

SEQ ID NO: 61971 - RNA, 42 nt, Artificial Sequence
  Fanconi anemia group M protein (201-214)
ggcgccugccccgcugcagagaucaagugucuggugauugac

SEQ ID NO: 61972 - RNA, 24 nt, Artificial Sequence
  Collagen alpha-4(IV) chain (170-177)
ggcgagaaggggaacagcguguuc

SEQ ID NO: 61973 - RNA, 63 nt, Artificial Sequence
  Heterogeneous nuclear ribonucleoproteins A2/B1 (333-353)
ggcgggaacuacggacccgguggcagcgggggauccggcgguuaugggggaagaucuagguac

SEQ ID NO: 61974 - RNA, 39 nt, Artificial Sequence
  Structural maintenance of chromosomes protein 4 (528-540)
ggcaucuacgggagacugggagaccucggugccauugau

SEQ ID NO: 61975 - RNA, 54 nt, Artificial Sequence
  60S ribosomal protein L5 (207-224)
ggcaaggagaccagcccccugcagacaccuguggucccagaaaacagauucccg

SEQ ID NO: 61976 - RNA, 45 nt, Artificial Sequence
  Charged multivesicular body protein 7 (48-62)
ggccuggccaccgugcuccaggaccuucugagaaggggggaguug

SEQ ID NO: 61977 - RNA, 39 nt, Artificial Sequence
  Complement C4-A (1353-1365)
ggccuggaggaagagcuccaguucagccuuggguccaag

SEQ ID NO: 61978 - RNA, 51 nt, Artificial Sequence
  Complement C4-A (1353-1369)
ggccuggaggaagagcuccaguucagccuuggguccaagaucaacgugaaa

SEQ ID NO: 61979 - RNA, 69 nt, Artificial Sequence
  Collagen alpha-1(XIX) chain (351-373)
ggccugaagggggacaaaggagagaccggucuccccggcuucccugggagcgugggaccaaagggccag

SEQ ID NO: 61980 - RNA, 60 nt, Artificial Sequence
  Neuronal tyrosine-phosphorylated phosphoinositide-3-kinase adapter 2 (33-52)
ggccuggugauccagaacgccagcgacauugcuagagagaaugauaggcuccggaacgaa

SEQ ID NO: 61981 - RNA, 60 nt, Artificial Sequence
  Kinesin-like protein KIF27 (84-103)
ggccagaccgggagcggaaagacauacacuaucgguggcgggcacauugccuccgugguc

SEQ ID NO: 61982 - RNA, 39 nt, Artificial Sequence
  Helicase SKI2W (705-717)
ggcagaagggggcuggaccccaccggaacagugauccuc

SEQ ID NO: 61983 - RNA, 30 nt, Artificial Sequence
  E3 ubiquitin-protein ligase HUWE1 (757-766)
ggcaccgaggaaagaauccccauuccucug

SEQ ID NO: 61984 - RNA, 39 nt, Artificial Sequence
  Ankyrin repeat domain-containing protein 11 (421-433)
ggcaccggggagaagcugagacucagcgcccacacaauc

SEQ ID NO: 61985 - RNA, 39 nt, Artificial Sequence
  US7745391-778469 (29-41)
ggcguggcccuggcucccagaccucucgggaccagcuuc

SEQ ID NO: 61986 - RNA, 51 nt, Artificial Sequence
  Meprin A subunit beta (617-633)
ggcgugugcaccgucagagacgggaaggccgaguguaggugccagagcgga

SEQ ID NO: 61987 - RNA, 87 nt, Artificial Sequence
  F-box/LRR-repeat protein 4 (227-255)
ggcgugaaggacaaacccguccugagccucaagaccucccuuaucgauaugaacgacauugaggaugacgccuacgcugaaaaagau

SEQ ID NO: 61988 - RNA, 42 nt, Artificial Sequence
  PHD finger protein 14 (609-622)
cacuucggcugccuggaccccccucucaagaaaagcccaaag

SEQ ID NO: 61989 - RNA, 45 nt, Artificial Sequence
  Arylsulfatase E (503-517)
caccagagaacccugagccccgugccucuccaacuugacaggcug

SEQ ID NO: 61990 - RNA, 51 nt, Artificial Sequence
  NACHT, LRR and PYD domains-containing protein 9 (146-162)
cacaccgugguccuggagggccccgacgggaucggaaagacaacucuccuu

SEQ ID NO: 61991 - RNA, 33 nt, Artificial Sequence
  60S ribosomal protein L8 (31-41)
aucgccgcugagggcauucacaccgggcaguuc

SEQ ID NO: 61992 - RNA, 48 nt, Artificial Sequence
  Kelch-like protein 2 (479-494)
aucgccgagaugagcaccagaagguccggcgcuggggugggaguccug

SEQ ID NO: 61993 - RNA, 36 nt, Artificial Sequence
  Protein RER1 (80-91)
aucgccuuccugagccccaagguggacccuucccuc

SEQ ID NO: 61994 - RNA, 39 nt, Artificial Sequence
  Peptidyl-prolyl cis-trans isomerase A (10-22)
aucgccguggacggcgagccccuggggagagucagcuuc

SEQ ID NO: 61995 - RNA, 42 nt, Artificial Sequence
  Dedicator of cytokinesis protein 4 (1742-1755)
aucggcgacggggcccugcccagaagcgauccuaaccucucc

SEQ ID NO: 61996 - RNA, 30 nt, Artificial Sequence
  L-lactate dehydrogenase A-like 6B (183-192)
aucauugugagcaaccccgucgacauacug

SEQ ID NO: 61997 - RNA, 60 nt, Artificial Sequence
  Carboxy-terminal domain RNA polymerase II polypeptide A small phosphatase 2 (215-234)
auccuggacaacagccccgccuccuacguguuccacaccgagaaugcugucccuguucag

SEQ ID NO: 61998 - RNA, 39 nt, Artificial Sequence
  Heat shock cognate 71 kDa protein (379-391)
auccugagcggcgacaaguccgagaacgugcaggaucuc

SEQ ID NO: 61999 - RNA, 63 nt, Artificial Sequence
  Poly(rC)-binding protein 2 (38-58)
aucaacauuagcgagggcaauugccccgaaagaauaaucacccuggccgggccuacaaacgcu

SEQ ID NO: 62000 - RNA, 36 nt, Artificial Sequence
  Diacylglycerol O-acyltransferase 2 (253-264)
auccccaagcuggagcacccuacccagcaagacauu

SEQ ID NO: 62001 - RNA, 45 nt, Artificial Sequence
  Elongation factor 1-alpha 1 (115-129)
aucguggccgcuggcgucggggaguucgaagcaggaauuagcaag

SEQ ID NO: 62002 - RNA, 51 nt, Artificial Sequence
  Macrophage migration inhibitory factor (3-19)
aucgugaacaccaauguccccagagccagcguuccugacggcuuccugucc

SEQ ID NO: 62003 - RNA, 30 nt, Artificial Sequence
  L-lactate dehydrogenase A chain (135-144)
aucgugagcaaccccgucgacauucugacc

SEQ ID NO: 62004 - RNA, 48 nt, Artificial Sequence
  Fructose-bisphosphate aldolase A (153-168)
aagaucggcgagcacacccccagcgcccuggcuauuauggaaaacgca

SEQ ID NO: 62005 - RNA, 33 nt, Artificial Sequence
  PWWP domain-containing protein 2B (191-201)
aagauccccagcagagugcacggcucccuggag

SEQ ID NO: 62006 - RNA, 51 nt, Artificial Sequence
  DNA mismatch repair protein Mlh3 (135-151)
aagcugcucagcuccacccuuauccccccucuggagauuacagugacugaa

SEQ ID NO: 62007 - RNA, 36 nt, Artificial Sequence
  Cathepsin K (314-325)
aagaacaaugccugcggcaucgcuaaccuggcaagc

SEQ ID NO: 62008 - RNA, 51 nt, Artificial Sequence
  Integrator complex subunit 12 (329-345)
aagcccgugggccugaccgggcucgccacaagcuccaaaggagguaucggc

SEQ ID NO: 62009 - RNA, 39 nt, Artificial Sequence
  Synaptojanin-1 (1453-1465)
aagagcagagccuccucuucacuggacggcuucaaagau

SEQ ID NO: 62010 - RNA, 39 nt, Artificial Sequence
  Thymidylate synthase (284-296)
aagguggagaaaaucgacgauuucaaggccgaagacuuu

SEQ ID NO: 62011 - RNA, 30 nt, Artificial Sequence
  Zinc finger MYND domain-containing protein 15 (138-147)
aagguggagcccgaagaggacagagaacug

SEQ ID NO: 62012 - RNA, 36 nt, Artificial Sequence
  Glyceraldehyde-3-phosphate dehydrogenase (219-230)
aaggugauccccgagcugaacggcaaacucaccggg

SEQ ID NO: 62013 - RNA, 39 nt, Artificial Sequence
  Alpha-enolase (343-355)
aaggugaaccagaucggcagcgucaccgagucccugcaa

SEQ ID NO: 62014 - RNA, 45 nt, Artificial Sequence
  Histone H2A type 2-A (100-114)
aaggugaccaucgcccagggcgggguccugcccaacauucaagcu

SEQ ID NO: 62015 - RNA, 27 nt, Artificial Sequence
  D-dopachrome decarboxylase (89-97)
cuggcccucggccaggacagaauccuu

SEQ ID NO: 62016 - RNA, 33 nt, Artificial Sequence
  Acidic fibroblast growth factor intracellular-binding protein (169-179)
cuggccagagacuacgcugcaaucguguucuuu

SEQ ID NO: 62017 - RNA, 54 nt, Artificial Sequence
  FAST kinase domain-containing protein 1 (497-514)
cuggaccuccuuagaaaggagcugaaaagcuugaagggcaacaccuuccccgaa

SEQ ID NO: 62018 - RNA, 42 nt, Artificial Sequence
  F-box only protein 41 (284-297)
cuggagagccuccuuaaggccgcuggcgggaaccuguugauc

SEQ ID NO: 62019 - RNA, 30 nt, Artificial Sequence
  Eukaryotic initiation factor 4A-III (110-119)
cugauccucgcccccaccagagagcuugcu

SEQ ID NO: 62020 - RNA, 39 nt, Artificial Sequence; identical to SEQ ID NO: 37793
  Alpha-enolase (342-354)

SEQ ID NO: 62021 - RNA, 33 nt, Artificial Sequence
  Threonine synthase-like 1 (295-305)
cugcucgagagaugcauccaccccgccgacauu

SEQ ID NO: 62022 - RNA, 30 nt, Artificial Sequence
  Beta-1,4-galactosyltransferase 7 (20-29)
cugcucagcggcgggcuucccagaaagugc

SEQ ID NO: 62023 - RNA, 30 nt, Artificial Sequence
  Protein S100-A11 (40-49)
cugagcuucaugaacaccgagcucgccgcu

SEQ ID NO: 62024 - RNA, 45 nt, Artificial Sequence
  4F2 cell-surface antigen heavy chain (496-510)
cugagcacccagcccggcagagaggaaggguccccucucgagcuu

SEQ ID NO: 62025 - RNA, 36 nt, Artificial Sequence
  L-lactate dehydrogenase A chain (254-265)
cugagcguggccgaccucgcugaguccaucaugaag

SEQ ID NO: 62026 - RNA, 27 nt, Artificial Sequence
  Complement C4-A (1202-1210)
cugaccaaggcccccguggaccuccuu

SEQ ID NO: 62027 - RNA, 36 nt, Artificial Sequence
  Usherin (3700-3711)
cuguacuggagccuccccgagaagccuaacggccuu

SEQ ID NO: 62028 - RNA, 33 nt, Artificial Sequence
  Phosphopantothenoylcysteine decarboxylase (1-11)
auggagcccaaggccagcugcccugcugcagcc

SEQ ID NO: 62029 - RNA, 42 nt, Artificial Sequence
  DEAD/H box polypeptide 11 like 12 (1-14)
augggccugaucugcagagaccccgccaccaaggugaaaccu

SEQ ID NO: 62030 - RNA, 39 nt, Artificial Sequence
  Elongation factor 1-alpha 1 (201-213)
augcuggagcccagcgccaacaugccuugguucaagggc

SEQ ID NO: 62031 - RNA, 42 nt, Artificial Sequence
  Transgelin-2 (130-143)
augaaccugggcgggcucgccguggcuagagacgauggacuu

SEQ ID NO: 62032 - RNA, 30 nt, Artificial Sequence
  Nucleoside diphosphate kinase B (76-85)
auggugugggagggccugaacgucguuaag

SEQ ID NO: 62033 - RNA, 33 nt, Artificial Sequence
  Endoplasmic reticulum aminopeptidase 2 (861-869)
aacgccaucagcagaauucccaagggccaggug

SEQ ID NO: 62034 - RNA, 60 nt, Artificial Sequence
  Wiskott-Aldrich syndrome protein (262-281)
aaccuggaccccgaucucagaagccuuuucuccagggccggcaucucugaggcucagcug

SEQ ID NO: 62035 - RNA, 27 nt, Artificial Sequence
  Cartilage intermediate layer protein 1 (779-787)
aaccuggagcccagaaccggcuuccuc

SEQ ID NO: 62036 - RNA, 27 nt, Artificial Sequence
  Probable phosphoglycerate mutase 4 (209-217)
aaccugcccaccggcaucccuauugug

SEQ ID NO: 62037 - RNA, 42 nt, Artificial Sequence
  Nuclear receptor subfamily 1 group D member 1 (343-356)
aacaauacccuggccgcucagagacacaacgaggcacucaau

SEQ ID NO: 62038 - RNA, 54 nt, Artificial Sequence
  Tumor protein D52 (212-229)
aacagcgccgcuaaugcauccgccaccacaacugagccccugccugaaaagacg

SEQ ID NO: 62039 - RNA, 60 nt, Artificial Sequence
  Tumor protein D52 (212-231)
aacagcgccgcuaaugcauccgccaccacaacugagccccugccugaaaagacgcaggag

SEQ ID NO: 62040 - RNA, 69 nt, Artificial Sequence
  Replication initiator 1 (10-32)
cccgccgcugaggugagaccuggccaggggaggggagcaaccgccgguccacggggcgcggcuccgccc

SEQ ID NO: 62041 - RNA, 45 nt, Artificial Sequence
  Histidine protein methyltransferase 1 homolog (142-156)
cccggcgagaacaucgugagcaaguccuucucuucacacagugac

SEQ ID NO: 62042 - RNA, 57 nt, Artificial Sequence
  Glutaredoxin-2, mitochondrial (32-50)
cccggcagaaccaggagcgccgcucggcgcauggaguccaacacaucuucaagucug

SEQ ID NO: 62043 - RNA, 57 nt, Artificial Sequence
  Insulin receptor substrate 2 (989-1007)
cccaagccuggcgccccaagcgggcacccggugggaucccuggacggucuccuuucu

SEQ ID NO: 62044 - RNA, 33 nt, Artificial Sequence
  Polycystin-1 (4192-4202)
cagcuggacggccucagcgugucccuugggaga

SEQ ID NO: 62045 - RNA, 33 nt, Artificial Sequence
  Keratin, type II cytoskeletal 8 (226-236)
cagcuguacgaggaagagaucagagaacuccaa

SEQ ID NO: 62046 - RNA, 93 nt, Artificial Sequence
  Cilia- and flagella-associated protein 52 (145-175)
agagacgccaucugcggcagccccgcugcagggcugaacgugggaaaugccaccaacgucauuuucuccaggugucgggaugagauguuuaug

SEQ ID NO: 62047 - RNA, 45 nt, Artificial Sequence
  Histone H3.3 (84-98)
agauuccagagcgccgcuaucggcgcacugcaagaggccuccgaa

SEQ ID NO: 62048 - RNA, 78 nt, Artificial Sequence
  keratin 8, isoform CRA (125-150)
agaggcgggcugggagguggcuacgggggagccagcggcaugggugggaucaccgcugugauggucaaccagaaucuc

SEQ ID NO: 62049 - RNA, 33 nt, Artificial Sequence
  Oxysterol-binding protein 2 (60-70)
agaggcaccaucaaccugagcacagcccacauu

SEQ ID NO: 62050 - RNA, 39 nt, Artificial Sequence
  F-actin-capping protein subunit alpha-2 (100-112)
agaaaggaggccaccgaccccaggccuugcgaaguggag

SEQ ID NO: 62051 - RNA, 57 nt, Artificial Sequence
  kelch repeat and BTB domain-containing protein 6 (1-18)
agaaaggugcugagggaggacgaucccagcuccguccggcucgccucuccuucaagu

SEQ ID NO: 62052 - RNA, 42 nt, Artificial Sequence
  UV excision repair protein RAD23 homolog B (268-281)
agacagaucauucaacagaaccccagccugcucccugcccuu

SEQ ID NO: 62053 - RNA, 72 nt, Artificial Sequence
  Protein boule-like (35-58)
agcgcccccagauacggcaccgugaucccuaacaggauuuucgucgggggaauagacuuuaagacaaaugag

SEQ ID NO: 62054 - RNA, 54 nt, Artificial Sequence
  Beta-1,3-galactosyltransferase 6 (23-40)
agcgcccagccccugagagacgcuaggugcgcacucgccccuggcgauccacgg

SEQ ID NO: 62055 - RNA, 39 nt, Artificial Sequence
  Structure-specific endonuclease subunit SLX4 (603-615)
agcgccucccagagagagcaccaagcucugcaggaccuc

SEQ ID NO: 62056 - RNA, 45 nt, Artificial Sequence
  Elongation factor 1-alpha 1 (396-410)
agcggcgacgccgcuaucguggauaugguccccgggaagccuaug

SEQ ID NO: 62057 - RNA, 39 nt, Artificial Sequence
  Fructose-bisphosphate aldolase A (272-284)
agcggcgggcaguccgaggaagaggccucuaucaaccug

SEQ ID NO: 62058 - RNA, 42 nt, Artificial Sequence
  Sodium-coupled monocarboxylate transporter 2 (343-356)
agcggcacccuguccacaguggccucuucaaucaacgcucuc

SEQ ID NO: 62059 - RNA, 39 nt, Artificial Sequence
  Poly(rC)-binding protein 1 (223-235)
agcauccagggccaacacaccauuuccccccuggaccuc

SEQ ID NO: 62060 - RNA, 51 nt, Artificial Sequence
  DNA ligase 3 (790-806)
agcaaguccgaggcccacaccgcugacggcaucucuauuagauuccccagg

SEQ ID NO: 62061 - RNA, 36 nt, Artificial Sequence
  Keratin, type II cytoskeletal 8 (253-264)
agccuggacauggauuccaucauugccgaggugaag

SEQ ID NO: 62062 - RNA, 36 nt, Artificial Sequence
  Rabenosyn-5 (541-552)
agccugcacaccagaacaaggucccucgacuuccgg

SEQ ID NO: 62063 - RNA, 36 nt, Artificial Sequence
  Leucine-rich repeat-containing protein 28 (186-197)
agcauggccggcaacagacuggcuuuccucccccuu

SEQ ID NO: 62064 - RNA, 30 nt, Artificial Sequence
  NUAK family SNF1-like kinase 2 (446-455)
agcaaccugaagcuccccaaaggcauccuu

SEQ ID NO: 62065 - RNA, 36 nt, Artificial Sequence
  Keratin, type I cytoskeletal 18 (272-283)
agccagcaaaucgaggaauccaccacaguggucacu

SEQ ID NO: 62066 - RNA, 66 nt, Artificial Sequence
  Striated muscle preferentially expressed protein kinase isoform X10 (928-946)
agccaggugcugagagagggcuccaaggccgggggagguacccuccuuugccugcccuuggcugaa

SEQ ID NO: 62067 - RNA, 30 nt, Artificial Sequence
  Vimentin (72-81)
agcuccgugcccggcgucagacugcuccag

SEQ ID NO: 62068 - RNA, 42 nt, Artificial Sequence
  4F2 cell-surface antigen heavy chain (497-510)
agcacccagcccggcagagaggaaggguccccucuggagcuc

SEQ ID NO: 62069 - RNA, 51 nt, Artificial Sequence
  Laminin subunit alpha-4 (1023-1039)
agcaccuccgugcccugcgccagagacaagcuggcuuucacacagucuagg

SEQ ID NO: 62070 - RNA, 39 nt, Artificial Sequence
  Otoferlin (965-977)
accgagcugagagugaucauuggcaagccccuccuuagc

SEQ ID NO: 62071 - RNA, 42 nt, Artificial Sequence
  Procollagen-lysine,2-oxoglutarate 5-dioxygenase 1 (388-401)
accgagcccaacagccugagacuccuuauccagcaaaauaag

SEQ ID NO: 62072 - RNA, 51 nt, Artificial Sequence
  Galectin-1 (71-87)
accgagcagagagaagccguguuccccuuucaaccuggcagcgucgcugag

SEQ ID NO: 62073 - RNA, 57 nt, Artificial Sequence
  Ovochymase-1 (314-332)
accaaggcccugagcuccgugcaggaggucaacggcucucaaagagggaaaggaauc

SEQ ID NO: 62074 - RNA, 72 nt, Artificial Sequence
  Envoplakin (1400-1423)
acccagaaggaccccaaacugagagaggaacacagcaggcucuccggcucucuugaugaggaaguggggcgg

SEQ ID NO: 62075 - RNA, 36 nt, Artificial Sequence
  Neuron navigator 2 (450-461)
accacagugggccccgccagcuccucuccuaagauc

SEQ ID NO: 62076 - RNA, 57 nt, Artificial Sequence
  Bifunctional heparan sulfate N-deacetylase/N-sulfotransferase 3 isoform X3 (310-335)
guggccauccuggucagcaaggagggcgcuagaauggggcucgacacccacacaccc

SEQ ID NO: 62077 - RNA, 36 nt, Artificial Sequence
  VIP peptides (52-63)
guguucaccgacaacuacacaagacugaggaagcag

SEQ ID NO: 62078 - RNA, 27 nt, Artificial Sequence
  60S acidic ribosomal protein P2 (54-62)
gugaucgcccagggcauugggaagcug

SEQ ID NO: 62079 - RNA, 54 nt, Artificial Sequence
  Elongation factor 1-alpha 1 (344-361)
gugaucauucugaaccaccccggccagauaagcgccggguacgcuccuguccuc

SEQ ID NO: 62080 - RNA, 51 nt, Artificial Sequence
  Activin receptor type-2A (262-278)
gugcuggagggcgccaucaacuuccagagagacgcuuuucucaggauugau

SEQ ID NO: 62081 - RNA, 57 nt, Artificial Sequence
  Serine/threonine-protein phosphatase with EF-hands 1 (308-326)
gugcugauccccccuaccgagacaaacagagaccacgauacugacagcaagcauaau

SEQ ID NO: 62082 - RNA, 33 nt, Artificial Sequence
  Galectin-1 (31-41)
gugcugaaccucggcaaggacagcaauaaccuu

SEQ ID NO: 62083 - RNA, 39 nt, Artificial Sequence
  Profilin-1 (41-53)
gugaacaucacccccgccgaggucggcguucuggugggg

SEQ ID NO: 62084 - RNA, 54 nt, Artificial Sequence
  Kin of IRRE-like protein 3 (402-419)
gugcccagagucggcgccggggagagggaaguuacccugacagugaacggaccu

SEQ ID NO: 62085 - RNA, 39 nt, Artificial Sequence
  Keratin, type II cytoskeletal 8 (66-78)
gugaccgucaaccagagccugcucuccccccuuguucug

SEQ ID NO: 62086 - RNA, 45 nt, Artificial Sequence
  Enhancer of rudimentary homolog (71-85)
guguacagagccgacacccagacauaucaacccuacaacaaggau

SEQ ID NO: 62087 - RNA, 48 nt, Artificial Sequence
  Ankyrin repeat domain-containing protein 26 (168-183)
uacgacgccaacaucgaggcuaagaauaaagaugaccugaccccccuc

SEQ ID NO: 62088 - RNA, 51 nt, Artificial Sequence
  78 kDa glucose-regulated protein (635-651)
uacggcagcgccgggcccccuccaaccggagaggaagacacagcugagaag

SEQ ID NO: 62089 - RNA, 57 nt, Artificial Sequence
  78 kDa glucose-regulated protein (635-653)
uacggcagcgccgggcccccuccaaccggagaggaagacacagcugagaaggaugaa

SEQ ID NO: 62090 - RNA, 36 nt, Artificial Sequence
  Alpha-enolase (270-281)
uacaucagccccgaccagcuggccgaucucuauaag

SEQ ID NO: 62091 - RNA, 36 nt, Artificial Sequence
  Microsomal glutathione S-transferase 1 (121-132)
uaccugaccccccucccucagccaaacagagcccuu

SEQ ID NO: 62092 - RNA, 42 nt, Artificial Sequence
  Beta-actin-like protein 2 (8-21)
uacaacgagcugagaguggcccccgacgaacacccuauccuc

SEQ ID NO: 62093 - RNA, 63 nt, Artificial Sequence
  Gamma-enolase (25-45)
uacaccgccaagggccuguucagagcugcagugcccagcggggccuccacaggaaucuaugag

SEQ ID NO: 62094 - RNA, 42 nt, Artificial Sequence
  Polypyrimidine tract-binding protein 1 (114-127)
uacaccagcgugacacccguccugagaggccagccuaucuau

SEQ ID NO: 62095 - RNA, 27 nt, Artificial Sequence
  HLA class I histocompatibility antigen, B-13 alpha chain (26-34)
uacguggacgauacccaguucgucaga

SEQ ID NO: 62096 - RNA, 39 nt, Artificial Sequence
  Matrix-remodeling-associated protein 5 (34-46)
uacgugcccagcgagguccacugcaccuucagaucccug

SEQ ID NO: 62097 - RNA, 27 nt, Artificial Sequence
  Flotillin-2 (156-164)
gacguguacgauaaggucgacuaucug

SEQ ID NO: 62098 - RNA, 27 nt, Artificial Sequence
  Gamma-adducin (305-313)
gaggccuuccacuacaucuuuaacgug

SEQ ID NO: 62099 - RNA, 27 nt, Artificial Sequence
  Nucleoporin GLE1 (443-451)
gagaucuucgacaagauucacagccug

SEQ ID NO: 62100 - RNA, 27 nt, Artificial Sequence
  GRIP1-associated protein 1 (707-715)
gagguggccgaacuguuccagagacuc

SEQ ID NO: 62101 - RNA, 27 nt, Artificial Sequence
  HMG domain-containing protein 3 (954-962)
gagguguucgcccugauccacgaacuc

SEQ ID NO: 62102 - RNA, 30 nt, Artificial Sequence
  Beta-hexosaminidase subunit beta (330-339)
gagguguuccccgaccaguuuauccaccug

SEQ ID NO: 62103 - RNA, 27 nt, Artificial Sequence
  Selenide, water dikinase 2 (336-344)
gaggugagcuucgucauccacaaccug

SEQ ID NO: 62104 - RNA, 27 nt, Artificial Sequence
  ATPase family AAA domain-containing protein 1 (15-23)
gagguggucggccugaucuucagacuc

SEQ ID NO: 62105 - RNA, 27 nt, Artificial Sequence
  MOB kinase activator 3A (64-72)
cacguggucgacuucuuuaacagaguu

SEQ ID NO: 62106 - RNA, 27 nt, Artificial Sequence
  Transmembraneoprotein NMB (539-547)
aagggccugagcguguuccucaacaga

SEQ ID NO: 62107 - RNA, 33 nt, Artificial Sequence
  Cytochrome b-245 light chain (78-88)
aagcuguucggccccuuuaccagaaacuacuau

SEQ ID NO: 62108 - RNA, 27 nt, Artificial Sequence
  Syntenin-1 (270-278)
augcccgccuucaucuuugagcacauu

SEQ ID NO: 62109 - RNA, 30 nt, Artificial Sequence
  Transcription factor 7-like 2 (366-375)
agagaggaacaggccaaguacuaugagcug

SEQ ID NO: 62110 - RNA, 27 nt, Artificial Sequence
  Tumor protein p63-regulated gene 1-like protein (59-67)
agagugaaggaguacuucgucuuuagg

SEQ ID NO: 62111 - RNA, 27 nt, Artificial Sequence
  Clathrin heavy chain 1 (1342-1350)
agagugaacauccccaagguccugagg

SEQ ID NO: 62112 - RNA, 30 nt, Artificial Sequence
  COP9 signalosome complex subunit 6 (311-320)
gugcuguacgacagacagggcaucgggagg

SEQ ID NO: 62113 - RNA, 54 nt, Artificial Sequence
  GTP-binding nuclear protein Ran (203-220)
gcccccccugagguggucauggacccagcucuggcagcccaguacgaacacgau

SEQ ID NO: 62114 - RNA, 27 nt, Artificial Sequence
  Ubiquitin carboxyl-terminal hydrolase 48 (534-542)
gccgcugacaucuucuacagcagauau

SEQ ID NO: 62115 - RNA, 27 nt, Artificial Sequence
  Transmembrane protein 141 (30-38)
gccuucaugaagggcguguuuaccuuc

SEQ ID NO: 62116 - RNA, 30 nt, Artificial Sequence
  DNA replication licensing factor MCM4 (846-855)
gcccuggcugacgaugacuuccucaccgug

SEQ ID NO: 62117 - RNA, 27 nt, Artificial Sequence
  Protein FAM188B (498-506)
gcccuggcugacaucguguggagagca

SEQ ID NO: 62118 - RNA, 27 nt, Artificial Sequence
  Protein TANC1 (1389-1397)
gcccuggcugaccuccaggaggcagug

SEQ ID NO: 62119 - RNA, 33 nt, Artificial Sequence
  Protein TANC1 (1389-1399)
gcccuggcugaccuccaggaggcagugaagcuu

SEQ ID NO: 62120 - RNA, 27 nt, Artificial Sequence
  5-oxoprolinase (523-531)
gcccuggcugacgugguccacgaggca

SEQ ID NO: 62121 - RNA, 27 nt, Artificial Sequence
  Nodal modulator 3 (459-467)
gcccuggcuggcgugagcuucgagauc

SEQ ID NO: 62122 - RNA, 30 nt, Artificial Sequence
  Midasin (1405-1414)
gcccuggcuaaccagaagcucuacagcgug

SEQ ID NO: 62123 - RNA, 27 nt, Artificial Sequence
  WD repeat-containing protein 36 (542-550)
gcccuggacgauuucagcaucuccgug

SEQ ID NO: 62124 - RNA, 30 nt, Artificial Sequence; identical to SEQ ID NO: 37897
  EP300-interacting inhibitor of differentiation 1 (85-94)

SEQ ID NO: 62125 - RNA, 27 nt, Artificial Sequence
  Elongation factor 2 (350-358)
gcccuggacaacuuccucgauaagcuu

SEQ ID NO: 62126 - RNA, 27 nt, Artificial Sequence
  Inverted formin-2 (131-139)
gcccuggacaccagcaacgugaugguc

SEQ ID NO: 62127 - RNA, 33 nt, Artificial Sequence
  Keratinocyte-associated protein 2 (108-118)
gcccuguucgcuagcggccucauccacagagug

SEQ ID NO: 62128 - RNA, 36 nt, Artificial Sequence
  Exportin-2 (684-695)
gcccuguucccccaccuccuucagccugugcugugg

SEQ ID NO: 62129 - RNA, 24 nt, Artificial Sequence
  Activating signal cointegrator 1 complex subunit 3 (627-634)
gcccugggcaccgugacaaacguc

SEQ ID NO: 62130 - RNA, 27 nt, Artificial Sequence
  Replication factor C subunit 5 (276-284)
gcccugcacgacauccucaccgagauu

SEQ ID NO: 62131 - RNA, 30 nt, Artificial Sequence
  Tryptophan-tRNA ligase, cytoplasmic (433-442)
gcccugaucgaggugcuccagccccuuauu

SEQ ID NO: 62132 - RNA, 30 nt, Artificial Sequence
  Tight junction protein ZO-1 (692-701)
gcccugcucgacgugacccccaacgcuguc

SEQ ID NO: 62133 - RNA, 27 nt, Artificial Sequence
  Polypeptide N-acetylgalactosaminyltransferase 2 (185-193)
gcccugcucggcaagaucgagaaagug

SEQ ID NO: 62134 - RNA, 27 nt, Artificial Sequence
  Bifunctional glutamate/proline-tRNA ligase (218-226)
gcccugcucaaccagcacuaccaagug

SEQ ID NO: 62135 - RNA, 27 nt, Artificial Sequence
  LEM domain-containing protein 2 (70-78)
gcccugcucaccgcugugacaaacguc

SEQ ID NO: 62136 - RNA, 30 nt, Artificial Sequence
  Nuclear pore complex protein Nup205 (494-503)
gcccugcucaccggcaucauuagcaaggcu

SEQ ID NO: 62137 - RNA, 30 nt, Artificial Sequence
  LYST-interacting protein LIP6 (84-93)
gcccugauggacggcaagguguacgauauc

SEQ ID NO: 62138 - RNA, 33 nt, Artificial Sequence
  Leishmanolysin-like peptidase (353-363)
gcccugauggaggacaccggcagacagaugcuc

SEQ ID NO: 62139 - RNA, 27 nt, Artificial Sequence
  Kinesin-like protein KIF7 (91-99)
gcccugaacgaggacaucgugagaguc

SEQ ID NO: 62140 - RNA, 27 nt, Artificial Sequence
  40S ribosomal protein S12 (17-25)
gcccugcaggaggugcucaagaccgcu

SEQ ID NO: 62141 - RNA, 27 nt, Artificial Sequence
  Anthrax toxin receptor 1 (207-215)
gcccugcagggcaucauucacagcaua

SEQ ID NO: 62142 - RNA, 30 nt, Artificial Sequence; identical to SEQ ID NO: 37915
  Probable ATP-dependent RNA helicase DDX5 (128-137)

SEQ ID NO: 62143 - RNA, 27 nt, Artificial Sequence
  Actin-related protein 2/3 complex subunit 1A (24-32)
gcccugagccccaacaaucacgaggug

SEQ ID NO: 62144 - RNA, 27 nt, Artificial Sequence
  DNA-dependent protein kinase catalytic subunit (3134-3142)
gcccugaccgagauccaggaauucauu

SEQ ID NO: 62145 - RNA, 27 nt, Artificial Sequence
  Annexin A1 (99-107)
gcccugaccggccaccucgaggaagug

SEQ ID NO: 62146 - RNA, 30 nt, Artificial Sequence
  Cyclin-dependent kinase 2 (95-104)
gcccugaccggcaucccccucccucuuauu

SEQ ID NO: 62147 - RNA, 30 nt, Artificial Sequence
  Staphylococcal nuclease domain-containing protein 1 (428-437)
gcccuggugagcaagggccucgcuaccguc

SEQ ID NO: 62148 - RNA, 27 nt, Artificial Sequence
  Nicotinate-nucleotide pyrophosphorylase (carboxylating) (45-53)
gcccugugggcuaagagccccggcgug

SEQ ID NO: 62149 - RNA, 33 nt, Artificial Sequence
  Guanine nucleotide-binding protein G(I)/G(S)/G(T) subunit beta-1 (74-84)
gcccugugggacaucgagaccggccagcaaaca

SEQ ID NO: 62150 - RNA, 27 nt, Artificial Sequence
  Centrosome-associated protein CEP250 (656-664)
gcccugugggagaagaacacccaccuc

SEQ ID NO: 62151 - RNA, 36 nt, Artificial Sequence
  Nuclear pore complex protein Nup160 (372-383)
gcccuguggcacgacgcugagaaccagaccgugguc

SEQ ID NO: 62152 - RNA, 36 nt, Artificial Sequence
  Tyrosine-protein kinase JAK1 (79-90)
gcccuguacgacgagaacaccaagcucugguaugcu

SEQ ID NO: 62153 - RNA, 33 nt, Artificial Sequence
  Caskin-2 (147-157)
gcccuguacggcaagaccgagguggucagacuc

SEQ ID NO: 62154 - RNA, 27 nt, Artificial Sequence
  Probable dolichyl pyrophosphate Glc1Man9GlcNAc2 alpha-1,3-glucosyltransferase (287-295)
gcccuguacaacgcucucgacaaggug

SEQ ID NO: 62155 - RNA, 27 nt, Artificial Sequence
  Nuclear pore complex protein Nup155 (1038-1046)
gcccuguacaacuggcucauccaggug

SEQ ID NO: 62156 - RNA, 39 nt, Artificial Sequence
  Lysine-tRNA ligase (583-595)
gccauguuccugaccgacagcaacaauaucaaggaggug

SEQ ID NO: 62157 - RNA, 27 nt, Artificial Sequence
  Protein GPR107 (189-197)
gccaugggcgagaagagcuucuccgug

SEQ ID NO: 62158 - RNA, 27 nt, Artificial Sequence
  Probable cation-transporting ATPase 13A3 (829-837)
gccaugaacggcaagagcuucuccgug

SEQ ID NO: 62159 - RNA, 27 nt, Artificial Sequence
  Protein Wnt-5a (20-28)
gccaugagcuccaaguucuuucuggug

SEQ ID NO: 62160 - RNA, 24 nt, Artificial Sequence
  Syndecan-4 (2-9)
gcccccgcuagacuguucgcacuc

SEQ ID NO: 62161 - RNA, 27 nt, Artificial Sequence
  Dehydrogenase/reductase SDR family member 4 (110-118)
gcccccggccugaucaagaccagcuuc

SEQ ID NO: 62162 - RNA, 27 nt, Artificial Sequence
  Filamin-A (1687-1695)
gccccccagccuggcaaguacgugauc

SEQ ID NO: 62163 - RNA, 27 nt, Artificial Sequence
  U1 small nuclear ribonucleoprotein 70 kDa (14-22)
gcccccagagacccuaucccauaccug

SEQ ID NO: 62164 - RNA, 27 nt, Artificial Sequence
  Vacuolar protein sorting-associated protein 16 homolog (41-49)
gcccccuacggcgggccuaucgcucug

SEQ ID NO: 62165 - RNA, 27 nt, Artificial Sequence
  Fatty acid desaturase 1 (12-20)
gcccagggccccaccccuagauacuuc

SEQ ID NO: 62166 - RNA, 30 nt, Artificial Sequence
  Elongation factor 1-gamma (19-28)
gcccaguacagcggcgcucaagugagaguc

SEQ ID NO: 62167 - RNA, 30 nt, Artificial Sequence
  Serine/threonine-protein kinase SMG1 (35-44)
gccagcgcugaccccgauaaccugaaguac

SEQ ID NO: 62168 - RNA, 30 nt, Artificial Sequence
  RalBP1-associated Eps domain-containing protein 1 (609-618)
gccagcgaccccgcuuccucucugagagug

SEQ ID NO: 62169 - RNA, 30 nt, Artificial Sequence
  Tryptophan-tRNA ligase, cytoplasmic (352-361)
gccagcgaccccaacuccucuaucuuccug

SEQ ID NO: 62170 - RNA, 39 nt, Artificial Sequence
  Extended synaptotagmin-2 (868-880)
gccagcgaggaacuggcuaagggcuggacccagugguac

SEQ ID NO: 62171 - RNA, 30 nt, Artificial Sequence
  Alpha-enolase (78-87)
gccagcgaguucuuuagauccggcaaguac

SEQ ID NO: 62172 - RNA, 36 nt, Artificial Sequence
  Unconventional myosin-Ib (243-254)
gccagcgagcuguucaaggacaaaaaggcucucuac

SEQ ID NO: 62173 - RNA, 36 nt, Artificial Sequence
  Protein-glutamate O-methyltransferase (421-432)
gccagcgagcccuccugguggaccacaggcaaguac

SEQ ID NO: 62174 - RNA, 24 nt, Artificial Sequence
  Keratinocyte-associated protein 2 (111-118)
gccagcggccugauccacagagug

SEQ ID NO: 62175 - RNA, 30 nt, Artificial Sequence
  Cadherin-5 (339-348)
gccaccgaccccacaaucgaucugagauac

SEQ ID NO: 62176 - RNA, 30 nt, Artificial Sequence
  Mitogen-activated protein kinase kinase kinase MLT (111-120)
gccaccgacguggcuaagggcaugcacuac

SEQ ID NO: 62177 - RNA, 33 nt, Artificial Sequence
  Mitogen-activated protein kinase kinase kinase MLT (111-121)
gccaccgacguggcuaagggcaugcacuaccug

SEQ ID NO: 62178 - RNA, 30 nt, Artificial Sequence
  Coatomer subunit beta' (480-489)
gccaccgaggaaagcuucuuuauccugaag

SEQ ID NO: 62179 - RNA, 36 nt, Artificial Sequence
  Rho GTPase-activating protein 5 (908-919)
gccaccgagaucacagcuaaguucacugcacuguac

SEQ ID NO: 62180 - RNA, 27 nt, Artificial Sequence
  Transcription initiation protein SPT3 homolog (109-117)
gccaccgagcugcagagcaugauguac

SEQ ID NO: 62181 - RNA, 27 nt, Artificial Sequence
  Clathrin heavy chain 1 (1626-1634)
gccaccgagacacagcccaucguguac

SEQ ID NO: 62182 - RNA, 27 nt, Artificial Sequence
  HEAT repeat-containing protein 5A (1311-1319)
gccgugaagcugcccggcgggcagcuc

SEQ ID NO: 62183 - RNA, 33 nt, Artificial Sequence
  L-lactate dehydrogenase B chain (200-210)
gccguguggagcggcgucaacguugcuggggug

SEQ ID NO: 62184 - RNA, 30 nt, Artificial Sequence
  Myotrophin (75-84)
gccguguacgagggccacgucagcugcguu

SEQ ID NO: 62185 - RNA, 30 nt, Artificial Sequence
  Ubiquitin carboxyl-terminal hydrolase 11 (318-327)
gccuacgcugaccuggugaagcaggcaugg

SEQ ID NO: 62186 - RNA, 27 nt, Artificial Sequence
  Phosphoinositide 3-kinase regulatory subunit 4 (481-489)
gccuacgcugagaacaucgcacugcuc

SEQ ID NO: 62187 - RNA, 27 nt, Artificial Sequence
  Solute carrier family 26 member 6 (67-75)
gccuacgcucugcuccuucagcaccug

SEQ ID NO: 62188 - RNA, 27 nt, Artificial Sequence
  CD109 antigen (1146-1154)
gccuacgcucugcucagccacuuccuu

SEQ ID NO: 62189 - RNA, 30 nt, Artificial Sequence
  Stress-induced-phosphoprotein 1 (349-358)
gccuacgcuagaaucggcaacagcuauuuc

SEQ ID NO: 62190 - RNA, 27 nt, Artificial Sequence
  Nuclear receptor coactivator 7 (730-738)
gccuacgcuacccaccccuucaaguuu

SEQ ID NO: 62191 - RNA, 27 nt, Artificial Sequence
  WD repeat-containing protein 36 (426-434)
gccuacuuccugaagcccaaagagcuc

SEQ ID NO: 62192 - RNA, 27 nt, Artificial Sequence
  Probable ATP-dependent RNA helicase DDX60 (93-101)
gccuacuucaacuuucccgagcugcuc

SEQ ID NO: 62193 - RNA, 27 nt, Artificial Sequence
  Liprin-alpha-4 (952-960)
gccuacggcgacaugaaccacgagugg

SEQ ID NO: 62194 - RNA, 30 nt, Artificial Sequence
  S-adenosylmethionine synthase isoform type-2 (376-385)
gccuacggccacuucgggagagacagcuuu

SEQ ID NO: 62195 - RNA, 27 nt, Artificial Sequence
  Mesoderm induction early response protein 1 (319-327)
gccuacggcaaggacuuccaccugauc

SEQ ID NO: 62196 - RNA, 27 nt, Artificial Sequence
  WD repeat-containing protein 36 (84-92)
gccuacggcaacguguucagcgcuuuu

SEQ ID NO: 62197 - RNA, 27 nt, Artificial Sequence
  Kynurenine-oxoglutarate transaminase 3 (134-142)
gccuacggcagccuguucaacaccauc

SEQ ID NO: 62198 - RNA, 27 nt, Artificial Sequence
  Cleavage stimulation factor subunit 3 (440-448)
gccuacaucgacuaucugagccaccuc

SEQ ID NO: 62199 - RNA, 27 nt, Artificial Sequence
  Leucine-zipper-like transcriptional regulator 1 (75-83)
gccuacaaggacgcuaucuauguguuc

SEQ ID NO: 62200 - RNA, 27 nt, Artificial Sequence
  Small subunit processome component 20 homolog (1114-1122)
gccuaccugcccaagauccuccagauu

SEQ ID NO: 62201 - RNA, 27 nt, Artificial Sequence
  Ubiquitin-like-conjugating enzyme ATG3 (65-73)
gccuaccugcccaccggcaagcaguuc

SEQ ID NO: 62202 - RNA, 33 nt, Artificial Sequence
  Elongation factor 2 (286-296)
gccuaccugcccgugaacgagagcuucggcuuu

SEQ ID NO: 62203 - RNA, 30 nt, Artificial Sequence
  Protein shisa-5 (128-137)
gccuacauggacgcucccaaggcagcccug

SEQ ID NO: 62204 - RNA, 30 nt, Artificial Sequence
  La-related protein 4B (250-259)
gccuacaacgacaauugguucaucaccuuu

SEQ ID NO: 62205 - RNA, 30 nt, Artificial Sequence
  Phosphatidylinositol-binding clathrin assembly protein (210-219)
gccuacaacgagggcaucauuaaucugcuc

SEQ ID NO: 62206 - RNA, 30 nt, Artificial Sequence
  Beta-hexosaminidase subunit alpha (194-203)
gccuacaacaagcugaauguguuccacugg

SEQ ID NO: 62207 - RNA, 27 nt, Artificial Sequence
  Cirhin (34-42)
gccuacaacaaucagagcaacagacug

SEQ ID NO: 62208 - RNA, 27 nt, Artificial Sequence
  Cell adhesion molecule-related/down-regulated by oncogenes (193-201)
gccuacaaccccgugacccaccagcug

SEQ ID NO: 62209 - RNA, 30 nt, Artificial Sequence
  Ubiquitin-associated protein 2-like (267-276)
gccuaccccccugcuccauucaugcacauc

SEQ ID NO: 62210 - RNA, 33 nt, Artificial Sequence
  Cathepsin D (202-212)
gccuaccccagaaucagcgugaacaauguccug

SEQ ID NO: 62211 - RNA, 27 nt, Artificial Sequence
  Ras GTPase-activating-like protein IQGAP1 (794-802)
gccuaccaggacagacuggcuuaucuc

SEQ ID NO: 62212 - RNA, 27 nt, Artificial Sequence
  Ras GTPase-activating-like protein IQGAP3 (955-963)
gccuaccagcaccuguucuaucuccuu

SEQ ID NO: 62213 - RNA, 27 nt, Artificial Sequence
  40S ribosomal protein S11 (9-17)
gccuaccagaagcaacccaccaucuuc

SEQ ID NO: 62214 - RNA, 27 nt, Artificial Sequence
  UDP-glucose:glycoprotein glucosyltransferase 2 (114-122)
gccuacagccccgcuauccagauguuc

SEQ ID NO: 62215 - RNA, 27 nt, Artificial Sequence
  Breast cancer anti-estrogen resistance protein 3 (211-219)
gccuacagcagagugcaguaucaauuc

SEQ ID NO: 62216 - RNA, 33 nt, Artificial Sequence
  Eukaryotic translation initiation factor 4 gamma 1 (168-178)
gccuacuaucccgcucagggcgugcaacaguuc

SEQ ID NO: 62217 - RNA, 27 nt, Artificial Sequence
  Heterogeneous nuclear ribonucleoprotein L (387-395)
ugccuguacggcaacguggagaagguc

SEQ ID NO: 62218 - RNA, 27 nt, Artificial Sequence
  Structural maintenance of chromosomes protein 4 (1136-1144)
gacgccgcucuggauuucaagaacgug

SEQ ID NO: 62219 - RNA, 27 nt, Artificial Sequence
  Phosphoacetylglucosamine mutase (288-296)
gacgccgauggccacuuccaucugauc

SEQ ID NO: 62220 - RNA, 27 nt, Artificial Sequence
  Nuclear cap-binding protein subunit 2 (93-101)
gacgccgagaacgcuaugagauacauc

SEQ ID NO: 62221 - RNA, 30 nt, Artificial Sequence
  Ras-related protein Rab-14 (163-172)
gacgccuuccuggaggcugcaaagaaaauc

SEQ ID NO: 62222 - RNA, 27 nt, Artificial Sequence
  Rho-associated protein kinase 1 (187-195)
gacgccauccacagcaugggcuucauu

SEQ ID NO: 62223 - RNA, 27 nt, Artificial Sequence
  Elongation factor 2 (348-356)
gacgcccugcuccagaugaucaccauu

SEQ ID NO: 62224 - RNA, 27 nt, Artificial Sequence
  SRR1-like protein (237-245)
gacgcccugagcaagauggugaucauu

SEQ ID NO: 62225 - RNA, 27 nt, Artificial Sequence
  Carnitine O-palmitoyltransferase 1, liver isoform (477-485)
gacgcccccaucguggcucaccugugg

SEQ ID NO: 62226 - RNA, 24 nt, Artificial Sequence
  ATP-binding cassette sub-family E member 1 (326-333)
gacgccagccugguguucaagguc

SEQ ID NO: 62227 - RNA, 30 nt, Artificial Sequence
  Glutamate receptor ionotropic, kainate 2 (325-334)
gacgccgugcacgucguuagcguggcugua

SEQ ID NO: 62228 - RNA, 27 nt, Artificial Sequence
  General transcription factor II-I repeat domain-containing protein 2B (818-826)
gacggccugaacuacauccccaagauu

SEQ ID NO: 62229 - RNA, 30 nt, Artificial Sequence
  HLA class I histocompatibility antigen, A-1 alpha chain (89-98)
gacggcagccacaccauccagauuauguac

SEQ ID NO: 62230 - RNA, 27 nt, Artificial Sequence
  Serine/threonine-protein kinase tousled-like 2 (313-321)
gacggcuacgccuuccagaaccugauc

SEQ ID NO: 62231 - RNA, 27 nt, Artificial Sequence
  Heterogeneous nuclear ribonucleoprotein L (411-419)
gacggcuacgccguggauagagcuauc

SEQ ID NO: 62232 - RNA, 27 nt, Artificial Sequence
  T-complex protein 1 subunit epsilon (135-143)
gacggcuacgagcaggccgcuagagug

SEQ ID NO: 62233 - RNA, 27 nt, Artificial Sequence
  Ribosomal protein S6 kinase alpha-1 (416-424)
gacggcuacguggucaaggagaccauc

SEQ ID NO: 62234 - RNA, 24 nt, Artificial Sequence
  DNA-directed RNA polymerase III subunit RPC3 (186-193)
gacauguaccuggugcccaagcuc

SEQ ID NO: 62235 - RNA, 27 nt, Artificial Sequence
  Cyclic AMP-responsive element-binding protein 3-like protein 2 (54-62)
gaccccuuccugagcgagaaguccgug

SEQ ID NO: 62236 - RNA, 33 nt, Artificial Sequence
  Tubulin beta chain (39-49)
gacagcgaucugcagcucgacagaaucuccgug

SEQ ID NO: 62237 - RNA, 33 nt, Artificial Sequence
  Zinc finger MYND domain-containing protein 11 (140-150)
gacagcgagcaggccgauaucgcuagaaugcug

SEQ ID NO: 62238 - RNA, 24 nt, Artificial Sequence
  Negative elongation factor C/D (323-330)
gacaccgauaucagccugauuaga

SEQ ID NO: 62239 - RNA, 27 nt, Artificial Sequence
  Kinectin (454-462)
gacuacgccagacuggugaacgagcuc

SEQ ID NO: 62240 - RNA, 27 nt, Artificial Sequence
  Enhancer of polycomb homolog 1 (423-431)
gacuacgauagcguguuccaccaucug

SEQ ID NO: 62241 - RNA, 27 nt, Artificial Sequence
  Histone deacetylase 1 (71-79)
gacuacaucaaguuccugagaagcauu

SEQ ID NO: 62242 - RNA, 27 nt, Artificial Sequence
  Protein KIAA0100 (885-893)
gacuaccccagauaucuguucgagauc

SEQ ID NO: 62243 - RNA, 27 nt, Artificial Sequence
  T-complex protein 1 subunit beta (509-517)
gaggccgcugaagugauccugagaguc

SEQ ID NO: 62244 - RNA, 27 nt, Artificial Sequence
  DNA-dependent protein kinase catalytic subunit (1728-1736)
gaguuccccccuggcaccccaagauuu

SEQ ID NO: 62245 - RNA, 33 nt, Artificial Sequence
  Nuclear protein 1 (26-36)
gagagcgaccuguacucccucgcccacucuuau

SEQ ID NO: 62246 - RNA, 30 nt, Artificial Sequence
  General transcription factor II-I (242-251)
gagagcgaagaccccgauuacuaucaguac

SEQ ID NO: 62247 - RNA, 39 nt, Artificial Sequence
  E3 ubiquitin-protein ligase HUWE1 (969-981)
gagagcgaagacuaccacuucuaucagggccugguguac

SEQ ID NO: 62248 - RNA, 27 nt, Artificial Sequence
  ATP-dependent RNA helicase DDX24 (571-579)
gagaccgacgaaaaggauuucuaccug

SEQ ID NO: 62249 - RNA, 33 nt, Artificial Sequence
  Serrate RNA effector molecule homolog (86-96)
gagaccgaagccgugaagagauacaacgacuau

SEQ ID NO: 62250 - RNA, 30 nt, Artificial Sequence
  Probable ATP-dependent RNA helicase DDX56 (239-248)
gagaccgaagaggacaaguuccugcuccuu

SEQ ID NO: 62251 - RNA, 30 nt, Artificial Sequence
  Complement C4-A (1516-1525)
gagaccgaaggcccccacgugcugcucuac

SEQ ID NO: 62252 - RNA, 27 nt, Artificial Sequence
  Copine-1 (269-277)
gagaccgaauacagcuuccuggacuau

SEQ ID NO: 62253 - RNA, 27 nt, Artificial Sequence
  Melanoma-associated antigen 11 (252-260)
gagguggaccccaccagccacuccuac

SEQ ID NO: 62254 - RNA, 27 nt, Artificial Sequence
  General transcription factor 3C polypeptide 2 (329-337)
gaguggaucccccuggccuggaagugg

SEQ ID NO: 62255 - RNA, 33 nt, Artificial Sequence
  Influenza virus NS1A-binding protein (632-642)
gaguggagccccuacaccaagaucuuccaguuu

SEQ ID NO: 62256 - RNA, 27 nt, Artificial Sequence
  Zinc finger protein 318 (408-416)
gaguacgccaagauccacgaccugcuc

SEQ ID NO: 62257 - RNA, 27 nt, Artificial Sequence
  CLIP-associating protein 1 (358-366)
gaguacgacaacuucuuucagcaccug

SEQ ID NO: 62258 - RNA, 27 nt, Artificial Sequence
  Pericentrin (3305-3313)
gaguacauccaccaucuggaagugauu

SEQ ID NO: 62259 - RNA, 27 nt, Artificial Sequence
  Transcriptional regulator homolog RPD3 (72-80)
gaguacaucaaguuccugagaagcauu

SEQ ID NO: 62260 - RNA, 30 nt, Artificial Sequence
  Rab GTPase-activating protein 1 (632-641)
gaguacauccccgaccuguauaaccacuuc

SEQ ID NO: 62261 - RNA, 27 nt, Artificial Sequence
  Gem-associated protein 4 (892-900)
gaguacauccaguucgugccccugcuc

SEQ ID NO: 62262 - RNA, 27 nt, Artificial Sequence
  Inhibitor of growth protein 5 (48-56)
gaguacaucagcaccgugaagacacug

SEQ ID NO: 62263 - RNA, 27 nt, Artificial Sequence
  Inositol polyphosphate multikinase (290-298)
gaguacaacaauaacuuccacgugcug

SEQ ID NO: 62264 - RNA, 27 nt, Artificial Sequence
  Sorting nexin-18 (463-471)
gaguaccagaaggugggccaaagcuuc

SEQ ID NO: 62265 - RNA, 27 nt, Artificial Sequence
  Poly (ADP-ribose) polymerase 12 (509-517)
gaguaccagaagguguggaaccuguuc

SEQ ID NO: 62266 - RNA, 27 nt, Artificial Sequence
  Poly (ADP-ribose) polymerase 4 (584-592)
gaguacagacccgaauucagcaacuuu

SEQ ID NO: 62267 - RNA, 27 nt, Artificial Sequence
  Ubiquitin-conjugating enzyme E2 K (161-169)
gaguacaccaagaaaaucgaaaaccug

SEQ ID NO: 62268 - RNA, 27 nt, Artificial Sequence
  Leucine-rich repeats and immunoglobulin-like domains protein 2 (560-568)
gaguacaccagcauccugcaccucuuc

SEQ ID NO: 62269 - RNA, 30 nt, Artificial Sequence
  HLA class I histocompatibility antigen, Cw-7 alpha chain (140-149)
uucgccuacgacggcaaggauuauaucgcu

SEQ ID NO: 62270 - RNA, 24 nt, Artificial Sequence
  60S ribosomal protein L3 (362-369)
uucaucgacaccacaagcaaguuu

SEQ ID NO: 62271 - RNA, 24 nt, Artificial Sequence
  Cysteine-rich protein 2-binding protein (155-162)
uucaucgagaagcacuggaccuuu

SEQ ID NO: 62272 - RNA, 27 nt, Artificial Sequence
  DNA replication licensing factor MCM5 (427-435)
uucaucauggagggcggggccauggug

SEQ ID NO: 62273 - RNA, 27 nt, Artificial Sequence
  60S acidic ribosomal protein P0 (108-116)
uuccuggccgaccccagcgcuuuugug

SEQ ID NO: 62274 - RNA, 27 nt, Artificial Sequence
  Trifunctional enzyme subunit beta, mitochondrial (184-192)
uuccuggcccccgagcucccugcugug

SEQ ID NO: 62275 - RNA, 27 nt, Artificial Sequence
  Membrane-bound transcription factor site-2 protease (251-259)
uuccuggacgccacccucacaagcgug

SEQ ID NO: 62276 - RNA, 30 nt, Artificial Sequence
  Glucosylceramidase (172-181)
uuccuggacgccuacgcugagcacaagcuc

SEQ ID NO: 62277 - RNA, 27 nt, Artificial Sequence
  Neutral alpha-glucosidase AB (604-612)
uuccuggacgauggccacaccuuuaac

SEQ ID NO: 62278 - RNA, 30 nt, Artificial Sequence
  Cytoplasmic dynein 2 heavy chain 1 (42-51)
uuccuggacgauggcaaccagaugcuccuu

SEQ ID NO: 62279 - RNA, 27 nt, Artificial Sequence
  Thimet oligopeptidase (294-302)
uuccuggacgagcucgcccagaagcuu

SEQ ID NO: 62280 - RNA, 27 nt, Artificial Sequence
  Regulatory-associated protein of mTOR (240-248)
uuccuggaccucggccccugggccgug

SEQ ID NO: 62281 - RNA, 27 nt, Artificial Sequence
  Protein FAM83H (343-351)
uuccuggaccccgauagacacuuucuc

SEQ ID NO: 62282 - RNA, 30 nt, Artificial Sequence
  CAD protein (150-159)
uuccuggaccccaacgccagaccucucgug

SEQ ID NO: 62283 - RNA, 27 nt, Artificial Sequence
  DDB1- and CUL4-associated factor 12 (303-311)
uuccuggaccccagacagccuagcuac

SEQ ID NO: 62284 - RNA, 27 nt, Artificial Sequence
  Desmoplakin (1057-1065)
uuccuggaccagaaccuccaaaaguac

SEQ ID NO: 62285 - RNA, 30 nt, Artificial Sequence
  Basic leucine zipper and W2 domain-containing protein 2 (51-60)
uuccuggacagcaccggcuccagacucgau

SEQ ID NO: 62286 - RNA, 27 nt, Artificial Sequence
  Exportin-1 (1034-1042)
uuccuggaggaaagagagaucgcccuc

SEQ ID NO: 62287 - RNA, 30 nt, Artificial Sequence
  Creatine kinase M-type (192-201)
uuccuguuugacaagcccgugagcccucuc

SEQ ID NO: 62288 - RNA, 27 nt, Artificial Sequence
  Ras-related GTP-binding protein C (226-234)
uuccuguuugacguggucagcaagauc

SEQ ID NO: 62289 - RNA, 33 nt, Artificial Sequence
  Nestin (43-53)
uuccuguuucccggcaccgagaaccaggaacuc

SEQ ID NO: 62290 - RNA, 33 nt, Artificial Sequence
  Unconventional myosin-Ib (362-372)
uuccuguuuagcuccgaccaccucaucgagaug

SEQ ID NO: 62291 - RNA, 33 nt, Artificial Sequence
  Glycogen phosphorylase, liver form (525-535)
uuccugggcgacgauguguuucucagagagcuu

SEQ ID NO: 62292 - RNA, 27 nt, Artificial Sequence
  Lysosomal alpha-glucosidase (139-147)
uuccugggccccgagccuaagagcgug

SEQ ID NO: 62293 - RNA, 27 nt, Artificial Sequence
  Sterol regulatory element-binding protein 1 (1036-1044)
uuccugcacgaggccaccgcuagacuc

SEQ ID NO: 62294 - RNA, 27 nt, Artificial Sequence
  DNA-dependent protein kinase catalytic subunit (319-327)
uuccugaagcaggugagcaacaugguc

SEQ ID NO: 62295 - RNA, 27 nt, Artificial Sequence
  ADP-ribosylation factor-binding protein GGA1 (90-98)
uuccugaacgagcucaucaaggugguc

SEQ ID NO: 62296 - RNA, 27 nt, Artificial Sequence
  CDK5 regulatory subunit-associated protein 2 (1316-1324)
uuccugaacggcaagagcguggggguc

SEQ ID NO: 62297 - RNA, 27 nt, Artificial Sequence
  Nestin (377-385)
uuccugcaggccagaacccccacacuc

SEQ ID NO: 62298 - RNA, 27 nt, Artificial Sequence
  Plectin (2481-2489)
uuccugagcgagaaggacucccuccuu

SEQ ID NO: 62299 - RNA, 27 nt, Artificial Sequence
  Hemoglobin subunit alpha (5-13)
uuccugagcuuucccaccacaaagacu

SEQ ID NO: 62300 - RNA, 27 nt, Artificial Sequence
  DDRGK domain-containing protein 1 (215-223)
uuccugaccgaguuuaucaacuacauu

SEQ ID NO: 62301 - RNA, 27 nt, Artificial Sequence
  Elongation factor 1-gamma (69-77)
uuccuggugggcgagagagucacccuc

SEQ ID NO: 62302 - RNA, 36 nt, Artificial Sequence
  Laminin subunit alpha-1 (2178-2189)
uuccugugggaccucggcagcggguccaccagacuu

SEQ ID NO: 62303 - RNA, 27 nt, Artificial Sequence
  Upstream stimulatory factor 1 (42-50)
uuccccgacccuaacgugaaguacguc

SEQ ID NO: 62304 - RNA, 27 nt, Artificial Sequence
  Deubiquitinating protein VCIP135 (505-513)
uucccccaccugccuggcaagaccuuu

SEQ ID NO: 62305 - RNA, 27 nt, Artificial Sequence
  Putative helicase MOV-10 (232-240)
uuccccaucgaccacuuuacccauauu

SEQ ID NO: 62306 - RNA, 27 nt, Artificial Sequence
  NEDD4 family-interacting protein 1 (61-69)
uuccccaagccuccaagcuacaacgug

SEQ ID NO: 62307 - RNA, 27 nt, Artificial Sequence
  Vacuolar fusion protein CCZ1 homolog (254-262)
uuccccagacacaucgagccugaacug

SEQ ID NO: 62308 - RNA, 24 nt, Artificial Sequence
  Retinoblastoma-binding protein 5 (81-88)
uuccccagcccuauccugaaggug

SEQ ID NO: 62309 - RNA, 27 nt, Artificial Sequence
  DNA polymerase alpha catalytic subunit (594-602)
uuccccuacgccuuuaaggaggugauc

SEQ ID NO: 62310 - RNA, 24 nt, Artificial Sequence
  HEAT repeat-containing protein 1 (243-250)
uuccccuacauccagaagggccug

SEQ ID NO: 62311 - RNA, 27 nt, Artificial Sequence
  Reticulocalbin-3 (52-60)
uuccaguacgaccacgaggccuuucug

SEQ ID NO: 62312 - RNA, 30 nt, Artificial Sequence
  Short transient receptor potential channel 4-associated protein (457-466)
uucagcgaccaccaugagaacaaguaccug

SEQ ID NO: 62313 - RNA, 27 nt, Artificial Sequence
  Phosphoinositide 3-kinase regulatory subunit 4 (20-28)
uucagcgacauccacgauuuugaguac

SEQ ID NO: 62314 - RNA, 27 nt, Artificial Sequence
  Serine/threonine-protein kinase N2 (754-762)
uucagcgagcccagagccguguuuuac

SEQ ID NO: 62315 - RNA, 33 nt, Artificial Sequence
  Low-density lipoprotein receptor-related protein 4 (36-46)
uucaccgaccccggcauggggaaccugacauac

SEQ ID NO: 62316 - RNA, 27 nt, Artificial Sequence
  PR domain zinc finger protein 10 (81-89)
uucaccgaccccggccagguggccuac

SEQ ID NO: 62317 - RNA, 27 nt, Artificial Sequence
  Unconventional myosin-Ib (229-237)
uucaccgaccagcaaaagcugaucuac

SEQ ID NO: 62318 - RNA, 33 nt, Artificial Sequence
  Glutathione S-transferase Mu 3 (27-37)
uucaccgacacaagcuacgaggaaaagagauau

SEQ ID NO: 62319 - RNA, 27 nt, Artificial Sequence
  Ribosomal protein S6 kinase alpha-5 (149-157)
uucaccgagcacgaagugcagaucuac

SEQ ID NO: 62320 - RNA, 30 nt, Artificial Sequence
  Unconventional myosin-Ib (526-535)
uucguggacaagaacaaugaucugcucuac

SEQ ID NO: 62321 - RNA, 27 nt, Artificial Sequence
  Heat shock 70 kDa protein 4 (200-208)
uucguggacaugggccacagcgccuac

SEQ ID NO: 62322 - RNA, 27 nt, Artificial Sequence
  Talin-1 (1850-1858)
uucguggacuaccagaccacaaugguc

SEQ ID NO: 62323 - RNA, 33 nt, Artificial Sequence; identical to SEQ ID NO: 38096
  Trafficking protein particle complex subunit 3 (115-125)

SEQ ID NO: 62324 - RNA, 27 nt, Artificial Sequence
  Serine/threonine-protein kinase Nek6 (272-280)
uucuacggcgacaagaugaaccuguuu

SEQ ID NO: 62325 - RNA, 27 nt, Artificial Sequence
  Myotubularin-related protein 5 (454-462)
uucuacggcgacgugcagacccacauc

SEQ ID NO: 62326 - RNA, 27 nt, Artificial Sequence
  Protein CLEC16A (161-169)
uucuacaacgagcacaccaaugacuuu

SEQ ID NO: 62327 - RNA, 27 nt, Artificial Sequence
  Fanconi anemia group I protein (922-930)
uucuaccagcccaagauccaacaguuu

SEQ ID NO: 62328 - RNA, 30 nt, Artificial Sequence
  Heat shock 70 kDa protein 1-like (295-304)
uucuacaccagcaucacaagagccagguuu

SEQ ID NO: 62329 - RNA, 27 nt, Artificial Sequence
  Little elongation complex subunit 2 (213-221)
uucuacgugggccacaucgacgccuuu

SEQ ID NO: 62330 - RNA, 27 nt, Artificial Sequence
  E3 ubiquitin-protein ligase MARCH6 (231-239)
ggccuggacgggagccucguguuccuu

SEQ ID NO: 62331 - RNA, 27 nt, Artificial Sequence
  Malate dehydrogenase, mitochondrial (144-152)
ggccuggaccccgccagagugaacguc

SEQ ID NO: 62332 - RNA, 27 nt, Artificial Sequence
  Asparagine synthetase (glutamine-hydrolyzing) (177-185)
ggccuggacagcucccucguggccgcu

SEQ ID NO: 62333 - RNA, 33 nt, Artificial Sequence
  DNA damage-binding protein 1 (996-1006)
ggccuguuccaccucggggaguuugugaacguc

SEQ ID NO: 62334 - RNA, 30 nt, Artificial Sequence
  Importin-9 (119-128)
ggccugcacgagacccagcccccuagcgug

SEQ ID NO: 62335 - RNA, 27 nt, Artificial Sequence
  HEAT repeat-containing protein 5A (449-457)
ggccugcucgacagcauccuuuccgug

SEQ ID NO: 62336 - RNA, 27 nt, Artificial Sequence
  HEAT repeat-containing protein 5B (445-453)
ggccugcucgagaucgugaccagcguc

SEQ ID NO: 62337 - RNA, 30 nt, Artificial Sequence
  Zinc transporter SLC39A7 (454-463)
ggccugcucgggggagugaucaugaugguc

SEQ ID NO: 62338 - RNA, 33 nt, Artificial Sequence; identical to SEQ ID NO: 38111
  Protein SON (535-545)

SEQ ID NO: 62339 - RNA, 27 nt, Artificial Sequence
  Nestin (273-281)
ggccugcagagccaaaucgcccaggug

SEQ ID NO: 62340 - RNA, 27 nt, Artificial Sequence
  Armadillo repeat containing 8, isoform CRA_g (325-333)
ggccugagcgaguccucugugaagguc

SEQ ID NO: 62341 - RNA, 27 nt, Artificial Sequence
  Eukaryotic translation initiation factor 3 subunit F (252-260)
ggccugagcuccgaccuccagcaagug

SEQ ID NO: 62342 - RNA, 27 nt, Artificial Sequence
  Bifunctional glutamate/proline-tRNA ligase (1274-1282)
ggccugaccacaagaacuaucggggug

SEQ ID NO: 62343 - RNA, 27 nt, Artificial Sequence
  Glyceraldehyde-3-phosphate dehydrogenase (230-238)
ggcauggccuucagagugcccaccgcu

SEQ ID NO: 62344 - RNA, 27 nt, Artificial Sequence
  WD repeat-containing protein 19 (311-319)
ggccccgacgagcugagaccuaugcuc

SEQ ID NO: 62345 - RNA, 27 nt, Artificial Sequence
  Uncharacterized protein KIAA0355 (842-850)
ggcagcgaccccgaguucgccagauac

SEQ ID NO: 62346 - RNA, 27 nt, Artificial Sequence
  Extended synaptotagmin-2 (388-396)
ggcagcgaccccuacgugagaauguau

SEQ ID NO: 62347 - RNA, 36 nt, Artificial Sequence; identical to SEQ ID NO: 38120
  YY1-associated protein 1 (203-214)

SEQ ID NO: 62348 - RNA, 33 nt, Artificial Sequence
  Clustered mitochondria protein homolog (777-787)
ggcaccgagcaccccaacacaauccaggaauac

SEQ ID NO: 62349 - RNA, 33 nt, Artificial Sequence
  Nucleolin (451-461)
ggcaccgagaucgacgggagaagcauuucccug

SEQ ID NO: 62350 - RNA, 27 nt, Artificial Sequence
  DNA-dependent protein kinase catalytic subunit (1480-1488)
ggcaccgagcugcucagccuuguguac

SEQ ID NO: 62351 - RNA, 27 nt, Artificial Sequence
  Pecanex-like protein 3 (789-797)
ggcgugcuggagaacaucuucgggguc

SEQ ID NO: 62352 - RNA, 33 nt, Artificial Sequence
  Ubiquitin-like protein 7 (158-168)
ggcgugcugcaggacaaggaucucuucagcguc

SEQ ID NO: 62353 - RNA, 27 nt, Artificial Sequence
  Polypyrimidine tract-binding protein 2 (308-316)
ggcguguacggggacguccagagaguu

SEQ ID NO: 62354 - RNA, 33 nt, Artificial Sequence
  Caseinolytic peptidase B protein homolog (337-347)
ggcugguacgacgaggaacacccccugguguuc

SEQ ID NO: 62355 - RNA, 27 nt, Artificial Sequence
  Signal recognition particle subunit SRP68 (586-594)
ggcuacaucaaggggauuuucggauuu

SEQ ID NO: 62356 - RNA, 27 nt, Artificial Sequence
  Hypoxanthine-guanine phosphoribosyltransferase (173-181)
ggcuacaagcccgacuucgugggguuu

SEQ ID NO: 62357 - RNA, 27 nt, Artificial Sequence
  GMP reductase 2 (151-159)
ggcuacagcgagcacuucguggaauuu

SEQ ID NO: 62358 - RNA, 27 nt, Artificial Sequence
  Lysine-specific histone demethylase 1B (77-85)
ggcuacaccagcagaugguaucaccug

SEQ ID NO: 62359 - RNA, 30 nt, Artificial Sequence
  ATP-binding cassette sub-family E member 1 (315-324)
ggcuacgugcccaccgagaaccugagauuc

SEQ ID NO: 62360 - RNA, 27 nt, Artificial Sequence
  Ankyrin repeat domain-containing protein 17 (2149-2157)
cacgccuucuggggcgggagcgugguc

SEQ ID NO: 62361 - RNA, 27 nt, Artificial Sequence
  CCR4-NOT transcription complex subunit 1 (1619-1627)
cacgccauccccccuacccuggcuaug

SEQ ID NO: 62362 - RNA, 27 nt, Artificial Sequence
  Syntaxin-binding protein 1 (295-303)
cacaucgccgaggugagccaggaaguc

SEQ ID NO: 62363 - RNA, 27 nt, Artificial Sequence
  Dolichyl-diphosphooligosaccharide-proteinosyltransferase subunit 1 (45-53)
caccuggccaaggugaccgcugagguc

SEQ ID NO: 62364 - RNA, 27 nt, Artificial Sequence
  ATP-binding cassette sub-family F member 1 (520-528)
caccuggacgcccagagacuccauuac

SEQ ID NO: 62365 - RNA, 27 nt, Artificial Sequence
  T-complex protein 1 subunit epsilon (147-155)
caccuggacaagaucagcgauuccgug

SEQ ID NO: 62366 - RNA, 30 nt, Artificial Sequence
  Pre-mRNA-processing-splicing factor 8 (1875-1884)
caccugcucgacuuccccaacaucgugauu

SEQ ID NO: 62367 - RNA, 27 nt, Artificial Sequence
  Polypyrimidine tract-binding protein 3 (383-391)
caccugagcaacauccccccuuccgug

SEQ ID NO: 62368 - RNA, 27 nt, Artificial Sequence
  Integrator complex subunit 4 (10-18)
caccugaccgacacaagccauggcgug

SEQ ID NO: 62369 - RNA, 27 nt, Artificial Sequence
  Clathrin heavy chain 1 (1356-1364)
caccugugggccgagcucguguuccuu

SEQ ID NO: 62370 - RNA, 36 nt, Artificial Sequence
  LanC-like protein 1 (74-85)
caccuguacgacguguucggcgaucccgccuaucuc

SEQ ID NO: 62371 - RNA, 27 nt, Artificial Sequence
  U3 small nucleolar RNA-associated protein 6 homolog (267-275)
cacaccgacgauccccugacaugggac

SEQ ID NO: 62372 - RNA, 27 nt, Artificial Sequence
  Ras GTPase-activating-like protein IQGAP3 (1072-1080)
cacaccgaccccgugcaucuguacaag

SEQ ID NO: 62373 - RNA, 30 nt, Artificial Sequence
  Receptor-type tyrosine-protein phosphatase F (1334-1343)
cacaccgaggugcccgccagaaaccuguac

SEQ ID NO: 62374 - RNA, 27 nt, Artificial Sequence
  Non-specific lipid-transfer protein (143-151)
cacguggaccugcucaucaacaaguac

SEQ ID NO: 62375 - RNA, 27 nt, Artificial Sequence
  Rhophilin-2 (351-359)
cacuacgccgcucuggcacauuauuuc

SEQ ID NO: 62376 - RNA, 27 nt, Artificial Sequence
  Heat shock protein 105 kDa (739-747)
cacuacgccaagaucgcugcagacuuc

SEQ ID NO: 62377 - RNA, 30 nt, Artificial Sequence
  Eukaryotic translation initiation factor 3 subunit I (312-321)
cacuacuucgacccccaguauuuugaguuc

SEQ ID NO: 62378 - RNA, 30 nt, Artificial Sequence
  General transcription factor 3C polypeptide 2 (687-696)
cacuacaucgacgccggcuaucugggguuc

SEQ ID NO: 62379 - RNA, 27 nt, Artificial Sequence
  Centrosomal protein of 192 kDa (2495-2503)
cacuacaucaacaugcccgugcaguuc

SEQ ID NO: 62380 - RNA, 27 nt, Artificial Sequence
  Tubulin gamma-1 chain (59-67)
cacuacauccccagagccgugcugcuc

SEQ ID NO: 62381 - RNA, 27 nt, Artificial Sequence
  Structural maintenance of chromosomes protein 4 (1123-1131)
cacuacaagcccaccccucuguauuuc

SEQ ID NO: 62382 - RNA, 27 nt, Artificial Sequence
  Rho GTPase-activating protein 5 (207-215)
cacuaccugagagaggugcaggccuuc

SEQ ID NO: 62383 - RNA, 30 nt, Artificial Sequence
  E3 ubiquitin-protein ligase Arkadia (644-653)
cacuacaugcccccuccauaugccagccug

SEQ ID NO: 62384 - RNA, 33 nt, Artificial Sequence
  Rho-related BTB domain-containing protein 3 (239-249)
cacuacaacagcgaccugaauaaccuccuuuuc

SEQ ID NO: 62385 - RNA, 27 nt, Artificial Sequence
  DNA mismatch repair protein Msh6 (458-466)
cacuaccccccugugcagguccuguuc

SEQ ID NO: 62386 - RNA, 27 nt, Artificial Sequence
  Dedicator of cytokinesis protein 5 (968-976)
cacuacagccauuauaucuccaccuuc

SEQ ID NO: 62387 - RNA, 27 nt, Artificial Sequence
  Dynein heavy chain 14, axonemal (48-56)
aucgccgagaaggaaacccuggaguac

SEQ ID NO: 62388 - RNA, 27 nt, Artificial Sequence
  Inositol 1,4,5-trisphosphate receptor type 1 (2578-2586)
aucuucggcgugauuauagacaccuuu

SEQ ID NO: 62389 - RNA, 27 nt, Artificial Sequence
  U5 small nuclear ribonucleoprotein 40 kDa protein (217-225)
aucuuccagggcaacgugcacaauuuu

SEQ ID NO: 62390 - RNA, 27 nt, Artificial Sequence
  Progesterone-induced-blocking factor 1 (734-742)
aucuucacccccaagccuacacuguuu

SEQ ID NO: 62391 - RNA, 27 nt, Artificial Sequence
  Phosphoserine aminotransferase (281-289)
aucauugacaacagccagggcuucuac

SEQ ID NO: 62392 - RNA, 30 nt, Artificial Sequence
  Vesicle-associated membrane protein-associated protein A (60-69)
aucauugaccccggcagcaccgugacaguc

SEQ ID NO: 62393 - RNA, 27 nt, Artificial Sequence
  T-complex protein 1 subunit gamma (100-108)
auccuggccggcgagaugcucagcgug

SEQ ID NO: 62394 - RNA, 36 nt, Artificial Sequence
  Adenosylhomocysteinase 2 (196-207)
auccuggacgauggcggggaccucacccacugggug

SEQ ID NO: 62395 - RNA, 27 nt, Artificial Sequence
  Disabled homolog 2 (198-206)
auccuggacgaucagaccaacaagcuc

SEQ ID NO: 62396 - RNA, 27 nt, Artificial Sequence
  Switch-associated protein 70 (208-216)
auccuggacgugcucaagcagggcuac

SEQ ID NO: 62397 - RNA, 27 nt, Artificial Sequence
  Protein SCAF8 (864-872)
auccugggcgggcagcccccuaacgug

SEQ ID NO: 62398 - RNA, 27 nt, Artificial Sequence
  Prolow-density lipoprotein receptor-related protein 1 (596-604)
auccugaaggacggcauucacaacgug

SEQ ID NO: 62399 - RNA, 27 nt, Artificial Sequence
  Nucleoprotein TPR (616-624)
auccugcucagccagaccacaggcgug

SEQ ID NO: 62400 - RNA, 30 nt, Artificial Sequence
  Noelin (14-23)
auccugaugggcaccgagcucacacaggug

SEQ ID NO: 62401 - RNA, 30 nt, Artificial Sequence
  ATP-citrate synthase (1022-1031)
auccugaacguggacggccucauugggguc

SEQ ID NO: 62402 - RNA, 30 nt, Artificial Sequence
  D-3-phosphoglycerate dehydrogenase (22-31)
auccugcaggacggcgggcuccaagugguc

SEQ ID NO: 62403 - RNA, 27 nt, Artificial Sequence
  Poly (ADP-ribose) polymerase 1 (477-485)
auccugagccccuggggcgccgaggug

SEQ ID NO: 62404 - RNA, 33 nt, Artificial Sequence
  Heat shock-related 70 kDa protein 2 (212-222)
auccugaccauugaggacggcauauucgaagug

SEQ ID NO: 62405 - RNA, 33 nt, Artificial Sequence
  Proteasome subunit alpha type-2 (46-56)
auccuguacgacgagagaagcgugcacaagguc

SEQ ID NO: 62406 - RNA, 30 nt, Artificial Sequence
  Elongation factor 2 (203-212)
aucaugauugaccccgugcugggcaccguc

SEQ ID NO: 62407 - RNA, 27 nt, Artificial Sequence
  Gem-associated protein 4 (471-479)
auccccgagagccagauuagacaagug

SEQ ID NO: 62408 - RNA, 27 nt, Artificial Sequence
  Serine/threonine-protein kinase 24 (212-220)
auccccaagaacaauccuccaacccug

SEQ ID NO: 62409 - RNA, 27 nt, Artificial Sequence
  Cathepsin D (24-32)
aucccccugcacaaguucaccagcauu

SEQ ID NO: 62410 - RNA, 24 nt, Artificial Sequence
  ATP-binding cassette sub-family F member 2 (391-398)
auccccccuccagugauuaugguc

SEQ ID NO: 62411 - RNA, 27 nt, Artificial Sequence
  Serine protease HTRA1 (3-11)
auccccagagccgcucugcucccucuu

SEQ ID NO: 62412 - RNA, 30 nt, Artificial Sequence
  Serine protease HTRA1 (3-12)
auccccagagccgcucugcucccucuucug

SEQ ID NO: 62413 - RNA, 24 nt, Artificial Sequence
  Lysine-specific demethylase 5D (1030-1037)
auccccgugcaccugccuaacauu

SEQ ID NO: 62414 - RNA, 24 nt, Artificial Sequence
  Pre-mRNA-processing-splicing factor 8 (724-731)
auccccuggaaggugccuggccug

SEQ ID NO: 62415 - RNA, 24 nt, Artificial Sequence
  Serine-tRNA ligase, cytoplasmic (357-364)
auccccuaccacauugugaacaua

SEQ ID NO: 62416 - RNA, 24 nt, Artificial Sequence
  T-complex protein 1 subunit gamma (296-303)
aucagcgaccuggcccagcacuac

SEQ ID NO: 62417 - RNA, 27 nt, Artificial Sequence
  39S ribosomal protein L12, mitochondrial (79-87)
aucagcgaccugaacgagcuccuuaag

SEQ ID NO: 62418 - RNA, 27 nt, Artificial Sequence
  Junction plakoglobin (651-659)
aucagcgaggacaagaaccccgauuac

SEQ ID NO: 62419 - RNA, 30 nt, Artificial Sequence
  ATP-citrate synthase (6-15)
aucagcgagcagaccggcaaggaacugcuc

SEQ ID NO: 62420 - RNA, 30 nt, Artificial Sequence
  Peptidyl-prolyl cis-trans isomerase FKBP9 (274-283)
aucagccaguccggcgacuuccugagauac

SEQ ID NO: 62421 - RNA, 24 nt, Artificial Sequence
  Staphylococcal nuclease domain-containing protein 1 (665-672)
aucaccgacgaucugcacuucuac

SEQ ID NO: 62422 - RNA, 27 nt, Artificial Sequence
  E3 ubiquitin-protein ligase TRIM21 (423-431)
aucaccgaccacggcagccugauuuac

SEQ ID NO: 62423 - RNA, 33 nt, Artificial Sequence
  5-oxoprolinase (1145-1155)
aucaccgaccccgagauucuggaaagcagauac

SEQ ID NO: 62424 - RNA, 30 nt, Artificial Sequence
  Wee1-like protein kinase (72-81)
aucaccgagagcaacaugaaguccagauac

SEQ ID NO: 62425 - RNA, 27 nt, Artificial Sequence
  Interleukin enhancer-binding factor 2 (89-97)
aucguggcccccggcaccuucgagguc

SEQ ID NO: 62426 - RNA, 27 nt, Artificial Sequence
  Pre-mRNA-processing-splicing factor 8 (1000-1008)
aucguggaccacaacauugccgauuac

SEQ ID NO: 62427 - RNA, 27 nt, Artificial Sequence
  EKC/KEOPS complex subunit TPRKB (48-56)
aucguggaccccuuccagauucugguc

SEQ ID NO: 62428 - RNA, 30 nt, Artificial Sequence
  Hydroxyacylglutathione hydrolase, mitochondrial (27-36)
aucguggaccccguccagccucaaaagguu

SEQ ID NO: 62429 - RNA, 39 nt, Artificial Sequence
  POTE ankyrin domain family member F (851-863)
aucgugauggacagcggcgauggggucacccacacaguu

SEQ ID NO: 62430 - RNA, 30 nt, Artificial Sequence
  Beta-secretase 2 (263-272)
aucugguacacccccauuaaggaggaaugg

SEQ ID NO: 62431 - RNA, 27 nt, Artificial Sequence
  Solute carrier family 12 member 4 (260-268)
aucuacgccggcgggauuaagagcaua

SEQ ID NO: 62432 - RNA, 33 nt, Artificial Sequence
  1-phosphatidylinositol 4,5-bisphosphate phosphodiesterase gamma-2 (1124-1134)
aucuacgaccccaaccuggccuuccucagauuu

SEQ ID NO: 62433 - RNA, 30 nt, Artificial Sequence
  Cullin-4B (579-588)
aucuacggcaaggacguguucgaggccuuu

SEQ ID NO: 62434 - RNA, 27 nt, Artificial Sequence
  ATP-dependent zinc metalloprotease YME1L1 (305-313)
aucuacggccugcucaagaaccccuuc

SEQ ID NO: 62435 - RNA, 27 nt, Artificial Sequence
  Protein transport protein Sec31A (147-155)
aucuacauuugggaccugaacaauuuc

SEQ ID NO: 62436 - RNA, 27 nt, Artificial Sequence
  USP6 N-terminal-like protein (97-105)
aucuacaagggcauuccccugcagcuc

SEQ ID NO: 62437 - RNA, 27 nt, Artificial Sequence
  Plectin (1069-1077)
aucuaccuggagaagcucaaaaccauu

SEQ ID NO: 62438 - RNA, 27 nt, Artificial Sequence
  Tumor susceptibility gene 101 protein (109-117)
aucuaccugcccuaucuccacgagugg

SEQ ID NO: 62439 - RNA, 27 nt, Artificial Sequence
  Ubiquitin-conjugating enzyme E2 variant 3 (109-117)
aucuaccugcccuaucuccagaacugg

SEQ ID NO: 62440 - RNA, 27 nt, Artificial Sequence
  Collagen alpha-1(XV) chain (1157-1165)
aucuaccugagagacagcaccgaguuc

SEQ ID NO: 62441 - RNA, 27 nt, Artificial Sequence
  Disks large homolog 1 (868-876)
aucuacaaccaggugaagcaaauuaua

SEQ ID NO: 62442 - RNA, 33 nt, Artificial Sequence; identical to SEQ ID NO: 38215
  Nuclear fragile X mental retardation-interacting protein 2 (473-483)

SEQ ID NO: 62443 - RNA, 30 nt, Artificial Sequence
  Pre-mRNA-processing-splicing factor 8 (1694-1703)
aucuaccccagcccuaccggcgugcugauu

SEQ ID NO: 62444 - RNA, 30 nt, Artificial Sequence
  5'-3' exoribonuclease 1 (610-619)
aucuaccccagcccuuggccagagaaguuc

SEQ ID NO: 62445 - RNA, 27 nt, Artificial Sequence
  Protein unc-119 homolog B (91-99)
aucuacagcauugacuucaccagauuu

SEQ ID NO: 62446 - RNA, 24 nt, Artificial Sequence
  Serine-protein kinase ATM (121-128)
aucuacacccugauucacuauaua

SEQ ID NO: 62447 - RNA, 27 nt, Artificial Sequence
  Exocyst complex component 6B (648-656)
aucuacaccaaccugaaucagaagauu

SEQ ID NO: 62448 - RNA, 27 nt, Artificial Sequence
  Aminoacylase-1 (390-398)
aucuacaccagacugcuccccgcccuu

SEQ ID NO: 62449 - RNA, 27 nt, Artificial Sequence
  Kelch domain-containing protein 7B (353-361)
aucuacgugaccggcgggcaccuguuc

SEQ ID NO: 62450 - RNA, 30 nt, Artificial Sequence
  RNA polymerase I-specific transcription initiation factor RRN3 (572-581)
aaguucaucgaccccauuuaccaggugugg

SEQ ID NO: 62451 - RNA, 30 nt, Artificial Sequence
  Ubiquitin carboxyl-terminal hydrolase 8 (551-560)
aaguuccuggaccccaucaccggcacauuu

SEQ ID NO: 62452 - RNA, 27 nt, Artificial Sequence
  pre-rRNA processing protein FTSJ3 (64-72)
aaguucaugcccgugagcucccugauc

SEQ ID NO: 62453 - RNA, 27 nt, Artificial Sequence
  M-phase inducer phosphatase 2 (349-357)
aaguucagcaacaucguggacaaauuu

SEQ ID NO: 62454 - RNA, 27 nt, Artificial Sequence
  Mitotic checkpoint protein BUB3 (21-29)
aaguucagccccaacaccucccaguuu

SEQ ID NO: 62455 - RNA, 27 nt, Artificial Sequence
  Protein SCAF11 (1039-1047)
aagcuggccgagagcaaaguguccguc

SEQ ID NO: 62456 - RNA, 27 nt, Artificial Sequence
  Neuroblast differentiation-associated protein AHNAK (2352-2360)
aagcuggacgccgauaugcccgaggug

SEQ ID NO: 62457 - RNA, 27 nt, Artificial Sequence
  Ryanodine receptor 1 (3709-3717)
aagcuggacgaggauuaccucuauaug

SEQ ID NO: 62458 - RNA, 30 nt, Artificial Sequence
  Nucleobindin-1 (98-107)
aagcuggacgagcucaaaagacaggaagug

SEQ ID NO: 62459 - RNA, 27 nt, Artificial Sequence
  Spectrin alpha chain, non-erythrocytic 1 (201-209)
aagcuggacgagaacagcgccuuccuc

SEQ ID NO: 62460 - RNA, 27 nt, Artificial Sequence
  Striatin-3 (767-775)
aagcuggacgagagcaucuacgaugug

SEQ ID NO: 62461 - RNA, 27 nt, Artificial Sequence
  DNA topoisomerase 2-alpha (278-286)
aagcuggacgagaccggcaacagccuc

SEQ ID NO: 62462 - RNA, 27 nt, Artificial Sequence
  Eukaryotic initiation factor 4A-III (152-160)
aagcuggacuacggccagcacgugguc

SEQ ID NO: 62463 - RNA, 27 nt, Artificial Sequence
  HEAT repeat-containing protein 2 (624-632)
aagcuguucagcauccucuccaccgug

SEQ ID NO: 62464 - RNA, 27 nt, Artificial Sequence
  Helicase-like transcription factor (170-178)
aagcugggccccgccccuaaaacccuc

SEQ ID NO: 62465 - RNA, 27 nt, Artificial Sequence
  Serine/threonine-protein kinase ULK4 (46-54)
aagcugaucccccucauuuucgaggug

SEQ ID NO: 62466 - RNA, 33 nt, Artificial Sequence
  GTP-binding protein Rheb (102-112)
aagcugcucgacauggugggcaaaguccagauc

SEQ ID NO: 62467 - RNA, 27 nt, Artificial Sequence
  Probable E3 ubiquitin-protein ligase HERC3 (474-482)
aagcugcucgagaaacuuuacaaggug

SEQ ID NO: 62468 - RNA, 30 nt, Artificial Sequence
  Dedicator of cytokinesis protein 1 (386-395)
aagcugcuccccggcgacauccaccagauu

SEQ ID NO: 62469 - RNA, 27 nt, Artificial Sequence
  Adenosylhomocysteinase 2 (47-55)
aagcugaacgaggugaucagacagguc

SEQ ID NO: 62470 - RNA, 27 nt, Artificial Sequence
  V-type proton ATPase catalytic subunit A (220-228)
aagcugcccgccaaccacccucuccuu

SEQ ID NO: 62471 - RNA, 27 nt, Artificial Sequence
  Proline-rich protein 11 (128-136)
aagcugcaggaggcccucaaaaccauc

SEQ ID NO: 62472 - RNA, 27 nt, Artificial Sequence
  Serine/threonine-protein kinase MRCK alpha (461-469)
aagcugcaggagagcacccaaacagug

SEQ ID NO: 62473 - RNA, 30 nt, Artificial Sequence
  Integrin alpha-V (338-347)
aagcugcaggaggugggccaagucagcguu

SEQ ID NO: 62474 - RNA, 33 nt, Artificial Sequence
  78 kDa glucose-regulated protein (2-12)
aagcugagccucguggccgcuaugcuucuguug

SEQ ID NO: 62475 - RNA, 27 nt, Artificial Sequence
  Serum albumin (257-265)
aagcuggugaccgaccucacaaaaguc

SEQ ID NO: 62476 - RNA, 27 nt, Artificial Sequence
  Zinc finger and BTB domain-containing protein 38 (661-669)
aagauggaccuggauaacaauuucuac

SEQ ID NO: 62477 - RNA, 27 nt, Artificial Sequence
  Sister chromatid cohesion protein PDS5 homolog B (1060-1068)
aagaugaacgagaaacuguacaccgug

SEQ ID NO: 62478 - RNA, 27 nt, Artificial Sequence
  Nucleophosmin (250-258)
aagaugcaggccagcaucgagaaagcu

SEQ ID NO: 62479 - RNA, 36 nt, Artificial Sequence
  Breast cancer anti-estrogen resistance protein 1 (335-346)
aagcccuucgacccugccagaaccccacuggugcuc

SEQ ID NO: 62480 - RNA, 27 nt, Artificial Sequence
  Poly (ADP-ribose) polymerase 1 (388-396)
aagccccugagcaacaugaaaauccuc

SEQ ID NO: 62481 - RNA, 27 nt, Artificial Sequence
  Vitamin K-dependent protein S (29-37)
aagcagcaagccagccaggugcugguc

SEQ ID NO: 62482 - RNA, 27 nt, Artificial Sequence
  POZ-, AT hook-, and zinc finger-containing protein 1 (157-165)
aagcagagcaacgugcaaauccugguc

SEQ ID NO: 62483 - RNA, 27 nt, Artificial Sequence
  Probable global transcription activator SNF2L1 (37-45)
aagcagaccgagcuguucgcccacuuu

SEQ ID NO: 62484 - RNA, 27 nt, Artificial Sequence
  Probable ATP-dependent RNA helicase DDX5 (451-459)
aagcaggugagcgaccugaucuccguc

SEQ ID NO: 62485 - RNA, 36 nt, Artificial Sequence
  Myosin-10 (296-307)
aagagcgaccugcuccuugagggcuucaacaauuac

SEQ ID NO: 62486 - RNA, 27 nt, Artificial Sequence
  Importin-11 (549-557)
aagagcgaccugagacccaugcucuac

SEQ ID NO: 62487 - RNA, 30 nt, Artificial Sequence
  Hepatocyte growth factor receptor (32-41)
aagagcgagaugaacgugaauaugaaauac

SEQ ID NO: 62488 - RNA, 27 nt, Artificial Sequence
  Leucine-rich repeat-containing protein 42 (68-76)
aagaccgaccacuucaucuuuacauac

SEQ ID NO: 62489 - RNA, 33 nt, Artificial Sequence
  AMP deaminase 2 (106-116)
aagaccgacagcgauuccgaccugcagcucuac

SEQ ID NO: 62490 - RNA, 27 nt, Artificial Sequence
  pre-rRNA processing protein FTSJ3 (466-474)
aagaccgagaucaugagcccccuguac

SEQ ID NO: 62491 - RNA, 27 nt, Artificial Sequence
  Fanconi anemia group I protein (402-410)
aagaccaucgagacaagccccucccug

SEQ ID NO: 62492 - RNA, 39 nt, Artificial Sequence
  Tubulin alpha-1C chain (5-17)
aagaccaucggcgggggagacgauagcuucaacacauuu

SEQ ID NO: 62493 - RNA, 36 nt, Artificial Sequence
  Calnexin (227-238)
aagaccuacuucacagacaaaaagacucaccuguau

SEQ ID NO: 62494 - RNA, 27 nt, Artificial Sequence
  General transcription factor 3C polypeptide 1 (135-143)
aagguggacgccggcaaacugcacuac

SEQ ID NO: 62495 - RNA, 33 nt, Artificial Sequence
  Protein phosphatase Slingshot homolog 3 (281-291)
aaggugcuggacgucagcgaucucgaguccguu

SEQ ID NO: 62496 - RNA, 27 nt, Artificial Sequence
  HEAT repeat-containing protein 5A (1475-1483)
aaggugcuggagacccucgucacaguu

SEQ ID NO: 62497 - RNA, 30 nt, Artificial Sequence
  DNA-directed RNA polymerase II subunit RPB3 (175-184)
aaguggaaccccaccgccggcguggcuuuc

SEQ ID NO: 62498 - RNA, 27 nt, Artificial Sequence
  UDP-glucose:glycoprotein glucosyltransferase 2 (42-50)
aaguggcccgagaccccucugcuccuu

SEQ ID NO: 62499 - RNA, 27 nt, Artificial Sequence
  Serine/threonine-protein kinase PLK3 (427-435)
aaguggguggacuacagcaacaaauuc

SEQ ID NO: 62500 - RNA, 27 nt, Artificial Sequence
  Integrin alpha-V (188-196)
aaguacgaccccaacguguauagcauc

SEQ ID NO: 62501 - RNA, 27 nt, Artificial Sequence
  Kinesin-like protein KIF7 (588-596)
aaguacuucgacaaaguggucacccug

SEQ ID NO: 62502 - RNA, 27 nt, Artificial Sequence
  Putative deoxyribonuclease TATDN1 (130-138)
aaguacuucgagaaacaguuugaacug

SEQ ID NO: 62503 - RNA, 33 nt, Artificial Sequence
  BTB/POZ domain-containing protein 3 (484-494)
aaguacuucagcgacggcuccucuaacaccuuu

SEQ ID NO: 62504 - RNA, 27 nt, Artificial Sequence
  Ras GTPase-activating-like protein IQGAP1 (191-199)
aaguacggcauccagaugcccgccuuc

SEQ ID NO: 62505 - RNA, 27 nt, Artificial Sequence
  General transcription factor IIF subunit 1 (83-91)
aaguacggcaucgugcugaaagaguuc

SEQ ID NO: 62506 - RNA, 24 nt, Artificial Sequence
  Protein SOGA1 (415-422)
aaguacggcaucgugcaggaguuc

SEQ ID NO: 62507 - RNA, 27 nt, Artificial Sequence
  Tyrosine-protein phosphatase non-receptor type 13 (1101-1109)
aaguacggccugggguuccagaucauu

SEQ ID NO: 62508 - RNA, 27 nt, Artificial Sequence
  Serine/threonine-protein kinase Kist (248-256)
aaguacggccccguggucagccugcuc

SEQ ID NO: 62509 - RNA, 24 nt, Artificial Sequence
  Serine/threonine-protein phosphatase 4 catalytic subunit (133-140)
aaguacggcagcgugaccgucugg

SEQ ID NO: 62510 - RNA, 27 nt, Artificial Sequence
  Magnesium transporter protein 1 (356-364)
aaguaccacggcuaucccuacagcuuc

SEQ ID NO: 62511 - RNA, 27 nt, Artificial Sequence
  Protein cramped-like (21-29)
aaguacaucgacuucgaucacguguuu

SEQ ID NO: 62512 - RNA, 27 nt, Artificial Sequence
  Ataxin-2-like protein (371-379)
aaguacaucccccugccucagagagug

SEQ ID NO: 62513 - RNA, 30 nt, Artificial Sequence; identical to SEQ ID NO: 38286
  Programmed cell death protein 6 (90-99)

SEQ ID NO: 62514 - RNA, 27 nt, Artificial Sequence
  Elongation of very long chain fatty acids protein 5 (200-208)
aaguacaucacccagggccaacugcuc

SEQ ID NO: 62515 - RNA, 27 nt, Artificial Sequence
  Muscleblind-like protein 3 (18-26)
aaguaccugcaccccccuccacaucuc

SEQ ID NO: 62516 - RNA, 27 nt, Artificial Sequence
  Muscleblind-like protein 2 (67-75)
aaguaccugcaccccccuacccaucuc

SEQ ID NO: 62517 - RNA, 27 nt, Artificial Sequence
  Nesprin-2 (895-903)
aaguaccugaaagccguggaggaacuc

SEQ ID NO: 62518 - RNA, 27 nt, Artificial Sequence
  Presenilin-1 (239-247)
aaguaccugcccgaguggaccgccugg

SEQ ID NO: 62519 - RNA, 30 nt, Artificial Sequence
  ATP-dependent RNA helicase DDX24 (720-729)
aaguacauggacguggucaaagagagaauc

SEQ ID NO: 62520 - RNA, 30 nt, Artificial Sequence
  Protein polybromo-1 (653-662)
aaguacaugacccccaugcagcaaaaacug

SEQ ID NO: 62521 - RNA, 27 nt, Artificial Sequence
  Zinc finger protein 3 (173-181)
aaguacaacgacuucggcaauagcuuu

SEQ ID NO: 62522 - RNA, 30 nt, Artificial Sequence
  Putative endoplasmin-like protein (136-145)
aaguacaacgacaccuucuggaaagaguuu

SEQ ID NO: 62523 - RNA, 27 nt, Artificial Sequence
  Sphingolipid delta(4)-desaturase DES1 (5-13)
aaguaccccgagaucaaaagccugaug

SEQ ID NO: 62524 - RNA, 27 nt, Artificial Sequence
  Neurolysin, mitochondrial (244-252)
aaguacccccacuauuucccugugaug

SEQ ID NO: 62525 - RNA, 27 nt, Artificial Sequence
  Protein farnesyltransferase/geranylgeranyltransferase type-1 subunit alpha (288-296)
aaguaccccaaccugcucaaucagcuu

SEQ ID NO: 62526 - RNA, 27 nt, Artificial Sequence
  Protein ERGIC-53 (288-296)
aaguaccaggaggaauucgagcacuuu

SEQ ID NO: 62527 - RNA, 27 nt, Artificial Sequence
  T-box transcription factor TBX3 (227-235)
aaguaccagcccagauuccacaucgug

SEQ ID NO: 62528 - RNA, 27 nt, Artificial Sequence
  Isoleucine-tRNA ligase, cytoplasmic (288-296)
aaguacagaccccuguucgacuauuuu

SEQ ID NO: 62529 - RNA, 27 nt, Artificial Sequence
  Bardet-Biedl syndrome 10 protein (585-593)
aaguacagcuucccccacaccuauauc

SEQ ID NO: 62530 - RNA, 27 nt, Artificial Sequence
  Ubiquitin-conjugating enzyme E2 variant 3 (36-44)
aaguacagcauggacaccuauguguuc

SEQ ID NO: 62531 - RNA, 27 nt, Artificial Sequence
  Inositol-trisphosphate 3-kinase C (318-326)
aaguacagccccuucguggucuccuuu

SEQ ID NO: 62532 - RNA, 27 nt, Artificial Sequence
  Serine/threonine-protein phosphatase 5 (314-322)
aaguacaccgcccagauguaugagcug

SEQ ID NO: 62533 - RNA, 27 nt, Artificial Sequence
  FACT complex subunit SPT16 (92-100)
aaguacaccgagggcgugcagagccug

SEQ ID NO: 62534 - RNA, 30 nt, Artificial Sequence
  Glycogen debranching enzyme (495-504)
aaguacaccgagaucacagccacuuauuuc

SEQ ID NO: 62535 - RNA, 27 nt, Artificial Sequence
  Phospholipase DDHD2 (124-132)
aaguacgugcccuauagcgaguccuuc

SEQ ID NO: 62536 - RNA, 27 nt, Artificial Sequence
  Serine/threonine-protein kinase RIO1 (222-230)
aaguacgugagcggcgaguucagauuu

SEQ ID NO: 62537 - RNA, 30 nt, Artificial Sequence
  Splicing factor U2AF 65 kDa subunit (90-99)
aaguacugggacgugcccccuccaggcuuc

SEQ ID NO: 62538 - RNA, 27 nt, Artificial Sequence
  Catenin alpha-1 (777-785)
cuggccuaccuccagagaaucgcucuu

SEQ ID NO: 62539 - RNA, 24 nt, Artificial Sequence
  Heterogeneous nuclear ribonucleoprotein F (259-266)
cuguucggcagagaccucagcuac

SEQ ID NO: 62540 - RNA, 27 nt, Artificial Sequence
  Tubulin beta-6 chain (312-320)
cuguucaagagaaucagcgagcaguuu

SEQ ID NO: 62541 - RNA, 24 nt, Artificial Sequence
  Plectin (4148-4155)
cugaucgaccaccagaccuaccuc

SEQ ID NO: 62542 - RNA, 36 nt, Artificial Sequence
  Heat shock 70 kDa protein 1-like (198-209)
cugaucuucgaccucggcgggggaaccuuugaugug

SEQ ID NO: 62543 - RNA, 27 nt, Artificial Sequence
  ATP synthase subunit beta, mitochondrial (215-223)
cugaucauggagcucauuaacaaugug

SEQ ID NO: 62544 - RNA, 27 nt, Artificial Sequence
  DNA damage-binding protein 1 (880-888)
cugcucgccagcaucaacuccaccgug

SEQ ID NO: 62545 - RNA, 30 nt, Artificial Sequence
  Zinc finger protein 530 (30-39)
cugcucgacgagaugcagagacuucuguac

SEQ ID NO: 62546 - RNA, 27 nt, Artificial Sequence
  Phospholysine phosphohistidine inorganic pyrophosphate phosphatase (15-23)
cugcucgacaucagcggcgugcuuuac

SEQ ID NO: 62547 - RNA, 27 nt, Artificial Sequence
  Vacuolar fusion protein CCZ1 homolog (130-138)
cugcucgacaagguguacagcuccguc

SEQ ID NO: 62548 - RNA, 27 nt, Artificial Sequence
  SPRY domain-containing SOCS box protein 1 (138-146)
cugcucgacaugcccccugugagcuac

SEQ ID NO: 62549 - RNA, 27 nt, Artificial Sequence
  Beta-hexosaminidase subunit alpha (173-181)
cugcucgacaccagcagacacuaccuu

SEQ ID NO: 62550 - RNA, 27 nt, Artificial Sequence
  Fragile X mental retardation protein 1 (20-28)
cugcucgacuaccaccuuaacuaucug

SEQ ID NO: 62551 - RNA, 27 nt, Artificial Sequence
  Supervillin (34-42)
cugcucgaggaagacacccccagauac

SEQ ID NO: 62552 - RNA, 27 nt, Artificial Sequence
  LEM domain-containing protein 2 (269-277)
cugcucgagcuucugcacgaauuguac

SEQ ID NO: 62553 - RNA, 33 nt, Artificial Sequence
  UDP-N-acetylglucosamine/UDP-glucose/GDP-mannose transporter (133-143)
cugcucgagaccaucauucuuggcaagcaguac

SEQ ID NO: 62554 - RNA, 33 nt, Artificial Sequence
  Complement decay-accelerating factor (9-19)
cugcucggcgagcuucccagacuguuguuacug

SEQ ID NO: 62555 - RNA, 24 nt, Artificial Sequence
  Kelch-like protein 24 (405-412)
cugcucggcaagguguacgucguu

SEQ ID NO: 62556 - RNA, 27 nt, Artificial Sequence
  Myosin-9 (292-300)
cugcuccuugagcccuacaacaaguau

SEQ ID NO: 62557 - RNA, 33 nt, Artificial Sequence
  Plectin (3700-3710)
cugcucagcgccgagguggcuagacuucuguug

SEQ ID NO: 62558 - RNA, 27 nt, Artificial Sequence
  Integrin alpha-3 (830-838)
cugcucuaccccaccgagaucacagug

SEQ ID NO: 62559 - RNA, 27 nt, Artificial Sequence
  Putative heat shock protein HSP 90-beta 2 (24-32)
cugaugagccucaucauuaacaccuuc

SEQ ID NO: 62560 - RNA, 27 nt, Artificial Sequence
  LIM and calponin homology domains-containing protein 1 (480-488)
cugaacgaccccaauccuaugaaguac

SEQ ID NO: 62561 - RNA, 27 nt, Artificial Sequence
  Leucine-rich repeat-containing protein 59 (77-85)
cugcccgccgacuucggcagacucgug

SEQ ID NO: 62562 - RNA, 27 nt, Artificial Sequence
  DNA-directed RNA polymerase II subunit RPB2 (74-82)
cugcccgccggcaucaacagcauugug

SEQ ID NO: 62563 - RNA, 27 nt, Artificial Sequence
  Lysosomal Pro-X carboxypeptidase (301-309)
cugcccgccuggccuaucaaggugguc

SEQ ID NO: 62564 - RNA, 27 nt, Artificial Sequence
  Leucine-tRNA ligase, cytoplasmic (424-432)
cugcccuucgagccugugccagucauc

SEQ ID NO: 62565 - RNA, 30 nt, Artificial Sequence
  RNA-binding protein 26 (329-338)
cugcccuucccugcccagccaccggugguc

SEQ ID NO: 62566 - RNA, 30 nt, Artificial Sequence
  Putative RNA polymerase II subunit B1 CTD phosphatase RPAP2 (434-443)
cugcccuucagaggcagcgggaccgccauc

SEQ ID NO: 62567 - RNA, 27 nt, Artificial Sequence
  Major facilitator superfamily domain-containing protein 12 (308-316)
cugcccaagaaauucaucgccaccauu

SEQ ID NO: 62568 - RNA, 27 nt, Artificial Sequence
  Targeting protein for Xklp2 (528-536)
cugccccucccucacuucgacaccauc

SEQ ID NO: 62569 - RNA, 27 nt, Artificial Sequence
  Heat shock 70 kDa protein 13 (26-34)
cugccccucccuaccccaaaggugauc

SEQ ID NO: 62570 - RNA, 27 nt, Artificial Sequence
  Alpha/beta hydrolase domain-containing protein 14B (203-211)
cugcccaaccacagagugcucaucaug

SEQ ID NO: 62571 - RNA, 27 nt, Artificial Sequence
  Ubiquitin carboxyl-terminal hydrolase 11 (143-151)
cugcccaacauccagaagguggagguc

SEQ ID NO: 62572 - RNA, 24 nt, Artificial Sequence
  Protein transport protein Sec61 subunit alpha isoform 2 (217-224)
cugcccaaccucaugaaucuuauc

SEQ ID NO: 62573 - RNA, 24 nt, Artificial Sequence
  Unconventional myosin-X (129-136)
cugcccccucacaucuucgccauu

SEQ ID NO: 62574 - RNA, 27 nt, Artificial Sequence
  Mimitin, mitochondrial (121-129)
cugcccccuccagugcagacccaaauc

SEQ ID NO: 62575 - RNA, 27 nt, Artificial Sequence
  Phosphoglycerate kinase 1 (181-189)
cugccccagaaggccggcggguuccuc

SEQ ID NO: 62576 - RNA, 27 nt, Artificial Sequence
  Coatomer subunit beta' (762-770)
cugcccagccagguguccagagucguu

SEQ ID NO: 62577 - RNA, 27 nt, Artificial Sequence
  Neutral amino acid transporter B(0) (246-254)
cugcccguggaccacaucagccucauu

SEQ ID NO: 62578 - RNA, 27 nt, Artificial Sequence
  Protein TALPID3 (38-46)
cugcccgugggcaccgggacaagccuc

SEQ ID NO: 62579 - RNA, 27 nt, Artificial Sequence
  Centrosomal protein of 63 kDa (446-454)
cugcccgugagcccucucggcuccauc

SEQ ID NO: 62580 - RNA, 24 nt, Artificial Sequence
  Clathrin heavy chain 1 (859-866)
cugcccuggcucgaggccagaauc

SEQ ID NO: 62581 - RNA, 24 nt, Artificial Sequence
  Protein transport protein Sec16A (155-162)
cugcccuaccucccucacuauauc

SEQ ID NO: 62582 - RNA, 27 nt, Artificial Sequence
  Very-long-chain (3R)-3-hydroxyacyl-CoA dehydratase 3 (314-322)
cugcccuacccugugaagaucaaaguc

SEQ ID NO: 62583 - RNA, 27 nt, Artificial Sequence
  HAUS augmin-like complex subunit 6 (131-139)
cugagcgaccucaagcacaugagauac

SEQ ID NO: 62584 - RNA, 27 nt, Artificial Sequence
  General transcription factor 3C polypeptide 1 (333-341)
cugagcgacucccagaugaagucuuac

SEQ ID NO: 62585 - RNA, 30 nt, Artificial Sequence; identical to SEQ ID NO: 38358
  Importin-7 (681-690)

SEQ ID NO: 62586 - RNA, 27 nt, Artificial Sequence
  Cytoplasmic dynein 1 heavy chain 1 (2161-2169)
cugagcgacguguuccccggcguccag

SEQ ID NO: 62587 - RNA, 30 nt, Artificial Sequence; identical to SEQ ID NO: 38360
  Cytoplasmic dynein 1 heavy chain 1 (2161-2170)

SEQ ID NO: 62588 - RNA, 39 nt, Artificial Sequence
  Creatine kinase B-type (162-174)
cugagcucccucgacggcgaucuugccgggagauacuau

SEQ ID NO: 62589 - RNA, 27 nt, Artificial Sequence
  Pumilio homolog 2 (167-175)
cugaccgccgcucagcaacagcaguac

SEQ ID NO: 62590 - RNA, 27 nt, Artificial Sequence
  26S proteasome non-ATPase regulatory subunit 2 (391-399)
cugaccgacgauggcaacaaguggcuc

SEQ ID NO: 62591 - RNA, 30 nt, Artificial Sequence
  Neural cell adhesion molecule L1 (975-984)
cugaccgaccucagcccccaccuuagauac

SEQ ID NO: 62592 - RNA, 30 nt, Artificial Sequence
  Pre-mRNA-processing-splicing factor 8 (246-255)
cugaccgaccucguggaugacaacuacuuc

SEQ ID NO: 62593 - RNA, 27 nt, Artificial Sequence
  Exosome component 10 (356-364)
cugaccgaccccgccaucgugaagguc

SEQ ID NO: 62594 - RNA, 24 nt, Artificial Sequence
  Tubulin polyglutamylase complex subunit 2 (125-132)
cugaccgacacauucacugccuac

SEQ ID NO: 62595 - RNA, 27 nt, Artificial Sequence
  Alpha-N-acetylglucosaminidase (121-129)
cugaccgaggccacacccaacagauac

SEQ ID NO: 62596 - RNA, 27 nt, Artificial Sequence
  AF4/FMR2 family member 4 (1028-1036)
cugaccgagcaccucaagaacagcuac

SEQ ID NO: 62597 - RNA, 33 nt, Artificial Sequence; identical to SEQ ID NO: 38370
  Unconventional myosin-X (71-81)

SEQ ID NO: 62598 - RNA, 27 nt, Artificial Sequence
  Actin-like protein 6A (94-102)
cugaccgagcucauguucgaacacuac

SEQ ID NO: 62599 - RNA, 33 nt, Artificial Sequence
  Adenosylhomocysteinase 2 (192-202)
cugaccgagcucacagacgaucaggccaaguac

SEQ ID NO: 62600 - RNA, 27 nt, Artificial Sequence
  Semaphorin-4C (58-66)
cugaccgagcccacaggccuccuuuac

SEQ ID NO: 62601 - RNA, 27 nt, Artificial Sequence
  Oxysterol-binding protein-related protein 1 (580-588)
cugaccgaguacauggaacacacauau

SEQ ID NO: 62602 - RNA, 39 nt, Artificial Sequence
  Melanoma-associated antigen 1 (239-251)
cugacccaggaccucgugcaagagaaguaccuugaauau

SEQ ID NO: 62603 - RNA, 33 nt, Artificial Sequence
  Caspase recruitment domain-containing protein 8 (43-53)
cugguggacaacagcaucagagagcuccaguac

SEQ ID NO: 62604 - RNA, 27 nt, Artificial Sequence
  Non-canonical poly(A) RNA polymerase PAPD5 (82-90)
cuguacggcagacacuucaacuaucuc

SEQ ID NO: 62605 - RNA, 27 nt, Artificial Sequence
  Ras-related protein Rap-2c (70-78)
cuguacaucaagaacggccagggguuc

SEQ ID NO: 62606 - RNA, 30 nt, Artificial Sequence
  Dedicator of cytokinesis protein 7 (456-465)
cuguacaucuauccccagagccucaacuuc

SEQ ID NO: 62607 - RNA, 27 nt, Artificial Sequence
  Mitochondrial carrier homolog 1 (63-71)
cuguaccuccccagcuucuuuaccuau

SEQ ID NO: 62608 - RNA, 27 nt, Artificial Sequence
  Eukaryotic translation initiation factor 3 subunit C-like protein (609-617)
cuguacaacagaaccauggugcagcuc

SEQ ID NO: 62609 - RNA, 27 nt, Artificial Sequence
  Serine/threonine-protein phosphatase 5 (284-292)
cuguaccccgaccacuuccaucuccuu

SEQ ID NO: 62610 - RNA, 27 nt, Artificial Sequence
  ATPase family AAA domain-containing protein 2B (421-429)
cuguaccccgagaucuucgaaaaguuu

SEQ ID NO: 62611 - RNA, 27 nt, Artificial Sequence
  Syntenin-1 (45-53)
cuguaccccagacucuauccugagcuu

SEQ ID NO: 62612 - RNA, 27 nt, Artificial Sequence
  Nuclear factor erythroid 2-related factor 1 (392-400)
cuguaccaggagguguucggcagacuc

SEQ ID NO: 62613 - RNA, 27 nt, Artificial Sequence
  Rapamycin-insensitive companion of mTOR (1676-1684)
cuguacagcgaggugucccaccuccuu

SEQ ID NO: 62614 - RNA, 24 nt, Artificial Sequence
  Nuclear protein 1 (29-36)
cuguacagccucgcccacuccuau

SEQ ID NO: 62615 - RNA, 27 nt, Artificial Sequence
  Protein CLEC16A (171-179)
cuguacaccgaggccaucaaguucuuu

SEQ ID NO: 62616 - RNA, 27 nt, Artificial Sequence
  UDP-glucose:glycoprotein glucosyltransferase 1 (1417-1425)
cuguacguggucgaccucaagaaauuc

SEQ ID NO: 62617 - RNA, 27 nt, Artificial Sequence
  Sorting nexin-30 (408-416)
auggccgacaagaacauccaguacuau

SEQ ID NO: 62618 - RNA, 24 nt, Artificial Sequence
  HLA class I histocompatibility antigen, Cw-2 alpha chain (4-11)
auggcccccagaacccugcuccuu

SEQ ID NO: 62619 - RNA, 24 nt, Artificial Sequence
  HLA class I histocompatibility antigen, A-23 alpha chain (4-11)
auggcccccagaacccuggugcuc

SEQ ID NO: 62620 - RNA, 30 nt, Artificial Sequence
  Uroporphyrinogen decarboxylase (66-75)
augcuggacgauuucggcccccacagauac

SEQ ID NO: 62621 - RNA, 27 nt, Artificial Sequence
  ATP-binding cassette sub-family F member 1 (474-482)
augcuggacgagcccaccaaccaccuc

SEQ ID NO: 62622 - RNA, 27 nt, Artificial Sequence
  V-type proton ATPase subunit S1 (306-314)
augcugcaggacuuccaaauccaggcc

SEQ ID NO: 62623 - RNA, 27 nt, Artificial Sequence
  Lysine-specific demethylase 5A (1454-1462)
augauggugggcgaccugcucgagguc

SEQ ID NO: 62624 - RNA, 27 nt, Artificial Sequence
  Inosine-5'-monophosphate dehydrogenase (348-356)
augauguacagcggcgagcugaaguuc

SEQ ID NO: 62625 - RNA, 27 nt, Artificial Sequence
  Nucleolar pre-ribosomal-associated protein 1 (691-699)
augccccaccugagcaugcagcaagug

SEQ ID NO: 62626 - RNA, 24 nt, Artificial Sequence
  Myoferlin (1357-1364)
augcccccucuggugaucaagguc

SEQ ID NO: 62627 - RNA, 27 nt, Artificial Sequence
  Serine/threonine-protein kinase D3 (532-540)
augcccgugaccccucaggccagcguc

SEQ ID NO: 62628 - RNA, 27 nt, Artificial Sequence
  Progressive ankylosis protein homolog (288-296)
augcccuacggcuggcugaccgagauc

SEQ ID NO: 62629 - RNA, 30 nt, Artificial Sequence
  YTH domain-containing family protein 2 (206-215)
augagcgacuccuaccugcccucuuauuac

SEQ ID NO: 62630 - RNA, 27 nt, Artificial Sequence
  Bleomycin hydrolase (410-418)
augaccgacgagugguucagcgaauac

SEQ ID NO: 62631 - RNA, 27 nt, Artificial Sequence
  Eukaryotic initiation factor 4A-III (233-241)
augaccgaccccaucagaauucuggug

SEQ ID NO: 62632 - RNA, 36 nt, Artificial Sequence
  Cytochrome c oxidase subunit 1 (484-495)
augguggaggaacccagcaugaaccuggaguggcuc

SEQ ID NO: 62633 - RNA, 33 nt, Artificial Sequence
  Son of sevenless homolog 2 (615-625)
auguacgccgaccccaacuucgugagaaccuuu

SEQ ID NO: 62634 - RNA, 27 nt, Artificial Sequence
  Trafficking protein particle complex subunit 2 (93-101)
auguaccugaagaccguggacaaauuc

SEQ ID NO: 62635 - RNA, 27 nt, Artificial Sequence
  Pyruvate carboxylase, mitochondrial (1012-1020)
auguaccccgacguguucgcccacuuu

SEQ ID NO: 62636 - RNA, 27 nt, Artificial Sequence
  Constitutive coactivator of PPAR-gamma-like protein 1 (568-576)
auguaccccuauaucuuccacgugcug

SEQ ID NO: 62637 - RNA, 27 nt, Artificial Sequence
  Msx2-interacting protein (2894-2902)
aacgccagccccgugaucuccucuguc

SEQ ID NO: 62638 - RNA, 27 nt, Artificial Sequence
  Cytoplasmic dynein 1 heavy chain 1 (3346-3354)
aacuucauccccaccauugugaauuuu

SEQ ID NO: 62639 - RNA, 30 nt, Artificial Sequence
  Ras GTPase-activating-like protein IQGAP3 (896-905)
aacaucauggacauuaagauaggccugcuc

SEQ ID NO: 62640 - RNA, 27 nt, Artificial Sequence
  Tuberin (178-186)
aaccuggccgcuuacgugccccuccuu

SEQ ID NO: 62641 - RNA, 27 nt, Artificial Sequence
  Nestin (83-91)
aaccuggccgaggaacucgagggcgug

SEQ ID NO: 62642 - RNA, 36 nt, Artificial Sequence
  Spliceosome RNA helicase DDX39B (201-212)
aaccuguucggcagagggauggacaucgagagggug

SEQ ID NO: 62643 - RNA, 27 nt, Artificial Sequence
  Protein unc-45 homolog A (297-305)
aaccugcucgaccuucugaccgaggug

SEQ ID NO: 62644 - RNA, 30 nt, Artificial Sequence
  Ras GTPase-activating-like protein IQGAP2 (826-835)
aaccugauggacaucaagauuggccuccuu

SEQ ID NO: 62645 - RNA, 42 nt, Artificial Sequence
  Peroxisome proliferator-activated receptor gamma coactivator 1-alpha (767-780)
aacagcgacgauuucgaccccgccuccaccaagucuaaauac

SEQ ID NO: 62646 - RNA, 33 nt, Artificial Sequence
  NADH-ubiquinone oxidoreductase chain 5 (109-119)
aacagcgaccccaauaucaaccaguucuuuaag

SEQ ID NO: 62647 - RNA, 27 nt, Artificial Sequence
  Cadherin EGF LAG seven-pass G-type receptor 2 (2584-2592)
aacagcgacacccugcucuuccacuac

SEQ ID NO: 62648 - RNA, 27 nt, Artificial Sequence
  Unconventional myosin-X (1519-1527)
aacagcgacguggucgagcagaucuac

SEQ ID NO: 62649 - RNA, 27 nt, Artificial Sequence
  Dedicator of cytokinesis protein 9 (118-126)
aacagcgacuggcaccuggugaauuac

SEQ ID NO: 62650 - RNA, 27 nt, Artificial Sequence
  Serine/threonine-protein kinase RIO3 (378-386)
aacagcgaggaaaugaaggaggccuac

SEQ ID NO: 62651 - RNA, 27 nt, Artificial Sequence
  Nuclear factor erythroid 2-related factor 2 (178-186)
aacaccgacuucggcgaugaguuuuac

SEQ ID NO: 62652 - RNA, 27 nt, Artificial Sequence
  26S proteasome non-ATPase regulatory subunit 12 (218-226)
aacaccgagaagcugaaacucaaguac

SEQ ID NO: 62653 - RNA, 27 nt, Artificial Sequence
  Transgelin-2 (106-114)
aacaccacagacaucuuccagacugug

SEQ ID NO: 62654 - RNA, 33 nt, Artificial Sequence
  Anaphase-promoting complex subunit 7 (236-246)
aacguggaccugcucggcagccuugccgaucug

SEQ ID NO: 62655 - RNA, 27 nt, Artificial Sequence
  C-Jun-amino-terminal kinase-interacting protein 4 (137-145)
aacuacgccgaccagaucagcagacug

SEQ ID NO: 62656 - RNA, 30 nt, Artificial Sequence
  Heterogeneous nuclear ribonucleoprotein U-like protein 1 (472-481)
aacuacgccggcagaugggacgugcugauc

SEQ ID NO: 62657 - RNA, 27 nt, Artificial Sequence
  Basic leucine zipper and W2 domain-containing protein 2 (110-118)
aacuacgcccagguguucaauaagcug

SEQ ID NO: 62658 - RNA, 27 nt, Artificial Sequence
  Baculoviral IAP repeat-containing protein 6 (803-811)
aacuacgccaccagaaucgugacacug

SEQ ID NO: 62659 - RNA, 27 nt, Artificial Sequence
  Cleavage stimulation factor subunit 3 (71-79)
aacuacgacaagguggagaaacuguuc

SEQ ID NO: 62660 - RNA, 27 nt, Artificial Sequence
  E3 ubiquitin-protein ligase SHPRH (409-417)
aacuacuucauccccagccacuauuuu

SEQ ID NO: 62661 - RNA, 30 nt, Artificial Sequence
  Translocon-associated protein subunit alpha (108-117)
aacuacaaggaccugaauggcaacguguuc

SEQ ID NO: 62662 - RNA, 27 nt, Artificial Sequence
  Ubiquitin fusion degradation protein 1 homolog (197-205)
aacuacaaugagaagaucuaugaacug

SEQ ID NO: 62663 - RNA, 27 nt, Artificial Sequence
  Neurofibromin (31-39)
aacuaccccgacgaguucaccaagcug

SEQ ID NO: 62664 - RNA, 27 nt, Artificial Sequence
  Zinc finger MYM-type protein 4 (344-352)
aacuaccagaaugugguccacaagcug

SEQ ID NO: 62665 - RNA, 27 nt, Artificial Sequence
  Alpha-mannosidase 2x (441-449)
aacuaccagagacuguucgacuuuuuc

SEQ ID NO: 62666 - RNA, 27 nt, Artificial Sequence
  Neuron navigator 2 (1368-1376)
aacuacagcaucauucccuaucugcuc

SEQ ID NO: 62667 - RNA, 27 nt, Artificial Sequence
  E1A-binding protein p400 (343-351)
cccuucgccaagccucugccaaccuuu

SEQ ID NO: 62668 - RNA, 30 nt, Artificial Sequence
  Cyclic AMP-responsive element-binding protein 3-like protein 2 (17-26)
cccagcuacggcgggcagcaacaguccuau

SEQ ID NO: 62669 - RNA, 27 nt, Artificial Sequence
  Coatomer subunit alpha (1152-1160)
cccaccgacgccuaccagcugaacuau

SEQ ID NO: 62670 - RNA, 30 nt, Artificial Sequence
  Endoplasmin (497-506)
cccaccgacaucacaagccuggaucaguac

SEQ ID NO: 62671 - RNA, 27 nt, Artificial Sequence
  Neurofibromin (147-155)
cccaccgaccuggagacaagaagcuac

SEQ ID NO: 62672 - RNA, 27 nt, Artificial Sequence
  H/ACA ribonucleoprotein complex subunit 1 (96-104)
cccuacuucaacgccccuguguaucug

SEQ ID NO: 62673 - RNA, 27 nt, Artificial Sequence
  E3 ubiquitin-protein ligase UBR4 (190-198)
cccuacaucauucacaccgugcuguau

SEQ ID NO: 62674 - RNA, 27 nt, Artificial Sequence
  Procollagen-lysine,2-oxoglutarate 5-dioxygenase 1 (449-457)
cccuacaucagcaacauuuaucugaua

SEQ ID NO: 62675 - RNA, 27 nt, Artificial Sequence
  Zinc finger protein 503 (342-350)
cccuacaagccuggccagaccguguuc

SEQ ID NO: 62676 - RNA, 27 nt, Artificial Sequence
  Synergin gamma (94-102)
cccuaccugggccaggccccuuuccuc

SEQ ID NO: 62677 - RNA, 27 nt, Artificial Sequence
  Tubulin polyglutamylase TTLL4 (755-763)
cccuaccugaucagcggcuccaaguuc

SEQ ID NO: 62678 - RNA, 33 nt, Artificial Sequence
  Protein-L-isoaspartate(D-aspartate) O-methyltransferase (45-55)
cccuacauggacagcccucaguccaucggcuuc

SEQ ID NO: 62679 - RNA, 30 nt, Artificial Sequence
  Oxysterol-binding protein-related protein 10 (414-423)
cccuacaacccuaucauuggcgagaccuuc

SEQ ID NO: 62680 - RNA, 30 nt, Artificial Sequence
  Oxysterol-binding protein-related protein 8 (441-450)
cccuacaacccuauccugggcgagaccuuc

SEQ ID NO: 62681 - RNA, 27 nt, Artificial Sequence
  DNA-dependent protein kinase catalytic subunit (2252-2260)
cccuacagacugaucuucgagaaguuu

SEQ ID NO: 62682 - RNA, 27 nt, Artificial Sequence
  Ubiquitin-associated protein 2-like (857-865)
cccuacagcggcgaccugaccaaguuc

SEQ ID NO: 62683 - RNA, 27 nt, Artificial Sequence
  Origin recognition complex subunit 5 (303-311)
cccuacuauagcaaguucauccugauu

SEQ ID NO: 62684 - RNA, 27 nt, Artificial Sequence
  Spectrin alpha chain, non-erythrocytic 1 (417-425)
cagcugcucggcagcgcccacgaggug

SEQ ID NO: 62685 - RNA, 27 nt, Artificial Sequence
  LIM and calponin homology domains-containing protein 1 (431-439)
cagauguucgagggcguggccagaguc

SEQ ID NO: 62686 - RNA, 27 nt, Artificial Sequence
  Protein transport protein Sec61 subunit alpha isoform 2 (272-280)
cagagcgcccugguguccaaccucuac

SEQ ID NO: 62687 - RNA, 36 nt, Artificial Sequence
  HLA class I histocompatibility antigen, A-1 alpha chain (86-97)
cagagcgaggacggcucccacaccauccaaauuaug

SEQ ID NO: 62688 - RNA, 27 nt, Artificial Sequence
  Peroxisome proliferator-activated receptor gamma coactivator 1-alpha (61-69)
cagagcgagaucauuuccaaccaauac

SEQ ID NO: 62689 - RNA, 36 nt, Artificial Sequence
  Probable ubiquitin carboxyl-terminal hydrolase FAF-X (1852-1863)
cagagcgaguccgaaaccgccggcucuacaaaguac

SEQ ID NO: 62690 - RNA, 27 nt, Artificial Sequence
  Obscurin-like protein 1 (662-670)
cagguggagcccggcgcccugagauac

SEQ ID NO: 62691 - RNA, 33 nt, Artificial Sequence
  Regulator of nonsense transcripts 1 (738-748)
caguggccccaaccugacaagccaauguucuuu

SEQ ID NO: 62692 - RNA, 27 nt, Artificial Sequence
  Bardet-Biedl syndrome 4 protein (147-155)
caguacgccagcgcuuuccacuuucug

SEQ ID NO: 62693 - RNA, 27 nt, Artificial Sequence
  Dynein light chain roadblock-type 1 (48-56)
caguacgccagccugaugcacuccuuc

SEQ ID NO: 62694 - RNA, 27 nt, Artificial Sequence
  Serine/threonine-protein kinase PLK4 (655-663)
caguacgccagcagauucgugcaacug

SEQ ID NO: 62695 - RNA, 30 nt, Artificial Sequence
  Neuron navigator 2 (639-648)
caguacgaccccuauaccgauagcagauuc

SEQ ID NO: 62696 - RNA, 27 nt, Artificial Sequence
  Disks large homolog 5 (1316-1324)
caguacaacccccacgugcaucaacug

SEQ ID NO: 62697 - RNA, 27 nt, Artificial Sequence
  YY1-associated protein 1 (219-227)
caguacaaccccaaguuccaaacccug

SEQ ID NO: 62698 - RNA, 27 nt, Artificial Sequence
  H/ACA ribonucleoprotein complex non-core subunit NAF1 (421-429)
caguaccccuucccucugccaguguuu

SEQ ID NO: 62699 - RNA, 27 nt, Artificial Sequence
  ATP-dependent RNA helicase DDX24 (585-593)
caguaccccggcagaagccugguguuc

SEQ ID NO: 62700 - RNA, 33 nt, Artificial Sequence
  Signal transducer and activator of transcription 1-alpha/beta (67-77)
caguacagcagauucucccuggagaacaauuuu

SEQ ID NO: 62701 - RNA, 27 nt, Artificial Sequence
  Regulatory-associated protein of mTOR (699-707)
caguacaccccccacagccaucaauuc

SEQ ID NO: 62702 - RNA, 27 nt, Artificial Sequence
  60S ribosomal protein L7 (200-208)
agauucaaggaggccaacaauuuucug

SEQ ID NO: 62703 - RNA, 27 nt, Artificial Sequence
  Cullin-3 (709-717)
agauuccugcccagcccuguggucauc

SEQ ID NO: 62704 - RNA, 27 nt, Artificial Sequence
  40S ribosomal protein S30 (115-123)
agauucgugaacgucguucccaccuuu

SEQ ID NO: 62705 - RNA, 27 nt, Artificial Sequence
  Putative PIP5K1A and PSMD4-like protein (555-563)
agaauccugagcaagcuccacaccgug

SEQ ID NO: 62706 - RNA, 27 nt, Artificial Sequence
  Schlafen family member 5 (693-701)
agaaucauggagaagauuaggaacgug

SEQ ID NO: 62707 - RNA, 27 nt, Artificial Sequence
  Condensin complex subunit 1 (412-420)
agacuggccgacaagagcgugcucguc

SEQ ID NO: 62708 - RNA, 27 nt, Artificial Sequence
  DNA replication licensing factor MCM4 (739-747)
agacuggccgaggcucacgcaaaggug

SEQ ID NO: 62709 - RNA, 30 nt, Artificial Sequence
  Histone-lysine N-methyltransferase ASH1L (2786-2795)
agacuggacaagagcgcccaccucuucuac

SEQ ID NO: 62710 - RNA, 30 nt, Artificial Sequence
  Prolyl 3-hydroxylase 1 (554-563)
agacuggacaccccccucuacuucagcuau

SEQ ID NO: 62711 - RNA, 27 nt, Artificial Sequence
  Elongation factor 2 (239-247)
agacugauggagcccaucuaccucgug

SEQ ID NO: 62712 - RNA, 30 nt, Artificial Sequence
  Solute carrier family 22 member 18 (149-158)
agacccgccgcucugggcaggcucgggcuu

SEQ ID NO: 62713 - RNA, 30 nt, Artificial Sequence
  BCL-6 corepressor (1395-1404)
agacccaugccuccagaggccaggcggcug

SEQ ID NO: 62714 - RNA, 33 nt, Artificial Sequence
  Protein FAM46B (291-301)
agacccaggccuagcaccgacgugcgggcccug

SEQ ID NO: 62715 - RNA, 27 nt, Artificial Sequence
  Nuclear factor 1 X-type (113-121)
agacaggccgacaagguguggaggcug

SEQ ID NO: 62716 - RNA, 27 nt, Artificial Sequence
  Multiple PDZ domain protein (911-919)
agacaggacgagaacacccccagcgug

SEQ ID NO: 62717 - RNA, 30 nt, Artificial Sequence
  REST corepressor 1 (336-345)
agacagcuggacauggagcucgugagcguc

SEQ ID NO: 62718 - RNA, 27 nt, Artificial Sequence
  Bifunctional coenzyme A synthase (204-212)
agacagguggagaaggccugggcucug

SEQ ID NO: 62719 - RNA, 36 nt, Artificial Sequence
  Serine/threonine-protein kinase SIK3 (368-379)
agaagcgacgccuacgaucacuauuccgcuaucuac

SEQ ID NO: 62720 - RNA, 27 nt, Artificial Sequence
  Truncated EKLF (17-25)
agaagcgacgagcugaccaggcacuac

SEQ ID NO: 62721 - RNA, 30 nt, Artificial Sequence
  Unconventional myosin-X (35-44)
agaaccgacuacggccagguguucacauau

SEQ ID NO: 62722 - RNA, 27 nt, Artificial Sequence
  Ribonuclease P protein subunit p21 (66-74)
agaaccaucgccaagaggcuggugcuc

SEQ ID NO: 62723 - RNA, 27 nt, Artificial Sequence
  Serine/threonine-protein kinase MRCK beta (1490-1498)
agaaccauggagugggugcagacaauc

SEQ ID NO: 62724 - RNA, 27 nt, Artificial Sequence
  Liprin-beta-1 (738-746)
agaguggacggcaggaugcugcacuac

SEQ ID NO: 62725 - RNA, 33 nt, Artificial Sequence
  DNA damage-binding protein 1 (263-273)
agaguggaccccaacggcagcagguaccugcuc

SEQ ID NO: 62726 - RNA, 33 nt, Artificial Sequence
  Src substrate cortactin (131-141)
agaguggaccagagcgccgucggcuucgaguac

SEQ ID NO: 62727 - RNA, 30 nt, Artificial Sequence
  HLA class I histocompatibility antigen, alpha chain E (284-293)
agauggaagcccgccagccagccuaccauc

SEQ ID NO: 62728 - RNA, 33 nt, Artificial Sequence
  Serine/threonine-protein phosphatase 2A 55 kDa regulatory subunit B alpha isoform (100-110)
agauggcugccccagaagaacgccgcucaauuc

SEQ ID NO: 62729 - RNA, 27 nt, Artificial Sequence
  snRNA-activating protein complex subunit 1 (64-72)
agauacuuccugcccccuuauaccuuu

SEQ ID NO: 62730 - RNA, 27 nt, Artificial Sequence
  Heterogeneous nuclear ribonucleoprotein H (275-283)
agauacggcgacgggggaagcaccuuc

SEQ ID NO: 62731 - RNA, 27 nt, Artificial Sequence
  Rab proteins geranylgeranyltransferase component A 1 (79-87)
agauacggcaacacccccuuccuguuu

SEQ ID NO: 62732 - RNA, 30 nt, Artificial Sequence
  Pre-mRNA-processing-splicing factor 8 (1090-1099)
agauacaucgacaggauucacauauucuuu

SEQ ID NO: 62733 - RNA, 27 nt, Artificial Sequence
  Cystine/glutamate transporter (148-156)
agauacauccuggagcccuucuuuauu

SEQ ID NO: 62734 - RNA, 27 nt, Artificial Sequence
  ER degradation-enhancing alpha-mannosidase-like protein 3 (281-289)
agauacaucagccagcccccucugcuc

SEQ ID NO: 62735 - RNA, 27 nt, Artificial Sequence
  Homeodomain-interacting protein kinase 2 (411-419)
agauacaucagccagacccaaggccug

SEQ ID NO: 62736 - RNA, 27 nt, Artificial Sequence
  DNA-directed RNA polymerase III subunit RPC3 (90-98)
agauacaucuauaccacaaagacucug

SEQ ID NO: 62737 - RNA, 27 nt, Artificial Sequence
  Probable global transcription activator SNF2L1 (867-875)
agauacaaggcccccuuccaccagcug

SEQ ID NO: 62738 - RNA, 27 nt, Artificial Sequence
  Ras GTPase-activating-like protein IQGAP1 (102-110)
agauacaaggccaccggccugcacuuc

SEQ ID NO: 62739 - RNA, 30 nt, Artificial Sequence
  RNA pseudouridylate synthase domain-containing protein 2 (461-470)
agauacaagggccccggguucgaguauuuu

SEQ ID NO: 62740 - RNA, 27 nt, Artificial Sequence
  Cytoplasmic dynein 1 heavy chain 1 (979-987)
agauacaagcuguaucaggagauguuc

SEQ ID NO: 62741 - RNA, 30 nt, Artificial Sequence
  DENN domain-containing protein 1B (346-355)
agauacaagcccggcgagccuaucaccuuc

SEQ ID NO: 62742 - RNA, 27 nt, Artificial Sequence
  Trimethylguanosine synthase (469-477)
agauaccuggagaagaacgugaaacuc

SEQ ID NO: 62743 - RNA, 27 nt, Artificial Sequence
  Catechol O-methyltransferase (196-204)
agauaccugcccgacacccuccuucug

SEQ ID NO: 62744 - RNA, 36 nt, Artificial Sequence
  Zinc finger protein 281 (390-401)
agauaccugcccaccgccagcuccaacucugcuuuc

SEQ ID NO: 62745 - RNA, 30 nt, Artificial Sequence
  Histone-binding protein RBBP7 (130-139)
agauacaugccccagaacccucacaucauu

SEQ ID NO: 62746 - RNA, 27 nt, Artificial Sequence
  E3 ubiquitin-protein ligase DZIP3 (194-202)
agauacaacggcgggcugcucgaguuc

SEQ ID NO: 62747 - RNA, 27 nt, Artificial Sequence
  Influenza virus NS1A-binding protein (531-539)
agauacaaccccgagaauaacaccugg

SEQ ID NO: 62748 - RNA, 27 nt, Artificial Sequence
  Kelch-like protein 11 (425-433)
agauacaaccccaaucugaacaccugg

SEQ ID NO: 62749 - RNA, 27 nt, Artificial Sequence
  Solute carrier family 35 member B1 (235-243)
agauaccccgccaucauuuauaacaua

SEQ ID NO: 62750 - RNA, 30 nt, Artificial Sequence
  Myotubularin-related protein 5 (78-87)
agauaccccccugacaucagggccaccuuc

SEQ ID NO: 62751 - RNA, 30 nt, Artificial Sequence
  Myotubularin-related protein 13 (1004-1013)
agauacccccagagcaucuucuccaccuuu

SEQ ID NO: 62752 - RNA, 27 nt, Artificial Sequence
  Golgin subfamily B member 1 (2035-2043)
agauaccaggagaagaucagcgcccug

SEQ ID NO: 62753 - RNA, 27 nt, Artificial Sequence
  Zinc phosphodiesterase ELAC protein 2 (313-321)
agauaccagcaauggauggagagguuc

SEQ ID NO: 62754 - RNA, 27 nt, Artificial Sequence
  Supervillin (423-431)
agauaccagacccaacccgugacacug

SEQ ID NO: 62755 - RNA, 36 nt, Artificial Sequence
  Magnesium transporter protein 1 (137-148)
agauacagcuccgccuucaccaacaggaucuuuuuc

SEQ ID NO: 62756 - RNA, 33 nt, Artificial Sequence
  Retinoic acid receptor alpha (412-422)
agauacacccccgagcaggacacaaugacuuuc

SEQ ID NO: 62757 - RNA, 27 nt, Artificial Sequence
  Beta-hexosaminidase subunit alpha (36-44)
agauacgugcuguaucccaacaauuuc

SEQ ID NO: 62758 - RNA, 33 nt, Artificial Sequence
  Beta-hexosaminidase subunit alpha (36-46)
agauacgugcuguaucccaacaauuuccaguuu

SEQ ID NO: 62759 - RNA, 27 nt, Artificial Sequence
  39S ribosomal protein L43, mitochondrial (21-29)
agauacgugcagcaacugcagaggcuc

SEQ ID NO: 62760 - RNA, 27 nt, Artificial Sequence
  Syntaxin-binding protein 1 (149-157)
agcgccgacuccuuccagucuuuuuac

SEQ ID NO: 62761 - RNA, 27 nt, Artificial Sequence
  Histone-binding protein RBBP4 (220-228)
agcuucaaccccuacuccgaguuuauc

SEQ ID NO: 62762 - RNA, 27 nt, Artificial Sequence
  Hemoglobin subunit alpha (7-15)
agcuuccccaccacaaagacuuacuuu

SEQ ID NO: 62763 - RNA, 27 nt, Artificial Sequence
  Dolichyl-diphosphooligosaccharide-proteinosyltransferase subunit 2 (185-193)
agcuucacccccgugggcgacgucuuu

SEQ ID NO: 62764 - RNA, 36 nt, Artificial Sequence
  Heat shock-related 70 kDa protein 2 (211-222)
agcauccugaccauugaggacggcauauucgaagug

SEQ ID NO: 62765 - RNA, 27 nt, Artificial Sequence
  Transcription factor BTF3 (88-96)
agccuggccgcuaacaccuucacaauc

SEQ ID NO: 62766 - RNA, 27 nt, Artificial Sequence
  Superkiller viralicidic activity 2-like 2 (92-100)
agccuggccgaccucaugcccagagug

SEQ ID NO: 62767 - RNA, 30 nt, Artificial Sequence
  Aminopeptidase B (318-327)
agccuggccgacgugaucauucacgagaua

SEQ ID NO: 62768 - RNA, 27 nt, Artificial Sequence
  Epoxide hydrolase 1 (350-358)
agccuggacgaucuccuuaccaacgug

SEQ ID NO: 62769 - RNA, 27 nt, Artificial Sequence
  Band 4.1-like protein 2 (550-558)
agccuggacggcgcccccaucggggug

SEQ ID NO: 62770 - RNA, 27 nt, Artificial Sequence
  RNA-binding motif protein, X-linked-like-2 (67-75)
agccuggacggcaaggccaucaaagug

SEQ ID NO: 62771 - RNA, 27 nt, Artificial Sequence
  Telomere-associated protein RIF1 (1157-1165)
agccuggacaagaccucccccgagaug

SEQ ID NO: 62772 - RNA, 27 nt, Artificial Sequence
  Cytoskeleton-associated protein 4 (535-543)
agccuggacaaccucaaggccuccgug

SEQ ID NO: 62773 - RNA, 24 nt, Artificial Sequence
  Signal recognition particle 54 kDa protein (200-207)
agccuguucgaggaaaugcuccag

SEQ ID NO: 62774 - RNA, 27 nt, Artificial Sequence
  WD repeat and FYVE domain-containing protein 3 (1518-1526)
agccuguucgagcacuuuaucgaacuc

SEQ ID NO: 62775 - RNA, 30 nt, Artificial Sequence; identical to SEQ ID NO: 38548
  Programmed cell death 6-interacting protein (103-112)

SEQ ID NO: 62776 - RNA, 36 nt, Artificial Sequence
  Junction plakoglobin (670-681)
agccuguucaagcacgaccccgccgcuugggaggca

SEQ ID NO: 62777 - RNA, 39 nt, Artificial Sequence
  Unconventional myosin-Ib (552-564)
agccuguuccccgagggcaacccugccaagaucaaucuc

SEQ ID NO: 62778 - RNA, 27 nt, Artificial Sequence
  Disintegrin and metalloproteinase domain-containing protein 10 (80-88)
agccuguucuccgacgaguuuaaggug

SEQ ID NO: 62779 - RNA, 30 nt, Artificial Sequence
  Renin receptor (103-112)
agccuguucuccgaggaaacccccgugguc

SEQ ID NO: 62780 - RNA, 27 nt, Artificial Sequence
  Tyrosine-protein phosphatase non-receptor type 9 (479-487)
agccugaucgacuuccucagagugguc

SEQ ID NO: 62781 - RNA, 27 nt, Artificial Sequence
  Probable E3 ubiquitin-protein ligase HECTD4 (234-242)
agccugaagaccuucgugcacacaguc

SEQ ID NO: 62782 - RNA, 30 nt, Artificial Sequence
  Acyl-coenzyme A thioesterase 1 isoform X1 (59-68)
agccugcucgccggcaagggguucgcugug

SEQ ID NO: 62783 - RNA, 27 nt, Artificial Sequence
  Cell cycle checkpoint control protein RAD9A (254-262)
agccugcucgacggccacuucgugcuu

SEQ ID NO: 62784 - RNA, 27 nt, Artificial Sequence
  Unconventional myosin-Ib (9-17)
agccugcucgacaacaugaucggcgug

SEQ ID NO: 62785 - RNA, 27 nt, Artificial Sequence
  Protein virilizer homolog (1470-1478)
agccugcucgacuccguggucggccuu

SEQ ID NO: 62786 - RNA, 27 nt, Artificial Sequence
  Programmed cell death 6-interacting protein (554-562)
agccugcucuccaaccuugacgaggug

SEQ ID NO: 62787 - RNA, 33 nt, Artificial Sequence
  E3 ubiquitin-protein ligase UBR1 (683-693)
agccugauggaccccaacaaguuccuccuucug

SEQ ID NO: 62788 - RNA, 33 nt, Artificial Sequence
  Insulin receptor substrate 2 (1109-1119)
agccugauggagcagguguccggcgucgaagcc

SEQ ID NO: 62789 - RNA, 27 nt, Artificial Sequence
  UHRF1-binding protein 1-like (1293-1301)
agccugaugaacauccagcacuuccuc

SEQ ID NO: 62790 - RNA, 30 nt, Artificial Sequence
  DNA-dependent protein kinase catalytic subunit (3481-3490)
agccugaugaccaaggagaucuccucugug

SEQ ID NO: 62791 - RNA, 27 nt, Artificial Sequence
  Serpin H1 (304-312)
agccugcccaagggcguggucgagguu

SEQ ID NO: 62792 - RNA, 24 nt, Artificial Sequence
  Vimentin (226-233)
agccugcaggaggaaaucgccuuc

SEQ ID NO: 62793 - RNA, 30 nt, Artificial Sequence
  Enhancer of mRNA-decapping protein 4 (777-786)
agccugcaggaguccauccucgcccaagug

SEQ ID NO: 62794 - RNA, 27 nt, Artificial Sequence
  Plasma membrane calcium-transporting ATPase 4 (1197-1205)
agccugcagucccucgagaccucugug

SEQ ID NO: 62795 - RNA, 27 nt, Artificial Sequence
  Ubiquitin-associated protein 2-like (493-501)
agccugaccuccaagauccccgcccuc

SEQ ID NO: 62796 - RNA, 33 nt, Artificial Sequence
  Ras-related C3 botulinum toxin substrate 1 (39-49)
agccuggugucccccgccucuuucgagaacguc

SEQ ID NO: 62797 - RNA, 27 nt, Artificial Sequence
  Renin receptor (241-249)
agccuguacggcgggaacgccgugguc

SEQ ID NO: 62798 - RNA, 33 nt, Artificial Sequence; identical to SEQ ID NO: 38571
  Renin receptor (241-251)

SEQ ID NO: 62799 - RNA, 39 nt, Artificial Sequence
  Renin receptor (241-253)
agccuguacggcgggaacgccguggucgagcucguuacc

SEQ ID NO: 62800 - RNA, 27 nt, Artificial Sequence
  Nucleolar pre-ribosomal-associated protein 1 (1994-2002)
agccuguacaucaaggacauuuggcuc

SEQ ID NO: 62801 - RNA, 30 nt, Artificial Sequence
  Endoplasmin (71-80)
agccuguacaagaacaaagagaucuuccuc

SEQ ID NO: 62802 - RNA, 27 nt, Artificial Sequence
  Probable ATP-dependent RNA helicase DDX59 (525-533)
agcauggacgaguacgugcaccagauc

SEQ ID NO: 62803 - RNA, 36 nt, Artificial Sequence
  Zinc finger protein 841 (58-69)
agcaugcuggagcagggcaaggaacccuggaccgug

SEQ ID NO: 62804 - RNA, 27 nt, Artificial Sequence
  E3 ubiquitin-protein ligase UBR2 (703-711)
agcaugauggaccccaaccacuuccug

SEQ ID NO: 62805 - RNA, 27 nt, Artificial Sequence
  Neuroblast differentiation-associated protein AHNAK (323-331)
agcauguccgagguggaccugaacguc

SEQ ID NO: 62806 - RNA, 27 nt, Artificial Sequence
  Unhealthy ribosome biogenesis protein 2 homolog (629-637)
agcauguccggcccccugaucggggug

SEQ ID NO: 62807 - RNA, 33 nt, Artificial Sequence
  Desmoplakin (1673-1683)
agcaugguggaggacaucaccggccugagacuc

SEQ ID NO: 62808 - RNA, 39 nt, Artificial Sequence
  Aminoacyl tRNA synthase complex-interacting multifunctional protein 1 (90-102)
agcaugguguccgagaacgucauccagucuaccgccguu

SEQ ID NO: 62809 - RNA, 27 nt, Artificial Sequence
  Poly (ADP-ribose) polymerase 4 (1186-1194)
agccccuucccugacaucccaaaggug

SEQ ID NO: 62810 - RNA, 27 nt, Artificial Sequence
  Neuroblast differentiation-associated protein AHNAK (1150-1158)
agccccaagggcaaauucucccuguuu

SEQ ID NO: 62811 - RNA, 30 nt, Artificial Sequence
  Cohesin subunit SA-1 (459-468)
agccccaacggcaaucugaucagaaugcuc

SEQ ID NO: 62812 - RNA, 27 nt, Artificial Sequence
  Neural Wiskott-Aldrich syndrome protein (82-90)
agccccagaggcuacuuccacaccuuu

SEQ ID NO: 62813 - RNA, 27 nt, Artificial Sequence
  Collagen alpha-1(VII) chain (586-594)
agccccagagugccuuccaucgagcug

SEQ ID NO: 62814 - RNA, 27 nt, Artificial Sequence
  Microtubule-associated protein 4 (280-288)
agccccaccaagcuggacgugacacuc

SEQ ID NO: 62815 - RNA, 27 nt, Artificial Sequence
  Kelch repeat and BTB domain-containing protein 2 (594-602)
agccccuggaagccuccaaccuaccug

SEQ ID NO: 62816 - RNA, 27 nt, Artificial Sequence
  Molybdenum cofactor sulfurase (515-523)
agccaggccgacgugauccccgcuguc

SEQ ID NO: 62817 - RNA, 27 nt, Artificial Sequence
  Protein FAM63A (74-82)
agcuccgcccccccuggcccaacccug

SEQ ID NO: 62818 - RNA, 27 nt, Artificial Sequence
  Coatomer subunit gamma-2 (186-194)
agcuccgacaacaucauggugcaguac

SEQ ID NO: 62819 - RNA, 30 nt, Artificial Sequence
  Oxysterol-binding protein-related protein 8 (244-253)
agcuccgacucuacccacgugacauucuac

SEQ ID NO: 62820 - RNA, 33 nt, Artificial Sequence
  RNA-binding protein with multiple splicing 2 (84-94)
agcuccgacaccacacagcaaggcuggaaguac

SEQ ID NO: 62821 - RNA, 27 nt, Artificial Sequence
  Discoidin domain-containing receptor 2 (676-684)
agcuccgacgugagaaccgucucuuac

SEQ ID NO: 62822 - RNA, 42 nt, Artificial Sequence
  RNA-binding protein EWS (265-278)
agcuccuucagacaggaccaccccucuucaaugggcguguac

SEQ ID NO: 62823 - RNA, 27 nt, Artificial Sequence
  Bromodomain and WD repeat-containing protein 1 (343-351)
agcaccgaccacgugaucagaauguac

SEQ ID NO: 62824 - RNA, 30 nt, Artificial Sequence
  Integrin alpha-5 (179-188)
agcaccgacaacuucacaagaauccuggag

SEQ ID NO: 62825 - RNA, 27 nt, Artificial Sequence
  Actin filament-associated protein 1 (443-451)
agcaccgaccccgaggcccugcacuac

SEQ ID NO: 62826 - RNA, 33 nt, Artificial Sequence
  Eukaryotic translation initiation factor 2A (26-36)
agcaccgacguggauaagacaggcgccuccuac

SEQ ID NO: 62827 - RNA, 30 nt, Artificial Sequence
  NADH dehydrogenase (ubiquinone) iron-sulfur protein 8, mitochondrial (174-183)
agcaccgagacacacgaagagcugcucuac

SEQ ID NO: 62828 - RNA, 39 nt, Artificial Sequence
  Src substrate cortactin (285-297)
agcaccuucgaggacgugacacaggucuccucugccuac

SEQ ID NO: 62829 - RNA, 30 nt, Artificial Sequence
  Protein Smaug homolog 1 (46-55)
agcguggacuacggccagacccacuauuac

SEQ ID NO: 62830 - RNA, 27 nt, Artificial Sequence
  Eukaryotic peptide chain release factor subunit 1 (70-78)
agcgugcugggcgccaucaccuccguc

SEQ ID NO: 62831 - RNA, 30 nt, Artificial Sequence
  Elongation factor 2 (500-509)
agcgugucccccgucguuagaguggccgua

SEQ ID NO: 62832 - RNA, 27 nt, Artificial Sequence
  Serum paraoxonase/arylesterase 2 (334-342)
agcguguacgacggcaagcugcucauc

SEQ ID NO: 62833 - RNA, 33 nt, Artificial Sequence; identical to SEQ ID NO: 38606
  Renin receptor (47-57)

SEQ ID NO: 62834 - RNA, 27 nt, Artificial Sequence
  Short transient receptor potential channel 4-associated protein (540-548)
agcuacgccgaccagauguuccugcuc

SEQ ID NO: 62835 - RNA, 27 nt, Artificial Sequence
  Ankyrin repeat and BTB/POZ domain-containing protein 2 (419-427)
agcuacgccgagaccccccugcagcuc

SEQ ID NO: 62836 - RNA, 27 nt, Artificial Sequence
  Zinc-binding alcohol dehydrogenase domain-containing protein 2 (16-24)
agcuacgccagacacuuccuggacuuu

SEQ ID NO: 62837 - RNA, 30 nt, Artificial Sequence
  Spatacsin (908-917)
agcuacgccucccugcagcaaaacaagugg

SEQ ID NO: 62838 - RNA, 30 nt, Artificial Sequence
  Tubulin polyglutamylase TTLL4 (773-782)
agcuacgacccccugagaaucuaucucuuc

SEQ ID NO: 62839 - RNA, 27 nt, Artificial Sequence
  Kinectin (1090-1098)
agcuacggcgaguggcugcacggguuc

SEQ ID NO: 62840 - RNA, 27 nt, Artificial Sequence
  Serine/threonine-protein kinase 3 (65-73)
agcuacggcuccguguucaaggccauc

SEQ ID NO: 62841 - RNA, 27 nt, Artificial Sequence
  Ubiquitin-like modifier-activating enzyme 1 (921-929)
agcuacaagaacggcuuccugaaucuc

SEQ ID NO: 62842 - RNA, 27 nt, Artificial Sequence
  Unconventional myosin-Va (78-86)
agcuaccugcacgagcccgccgugcuc

SEQ ID NO: 62843 - RNA, 27 nt, Artificial Sequence
  Actin-related protein 10 (66-74)
agcuaccugaaggaguucauccacauu

SEQ ID NO: 62844 - RNA, 27 nt, Artificial Sequence
  Kelch-like protein 15 (402-410)
agcuacaacggcaagcuguauguguuc

SEQ ID NO: 62845 - RNA, 33 nt, Artificial Sequence
  Coatomer subunit alpha (369-379)
agcuacaaccccgccgagaaugcugugcugcuc

SEQ ID NO: 62846 - RNA, 27 nt, Artificial Sequence
  Protein artemis (321-329)
agcuacuccgagaucaaggacuuccug

SEQ ID NO: 62847 - RNA, 27 nt, Artificial Sequence
  Zinc finger protein 24 (343-351)
agcuacucccagucuucaaaccuguuc

SEQ ID NO: 62848 - RNA, 27 nt, Artificial Sequence
  Melanoma-associated antigen 3 (282-290)
agcuacgugaagguccugcaccauaug

SEQ ID NO: 62849 - RNA, 27 nt, Artificial Sequence
  Basement membrane-specific heparan sulfate proteoglycan core protein (176-184)
agcuacgugaccuccccccagggcuuc

SEQ ID NO: 62850 - RNA, 27 nt, Artificial Sequence
  Cell differentiation protein RCD1 homolog (6-14)
accgccgcucccgugccuacaacucug

SEQ ID NO: 62851 - RNA, 27 nt, Artificial Sequence
  Protein PRRC2C (2488-2496)
accgccauccacaacuuccccacagug

SEQ ID NO: 62852 - RNA, 27 nt, Artificial Sequence
  Lipoma-preferred partner (284-292)
accgccauggaccagguguuccacguc

SEQ ID NO: 62853 - RNA, 27 nt, Artificial Sequence
  Integrator complex subunit 1 (301-309)
accgccacaaugcacauccuggugguc

SEQ ID NO: 62854 - RNA, 27 nt, Artificial Sequence
  Histone-lysine N-methyltransferase 2C (316-324)
accuuccaggacuuuagccacaucuuc

SEQ ID NO: 62855 - RNA, 27 nt, Artificial Sequence
  Probable ATP-dependent RNA helicase DDX27 (430-438)
accuucacagaccacgugaugcuguuu

SEQ ID NO: 62856 - RNA, 27 nt, Artificial Sequence
  Zinc finger protein RFP (458-466)
accuucacauuuagccacgccacuuuc

SEQ ID NO: 62857 - RNA, 27 nt, Artificial Sequence
  WD repeat-containing protein 61 (32-40)
acccacgugggcaaggucaacaucuuc

SEQ ID NO: 62858 - RNA, 27 nt, Artificial Sequence
  Very-long-chain enoyl-CoA reductase (28-36)
accaucgccgagauuaagaaccuguuc

SEQ ID NO: 62859 - RNA, 27 nt, Artificial Sequence
  Heat shock-related 70 kDa protein 2 (214-222)
accaucgaggacggcauuuucgaagug

SEQ ID NO: 62860 - RNA, 27 nt, Artificial Sequence
  40S ribosomal protein S4, X isoform (127-135)
accaucagauaccccgacccucugauu

SEQ ID NO: 62861 - RNA, 27 nt, Artificial Sequence
  Protein FAM73A (584-592)
acccuggccgaggaccucaugcagcuu

SEQ ID NO: 62862 - RNA, 33 nt, Artificial Sequence
  Calmodulin-regulated spectrin-associated protein 1 (102-112)
acccuggccgagcuccagcccccugugcaacuu

SEQ ID NO: 62863 - RNA, 27 nt, Artificial Sequence
  Importin-4 (587-595)
acccuggccgagacaauccagggccuc

SEQ ID NO: 62864 - RNA, 27 nt, Artificial Sequence
  E3 ubiquitin-protein ligase UBR4 (345-353)
acccuggacgccgcuaucagcaaggug

SEQ ID NO: 62865 - RNA, 27 nt, Artificial Sequence
  Molybdenum cofactor sulfurase (474-482)
acccuggacgaugugcaggccuuccuc

SEQ ID NO: 62866 - RNA, 27 nt, Artificial Sequence
  Solute carrier family 23 member 2 (493-501)
acccuguucggcaugaucacagccgug

SEQ ID NO: 62867 - RNA, 33 nt, Artificial Sequence
  Putative elongation factor 1-alpha-like 3 (142-152)
acccugggcgugaagcagcucaucgucgggguu

SEQ ID NO: 62868 - RNA, 27 nt, Artificial Sequence
  Dynactin subunit 1 (646-654)
acccugcacagauacgagcaugcccuc

SEQ ID NO: 62869 - RNA, 30 nt, Artificial Sequence
  60S acidic ribosomal protein P0 (50-59)
acccugcacagcagauuccucgagggcgug

SEQ ID NO: 62870 - RNA, 27 nt, Artificial Sequence
  Peptidyl-prolyl cis-trans isomerase FKBP9 (457-465)
acccugcucgacagcacauggaaccuu

SEQ ID NO: 62871 - RNA, 30 nt, Artificial Sequence; identical to SEQ ID NO: 38644
  Midasin (3030-3039)

SEQ ID NO: 62872 - RNA, 30 nt, Artificial Sequence
  Puromycin-sensitive aminopeptidase (786-795)
acccugcuccccgaccuuauccagaaggug

SEQ ID NO: 62873 - RNA, 33 nt, Artificial Sequence
  116 kDa U5 small nuclear ribonucleoprotein component (103-113)
acccugauggagcagacacuccccgugacuguc

SEQ ID NO: 62874 - RNA, 27 nt, Artificial Sequence
  SH3 domain-binding glutamic acid-rich-like protein 3 (218-226)
acccugcaggaguuccucaagcuugcc

SEQ ID NO: 62875 - RNA, 27 nt, Artificial Sequence
  Zinc finger BED domain-containing protein 5 (529-537)
acccugagcgacuuccucacagagauc

SEQ ID NO: 62876 - RNA, 27 nt, Artificial Sequence
  Elongation protein 4 homolog (S. cerevisiae), isoform CRA_b (319-327)
acccugagcgacguggucguuggccuc

SEQ ID NO: 62877 - RNA, 27 nt, Artificial Sequence
  Protein MON2 homolog (629-637)
acccugagcaacaaguccuacucugug

SEQ ID NO: 62878 - RNA, 39 nt, Artificial Sequence
  Malate dehydrogenase, mitochondrial (54-66)
acccuguacgacaucgcccacacacccggcguggcugca

SEQ ID NO: 62879 - RNA, 27 nt, Artificial Sequence
  Cyclic AMP-dependent transcription factor ATF-6 beta (30-38)
acccuguacagcggccucgacgaggug

SEQ ID NO: 62880 - RNA, 30 nt, Artificial Sequence
  NAD(P)H dehydrogenase (quinone) 1 (124-133)
acccccgccgacgcuagaauccagauucug

SEQ ID NO: 62881 - RNA, 27 nt, Artificial Sequence
  Dual specificity protein phosphatase 4 (356-364)
acccccgccacaccuacuagccaguuc

SEQ ID NO: 62882 - RNA, 27 nt, Artificial Sequence
  Cytoplasmic dynein 1 heavy chain 1 (264-272)
acccccagaauccagggccugacagug

SEQ ID NO: 62883 - RNA, 27 nt, Artificial Sequence
  Exostosin-2 (555-563)
accagcgacgagcugcaguucggcuac

SEQ ID NO: 62884 - RNA, 30 nt, Artificial Sequence
  Anoctamin-1 (662-671)
accagcgacuucauccccagacugguguac

SEQ ID NO: 62885 - RNA, 33 nt, Artificial Sequence
  Actin-binding LIM protein 3 (350-360)
accagcgaggacaucucccagacaucuaaguac

SEQ ID NO: 62886 - RNA, 33 nt, Artificial Sequence
  Serine/threonine-protein kinase MRCK alpha (699-709)
accagcgagcuggacaagcucacaacucuuuac

SEQ ID NO: 62887 - RNA, 30 nt, Artificial Sequence
  Catenin beta-1 (297-306)
accacagacugccugcagauccucgccuac

SEQ ID NO: 62888 - RNA, 30 nt, Artificial Sequence
  Junction plakoglobin (287-296)
accacagacugccugcagcuccuugccuac

SEQ ID NO: 62889 - RNA, 27 nt, Artificial Sequence
  ATP-dependent 6-phosphofructokinase, muscle type (251-259)
accacagacuucaucuuuaaccuguac

SEQ ID NO: 62890 - RNA, 27 nt, Artificial Sequence
  Serine/threonine-protein kinase N2 (73-81)
accacagacaagaaaagccuggccuac

SEQ ID NO: 62891 - RNA, 27 nt, Artificial Sequence
  Heterogeneous nuclear ribonucleoprotein F (256-264)
accacagaccuguucggcagagaucuc

SEQ ID NO: 62892 - RNA, 30 nt, Artificial Sequence
  Heterogeneous nuclear ribonucleoprotein F (256-265)
accacagaccuguucggcagagaucucagc

SEQ ID NO: 62893 - RNA, 30 nt, Artificial Sequence
  Cofilin-1 (63-72)
accguggacgaucccuacgccacauucguc

SEQ ID NO: 62894 - RNA, 27 nt, Artificial Sequence
  Heat shock cognate 71 kDa protein (138-146)
accgugacaaacgccgucguuacugug

SEQ ID NO: 62895 - RNA, 27 nt, Artificial Sequence
  Kelch-like protein 9 (442-450)
accguguacggcgggcugauguauauc

SEQ ID NO: 62896 - RNA, 27 nt, Artificial Sequence
  Kelch-like protein 13 (468-476)
accguguacggcggggucauguauauc

SEQ ID NO: 62897 - RNA, 30 nt, Artificial Sequence
  60S ribosomal protein L13 (24-33)
accugguucaaccagcccgccagaaagauc

SEQ ID NO: 62898 - RNA, 33 nt, Artificial Sequence; identical to SEQ ID NO: 38671
  WD repeat-containing protein 35 (163-173)

SEQ ID NO: 62899 - RNA, 36 nt, Artificial Sequence
  26S protease regulatory subunit 4 (183-194)
accuacgccgacaucggcgggcuggauaaccagauu

SEQ ID NO: 62900 - RNA, 27 nt, Artificial Sequence
  DNA replication licensing factor MCM3 (90-98)
accuacgccaagcaguaugaggaauuc

SEQ ID NO: 62901 - RNA, 27 nt, Artificial Sequence
  AT-rich interactive domain-containing protein 2 (938-946)
accuacgcccccgcuauccaccagauu

SEQ ID NO: 62902 - RNA, 27 nt, Artificial Sequence
  Ataxin-2-like protein (167-175)
accuacgagggcaucuucaagacacug

SEQ ID NO: 62903 - RNA, 27 nt, Artificial Sequence
  Dedicator of cytokinesis protein 7 (588-596)
accuacuucgacaagaacuauaaucug

SEQ ID NO: 62904 - RNA, 27 nt, Artificial Sequence
  Tubulin beta-6 chain (156-164)
accuacggcgaccugaaccaccucgug

SEQ ID NO: 62905 - RNA, 27 nt, Artificial Sequence
  Cytoplasmic aconitate hydratase (542-550)
accuacaucaagagccccccuuucuuu

SEQ ID NO: 62906 - RNA, 27 nt, Artificial Sequence
  Fanconi anemia group M protein (303-311)
accuacauccagauucuggagagcuuc

SEQ ID NO: 62907 - RNA, 27 nt, Artificial Sequence
  Protein FAM178B (655-663)
accuacaucagauggcaggagcugcuc

SEQ ID NO: 62908 - RNA, 27 nt, Artificial Sequence
  DNA-dependent protein kinase catalytic subunit (523-531)
accuacaaggacuauguggaucuguuc

SEQ ID NO: 62909 - RNA, 27 nt, Artificial Sequence
  ETS translocation variant 3 (134-142)
accuacaaguucaacuuuaauaaacug

SEQ ID NO: 62910 - RNA, 33 nt, Artificial Sequence
  Leucine-rich repeat-containing protein 58 (257-267)
accuaccugcccagagagauccucaaccuuauu

SEQ ID NO: 62911 - RNA, 30 nt, Artificial Sequence
  Eukaryotic translation initiation factor 3 subunit I (47-56)
accuacaugggccacacaggggccgugugg

SEQ ID NO: 62912 - RNA, 27 nt, Artificial Sequence
  F-box only protein 38 (157-165)
accuacaugccccacgugcauauccug

SEQ ID NO: 62913 - RNA, 30 nt, Artificial Sequence; identical to SEQ ID NO: 38686
  Protein polybromo-1 (261-270)

SEQ ID NO: 62914 - RNA, 30 nt, Artificial Sequence
  Cell division cycle and apoptosis regulator protein 1 (191-200)
accuacaaccccaauaugccuuucaagugg

SEQ ID NO: 62915 - RNA, 27 nt, Artificial Sequence
  Cell cycle control protein 50A (296-304)
accuacaacuaucccgugcacuacuuc

SEQ ID NO: 62916 - RNA, 27 nt, Artificial Sequence
  Aryl hydrocarbon receptor (47-55)
accuaccccgccgagcugaacaauauc

SEQ ID NO: 62917 - RNA, 27 nt, Artificial Sequence
  Elongation factor 1-gamma (5-13)
accuaccccgagaacuggagagccuuc

SEQ ID NO: 62918 - RNA, 27 nt, Artificial Sequence
  Pre-mRNA-processing-splicing factor 8 (224-232)
accuaccagagauggcaauucacacug

SEQ ID NO: 62919 - RNA, 27 nt, Artificial Sequence
  Helicase SKI2W (746-754)
accuacacaaugauccugaaccuccuu

SEQ ID NO: 62920 - RNA, 27 nt, Artificial Sequence
  U5 small nuclear ribonucleoprotein 200 kDa helicase (604-612)
accuacacacagcuggugagacucauc

SEQ ID NO: 62921 - RNA, 27 nt, Artificial Sequence
  Catenin beta-1 (330-338)
accuacacauaugagaagcugcucugg

SEQ ID NO: 62922 - RNA, 27 nt, Artificial Sequence
  Alanine-tRNA ligase, cytoplasmic (24-32)
accuacgugcacagcuccgccacaauc

SEQ ID NO: 62923 - RNA, 27 nt, Artificial Sequence
  E3 ubiquitin-protein ligase RNF213 (931-939)
accuacgugaaggagaucgaagucugg

SEQ ID NO: 62924 - RNA, 27 nt, Artificial Sequence
  tRNA wybutosine-synthesizing protein 4 (507-515)
accuacgugcccuggccucugaugcuc

SEQ ID NO: 62925 - RNA, 27 nt, Artificial Sequence
  Cholinephosphotransferase 1 (178-186)
accuacgugagcggcaugcugagauuc

SEQ ID NO: 62926 - RNA, 27 nt, Artificial Sequence
  Kinectin (1222-1230)
accuacgugacagaggucagagaacug

SEQ ID NO: 62927 - RNA, 27 nt, Artificial Sequence
  Renin receptor (97-105)
guggccaacagcauccacucccuguuc

SEQ ID NO: 62928 - RNA, 27 nt, Artificial Sequence
  Elongation factor 1-alpha 1 (433-441)
guggccgucggcguuaucaaggcugug

SEQ ID NO: 62929 - RNA, 27 nt, Artificial Sequence
  Glycogen synthase kinase-3 alpha (117-125)
guggccuacaccgacaucaaggucauu

SEQ ID NO: 62930 - RNA, 27 nt, Artificial Sequence
  Influenza virus NS1A-binding protein (484-492)
guguucgaccccgucaccaagcugugg

SEQ ID NO: 62931 - RNA, 39 nt, Artificial Sequence
  Cathepsin D (178-190)
guguucggcgaggccaccaagcagcccgggaucacauuu

SEQ ID NO: 62932 - RNA, 30 nt, Artificial Sequence
  Pre-mRNA-processing factor 19 (271-280)
guguuccaccccagccaggaccuggucuuu

SEQ ID NO: 62933 - RNA, 27 nt, Artificial Sequence
  Heterogeneous nuclear ribonucleoprotein C-like 1 (18-26)
guguucaucggcaaccugaauacccuc

SEQ ID NO: 62934 - RNA, 33 nt, Artificial Sequence
  Tectonic-3 (150-160)
guguucauggacagcaacggcaucagacaguuu

SEQ ID NO: 62935 - RNA, 30 nt, Artificial Sequence
  Serine/threonine-protein kinase N2 (753-762)
guguucagcgagcccagagccgucuuuuac

SEQ ID NO: 62936 - RNA, 27 nt, Artificial Sequence
  Paired amphipathic helix protein Sin3b (212-220)
guguucaccgaggucgccaaccuguuu

SEQ ID NO: 62937 - RNA, 33 nt, Artificial Sequence
  Cytospin-A (478-488)
gugaucgacgaggaugucaagagcggcagauac

SEQ ID NO: 62938 - RNA, 27 nt, Artificial Sequence
  Bifunctional glutamate/proline-tRNA ligase (506-514)
gugaucgaccccgucgccccuagauac

SEQ ID NO: 62939 - RNA, 30 nt, Artificial Sequence
  Zinc finger protein 638 (208-217)
gugaucgacuacggccacgccagcaaguau

SEQ ID NO: 62940 - RNA, 27 nt, Artificial Sequence
  DNA replication licensing factor MCM4 (151-159)
gugaucuggggcaccgacgucaacguu

SEQ ID NO: 62941 - RNA, 27 nt, Artificial Sequence
  Eukaryotic initiation factor 4A-II (181-189)
gugcuggacgaggccgaugaaaugcuc

SEQ ID NO: 62942 - RNA, 27 nt, Artificial Sequence
  Protein VPRBP (540-548)
gugcuggacgaggccggcagcaccguc

SEQ ID NO: 62943 - RNA, 27 nt, Artificial Sequence
  Protein ELYS (1430-1438)
gugcuggacgagggccucaccagcguc

SEQ ID NO: 62944 - RNA, 33 nt, Artificial Sequence
  WD repeat-containing protein 48 (472-482)
gugcuggaccccaacauggaucucagaaccguc

SEQ ID NO: 62945 - RNA, 33 nt, Artificial Sequence
  Acylamino-acid-releasing enzyme (226-236)
gugcuggacgucgagagcggcaacaucuccguu

SEQ ID NO: 62946 - RNA, 30 nt, Artificial Sequence; identical to SEQ ID NO: 38719
  Serine/threonine-protein kinase Sgk1 (270-279)

SEQ ID NO: 62947 - RNA, 33 nt, Artificial Sequence; identical to SEQ ID NO: 38720
  Serine/threonine-protein kinase Sgk1 (270-280)

SEQ ID NO: 62948 - RNA, 36 nt, Artificial Sequence
  Serine/threonine-protein kinase Sgk1 (270-281)
gugcuggacuacaucaacggcggggagcucuucuau

SEQ ID NO: 62949 - RNA, 27 nt, Artificial Sequence
  RNA-binding protein 34 (333-341)
gugcuguucgagaacaccgacagcguc

SEQ ID NO: 62950 - RNA, 30 nt, Artificial Sequence
  Major prion protein (233-242)
gugcuguucagcucccccccugucauccuc

SEQ ID NO: 62951 - RNA, 27 nt, Artificial Sequence
  Protein transport protein Sec16A (1388-1396)
gugcugaucggcagcaaccacucccuc

SEQ ID NO: 62952 - RNA, 27 nt, Artificial Sequence
  ATP-binding cassette sub-family D member 3 (541-549)
gugcugaaggaguaccucgacaacguc

SEQ ID NO: 62953 - RNA, 30 nt, Artificial Sequence; identical to SEQ ID NO: 38726
  Phosphotriesterase-related protein (148-157)

SEQ ID NO: 62954 - RNA, 33 nt, Artificial Sequence
  Eukaryotic translation initiation factor 4 gamma 1 (187-197)
gugcugaugaaccagcccccucaaaucgcccca

SEQ ID NO: 62955 - RNA, 27 nt, Artificial Sequence
  GDP-L-fucose synthase (187-195)
gugcugcccggccucauccacaagguc

SEQ ID NO: 62956 - RNA, 27 nt, Artificial Sequence
  CCR4-NOT transcription complex subunit 4 (471-479)
gugcugccccagagauucccucaauuu

SEQ ID NO: 62957 - RNA, 27 nt, Artificial Sequence
  Mini-chromosome maintenance complex-binding protein (204-212)
gugcugcccagcguccucaacaaguuc

SEQ ID NO: 62958 - RNA, 30 nt, Artificial Sequence
  Fatty acid synthase (1496-1505)
gugcugcagggcgaccucgucaugaacguu

SEQ ID NO: 62959 - RNA, 27 nt, Artificial Sequence
  Coatomer subunit alpha (130-138)
gugcugaccggccacaaccauuacguc

SEQ ID NO: 62960 - RNA, 27 nt, Artificial Sequence
  Protein O-GlcNAcase (247-255)
gugcuguggaccggccccaaggucguu

SEQ ID NO: 62961 - RNA, 33 nt, Artificial Sequence
  Integral membrane protein 2C (51-61)
gugcuguacgaggacagccucuccucucagguc

SEQ ID NO: 62962 - RNA, 27 nt, Artificial Sequence
  Deoxynucleotidyltransferase terminal-interacting protein 2 (359-367)
gugaugaagagccugacccagacauuc

SEQ ID NO: 62963 - RNA, 30 nt, Artificial Sequence
  Protein C-ets-2 (78-87)
gugaugagccaggcccugaaggcuaccuuc

SEQ ID NO: 62964 - RNA, 24 nt, Artificial Sequence
  ER membrane protein complex subunit 1 (192-199)
gugcccuucagccacgucaacauc

SEQ ID NO: 62965 - RNA, 27 nt, Artificial Sequence
  ER membrane protein complex subunit 1 (192-200)
gugcccuucagccacgucaacaucguu

SEQ ID NO: 62966 - RNA, 24 nt, Artificial Sequence
  Interferon-induced 35 kDa protein (52-59)
gugcccuucagcgucccuaagauc

SEQ ID NO: 62967 - RNA, 27 nt, Artificial Sequence
  Protein transport protein Sec16A (69-77)
gugccccacuucccuaccccaagcauc

SEQ ID NO: 62968 - RNA, 30 nt, Artificial Sequence
  Filamin-A (436-445)
gugcccaucccuagaagcccauacaccguc

SEQ ID NO: 62969 - RNA, 27 nt, Artificial Sequence
  Tubulin alpha-1C chain (394-402)
gugcccaaggacgucaacgccgcuauc

SEQ ID NO: 62970 - RNA, 27 nt, Artificial Sequence
  Helicase with zinc finger domain 2 (656-664)
gugcccgucggcuucuuuagccacauc

SEQ ID NO: 62971 - RNA, 27 nt, Artificial Sequence
  RNA-binding protein NOB1 (300-308)
gugagcgacgauggcacccugcacaug

SEQ ID NO: 62972 - RNA, 33 nt, Artificial Sequence
  rRNA 2'-O-methyltransferase fibrillarin (174-184)
gugagcgacaucgucggccccgaugggcugguu

SEQ ID NO: 62973 - RNA, 30 nt, Artificial Sequence; identical to SEQ ID NO: 38746
  Glyoxalase domain-containing protein 4 (145-154)

SEQ ID NO: 62974 - RNA, 27 nt, Artificial Sequence
  Tripeptidyl-peptidase 1 (68-76)
gugagcgaccccuccucuccucaguac

SEQ ID NO: 62975 - RNA, 27 nt, Artificial Sequence
  DENN domain-containing protein 1B (677-685)
gugagcgaccccaccuccggccuggau

SEQ ID NO: 62976 - RNA, 30 nt, Artificial Sequence
  DENN domain-containing protein 1B (677-686)
gugagcgaccccaccuccggccuggauuuc

SEQ ID NO: 62977 - RNA, 33 nt, Artificial Sequence
  Liprin-beta-1 (207-217)
gugagcgagauggacuccgaaagacugcaguac

SEQ ID NO: 62978 - RNA, 27 nt, Artificial Sequence
  DnaJ homolog subfamily B member 12 (287-295)
gugaccgaccaccugggcgucguuuac

SEQ ID NO: 62979 - RNA, 27 nt, Artificial Sequence
  Selenocysteine insertion sequence-binding protein 2 (645-653)
gugaccgaccugcucaaggagcuuguc

SEQ ID NO: 62980 - RNA, 27 nt, Artificial Sequence
  Disabled homolog 2 (128-136)
gugaccgacaacagagccuucggcuac

SEQ ID NO: 62981 - RNA, 27 nt, Artificial Sequence
  Integrin beta-1 (77-85)
gugaccgaggaauuccagcccgucuac

SEQ ID NO: 62982 - RNA, 33 nt, Artificial Sequence
  Neutral alpha-glucosidase AB (29-39)
gugaccgagggcggggaacccuacagacuguau

SEQ ID NO: 62983 - RNA, 27 nt, Artificial Sequence
  Cohesin subunit SA-1 (101-109)
guggucgacgauuggaucgagagcuac

SEQ ID NO: 62984 - RNA, 30 nt, Artificial Sequence
  Tubulin-tyrosine ligase (13-22)
guguacgccgaggucagcagacugcuccuu

SEQ ID NO: 62985 - RNA, 27 nt, Artificial Sequence
  E3 ubiquitin-protein ligase MARCH6 (744-752)
guguacgccaacggcaucagaaauauu

SEQ ID NO: 62986 - RNA, 27 nt, Artificial Sequence
  Enoyl-CoA delta isomerase 2, mitochondrial (230-238)
guguacgccagcgacagagcuaccuuc

SEQ ID NO: 62987 - RNA, 27 nt, Artificial Sequence
  Receptor tyrosine-protein kinase erbB-3 (110-118)
guguacgacggcaaguucgccaucuuu

SEQ ID NO: 62988 - RNA, 27 nt, Artificial Sequence
  SRR1-like protein (178-186)
guguacgacccccuguucagccagcuc

SEQ ID NO: 62989 - RNA, 33 nt, Artificial Sequence
  Prolow-density lipoprotein receptor-related protein 1 (736-746)
guguacgagggccccgaacugaaccacgccuuc

SEQ ID NO: 62990 - RNA, 30 nt, Artificial Sequence
  Partitioning defective 3 homolog B (682-691)
guguacuuccccgaccagcacaucaacuuu

SEQ ID NO: 62991 - RNA, 27 nt, Artificial Sequence
  Exocyst complex component 6B (452-460)
guguacggcuuccccgucaaccagcug

SEQ ID NO: 62992 - RNA, 33 nt, Artificial Sequence
  Phosphatidylinositol-binding clathrin assembly protein (87-97)
guguacggcaacgagagauucauccaguaucug

SEQ ID NO: 62993 - RNA, 27 nt, Artificial Sequence
  Alanine-tRNA ligase, cytoplasmic (92-100)
guguaccaccauaccuucuuugagaug

SEQ ID NO: 62994 - RNA, 27 nt, Artificial Sequence
  Elongator complex protein 1 (1236-1244)
guguaccacauccugaagguccucuuc

SEQ ID NO: 62995 - RNA, 27 nt, Artificial Sequence
  Sterol regulatory element-binding protein cleavage-activating protein (751-759)
guguacaucgaccagaccaugguccug

SEQ ID NO: 62996 - RNA, 27 nt, Artificial Sequence
  Prelamin-A/C (44-52)
guguacaucgacagagucaggagccug

SEQ ID NO: 62997 - RNA, 27 nt, Artificial Sequence
  F-box only protein 42 (181-189)
guguacaaggaccugcucguccuuuuc

SEQ ID NO: 62998 - RNA, 27 nt, Artificial Sequence
  mRNA cap guanine-N7 methyltransferase (390-398)
guguacaagaaaaccuuccuggaguuu

SEQ ID NO: 62999 - RNA, 27 nt, Artificial Sequence
  Kelch repeat and BTB domain-containing protein 6 (407-415)
guguacaagcccgcccagaacagcugg

SEQ ID NO: 63000 - RNA, 27 nt, Artificial Sequence
  Brain-specific angiogenesis inhibitor 1-associated protein 2 (16-24)
guguacaagaccaucauggagcaguuc

SEQ ID NO: 63001 - RNA, 27 nt, Artificial Sequence
  Polymerase I and transcript release factor (225-233)
guguacaagguccccccuuucaccuuu

SEQ ID NO: 63002 - RNA, 27 nt, Artificial Sequence
  Sarcolemmal membrane-associated protein (22-30)
guguaccuggacgagcccaucaagauu

SEQ ID NO: 63003 - RNA, 33 nt, Artificial Sequence
  Molybdenum cofactor sulfurase (50-60)
guguaccuggaccacgccggcgcuacccucuuc

SEQ ID NO: 63004 - RNA, 30 nt, Artificial Sequence
  Plectin (3681-3690)
guguaccugcccggcagcagacagacccuc

SEQ ID NO: 63005 - RNA, 27 nt, Artificial Sequence
  Nuclear nucleic acid-binding protein C1D (92-100)
guguacaugaacagagucaaggagauc

SEQ ID NO: 63006 - RNA, 27 nt, Artificial Sequence
  Pre-mRNA-splicing factor SPF27 (137-145)
guguacaacgagaaucugguccacaug

SEQ ID NO: 63007 - RNA, 27 nt, Artificial Sequence
  Kelch-like protein 11 (473-481)
guguacaaccccgagcuggacaagugg

SEQ ID NO: 63008 - RNA, 27 nt, Artificial Sequence
  Kelch repeat and BTB domain-containing protein 6 (536-544)
guguacaaccccgucagagccgagugg

SEQ ID NO: 63009 - RNA, 33 nt, Artificial Sequence
  Zinc transporter ZIP6 (191-201)
guguacaacaccgucagcgagggcacacacuuc

SEQ ID NO: 63010 - RNA, 30 nt, Artificial Sequence
  BAG family molecular chaperone regulator 3 (113-122)
guguacccccagccuggcaugcaaagauuc

SEQ ID NO: 63011 - RNA, 33 nt, Artificial Sequence
  3-ketodihydrosphingosine reductase (150-160)
guguaccccagcagagccgucaucaccacaaug

SEQ ID NO: 63012 - RNA, 27 nt, Artificial Sequence
  Hemoglobin subunit gamma-2 (35-43)
guguaccccuggacccagagauucuuu

SEQ ID NO: 63013 - RNA, 27 nt, Artificial Sequence
  Nuclear factor of activated T-cells 5 (855-863)
guguaccagcaaaccagccacaugaug

SEQ ID NO: 63014 - RNA, 27 nt, Artificial Sequence
  Anaphase-promoting complex subunit 2 (564-572)
guguacagcgccggcgucuauagacug

SEQ ID NO: 63015 - RNA, 33 nt, Artificial Sequence
  N-acetylgalactosamine kinase (311-321)
guguacagcgaggccgcuagaguccugcaguuc

SEQ ID NO: 63016 - RNA, 27 nt, Artificial Sequence
  Zinc transporter 6 (62-70)
guguacagcuucggcuuugagagacug

SEQ ID NO: 63017 - RNA, 27 nt, Artificial Sequence
  La-related protein 4 (319-327)
guguacagcaucgucccccaguccugg

SEQ ID NO: 63018 - RNA, 33 nt, Artificial Sequence
  Pre-mRNA-processing-splicing factor 8 (1177-1187)
guguacagcaaggacaaccccaaucugcucuuc

SEQ ID NO: 63019 - RNA, 27 nt, Artificial Sequence
  Condensin-2 complex subunit H2 (66-74)
guguacagcaagaaagucgaguaucug

SEQ ID NO: 63020 - RNA, 27 nt, Artificial Sequence
  Zinc transporter 7 (318-326)
guguacagccugcaggagcaacacuuc

SEQ ID NO: 63021 - RNA, 33 nt, Artificial Sequence; identical to SEQ ID NO: 38794
  Ribonuclease P protein subunit p30 (155-165)

SEQ ID NO: 63022 - RNA, 27 nt, Artificial Sequence
  E3 ubiquitin-protein ligase MGRN1 (148-156)
guguacagccccaaguccccuucucug

SEQ ID NO: 63023 - RNA, 27 nt, Artificial Sequence
  DDB1- and CUL4-associated factor 13 (310-318)
guguacaccggcaucgaccaccauugg

SEQ ID NO: 63024 - RNA, 30 nt, Artificial Sequence
  Nuclear pore complex protein Nup153 (667-676)
guguacaccagacccgccaucagcuccuuc

SEQ ID NO: 63025 - RNA, 27 nt, Artificial Sequence
  Tensin-2 (334-342)
guguacaccagcggcgucuaucacauc

SEQ ID NO: 63026 - RNA, 27 nt, Artificial Sequence
  Pre-mRNA-processing-splicing factor 8 (809-817)
guguacaccacaacuguccacuggcug

SEQ ID NO: 63027 - RNA, 27 nt, Artificial Sequence
  Volume-regulated anion channel subunit LRRC8E (11-19)
guguacgucgagaagaucagcuuccug

SEQ ID NO: 63028 - RNA, 27 nt, Artificial Sequence
  Cleavage and polyadenylation specificity factor subunit 7 (127-135)
guguacgucggcagcuucuccuggugg

SEQ ID NO: 63029 - RNA, 27 nt, Artificial Sequence
  Kinesin-like protein KIF3B (174-182)
guguacgucaaggaccugagcuccuuc

SEQ ID NO: 63030 - RNA, 27 nt, Artificial Sequence
  Cytochrome c oxidase assembly protein COX11, mitochondrial (223-231)
guguacguccuggagagcuggcaccuc

SEQ ID NO: 63031 - RNA, 27 nt, Artificial Sequence
  Splicing factor 3B subunit 1 (254-262)
guguacuggaagaucuauaacagcauu

SEQ ID NO: 63032 - RNA, 27 nt, Artificial Sequence
  Dolichyl-diphosphooligosaccharide-proteinosyltransferase subunit 2 (453-461)
guguacuggacccagcugaacauguuc

SEQ ID NO: 63033 - RNA, 27 nt, Artificial Sequence
  Tripartite motif-containing protein 47 (182-190)
uacgccgacagagcucuggcauucuau

SEQ ID NO: 63034 - RNA, 27 nt, Artificial Sequence
  Monocarboxylate transporter 1 (34-42)
uacgccuuccccaagagcaucaccgug

SEQ ID NO: 63035 - RNA, 24 nt, Artificial Sequence
  DDB1- and CUL4-associated factor 4 (355-362)
uacgccuaucugccccuccacgug

SEQ ID NO: 63036 - RNA, 30 nt, Artificial Sequence; identical to SEQ ID NO: 38809
  Septin-9 (180-189)

SEQ ID NO: 63037 - RNA, 27 nt, Artificial Sequence
  Serine/threonine-protein kinase ATR (1253-1261)
uacuuccugcccgaccacccugagcuc

SEQ ID NO: 63038 - RNA, 27 nt, Artificial Sequence
  Cytochrome c oxidase subunit 2 (113-121)
uacggcgggcugaucuucaacagcuau

SEQ ID NO: 63039 - RNA, 27 nt, Artificial Sequence
  Sterol O-acyltransferase 1 (161-169)
uacaucgacgagggcagacuggugcuc

SEQ ID NO: 63040 - RNA, 27 nt, Artificial Sequence
  Unconventional myosin-Ic (44-52)
uacaucggccccgugcuggucagcguu

SEQ ID NO: 63041 - RNA, 27 nt, Artificial Sequence
  DENN domain-containing protein 5B (228-236)
uacauccacaacauucuguaugaggug

SEQ ID NO: 63042 - RNA, 27 nt, Artificial Sequence
  Kinesin-like protein KIF1A (510-518)
uacaucaaggacggcauuaccagagug

SEQ ID NO: 63043 - RNA, 36 nt, Artificial Sequence
  Signal recognition particle 9 kDa protein (18-29)
uaccuggccgaccccaugaaggcuagagugguccuc

SEQ ID NO: 63044 - RNA, 27 nt, Artificial Sequence
  Ras GTPase-activating-like protein IQGAP2 (898-906)
uaccuggccaagcucaucuuccagaug

SEQ ID NO: 63045 - RNA, 27 nt, Artificial Sequence
  Kinesin-like protein KIF13A (1108-1116)
uaccuggacgagcagaucaagaaagug

SEQ ID NO: 63046 - RNA, 27 nt, Artificial Sequence
  Metastasis-associated protein MTA3 (123-131)
uaccuggacaaggaggauaccuucuuu

SEQ ID NO: 63047 - RNA, 24 nt, Artificial Sequence
  Guanine nucleotide-binding protein-like 3-like protein (294-301)
uaccuggacaaguucaucagacuc

SEQ ID NO: 63048 - RNA, 27 nt, Artificial Sequence
  DNA topoisomerase 1 (723-731)
uaccuggaccccagaaucaccguggcc

SEQ ID NO: 63049 - RNA, 30 nt, Artificial Sequence
  Proteasome activator complex subunit 3 (188-197)
uaccuggaccagaucagcagauauuacauu

SEQ ID NO: 63050 - RNA, 36 nt, Artificial Sequence
  Lysosomal protective protein (125-136)
uaccuggagagccccgccggcgugggguucuccuau

SEQ ID NO: 63051 - RNA, 33 nt, Artificial Sequence
  ATP synthase F(0) complex subunit B1, mitochondrial (165-175)
uaccuguucgacgugcagagaaacaauaucgcc

SEQ ID NO: 63052 - RNA, 36 nt, Artificial Sequence
  ATP synthase F(0) complex subunit B1, mitochondrial (165-176)
uaccuguucgacgugcagagaaacaauaucgccaug

SEQ ID NO: 63053 - RNA, 27 nt, Artificial Sequence
  WD repeat-containing protein 81 (72-80)
uaccuguucgagcccguggccaaggcu

SEQ ID NO: 63054 - RNA, 27 nt, Artificial Sequence
  WD repeat and FYVE domain-containing protein 3 (158-166)
uaccuguucuuugaccucccccacgug

SEQ ID NO: 63055 - RNA, 27 nt, Artificial Sequence
  LIM domain-containing protein ajuba (391-399)
uaccuguucagcggcuuucaggaggcc

SEQ ID NO: 63056 - RNA, 27 nt, Artificial Sequence
  Heat shock cognate 71 kDa protein (134-142)
uaccugggcaagaccgugacaaacgcc

SEQ ID NO: 63057 - RNA, 30 nt, Artificial Sequence
  Intraflagellar transport protein 172 homolog (461-470)
uaccugaucgacauuaagaccauagccauc

SEQ ID NO: 63058 - RNA, 27 nt, Artificial Sequence
  Ankyrin repeat domain-containing protein 17 (599-607)
uaccugcucgacuaucccaacaaucuu

SEQ ID NO: 63059 - RNA, 30 nt, Artificial Sequence
  Ankyrin repeat domain-containing protein 17 (599-608)
uaccugcucgacuaucccaacaaucuucug

SEQ ID NO: 63060 - RNA, 33 nt, Artificial Sequence
  Filamin-A (148-158)
uaccugcucaaggacaaaggcgaguauacccuu

SEQ ID NO: 63061 - RNA, 27 nt, Artificial Sequence
  Condensin complex subunit 3 (370-378)
uaccugcucagcuauauccaguccauu

SEQ ID NO: 63062 - RNA, 27 nt, Artificial Sequence
  UDP-glucose 6-dehydrogenase (143-151)
uaccugauggacgagggcgcccaccuc

SEQ ID NO: 63063 - RNA, 27 nt, Artificial Sequence
  L-lactate dehydrogenase A chain (172-180)
uaccugaugggcgagagacucggggug

SEQ ID NO: 63064 - RNA, 36 nt, Artificial Sequence
  H/ACA ribonucleoprotein complex subunit 3 (6-17)
uaccugaacgagcagggcgacagaguguauacccuc

SEQ ID NO: 63065 - RNA, 27 nt, Artificial Sequence
  POZ-, AT hook-, and zinc finger-containing protein 1 (645-653)
uaccugaacaagcacauccagaaagug

SEQ ID NO: 63066 - RNA, 27 nt, Artificial Sequence
  Structural maintenance of chromosomes protein 4 (748-756)
uaccugaacgugcaggucaaggagcuc

SEQ ID NO: 63067 - RNA, 27 nt, Artificial Sequence
  Mitochondrial-processing peptidase subunit alpha (107-115)
uaccugagcggcaucgcccacuuccuc

SEQ ID NO: 63068 - RNA, 27 nt, Artificial Sequence
  Gelsolin (409-417)
uaccugagcucccacaucgccaacgug

SEQ ID NO: 63069 - RNA, 27 nt, Artificial Sequence
  Protein S100-A10 (25-33)
uaccugaccaaggaggaccucagagug

SEQ ID NO: 63070 - RNA, 30 nt, Artificial Sequence; identical to SEQ ID NO: 38843
  Plectin (73-82)

SEQ ID NO: 63071 - RNA, 33 nt, Artificial Sequence
  Mitochondrial carrier homolog 1 (278-288)
uaccugguggacgauagcuucucccaggcccuc

SEQ ID NO: 63072 - RNA, 27 nt, Artificial Sequence
  Thimet oligopeptidase (612-620)
uaccuguggagcgagguguauuccaug

SEQ ID NO: 63073 - RNA, 36 nt, Artificial Sequence
  SWI/SNF-related matrix-associated actin-dependent regulator of chromatin subfamily A containing DEAD/H box 1 (108-119)
uaccuguaucaggagggcaacaaugggccccaccuc

SEQ ID NO: 63074 - RNA, 27 nt, Artificial Sequence
  Transcriptional enhancer factor TEF-3 (369-377)
uacaugaucaacuucauucacaagcug

SEQ ID NO: 63075 - RNA, 24 nt, Artificial Sequence
  Pterin-4-alpha-carbinolamine dehydratase (70-77)
uacaacaaggugcacaucacccug

SEQ ID NO: 63076 - RNA, 24 nt, Artificial Sequence
  Mid1-interacting protein 1 (7-14)
uacaaccagaagcacagccuguuc

SEQ ID NO: 63077 - RNA, 27 nt, Artificial Sequence
  Phosducin-like protein 3 (158-166)
uaccccgacagaaaccugccuaccauc

SEQ ID NO: 63078 - RNA, 33 nt, Artificial Sequence
  Lipase maturation factor 2 (522-532)
uaccccuuccacaagcagccuccaaccuaugug

SEQ ID NO: 63079 - RNA, 24 nt, Artificial Sequence
  Ubiquitin-conjugating enzyme E2 K (66-73)
uaccccuucaacccuccaaaggug

SEQ ID NO: 63080 - RNA, 36 nt, Artificial Sequence; identical to SEQ ID NO: 38853
  Dolichyl-diphosphooligosaccharide-proteinosyltransferase 48 kDa subunit (233-244)

SEQ ID NO: 63081 - RNA, 27 nt, Artificial Sequence
  Ganglioside-induced differentiation-associated protein 2 (176-184)
uacccccuggaggacgccacccacauc

SEQ ID NO: 63082 - RNA, 27 nt, Artificial Sequence
  TFIIH basal transcription factor complex helicase XPD subunit (39-47)
uacccccuggaggugaccaagcucauc

SEQ ID NO: 63083 - RNA, 27 nt, Artificial Sequence
  AP-2 complex subunit beta (421-429)
uaccccaacaaguaugagagcaucauu

SEQ ID NO: 63084 - RNA, 30 nt, Artificial Sequence
  BAG family molecular chaperone regulator 4 (184-193)
uaccccuauggcgacgggaacagaagcgug

SEQ ID NO: 63085 - RNA, 33 nt, Artificial Sequence
  InaD-like protein (703-713)
uaccaggacccccuggauccuaccagaagcgug

SEQ ID NO: 63086 - RNA, 33 nt, Artificial Sequence
  DNA mismatch repair protein Msh6 (977-987)
uaccagcuggagauccccgaaaacuucaccaca

SEQ ID NO: 63087 - RNA, 27 nt, Artificial Sequence
  Ubiquitin-like-conjugating enzyme ATG3 (210-218)
uaccagacccccagacuguggcucuuc

SEQ ID NO: 63088 - RNA, 27 nt, Artificial Sequence
  RNA binding protein fox-1 homolog 2 (317-325)
uacagcgacggcuaugggagaguguac

SEQ ID NO: 63089 - RNA, 27 nt, Artificial Sequence
  Signal transducer and activator of transcription 3 (22-30)
uacagcgacuccuuccccauggagcug

SEQ ID NO: 63090 - RNA, 30 nt, Artificial Sequence
  Protein TANC2 (62-71)
uacagcgagaacguggaaagaaccaaguau

SEQ ID NO: 63091 - RNA, 24 nt, Artificial Sequence
  Putative heat shock protein HSP 90-beta 2 (33-40)
uacagcaacaaggagaucuuccug

SEQ ID NO: 63092 - RNA, 33 nt, Artificial Sequence
  Probable E3 ubiquitin-protein ligase HECTD2 (624-634)
uacaccgacuuccugcucaacaagagcaucuau

SEQ ID NO: 63093 - RNA, 27 nt, Artificial Sequence
  Tight junction protein ZO-1 (1054-1062)
uacaccgaccaguucagcagaaacuau

SEQ ID NO: 63094 - RNA, 27 nt, Artificial Sequence
  RNA-binding protein FUS (324-332)
uacaccgacagagagacaggcaagcug

SEQ ID NO: 63095 - RNA, 30 nt, Artificial Sequence
  Cytochrome c oxidase subunit 2 (110-119)
uacaccgacuauggcgggcugaucuucaac

SEQ ID NO: 63096 - RNA, 33 nt, Artificial Sequence
  Cytochrome c oxidase subunit 2 (110-120)
uacaccgacuauggcgggcugaucuucaacagc

SEQ ID NO: 63097 - RNA, 24 nt, Artificial Sequence
  Peroxisomal multifunctional enzyme type 2 (339-346)
uacaccgagcuggaagccaucaug

SEQ ID NO: 63098 - RNA, 27 nt, Artificial Sequence
  Peroxisomal multifunctional enzyme type 2 (339-347)
uacaccgagcuggaagccaucauguau

SEQ ID NO: 63099 - RNA, 27 nt, Artificial Sequence
  RNA-binding protein FUS (6-14)
uacacccagcaagccacacagagcuau

SEQ ID NO: 63100 - RNA, 30 nt, Artificial Sequence
  F-box only protein 11 (224-233)
uacaccagcuaucccaugcacgacuucuac

SEQ ID NO: 63101 - RNA, 27 nt, Artificial Sequence
  Zinc finger and BTB domain-containing protein 38 (794-802)
uacguggccgaccccggcgggagccug

SEQ ID NO: 63102 - RNA, 24 nt, Artificial Sequence
  Bax inhibitor 1 (92-99)
uacgugcacauggucacccauuuc

SEQ ID NO: 63103 - RNA, 36 nt, Artificial Sequence
  Negative elongation factor E (265-276)
uacguguauggcgaggacaugacccccacacugcuc

SEQ ID NO: 63104 - RNA, 27 nt, Artificial Sequence
  Medium-chain specific acyl-CoA dehydrogenase, mitochondrial (316-324)
uacuaugccagcaucgcuaaggcauuc

SEQ ID NO: 63105 - RNA, 30 nt, Artificial Sequence
  Eukaryotic translation initiation factor 3 subunit A (275-284)
uacuauaacaaggugagcaccgucuucugg

SEQ ID NO: 63106 - RNA, 33 nt, Artificial Sequence
  Importin-7 (763-773)
uacuauaacccccaccugcuccuuaauacccug

SEQ ID NO: 63107 - RNA, 27 nt, Artificial Sequence
  Prenylcysteine oxidase 1 (220-228)
uacuaucagcacaucgugaccacacug

SEQ ID NO: 63108 - RNA, 27 nt, Artificial Sequence
  Protein PAT1 homolog 1 (367-375)
uacuaucagaacuacuucgagaagcug

SEQ ID NO: 63109 - RNA, 27 nt, Artificial Sequence
  ATP-binding cassette sub-family F member 1 (528-536)
uacuauagaggcaacuacaugaccuuc

SEQ ID NO: 63110 - RNA, 27 nt, Artificial Sequence
  Polypyrimidine tract-binding protein 2 (124-132)
uacuauagcgccgugaccccccaccug

SEQ ID NO: 63111 - RNA, 27 nt, Artificial Sequence
  Eukaryotic translation initiation factor 2A (345-353)
uacuauagcccccacggccauauccug

SEQ ID NO: 63112 - RNA, 27 nt, Artificial Sequence
  26S protease regulatory subunit 6B (111-119)
uacuaugugagaauccugagcaccauu

SEQ ID NO: 63113 - RNA, 33 nt, Artificial Sequence
  Glutathione peroxidase 1 (7-17)
gccgcugcagccgcggcugcccagagcguguac

SEQ ID NO: 63114 - RNA, 27 nt, Artificial Sequence
  Interferon alpha-inducible protein 27-like protein 2 (6-14)
gccgcugcagccgugggcggggcgcug

SEQ ID NO: 63115 - RNA, 27 nt, Artificial Sequence
  Pumilio homolog 2 (304-312)
gccgcugcaaaccccacccuggccuuc

SEQ ID NO: 63116 - RNA, 27 nt, Artificial Sequence
  Angiomotin (918-926)
gccgcugcacccgccgcggcugccgca

SEQ ID NO: 63117 - RNA, 27 nt, Artificial Sequence
  RNA-binding protein 38 (217-225)
gccgcugcacccgccggcaccacauuc

SEQ ID NO: 63118 - RNA, 30 nt, Artificial Sequence
  Protein SON (246-255)
gccgcugcacccgugccuaccacaacucug

SEQ ID NO: 63119 - RNA, 27 nt, Artificial Sequence
  Kelch-like protein 7 (15-23)
gccgcugcaagccacuucuuuaaccug

SEQ ID NO: 63120 - RNA, 27 nt, Artificial Sequence
  Ephrin-A1 (167-175)
gccgcugacgaucccgaggugagaguc

SEQ ID NO: 63121 - RNA, 27 nt, Artificial Sequence
  RNA-binding protein 4 (47-55)
gccgcugaggacgcaaucagaaaccug

SEQ ID NO: 63122 - RNA, 27 nt, Artificial Sequence
  Death-associated protein kinase 3 (334-342)
gccgcugaggaaggccugagagagcuc

SEQ ID NO: 63123 - RNA, 27 nt, Artificial Sequence
  Perilipin-3 (62-70)
gccgcugagaagggcgugagaacccug

SEQ ID NO: 63124 - RNA, 24 nt, Artificial Sequence
  Ribosome-binding protein 1 (105-112)
gccgcuuucgagaagcaggugcug

SEQ ID NO: 63125 - RNA, 27 nt, Artificial Sequence
  Glycine dehydrogenase (decarboxylating), mitochondrial (969-977)
gccgcuuucccccugccuuuugugaag

SEQ ID NO: 63126 - RNA, 27 nt, Artificial Sequence
  DNA-directed RNA polymerase II subunit RPB1 (1495-1503)
gccgcuggccccaccgggauguucuuu

SEQ ID NO: 63127 - RNA, 27 nt, Artificial Sequence
  Programmed cell death protein 4 (282-290)
gccgcucuggacaaggcaaccgugcuc

SEQ ID NO: 63128 - RNA, 27 nt, Artificial Sequence
  Leucine-rich repeat-containing protein 59 (36-44)
gccgcucugcccaaggcaaccauccuc

SEQ ID NO: 63129 - RNA, 27 nt, Artificial Sequence
  E3 ubiquitin-protein ligase BRE1B (225-233)
gccgcucaggcacacaccagagagcug

SEQ ID NO: 63130 - RNA, 33 nt, Artificial Sequence
  NEDD8-activating enzyme E1 regulatory subunit (495-505)
gccgcucaggaggugaucaagauuauaaccaaa

SEQ ID NO: 63131 - RNA, 27 nt, Artificial Sequence
  Protein FAM50A (7-15)
gccgcuagcgaggcaggcagagccaug

SEQ ID NO: 63132 - RNA, 27 nt, Artificial Sequence
  4F2 cell-surface antigen heavy chain (127-135)
gccgcuagcggcgcagccaugucccug

SEQ ID NO: 63133 - RNA, 27 nt, Artificial Sequence
  Nuclear pore membraneoprotein 210 (1023-1031)
gccgcuagccccaucauuacccuggug

SEQ ID NO: 63134 - RNA, 27 nt, Artificial Sequence
  Cirhin (108-116)
gccgcuagccccuccggcucucagcug

SEQ ID NO: 63135 - RNA, 27 nt, Artificial Sequence
  40S ribosomal protein SA (92-100)
gccgcuaccggcgcaacacccaucgcc

SEQ ID NO: 63136 - RNA, 27 nt, Artificial Sequence
  ELM2 and SANT domain-containing protein 1 (966-974)
gccgcugugaaggcaacccagacacug

SEQ ID NO: 63137 - RNA, 27 nt, Artificial Sequence
  UPF0668 protein C10orf76 (556-564)
gccgcugugaaccacaucagccagcug

SEQ ID NO: 63138 - RNA, 27 nt, Artificial Sequence
  Leucine-rich repeat and calponin homology domain-containing protein 3 (56-64)
gccgcugugaccggcguccugagccuc

SEQ ID NO: 63139 - RNA, 27 nt, Artificial Sequence
  Synaptonemal complex protein SC65 (428-436)
gccgaggcugaacccgagccugaacug

SEQ ID NO: 63140 - RNA, 27 nt, Artificial Sequence
  Rhotekin (187-195)
gccgaggcuggccccgacuucgaacug

SEQ ID NO: 63141 - RNA, 30 nt, Artificial Sequence
  Catenin alpha-1 (750-759)
gccgaggcuggcagcagaauggacaagcug

SEQ ID NO: 63142 - RNA, 27 nt, Artificial Sequence
  Leucine-tRNA ligase, cytoplasmic (461-469)
gccgaggcuaaggaaaaaaucuaccug

SEQ ID NO: 63143 - RNA, 36 nt, Artificial Sequence
  5'-AMP-activated protein kinase catalytic subunit alpha-1 (501-512)
gccgaggcucagggcaagagcuccgaagugucucug

SEQ ID NO: 63144 - RNA, 27 nt, Artificial Sequence
  Something about silencing protein 10 (119-127)
gccgaggcuagcguggaccccucccug

SEQ ID NO: 63145 - RNA, 33 nt, Artificial Sequence
  Mediator of DNA damage checkpoint protein 1 (431-441)
gccgaggaagacaugccccagagagugguccug

SEQ ID NO: 63146 - RNA, 27 nt, Artificial Sequence
  NudC domain-containing protein 1 (175-183)
gccgaggaacacagcaucgcuacccug

SEQ ID NO: 63147 - RNA, 27 nt, Artificial Sequence
  Peroxisome assembly protein 26 (71-79)
gccgaggaacccgcuggcaccagccug

SEQ ID NO: 63148 - RNA, 27 nt, Artificial Sequence
  Alpha-actinin-4 (804-812)
gccgaguucaacagaaucaugagccug

SEQ ID NO: 63149 - RNA, 27 nt, Artificial Sequence
  Coatomer subunit beta' (333-341)
gccgagaucaaggacggcgaaagacug

SEQ ID NO: 63150 - RNA, 33 nt, Artificial Sequence
  Stathmin (73-83)
gccgagaagagagaacacgagaaagaagugcug

SEQ ID NO: 63151 - RNA, 27 nt, Artificial Sequence
  Heat shock protein 105 kDa (311-319)
gccgagcugcuccagaagaucgaagug

SEQ ID NO: 63152 - RNA, 27 nt, Artificial Sequence
  LisH domain-containing protein ARMC9 (557-565)
gccgagaugaucagacagauugaauuc

SEQ ID NO: 63153 - RNA, 36 nt, Artificial Sequence
  V-type proton ATPase subunit C 1 (170-181)
gccgagauggugguccccagaagcuccaacguucug

SEQ ID NO: 63154 - RNA, 33 nt, Artificial Sequence
  Centromere protein F (2273-2283)
gccgagaacagcaaggcugaaguggagacccug

SEQ ID NO: 63155 - RNA, 33 nt, Artificial Sequence
  Thioredoxin domain-containing protein 5 (207-217)
gccgagcccgaagcugacaagggcaccgugcug

SEQ ID NO: 63156 - RNA, 33 nt, Artificial Sequence
  Cell cycle and apoptosis regulator protein 2 (303-313)
gccgagcagcaagacagcggcagacuguaccuc

SEQ ID NO: 63157 - RNA, 30 nt, Artificial Sequence
  AP-1 complex subunit beta-1 (188-197)
gccgagagccaccccuccucuaaccugcuc

SEQ ID NO: 63158 - RNA, 33 nt, Artificial Sequence
  Clathrin heavy chain 1 (493-503)
gccgagaccggccaggugcaaaagaucguccug

SEQ ID NO: 63159 - RNA, 39 nt, Artificial Sequence
  T-complex protein 1 subunit eta (76-88)
gccgaggugggcgacgggaccacaagcgucacucugcuc

SEQ ID NO: 63160 - RNA, 27 nt, Artificial Sequence
  Heterogeneous nuclear ribonucleoprotein M (129-137)
gccgaggugcugaacaagcacagccuc

SEQ ID NO: 63161 - RNA, 27 nt, Artificial Sequence
  X-box-binding protein 1 (28-36)
gccggcgcucccgcagggcaggcccug

SEQ ID NO: 63162 - RNA, 27 nt, Artificial Sequence
  Protein YIF1A (153-161)
gccggcauggcucuggggauccagaag

SEQ ID NO: 63163 - RNA, 27 nt, Artificial Sequence
  PAB-dependent poly(A)-specific ribonuclease subunit PAN2 (870-878)
gcccacaucaaggugggcgagaccuac

SEQ ID NO: 63164 - RNA, 27 nt, Artificial Sequence
  Coatomer subunit gamma-1 (45-53)
gcccacauccugaccaagauucucuac

SEQ ID NO: 63165 - RNA, 27 nt, Artificial Sequence
  Clathrin heavy chain 1 (1312-1320)
gcccacaugggcauguucaccgagcug

SEQ ID NO: 63166 - RNA, 27 nt, Artificial Sequence
  Elongation factor 2 (491-499)
gcccacaacaugagagugaugaaguuc

SEQ ID NO: 63167 - RNA, 27 nt, Artificial Sequence
  Methionine-R-sulfoxide reductase B1 (38-46)
gcccacagcucccccuggccugcuuuc

SEQ ID NO: 63168 - RNA, 27 nt, Artificial Sequence
  Calcineurin-binding protein cabin-1 (1962-1970)
gcccacaccaagcccagaccugcucug

SEQ ID NO: 63169 - RNA, 27 nt, Artificial Sequence
  Protein RTF2 homolog (296-304)
gcccacugggugacccauacaagcuac

SEQ ID NO: 63170 - RNA, 30 nt, Artificial Sequence
  Endoplasmic reticulum-Golgi intermediate compartment protein 2 (241-250)
gccaucgaccacaaccagauguuccaauac

SEQ ID NO: 63171 - RNA, 27 nt, Artificial Sequence
  E3 ubiquitin-protein ligase RNF135 (258-266)
gccauccaccccaccuucaaccugaag

SEQ ID NO: 63172 - RNA, 27 nt, Artificial Sequence
  Proteasome subunit alpha type-2 (187-195)
gccauccacaccgcuauucugacacuc

SEQ ID NO: 63173 - RNA, 27 nt, Artificial Sequence
  All-trans-retinol 13,14-reductase (189-197)
gccaucauugacaaguacauaaaacug

SEQ ID NO: 63174 - RNA, 27 nt, Artificial Sequence
  General transcription factor 3C polypeptide 3 (294-302)
gccauccuggacaagaacuucagaaaa

SEQ ID NO: 63175 - RNA, 27 nt, Artificial Sequence
  AP-1 complex subunit beta-1 (487-495)
gccaucgugaagcuguuccucaaaaag

SEQ ID NO: 63176 - RNA, 27 nt, Artificial Sequence
  Ribosomal RNA processing protein 36 homolog (221-229)
gcccuggcugagaaguucaaagaacuc

SEQ ID NO: 63177 - RNA, 27 nt, Artificial Sequence
  Gem-associated protein 4 (288-296)
gcccuggcugagaaggugaaagaagca

SEQ ID NO: 63178 - RNA, 27 nt, Artificial Sequence
  Glycosylphosphatidylinositol anchor attachment 1 protein (584-592)
gcccuggcucagggcgugcucgagcac

SEQ ID NO: 63179 - RNA, 39 nt, Artificial Sequence
  Ankyrin repeat and KH domain-containing protein 1 (182-194)
gcccuggacgaggcugcagccgcgcucaccagaaugaag

SEQ ID NO: 63180 - RNA, 27 nt, Artificial Sequence
  Hexokinase-1 (530-538)
gcccuggaccucggcgggaccaacuuc

SEQ ID NO: 63181 - RNA, 30 nt, Artificial Sequence
  N-acylneuraminate cytidylyltransferase (79-88)
gcccuggacagcggcgcuuuccaguccgug

SEQ ID NO: 63182 - RNA, 30 nt, Artificial Sequence
  EP300-interacting inhibitor of differentiation 1 (70-79)
gcccuggaggaagcugacaagauguuccuc

SEQ ID NO: 63183 - RNA, 30 nt, Artificial Sequence
  Zinc finger protein ZXDC (46-55)
gcccuguucagcgacacccccgcuaacgca

SEQ ID NO: 63184 - RNA, 27 nt, Artificial Sequence
  Dystonin (1368-1376)
gcccuguucagcaaggugcucgagaga

SEQ ID NO: 63185 - RNA, 27 nt, Artificial Sequence
  Protein transport protein Sec23A (40-48)
gcccuguucaccccccucaaggagaga

SEQ ID NO: 63186 - RNA, 27 nt, Artificial Sequence
  PRKCA-binding protein (279-287)
gcccugggcgagccccucuacagagug

SEQ ID NO: 63187 - RNA, 27 nt, Artificial Sequence
  Talin-2 (171-179)
gcccugcacgaccuccuucagcaugug

SEQ ID NO: 63188 - RNA, 27 nt, Artificial Sequence
  Golgin subfamily A member 3 (270-278)
gcccugcacgagagaauccaggcucuc

SEQ ID NO: 63189 - RNA, 27 nt, Artificial Sequence
  SURP and G-patch domain-containing protein 2 (429-437)
gcccugcucggccagaccuucagccuu

SEQ ID NO: 63190 - RNA, 27 nt, Artificial Sequence
  E3 ubiquitin-protein ligase AMFR (24-32)
gcccugcucggcaccaucauuagcgcu

SEQ ID NO: 63191 - RNA, 30 nt, Artificial Sequence
  Tropomodulin-3 (44-53)
gcccugcuccccgcuggcuucagacagaag

SEQ ID NO: 63192 - RNA, 36 nt, Artificial Sequence
  RNA-binding protein NOB1 (19-30)
gcccugcaggacaucggcaagaacauuuacaccaua

SEQ ID NO: 63193 - RNA, 27 nt, Artificial Sequence
  Kinesin-1 heavy chain (666-674)
gcccugagcgaggaacucgugcagcuu

SEQ ID NO: 63194 - RNA, 30 nt, Artificial Sequence
  Syntaxin-8 (157-166)
gcccugagcuccaucauuucuagacagaag

SEQ ID NO: 63195 - RNA, 27 nt, Artificial Sequence
  Protein RCC2 (151-159)
gcccugaccgagacaggcagcguguuc

SEQ ID NO: 63196 - RNA, 27 nt, Artificial Sequence
  Zinc finger BED domain-containing protein 4 (250-258)
gcccuggugggcagcuccccccaccuc

SEQ ID NO: 63197 - RNA, 33 nt, Artificial Sequence
  Protein unc-93 homolog B1 (440-450)
gcccuguggggcguggggagcgcucucaacaag

SEQ ID NO: 63198 - RNA, 30 nt, Artificial Sequence; identical to SEQ ID NO: 38971
  Galectin-3-binding protein (184-193)

SEQ ID NO: 63199 - RNA, 27 nt, Artificial Sequence
  Fructose-bisphosphate aldolase A (132-140)
gccauggcuaccgugacagcacugaga

SEQ ID NO: 63200 - RNA, 30 nt, Artificial Sequence
  Myosin-9 (1912-1921)
gccaugaacagagaggugagcucccugaag

SEQ ID NO: 63201 - RNA, 27 nt, Artificial Sequence
  NAD(P)H dehydrogenase (quinone) 1 (128-136)
gccauguacgacaagggccccuucaga

SEQ ID NO: 63202 - RNA, 27 nt, Artificial Sequence
  Type II inositol 3,4-bisphosphate 4-phosphatase (368-376)
gcccccgcugcacacuuccagggcuuu

SEQ ID NO: 63203 - RNA, 33 nt, Artificial Sequence
  Ankyrin repeat and zinc finger domain-containing protein 1 (4-14)
gcccccgacgcugcaccugccccagcgagcauc

SEQ ID NO: 63204 - RNA, 30 nt, Artificial Sequence
  E3 ubiquitin-protein ligase NEURL1B (119-128)
gcccccagaccugacggcgggaggacccug

SEQ ID NO: 63205 - RNA, 27 nt, Artificial Sequence
  40S ribosomal protein S4, Y isoform 1 (27-35)
gcccccagaccuagcaccggcccacac

SEQ ID NO: 63206 - RNA, 30 nt, Artificial Sequence
  60S ribosomal protein L36 (51-60)
gcccccuacgagagaagggcuauggaacug

SEQ ID NO: 63207 - RNA, 30 nt, Artificial Sequence
  PHD and RING finger domain-containing protein 1 (159-168)
gcccaguucggcgggaagauccugagaaaa

SEQ ID NO: 63208 - RNA, 33 nt, Artificial Sequence
  Cleavage stimulation factor subunit 3 (59-69)
gcccaguuccccagcuccggcagauuuuggaag

SEQ ID NO: 63209 - RNA, 30 nt, Artificial Sequence
  Transcription and mRNA export factor ENY2 (10-19)
gcccagaugagagcugcaaucaaccaaaag

SEQ ID NO: 63210 - RNA, 27 nt, Artificial Sequence
  V-type proton ATPase 21 kDa proteolipid subunit (10-18)
gcccagaaccccagccuguucgugaag

SEQ ID NO: 63211 - RNA, 24 nt, Artificial Sequence
  Myosin-9 (2-9)
gcccagcaagcugcagacaaguac

SEQ ID NO: 63212 - RNA, 27 nt, Artificial Sequence
  MICOS complex subunit MIC60 (196-204)
gcccagcaagagaagcaggaacaggug

SEQ ID NO: 63213 - RNA, 27 nt, Artificial Sequence
  Ubiquitin-like protein 5 (33-41)
gcccagaccggcacaagauggaacaag

SEQ ID NO: 63214 - RNA, 27 nt, Artificial Sequence
  Cytochrome c oxidase assembly factor 3 homolog, mitochondrial (44-52)
gcccaguggcaaaaggugcugcccaga

SEQ ID NO: 63215 - RNA, 27 nt, Artificial Sequence
  SUMO-activating enzyme subunit 1 (17-25)
gcccaguacgacagacaaaucaggcug

SEQ ID NO: 63216 - RNA, 27 nt, Artificial Sequence
  Poly(U)-binding-splicing factor PUF60 (204-212)
gccagagcuuucaacaggaucuacgug

SEQ ID NO: 63217 - RNA, 27 nt, Artificial Sequence
  Protein transport protein Sec61 subunit alpha isoform 1 (310-318)
gccagauucagcggcaaccugcucgug

SEQ ID NO: 63218 - RNA, 27 nt, Artificial Sequence
  Ran GTPase-activating protein 1 (576-584)
gccagacacagccugcuccagacccuu

SEQ ID NO: 63219 - RNA, 33 nt, Artificial Sequence
  Probable RNA-binding protein 19 (488-498)
gccagcgcucugggcuccucuucauacaagaaa

SEQ ID NO: 63220 - RNA, 27 nt, Artificial Sequence
  Polyadenylate-binding protein 1 (551-559)
gccagcgcucccccucaggagcaaaag

SEQ ID NO: 63221 - RNA, 27 nt, Artificial Sequence
  3'(2'),5'-bisphosphate nucleotidase 1 (13-21)
gccagcgcuuacuccaucgcacagaag

SEQ ID NO: 63222 - RNA, 27 nt, Artificial Sequence
  WD repeat-containing protein 26 (616-624)
gccagcgacgauggcaccgugagaauc

SEQ ID NO: 63223 - RNA, 27 nt, Artificial Sequence
  WD repeat-containing protein 61 (115-123)
gccagcgacgauggcuacaucaagauu

SEQ ID NO: 63224 - RNA, 30 nt, Artificial Sequence
  Selenoprotein O (215-224)
gccagcgacaacaccggcagauacgcuuau

SEQ ID NO: 63225 - RNA, 27 nt, Artificial Sequence
  Protein flightless-1 homolog (1107-1115)
gccagcgaccccgaugaggcuaagcug

SEQ ID NO: 63226 - RNA, 30 nt, Artificial Sequence; identical to SEQ ID NO: 38999
  Transcription factor 20 (70-79)

SEQ ID NO: 63227 - RNA, 33 nt, Artificial Sequence
  Zinc finger protein 622 (77-87)
gccagcuucaacgcuuacgagaaucaccugaag

SEQ ID NO: 63228 - RNA, 27 nt, Artificial Sequence
  LIM domain and actin-binding protein 1 (496-504)
gccagcuuccaguccaccucugugaag

SEQ ID NO: 63229 - RNA, 33 nt, Artificial Sequence
  Origin recognition complex subunit 3 (514-524)
gccagcggcucccagcccaaggggcugcaaaaa

SEQ ID NO: 63230 - RNA, 33 nt, Artificial Sequence
  Serine/threonine-protein phosphatase 6 regulatory ankyrin repeat subunit B (624-634)
gccagcaucuucgugaaggacaacgucaccaaa

SEQ ID NO: 63231 - RNA, 33 nt, Artificial Sequence
  Serine/threonine-protein phosphatase 6 regulatory ankyrin repeat subunit A (637-647)
gccagcauccuggugaaggacuacauucucaaa

SEQ ID NO: 63232 - RNA, 33 nt, Artificial Sequence
  39S ribosomal protein L22, mitochondrial (37-47)
gccagccuggacaucuccagaaagugggagaaa

SEQ ID NO: 63233 - RNA, 27 nt, Artificial Sequence
  Centrosome-associated protein 350 (95-103)
gccagccugaucaagcagcucgaggug

SEQ ID NO: 63234 - RNA, 33 nt, Artificial Sequence
  Deoxynucleotidyltransferase terminal-interacting protein 2 (668-678)
gccagcauggaccccaagagauucuacaaaaag

SEQ ID NO: 63235 - RNA, 33 nt, Artificial Sequence
  Myosin-10 (370-380)
gccagcaugcccgagaacaccguggcucagaag

SEQ ID NO: 63236 - RNA, 36 nt, Artificial Sequence
  Discoidin, CUB and LCCL domain-containing protein 2 (153-164)
gccagcaacuuccuggagcccgaauuuuccaaguac

SEQ ID NO: 63237 - RNA, 27 nt, Artificial Sequence
  Chromosome transmission fidelity protein 8 homolog isoform 2 (379-387)
gccagcaaccccgcuaccuuccagaga

SEQ ID NO: 63238 - RNA, 36 nt, Artificial Sequence
  Heterogeneous nuclear ribonucleoprotein H (160-171)
gccagccaggagaucgcugaaaaggcacugaaaaag

SEQ ID NO: 63239 - RNA, 27 nt, Artificial Sequence
  Zinc finger protein 574 (226-234)
gccagccaggagcuguggcucaaccac

SEQ ID NO: 63240 - RNA, 27 nt, Artificial Sequence
  E3 ubiquitin-protein ligase MARCH7 (344-352)
gccagccagggcuucagauuucugagg

SEQ ID NO: 63241 - RNA, 27 nt, Artificial Sequence
  Ubiquitin-conjugating enzyme E2 T (183-191)
gccagccagcuggugggcaucgagaag

SEQ ID NO: 63242 - RNA, 39 nt, Artificial Sequence
  Anthrax toxin receptor 2 (131-143)
gccagcuacuauggcgggagaggaguggguggcaucaag

SEQ ID NO: 63243 - RNA, 27 nt, Artificial Sequence
  Transmembrane protein 147 (107-115)
gccaccgcugagcugaucaugagcaga

SEQ ID NO: 63244 - RNA, 30 nt, Artificial Sequence
  Multifunctional protein ADE2 (2-11)
gccaccgcugaggugcugaacaucggcaag

SEQ ID NO: 63245 - RNA, 33 nt, Artificial Sequence
  Clathrin heavy chain 1 (311-321)
gccaccgcuggcaucauuggggugaacagaaag

SEQ ID NO: 63246 - RNA, 27 nt, Artificial Sequence
  Cilia- and flagella-associated protein 58 (79-87)
gccaccgcucugaagcucagccaggac

SEQ ID NO: 63247 - RNA, 33 nt, Artificial Sequence
  Mitogen-activated protein kinase-binding protein 1 (686-696)
gccaccgcuagccccuucuccggccugcagaag

SEQ ID NO: 63248 - RNA, 27 nt, Artificial Sequence
  Glucosamine 6-phosphate N-acetyltransferase (99-107)
gccaccgcuacacugaucauugagcac

SEQ ID NO: 63249 - RNA, 27 nt, Artificial Sequence
  UPF0472 protein C16orf72 (67-75)
gccaccgcuguggcacagcuguacaag

SEQ ID NO: 63250 - RNA, 30 nt, Artificial Sequence
  NAD(P) transhydrogenase, mitochondrial (730-739)
gccaccgacgcugcagccaaccugacaaag

SEQ ID NO: 63251 - RNA, 33 nt, Artificial Sequence
  E3 ubiquitin-protein ligase RNF220 (291-301)
gccaccgacgaucugcaccauagcgacagauac

SEQ ID NO: 63252 - RNA, 30 nt, Artificial Sequence
  Collagen alpha-1(XII) chain (183-192)
gccaccgaccccgaugacacacacgcuuac

SEQ ID NO: 63253 - RNA, 27 nt, Artificial Sequence
  V-type proton ATPase 21 kDa proteolipid subunit (120-128)
gccaccgaccccaaggcuaucggccac

SEQ ID NO: 63254 - RNA, 27 nt, Artificial Sequence
  ATP-dependent RNA helicase DDX1 (614-622)
gccaccgagaaggaaaaagugugguac

SEQ ID NO: 63255 - RNA, 36 nt, Artificial Sequence
  Apoptosis inhibitor 5 (17-28)
gccaccgagcaggugggccaacacaaggacgcuuac

SEQ ID NO: 63256 - RNA, 33 nt, Artificial Sequence
  Calcium-binding protein 39 (186-196)
gccaccuucaaggaccugcucacaagacacaaa

SEQ ID NO: 63257 - RNA, 30 nt, Artificial Sequence
  Serine/threonine-protein kinase OSR1 (172-181)
gccaccggcggggacaucacaagaaacaag

SEQ ID NO: 63258 - RNA, 30 nt, Artificial Sequence
  Inositol-pentakisphosphate 2-kinase (170-179)
gccaccggcaaguggaaacagaucagcaag

SEQ ID NO: 63259 - RNA, 30 nt, Artificial Sequence
  DNA-directed RNA polymerase II subunit RPB2 (442-451)
gccaccggcaacuggggggaccagaagaaa

SEQ ID NO: 63260 - RNA, 27 nt, Artificial Sequence
  Plexin-B2 (68-76)
gccaccggccccgcucuggacaacaag

SEQ ID NO: 63261 - RNA, 27 nt, Artificial Sequence
  General transcription factor IIH subunit 2 (32-40)
gccaccaucgaggacauucuguucaag

SEQ ID NO: 63262 - RNA, 33 nt, Artificial Sequence
  Polycomb group RING finger protein 6 (210-220)
gccaccaucggccacguggagaaguuccugaga

SEQ ID NO: 63263 - RNA, 33 nt, Artificial Sequence
  Isocitrate dehydrogenase (NAD) subunit alpha, mitochondrial (333-343)
gccaccaucaaggacggcaaaagccugacaaag

SEQ ID NO: 63264 - RNA, 27 nt, Artificial Sequence
  Protein MMS22-like (831-839)
gccaccauccccccuauuagcucccug

SEQ ID NO: 63265 - RNA, 30 nt, Artificial Sequence
  Ankyrin repeat and KH domain-containing protein 1 (1428-1437)
gccaccaucacagacaaggagcugcucaaa

SEQ ID NO: 63266 - RNA, 33 nt, Artificial Sequence
  Ankyrin repeat and KH domain-containing protein 1 (1428-1438)
gccaccaucacagacaaggagcugcucaaaaag

SEQ ID NO: 63267 - RNA, 33 nt, Artificial Sequence
  Ankyrin repeat domain-containing protein 17 (1306-1316)
gccaccaucacagacaaggagaugcugaaaaag

SEQ ID NO: 63268 - RNA, 30 nt, Artificial Sequence
  HAUS augmin-like complex subunit 7 (418-427)
gccaccaagaugaacgagcugauggaaaaa

SEQ ID NO: 63269 - RNA, 27 nt, Artificial Sequence
  E3 SUMO-protein ligase NSE2 (69-77)
gccacccuggacagacagcucaaccac

SEQ ID NO: 63270 - RNA, 33 nt, Artificial Sequence
  PIN2/TERF1-interacting telomerase inhibitor 1 (312-322)
gccacccuggaggaaacacucgugaagaaaaag

SEQ ID NO: 63271 - RNA, 33 nt, Artificial Sequence
  Coatomer subunit beta (111-121)
gccacccugggcgaccucaagcuuguggagaaa

SEQ ID NO: 63272 - RNA, 36 nt, Artificial Sequence
  DNA-directed RNA polymerase II subunit RPB1 (907-918)
gccacccugaagcccagcaacaaagcuuucgagaag

SEQ ID NO: 63273 - RNA, 33 nt, Artificial Sequence
  Telomerase protein component 1 (83-93)
gccacccugagcgaccucaagacaauggagaaa

SEQ ID NO: 63274 - RNA, 30 nt, Artificial Sequence; identical to SEQ ID NO: 39047
  KIF1-binding protein (254-263)

SEQ ID NO: 63275 - RNA, 36 nt, Artificial Sequence
  Eukaryotic initiation factor 4A-I (214-225)
gccaccaugcccagcgacgugcuggaggucacaaag

SEQ ID NO: 63276 - RNA, 33 nt, Artificial Sequence
  Activity-dependent neuroprotector homeobox protein (988-998)
gccaccaugcagggcgacagagagcaacugaag

SEQ ID NO: 63277 - RNA, 30 nt, Artificial Sequence
  Arf-GAP with coiled-coil, ANK repeat and PH domain-containing protein 2 (155-164)
gccaccaacauccugacagcuacuagaaag

SEQ ID NO: 63278 - RNA, 30 nt, Artificial Sequence
  Homeobox protein Hox-A13 (342-351)
gccaccaacaaguucaucacaaaagacaag

SEQ ID NO: 63279 - RNA, 30 nt, Artificial Sequence; identical to SEQ ID NO: 39052
  Rho-related BTB domain-containing protein 3 (557-566)

SEQ ID NO: 63280 - RNA, 27 nt, Artificial Sequence
  Glutathione S-transferase kappa 1 (148-156)
gccacccccaaggugaaaaaccagcug

SEQ ID NO: 63281 - RNA, 30 nt, Artificial Sequence
  Splicing factor 1 (7-16)
gccaccccccuggacuucccuagcaagaaa

SEQ ID NO: 63282 - RNA, 27 nt, Artificial Sequence
  Geranylgeranyl transferase type-2 subunit alpha (31-39)
gccacccaggcuguguuccaaaagaga

SEQ ID NO: 63283 - RNA, 36 nt, Artificial Sequence
  Forkhead box protein J3 (44-55)
gccacccagaacgcucacggcacagggaucagcaag

SEQ ID NO: 63284 - RNA, 27 nt, Artificial Sequence
  Tubby-related protein 4 (741-749)
gccacccaguaccccgugagcaacaga

SEQ ID NO: 63285 - RNA, 33 nt, Artificial Sequence
  Importin subunit alpha-5 (407-417)
gccaccagcggcggguccgcugagcagaucaag

SEQ ID NO: 63286 - RNA, 27 nt, Artificial Sequence
  CLIP-associating protein 1 (426-434)
gccaccagcggcguggucgcuguuaga

SEQ ID NO: 63287 - RNA, 27 nt, Artificial Sequence
  Origin recognition complex subunit 3 (253-261)
gccaccagccccaucauuauacacaga

SEQ ID NO: 63288 - RNA, 30 nt, Artificial Sequence
  Origin recognition complex subunit 3 (253-262)
gccaccagccccaucauuauacacagacug

SEQ ID NO: 63289 - RNA, 27 nt, Artificial Sequence
  Importin subunit alpha-1 (60-68)
gccaccagcccccugcaggagaacaga

SEQ ID NO: 63290 - RNA, 27 nt, Artificial Sequence
  tRNA pseudouridine synthase-like 1 (125-133)
gccaccagcagaacauaccuguauagg

SEQ ID NO: 63291 - RNA, 33 nt, Artificial Sequence
  Golgi apparatus membrane protein TVP23 homolog B (186-196)
gccaccagcuacuucggcaagcaguuucugaga

SEQ ID NO: 63292 - RNA, 33 nt, Artificial Sequence
  ATP-citrate synthase (93-103)
gccaccgugggcaaggcuacaggguuccugaaa

SEQ ID NO: 63293 - RNA, 27 nt, Artificial Sequence
  Phosphoribosyl pyrophosphate synthase-associated protein 1 (222-230)
gccaccgugcaccccggccuggagcuc

SEQ ID NO: 63294 - RNA, 30 nt, Artificial Sequence
  Integrator complex subunit 7 (445-454)
gccaccgugaucuucgucgcuagccagaag

SEQ ID NO: 63295 - RNA, 27 nt, Artificial Sequence
  Pre-mRNA-processing factor 19 (180-188)
gccaccgugcugacaacugagagaaag

SEQ ID NO: 63296 - RNA, 33 nt, Artificial Sequence
  Mitochondrial folate transporter/carrier (241-251)
gccaccuaccccuaucagguggucagagcuagg

SEQ ID NO: 63297 - RNA, 33 nt, Artificial Sequence
  Eukaryotic translation initiation factor 3 subunit D (48-58)
gccaccuaccaggacaagagauauacaaacaaa

SEQ ID NO: 63298 - RNA, 27 nt, Artificial Sequence
  Cleavage and polyadenylation specificity factor subunit 2 (52-60)
gccaccuacgugcagcccagaaggaag

SEQ ID NO: 63299 - RNA, 27 nt, Artificial Sequence
  Protein phosphatase methylesterase 1 (362-370)
gccguggcuaccuuccugaucagacac

SEQ ID NO: 63300 - RNA, 27 nt, Artificial Sequence
  Serine/threonine-protein kinase SIK2 (699-707)
gccguggacccccagcacaacggcuac

SEQ ID NO: 63301 - RNA, 27 nt, Artificial Sequence
  Fanconi anemia group D2 protein (69-77)
gccguggaccagaucgcuuuccaaaag

SEQ ID NO: 63302 - RNA, 27 nt, Artificial Sequence
  Breast cancer type 1 susceptibility protein (1104-1112)
gccguguucagcaaguccguccagaaa

SEQ ID NO: 63303 - RNA, 33 nt, Artificial Sequence
  Uncharacterized aarF domain-containing protein kinase 5 (335-345)
gccgugcacgacaucgcugagaagcugauuaaa

SEQ ID NO: 63304 - RNA, 27 nt, Artificial Sequence
  Telomere-associated protein RIF1 (481-489)
gccgugcacgacagcuucgucgcuguu

SEQ ID NO: 63305 - RNA, 33 nt, Artificial Sequence
  Protein canopy homolog 4 (15-25)
gccgugcacgaggcuugggcaggcaugcugaag

SEQ ID NO: 63306 - RNA, 27 nt, Artificial Sequence
  Zinc transporter ZIP3 (302-310)
gccgugcacgagacccuggucgcuguu

SEQ ID NO: 63307 - RNA, 27 nt, Artificial Sequence
  Bifunctional methylenetetrahydrofolate dehydrogenase/cyclohydrolase, mitochondrial (270-278)
gccgugaucgacgucggcauuaacaga

SEQ ID NO: 63308 - RNA, 39 nt, Artificial Sequence
  Cytoplasmic dynein 1 heavy chain 1 (3288-3300)
gccgugaucgaggcucagaacgcagucaagagcauuaaa

SEQ ID NO: 63309 - RNA, 27 nt, Artificial Sequence
  Nucleosome-remodeling factor subunit BPTF (2407-2415)
gccgugaucgagcaccugaagcagaaa

SEQ ID NO: 63310 - RNA, 33 nt, Artificial Sequence
  L-xylulose reductase (110-120)
gccgugauccaggucagccaaauuguugcuaga

SEQ ID NO: 63311 - RNA, 33 nt, Artificial Sequence
  Protein S100-A16 (11-21)
gccgugaucguccugguugagaacuucuacaag

SEQ ID NO: 63312 - RNA, 30 nt, Artificial Sequence
  Periodic tryptophan protein 1 homolog (46-55)
gccgugcuggaccucagcuggaacaagcuu

SEQ ID NO: 63313 - RNA, 33 nt, Artificial Sequence
  Zinc finger SWIM domain-containing protein 8 (430-440)
gccgugcuggaccccgcucucagcccucagaga

SEQ ID NO: 63314 - RNA, 27 nt, Artificial Sequence
  Vacuolar protein sorting-associated protein 11 homolog (740-748)
gccgugcugaagcacaucgagaacaaa

SEQ ID NO: 63315 - RNA, 33 nt, Artificial Sequence
  Charged multivesicular body protein 3 (30-40)
gccgugcugagagucgcuggcagccuccagaag

SEQ ID NO: 63316 - RNA, 33 nt, Artificial Sequence
  Long-chain-fatty-acid-CoA ligase 4 (332-342)
gccgugcccgagaucauggacagaauuuacaag

SEQ ID NO: 63317 - RNA, 33 nt, Artificial Sequence
  Aspartyl aminopeptidase (23-33)
gccgugcagaccgcugcaaaggagcugcucaaa

SEQ ID NO: 63318 - RNA, 30 nt, Artificial Sequence
  TSC22 domain family protein 4 (336-345)
gccgugagagaggaagucgagguucugaag

SEQ ID NO: 63319 - RNA, 30 nt, Artificial Sequence
  Peroxisomal acyl-coenzyme A oxidase 1 (63-72)
gccgugagaaagagcgcuaucauggucaaa

SEQ ID NO: 63320 - RNA, 33 nt, Artificial Sequence
  Pre-mRNA-processing factor 6 (914-924)
gccgugagcaaggacaucgcuaacuggcagaaa

SEQ ID NO: 63321 - RNA, 27 nt, Artificial Sequence
  5'-AMP-activated protein kinase subunit gamma-1 (141-149)
gccgugagcucccugaucagaaacaag

SEQ ID NO: 63322 - RNA, 33 nt, Artificial Sequence
  CD99 antigen-like protein 2 (58-68)
gccgugagcuccuacaucucuuaucagcaaaag

SEQ ID NO: 63323 - RNA, 27 nt, Artificial Sequence
  Inactive hydroxysteroid dehydrogenase-like protein 1 (258-266)
gccgugagcacccugggcaucuccaag

SEQ ID NO: 63324 - RNA, 33 nt, Artificial Sequence
  CD81 antigen (63-73)
gccguggucgacgaugacgcuaacaaugcaaag

SEQ ID NO: 63325 - RNA, 27 nt, Artificial Sequence
  GTP-binding protein 2 (496-504)
gccguggucgagaagauccacgcuaaa

SEQ ID NO: 63326 - RNA, 33 nt, Artificial Sequence
  Mitochondrial folate transporter/carrier (154-164)
gccguggucaacagcccccacagacaguacaag

SEQ ID NO: 63327 - RNA, 27 nt, Artificial Sequence
  Inositol 1,4,5-trisphosphate receptor-interacting protein (385-393)
gccguguacgagagacacuuccugagg

SEQ ID NO: 63328 - RNA, 33 nt, Artificial Sequence
  Nuclear factor interleukin-3-regulated protein (146-156)
gccguguacuuccaggacuaucaaaccagcaag

SEQ ID NO: 63329 - RNA, 27 nt, Artificial Sequence
  Aladin (158-166)
gccuggcacccccauaccaacaaguuc

SEQ ID NO: 63330 - RNA, 27 nt, Artificial Sequence
  Ankyrin-2 (1480-1488)
gccuacaucgcugaccaccugggcuuc

SEQ ID NO: 63331 - RNA, 27 nt, Artificial Sequence
  Leucine-rich repeat protein SHOC-2 (468-476)
gccuaccugaaggaccuccagaaacuu

SEQ ID NO: 63332 - RNA, 27 nt, Artificial Sequence
  Fragile X mental retardation syndrome-related protein 1 (356-364)
gccuaccugaaggagguggaacagcuc

SEQ ID NO: 63333 - RNA, 27 nt, Artificial Sequence
  Serine/threonine-protein kinase RIO1 (156-164)
gccuaccugagcaaggcuauggagauc

SEQ ID NO: 63334 - RNA, 27 nt, Artificial Sequence
  ER degradation-enhancing alpha-mannosidase-like protein 1 (395-403)
gccuaccagagcauccaaaacuaucug

SEQ ID NO: 63335 - RNA, 27 nt, Artificial Sequence
  Angiomotin-like protein 1 (604-612)
gccuacguggagaaggucgaaaaacug

SEQ ID NO: 63336 - RNA, 27 nt, Artificial Sequence
  Angiomotin-like protein 2 (481-489)
gccuacguggagaaggucgaaagacug

SEQ ID NO: 63337 - RNA, 27 nt, Artificial Sequence
  Zinc finger protein 580 (248-256)
gacgccgcugagcuggcacagcacgug

SEQ ID NO: 63338 - RNA, 27 nt, Artificial Sequence
  Embryonic stem cell-specific 5-hydroxymethylcytosine-binding protein (62-70)
gacgccgauagcuccgagagaaucauu

SEQ ID NO: 63339 - RNA, 27 nt, Artificial Sequence
  Proteasome subunit beta type-10 (90-98)
gacgccgagaugaccacaagaauggug

SEQ ID NO: 63340 - RNA, 27 nt, Artificial Sequence
  Torsin-1A-interacting protein 2 (129-137)
gacgcccaccugggcagcuccucugug

SEQ ID NO: 63341 - RNA, 27 nt, Artificial Sequence
  Centrosomal protein of 95 kDa (61-69)
gacgcccacaacgugcaggcugucauc

SEQ ID NO: 63342 - RNA, 27 nt, Artificial Sequence
  Cohesin subunit SA-1 (302-310)
gacgccaucgcugagauuagagcaaua

SEQ ID NO: 63343 - RNA, 27 nt, Artificial Sequence
  Heat shock cognate 71 kDa protein (323-331)
gacgccaagcuggauaaaagccagauc

SEQ ID NO: 63344 - RNA, 24 nt, Artificial Sequence
  Phosphatidylinositol 4-kinase alpha (403-410)
gacgcccccgagcugagccacgug

SEQ ID NO: 63345 - RNA, 24 nt, Artificial Sequence
  Carnitine O-palmitoyltransferase 1, liver isoform (477-484)
gacgcccccaucguggcucaccug

SEQ ID NO: 63346 - RNA, 30 nt, Artificial Sequence
  Transcription activator BRG1 (696-705)
gacgcccccaaggcuggccagcuggaggca

SEQ ID NO: 63347 - RNA, 27 nt, Artificial Sequence
  Protein RMD5 homolog B (51-59)
gacgccagagagcagcaacagcagauc

SEQ ID NO: 63348 - RNA, 27 nt, Artificial Sequence
  Myotubularin (278-286)
gacgccagacccagcgugaacgcuguc

SEQ ID NO: 63349 - RNA, 27 nt, Artificial Sequence
  Filamin-A (1614-1622)
gacgccagcaagugcaccgugacaguc

SEQ ID NO: 63350 - RNA, 27 nt, Artificial Sequence
  E3 ubiquitin-protein ligase RNF114 (127-135)
gacgccagccugcagcccagaaacgug

SEQ ID NO: 63351 - RNA, 27 nt, Artificial Sequence
  Translocon-associated protein subunit delta (40-48)
gacgccgugaucagcaccgagacaguc

SEQ ID NO: 63352 - RNA, 24 nt, Artificial Sequence
  DNA-directed RNA polymerase II subunit RPB2 (306-313)
gacgccgugaacguccagaagauc

SEQ ID NO: 63353 - RNA, 27 nt, Artificial Sequence
  Adipocyte plasma membrane-associated protein (180-188)
gacgccuacaagggccuguucgaggug

SEQ ID NO: 63354 - RNA, 27 nt, Artificial Sequence
  Securin (108-116)
gacgccuaccccgagaucgaaaaguuc

SEQ ID NO: 63355 - RNA, 33 nt, Artificial Sequence
  Proteasome subunit beta type-4 (118-128)
gacgaggaacugcucggcgaugggcacagcuac

SEQ ID NO: 63356 - RNA, 27 nt, Artificial Sequence
  DNA polymerase alpha catalytic subunit (336-344)
gacgaggaacagguguuccacuuuuac

SEQ ID NO: 63357 - RNA, 33 nt, Artificial Sequence
  26S protease regulatory subunit 8 (123-133)
gacgagaucgauagcauuggcuccucuagacug

SEQ ID NO: 63358 - RNA, 27 nt, Artificial Sequence
  N-alpha-acetyltransferase 10 (47-55)
gacgagaacggcaagaucgugggguac

SEQ ID NO: 63359 - RNA, 27 nt, Artificial Sequence
  40S ribosomal protein S18 (62-70)
gacgagguggaaagagucaucaccauu

SEQ ID NO: 63360 - RNA, 27 nt, Artificial Sequence
  Rab GDP dissociation inhibitor beta (21-29)
gacuucaaggugaccgagggcagcuuu

SEQ ID NO: 63361 - RNA, 27 nt, Artificial Sequence
  Fatty acid synthase (2469-2477)
gacggcaaggugagcguccacguuauc

SEQ ID NO: 63362 - RNA, 27 nt, Artificial Sequence
  Nucleoporin NUP53 (211-219)
gacggcagaaucuucggggagagcauu

SEQ ID NO: 63363 - RNA, 27 nt, Artificial Sequence
  Nicotinamide/nicotinic acid mononucleotide adenylyltransferase 1 (112-120)
gaccaccagcaaaacagccccacccug

SEQ ID NO: 63364 - RNA, 42 nt, Artificial Sequence
  Glia-derived nexin (118-131)
gacaucgugaccgucgccaacgcuguuuucgugaagaaugca

SEQ ID NO: 63365 - RNA, 27 nt, Artificial Sequence
  Non-POU domain-containing octamer-binding protein (226-234)
gaccugaugagaaggcaggaggaacuc

SEQ ID NO: 63366 - RNA, 27 nt, Artificial Sequence
  Homeodomain-interacting protein kinase 1 (252-260)
gaccccuuccagcaaaccuuuaucgug

SEQ ID NO: 63367 - RNA, 27 nt, Artificial Sequence
  Mediator of RNA polymerase II transcription subunit 13-like (1410-1418)
gaccccuacggcgggcacagagaugug

SEQ ID NO: 63368 - RNA, 24 nt, Artificial Sequence
  Plectin (3424-3431)
gaccccuacagcggcuccaccauc

SEQ ID NO: 63369 - RNA, 27 nt, Artificial Sequence
  Elongator complex protein 2 (46-54)
gaccaguuccaaaaggugcugagccuc

SEQ ID NO: 63370 - RNA, 30 nt, Artificial Sequence
  Ras GTPase-activating protein-binding protein 2 (285-294)
gacagcgauaacagaaggaucauucgguac

SEQ ID NO: 63371 - RNA, 24 nt, Artificial Sequence
  AP-3 complex subunit delta-1 (314-321)
gacagcgaucagaaccugaaguac

SEQ ID NO: 63372 - RNA, 27 nt, Artificial Sequence
  Ubiquitin carboxyl-terminal hydrolase 28 (507-515)
gacagcuacggcgggcugagaaacgug

SEQ ID NO: 63373 - RNA, 27 nt, Artificial Sequence
  Zinc transporter ZIP6 (485-493)
gacaccgaugacagaacagagggcuac

SEQ ID NO: 63374 - RNA, 24 nt, Artificial Sequence
  Poly (ADP-ribose) polymerase 14 (118-125)
gacaccaucauggccacaaagcug

SEQ ID NO: 63375 - RNA, 24 nt, Artificial Sequence
  Protein S100-A9 (67-74)
gacaccaacgccgauaagcagcug

SEQ ID NO: 63376 - RNA, 27 nt, Artificial Sequence
  Protein FAM172A (263-271)
gacgugaagaacaaagucaccgccguu

SEQ ID NO: 63377 - RNA, 27 nt, Artificial Sequence
  Cytochrome c oxidase subunit 6C (57-65)
gacgugaugaaggauuucgaggaaaug

SEQ ID NO: 63378 - RNA, 27 nt, Artificial Sequence
  N-acetyl-D-glucosamine kinase (175-183)
gaggccgcuccccacgacaucggcuac

SEQ ID NO: 63379 - RNA, 30 nt, Artificial Sequence
  Myosin light polypeptide 6 (148-157)
gaggccuucgugagacacauccugagcggc

SEQ ID NO: 63380 - RNA, 27 nt, Artificial Sequence
  Hsp70-binding protein 1 (201-209)
gaggccggcgcugcagggcugagaugg

SEQ ID NO: 63381 - RNA, 24 nt, Artificial Sequence
  Probable U3 small nucleolar RNA-associated protein 11 (43-50)
gaggccaagaaaaucgaaagacug

SEQ ID NO: 63382 - RNA, 27 nt, Artificial Sequence
  Ribosomal RNA-processing protein 7 homolog A (260-268)
gaggaagacaagcagagaaucgagcug

SEQ ID NO: 63383 - RNA, 27 nt, Artificial Sequence
  WD40 repeat-containing protein SMU1 (197-205)
gaggaagagaaguuccccacccagcug

SEQ ID NO: 63384 - RNA, 30 nt, Artificial Sequence
  Guanine nucleotide-binding protein-like 3-like protein (97-106)
gaggaauucgagcacaaggaagaggugcug

SEQ ID NO: 63385 - RNA, 27 nt, Artificial Sequence
  Protocadherin Fat 1 (2948-2956)
gaggaaaucaacagacaggugaccuac

SEQ ID NO: 63386 - RNA, 27 nt, Artificial Sequence
  Midasin (582-590)
gaggaaaucagccaccugauuuccuuc

SEQ ID NO: 63387 - RNA, 27 nt, Artificial Sequence
  Protein strawberry notch homolog 2 (93-101)
gaggaacugggccacaccgagacauac

SEQ ID NO: 63388 - RNA, 27 nt, Artificial Sequence
  X-ray repair cross-complementing protein 5 (651-659)
gaggaacagagauucaacaauuuucug

SEQ ID NO: 63389 - RNA, 24 nt, Artificial Sequence
  Angiomotin-like protein 2 (573-580)
gaggaaagagccaugaggcaguuc

SEQ ID NO: 63390 - RNA, 30 nt, Artificial Sequence
  Methylmalonic aciduria and homocystinuria type D protein, mitochondrial (191-200)
gaggaaguggagaucgaaagagagguccug

SEQ ID NO: 63391 - RNA, 27 nt, Artificial Sequence
  Mitotic checkpoint serine/threonine-protein kinase BUB1 beta (160-168)
gaggaauacgaggccagagaaaacuuc

SEQ ID NO: 63392 - RNA, 27 nt, Artificial Sequence
  Mediator of RNA polymerase II transcription subunit 18 (128-136)
gaguucguggccaagggccaccuguuu

SEQ ID NO: 63393 - RNA, 27 nt, Artificial Sequence
  Glycerol-3-phosphate dehydrogenase 1-like protein (49-57)
gagggccccgaagggcugaagcucauc

SEQ ID NO: 63394 - RNA, 27 nt, Artificial Sequence
  3-ketoacyl-CoA thiolase, mitochondrial (221-229)
gagcacgccagaccccagaccacacug

SEQ ID NO: 63395 - RNA, 27 nt, Artificial Sequence
  COMM domain-containing protein 6 (77-85)
gagaucgccgcugugauugaaaccguc

SEQ ID NO: 63396 - RNA, 30 nt, Artificial Sequence; identical to SEQ ID NO: 39169
  Actin-related protein 6 (47-56)

SEQ ID NO: 63397 - RNA, 27 nt, Artificial Sequence
  Spectrin beta chain, non-erythrocytic 1 (1987-1995)
gagaucaaggaaaaacugcuccagcuu

SEQ ID NO: 63398 - RNA, 27 nt, Artificial Sequence
  DnaJ homolog subfamily C member 8 (83-91)
gagaucaagaaaagauucaggcagcug

SEQ ID NO: 63399 - RNA, 27 nt, Artificial Sequence
  Heat shock protein 105 kDa (740-748)
gagaucaagaccaaaauuaaggaacug

SEQ ID NO: 63400 - RNA, 27 nt, Artificial Sequence
  Replication protein A 14 kDa subunit (62-70)
gagaucagcggcauuguggaagucguu

SEQ ID NO: 63401 - RNA, 27 nt, Artificial Sequence
  Centrosomal protein of 170 kDa (1472-1480)
gagaucagcuccauucugcaggaacuc

SEQ ID NO: 63402 - RNA, 33 nt, Artificial Sequence
  Peptidyl-prolyl cis-trans isomerase CWC27 homolog (445-455)
gagaucuacgaccccagaaacccugugaauaag

SEQ ID NO: 63403 - RNA, 27 nt, Artificial Sequence
  Serine-protein kinase ATM (1146-1154)
gagaucuacaacagaaagagcgugcug

SEQ ID NO: 63404 - RNA, 27 nt, Artificial Sequence
  Translin-associated protein X (45-53)
gagcuggacgccagacacgauaaguac

SEQ ID NO: 63405 - RNA, 27 nt, Artificial Sequence
  Ankyrin repeat domain-containing protein 40 (281-289)
gagcuggacagacaggaacucaccuac

SEQ ID NO: 63406 - RNA, 27 nt, Artificial Sequence
  Uncharacterized protein C16orf45 (98-106)
gagcugauccagaagauucacaaacuc

SEQ ID NO: 63407 - RNA, 27 nt, Artificial Sequence
  ATP-dependent DNA helicase Q1 (34-42)
gagcugauccagaagaaaaaggugcuc

SEQ ID NO: 63408 - RNA, 27 nt, Artificial Sequence
  Dedicator of cytokinesis protein 7 (661-669)
gagcugaagagcuccaucucugcccuc

SEQ ID NO: 63409 - RNA, 27 nt, Artificial Sequence
  Protein Spindly (108-116)
gagcugaagaccaaaaucgaaaagcuc

SEQ ID NO: 63410 - RNA, 27 nt, Artificial Sequence
  Hypoxia-inducible factor 1-alpha (705-713)
gagcugaaccccaagauccucgcccuu

SEQ ID NO: 63411 - RNA, 27 nt, Artificial Sequence
  NF-kappa-B inhibitor-interacting Ras-like protein 1 (70-78)
gagcugcccaagcacuacuucagcuuu

SEQ ID NO: 63412 - RNA, 27 nt, Artificial Sequence
  Transmembrane emp24 domain-containing protein 9 (163-171)
gagcugcagcucagagugaggcaacuu

SEQ ID NO: 63413 - RNA, 27 nt, Artificial Sequence
  FRAS1-related extracellular matrix protein 2 (2560-2568)
gagcugagcaacuucgaacucacccuu

SEQ ID NO: 63414 - RNA, 27 nt, Artificial Sequence
  Immediate early response gene 5 protein (99-107)
gagccccagccugaaagaagcuccgug

SEQ ID NO: 63415 - RNA, 27 nt, Artificial Sequence
  Tubulin beta-6 chain (116-124)
gagcccuacaacgccacccugagcgug

SEQ ID NO: 63416 - RNA, 30 nt, Artificial Sequence
  Proline-rich protein PRCC (289-298)
gagcccuacccuuauccaaucccgaccgug

SEQ ID NO: 63417 - RNA, 24 nt, Artificial Sequence
  Eukaryotic translation initiation factor 3 subunit A (641-648)
gagcagaucaagaaaaccgaacug

SEQ ID NO: 63418 - RNA, 27 nt, Artificial Sequence
  Integrator complex subunit 1 (747-755)
gagcagcccgaaaccuacuauaagugg

SEQ ID NO: 63419 - RNA, 27 nt, Artificial Sequence
  Oxysterol-binding protein-related protein 9 (151-159)
gagcagagaaagaaaaucgaaacccug

SEQ ID NO: 63420 - RNA, 39 nt, Artificial Sequence
  (1108-1120)
gagagcgacaaguacgccgaaagaaaaggcgcugcauau

SEQ ID NO: 63421 - RNA, 30 nt, Artificial Sequence
  39S ribosomal protein L2, mitochondrial (197-206)
gagagcgaacccggcagaggggcccaguac

SEQ ID NO: 63422 - RNA, 27 nt, Artificial Sequence
  Trafficking protein particle complex subunit 3 (73-81)
gagaccgccgacgugaucgcuaagguc

SEQ ID NO: 63423 - RNA, 33 nt, Artificial Sequence
  60S ribosomal protein L17 (31-41)
gagaccgcccaggcuaucaagggcaugcacauu

SEQ ID NO: 63424 - RNA, 33 nt, Artificial Sequence
  Semaphorin-3C (312-322)
gagaccgacaaccccagaacaacucugguguac

SEQ ID NO: 63425 - RNA, 27 nt, Artificial Sequence
  Maturin (26-34)
gagaccgaaagaaggauggacuucuac

SEQ ID NO: 63426 - RNA, 27 nt, Artificial Sequence
  Type II inositol 3,4-bisphosphate 4-phosphatase (389-397)
gagaccgaaagaaggaacacaggcuac

SEQ ID NO: 63427 - RNA, 27 nt, Artificial Sequence
  Crooked neck-like protein 1 (679-687)
gagaccgaaagaacaaggaaccuguac

SEQ ID NO: 63428 - RNA, 27 nt, Artificial Sequence
  Mortality factor 4-like protein 1 (187-195)
gagaccuucaugaacagaguggaaguc

SEQ ID NO: 63429 - RNA, 27 nt, Artificial Sequence
  Proteasome-associated protein ECM29 homolog (349-357)
gagaccuuccccgccaacauccaggug

SEQ ID NO: 63430 - RNA, 27 nt, Artificial Sequence
  Nucleoporin NUP188 homolog (337-345)
gagaccagcuccguggucagaaagauc

SEQ ID NO: 63431 - RNA, 27 nt, Artificial Sequence
  NF-kappa-B-repressing factor (487-495)
gaggugaucgccgaagcugucggcguu

SEQ ID NO: 63432 - RNA, 27 nt, Artificial Sequence
  Sphingolipid delta(4)-desaturase DES1 (150-158)
gaggugaucaacaccgucgcccagguu

SEQ ID NO: 63433 - RNA, 27 nt, Artificial Sequence
  U11/U12 small nuclear ribonucleoprotein 48 kDa protein (239-247)
gaggugaucagagacgucauuaacguu

SEQ ID NO: 63434 - RNA, 27 nt, Artificial Sequence
  T-complex protein 1 subunit theta (462-470)
gaggugaucagcaagcuguacgccguc

SEQ ID NO: 63435 - RNA, 27 nt, Artificial Sequence
  Protein O-GlcNAcase (266-274)
gaggugagcaagaucauuaaaagagcc

SEQ ID NO: 63436 - RNA, 30 nt, Artificial Sequence
  Prolyl 3-hydroxylase OGFOD1 (211-220)
gaggugagccccgucuccuuccaccagguu

SEQ ID NO: 63437 - RNA, 30 nt, Artificial Sequence
  Melanoma-associated antigen 1 (222-231)
gagguguacgacggcagagaacacagcgcc

SEQ ID NO: 63438 - RNA, 27 nt, Artificial Sequence
  Exocyst complex component 4 (587-595)
gaguacauccacgcccugacccuccuu

SEQ ID NO: 63439 - RNA, 33 nt, Artificial Sequence
  Inactive tyrosine-protein kinase transmembrane receptor ROR1 (4-14)
gaguacaucaaccagggcgaccugcacgaauuc

SEQ ID NO: 63440 - RNA, 27 nt, Artificial Sequence
  Vacuolar protein sorting-associated protein 4B (64-72)
gaguaccuggacagagccgaaaagcuc

SEQ ID NO: 63441 - RNA, 27 nt, Artificial Sequence
  5'-3' exoribonuclease 1 (989-997)
gaguaccuggaaagagcccccgagcuc

SEQ ID NO: 63442 - RNA, 24 nt, Artificial Sequence
  Tubulin beta chain (178-185)
gaguaccccgacagaaucaugaac

SEQ ID NO: 63443 - RNA, 30 nt, Artificial Sequence
  Zinc finger protein 281 (515-524)
gaguacagcaaguaucugcagcaagccuuc

SEQ ID NO: 63444 - RNA, 27 nt, Artificial Sequence
  UPF0469 protein KIAA0907 (327-335)
gaguacagcagauucgugaaccagauc

SEQ ID NO: 63445 - RNA, 27 nt, Artificial Sequence
  Melanoma-associated antigen D1 (504-512)
gaguacaccgacguguaucccgaaauc

SEQ ID NO: 63446 - RNA, 27 nt, Artificial Sequence
  Probable global transcription activator SNF2L2 (535-543)
gaguacguggccaaccugaccaaucuc

SEQ ID NO: 63447 - RNA, 33 nt, Artificial Sequence
  HLA class I histocompatibility antigen, alpha chain F (43-53)
gaguacguggacgauacccaguuccugagauuu

SEQ ID NO: 63448 - RNA, 27 nt, Artificial Sequence
  Zinc finger protein 506 (117-125)
gaguacgugaaguuccugcacaaauuu

SEQ ID NO: 63449 - RNA, 27 nt, Artificial Sequence
  Kinesin-like protein KIF22 (218-226)
uucgccgacuuugagagacacuuccug

SEQ ID NO: 63450 - RNA, 27 nt, Artificial Sequence
  Phosphatidylinositol 4-phosphate 3-kinase C2 domain-containing subunit alpha (950-958)
uucgccgaccaggaggugagaagccug

SEQ ID NO: 63451 - RNA, 27 nt, Artificial Sequence
  E3 ubiquitin-protein ligase TRIM22 (386-394)
uucgccuuugaccccagcgugaacuac

SEQ ID NO: 63452 - RNA, 27 nt, Artificial Sequence
  Protein disulfide-isomerase A3 (184-192)
uucgcccacaccaacguggagagccug

SEQ ID NO: 63453 - RNA, 27 nt, Artificial Sequence
  Sarcosine dehydrogenase, mitochondrial (859-867)
uucgccaucgacaagaccauugcuuac

SEQ ID NO: 63454 - RNA, 27 nt, Artificial Sequence
  Eukaryotic translation initiation factor 3 subunit E (53-61)
uucgccauggacguguacaagaaccug

SEQ ID NO: 63455 - RNA, 27 nt, Artificial Sequence
  Protein-tyrosine kinase 2-beta (257-265)
uucgccaacaucgaccaggagaccuac

SEQ ID NO: 63456 - RNA, 33 nt, Artificial Sequence; identical to SEQ ID NO: 39229
  Glutamine and serine-rich protein 1 (1659-1669)

SEQ ID NO: 63457 - RNA, 27 nt, Artificial Sequence
  Ubiquilin-1 (50-58)
uucgccgugcccgagaacagcuccguc

SEQ ID NO: 63458 - RNA, 30 nt, Artificial Sequence
  Eukaryotic translation initiation factor 3 subunit B (568-577)
uucgccugggagcccaacggcagcaaguuu

SEQ ID NO: 63459 - RNA, 33 nt, Artificial Sequence
  Probable ATP-dependent RNA helicase DDX56 (464-474)
uucgaggacaaccccagagaucugcagcuccuu

SEQ ID NO: 63460 - RNA, 27 nt, Artificial Sequence
  Coatomer subunit gamma-1 (783-791)
uucgagaaggaagagaccuuuacacug

SEQ ID NO: 63461 - RNA, 27 nt, Artificial Sequence
  Alpha-parvin (133-141)
uucgagaagcuggaaagcgagaaacuc

SEQ ID NO: 63462 - RNA, 30 nt, Artificial Sequence
  Glycogen phosphorylase, brain form (327-336)
uucgagaccuuucccgacaagguggccauc

SEQ ID NO: 63463 - RNA, 33 nt, Artificial Sequence
  Destrin (89-99)
uucgagaccaaggaaagcagaaaagaggaacug

SEQ ID NO: 63464 - RNA, 27 nt, Artificial Sequence
  Zinc finger protein 462 (268-276)
uucggcgacagcgggagacuguacuau

SEQ ID NO: 63465 - RNA, 27 nt, Artificial Sequence
  Endoplasmic reticulum-Golgi intermediate compartment protein 3 (214-222)
uuccacuuugcccccggcaagagcuuc

SEQ ID NO: 63466 - RNA, 30 nt, Artificial Sequence
  HLA class II histocompatibility antigen, DQ alpha 1 chain (134-143)
uucaucgacaaguuuacccccccugugguc

SEQ ID NO: 63467 - RNA, 27 nt, Artificial Sequence
  Guanine nucleotide-binding protein G(I)/G(S)/G(T) subunit beta-1 (58-66)
uuccuggacgauaaccagaucgugacc

SEQ ID NO: 63468 - RNA, 27 nt, Artificial Sequence
  Basigin (25-33)
uuccugcccgagccuaugggcaccgcc

SEQ ID NO: 63469 - RNA, 30 nt, Artificial Sequence
  Volume-regulated anion channel subunit LRRC8D (80-89)
uuccugagcgagguguccgaaaacaagcuc

SEQ ID NO: 63470 - RNA, 27 nt, Artificial Sequence
  Transmembrane protein 97 (18-26)
uuccugagccacauccccauuacccuc

SEQ ID NO: 63471 - RNA, 30 nt, Artificial Sequence
  Vitamin K-dependent protein S (26-35)
uuccugagcaagcagcaagccucccaggug

SEQ ID NO: 63472 - RNA, 27 nt, Artificial Sequence
  Helicase with zinc finger domain 2 (630-638)
uucagacccccuaccagggccgagcug

SEQ ID NO: 63473 - RNA, 27 nt, Artificial Sequence
  Myeloid leukemia factor 2 (203-211)
uucagacagcaaaggccccuggaguuu

SEQ ID NO: 63474 - RNA, 27 nt, Artificial Sequence
  Importin subunit alpha-7 (90-98)
uucagcgacgauuccgaccugcagcuc

SEQ ID NO: 63475 - RNA, 27 nt, Artificial Sequence
  Protein phosphatase 1D (12-20)
uucagcgaccagggcgggagaaaguac

SEQ ID NO: 63476 - RNA, 27 nt, Artificial Sequence
  60S ribosomal protein L11 (98-106)
uucagcgacaccggcaacuuuggguuc

SEQ ID NO: 63477 - RNA, 27 nt, Artificial Sequence
  Renin receptor (105-113)
uucagcgaggaaacccccgugguccug

SEQ ID NO: 63478 - RNA, 27 nt, Artificial Sequence
  Transforming protein RhoA (80-88)
uucagcaucgacucccccgauucucug

SEQ ID NO: 63479 - RNA, 27 nt, Artificial Sequence
  Condensin complex subunit 3 (305-313)
uucagcaucaccccccuguccgagcuc

SEQ ID NO: 63480 - RNA, 27 nt, Artificial Sequence
  Unconventional myosin-Ib (364-372)
uucagcuccgaccaccugaucgagaug

SEQ ID NO: 63481 - RNA, 27 nt, Artificial Sequence
  TBC1 domain family member 22B (80-88)
uucagcucccccucuuuucagacccug

SEQ ID NO: 63482 - RNA, 27 nt, Artificial Sequence
  Basic leucine zipper and W2 domain-containing protein 2 (234-242)
uucaccgacgccggccugaaggagcuc

SEQ ID NO: 63483 - RNA, 27 nt, Artificial Sequence
  Multidrug resistance protein 1 (175-183)
uucaccgacaaggagcugcucgccuac

SEQ ID NO: 63484 - RNA, 27 nt, Artificial Sequence
  Protein VPRBP (1070-1078)
uucaccgaggaccacuacguggaauuu

SEQ ID NO: 63485 - RNA, 30 nt, Artificial Sequence
  Neuronal calcium sensor 1 (22-31)
uucaccgagaaggaagugcagcaaugguac

SEQ ID NO: 63486 - RNA, 27 nt, Artificial Sequence
  RNMT-activating mini protein (19-27)
uucaccgagaacgacaaggaauaccag

SEQ ID NO: 63487 - RNA, 39 nt, Artificial Sequence
  DNA-directed RNA polymerase II subunit RPB7 (31-43)
uucaccgagguggaaggcacaugcacugggaaguacgga

SEQ ID NO: 63488 - RNA, 27 nt, Artificial Sequence
  SURP and G-patch domain-containing protein 1 (198-206)
uucguggccgagggcgggcccgaacug

SEQ ID NO: 63489 - RNA, 30 nt, Artificial Sequence
  Glutamyl-tRNA(Gln) amidotransferase subunit C, mitochondrial (112-121)
uucguggcccccccuggcaacaucagccug

SEQ ID NO: 63490 - RNA, 27 nt, Artificial Sequence
  E3 ubiquitin-protein ligase RNF187 (182-190)
uucguggaggaagaggaacacuuucug

SEQ ID NO: 63491 - RNA, 27 nt, Artificial Sequence
  Ubiquitin carboxyl-terminal hydrolase 22 (45-53)
uucguguggagcggcaccgccgaggcu

SEQ ID NO: 63492 - RNA, 33 nt, Artificial Sequence
  Membrane cofactor protein (69-79)
uucuacauccccccucuggccacccacacaauu

SEQ ID NO: 63493 - RNA, 27 nt, Artificial Sequence
  GPI transamidase component PIG-T (539-547)
uucuacaaccugcucaccagaacauuu

SEQ ID NO: 63494 - RNA, 27 nt, Artificial Sequence
  RNA polymerase II-associated factor 1 homolog (423-431)
ggcgccaccgcugcagcccccgugccu

SEQ ID NO: 63495 - RNA, 33 nt, Artificial Sequence
  Nuclear mitotic apparatus protein 1 (775-785)
ggcgaggcccaccaggcugaaaccgaggugcug

SEQ ID NO: 63496 - RNA, 30 nt, Artificial Sequence
  Cytoplasmic dynein 1 light intermediate chain 2 (61-70)
ggcgaggacgggagcggaaagaccacacug

SEQ ID NO: 63497 - RNA, 33 nt, Artificial Sequence; identical to SEQ ID NO: 39270
  von Willebrand factor A domain-containing protein 5A (208-218)

SEQ ID NO: 63498 - RNA, 27 nt, Artificial Sequence
  Protein Jade-2 (168-176)
ggcgaggaccuggaaaaggugacccuc

SEQ ID NO: 63499 - RNA, 30 nt, Artificial Sequence
  Zinc finger protein 622 (359-368)
ggcgaggaccccaacaaggccgaagagcug

SEQ ID NO: 63500 - RNA, 33 nt, Artificial Sequence
  Eukaryotic translation initiation factor 3 subunit C-like protein (542-552)
ggcgaggacagcgccgugcugauggaaagacuc

SEQ ID NO: 63501 - RNA, 27 nt, Artificial Sequence
  Poly(U)-binding-splicing factor PUF60 (123-131)
ggcgaggacaccaucagacaggccuuc

SEQ ID NO: 63502 - RNA, 30 nt, Artificial Sequence
  Glutamine-tRNA ligase (351-360)
ggcgaggaacugaaggggcacaacacccuc

SEQ ID NO: 63503 - RNA, 27 nt, Artificial Sequence
  DNA damage-binding protein 1 (783-791)
ggcgaggaaguggagguccacaaccug

SEQ ID NO: 63504 - RNA, 30 nt, Artificial Sequence
  RNA-binding protein 8A (81-90)
ggcgagaucaagaacauucaccugaaucuc

SEQ ID NO: 63505 - RNA, 33 nt, Artificial Sequence
  Supervillin (797-807)
ggcgagaucaagacccccacaggggaaggacug

SEQ ID NO: 63506 - RNA, 27 nt, Artificial Sequence
  Hsc70-interacting protein (128-136)
ggcgagcugcagaaggccaucgaccuc

SEQ ID NO: 63507 - RNA, 27 nt, Artificial Sequence
  Antigen peptide transporter 2 (87-95)
ggcgagcugacccaggggagccuccuu

SEQ ID NO: 63508 - RNA, 30 nt, Artificial Sequence
  Cytoplasmic dynein 1 heavy chain 1 (2173-2182)
ggcgagaugaccgcccugagagaagagcuc

SEQ ID NO: 63509 - RNA, 30 nt, Artificial Sequence
  Ras-related protein Rab-5A (27-36)
ggcgagagcgccguggggaaguccucucug

SEQ ID NO: 63510 - RNA, 33 nt, Artificial Sequence
  U4/U6 small nuclear ribonucleoprotein Prp4 (45-55)
ggcgagagcgggauccugggaaaggacggucuc

SEQ ID NO: 63511 - RNA, 27 nt, Artificial Sequence
  tRNA wybutosine-synthesizing protein 2 homolog (54-62)
ggcgagacccugcccgaacagcaccuc

SEQ ID NO: 63512 - RNA, 27 nt, Artificial Sequence
  Nuclear protein localization protein 4 homolog (480-488)
ggcgagacccaggacuuccacagccug

SEQ ID NO: 63513 - RNA, 27 nt, Artificial Sequence
  Eukaryotic translation initiation factor 5A-1 (106-114)
ggcgaggugagagaagaccugaggcuc

SEQ ID NO: 63514 - RNA, 27 nt, Artificial Sequence
  Heterogeneous nuclear ribonucleoprotein H (422-430)
ggcggguacggaggucagagcuccaug

SEQ ID NO: 63515 - RNA, 27 nt, Artificial Sequence
  Class E basic helix-loop-helix protein 41 (81-89)
ggccaccuggagaaggccgugguccuc

SEQ ID NO: 63516 - RNA, 27 nt, Artificial Sequence
  Guanine nucleotide-binding protein subunit beta-2-like 1 (13-21)
ggccacaacgggugggugacccagauc

SEQ ID NO: 63517 - RNA, 27 nt, Artificial Sequence
  Oxysterol-binding protein-related protein 9 (262-270)
ggccacagccccccuuccucuucacug

SEQ ID NO: 63518 - RNA, 27 nt, Artificial Sequence
  DNA replication licensing factor MCM6 (508-516)
ggccacuacgacagaagcaagucccug

SEQ ID NO: 63519 - RNA, 33 nt, Artificial Sequence
  40S ribosomal protein S15 (113-123)
ggccacuaccugggggaguucagcaucaccuau

SEQ ID NO: 63520 - RNA, 27 nt, Artificial Sequence
  Coatomer subunit alpha (731-739)
ggccacuaccagaacgcccuguaucuc

SEQ ID NO: 63521 - RNA, 27 nt, Artificial Sequence
  Poly(rC)-binding protein 1 (259-267)
ggcaucgacagcuccucucccgaggug

SEQ ID NO: 63522 - RNA, 27 nt, Artificial Sequence
  Mitogen-activated protein kinase kinase kinase 6 (197-205)
ggccuggccgacgggcucgugcaggcu

SEQ ID NO: 63523 - RNA, 27 nt, Artificial Sequence
  Multiple PDZ domain protein (814-822)
ggccuggccgacaagccccucuucaga

SEQ ID NO: 63524 - RNA, 27 nt, Artificial Sequence
  Ras GTPase-activating-like protein IQGAP3 (153-161)
ggccuggccccccagauccacgaccuc

SEQ ID NO: 63525 - RNA, 27 nt, Artificial Sequence
  26S protease regulatory subunit 8 (27-35)
ggccuggacaagcagaucaaagagauu

SEQ ID NO: 63526 - RNA, 27 nt, Artificial Sequence
  Nuclear autoantigenic sperm protein (409-417)
ggccuggaggaaaaggugagagccaaa

SEQ ID NO: 63527 - RNA, 27 nt, Artificial Sequence
  Nuclear pore complex protein Nup98-Nup96 (50-58)
ggccuguucgggaacagccagaccaag

SEQ ID NO: 63528 - RNA, 27 nt, Artificial Sequence
  Box C/D snoRNA protein 1 (14-22)
ggccugcacagcguggccgaggggguc

SEQ ID NO: 63529 - RNA, 27 nt, Artificial Sequence
  60S ribosomal protein L11 (85-93)
ggccugaaggugagagaguacgaacuc

SEQ ID NO: 63530 - RNA, 27 nt, Artificial Sequence
  Kinesin-like protein KIF3A (576-584)
ggccugcucgagaacaucagacagcuu

SEQ ID NO: 63531 - RNA, 33 nt, Artificial Sequence
  Mitochondrial import inner membrane translocase subunit TIM50 (78-88)
ggccugcucggggccggagguaccgugagcguc

SEQ ID NO: 63532 - RNA, 27 nt, Artificial Sequence
  C-terminal-binding protein 1 (238-246)
ggccugaacgagcacaaucaucaccuc

SEQ ID NO: 63533 - RNA, 30 nt, Artificial Sequence; identical to SEQ ID NO: 39306
  Acyl-CoA synthetase family member 4 (721-730)

SEQ ID NO: 63534 - RNA, 27 nt, Artificial Sequence
  Fos-related antigen 2 (165-173)
ggccugcagaaggagaucgccgaacuc

SEQ ID NO: 63535 - RNA, 27 nt, Artificial Sequence
  Mitofusin-1 (547-555)
ggccugagcgagcccaucuuccagcuc

SEQ ID NO: 63536 - RNA, 27 nt, Artificial Sequence
  Serine/threonine-protein phosphatase 2B catalytic subunit beta isoform (228-236)
ggccugagccccgagauccacacccuc

SEQ ID NO: 63537 - RNA, 27 nt, Artificial Sequence
  Neurofibromin (37-45)
ggccugaccacaauccucaagaacgug

SEQ ID NO: 63538 - RNA, 27 nt, Artificial Sequence
  Retinoic acid receptor gamma (203-211)
ggccugugggacaaguucagcgagcuc

SEQ ID NO: 63539 - RNA, 27 nt, Artificial Sequence
  Uncharacterized protein C17orf85 (252-260)
ggccuguacgccgacaccagagagaag

SEQ ID NO: 63540 - RNA, 24 nt, Artificial Sequence
  Very-long-chain (3R)-3-hydroxyacyl-CoA dehydratase 1 (106-113)
ggccuguacaagagcauccagaaa

SEQ ID NO: 63541 - RNA, 27 nt, Artificial Sequence
  Tripartite motif-containing protein 65 (17-25)
ggccuguaccaggaccccgugacccuc

SEQ ID NO: 63542 - RNA, 30 nt, Artificial Sequence
  Thioredoxin reductase 1, cytoplasmic (282-291)
ggccaguucaucgggccccacagaauuaag

SEQ ID NO: 63543 - RNA, 27 nt, Artificial Sequence
  Cdc42 effector protein 3 (76-84)
ggccaguuccccgggcacaacgaguuu

SEQ ID NO: 63544 - RNA, 27 nt, Artificial Sequence
  Regulator of chromosome condensation (439-447)
ggccagcacaccgugcugcucgucaag

SEQ ID NO: 63545 - RNA, 27 nt, Artificial Sequence
  Chromodomain-helicase-DNA-binding protein 4 (1164-1172)
ggccagaacaagaaagugaugaucuac

SEQ ID NO: 63546 - RNA, 39 nt, Artificial Sequence
  EH domain-containing protein 2 (65-77)
ggccaguacagcaccgggaagacauccuucauccaauau

SEQ ID NO: 63547 - RNA, 33 nt, Artificial Sequence
  Heterogeneous nuclear ribonucleoprotein H (256-266)
ggcagcgacagauucgggagggaucugaacuac

SEQ ID NO: 63548 - RNA, 27 nt, Artificial Sequence
  Mitochondrial import inner membrane translocase subunit TIM50 (62-70)
ggcagcgaggggcccuccuacgccaag

SEQ ID NO: 63549 - RNA, 33 nt, Artificial Sequence
  Ribonucleoside-diphosphate reductase subunit M2 (238-248)
ggcagcuucgccuccaucuuuuggcugaagaaa

SEQ ID NO: 63550 - RNA, 27 nt, Artificial Sequence
  HLA class I histocompatibility antigen, A-2 alpha chain (25-33)
ggcagccacuccaugagauacuucuuu

SEQ ID NO: 63551 - RNA, 30 nt, Artificial Sequence
  HLA class I histocompatibility antigen, A-1 alpha chain (25-34)
ggcagccacuccaugagauacuucuuuacc

SEQ ID NO: 63552 - RNA, 27 nt, Artificial Sequence
  HLA class I histocompatibility antigen, Cw-4 alpha chain (25-33)
ggcagccacuccaugagauacuucucu

SEQ ID NO: 63553 - RNA, 27 nt, Artificial Sequence
  60S ribosomal protein L37 (23-31)
ggcagcaaggccuaccaccugcagaaa

SEQ ID NO: 63554 - RNA, 33 nt, Artificial Sequence
  Protein PRR14L (865-875)
ggcagccugcccggggacaagaucagaaacaaa

SEQ ID NO: 63555 - RNA, 30 nt, Artificial Sequence
  Smoothelin (449-458)
ggcaccgccgagcccgggggaagcaugaag

SEQ ID NO: 63556 - RNA, 33 nt, Artificial Sequence
  Embryonic stem cell-specific 5-hydroxymethylcytosine-binding protein (329-339)
ggcaccgccgggcugcucgagcaguggcuuaag

SEQ ID NO: 63557 - RNA, 33 nt, Artificial Sequence
  Glutamine-rich protein 1 (209-219)
ggcaccgccagcgugcugcagcccgucaagaaa

SEQ ID NO: 63558 - RNA, 30 nt, Artificial Sequence
  Sphingosine-1-phosphate phosphatase 1 (135-144)
ggcaccgagcuggggaacgaacucuucuac

SEQ ID NO: 63559 - RNA, 33 nt, Artificial Sequence
  WD repeat-containing protein 92 (479-489)
ggcaccuucggggccacaagccugcagcaaaga

SEQ ID NO: 63560 - RNA, 33 nt, Artificial Sequence
  Cactin isoform X2  (208-218)
ggcaccuucaucuggaacaaggcccuggagaaa

SEQ ID NO: 63561 - RNA, 33 nt, Artificial Sequence
  Unconventional myosin-IXa (2491-2501)
ggcaccuucaaccccgagaaggggaaacagaag

SEQ ID NO: 63562 - RNA, 27 nt, Artificial Sequence
  Biogenesis of lysosome-related organelles complex 1 subunit 4 (164-172)
ggcaccuuccccagagccuuuaagaaa

SEQ ID NO: 63563 - RNA, 30 nt, Artificial Sequence
  Actin-like protein 6A (362-371)
ggcaccuuccagcaaauguggaucagcaag

SEQ ID NO: 63564 - RNA, 33 nt, Artificial Sequence
  Neurobeachin-like protein 1 (754-764)
ggcaccaucgagaagagcaaacugauuacaaag

SEQ ID NO: 63565 - RNA, 27 nt, Artificial Sequence
  Isoleucine-tRNA ligase, cytoplasmic (62-70)
ggcaccaucaaggacauugugacaaga

SEQ ID NO: 63566 - RNA, 36 nt, Artificial Sequence
  Histone H2B type 1-K (115-126)
ggcaccaaggccgugacaaaauacacuagcgcuaag

SEQ ID NO: 63567 - RNA, 30 nt, Artificial Sequence
  Integrator complex subunit 5 (378-387)
ggcacccugcagcccccuuucacagccaga

SEQ ID NO: 63568 - RNA, 27 nt, Artificial Sequence
  Phosphomannomutase 1 (22-30)
ggcacccugacacccgccagacagaag

SEQ ID NO: 63569 - RNA, 33 nt, Artificial Sequence
  Probable phospholipid-transporting ATPase IIA (238-248)
ggcacccugacacagaacgagaugaucuucaag

SEQ ID NO: 63570 - RNA, 27 nt, Artificial Sequence
  Thioredoxin domain-containing protein 9 (203-211)
ggcaccaacuucacaaagcuggagaaa

SEQ ID NO: 63571 - RNA, 27 nt, Artificial Sequence
  Rho guanine nucleotide exchange factor 17 (1361-1369)
ggcacccaggggagccccaucacaaag

SEQ ID NO: 63572 - RNA, 30 nt, Artificial Sequence
  Inter-alpha-trypsin inhibitor heavy chain H5 (656-665)
ggcacccagcccgggccucugcucaagaaa

SEQ ID NO: 63573 - RNA, 36 nt, Artificial Sequence
  Sorting nexin-1 (275-286)
ggcacccagacacugagcggggccggacuccuuaag

SEQ ID NO: 63574 - RNA, 39 nt, Artificial Sequence
  HCLS1-binding protein 3 (136-148)
ggcaccagaagccccggggccgcuggacugacauccagg

SEQ ID NO: 63575 - RNA, 27 nt, Artificial Sequence
  Bardet-Biedl syndrome 10 protein (375-383)
ggcaccagcucccuguucaucuacaag

SEQ ID NO: 63576 - RNA, 27 nt, Artificial Sequence
  Proteasome subunit beta type-7 (229-237)
ggcaccacagccgugcugacugagaag

SEQ ID NO: 63577 - RNA, 30 nt, Artificial Sequence
  E3 ubiquitin-protein ligase CBL (49-58)
ggcaccguggacaagaaaauggucgagaag

SEQ ID NO: 63578 - RNA, 27 nt, Artificial Sequence
  E3 SUMO-protein ligase PIAS1 (411-419)
ggcaccugggcccccaugagaagcaag

SEQ ID NO: 63579 - RNA, 27 nt, Artificial Sequence
  Rho-associated protein kinase 2 (301-309)
ggcaccuacagcaagaucauggaccac

SEQ ID NO: 63580 - RNA, 27 nt, Artificial Sequence
  40S ribosomal protein S16 (64-72)
ggcguggacaucagagucaggguuaag

SEQ ID NO: 63581 - RNA, 30 nt, Artificial Sequence
  Phosphoribosyl pyrophosphate synthase-associated protein 1 (94-103)
ggcgugauccccuacuucccuuauagcaag

SEQ ID NO: 63582 - RNA, 27 nt, Artificial Sequence
  Tenascin (23-31)
ggcgugcugaagaaagucaucagacac

SEQ ID NO: 63583 - RNA, 27 nt, Artificial Sequence
  Sterol regulatory element-binding protein 2 (852-860)
ggcgugaugagccccccucuguccaga

SEQ ID NO: 63584 - RNA, 30 nt, Artificial Sequence
  NADH dehydrogenase (ubiquinone) iron-sulfur protein 6, mitochondrial (29-38)
ggcgugagagucagccccaccggggagaag

SEQ ID NO: 63585 - RNA, 27 nt, Artificial Sequence
  Double-strand-break repair protein rad21 homolog (62-70)
ggcguggucagaaucuaccacaggaag

SEQ ID NO: 63586 - RNA, 24 nt, Artificial Sequence
  Melanoma-associated antigen B2 (231-238)
ggcguguacgacggggaggaacac

SEQ ID NO: 63587 - RNA, 27 nt, Artificial Sequence
  RNA-binding motif, single-stranded-interacting protein 2 (399-407)
ggcguguacagcuuccaguuuaacaag

SEQ ID NO: 63588 - RNA, 27 nt, Artificial Sequence
  Glutathione synthetase (158-166)
ggcuacaugcccagacaguauagccug

SEQ ID NO: 63589 - RNA, 27 nt, Artificial Sequence
  Far upstream element-binding protein 3 (340-348)
cacgccgcucauaucauuagcgagcug

SEQ ID NO: 63590 - RNA, 27 nt, Artificial Sequence
  Ectonucleoside triphosphate diphosphohydrolase 4 (473-481)
cacgccgaccugcauagacucaaguac

SEQ ID NO: 63591 - RNA, 27 nt, Artificial Sequence
  V-type proton ATPase subunit B, brain isoform (310-318)
cacgccgacgugagcaaccagcuguac

SEQ ID NO: 63592 - RNA, 27 nt, Artificial Sequence
  BRCA1-A complex subunit BRE (227-235)
cacgcccugggcgggagcuccgcucuc

SEQ ID NO: 63593 - RNA, 24 nt, Artificial Sequence
  Dolichyl-diphosphooligosaccharide-proteinosyltransferase 48 kDa subunit (235-242)
cacgccgugggcaagaacacccug

SEQ ID NO: 63594 - RNA, 27 nt, Artificial Sequence
  Perilipin-3 (249-257)
cacgccuacgagcauagccugggcaag

SEQ ID NO: 63595 - RNA, 27 nt, Artificial Sequence
  TBC1 domain family member 14 (206-214)
cacgaggccgaagagggcagcaagcug

SEQ ID NO: 63596 - RNA, 33 nt, Artificial Sequence
  DNA-directed RNA polymerases I and III subunit RPAC2 (45-55)
cacgaggaagaccauacccugggcaacagccuc

SEQ ID NO: 63597 - RNA, 30 nt, Artificial Sequence
  Exosome complex exonuclease RRP44 (679-688)
cacgaggaauucagcgagcaugcccugcuc

SEQ ID NO: 63598 - RNA, 27 nt, Artificial Sequence
  THO complex subunit 5 homolog (154-162)
cacgaggaaaucgaccuggugagccuc

SEQ ID NO: 63599 - RNA, 27 nt, Artificial Sequence
  Tuftelin-interacting protein 11 (365-373)
cacgaggaaagagugaucagcaaccug

SEQ ID NO: 63600 - RNA, 27 nt, Artificial Sequence
  X-linked retinitis pigmentosa GTPase regulator (637-645)
cacgaguucagcaagaccgaagagcug

SEQ ID NO: 63601 - RNA, 27 nt, Artificial Sequence
  GON-4-like protein (1051-1059)
cacgagggcgggcccgacagcaagcug

SEQ ID NO: 63602 - RNA, 27 nt, Artificial Sequence
  AP-3 complex subunit delta-1 (103-111)
cacgagggcaccgacgugaucaugcug

SEQ ID NO: 63603 - RNA, 27 nt, Artificial Sequence
  Gem-associated protein 5 (588-596)
cacgagcauggcagccagcccgaacug

SEQ ID NO: 63604 - RNA, 27 nt, Artificial Sequence
  Zinc finger protein 644 (930-938)
cacgagauccaugacccccagcaccug

SEQ ID NO: 63605 - RNA, 27 nt, Artificial Sequence
  Glycerol-3-phosphate dehydrogenase, mitochondrial (539-547)
cacgagauccugaacgaaguggaccuc

SEQ ID NO: 63606 - RNA, 27 nt, Artificial Sequence
  Eukaryotic translation initiation factor 3 subunit I (165-173)
cacgagagcggcgaacugaaccaguac

SEQ ID NO: 63607 - RNA, 27 nt, Artificial Sequence
  Insulin-like growth factor 2 mRNA-binding protein 2 (301-309)
cacgagaccggcacaaagaucacuauu

SEQ ID NO: 63608 - RNA, 27 nt, Artificial Sequence
  Inositol-trisphosphate 3-kinase B (874-882)
cacgaggugaucggcagcucccugcuc

SEQ ID NO: 63609 - RNA, 27 nt, Artificial Sequence
  Trabeculin-alpha (2620-2628)
cacgaggugaaggaagcccagacccug

SEQ ID NO: 63610 - RNA, 30 nt, Artificial Sequence
  Translocation protein SEC62 (284-293)
cacgaguacaagggccccaaagccgaccug

SEQ ID NO: 63611 - RNA, 24 nt, Artificial Sequence
  Bifunctional glutamate/proline-tRNA ligase (272-279)
cacuucgagaccaucaugaaguac

SEQ ID NO: 63612 - RNA, 27 nt, Artificial Sequence
  PTB domain-containing engulfment adapter protein 1 (23-31)
cacuucauccccuacaacgccaaguuu

SEQ ID NO: 63613 - RNA, 27 nt, Artificial Sequence
  Squalene synthase (268-276)
caccauauccccgacgugauuaccuac

SEQ ID NO: 63614 - RNA, 27 nt, Artificial Sequence
  CD109 antigen (1425-1433)
caccauagcuccgugaucuucauuuuu

SEQ ID NO: 63615 - RNA, 27 nt, Artificial Sequence
  Protein Churchill (92-100)
caccaugugaucgccagacacgaguac

SEQ ID NO: 63616 - RNA, 27 nt, Artificial Sequence
  SUN domain-containing protein 1 (591-599)
caccaugugagcgucaccaagcagcug

SEQ ID NO: 63617 - RNA, 27 nt, Artificial Sequence
  Huntingtin (895-903)
caccauuacaccggccugcucaagcuu

SEQ ID NO: 63618 - RNA, 33 nt, Artificial Sequence
  DNA-directed RNA polymerase III subunit RPC1 (122-132)
cacaucgacgagcagagcggcaaggaaaaauac

SEQ ID NO: 63619 - RNA, 36 nt, Artificial Sequence
  GPI transamidase component PIG-T (548-559)
cacaucgaggaacccagaaccggcgggcuggccaag

SEQ ID NO: 63620 - RNA, 27 nt, Artificial Sequence
  Peroxisomal acyl-coenzyme A oxidase 1 (21-29)
cacauccuggacggcagccccgagaag

SEQ ID NO: 63621 - RNA, 33 nt, Artificial Sequence; identical to SEQ ID NO: 39394
  Kinesin-like protein KIF20B (82-92)

SEQ ID NO: 63622 - RNA, 30 nt, Artificial Sequence
  Protein polybromo-1 (618-627)
cacauccuggagaagcuccuuaaagaaaag

SEQ ID NO: 63623 - RNA, 27 nt, Artificial Sequence
  ADNP homeobox protein 2 (899-907)
cacaucaugcccaccgugcauacaguc

SEQ ID NO: 63624 - RNA, 27 nt, Artificial Sequence
  Cytoskeleton-associated protein 5 (447-455)
cacaucaacgacagcgcccccgaggug

SEQ ID NO: 63625 - RNA, 30 nt, Artificial Sequence
  Tumor suppressor candidate 3 (250-259)
cacaucagaggccccccuuacgcccauaag

SEQ ID NO: 63626 - RNA, 27 nt, Artificial Sequence
  E3 ubiquitin-protein ligase pellino homolog 3 (110-118)
cacaucagcaccccccugguguccaag

SEQ ID NO: 63627 - RNA, 27 nt, Artificial Sequence
  Death-associated protein kinase 3 (166-174)
cacaagaucgaggccggcaacgaauuc

SEQ ID NO: 63628 - RNA, 27 nt, Artificial Sequence
  Alpha-actinin-4 (413-421)
caccuggccgagaaguucagacagaaa

SEQ ID NO: 63629 - RNA, 27 nt, Artificial Sequence
  Synembryn-A (382-390)
caccuggacaccgaugugaagagaguc

SEQ ID NO: 63630 - RNA, 27 nt, Artificial Sequence
  CAD protein (188-196)
caccuguucaacguggcccauacccuc

SEQ ID NO: 63631 - RNA, 30 nt, Artificial Sequence
  AP-5 complex subunit zeta-1 (1130-1139)
caccuguucagcggccaucucuccacccuu

SEQ ID NO: 63632 - RNA, 30 nt, Artificial Sequence
  Proteasome inhibitor PI31 subunit (116-125)
caccugggcgacuuccauagaaccuacaag

SEQ ID NO: 63633 - RNA, 27 nt, Artificial Sequence
  Cytoplasmic FMR1-interacting protein 1 (638-646)
caccugaucaacuucagcgagacccuc

SEQ ID NO: 63634 - RNA, 33 nt, Artificial Sequence
  Centromere protein H (132-142)
caccugcucgagcuuaacaagcugaucaugaaa

SEQ ID NO: 63635 - RNA, 27 nt, Artificial Sequence
  Solute carrier family 35 member C2 (289-297)
caccugcucggcgaccagaucagccuu

SEQ ID NO: 63636 - RNA, 27 nt, Artificial Sequence
  Rotatin (987-995)
caccugcccgugcaugucaucggccac

SEQ ID NO: 63637 - RNA, 27 nt, Artificial Sequence
  SAP30-binding protein (125-133)
caccugcaggacaagauccaaaaacuc

SEQ ID NO: 63638 - RNA, 33 nt, Artificial Sequence
  Collagen alpha-1(XV) chain (1257-1267)
caccugcaggaccucagcaccaucgugagaaag

SEQ ID NO: 63639 - RNA, 27 nt, Artificial Sequence
  Small integral membrane protein 17 (92-100)
caccugaccaucaugguggccgucguu

SEQ ID NO: 63640 - RNA, 30 nt, Artificial Sequence
  Dysbindin (37-46)
caccugguggagaagcagcucaucagcaaa

SEQ ID NO: 63641 - RNA, 27 nt, Artificial Sequence
  Zinc finger and BTB domain-containing protein 7B (252-260)
caccuggugcccgaggucccuaccguu

SEQ ID NO: 63642 - RNA, 30 nt, Artificial Sequence
  Ubinuclein-1 (86-95)
caccuguacgagcagggcgggagacucaag

SEQ ID NO: 63643 - RNA, 30 nt, Artificial Sequence
  Fructosamine-3-kinase (111-120)
caccuguacaaccagaagcucagagagaaa

SEQ ID NO: 63644 - RNA, 30 nt, Artificial Sequence
  Cysteine-tRNA ligase, cytoplasmic (30-39)
caccuguacaacagccucaccagaaauaag

SEQ ID NO: 63645 - RNA, 27 nt, Artificial Sequence
  Protein TANC1 (1825-1833)
caccuguaccaggagagcaucuccaag

SEQ ID NO: 63646 - RNA, 27 nt, Artificial Sequence
  Importin-7 (406-414)
cacaugaucggcagccuggccgagauu

SEQ ID NO: 63647 - RNA, 33 nt, Artificial Sequence; identical to SEQ ID NO: 39420
  ATP-dependent RNA helicase DDX18 (255-265)

SEQ ID NO: 63648 - RNA, 27 nt, Artificial Sequence
  Proline-rich protein 11 (150-158)
cacaugagcggcaagcugaccaacgug

SEQ ID NO: 63649 - RNA, 27 nt, Artificial Sequence
  Protein CutA (98-106)
caccccuacgagguggccgaagucauc

SEQ ID NO: 63650 - RNA, 27 nt, Artificial Sequence
  Cyclic AMP-dependent transcription factor ATF-6 beta (691-699)
caccaggccagccaucaaccccuguac

SEQ ID NO: 63651 - RNA, 27 nt, Artificial Sequence
  NUAK family SNF1-like kinase 2 (201-209)
caccagggcaaguuccugcaaaccuuu

SEQ ID NO: 63652 - RNA, 27 nt, Artificial Sequence
  Golgi resident protein GCP60 (496-504)
caccaguaccccggcagagggguguau

SEQ ID NO: 63653 - RNA, 27 nt, Artificial Sequence
  Major prion protein (148-156)
cacagauaccccaaccagguguauuac

SEQ ID NO: 63654 - RNA, 27 nt, Artificial Sequence
  STAGA complex 65 subunit gamma (129-137)
cacagcgaccccgaguccgauuucuac

SEQ ID NO: 63655 - RNA, 27 nt, Artificial Sequence
  Histone-lysine N-methyltransferase NSD3 (877-885)
cacagcgaccccauguucuccucuuac

SEQ ID NO: 63656 - RNA, 30 nt, Artificial Sequence
  Protein FAM135A (1394-1403)
cacagcgaccccagacagaccuuccuguac

SEQ ID NO: 63657 - RNA, 27 nt, Artificial Sequence
  PERQ amino acid-rich with GYF domain-containing protein 1 (731-739)
cacagcgaccccuccauccugggcuac

SEQ ID NO: 63658 - RNA, 27 nt, Artificial Sequence
  NAD(P)H dehydrogenase (quinone) 1 (9-17)
cacagcgagagaaccuccuucaacuac

SEQ ID NO: 63659 - RNA, 33 nt, Artificial Sequence
  Heterogeneous nuclear ribonucleoproteins A2/B1 (72-82)
cacagcaucgacggcagaguggucgagcccaag

SEQ ID NO: 63660 - RNA, 30 nt, Artificial Sequence
  Rho-related BTB domain-containing protein 3 (176-185)
cacagccuggacgauuucuacaucggcaag

SEQ ID NO: 63661 - RNA, 27 nt, Artificial Sequence
  Cytochrome c1, heme protein, mitochondrial (27-35)
cacagcauggacuucguggccuacaga

SEQ ID NO: 63662 - RNA, 27 nt, Artificial Sequence
  FUN14 domain-containing protein 1 (39-47)
cacagcuccggccccaugguggagaag

SEQ ID NO: 63663 - RNA, 27 nt, Artificial Sequence
  Isocitrate dehydrogenase (NAD) subunit gamma, mitochondrial (342-350)
cacagcuacgccaccuccaucagaaag

SEQ ID NO: 63664 - RNA, 27 nt, Artificial Sequence
  KAT8 regulatory NSL complex subunit 1 (802-810)
cacaccgacaugagcuccucuucauac

SEQ ID NO: 63665 - RNA, 30 nt, Artificial Sequence
  Histone-lysine N-methyltransferase SETD1A (230-239)
cacaccaucacaaaccugacuacgcccaag

SEQ ID NO: 63666 - RNA, 33 nt, Artificial Sequence
  DNA damage-binding protein 2 (96-106)
cacacccuggacagcuacagaauccuccagaag

SEQ ID NO: 63667 - RNA, 27 nt, Artificial Sequence
  Transmembraneoprotein NMB (178-186)
cacacccugggccaguacuuccaaaag

SEQ ID NO: 63668 - RNA, 27 nt, Artificial Sequence
  Necdin (95-103)
cacaccauggaguucgcccuggugaag

SEQ ID NO: 63669 - RNA, 27 nt, Artificial Sequence
  Integrin beta-5 (781-789)
cacaccguggacuucacauuuaacaag

SEQ ID NO: 63670 - RNA, 27 nt, Artificial Sequence
  Histone-lysine N-methyltransferase 2A (25-33)
cacguggaccaggaucugaccacauac

SEQ ID NO: 63671 - RNA, 27 nt, Artificial Sequence
  Adapter protein CIKS (72-80)
cacguguacagcuggcccaagaacaaa

SEQ ID NO: 63672 - RNA, 27 nt, Artificial Sequence
  KN motif and ankyrin repeat domain-containing protein 1 (825-833)
cacuacaucgagagaauucagaagcug

SEQ ID NO: 63673 - RNA, 27 nt, Artificial Sequence
  Astrotactin-2 (291-299)
cacuacaacagccauuaugagaaguuc

SEQ ID NO: 63674 - RNA, 27 nt, Artificial Sequence
  Tensin-1 (1660-1668)
cacuacccccugaacaccgugacauuc

SEQ ID NO: 63675 - RNA, 27 nt, Artificial Sequence
  Kelch-like protein 15 (472-480)
cacuacagcgacuccauccugaccuuc

SEQ ID NO: 63676 - RNA, 27 nt, Artificial Sequence
  ATP-dependent RNA helicase DHX36 (726-734)
aucgccgacgcuagaaggaaggagcug

SEQ ID NO: 63677 - RNA, 30 nt, Artificial Sequence; identical to SEQ ID NO: 39450
  Small ubiquitin-related modifier 1 (46-55)

SEQ ID NO: 63678 - RNA, 27 nt, Artificial Sequence
  Sarcoplasmic/endoplasmic reticulum calcium ATPase 1 (718-726)
aucgccaugggcagcgggaccgcugug

SEQ ID NO: 63679 - RNA, 30 nt, Artificial Sequence
  DNA-directed RNA polymerase I subunit RPA1 (1631-1640)
aucgccguggaccccagacaccugagccuc

SEQ ID NO: 63680 - RNA, 27 nt, Artificial Sequence
  Derlin-3 (176-184)
aucgccgugggccacauuuacuauuuc

SEQ ID NO: 63681 - RNA, 33 nt, Artificial Sequence
  CD99 antigen (129-139)
aucgccuaccagaagaaaaagcugugcuucaaa

SEQ ID NO: 63682 - RNA, 27 nt, Artificial Sequence
  Dolichyl-diphosphooligosaccharide-proteinosyltransferase subunit 1 (381-389)
aucgagauugacagccccuacgaaaua

SEQ ID NO: 63683 - RNA, 27 nt, Artificial Sequence
  NEDD8-activating enzyme E1 regulatory subunit (166-174)
aucgagagccaccccgacaacgcccug

SEQ ID NO: 63684 - RNA, 27 nt, Artificial Sequence
  Splicing factor 3A subunit 1 (762-770)
aucuucauuaaggacagcaacucccug

SEQ ID NO: 63685 - RNA, 27 nt, Artificial Sequence
  Retinoic acid receptor RXR-gamma (443-451)
aucggcgacacccccauugauacauuc

SEQ ID NO: 63686 - RNA, 27 nt, Artificial Sequence
  C-myc promoter-binding protein (1082-1090)
aucggcaagcccccucugagaagcaaa

SEQ ID NO: 63687 - RNA, 27 nt, Artificial Sequence
  Serine/threonine-protein kinase tousled-like 2 (421-429)
auccacaacgaggacaauagccaguuc

SEQ ID NO: 63688 - RNA, 27 nt, Artificial Sequence
  Exportin-2 (769-777)
aucauuauacccgagauccagaaggug

SEQ ID NO: 63689 - RNA, 27 nt, Artificial Sequence
  Cytoplasmic dynein 1 heavy chain 1 (201-209)
aucauuaccaaggaccuguuccaggug

SEQ ID NO: 63690 - RNA, 27 nt, Artificial Sequence
  Renin receptor (326-334)
aucauuuacagaaugaccaaccagaag

SEQ ID NO: 63691 - RNA, 39 nt, Artificial Sequence
  Putative heat shock 70 kDa protein 7 (30-42)
auccuggccaacgaccagggcaauagaaccacacccagc

SEQ ID NO: 63692 - RNA, 27 nt, Artificial Sequence
  Very-long-chain enoyl-CoA reductase (8-16)
auccuggacgccaagaccagagagaaa

SEQ ID NO: 63693 - RNA, 33 nt, Artificial Sequence
  Ribosome-binding protein 1 (545-555)
auccuggaggacgaacagacccaaagacagaag

SEQ ID NO: 63694 - RNA, 30 nt, Artificial Sequence
  60S ribosomal protein L19 (118-127)
auccugauggagcacauucauaagcucaaa

SEQ ID NO: 63695 - RNA, 27 nt, Artificial Sequence
  Chromobox protein homolog 6 (175-183)
auccugaaccucaaggugauugacaaa

SEQ ID NO: 63696 - RNA, 30 nt, Artificial Sequence
  A-kinase anchor protein 8-like (468-477)
auccugaacaauaagcucauuagcaaaaag

SEQ ID NO: 63697 - RNA, 36 nt, Artificial Sequence
  Replication factor C subunit 3 (55-66)
auccugagagagcucuacggcgugggggucgaaaag

SEQ ID NO: 63698 - RNA, 33 nt, Artificial Sequence
  Beta-crystallin B2 (110-120)
auccuguacgagaaccccaauuucaccggcaag

SEQ ID NO: 63699 - RNA, 36 nt, Artificial Sequence
  Discoidin, CUB and LCCL domain-containing protein 2 (337-348)
auccuguacagcgacgauggccagaaguggaccgug

SEQ ID NO: 63700 - RNA, 27 nt, Artificial Sequence
  Tight junction protein ZO-1 (1314-1322)
auccccgagccucagaagccacaacug

SEQ ID NO: 63701 - RNA, 27 nt, Artificial Sequence
  Histone H2A.V (85-93)
aucccccacauucauaagagccugaua

SEQ ID NO: 63702 - RNA, 27 nt, Artificial Sequence
  Msx2-interacting protein (466-474)
auccccauuccuacccugccaagcgug

SEQ ID NO: 63703 - RNA, 27 nt, Artificial Sequence
  Histone-lysine N-methyltransferase 2E (370-378)
auccccaagggcaccgagauuacaaua

SEQ ID NO: 63704 - RNA, 27 nt, Artificial Sequence
  E3 ubiquitin-protein ligase UBR4 (92-100)
auccccagaaaccagcugcaaagcgug

SEQ ID NO: 63705 - RNA, 27 nt, Artificial Sequence
  Nucleoporin GLE1 (428-436)
auccccgugagccagauuuccaccaua

SEQ ID NO: 63706 - RNA, 27 nt, Artificial Sequence
  ER membrane protein complex subunit 1 (895-903)
auccccuacagcccugacgugcagauu

SEQ ID NO: 63707 - RNA, 33 nt, Artificial Sequence
  Elongator complex protein 6 (249-259)
auccaggacaagagcguguccuucuuugccaaa

SEQ ID NO: 63708 - RNA, 27 nt, Artificial Sequence
  GPI transamidase component PIG-T (440-448)
auccaguucgagagagcccugcucaag

SEQ ID NO: 63709 - RNA, 30 nt, Artificial Sequence; identical to SEQ ID NO: 39482
  Kelch domain-containing protein 2 (308-317)

SEQ ID NO: 63710 - RNA, 27 nt, Artificial Sequence
  Helicase with zinc finger domain 2 (2172-2180)
auccagggccccccugggaccggaaag

SEQ ID NO: 63711 - RNA, 27 nt, Artificial Sequence
  Large proline-rich protein BAG6 (377-385)
auccagauuaacgugggcaccacaguc

SEQ ID NO: 63712 - RNA, 30 nt, Artificial Sequence
  Focadhesin (263-272)
auccagcugacccaaaugagccuccagcuu

SEQ ID NO: 63713 - RNA, 36 nt, Artificial Sequence
  Beta-2-microglobulin (21-32)
auccagagaacccccaagauucaaguguacagcagg

SEQ ID NO: 63714 - RNA, 30 nt, Artificial Sequence
  26S proteasome non-ATPase regulatory subunit 7 (266-275)
aucagaagcguggucgcccugcacaaccuc

SEQ ID NO: 63715 - RNA, 27 nt, Artificial Sequence
  Kinesin-like protein KIF20B (1684-1692)
aucagcgacgauagaaacuccucugug

SEQ ID NO: 63716 - RNA, 27 nt, Artificial Sequence
  Sperm-specific antigen 2 (226-234)
aucagcgacgaggccaacuccaauuuc

SEQ ID NO: 63717 - RNA, 27 nt, Artificial Sequence
  Lysosome-associated membraneoprotein 2 (66-74)
aucagcgaccacggcaccgugacauac

SEQ ID NO: 63718 - RNA, 27 nt, Artificial Sequence
  Dolichyl-diphosphooligosaccharide-proteinosyltransferase 48 kDa subunit (164-172)
aucagcgaccugggccagcacacccuc

SEQ ID NO: 63719 - RNA, 27 nt, Artificial Sequence
  Dynamin-1-like protein (174-182)
aucagcaaccccaauuccauuauacug

SEQ ID NO: 63720 - RNA, 27 nt, Artificial Sequence
  HEAT repeat-containing protein 1 (915-923)
aucagcucccccguggucaccucucug

SEQ ID NO: 63721 - RNA, 33 nt, Artificial Sequence
  UBAP1-MVB12-associated (UMA)-domain containing protein 1 isoform b (69-79)
aucaccgaccugcccgaucaccuccuuagcuac

SEQ ID NO: 63722 - RNA, 27 nt, Artificial Sequence
  U4/U6.U5 tri-snRNP-associated protein 2 (264-272)
aucaccgagaaggaauacaaaacauau

SEQ ID NO: 63723 - RNA, 30 nt, Artificial Sequence
  T-complex protein 1 subunit delta (70-79)
aucaccaacgacggcgccacaauucugaag

SEQ ID NO: 63724 - RNA, 33 nt, Artificial Sequence
  Cytoplasmic dynein 2 heavy chain 1 (74-84)
aucaccuacgagagccccccuggccugaagaaa

SEQ ID NO: 63725 - RNA, 33 nt, Artificial Sequence
  Isocitrate dehydrogenase (NADP) cytoplasmic (55-65)
aucaccuacacacccagcgacggcacucagaag

SEQ ID NO: 63726 - RNA, 27 nt, Artificial Sequence
  ATP-binding cassette sub-family F member 1 (656-664)
aucgugggccccaacggggucggaaag

SEQ ID NO: 63727 - RNA, 39 nt, Artificial Sequence
  Glia-derived nexin (119-131)
aucgugaccgucgccaacgcuguuuucgugaagaaugca

SEQ ID NO: 63728 - RNA, 30 nt, Artificial Sequence
  Protein enabled homolog (37-46)
aucuaccaccauaccggcaacaauacauuc

SEQ ID NO: 63729 - RNA, 27 nt, Artificial Sequence
  Vacuolar protein sorting-associated protein 13C (1267-1275)
aucuaccaccccgacauucagcugcuc

SEQ ID NO: 63730 - RNA, 27 nt, Artificial Sequence
  Calpain-5 (449-457)
aucuacauuaacagcagauccguguuc

SEQ ID NO: 63731 - RNA, 27 nt, Artificial Sequence
  Cyclin E variant ex7del (19-27)
aucuaccccccuaagcugcaccaguuc

SEQ ID NO: 63732 - RNA, 27 nt, Artificial Sequence
  BTB/POZ domain-containing protein 10 (83-91)
aucuacagcaccaagcuguauagauuc

SEQ ID NO: 63733 - RNA, 30 nt, Artificial Sequence
  Beta-soluble NSF attachment protein (71-80)
aucuacaccgacaugggcagauucacaauu

SEQ ID NO: 63734 - RNA, 27 nt, Artificial Sequence
  WD repeat-containing protein 1 (53-61)
aucuacaccgagcacgcccaucaggug

SEQ ID NO: 63735 - RNA, 27 nt, Artificial Sequence
  SMC5-SMC6 complex localization factor protein 2 (149-157)
aucuacgugcccagcuccuaucaccug

SEQ ID NO: 63736 - RNA, 33 nt, Artificial Sequence
  WW domain-binding protein 2 (229-239)
aaggccgcugaggcagccgcgagcgcuuacuau

SEQ ID NO: 63737 - RNA, 27 nt, Artificial Sequence
  40S ribosomal protein S17 (11-19)
aaggccgcuagagugaucauugagaaa

SEQ ID NO: 63738 - RNA, 27 nt, Artificial Sequence
  F-box/WD repeat-containing protein 8 (325-333)
aaggccgaggacagcgcuagaacccug

SEQ ID NO: 63739 - RNA, 36 nt, Artificial Sequence
  Vacuolar fusion protein CCZ1 homolog (154-165)
aaggccauggaggacggcggggugaaacugcucaag

SEQ ID NO: 63740 - RNA, 27 nt, Artificial Sequence
  Ceramide synthase 2 (35-43)
aaggccagcgaccuguacaucacccuc

SEQ ID NO: 63741 - RNA, 27 nt, Artificial Sequence
  Vacuolar protein sorting-associated protein 11 homolog (811-819)
aaggccagccccaaaaucuuccagaag

SEQ ID NO: 63742 - RNA, 27 nt, Artificial Sequence
  60S ribosomal protein L4 (175-183)
aaggccuggaacgacaucaaaaaggug

SEQ ID NO: 63743 - RNA, 33 nt, Artificial Sequence
  Replication protein A 70 kDa DNA-binding subunit (157-167)
aaggccuacggcgcuagcaaaaccuucgggaag

SEQ ID NO: 63744 - RNA, 36 nt, Artificial Sequence
  NHP2-like protein 1 (9-20)
aaggccuacccccuggcugacgcacaccucaccaaa

SEQ ID NO: 63745 - RNA, 27 nt, Artificial Sequence
  WD repeat-containing protein WRAP73 (276-284)
aaggaggccgaaaaaagcccccagcug

SEQ ID NO: 63746 - RNA, 30 nt, Artificial Sequence
  Kinesin-like protein KIF20A (425-434)
aaggaggccggcaacaucaauaccagccug

SEQ ID NO: 63747 - RNA, 30 nt, Artificial Sequence
  Golgin subfamily B member 1 (533-542)
aaggaggcccaggaagagaucgcuuuccug

SEQ ID NO: 63748 - RNA, 30 nt, Artificial Sequence
  Transmembrane protein 165 (82-91)
aaggaggaccccgccacccagacaaaccug

SEQ ID NO: 63749 - RNA, 27 nt, Artificial Sequence
  Zinc finger protein AEBP2 (439-447)
aaggaggacagcggcaaaaucaagcug

SEQ ID NO: 63750 - RNA, 27 nt, Artificial Sequence
  Charged multivesicular body protein 4a (192-200)
aaggaggaagagcccagcgugaaacug

SEQ ID NO: 63751 - RNA, 27 nt, Artificial Sequence
  E3 ubiquitin-protein ligase makorin-1 (351-359)
aaggaggaaaaacagaagcugauccuc

SEQ ID NO: 63752 - RNA, 27 nt, Artificial Sequence
  DNA topoisomerase I, mitochondrial (544-552)
aaggaggaaaacaaacagguggcccug

SEQ ID NO: 63753 - RNA, 33 nt, Artificial Sequence
  DNA damage-binding protein 1 (287-297)
aaggaggaacagauggacggcaccgugacacug

SEQ ID NO: 63754 - RNA, 30 nt, Artificial Sequence
  TATA element modulatory factor (490-499)
aaggaggaaagcuccucuaucucaagucug

SEQ ID NO: 63755 - RNA, 27 nt, Artificial Sequence
  Transcriptional adapter 3 (372-380)
aaggaggaagugagcagacaggagcug

SEQ ID NO: 63756 - RNA, 27 nt, Artificial Sequence
  Peptidyl-prolyl cis-trans isomerase-like 2 (4-12)
aaggaguucaaaggcgacgaaauccug

SEQ ID NO: 63757 - RNA, 30 nt, Artificial Sequence
  Protein transport protein Sec31A (436-445)
aaggaguuccugagcagauccgaccagcuc

SEQ ID NO: 63758 - RNA, 27 nt, Artificial Sequence
  Heterogeneous nuclear ribonucleoprotein Q (66-74)
aaggaguucaacgaagacggcgcccug

SEQ ID NO: 63759 - RNA, 27 nt, Artificial Sequence
  CUGBP Elav-like family member 2 (417-425)
aaggagggccccgaaggggccaaccug

SEQ ID NO: 63760 - RNA, 27 nt, Artificial Sequence
  Nuclear nucleic acid-binding protein C1D (79-87)
aaggagcaccccgugaaacaggaacug

SEQ ID NO: 63761 - RNA, 30 nt, Artificial Sequence
  Trafficking kinesin-binding protein 2 (299-308)
aaggagcacgugaucgaaaaagaggaacug

SEQ ID NO: 63762 - RNA, 33 nt, Artificial Sequence
  HEAT repeat-containing protein 1 (449-459)
aaggagaucgccgaccugaaaaagcaggaacuc

SEQ ID NO: 63763 - RNA, 30 nt, Artificial Sequence
  Serine palmitoyltransferase 2 (526-535)
aaggagaucgacgaagugggcgaucugcuc

SEQ ID NO: 63764 - RNA, 30 nt, Artificial Sequence
  (Pyruvate dehydrogenase (acetyl-transferring)) kinase isozyme 4, mitochondrial (34-43)
aaggagaucgacauucugcccacccagcuc

SEQ ID NO: 63765 - RNA, 33 nt, Artificial Sequence
  Cytochrome b-c1 complex subunit Rieske, mitochondrial (182-192)
aaggagaucgaacaggaggccgcuguggaacug

SEQ ID NO: 63766 - RNA, 33 nt, Artificial Sequence
  40S ribosomal protein S7 (47-57)
aaggagaucgaagugggcgggggaagaaaagcc

SEQ ID NO: 63767 - RNA, 27 nt, Artificial Sequence
  RuvB-like 1 (172-180)
aaggagaucauucaggacgugacccug

SEQ ID NO: 63768 - RNA, 30 nt, Artificial Sequence
  Structural maintenance of chromosomes protein 4 (263-272)
aaggagaucaacgaaaaaagcaauauucug

SEQ ID NO: 63769 - RNA, 30 nt, Artificial Sequence
  Deoxynucleotidyltransferase terminal-interacting protein 2 (311-320)
aaggagaucaacgaaaaaagcucccagcug

SEQ ID NO: 63770 - RNA, 27 nt, Artificial Sequence
  Protein bicaudal D homolog 2 (150-158)
aaggagaucaaccagaauguggaaauu

SEQ ID NO: 63771 - RNA, 27 nt, Artificial Sequence
  Nibrin (635-643)
aaggagaucagcaacaaugacaaacug

SEQ ID NO: 63772 - RNA, 33 nt, Artificial Sequence
  SNW domain-containing protein 1 (141-151)
aaggagaucaccgaaaaaacaagaguggcccug

SEQ ID NO: 63773 - RNA, 27 nt, Artificial Sequence
  Sperm-associated antigen 5 (893-901)
aaggagaaaaccgaacaggagacacug

SEQ ID NO: 63774 - RNA, 30 nt, Artificial Sequence
  Microfibrillar-associated protein 1 (250-259)
aaggagcuggaagagaacaaaagaagccuc

SEQ ID NO: 63775 - RNA, 27 nt, Artificial Sequence
  LYR motif-containing protein 2 (77-85)
aaggagcuggaaaaaacccucgcccuu

SEQ ID NO: 63776 - RNA, 30 nt, Artificial Sequence
  Prefoldin subunit 1 (92-101)
aaggagcuggaacagaaaaagagcuaccuc

SEQ ID NO: 63777 - RNA, 30 nt, Artificial Sequence
  Developmentally-regulated GTP-binding protein 2 (161-170)
aaggagcuggaaagcgugggcaucagacuc

SEQ ID NO: 63778 - RNA, 30 nt, Artificial Sequence
  Ancient ubiquitous protein 1 (250-259)
aaggagcugggccagaccgggacaagacuc

SEQ ID NO: 63779 - RNA, 30 nt, Artificial Sequence; identical to SEQ ID NO: 39552
  U2 small nuclear ribonucleoprotein B'' (57-66)

SEQ ID NO: 63780 - RNA, 30 nt, Artificial Sequence
  TSC22 domain family protein 1 (1011-1020)
aaggagcugaucgaaaaaaacagccagcuc

SEQ ID NO: 63781 - RNA, 30 nt, Artificial Sequence
  Bifunctional 3'-phosphoadenosine 5'-phosphosulfate synthase 1 (235-244)
aaggagcuguacgugcccgaaaacaaacuc

SEQ ID NO: 63782 - RNA, 33 nt, Artificial Sequence
  Polymerase I and transcript release factor (170-180)
aaggagaaccuggaaaaaaccagacacacacuc

SEQ ID NO: 63783 - RNA, 27 nt, Artificial Sequence
  SCY1-like protein 2 (264-272)
aaggagcaggaacaagcccagaaacug

SEQ ID NO: 63784 - RNA, 30 nt, Artificial Sequence
  Corepressor interacting with RBPJ 1 (48-57)
aaggagcaggaaagcuacgacaacagacug

SEQ ID NO: 63785 - RNA, 27 nt, Artificial Sequence
  Kinesin-like protein (323-331)
aaggagcagaucaccauuagccaacug

SEQ ID NO: 63786 - RNA, 30 nt, Artificial Sequence
  Catenin alpha-1 (81-90)
aaggagagccaguuccugaaagaagagcuc

SEQ ID NO: 63787 - RNA, 27 nt, Artificial Sequence
  General transcription factor II-I repeat domain-containing protein 1 (343-351)
aaggagaccgaagacaucaacacacug

SEQ ID NO: 63788 - RNA, 27 nt, Artificial Sequence
  Endothelial PAS domain-containing protein 1 (29-37)
aaggagaccgaaguguucuacgagcug

SEQ ID NO: 63789 - RNA, 33 nt, Artificial Sequence
  Activator of 90 kDa heat shock protein ATPase homolog 1 (136-146)
aaggagaccuuccugacaagccccgaagagcuc

SEQ ID NO: 63790 - RNA, 27 nt, Artificial Sequence
  Double-strand-break repair protein rad21 homolog (364-372)
aaggagaccggcgggguggaaaaacug

SEQ ID NO: 63791 - RNA, 30 nt, Artificial Sequence
  Transcription factor BTF3 (46-55)
aaggagaccaucaugaaccaggaaaaacug

SEQ ID NO: 63792 - RNA, 27 nt, Artificial Sequence
  RNA-binding protein PNO1 (122-130)
aaggagaccaaagacgugagcgcccug

SEQ ID NO: 63793 - RNA, 27 nt, Artificial Sequence
  Spectrin beta chain, non-erythrocytic 1 (832-840)
aaggagguggccgaacugaccagacuc

SEQ ID NO: 63794 - RNA, 30 nt, Artificial Sequence
  Sequestosome-1 (324-333)
aaggagguggaccccagcaccggcgaacug

SEQ ID NO: 63795 - RNA, 30 nt, Artificial Sequence
  Vacuolar protein sorting-associated protein 52 homolog (10-19)
aaggagguggaaagcuuccagcaacugcuc

SEQ ID NO: 63796 - RNA, 30 nt, Artificial Sequence
  Sodium/potassium-transporting ATPase subunit alpha-1 (37-46)
aaggaggugagcauggacgaucacaaacug

SEQ ID NO: 63797 - RNA, 33 nt, Artificial Sequence
  Actin-related protein 5 (555-565)
aaggaguacgaagagaaaggcggggaauaucug

SEQ ID NO: 63798 - RNA, 27 nt, Artificial Sequence
  Erythrocyte band 7 integral membrane protein (58-66)
aaggaguacgaaagagccaucauuuuc

SEQ ID NO: 63799 - RNA, 27 nt, Artificial Sequence
  Son of sevenless homolog 1 (679-687)
aaggaguacauccagcccgugcaacug

SEQ ID NO: 63800 - RNA, 27 nt, Artificial Sequence
  Ran-binding protein 17 (349-357)
aaggaguaccccgaagugaucagacug

SEQ ID NO: 63801 - RNA, 36 nt, Artificial Sequence
  Intermediate filament family orphan 2 (103-114)
aaggaguaccaggaaaccaucggccaaauugagcug

SEQ ID NO: 63802 - RNA, 27 nt, Artificial Sequence
  Mitochondrial ubiquitin ligase activator of NFKB 1 (158-166)
aaguuccaccccagcauccaguccuuu

SEQ ID NO: 63803 - RNA, 30 nt, Artificial Sequence
  Structural maintenance of chromosomes protein 4 (295-304)
aaguucaucgaggaaaacaaagagaaguuu

SEQ ID NO: 63804 - RNA, 27 nt, Artificial Sequence
  NADH dehydrogenase (ubiquinone) 1 alpha subcomplex subunit 12 (107-115)
aaguucaucuggaccaaccacaaauuu

SEQ ID NO: 63805 - RNA, 27 nt, Artificial Sequence
  Kelch domain-containing protein 3 (136-144)
aaguucaaccccgugagcuuuaccugg

SEQ ID NO: 63806 - RNA, 27 nt, Artificial Sequence
  Bromodomain and WD repeat-containing protein 1 (309-317)
aaguucagccccagaccucugaaauuu

SEQ ID NO: 63807 - RNA, 27 nt, Artificial Sequence
  Protein SHQ1 homolog (255-263)
aaguucgugaacaaaagcuaccugcuc

SEQ ID NO: 63808 - RNA, 27 nt, Artificial Sequence
  Tyrosine-protein phosphatase non-receptor type 9 (176-184)
aagggcgccuuccccgcuagacugaaa

SEQ ID NO: 63809 - RNA, 27 nt, Artificial Sequence
  Protein SCAF8 (528-536)
aagggccugcccccuaucagaagcaaa

SEQ ID NO: 63810 - RNA, 27 nt, Artificial Sequence
  BTB/POZ domain-containing adapter for CUL3-mediated RhoA degradation protein 2 (78-86)
aagcacuucggcaccauccugaacuac

SEQ ID NO: 63811 - RNA, 27 nt, Artificial Sequence
  Hsp90 co-chaperone Cdc37 (147-155)
aagcacaaaaccuucguggagaaguac

SEQ ID NO: 63812 - RNA, 27 nt, Artificial Sequence
  Transcription intermediary factor 1-beta (340-348)
aagcaccaggagcauauccugagauuc

SEQ ID NO: 63813 - RNA, 27 nt, Artificial Sequence
  Proliferating cell nuclear antigen (240-248)
aagaucgccgacaugggccaccugaaa

SEQ ID NO: 63814 - RNA, 27 nt, Artificial Sequence
  Ubiquitin-conjugating enzyme E2 G2 (125-133)
aagaucgccaaacagauugugcaaaag

SEQ ID NO: 63815 - RNA, 27 nt, Artificial Sequence
  Signal peptidase complex subunit 2 (40-48)
aagaucgacgauaaacccgugaagauu

SEQ ID NO: 63816 - RNA, 27 nt, Artificial Sequence
  T-box transcription factor TBX3 (273-281)
aagaucgacaacaaucccuucgccaaa

SEQ ID NO: 63817 - RNA, 27 nt, Artificial Sequence
  Myeloid leukemia factor 1 (90-98)
aagaucggcgacgagcccccuaaagug

SEQ ID NO: 63818 - RNA, 27 nt, Artificial Sequence
  Ras GTPase-activating-like protein IQGAP1 (916-924)
aagaucggccugcucgugaaaaacaag

SEQ ID NO: 63819 - RNA, 33 nt, Artificial Sequence
  Replication factor C subunit 1 (468-478)
aagaucauugacgaggauggccugcucaaccuu

SEQ ID NO: 63820 - RNA, 27 nt, Artificial Sequence
  Nucleoprotein TPR (1420-1428)
aagaucauugacauacaggagaaagug

SEQ ID NO: 63821 - RNA, 27 nt, Artificial Sequence
  Importin-8 (102-110)
aagauccuggaccaguacagacaaaaa

SEQ ID NO: 63822 - RNA, 33 nt, Artificial Sequence
  Sorting nexin-14 (635-645)
aagauccugcccgacgugaaccucggcaaaauu

SEQ ID NO: 63823 - RNA, 27 nt, Artificial Sequence
  V-type proton ATPase subunit E 2 (52-60)
aagaucauggaguacuaugaaaaaaag

SEQ ID NO: 63824 - RNA, 27 nt, Artificial Sequence
  Heat shock protein HSP 90-alpha (389-397)
aagaucaugaaagacauucuggagaag

SEQ ID NO: 63825 - RNA, 27 nt, Artificial Sequence
  Calcium-independent phospholipase A2-gamma (789-797)
aagaucaacgacuggauuaaacugaag

SEQ ID NO: 63826 - RNA, 27 nt, Artificial Sequence
  Heterogeneous nuclear ribonucleoprotein U-like protein 1 (262-270)
aagaucaacgaggaaauuagcgugaaa

SEQ ID NO: 63827 - RNA, 30 nt, Artificial Sequence
  UDP-glucose:glycoprotein glucosyltransferase 2 (148-157)
aagaucaacgagauuaaaaagcugcucaaa

SEQ ID NO: 63828 - RNA, 30 nt, Artificial Sequence
  Serine/threonine-protein phosphatase 4 regulatory subunit 3B (55-64)
aagaucaaccccaauaccgccuaccagaaa

SEQ ID NO: 63829 - RNA, 30 nt, Artificial Sequence
  Oral-facial-digital syndrome 1 protein (116-125)
aagaucaaccccaccagcucccuguacaaa

SEQ ID NO: 63830 - RNA, 27 nt, Artificial Sequence
  Poly(A) polymerase alpha (641-649)
aagauccccaccccuauugugggcguc

SEQ ID NO: 63831 - RNA, 27 nt, Artificial Sequence
  Prefoldin subunit 5 (129-137)
aagauccagcccgcccugcaagagaaa

SEQ ID NO: 63832 - RNA, 36 nt, Artificial Sequence
  Oxysterol-binding protein-related protein 9 (687-698)
aagaucagagacauugaugccgcuaccgaggcaaaa

SEQ ID NO: 63833 - RNA, 27 nt, Artificial Sequence
  Protein IMPACT (108-116)
aagaucagagacgugcugauucagaaa

SEQ ID NO: 63834 - RNA, 30 nt, Artificial Sequence
  Proto-oncogene tyrosine-protein kinase receptor Ret (156-165)
aagaucagagaguacgaacagacccugaaa

SEQ ID NO: 63835 - RNA, 30 nt, Artificial Sequence
  Heat shock factor protein 1 (131-140)
aagaucagacaggacagcgugaccaaacug

SEQ ID NO: 63836 - RNA, 36 nt, Artificial Sequence
  PDZ domain-containing RING finger protein 4 (443-454)
aagaucagaagcgacggcaccagguacauuacaaaa

SEQ ID NO: 63837 - RNA, 33 nt, Artificial Sequence
  Insulin-like growth factor I (3-13)
aagaucagcucccugcccacccagcucuucaaa

SEQ ID NO: 63838 - RNA, 27 nt, Artificial Sequence
  Importin-7 (419-427)
aagaucuacaaagaccagauggaguau

SEQ ID NO: 63839 - RNA, 27 nt, Artificial Sequence
  Mothers against decapentaplegic homolog 4 (428-436)
aagaucuaccccagcgccuauauuaaa

SEQ ID NO: 63840 - RNA, 27 nt, Artificial Sequence
  RING finger protein 113A (151-159)
aagaucuacagaggcauuaacaauuau

SEQ ID NO: 63841 - RNA, 30 nt, Artificial Sequence
  Prefoldin subunit 1 (28-37)
aagcuggccgacauccagauugagcaacuc

SEQ ID NO: 63842 - RNA, 36 nt, Artificial Sequence
  DNA topoisomerase 2-alpha (976-987)
aagcuggccgaggcugaaagagugggccuccacaaa

SEQ ID NO: 63843 - RNA, 27 nt, Artificial Sequence
  Retinoblastoma-like protein 1 (329-337)
aagcuggccgagauccucuacuauaaa

SEQ ID NO: 63844 - RNA, 27 nt, Artificial Sequence
  Neuron navigator 3 (940-948)
aagcuggccgaguacgugaucaccaaa

SEQ ID NO: 63845 - RNA, 33 nt, Artificial Sequence
  Protein PRR14L (1625-1635)
aagcuggcccccgcuaugaaaacccagaagcuc

SEQ ID NO: 63846 - RNA, 27 nt, Artificial Sequence
  Ubiquitin-40S ribosomal protein S27a (95-103)
aagcuggccgugcucaaauacuauaag

SEQ ID NO: 63847 - RNA, 30 nt, Artificial Sequence
  Disco-interacting protein 2 homolog A (376-385)
aagcuggccuacacccuccuuaacaaacug

SEQ ID NO: 63848 - RNA, 27 nt, Artificial Sequence
  Conserved oligomeric Golgi complex subunit 3 (394-402)
aagcuggacgagcuccuugaaaaacug

SEQ ID NO: 63849 - RNA, 30 nt, Artificial Sequence
  REST corepressor 1 (145-154)
aagcuggacgaguacaucgccauugcuaaa

SEQ ID NO: 63850 - RNA, 30 nt, Artificial Sequence
  40S ribosomal protein S7 (145-154)
aagcuggacggcagcagacucaucaaagug

SEQ ID NO: 63851 - RNA, 27 nt, Artificial Sequence
  CASP8-associated protein 2 (343-351)
aagcuggacaaaaaccccaaucaggug

SEQ ID NO: 63852 - RNA, 27 nt, Artificial Sequence
  Cysteine and histidine-rich protein 1 (100-108)
aagcuggaggaaagacucuacagcgug

SEQ ID NO: 63853 - RNA, 27 nt, Artificial Sequence
  Glutathione S-transferase omega-1 (152-160)
aagcuggaggaagugcucaccaacaaa

SEQ ID NO: 63854 - RNA, 33 nt, Artificial Sequence
  Thioredoxin domain-containing protein 5 (32-42)
aagcuguucaaacccggccaggaggccgugaag

SEQ ID NO: 63855 - RNA, 33 nt, Artificial Sequence
  Mitotic checkpoint serine/threonine-protein kinase BUB1 (954-964)
aagcuguuccccaaaggcaccaucuuuacagcc

SEQ ID NO: 63856 - RNA, 27 nt, Artificial Sequence
  Vacuolar protein sorting-associated protein 11 homolog (687-695)
aagcuguuccagcaaaucaugcacuac

SEQ ID NO: 63857 - RNA, 39 nt, Artificial Sequence
  YEATS domain-containing protein 4 (115-127)
aagcuguuccagagcgacaccaacgccaugcucggcaaa

SEQ ID NO: 63858 - RNA, 27 nt, Artificial Sequence
  Peroxisomal acyl-coenzyme A oxidase 1 (537-545)
aagcuguucagcgagaaacuccuuaag

SEQ ID NO: 63859 - RNA, 33 nt, Artificial Sequence
  28S ribosomal protein S33, mitochondrial (35-45)
aagcuguucagcgagcucccccuugccaaaaag

SEQ ID NO: 63860 - RNA, 27 nt, Artificial Sequence
  BAH and coiled-coil domain-containing protein 1 (52-60)
aagcuguucuacaaagccaucgugaga

SEQ ID NO: 63861 - RNA, 30 nt, Artificial Sequence
  Nucleolar protein 58 (93-102)
aagcugggcggggugaucaaagagaagcuc

SEQ ID NO: 63862 - RNA, 30 nt, Artificial Sequence
  Histone H1.2 (81-90)
aagcugggccucaaaagccuuguguccaag

SEQ ID NO: 63863 - RNA, 27 nt, Artificial Sequence
  Cytochrome c oxidase subunit NDUFA4 (39-47)
aagcugggccccaacgaccaguacaaa

SEQ ID NO: 63864 - RNA, 27 nt, Artificial Sequence
  DCC-interacting protein 13-alpha (553-561)
aagcugaucgacccccagacccaagug

SEQ ID NO: 63865 - RNA, 27 nt, Artificial Sequence
  DNA topoisomerase 2-beta (209-217)
aagcugaucgagguggucaaaaagaaa

SEQ ID NO: 63866 - RNA, 27 nt, Artificial Sequence
  Dynactin subunit 4 (146-154)
aagcugaucgaguacuaucagcaacuc

SEQ ID NO: 63867 - RNA, 30 nt, Artificial Sequence
  Glycerol-3-phosphate dehydrogenase 1-like protein (55-64)
aagcugaucagcgacauuauaagagagaaa

SEQ ID NO: 63868 - RNA, 27 nt, Artificial Sequence
  Spectrin beta chain, non-erythrocytic 1 (387-395)
aagcugaucagcgacauuaacaaagcc

SEQ ID NO: 63869 - RNA, 39 nt, Artificial Sequence
  Transcription elongation factor B polypeptide 1 (4-16)
aagcugaucagcuccgacggccacgaguucauugugaaa

SEQ ID NO: 63870 - RNA, 27 nt, Artificial Sequence
  Vacuolar protein sorting-associated protein 4B (71-79)
aagcugaaagaguaccucaagaacaaa

SEQ ID NO: 63871 - RNA, 36 nt, Artificial Sequence
  Heterogeneous nuclear ribonucleoproteins C1/C2 (187-198)
aagcugaaaggcgacgaucuccaggccaucaagaaa

SEQ ID NO: 63872 - RNA, 33 nt, Artificial Sequence
  Tight junction-associated protein 1 (150-160)
aagcugcucgacgccaaaaacaccaucaauaag

SEQ ID NO: 63873 - RNA, 33 nt, Artificial Sequence
  26S proteasome non-ATPase regulatory subunit 7 (204-214)
aagcugcucgacaucagaagcuaccuugagaaa

SEQ ID NO: 63874 - RNA, 33 nt, Artificial Sequence
  Methionine-tRNA ligase, cytoplasmic (453-463)
aagcugcucgaccuuaaaaagcagcuggccgug

SEQ ID NO: 63875 - RNA, 27 nt, Artificial Sequence
  Dihydrolipoyllysine-residue succinyltransferase component of 2-oxoglutarate dehydrogenase complex, mitochondrial (80-88)
aagcugcucgagacccagcuucaaaaa

SEQ ID NO: 63876 - RNA, 30 nt, Artificial Sequence
  Aspartate-tRNA ligase, cytoplasmic (373-382)
aagcugcucggccaccuugugaaagagaag

SEQ ID NO: 63877 - RNA, 27 nt, Artificial Sequence
  U3 small nucleolar ribonucleoprotein protein IMP3 (11-19)
aagcugcucaaacagguggacuuccuu

SEQ ID NO: 63878 - RNA, 27 nt, Artificial Sequence
  Protein Smaug homolog 1 (103-111)
aagcugcuccccaaaauccuugcccac

SEQ ID NO: 63879 - RNA, 27 nt, Artificial Sequence
  Box C/D snoRNA protein 1 (321-329)
aagcugcuccccaacggcuucaccaaa

SEQ ID NO: 63880 - RNA, 27 nt, Artificial Sequence
  Anaphase-promoting complex subunit 5 (482-490)
aagcugcuccagaaacuucuggugcac

SEQ ID NO: 63881 - RNA, 33 nt, Artificial Sequence
  Nucleoprotein TPR (1356-1366)
aagcugcucagcgagaaagaagugcacaccaag

SEQ ID NO: 63882 - RNA, 30 nt, Artificial Sequence
  DNA replication ATP-dependent helicase/nuclease DNA2 (580-589)
aagcugauggagaacaccuucgugagcaaa

SEQ ID NO: 63883 - RNA, 30 nt, Artificial Sequence
  Integrin alpha-9 (198-207)
aagcugaacgacgaggugaucaugaauaga

SEQ ID NO: 63884 - RNA, 27 nt, Artificial Sequence
  Eukaryotic translation initiation factor 3 subunit C-like protein (333-341)
aagcugaacgagauccuccaggccaga

SEQ ID NO: 63885 - RNA, 33 nt, Artificial Sequence
  Eukaryotic translation initiation factor 3 subunit C-like protein (333-343)
aagcugaacgagauccuccaggccagaggcaaa

SEQ ID NO: 63886 - RNA, 27 nt, Artificial Sequence
  PHD finger protein 14 (693-701)
aagcugaacauccccgccauucucaga

SEQ ID NO: 63887 - RNA, 27 nt, Artificial Sequence
  EH domain-containing protein 4 (478-486)
aagcugcccaacagcgugcucggcaaa

SEQ ID NO: 63888 - RNA, 30 nt, Artificial Sequence
  Sarcospan (62-71)
aagcugcccagcuccgagccucucucuaga

SEQ ID NO: 63889 - RNA, 27 nt, Artificial Sequence
  40S ribosomal protein S18 (106-114)
aagcugagagaggaccucgaaaggcuu

SEQ ID NO: 63890 - RNA, 33 nt, Artificial Sequence
  Catenin delta-1 (688-698)
aagcugagagagacccagggcaucgaaaaacuc

SEQ ID NO: 63891 - RNA, 33 nt, Artificial Sequence; identical to SEQ ID NO: 39664
  Ankycorbin (218-228)

SEQ ID NO: 63892 - RNA, 27 nt, Artificial Sequence
  Serine/threonine-protein kinase N1 (262-270)
aagcugaccgagagcaaccagaaacuc

SEQ ID NO: 63893 - RNA, 27 nt, Artificial Sequence
  Melanoma-associated antigen D1 (477-485)
aagcuggugaaauaccucaugcuuaag

SEQ ID NO: 63894 - RNA, 27 nt, Artificial Sequence
  Cytochrome c oxidase subunit 5B, mitochondrial (121-129)
aagcuggugccccagcaacucgcccac

SEQ ID NO: 63895 - RNA, 30 nt, Artificial Sequence
  E3 ubiquitin-protein ligase TTC3 (1097-1106)
aagcugugggacaugaaccccaaacagaag

SEQ ID NO: 63896 - RNA, 30 nt, Artificial Sequence
  Fatty acid desaturase 2 (413-422)
aagcuguggcucgacgccuaccuucacaaa

SEQ ID NO: 63897 - RNA, 27 nt, Artificial Sequence
  Serine/threonine-protein kinase ATR (289-297)
aagcuguacgaggaaccccucagcaaa

SEQ ID NO: 63898 - RNA, 27 nt, Artificial Sequence
  Retinoblastoma-like protein 2 (304-312)
aagcuguacgagaaaaagcuccuuaaa

SEQ ID NO: 63899 - RNA, 30 nt, Artificial Sequence
  Lamina-associated polypeptide 2, isoforms beta/gamma (140-149)
aagcuguacgagaaaaagcuccuuaaacug

SEQ ID NO: 63900 - RNA, 27 nt, Artificial Sequence
  Dedicator of cytokinesis protein 7 (424-432)
aagcuguaccccgacagcagagugagg

SEQ ID NO: 63901 - RNA, 27 nt, Artificial Sequence
  Protein diaphanous homolog 3 (930-938)
aagcuguaccagagcaucauuggcuau

SEQ ID NO: 63902 - RNA, 30 nt, Artificial Sequence
  Nuclear pore complex protein Nup98-Nup96 (1480-1489)
aagcuguacagcgacuccaucagagagaaa

SEQ ID NO: 63903 - RNA, 27 nt, Artificial Sequence
  NADH dehydrogenase (ubiquinone) iron-sulfur protein 7, mitochondrial (74-82)
aagauggcccccgcucugagaaaagug

SEQ ID NO: 63904 - RNA, 27 nt, Artificial Sequence
  TRPM8 channel-associated factor 1 (447-455)
aagauguucagccaccaggugcaaaaa

SEQ ID NO: 63905 - RNA, 36 nt, Artificial Sequence
  Heat shock cognate 71 kDa protein (82-93)
aagaugaaagagaucgccgaagcuuaccugggcaag

SEQ ID NO: 63906 - RNA, 30 nt, Artificial Sequence
  Neuroblast differentiation-associated protein AHNAK (380-389)
aagaugcccaaaaugaagaugccuaccuuc

SEQ ID NO: 63907 - RNA, 27 nt, Artificial Sequence
  DNA replication licensing factor MCM7 (236-244)
aagaugcaggagcacagcgaccaagug

SEQ ID NO: 63908 - RNA, 27 nt, Artificial Sequence
  Intraflagellar transport protein 74 homolog (462-470)
aagaugaccgaggaacagcacagccug

SEQ ID NO: 63909 - RNA, 27 nt, Artificial Sequence
  Nuclear receptor corepressor 1 (1336-1344)
aagcccuacgacggcaucaccacaauu

SEQ ID NO: 63910 - RNA, 30 nt, Artificial Sequence
  Hippocampus abundant transcript-like protein 1 (216-225)
aagcaggccgaccccuucgcuagccugaaa

SEQ ID NO: 63911 - RNA, 27 nt, Artificial Sequence
  T-complex protein 1 subunit zeta (39-47)
aagcaggacgagcccaucgaucuguuc

SEQ ID NO: 63912 - RNA, 27 nt, Artificial Sequence
  Catenin alpha-1 (865-873)
aagcaggacgagacccaaacaaaaauc

SEQ ID NO: 63913 - RNA, 27 nt, Artificial Sequence
  Cytoplasmic dynein 1 heavy chain 1 (1181-1189)
aagcaguucgagaaacaaguggaacug

SEQ ID NO: 63914 - RNA, 27 nt, Artificial Sequence
  Probable E3 ubiquitin-protein ligase makorin-2 (226-234)
aagcaguucgagaaccccaucauuaaa

SEQ ID NO: 63915 - RNA, 27 nt, Artificial Sequence
  Bromodomain adjacent to zinc finger domain protein 2A (588-596)
aagcaguuccccgaggugaucaaauac

SEQ ID NO: 63916 - RNA, 27 nt, Artificial Sequence
  60S ribosomal protein L22-like 1 (69-77)
aagcaguucagcaaaagauaccugaag

SEQ ID NO: 63917 - RNA, 27 nt, Artificial Sequence
  Interleukin enhancer-binding factor 3 (519-527)
aagcagcaaggccccauccugaccaaa

SEQ ID NO: 63918 - RNA, 27 nt, Artificial Sequence
  Actin-related protein 8 (80-88)
aagcagcaaggccagccccuguacaaa

SEQ ID NO: 63919 - RNA, 27 nt, Artificial Sequence
  SAM and SH3 domain-containing protein 1 (898-906)
aagagauucagcgagccccagaaacug

SEQ ID NO: 63920 - RNA, 27 nt, Artificial Sequence
  AP-3 complex subunit mu-2 (240-248)
aagagaugggagagcgaaaggauccug

SEQ ID NO: 63921 - RNA, 27 nt, Artificial Sequence
  AP-3 complex subunit mu-1 (186-194)
aagagaugggagagcgaaagggugcug

SEQ ID NO: 63922 - RNA, 27 nt, Artificial Sequence
  Rabankyrin-5 (851-859)
aagagcgccgaggcuauccugaaaaga

SEQ ID NO: 63923 - RNA, 27 nt, Artificial Sequence
  Neuron-specific calcium-binding protein hippocalcin (174-182)
aagagcgaccccuccaucgugagacug

SEQ ID NO: 63924 - RNA, 30 nt, Artificial Sequence
  Pre-mRNA-processing factor 40 homolog B (165-174)
aagagcgacaccggcaaacccuacuauuac

SEQ ID NO: 63925 - RNA, 30 nt, Artificial Sequence
  Supervillin (396-405)
aagagcuucgacgagcagaacgugcccaaa

SEQ ID NO: 63926 - RNA, 33 nt, Artificial Sequence
  Tumor protein D54 (26-36)
aagagcuucgaggacagagugggcaccaucaaa

SEQ ID NO: 63927 - RNA, 27 nt, Artificial Sequence
  Mitogen-activated protein kinase kinase kinase kinase 4 (1062-1070)
aagagcuucggcgagcuggugcacaaa

SEQ ID NO: 63928 - RNA, 33 nt, Artificial Sequence
  Myristoylated alanine-rich C-kinase substrate (162-172)
aagagcuucaaacuguccggcuuuucuuucaag

SEQ ID NO: 63929 - RNA, 27 nt, Artificial Sequence
  Kinetochore protein Spc25 (11-19)
aagagcaucaacgaguucuggaauaaa

SEQ ID NO: 63930 - RNA, 27 nt, Artificial Sequence
  MICOS complex subunit MIC60 (102-110)
aagagcauccaguccggcccccugaaa

SEQ ID NO: 63931 - RNA, 27 nt, Artificial Sequence
  DNA-dependent protein kinase catalytic subunit (2416-2424)
aagagcaaagacuucgugcaggucaug

SEQ ID NO: 63932 - RNA, 27 nt, Artificial Sequence
  Choline-phosphate cytidylyltransferase A (259-267)
aagagcaaagaguucgugcagaagguc

SEQ ID NO: 63933 - RNA, 27 nt, Artificial Sequence
  Phosphatidylinositol 4,5-bisphosphate 3-kinase catalytic subunit delta isoform (860-868)
aagagcaaaaaccccggcgaggcccug

SEQ ID NO: 63934 - RNA, 30 nt, Artificial Sequence
  Arf-GAP with Rho-GAP domain, ANK repeat and PH domain-containing protein 3 (219-228)
aagagccuggaccagcccuuccucuccaaa

SEQ ID NO: 63935 - RNA, 30 nt, Artificial Sequence
  Golgi-specific brefeldin A-resistance guanine nucleotide exchange factor 1 (944-953)
aagagccuggaggaaaccaucauucagaaa

SEQ ID NO: 63936 - RNA, 33 nt, Artificial Sequence
  Charged multivesicular body protein 2a (94-104)
aagagcaacaauuccauggcccaggcuaugaaa

SEQ ID NO: 63937 - RNA, 27 nt, Artificial Sequence
  B9 domain-containing protein 1 (56-64)
aagagccaggacgugagacaagcccug

SEQ ID NO: 63938 - RNA, 36 nt, Artificial Sequence
  5-aminolevulinate synthase, nonspecific, mitochondrial (174-185)
aagaccgacggcggggaucccagcggacugcucaaa

SEQ ID NO: 63939 - RNA, 27 nt, Artificial Sequence
  BRCA1-associated protein (26-34)
aagaccgacggcaaaaucgugcaguac

SEQ ID NO: 63940 - RNA, 27 nt, Artificial Sequence
  Zinc finger homeobox protein 3 (90-98)
aagaccgacaaacacgugcagaaguac

SEQ ID NO: 63941 - RNA, 30 nt, Artificial Sequence
  Ubiquitin carboxyl-terminal hydrolase 7 (381-390)
aagaccgaccccaaagauccugccaacuac

SEQ ID NO: 63942 - RNA, 27 nt, Artificial Sequence
  Origin recognition complex subunit 3 (194-202)
aagaccgaccccaaaaugcugagcaag

SEQ ID NO: 63943 - RNA, 27 nt, Artificial Sequence
  U2 small nuclear ribonucleoprotein B'' (85-93)
aagaccgacagcgauaucauuuccaaa

SEQ ID NO: 63944 - RNA, 30 nt, Artificial Sequence
  Membrane metallo-endopeptidase-like 1 (728-737)
aagaccgacgugcacagcccccugaaauac

SEQ ID NO: 63945 - RNA, 27 nt, Artificial Sequence
  Phosphatidylinositol 4,5-bisphosphate 3-kinase catalytic subunit alpha isoform (1030-1038)
aagaccgagcaggaagcccuggaguac

SEQ ID NO: 63946 - RNA, 27 nt, Artificial Sequence
  Vesicle-associated membrane protein-associated protein B/C (147-155)
aagaccgagacacccaucgugagcaaa

SEQ ID NO: 63947 - RNA, 33 nt, Artificial Sequence
  Leukotriene A-4 hydrolase (355-365)
aagaccuucggcgagacacaccccuuuacuaaa

SEQ ID NO: 63948 - RNA, 30 nt, Artificial Sequence
  Zinc finger CCCH domain-containing protein 11A (404-413)
aagaccuucagcgaggugcuggccgaaaaa

SEQ ID NO: 63949 - RNA, 33 nt, Artificial Sequence
  60S ribosomal protein L39-like (5-15)
aagaccuucacaaucaaaagauuucuggccaag

SEQ ID NO: 63950 - RNA, 27 nt, Artificial Sequence
  Microtubule-actin cross-linking factor 1, isoforms 1/2/3/5 (99-107)
aagaccuucacaaaaugggugaacaag

SEQ ID NO: 63951 - RNA, 30 nt, Artificial Sequence
  Transcription initiation factor TFIID subunit 7 (78-87)
aagaccaucgacaaaaagacauucuacaaa

SEQ ID NO: 63952 - RNA, 33 nt, Artificial Sequence
  Transforming growth factor beta-1 (34-44)
aagaccaucgacauggagcuggugaaaagaaag

SEQ ID NO: 63953 - RNA, 27 nt, Artificial Sequence
  Max-like protein X (125-133)
aagaccaucgacuacauucaguuccug

SEQ ID NO: 63954 - RNA, 33 nt, Artificial Sequence
  Max-like protein X (125-135)
aagaccaucgacuacauucaguuccugcacaaa

SEQ ID NO: 63955 - RNA, 39 nt, Artificial Sequence
  tRNA pseudouridine synthase A, mitochondrial (110-122)
aagaccaucgaggacgaucuggugagcgcccucgucaga

SEQ ID NO: 63956 - RNA, 27 nt, Artificial Sequence
  Polymerase delta-interacting protein 3 (147-155)
aagaccauccaggugccccaacagaaa

SEQ ID NO: 63957 - RNA, 33 nt, Artificial Sequence
  Cyclin-dependent kinase 11A (11-21)
aagacccuggacgagauccuccaggaaaaaaag

SEQ ID NO: 63958 - RNA, 33 nt, Artificial Sequence
  Exportin-2 (17-27)
aagacccuggaccccgauccugccaucagaagg

SEQ ID NO: 63959 - RNA, 36 nt, Artificial Sequence
  Coatomer subunit gamma-1 (795-806)
aagacccuggaggaagccgugggcaacaucgucaaa

SEQ ID NO: 63960 - RNA, 27 nt, Artificial Sequence
  Protein prune homolog 2 (118-126)
aagacccuggagagcgccguggucaaa

SEQ ID NO: 63961 - RNA, 33 nt, Artificial Sequence
  Chromatin assembly factor 1 subunit B (467-477)
aagacccugcagcccagcucccaaaacacaaaa

SEQ ID NO: 63962 - RNA, 33 nt, Artificial Sequence
  RE1-silencing transcription factor (417-427)
aagaccauggacgugagcaaagucaagcugaaa

SEQ ID NO: 63963 - RNA, 33 nt, Artificial Sequence
  Arfaptin-2 (216-226)
aagaccauggaggacacacugaugacugugaaa

SEQ ID NO: 63964 - RNA, 27 nt, Artificial Sequence
  Asparagine synthetase domain-containing protein 1 (361-369)
aagaccaugcccacaacuuucaacaga

SEQ ID NO: 63965 - RNA, 27 nt, Artificial Sequence
  Uncharacterized protein C15orf41 (95-103)
aagacccccgacuucauccugcaggug

SEQ ID NO: 63966 - RNA, 27 nt, Artificial Sequence
  Neuroblast differentiation-associated protein AHNAK (489-497)
aagacccccgagaugaucauucagaaa

SEQ ID NO: 63967 - RNA, 30 nt, Artificial Sequence
  LIM and SH3 domain protein 1 (112-121)
aagacccaggaccaaaucagcaacauuaaa

SEQ ID NO: 63968 - RNA, 27 nt, Artificial Sequence
  mRNA-capping enzyme (403-411)
aagacccaggagcccuucagcgugaga

SEQ ID NO: 63969 - RNA, 33 nt, Artificial Sequence
  mRNA-capping enzyme (403-413)
aagacccaggagcccuucagcgugagaaacaaa

SEQ ID NO: 63970 - RNA, 27 nt, Artificial Sequence
  Actin-related protein 10 (403-411)
aagacccagcccccucugaugaaaaga

SEQ ID NO: 63971 - RNA, 33 nt, Artificial Sequence
  Src substrate cortactin (299-309)
aagaccgugcccgucgaggccguuacaagcaaa

SEQ ID NO: 63972 - RNA, 36 nt, Artificial Sequence
  X-ray repair cross-complementing protein 5 (274-285)
aagaccuggacaguggucgacgccaaaacucugaag

SEQ ID NO: 63973 - RNA, 30 nt, Artificial Sequence
  NADH dehydrogenase (ubiquinone) 1 subunit C2 (106-115)
aagaccuacggcgagaucuucgaaaaauuu

SEQ ID NO: 63974 - RNA, 33 nt, Artificial Sequence
  Zinc finger protein SNAI2 (135-145)
aagaccuacagcacauucuccggccuggccaaa

SEQ ID NO: 63975 - RNA, 30 nt, Artificial Sequence
  ETS translocation variant 1 (301-310)
aagguggccggcgagagauacgucuauaaa

SEQ ID NO: 63976 - RNA, 27 nt, Artificial Sequence
  5'-AMP-activated protein kinase catalytic subunit alpha-2 (41-49)
aagguggccgucaaaauccugaacaga

SEQ ID NO: 63977 - RNA, 27 nt, Artificial Sequence
  Heat shock cognate 71 kDa protein (601-609)
aaggugugcaaccccaucauuaccaaa

SEQ ID NO: 63978 - RNA, 24 nt, Artificial Sequence
  Proteasome activator complex subunit 3 (6-13)
aagguggaccaggaggucaaacug

SEQ ID NO: 63979 - RNA, 27 nt, Artificial Sequence
  Proteasome activator complex subunit 3 (6-14)
aagguggaccaggaggucaaacugaag

SEQ ID NO: 63980 - RNA, 30 nt, Artificial Sequence
  Kinesin-like protein KIFC3 (522-531)
aagguguucgaguuuggccacaccaacaga

SEQ ID NO: 63981 - RNA, 33 nt, Artificial Sequence
  Nucleolin (370-380)
aagguguucggcaacgagaucaaacuggaaaag

SEQ ID NO: 63982 - RNA, 36 nt, Artificial Sequence
  CUGBP Elav-like family member 2 (453-464)
aagguguucaucgacaaacagaccaaccugagcaag

SEQ ID NO: 63983 - RNA, 27 nt, Artificial Sequence
  Cathepsin L1 (104-112)
aagguguuccaggagccccuguuuuac

SEQ ID NO: 63984 - RNA, 27 nt, Artificial Sequence
  Aspartyl/asparaginyl beta-hydroxylase (462-470)
aaggugcacuacggcuucauccugaaa

SEQ ID NO: 63985 - RNA, 39 nt, Artificial Sequence
  Homeodomain-interacting protein kinase 2 (343-355)
aaggugaucgacuucggcagcgccucccacgucucuaaa

SEQ ID NO: 63986 - RNA, 33 nt, Artificial Sequence
  Leucine-rich repeat-containing protein 61 (158-168)
aaggugaucgacggcgagagagucauugggagg

SEQ ID NO: 63987 - RNA, 27 nt, Artificial Sequence
  Prefoldin subunit 1 (19-27)
aaggugaucgacacccagcaaaaaguc

SEQ ID NO: 63988 - RNA, 27 nt, Artificial Sequence
  UPF0428 protein CXorf56 (42-50)
aaggugaucgagaaacagcuggaaaga

SEQ ID NO: 63989 - RNA, 33 nt, Artificial Sequence
  Liprin-alpha-1 (251-261)
aaggugaucgagcugcaggaaauuauaagcaaa

SEQ ID NO: 63990 - RNA, 33 nt, Artificial Sequence
  Signal-induced proliferation-associated 1-like protein 2 (559-569)
aaggugaucaacgccgagaaugcugcacacaaa

SEQ ID NO: 63991 - RNA, 27 nt, Artificial Sequence
  60S acidic ribosomal protein P2 (41-49)
aaggugaucagcgagcugaacggcaaa

SEQ ID NO: 63992 - RNA, 33 nt, Artificial Sequence
  Protein PRRC2C (1140-1150)
aaggugaucagcaaagaccuggucauugagaga

SEQ ID NO: 63993 - RNA, 33 nt, Artificial Sequence
  Zinc finger protein 721 (156-166)
aaggugaucaccagcuccucuucauucgccaaa

SEQ ID NO: 63994 - RNA, 36 nt, Artificial Sequence
  Probable U3 small nucleolar RNA-associated protein 11 (109-120)
aaggugaaaggcgucaccaaccagacagggcugaag

SEQ ID NO: 63995 - RNA, 33 nt, Artificial Sequence
  Neuroblast differentiation-associated protein AHNAK (487-497)
aaggugaaaacccccgagaugaucauucagaag

SEQ ID NO: 63996 - RNA, 30 nt, Artificial Sequence
  Gamma-interferon-inducible protein 16 (243-252)
aaggugcugaacaccagccucaaagagaag

SEQ ID NO: 63997 - RNA, 30 nt, Artificial Sequence
  E3 ubiquitin-protein ligase RNF216 (197-206)
aaggugcugccccagaccauccucuacaaa

SEQ ID NO: 63998 - RNA, 30 nt, Artificial Sequence
  Serine/threonine-protein kinase Sgk1 (222-231)
aaggugcugcagaaaaaggccauccucaaa

SEQ ID NO: 63999 - RNA, 33 nt, Artificial Sequence
  Flavin reductaseADPH) (137-147)
aaggugcugagagagagcggccucaaauacguc

SEQ ID NO: 64000 - RNA, 30 nt, Artificial Sequence
  Polymerase I and transcript release factor (227-236)
aaggugcccccuuucaccuuucacgucaaa

SEQ ID NO: 64001 - RNA, 33 nt, Artificial Sequence
  Leucine-tRNA ligase, cytoplasmic (486-496)
aaggugcaggacgucaaaaagaccauccaaaaa

SEQ ID NO: 64002 - RNA, 30 nt, Artificial Sequence
  28S ribosomal protein S29, mitochondrial (203-212)
aaggugcaggagaaauacgucuggaacaag

SEQ ID NO: 64003 - RNA, 27 nt, Artificial Sequence
  Prelamin-A/C (108-116)
aaggugagagaggaauucaaagagcug

SEQ ID NO: 64004 - RNA, 30 nt, Artificial Sequence
  ATP-dependent RNA helicase DHX8 (1091-1100)
aaggugagcgaccccaccaaacuguccaag

SEQ ID NO: 64005 - RNA, 27 nt, Artificial Sequence
  Protein O-GlcNAcase (850-858)
aaggugaccgaccccagcgucgccaaa

SEQ ID NO: 64006 - RNA, 27 nt, Artificial Sequence
  Voltage-dependent anion-selective channel protein 1 (53-61)
aaggugaccggcagccuggagacaaaa

SEQ ID NO: 64007 - RNA, 33 nt, Artificial Sequence
  Septin-9 (202-212)
aagguggucaacaucguucccgugauugccaaa

SEQ ID NO: 64008 - RNA, 27 nt, Artificial Sequence
  Arf-GAP with Rho-GAP domain, ANK repeat and PH domain-containing protein 3 (53-61)
aagguguaccugggcaucagaaaaaag

SEQ ID NO: 64009 - RNA, 27 nt, Artificial Sequence
  Ubiquitin carboxyl-terminal hydrolase 32 (278-286)
aaguacgcccccagauucaacggcuuu

SEQ ID NO: 64010 - RNA, 27 nt, Artificial Sequence
  Methionine synthase (216-224)
aaguacgcccccagaccuaucuucauu

SEQ ID NO: 64011 - RNA, 27 nt, Artificial Sequence
  Metastasis-associated protein MTA2 (282-290)
aaguacggcaaagacuucaacgauauc

SEQ ID NO: 64012 - RNA, 27 nt, Artificial Sequence
  Glycerol-3-phosphate acyltransferase 4 (365-373)
aaguacggcauggugaccuaucugcuc

SEQ ID NO: 64013 - RNA, 24 nt, Artificial Sequence
  Splicing factor 3B subunit 6 (41-48)
aaguacggccccaucagacagauu

SEQ ID NO: 64014 - RNA, 27 nt, Artificial Sequence
  Inositol 1,4,5-trisphosphate receptor type 3 (117-125)
aaguacggcagcgugauccagcugcuc

SEQ ID NO: 64015 - RNA, 27 nt, Artificial Sequence
  KH domain-containing, RNA-binding, signal transduction-associated protein 3 (44-52)
aaguacaucgacguggucauuaacaaa

SEQ ID NO: 64016 - RNA, 27 nt, Artificial Sequence
  Probable E3 ubiquitin-protein ligase HERC6 (822-830)
aaguacaucgacuauauuuucaacgug

SEQ ID NO: 64017 - RNA, 33 nt, Artificial Sequence
  Zinc finger FYVE domain-containing protein 16 (1129-1139)
aaguacaucgagaaccuggacaauauuaccuuc

SEQ ID NO: 64018 - RNA, 27 nt, Artificial Sequence
  Serine/threonine-protein kinase RIO3 (304-312)
aaguacaucaaagacgauuucagauuu

SEQ ID NO: 64019 - RNA, 27 nt, Artificial Sequence
  FERM domain-containing protein 6 (210-218)
aaguacaucaaagaggccgugagacug

SEQ ID NO: 64020 - RNA, 27 nt, Artificial Sequence
  ER membrane protein complex subunit 3 (66-74)
aaguacauccccaaacagagcuuccug

SEQ ID NO: 64021 - RNA, 27 nt, Artificial Sequence
  Cleavage stimulation factor subunit 1 (212-220)
aaguacauccaggaggccgaaaugcug

SEQ ID NO: 64022 - RNA, 27 nt, Artificial Sequence
  Poly(A)-specific ribonuclease PARN (21-29)
aaguacaucaccaaaagcuucaacuuu

SEQ ID NO: 64023 - RNA, 27 nt, Artificial Sequence
  Tetratricopeptide repeat protein 14 (427-435)
aaguacaugcagaaaagccuggagcuc

SEQ ID NO: 64024 - RNA, 27 nt, Artificial Sequence
  Heparan sulfate 2-sulfotransferase (241-249)
aaguacaaccugaucaaugaguauuuc

SEQ ID NO: 64025 - RNA, 27 nt, Artificial Sequence
  Homeobox protein Hox-B7 (13-21)
aaguaccccgccagcuccucuguguuc

SEQ ID NO: 64026 - RNA, 27 nt, Artificial Sequence
  Adenosylhomocysteinase 2 (210-218)
aaguaccccaacguguucaaaaagauc

SEQ ID NO: 64027 - RNA, 27 nt, Artificial Sequence
  Zinc finger C2HC domain-containing protein 1A (306-314)
aaguaccccguggagugggccaaauuc

SEQ ID NO: 64028 - RNA, 27 nt, Artificial Sequence
  T-box transcription factor TBX15 (239-247)
aaguaccagcccagagugcacgucauc

SEQ ID NO: 64029 - RNA, 30 nt, Artificial Sequence; identical to SEQ ID NO: 39802
  Intron-binding protein aquarius (90-99)

SEQ ID NO: 64030 - RNA, 27 nt, Artificial Sequence
  Putative zinc finger protein 724 (149-157)
aaguacgugaaagacuuccacaaguuu

SEQ ID NO: 64031 - RNA, 27 nt, Artificial Sequence
  Zinc finger protein 107 (80-88)
aaguacgugaaagucuucgacaaguuu

SEQ ID NO: 64032 - RNA, 27 nt, Artificial Sequence
  Zinc finger protein 486 (191-199)
aaguacgugaaagucuuccaccaguuu

SEQ ID NO: 64033 - RNA, 27 nt, Artificial Sequence
  Zinc finger protein 675 (148-156)
aaguacgugaaagucuucaacaaguuu

SEQ ID NO: 64034 - RNA, 27 nt, Artificial Sequence
  Nuclear pore membraneoprotein 210 (17-25)
cuggccgcuggccccagcgcagccgcg

SEQ ID NO: 64035 - RNA, 27 nt, Artificial Sequence
  Lck-interacting transmembrane adapter 1 (150-158)
cuggccgcucuccccggcgugagccuu

SEQ ID NO: 64036 - RNA, 27 nt, Artificial Sequence
  Prolyl endopeptidase-like (376-384)
cuggccgacgauagcgugagaucccuc

SEQ ID NO: 64037 - RNA, 27 nt, Artificial Sequence
  Helicase ARIP4 (250-258)
cuggccaucgugcccgucaacacccuc

SEQ ID NO: 64038 - RNA, 27 nt, Artificial Sequence
  Receptor-interacting serine/threonine-protein kinase 4 (637-645)
cuggccaagcagcccggcgugagcguc

SEQ ID NO: 64039 - RNA, 27 nt, Artificial Sequence
  Importin-9 (625-633)
cuggcccaggacaucuucaaggagcuc

SEQ ID NO: 64040 - RNA, 27 nt, Artificial Sequence
  Exosome complex exonuclease RRP44 (767-775)
cuggccagccccaucuacacccacuuc

SEQ ID NO: 64041 - RNA, 27 nt, Artificial Sequence
  Serine/threonine-protein kinase 17B (265-273)
cuggccaccgacuucauccagagccuc

SEQ ID NO: 64042 - RNA, 27 nt, Artificial Sequence
  Junction plakoglobin (139-147)
cuggccaccagagcucuccccgagcuu

SEQ ID NO: 64043 - RNA, 27 nt, Artificial Sequence
  UBX domain-containing protein 8 (242-250)
cuggccguggagggcgggcagagccuc

SEQ ID NO: 64044 - RNA, 27 nt, Artificial Sequence
  F-box only protein 32 (100-108)
cuggaggaccagcaaaacaucagacuc

SEQ ID NO: 64045 - RNA, 27 nt, Artificial Sequence
  Ubiquitin carboxyl-terminal hydrolase 22 (475-483)
cuggagagcggccacuacaccuccuuc

SEQ ID NO: 64046 - RNA, 27 nt, Artificial Sequence
  Gamma-aminobutyric acid receptor subunit pi (247-255)
cuggagaccuacgugcccagcacauuc

SEQ ID NO: 64047 - RNA, 27 nt, Artificial Sequence
  Condensin-2 complex subunit H2 (434-442)
cuguucaucgccaccagccagaaguuu

SEQ ID NO: 64048 - RNA, 27 nt, Artificial Sequence
  ATP-dependent RNA helicase DDX54 (153-161)
cugauccucagccccaccagagagcuu

SEQ ID NO: 64049 - RNA, 27 nt, Artificial Sequence
  Lysine-specific demethylase 4B (245-253)
cugaucagccccauuauacucaagaaa

SEQ ID NO: 64050 - RNA, 27 nt, Artificial Sequence
  Protocadherin-1 (27-35)
cugcucgcccccagcccuggccacgcu

SEQ ID NO: 64051 - RNA, 33 nt, Artificial Sequence
  ETS translocation variant 5 (377-387)
cugcucgacgaucccgccaacgcucacuucauc

SEQ ID NO: 64052 - RNA, 27 nt, Artificial Sequence
  ATP-binding cassette sub-family F member 3 (350-358)
cugcucgacgagcccaccaacaugcuu

SEQ ID NO: 64053 - RNA, 30 nt, Artificial Sequence
  Zinc finger protein 490 (73-82)
cugcucgaccccggccagagaaacaucuac

SEQ ID NO: 64054 - RNA, 27 nt, Artificial Sequence
  Probable global transcription activator SNF2L1 (721-729)
cugcucgagaaggaaauccuuuacuau

SEQ ID NO: 64055 - RNA, 39 nt, Artificial Sequence
  NKG2D ligand 3 (11-23)
cugcucuucgacuggagcggcaccgggagagccgaugcu

SEQ ID NO: 64056 - RNA, 27 nt, Artificial Sequence
  Sterol regulatory element-binding protein 2 (843-851)
cugcuccacagcuucguggacuccguc

SEQ ID NO: 64057 - RNA, 27 nt, Artificial Sequence
  Uncharacterized protein C18orf63 (124-132)
cugcucauccagggcagagacuuccuu

SEQ ID NO: 64058 - RNA, 27 nt, Artificial Sequence
  Transmembrane emp24 domain-containing protein 3 (78-86)
cugcucaagagcuucuuuaccgagaaa

SEQ ID NO: 64059 - RNA, 33 nt, Artificial Sequence
  Protein disulfide-isomerase A3 (14-24)
cugcuccuugccgcugcaagacuggccgcggcu

SEQ ID NO: 64060 - RNA, 27 nt, Artificial Sequence
  Peptidyl-prolyl cis-trans isomerase B (16-24)
cugcuccuucccggcccuagcgccgcu

SEQ ID NO: 64061 - RNA, 30 nt, Artificial Sequence
  Plasma alpha-L-fucosidase (19-28)
cugcuccuucccccuccaccgugccccgcc

SEQ ID NO: 64062 - RNA, 27 nt, Artificial Sequence
  PRKC apoptosis WT1 regulator protein (216-224)
cugcuccaggagcccccuagaaccgug

SEQ ID NO: 64063 - RNA, 30 nt, Artificial Sequence
  Chromodomain-helicase-DNA-binding protein 7 (695-704)
cugcucgugaacagccuuuucgccggcaug

SEQ ID NO: 64064 - RNA, 33 nt, Artificial Sequence; identical to SEQ ID NO: 39837
  Notchless protein homolog 1 (181-191)

SEQ ID NO: 64065 - RNA, 27 nt, Artificial Sequence
  Adenosine 3'-phospho 5'-phosphosulfate transporter 1 (251-259)
cugcucuacggccacaccgugacaguc

SEQ ID NO: 64066 - RNA, 27 nt, Artificial Sequence
  Activating signal cointegrator 1 complex subunit 1 (68-76)
cugcucuacaagcacaucgugggcaaa

SEQ ID NO: 64067 - RNA, 27 nt, Artificial Sequence
  DNA-dependent protein kinase catalytic subunit (3482-3490)
cugaugaccaaggagaucagcuccgug

SEQ ID NO: 64068 - RNA, 27 nt, Artificial Sequence
  Nucleus accumbens-associated protein 1 (343-351)
cugcccgccgagcucaucaaccagauu

SEQ ID NO: 64069 - RNA, 24 nt, Artificial Sequence
  Mothers against decapentaplegic homolog 2 (5-12)
cugcccuucaccccuccagugguc

SEQ ID NO: 64070 - RNA, 27 nt, Artificial Sequence
  Biorientation of chromosomes in cell division protein 1-like 1 (907-915)
cugcccaucagcuccgccaccacaauu

SEQ ID NO: 64071 - RNA, 27 nt, Artificial Sequence
  Catenin alpha-1 (553-561)
cugccccaggagcaaaaggccaaaauc

SEQ ID NO: 64072 - RNA, 27 nt, Artificial Sequence
  E3 ubiquitin-protein ligase RNF213 (5003-5011)
cugcccagcuccgugaucucugccauu

SEQ ID NO: 64073 - RNA, 24 nt, Artificial Sequence
  Eukaryotic translation initiation factor 3 subunit C-like protein (816-823)
cugcccaccgugcacagcaucauu

SEQ ID NO: 64074 - RNA, 24 nt, Artificial Sequence
  Regulation of nuclear pre-mRNA domain-containing protein 1A (190-197)
cugcccguggagguccaggaaguu

SEQ ID NO: 64075 - RNA, 27 nt, Artificial Sequence
  CDK5 and ABL1 enzyme substrate 2 (40-48)
cugcccuacggcgaggggcucagaauc

SEQ ID NO: 64076 - RNA, 27 nt, Artificial Sequence
  Collagen alpha-1(XII) chain (105-113)
cugcccuacaagggcgggaacacccuc

SEQ ID NO: 64077 - RNA, 27 nt, Artificial Sequence
  A-kinase anchor protein 1, mitochondrial (646-654)
cugcccuacacccagagcgugcaaauc

SEQ ID NO: 64078 - RNA, 27 nt, Artificial Sequence
  Putative tRNA (cytidine(32)/guanosine(34)-2'-O)-methyltransferase (30-38)
cugcagcucgacaaggaguuccaacuu

SEQ ID NO: 64079 - RNA, 27 nt, Artificial Sequence
  Double-stranded RNA-binding protein Staufen homolog 1 (119-127)
cugcagaacgagccccucccugaaaga

SEQ ID NO: 64080 - RNA, 30 nt, Artificial Sequence; identical to SEQ ID NO: 39853
  CD44 antigen (331-340)

SEQ ID NO: 64081 - RNA, 27 nt, Artificial Sequence
  Vimentin (44-52)
cugagacccagcaccuccaggucucuc

SEQ ID NO: 64082 - RNA, 27 nt, Artificial Sequence
  Protein CASC5 (113-121)
cugagcgcccccauccacacccagaug

SEQ ID NO: 64083 - RNA, 30 nt, Artificial Sequence
  Fibronectin type III domain-containing protein 3B (320-329)
cugagcgacaagggcagagaugggaaauac

SEQ ID NO: 64084 - RNA, 27 nt, Artificial Sequence
  Cytoplasmic dynein 1 heavy chain 1 (69-77)
cugagcgacccccaggugcacaccguc

SEQ ID NO: 64085 - RNA, 27 nt, Artificial Sequence
  Stress-induced-phosphoprotein 1 (194-202)
cugagcgaccccaccuacagagagcuc

SEQ ID NO: 64086 - RNA, 27 nt, Artificial Sequence
  Cytochrome c oxidase subunit 4 isoform 1, mitochondrial (131-139)
cugagcgaccccgugauccacucccuc

SEQ ID NO: 64087 - RNA, 33 nt, Artificial Sequence
  tRNA-splicing endonuclease subunit Sen54 (146-156)
cugaccgaccacacagugacuuuccuccaguac

SEQ ID NO: 64088 - RNA, 33 nt, Artificial Sequence
  Beta-galactosidase-1-like protein 2 (348-358)
cugaccgaggccggcgacuacacagcuaaguau

SEQ ID NO: 64089 - RNA, 24 nt, Artificial Sequence
  Serine/threonine-protein kinase 24 (284-291)
cugaccgagcucaucgacagauac

SEQ ID NO: 64090 - RNA, 27 nt, Artificial Sequence
  Endoplasmic reticulum-Golgi intermediate compartment protein 3 (39-47)
cugaccacagaggugcaccccgaacuc

SEQ ID NO: 64091 - RNA, 24 nt, Artificial Sequence
  POTE ankyrin domain family member F (708-715)
cuggugaucgacaacggcagcggg

SEQ ID NO: 64092 - RNA, 36 nt, Artificial Sequence
  CD44 antigen (399-410)
cuggugaacaaggagagcuccgaaacccccgaccag

SEQ ID NO: 64093 - RNA, 27 nt, Artificial Sequence
  Structural maintenance of chromosomes flexible hinge domain-containing protein 1 (857-865)
cuggugaccgacauccagcccguccuc

SEQ ID NO: 64094 - RNA, 27 nt, Artificial Sequence
  Cytoplasmic dynein 1 light intermediate chain 1 (179-187)
cugguguacaaguauaucguccagaaa

SEQ ID NO: 64095 - RNA, 27 nt, Artificial Sequence
  Protein archease (109-117)
cuguacaaguucagcgccgacgaguuu

SEQ ID NO: 64096 - RNA, 27 nt, Artificial Sequence
  Tumor protein D54 (125-133)
cuguacaagaaaacccaggagacacuc

SEQ ID NO: 64097 - RNA, 30 nt, Artificial Sequence
  CD109 antigen (139-148)
cuguacaagcccaaacaggaggugaaguuc

SEQ ID NO: 64098 - RNA, 27 nt, Artificial Sequence
  Ras-related GTP-binding protein C (292-300)
cuguaccucaaggaggugaccaaauuc

SEQ ID NO: 64099 - RNA, 27 nt, Artificial Sequence
  Exportin-5 (626-634)
cuguacaaccacgugaagcagcuccuu

SEQ ID NO: 64100 - RNA, 27 nt, Artificial Sequence
  Interferon-induced GTP-binding protein Mx2 (422-430)
cuguacaacaagaucagagaggacuuc

SEQ ID NO: 64101 - RNA, 27 nt, Artificial Sequence
  ATPase family AAA domain-containing protein 2 (447-455)
cuguaccccgagguguucgaaaaguuu

SEQ ID NO: 64102 - RNA, 27 nt, Artificial Sequence
  TELO2-interacting protein 2 (300-308)
cuguacacccccgagcaccaucucauc

SEQ ID NO: 64103 - RNA, 27 nt, Artificial Sequence
  Formin-binding protein 1-like (181-189)
auggccgacgagaacaagaaugaauac

SEQ ID NO: 64104 - RNA, 30 nt, Artificial Sequence
  Condensin complex subunit 1 (1002-1011)
auggagcugcucgacggcaagcagacccuu

SEQ ID NO: 64105 - RNA, 30 nt, Artificial Sequence
  Nucleoprotein TPR (1009-1018)
auggagguggaaaaggagaaacaggaacug

SEQ ID NO: 64106 - RNA, 33 nt, Artificial Sequence
  Eukaryotic translation initiation factor 2 subunit 2 (6-16)
augaucuucgaccccaccaugagcaagaaaaag

SEQ ID NO: 64107 - RNA, 27 nt, Artificial Sequence
  Melanoma-associated antigen D1 (497-505)
augcugagagacaucauuagggaguac

SEQ ID NO: 64108 - RNA, 30 nt, Artificial Sequence
  Cytochrome c oxidase subunit NDUFA4 (1-10)
augcugagacagaucauuggccaagccaag

SEQ ID NO: 64109 - RNA, 27 nt, Artificial Sequence
  Tetratricopeptide repeat protein 17 (580-588)
augcccgacgaucacgccagaaagauc

SEQ ID NO: 64110 - RNA, 24 nt, Artificial Sequence
  Protein polybromo-1 (426-433)
augcccaucagccugcagcaaauu

SEQ ID NO: 64111 - RNA, 30 nt, Artificial Sequence
  Cell division cycle protein 27 homolog (515-524)
augcaggccgagagaaucuucagcgaagug

SEQ ID NO: 64112 - RNA, 33 nt, Artificial Sequence
  CD44 antigen (412-422)
augaccgccgacgagacaagaaaccugcagaau

SEQ ID NO: 64113 - RNA, 33 nt, Artificial Sequence
  14-3-3 protein beta/alpha (1-11)
augaccauggacaagagcgagcuggugcagaaa

SEQ ID NO: 64114 - RNA, 27 nt, Artificial Sequence
  Centromere/kinetochore protein zw10 homolog (415-423)
augaccagcgagauccacaacacagug

SEQ ID NO: 64115 - RNA, 27 nt, Artificial Sequence
  Pyridoxal kinase (93-101)
augguggucgacaucguucaggagcug

SEQ ID NO: 64116 - RNA, 27 nt, Artificial Sequence
  Nucleoside diphosphate kinase (76-84)
auggugugggagggccugaacgucguu

SEQ ID NO: 64117 - RNA, 27 nt, Artificial Sequence
  Tyrosine-protein phosphatase non-receptor type 14 (204-212)
auguacaucaacgagguggaaagacug

SEQ ID NO: 64118 - RNA, 27 nt, Artificial Sequence
  Phosphatidate cytidylyltransferase 2 (308-316)
auguaccccuuccagauccacagcauu

SEQ ID NO: 64119 - RNA, 27 nt, Artificial Sequence
  M-phase phosphoprotein 8 (351-359)
aacgccuuccuggagaagaaaaccgug

SEQ ID NO: 64120 - RNA, 27 nt, Artificial Sequence
  E3 ubiquitin-protein ligase RNF213 (2663-2671)
aacgccuuccugagcaaguccucugug

SEQ ID NO: 64121 - RNA, 27 nt, Artificial Sequence
  H/ACA ribonucleoprotein complex subunit 4 (161-169)
aacgccaucgagggcgggacccagcug

SEQ ID NO: 64122 - RNA, 27 nt, Artificial Sequence
  Protein transport protein Sec31A (866-874)
aacgccuaccccaauaccccuuauauc

SEQ ID NO: 64123 - RNA, 27 nt, Artificial Sequence
  Ribonuclease P/MRP protein subunit POP5 (58-66)
aacgccuacaccggcaucgugcugcuc

SEQ ID NO: 64124 - RNA, 27 nt, Artificial Sequence
  Cytoplasmic dynein 1 heavy chain 1 (1442-1450)
aacgaggccaucgugaaggacguccug

SEQ ID NO: 64125 - RNA, 30 nt, Artificial Sequence
  Hsc70-interacting protein (314-323)
aacgagauccugagcgaccccgaagugcuc

SEQ ID NO: 64126 - RNA, 24 nt, Artificial Sequence
  DENN domain-containing protein 5A (694-701)
aacgagaucaccggccacacauac

SEQ ID NO: 64127 - RNA, 27 nt, Artificial Sequence
  Nucleoprotein TPR (857-865)
aacgagguggaacagagacacacccug

SEQ ID NO: 64128 - RNA, 27 nt, Artificial Sequence
  Serine/arginine repetitive matrix protein 2 (2175-2183)
aaccacgcccagagcagaaucgcucug

SEQ ID NO: 64129 - RNA, 27 nt, Artificial Sequence
  EH domain-containing protein 1 (209-217)
aaccacgaggacaagaucagagugguc

SEQ ID NO: 64130 - RNA, 30 nt, Artificial Sequence
  Nuclear receptor coactivator 6 (844-853)
aaccacuucagcggccaugggauguccuuu

SEQ ID NO: 64131 - RNA, 27 nt, Artificial Sequence
  UDP-N-acetylhexosamine pyrophosphorylase (327-335)
aacaucgccaaucacuucuuuaccgug

SEQ ID NO: 64132 - RNA, 27 nt, Artificial Sequence
  Mediator of RNA polymerase II transcription subunit 22 (67-75)
aacaucgugagagccggcgagagccug

SEQ ID NO: 64133 - RNA, 27 nt, Artificial Sequence
  Peroxisomal acyl-coenzyme A oxidase 1 (642-650)
aacaaggccgaggugcacgaaagcuac

SEQ ID NO: 64134 - RNA, 30 nt, Artificial Sequence
  FERM domain-containing protein 6 (261-270)
aaccuggacgaggaaaagcagcuccuuuac

SEQ ID NO: 64135 - RNA, 24 nt, Artificial Sequence
  WD repeat-containing protein 43 (333-340)
aaccugaucaagaaaaccgugcuc

SEQ ID NO: 64136 - RNA, 27 nt, Artificial Sequence
  C-terminal-binding protein 2 (784-792)
aaccugaaugagcacaaccaucaccuc

SEQ ID NO: 64137 - RNA, 33 nt, Artificial Sequence
  CD44 antigen (330-340)
aaccugcagaauguggacaugaagaucggcguc

SEQ ID NO: 64138 - RNA, 30 nt, Artificial Sequence
  E3 ubiquitin-protein ligase makorin-1 (292-301)
aaccccagcgagagaagguucggcauccug

SEQ ID NO: 64139 - RNA, 33 nt, Artificial Sequence
  Transcription factor COE2 (207-217)
aaccagggcuacaucagaaauaccagcuccauu

SEQ ID NO: 64140 - RNA, 27 nt, Artificial Sequence
  Interferon-induced GTP-binding protein Mx2 (643-651)
aaccagauccccuucauuauacaauac

SEQ ID NO: 64141 - RNA, 27 nt, Artificial Sequence
  Transportin-1 (49-57)
aaccaguaccccgacuucaauaacuau

SEQ ID NO: 64142 - RNA, 27 nt, Artificial Sequence
  Dolichyl-diphosphooligosaccharide-proteinosyltransferase 48 kDa subunit (395-403)
aacagacugggcuacacccaccucuau

SEQ ID NO: 64143 - RNA, 27 nt, Artificial Sequence
  TATA-binding protein-associated factor 2N (227-235)
aacagcgacaauaacaccaucuucgug

SEQ ID NO: 64144 - RNA, 27 nt, Artificial Sequence
  Niban-like protein 1 (154-162)
aacagcgaccccaaucugcaccuccuu

SEQ ID NO: 64145 - RNA, 27 nt, Artificial Sequence
  Serine/threonine-protein kinase TBK1 (330-338)
aacaccgccacaaucuuccacgagcug

SEQ ID NO: 64146 - RNA, 30 nt, Artificial Sequence
  GREB1-like protein (1697-1706)
aacaccgaccugacacagaaugugcaauac

SEQ ID NO: 64147 - RNA, 30 nt, Artificial Sequence; identical to SEQ ID NO: 39920
  Eukaryotic translation initiation factor 3 subunit C-like protein (462-471)

SEQ ID NO: 64148 - RNA, 30 nt, Artificial Sequence
  Guanine deaminase (328-337)
aacaccgacagacccggcggguacagcuau

SEQ ID NO: 64149 - RNA, 30 nt, Artificial Sequence
  26S proteasome non-ATPase regulatory subunit 13 (227-236)
aacaccgacagacaguggcugaucgauaca

SEQ ID NO: 64150 - RNA, 33 nt, Artificial Sequence
  Polypyrimidine tract-binding protein 1 (102-112)
aacaccgaggaagccgcuaauacaauggugaac

SEQ ID NO: 64151 - RNA, 27 nt, Artificial Sequence
  MOB kinase activator 1A (60-68)
aacaccguggacuucuuuaaucagauc

SEQ ID NO: 64152 - RNA, 27 nt, Artificial Sequence
  Vesicular integral-membrane protein VIP36 (305-313)
aacguggacgaucccaccggcaauuuc

SEQ ID NO: 64153 - RNA, 33 nt, Artificial Sequence
  Dynactin subunit 6 (105-115)
aacgugaucgagagcaaggccuacgucggcaga

SEQ ID NO: 64154 - RNA, 27 nt, Artificial Sequence
  Sperm-associated antigen 16 protein (89-97)
aacgugcccgacgucuacacccagauc

SEQ ID NO: 64155 - RNA, 27 nt, Artificial Sequence
  Activity-dependent neuroprotector homeobox protein (450-458)
aacuacaucaugaagauucacaauuuc

SEQ ID NO: 64156 - RNA, 27 nt, Artificial Sequence
  Abelson tyrosine-protein kinase 2 (124-132)
aacuacaucacccccgugaauagccug

SEQ ID NO: 64157 - RNA, 27 nt, Artificial Sequence
  Opioid growth factor receptor (195-203)
aacuaccagaagagauuccaaaaucug

SEQ ID NO: 64158 - RNA, 27 nt, Artificial Sequence
  DNA-directed RNA polymerase II subunit RPB4 (66-74)
aacuacaccgccagauucagcagguuu

SEQ ID NO: 64159 - RNA, 30 nt, Artificial Sequence
  BTB/POZ domain-containing adapter for CUL3-mediated RhoA degradation protein 3 (245-254)
cccgaggccagaaucuacgaagagacccug

SEQ ID NO: 64160 - RNA, 27 nt, Artificial Sequence
  Ubiquitin-like modifier-activating enzyme 7 (898-906)
cccuucgccccugcuauccagaccuuu

SEQ ID NO: 64161 - RNA, 27 nt, Artificial Sequence
  Short-chain dehydrogenase/reductase 3 (219-227)
cccuuccacaccagcacagagauguuu

SEQ ID NO: 64162 - RNA, 30 nt, Artificial Sequence
  Nodal modulator 2 (293-302)
cccuucuacagaggcgagaggaucaccuuu

SEQ ID NO: 64163 - RNA, 30 nt, Artificial Sequence
  Beta-2-microglobulin (110-119)
cccaagaucgugaaaugggacagagauaug

SEQ ID NO: 64164 - RNA, 27 nt, Artificial Sequence
  Proteasomal ubiquitin receptor ADRM1 (86-94)
ccccagugcccuagcggcagaguguac

SEQ ID NO: 64165 - RNA, 36 nt, Artificial Sequence
  NADH dehydrogenase (ubiquinone) 1 alpha subcomplex subunit 3 (73-84)
ccccagggcccuagccuggaguggcucaagaaacuu

SEQ ID NO: 64166 - RNA, 27 nt, Artificial Sequence
  Signal recognition particle 9 kDa protein (2-10)
ccccaguaccaaaccugggaggaauuc

SEQ ID NO: 64167 - RNA, 30 nt, Artificial Sequence; identical to SEQ ID NO: 39940
  Gamma-aminobutyric acid receptor-associated protein (52-61)

SEQ ID NO: 64168 - RNA, 33 nt, Artificial Sequence
  B-cell CLL/lymphoma 9-like protein (1331-1341)
cccagcgagaagccuuccucuacccugcaguac

SEQ ID NO: 64169 - RNA, 27 nt, Artificial Sequence
  Retroviral-like aspartic protease 1 (314-322)
cccgugggcgggagccuggaggacgaa

SEQ ID NO: 64170 - RNA, 27 nt, Artificial Sequence
  Procollagen-lysine,2-oxoglutarate 5-dioxygenase 3 (459-467)
cccuacaucagccaggccuaugugauu

SEQ ID NO: 64171 - RNA, 27 nt, Artificial Sequence
  Telomerase protein component 1 (1087-1095)
cccuacgugggcgggcuggaggaauuc

SEQ ID NO: 64172 - RNA, 27 nt, Artificial Sequence
  U5 small nuclear ribonucleoprotein 200 kDa helicase (643-651)
caggaggacgugagacugaucggccuc

SEQ ID NO: 64173 - RNA, 27 nt, Artificial Sequence
  Ras GTPase-activating protein-binding protein 1 (211-219)
caggaggaaaagcccgagccugugcug

SEQ ID NO: 64174 - RNA, 27 nt, Artificial Sequence
  Threonylcarbamoyladenosine tRNA methylthiotransferase (57-65)
caggaggaaaacaagaaaaucgugcug

SEQ ID NO: 64175 - RNA, 30 nt, Artificial Sequence
  Eukaryotic translation initiation factor 3 subunit K (94-103)
caggaggaaagacccaucaggcaaauucug

SEQ ID NO: 64176 - RNA, 36 nt, Artificial Sequence
  RNA polymerase II subunit A C-terminal domain phosphatase SSU72 (177-188)
caggaguucgaagagaagagcggcagaaccuuucug

SEQ ID NO: 64177 - RNA, 27 nt, Artificial Sequence
  Clathrin heavy chain 1 (10-18)
caggagcaccugcaacuccagaaccuu

SEQ ID NO: 64178 - RNA, 27 nt, Artificial Sequence
  Bifunctional arginine demethylase and lysyl-hydroxylase JMJD6 (356-364)
caggagcaccccgaacuggccgugcuc

SEQ ID NO: 64179 - RNA, 30 nt, Artificial Sequence
  F-box only protein 11 (141-150)
caggagaagcugcccgacgaagugguccuc

SEQ ID NO: 64180 - RNA, 30 nt, Artificial Sequence
  protein PET100 homolog, mitochondrial (48-57)
caggagcuggaagaguucaaggaaagacuc

SEQ ID NO: 64181 - RNA, 30 nt, Artificial Sequence; identical to SEQ ID NO: 39954
  Protein SHQ1 homolog (236-245)

SEQ ID NO: 64182 - RNA, 30 nt, Artificial Sequence
  Histone-lysine N-methyltransferase SETD7 (253-262)
caggagguggacagcagagauugggcccug

SEQ ID NO: 64183 - RNA, 27 nt, Artificial Sequence
  Neutral amino acid transporter B(0) (224-232)
caggagguggaaggcaugaacauccug

SEQ ID NO: 64184 - RNA, 27 nt, Artificial Sequence
  Uridine-cytidine kinase 2 (143-151)
caggaggugagagaccuguuccaaaug

SEQ ID NO: 64185 - RNA, 27 nt, Artificial Sequence
  WD repeat-containing protein 3 (640-648)
caguucgugcccaagagccaccuguuu

SEQ ID NO: 64186 - RNA, 27 nt, Artificial Sequence
  Niban-like protein 1 (79-87)
cagaucagcauucccuuccugcucaag

SEQ ID NO: 64187 - RNA, 27 nt, Artificial Sequence
  Rho-associated protein kinase 2 (563-571)
cagcuggacgagaccaacgcccuccuu

SEQ ID NO: 64188 - RNA, 27 nt, Artificial Sequence
  Ras-associated and pleckstrin homology domains-containing protein 1 (496-504)
cagcuggaccacgugaacgucuacuau

SEQ ID NO: 64189 - RNA, 27 nt, Artificial Sequence
  Disco-interacting protein 2 homolog A (1561-1569)
cagcuggaccccaucuacguggccuau

SEQ ID NO: 64190 - RNA, 27 nt, Artificial Sequence
  Transcription elongation factor SPT5 (537-545)
cagcuggacccccaaaccgugggcguc

SEQ ID NO: 64191 - RNA, 27 nt, Artificial Sequence
  Transcriptional repressor CTCF (65-73)
cagcuggaccccacccuccuucaaaug

SEQ ID NO: 64192 - RNA, 27 nt, Artificial Sequence
  Ubiquitin-40S ribosomal protein S27a (69-77)
cagcuggaggacggcagaacccucagc

SEQ ID NO: 64193 - RNA, 27 nt, Artificial Sequence
  Mortality factor 4-like protein 2 (145-153)
cagcuguuccaacuccccgccaagaaa

SEQ ID NO: 64194 - RNA, 30 nt, Artificial Sequence
  Transitional endoplasmic reticulum ATPase (50-59)
cagcuguucagaggcgacaccgugcuccuu

SEQ ID NO: 64195 - RNA, 33 nt, Artificial Sequence
  Transitional endoplasmic reticulum ATPase (50-60)
cagcuguucagaggcgacaccgugcuccuuaag

SEQ ID NO: 64196 - RNA, 30 nt, Artificial Sequence; identical to SEQ ID NO: 39969
  Mitofusin-2 (172-181)

SEQ ID NO: 64197 - RNA, 27 nt, Artificial Sequence
  Kinesin-like protein KIF15 (1210-1218)
cagcugaucgagaagaacuggcuccuu

SEQ ID NO: 64198 - RNA, 27 nt, Artificial Sequence
  Cleavage and polyadenylation specificity factor subunit 2 (95-103)
cagcugcucgaccaaaucuggagaacc

SEQ ID NO: 64199 - RNA, 27 nt, Artificial Sequence
  Eukaryotic translation initiation factor 4 gamma 1 (739-747)
cagcugaugaagcaagugacccagcuc

SEQ ID NO: 64200 - RNA, 27 nt, Artificial Sequence
  Lanosterol 14-alpha demethylase (218-226)
cagcugaacgagaagguggcccaacuc

SEQ ID NO: 64201 - RNA, 27 nt, Artificial Sequence
  Pleckstrin homology-like domain family B member 1 (775-783)
cagcugcaagagaagcucguggcccuu

SEQ ID NO: 64202 - RNA, 27 nt, Artificial Sequence
  WD and tetratricopeptide repeats protein 1 (274-282)
cagcuguacagcaaggccgugcaaaga

SEQ ID NO: 64203 - RNA, 27 nt, Artificial Sequence
  Zinc finger protein ubi-d4 (70-78)
cagcuguacagcuaucccgccagaagg

SEQ ID NO: 64204 - RNA, 27 nt, Artificial Sequence
  KxDL motif-containing protein 1 (65-73)
cagaugagcgagagauuccugcaccau

SEQ ID NO: 64205 - RNA, 27 nt, Artificial Sequence
  Helicase with zinc finger domain 2 (1555-1563)
cagcccgccccuagaagccaacagcug

SEQ ID NO: 64206 - RNA, 27 nt, Artificial Sequence
  V-type proton ATPase subunit B, brain isoform (42-50)
cagcccagacugaccuacaagacagug

SEQ ID NO: 64207 - RNA, 30 nt, Artificial Sequence
  Transmembrane protein 160 (91-100)
cagagcgacaugggcagagaggccgcuuac

SEQ ID NO: 64208 - RNA, 27 nt, Artificial Sequence
  Synaptotagmin-like protein 2 (379-387)
cagagcgaccccaagccuucccaauac

SEQ ID NO: 64209 - RNA, 30 nt, Artificial Sequence
  Very long-chain specific acyl-CoA dehydrogenase, mitochondrial (600-609)
cagagcgaccccuggcaacaggagcuguac

SEQ ID NO: 64210 - RNA, 27 nt, Artificial Sequence
  E3 ubiquitin-protein ligase TRAF7 (293-301)
cagaccgacgauagauuccacgagaug

SEQ ID NO: 64211 - RNA, 27 nt, Artificial Sequence
  WD repeat and FYVE domain-containing protein 3 (796-804)
cagaccgacgagagacuggcccaauac

SEQ ID NO: 64212 - RNA, 30 nt, Artificial Sequence
  Tetratricopeptide repeat protein 19, mitochondrial (128-137)
cagaccgacaacaagaaagccaucacauac

SEQ ID NO: 64213 - RNA, 33 nt, Artificial Sequence
  Nuclear pore complex protein Nup133 (878-888)
cagaccgacaaccaaagcagacugcagagguac

SEQ ID NO: 64214 - RNA, 27 nt, Artificial Sequence
  Signal recognition particle receptor subunit beta (32-40)
cagaccgaccccacacugcucagcgug

SEQ ID NO: 64215 - RNA, 27 nt, Artificial Sequence
  Helicase with zinc finger domain 2 (612-620)
cagaccgaccccgugacacugcaauac

SEQ ID NO: 64216 - RNA, 27 nt, Artificial Sequence
  Small G protein signaling modulator 3 (245-253)
cagaccgaccaaagagugcugaggcac

SEQ ID NO: 64217 - RNA, 30 nt, Artificial Sequence
  SWI/SNF-related matrix-associated actin-dependent regulator of chromatin subfamily A member 5 (85-94)
cagaccgacagagccaacagguucgaguac

SEQ ID NO: 64218 - RNA, 30 nt, Artificial Sequence
  Sodium-dependent lysophosphatidylcholine symporter 1 (104-113)
cagaccgagagagacagcgccacagcuuac

SEQ ID NO: 64219 - RNA, 27 nt, Artificial Sequence
  Ras GTPase-activating-like protein IQGAP1 (980-988)
cagaccaaccccacauaccuggccaag

SEQ ID NO: 64220 - RNA, 27 nt, Artificial Sequence
  Mitochondrial-processing peptidase subunit alpha (144-152)
cagaccagcagagacacaacuauguac

SEQ ID NO: 64221 - RNA, 27 nt, Artificial Sequence
  DNA-directed RNA polymerase III subunit RPC5 (106-114)
cagaccacaagcaacacuuccagauac

SEQ ID NO: 64222 - RNA, 27 nt, Artificial Sequence
  Catenin beta-1 (78-86)
cagguggccgacaucgauggccaauac

SEQ ID NO: 64223 - RNA, 27 nt, Artificial Sequence
  Regulator of microtubule dynamics protein 1 (253-261)
cagguggaccccaacuucuacagcaag

SEQ ID NO: 64224 - RNA, 30 nt, Artificial Sequence
  Cell division cycle protein 27 homolog (594-603)
cagguggaccccaacuacgccuaugcuuac

SEQ ID NO: 64225 - RNA, 42 nt, Artificial Sequence
  Protein Tob2 (303-316)
cagguguucggcgggggagccaacagccuguuucucgagaag

SEQ ID NO: 64226 - RNA, 33 nt, Artificial Sequence
  UPF0488 protein C8orf33 (189-199)
caggugcaacccgucgacggcgccaccagaaag

SEQ ID NO: 64227 - RNA, 27 nt, Artificial Sequence
  Dynamin-like 120 kDa protein, mitochondrial (858-866)
cagguguacagaaggcacuuccugaag

SEQ ID NO: 64228 - RNA, 27 nt, Artificial Sequence
  Zinc finger MIZ domain-containing protein 2 (283-291)
caguacgcccccagcaccgcucaauuc

SEQ ID NO: 64229 - RNA, 27 nt, Artificial Sequence
  HEAT repeat-containing protein 6 (870-878)
caguacgccagaaucuggaacgcucug

SEQ ID NO: 64230 - RNA, 27 nt, Artificial Sequence
  Ubiquitin carboxyl-terminal hydrolase 48 (677-685)
caguacuuccccaaggccccugaguuu

SEQ ID NO: 64231 - RNA, 27 nt, Artificial Sequence
  DNA-directed RNA polymerase III subunit RPC2 (60-68)
caguacaaggacgugcccaucaccuau

SEQ ID NO: 64232 - RNA, 33 nt, Artificial Sequence
  Negative elongation factor A (142-152)
caguaccugaacaagaaugcccucaccacacuu

SEQ ID NO: 64233 - RNA, 27 nt, Artificial Sequence
  Laminin subunit alpha-4 (1299-1307)
caguacaacgacggccugagccacuuc

SEQ ID NO: 64234 - RNA, 27 nt, Artificial Sequence
  Protein spire homolog 1 (293-301)
caguacaacccccugccuaucgaguau

SEQ ID NO: 64235 - RNA, 27 nt, Artificial Sequence
  Protein transport protein Sec61 subunit alpha isoform 1 (275-283)
caguacaacaccuaucccaucaagcug

SEQ ID NO: 64236 - RNA, 30 nt, Artificial Sequence
  Protein transport protein Sec61 subunit alpha isoform 1 (275-284)
caguacaacaccuaucccaucaagcuguuc

SEQ ID NO: 64237 - RNA, 27 nt, Artificial Sequence
  Gem-associated protein 5 (1174-1182)
caguaccaagaggccuuccagaagcug

SEQ ID NO: 64238 - RNA, 27 nt, Artificial Sequence
  E3 ubiquitin-protein ligase RNF213 (2046-2054)
caguaccaaaaggugcccguccuguuc

SEQ ID NO: 64239 - RNA, 27 nt, Artificial Sequence
  Spectrin beta chain, non-erythrocytic 2 (18-26)
caguacagcgacaucaacaauagaugg

SEQ ID NO: 64240 - RNA, 27 nt, Artificial Sequence
  Ubiquitin-like modifier-activating enzyme 1 (717-725)
caguacagcaacaauaucagacaacug

SEQ ID NO: 64241 - RNA, 27 nt, Artificial Sequence
  Phosphatidylinositol transfer protein beta isoform (56-64)
caguacacccacaagaucuaucaucug

SEQ ID NO: 64242 - RNA, 27 nt, Artificial Sequence
  Laminin subunit gamma-1 (6-14)
agagccgcucccgcacugaggccucgg

SEQ ID NO: 64243 - RNA, 27 nt, Artificial Sequence
  CCAAT/enhancer-binding protein beta (62-70)
agagccaucgacuucagccccuaccug

SEQ ID NO: 64244 - RNA, 33 nt, Artificial Sequence
  X-ray repair cross-complementing protein 6 (586-596)
agagccuacggccugaagagcgggcucaaaaag

SEQ ID NO: 64245 - RNA, 27 nt, Artificial Sequence
  Filamin-B (649-657)
agagccuacggccccgggcuggagaag

SEQ ID NO: 64246 - RNA, 27 nt, Artificial Sequence
  Ras and Rab interactor 2 (179-187)
agagacgugcugcccuucacccucaag

SEQ ID NO: 64247 - RNA, 33 nt, Artificial Sequence
  Glutamine-tRNA ligase (34-44)
agagaggccgcuacccaggcacaacagacacug

SEQ ID NO: 64248 - RNA, 33 nt, Artificial Sequence
  Pre-mRNA-processing-splicing factor 8 (1275-1285)
agagaggccguggucaacacccaggaacugcuc

SEQ ID NO: 64249 - RNA, 27 nt, Artificial Sequence
  TFIIH basal transcription factor complex helicase XPB subunit (472-480)
agagaggacgauaagaucguggaccug

SEQ ID NO: 64250 - RNA, 33 nt, Artificial Sequence
  Nuclear pore complex protein Nup107 (142-152)
agagaggacgaucccggcgaagccgcuagcaug

SEQ ID NO: 64251 - RNA, 30 nt, Artificial Sequence
  Translationally-controlled tumor protein (152-161)
agagaggacggcgugacccccuacaugauc

SEQ ID NO: 64252 - RNA, 27 nt, Artificial Sequence
  Catenin beta-1 (457-465)
agagaggacaucaccgaacccgccauu

SEQ ID NO: 64253 - RNA, 36 nt, Artificial Sequence
  Histone-lysine N-methyltransferase 2D (2065-2076)
agagaggaccccggcaccgggaugggaagcucccug

SEQ ID NO: 64254 - RNA, 33 nt, Artificial Sequence
  Protein ELYS (1949-1959)
agagaggacagcaaccuggaauccucucagcuc

SEQ ID NO: 64255 - RNA, 33 nt, Artificial Sequence
  DNA damage-inducible transcript 4 protein (39-49)
agagaggaaggcuucgacaggagcaccucccug

SEQ ID NO: 64256 - RNA, 30 nt, Artificial Sequence
  Protein THEMIS2 (210-219)
agagaggaaaaccccgaguucaccagccug

SEQ ID NO: 64257 - RNA, 30 nt, Artificial Sequence
  Serine/threonine-protein phosphatase 2B catalytic subunit beta isoform (441-450)
agagaggaaagcgaguccgugcugacccuc

SEQ ID NO: 64258 - RNA, 30 nt, Artificial Sequence
  Poly(rC)-binding protein 2 (40-49)
agagaggaaagcggcgccaggaucaacauu

SEQ ID NO: 64259 - RNA, 30 nt, Artificial Sequence
  Vigilin (608-617)
agagaggaaagcaacaccaagaucgaccug

SEQ ID NO: 64260 - RNA, 27 nt, Artificial Sequence
  Double-strand-break repair protein rad21 homolog (146-154)
agagaggaagugggcaacaucagcauu

SEQ ID NO: 64261 - RNA, 27 nt, Artificial Sequence
  U3 small nucleolar RNA-associated protein 14 homolog A (370-378)
agagaguucgaagagaggcggagccug

SEQ ID NO: 64262 - RNA, 33 nt, Artificial Sequence
  ADP-ribose pyrophosphatase, mitochondrial (229-239)
agagaguucggcgaagaggcccugaacagccuc

SEQ ID NO: 64263 - RNA, 27 nt, Artificial Sequence
  Procollagen-lysine,2-oxoglutarate 5-dioxygenase 2 (100-108)
agagaguucaucgcccccgugacccug

SEQ ID NO: 64264 - RNA, 30 nt, Artificial Sequence
  Peptidyl-prolyl cis-trans isomerase FKBP14 (202-211)
agagaguucaccuacaagcacgacgaacug

SEQ ID NO: 64265 - RNA, 27 nt, Artificial Sequence
  Splicing factor 3B subunit 1 (390-398)
agagagaucgacgaaaggaaccggccc

SEQ ID NO: 64266 - RNA, 30 nt, Artificial Sequence
  Nucleolin (546-555)
agagagaucgaaggcagggccauucggcug

SEQ ID NO: 64267 - RNA, 27 nt, Artificial Sequence
  Cytoplasmic dynein 1 heavy chain 1 (254-262)
agagagauccagaaggugaccaaacug

SEQ ID NO: 64268 - RNA, 33 nt, Artificial Sequence
  Death-associated protein kinase 3 (69-79)
agagagaucaggcaccccaacauuauaacccug

SEQ ID NO: 64269 - RNA, 30 nt, Artificial Sequence
  E3 ubiquitin-protein ligase BRE1B (440-449)
agagagaaggacgaugccaacuucaaacug

SEQ ID NO: 64270 - RNA, 27 nt, Artificial Sequence
  Transcription factor AP-2 alpha (Activating enhancer binding protein 2 alpha), isoform CRA_c (266-274)
agagagaagcuggacaaaaucggccuc

SEQ ID NO: 64271 - RNA, 27 nt, Artificial Sequence
  Putative pituitary tumor-transforming gene 3 protein (153-161)
agagagcuggaaaagcucuuccagcuu

SEQ ID NO: 64272 - RNA, 30 nt, Artificial Sequence
  Guanine nucleotide-binding protein G(I)/G(S)/G(T) subunit beta-2 (137-146)
agagagcugcccggccacaccggguaccuc

SEQ ID NO: 64273 - RNA, 30 nt, Artificial Sequence
  Glycosylphosphatidylinositol anchor attachment 1 protein (565-574)
agagagcugcaggaagccccccucagccuu

SEQ ID NO: 64274 - RNA, 30 nt, Artificial Sequence
  Ataxin-10 (119-128)
agagagcugaggguggaacaggagagccuc

SEQ ID NO: 64275 - RNA, 30 nt, Artificial Sequence
  TSC22 domain family protein 3 (77-86)
agagagcugguggaaaagaacagccagcuc

SEQ ID NO: 64276 - RNA, 33 nt, Artificial Sequence
  Src substrate cortactin (59-69)
agagagaacguguuccaggaacaccaaacccug

SEQ ID NO: 64277 - RNA, 33 nt, Artificial Sequence
  WW domain-containing transcription regulator protein 1 (308-318)
agagagcagagcaccgacuccggccuggggcuc

SEQ ID NO: 64278 - RNA, 27 nt, Artificial Sequence
  Endoplasmin (427-435)
agagagacccugcagcaacacaagcuc

SEQ ID NO: 64279 - RNA, 30 nt, Artificial Sequence
  Rho guanine nucleotide exchange factor 2 (633-642)
agagagguggaaggccugaaggaccuccuu

SEQ ID NO: 64280 - RNA, 27 nt, Artificial Sequence
  Bifunctional methylenetetrahydrofolate dehydrogenase/cyclohydrolase, mitochondrial (337-345)
agagaggugcugaagagcaaagaacuc

SEQ ID NO: 64281 - RNA, 27 nt, Artificial Sequence
  Phosphoserine aminotransferase (319-327)
agauuccuggacaaggcccucgagcuu

SEQ ID NO: 64282 - RNA, 30 nt, Artificial Sequence
  AP-5 complex subunit sigma-1 (172-181)
agauuccugccccacggccagcuccuuuuu

SEQ ID NO: 64283 - RNA, 27 nt, Artificial Sequence
  Arf-GAP with coiled-coil, ANK repeat and PH domain-containing protein 2 (770-778)
agauuccagcaagacagccagaaguuu

SEQ ID NO: 64284 - RNA, 27 nt, Artificial Sequence
  NADH dehydrogenase (ubiquinone) 1 beta subcomplex subunit 5, mitochondrial (61-69)
agauucuacgacaggcgguuucugaag

SEQ ID NO: 64285 - RNA, 33 nt, Artificial Sequence
  Putative helicase MOV-10 (450-460)
agaggccuggacgauaucaaggaccucaaagug

SEQ ID NO: 64286 - RNA, 33 nt, Artificial Sequence
  Protein EFR3 homolog A (165-175)
agaaucgccggcauuagggggauacagggagug

SEQ ID NO: 64287 - RNA, 33 nt, Artificial Sequence
  Nuclear cap-binding protein subunit 1 (194-204)
agaaucuucgccaacaccgagagcuaccugaag

SEQ ID NO: 64288 - RNA, 27 nt, Artificial Sequence
  Transcription cofactor vestigial-like protein 4 (79-87)
agaaucuucaacccccaccugaauaag

SEQ ID NO: 64289 - RNA, 27 nt, Artificial Sequence
  Tubulin polyglutamylase TTLL7 (765-773)
agaaucuucaacaggguguuuaaucgg

SEQ ID NO: 64290 - RNA, 30 nt, Artificial Sequence
  Centrosomal protein of 192 kDa (1349-1358)
agaaucuuccccgacaaguuugugcugaaa

SEQ ID NO: 64291 - RNA, 27 nt, Artificial Sequence
  V-type proton ATPase subunit B, brain isoform (380-388)
agaaucuuccccaaggagaugcugaaa

SEQ ID NO: 64292 - RNA, 27 nt, Artificial Sequence
  COUP transcription factor 2 (293-301)
agaaucuuccaggagcaaguggaaaag

SEQ ID NO: 64293 - RNA, 27 nt, Artificial Sequence
  BolA-like protein 3 (99-107)
agaaucuucaccagcgugcccaagagg

SEQ ID NO: 64294 - RNA, 30 nt, Artificial Sequence
  Serine/threonine-protein kinase PLK2 (71-80)
agaaucauuguggaccccaccacaggcaag

SEQ ID NO: 64295 - RNA, 27 nt, Artificial Sequence
  Exostosin-2 (166-174)
agaaucaaggagaccgcccaggcuaug

SEQ ID NO: 64296 - RNA, 33 nt, Artificial Sequence
  Calcium-independent phospholipase A2-gamma (131-141)
agaaucaagagcacccugaacuccgugucuaaa

SEQ ID NO: 64297 - RNA, 33 nt, Artificial Sequence
  Inactive tyrosine-protein kinase 7 (630-640)
agaauccuggaccccaccaagcucggcccuagg

SEQ ID NO: 64298 - RNA, 33 nt, Artificial Sequence
  MORC family CW-type zinc finger protein 3 (659-669)
agaauccuggagaugaacgacaaguacgugaaa

SEQ ID NO: 64299 - RNA, 27 nt, Artificial Sequence
  Eukaryotic translation initiation factor 3 subunit C-like protein (507-515)
agaauccugcacaccuacuauaaguuc

SEQ ID NO: 64300 - RNA, 30 nt, Artificial Sequence
  DNA polymerase alpha subunit B (497-506)
agaauccugaagcacauucucacccagagg

SEQ ID NO: 64301 - RNA, 27 nt, Artificial Sequence
  Chromodomain-helicase-DNA-binding protein 4 (623-631)
agaauccugaaccacagcguggacaag

SEQ ID NO: 64302 - RNA, 27 nt, Artificial Sequence
  Catechol O-methyltransferase (58-66)
agaauccugaaccacgugcuccagcau

SEQ ID NO: 64303 - RNA, 30 nt, Artificial Sequence
  Cleavage stimulation factor subunit 2 tau variant (180-189)
agaaucauggaccccgagauugcccugaag

SEQ ID NO: 64304 - RNA, 27 nt, Artificial Sequence
  Rho GTPase-activating protein 7 (278-286)
agaaucaacgugcccauggucaggaag

SEQ ID NO: 64305 - RNA, 33 nt, Artificial Sequence
  Pleckstrin homology domain-containing family A member 5 (177-187)
agaauccaggacgugauggagggccugagcaag

SEQ ID NO: 64306 - RNA, 27 nt, Artificial Sequence
  ATP-dependent RNA helicase DDX19B (454-462)
agaauccaggagcacuucaacaagaaa

SEQ ID NO: 64307 - RNA, 27 nt, Artificial Sequence
  Dolichyl-diphosphooligosaccharide-proteinosyltransferase subunit DAD1 (74-82)
agaauccagauuaacccccaaaauaag

SEQ ID NO: 64308 - RNA, 27 nt, Artificial Sequence
  Dynamin-like 120 kDa protein, mitochondrial (500-508)
agaauccagcaaauuauagagggcaag

SEQ ID NO: 64309 - RNA, 33 nt, Artificial Sequence
  Coronin-2B (108-118)
agaaucugggagauucccgaaggcgggcugaag

SEQ ID NO: 64310 - RNA, 36 nt, Artificial Sequence
  Coronin-2B (113-124)
agaaucugggagauucccgaaggcgggcugaagagg

SEQ ID NO: 64311 - RNA, 27 nt, Artificial Sequence
  E3 ubiquitin-protein ligase HECTD1 (480-488)
agaaucugggagcccaccuacacaauu

SEQ ID NO: 64312 - RNA, 30 nt, Artificial Sequence
  Protein kinase C iota type (269-278)
agaaucuacgccaugaagguggucaaaaag

SEQ ID NO: 64313 - RNA, 30 nt, Artificial Sequence
  DNA dC-dU-editing enzyme APOBEC-3B (119-128)
agaaucuacgacuaugauccccuguacaag

SEQ ID NO: 64314 - RNA, 36 nt, Artificial Sequence
  Fragile X mental retardation syndrome-related protein 1 (263-274)
agaaucuacggcgagagcgccgacgcugugaagaaa

SEQ ID NO: 64315 - RNA, 33 nt, Artificial Sequence
  Arpin (3-13)
agaaucuaccacgacggcgcccugaggaacaag

SEQ ID NO: 64316 - RNA, 27 nt, Artificial Sequence
  Long-chain-fatty-acid-CoA ligase 3 (389-397)
agaaucuacaagaacgugaugaauaaa

SEQ ID NO: 64317 - RNA, 36 nt, Artificial Sequence
  Reticulon-1 (565-576)
agaaucuacaagagcgugcugcaggccguccaaaaa

SEQ ID NO: 64318 - RNA, 27 nt, Artificial Sequence
  Protein MMS22-like (284-292)
agaaucuacagcaaguuccaccagaaa

SEQ ID NO: 64319 - RNA, 33 nt, Artificial Sequence
  Cytoplasmic dynein 1 heavy chain 1 (1603-1613)
agacuggccgaccuccuuggcaagauccagaaa

SEQ ID NO: 64320 - RNA, 27 nt, Artificial Sequence
  NADH dehydrogenase (ubiquinone) 1 beta subcomplex subunit 4 (36-44)
agacuggccaucagggcucagcucaag

SEQ ID NO: 64321 - RNA, 27 nt, Artificial Sequence
  Vacuolar protein sorting-associated protein 51 homolog (159-167)
agacuggcccagcaacucaggcagcgg

SEQ ID NO: 64322 - RNA, 27 nt, Artificial Sequence
  Replication initiator 1 (39-47)
agacuggccagccuccaguccgaggug

SEQ ID NO: 64323 - RNA, 27 nt, Artificial Sequence
  HEAT repeat-containing protein 2 (751-759)
agacuggacgaugugagcaacgacguc

SEQ ID NO: 64324 - RNA, 27 nt, Artificial Sequence
  Arf-GAP with Rho-GAP domain, ANK repeat and PH domain-containing protein 1 (106-114)
agacuggacaccgaucaccucagguac

SEQ ID NO: 64325 - RNA, 30 nt, Artificial Sequence
  Centrosomal protein of 41 kDa (29-38)
agacuggacaccggcaacagcaugacaaag

SEQ ID NO: 64326 - RNA, 27 nt, Artificial Sequence
  Protein flightless-1 homolog (672-680)
agacuguucgccgagaagaucaacaaa

SEQ ID NO: 64327 - RNA, 27 nt, Artificial Sequence
  Elongator complex protein 2 (264-272)
agacuguucgcccccuggaagaggaaa

SEQ ID NO: 64328 - RNA, 27 nt, Artificial Sequence
  NEDD8-conjugating enzyme Ubc12 (158-166)
agacuguucgagcagaacgugcaaagg

SEQ ID NO: 64329 - RNA, 27 nt, Artificial Sequence
  Synaptonemal complex protein SC65 (104-112)
agacuguucggcagggugcucgagcgg

SEQ ID NO: 64330 - RNA, 27 nt, Artificial Sequence
  Plectin (177-185)
agacuguucaacgccaucauucacagg

SEQ ID NO: 64331 - RNA, 30 nt, Artificial Sequence
  Transformation/transcription domain-associated protein (1453-1462)
agacuguuccccaacagcuuuaaugacaag

SEQ ID NO: 64332 - RNA, 30 nt, Artificial Sequence
  Zinc finger protein ZXDC (460-469)
agacuguucaccagcaagcacuccaugaaa

SEQ ID NO: 64333 - RNA, 27 nt, Artificial Sequence
  Insulin-degrading enzyme (683-691)
agacugcacaucgaggcccuccuucau

SEQ ID NO: 64334 - RNA, 33 nt, Artificial Sequence
  Proteasome subunit alpha type-4 (20-30)
agacugaucgcccagagguaccuccuucaauau

SEQ ID NO: 64335 - RNA, 30 nt, Artificial Sequence
  Probable ATP-dependent RNA helicase DDX17 (304-313)
agacugaucgacuuccucgagagcggcaag

SEQ ID NO: 64336 - RNA, 33 nt, Artificial Sequence
  General transcription factor 3C polypeptide 1 (377-387)
agacugaucgagagccucuucaccauucagaag

SEQ ID NO: 64337 - RNA, 36 nt, Artificial Sequence
  Protein S100-A13 (77-88)
agacugaucggcgagcucgccaaggaaauuaggaaa

SEQ ID NO: 64338 - RNA, 33 nt, Artificial Sequence
  ATP synthase subunit a (41-51)
agacugaucaccacacagcaauggcucauuaag

SEQ ID NO: 64339 - RNA, 33 nt, Artificial Sequence
  Peroxisomal multifunctional enzyme type 2 (634-644)
agacugaaggacaucggccccgagguggucaaa

SEQ ID NO: 64340 - RNA, 27 nt, Artificial Sequence
  Cardiolipin synthase (CMP-forming) (235-243)
agacugaagcccaccuucaucagcaaa

SEQ ID NO: 64341 - RNA, 36 nt, Artificial Sequence
  Eukaryotic translation initiation factor 3 subunit A (340-351)
agacugcucgacauggauggcaucauuguggagaag

SEQ ID NO: 64342 - RNA, 27 nt, Artificial Sequence
  Oxidation resistance protein 1 (21-37)
agacugcucgacagcgagaucaagcuu

SEQ ID NO: 64343 - RNA, 30 nt, Artificial Sequence
  Mucosa-associated lymphoid tissue lymphoma translocation protein 1 (834-843)
agacugcucgaggacaagaaaaucaccgug

SEQ ID NO: 64344 - RNA, 33 nt, Artificial Sequence
  Condensin-2 complex subunit D3 (225-235)
agacugcuccccaaguucagccuuaaagagaag

SEQ ID NO: 64345 - RNA, 30 nt, Artificial Sequence
  Uridine-cytidine kinase-like 1 (31-40)
agacugcuccccccugugggcaccgggagg

SEQ ID NO: 64346 - RNA, 30 nt, Artificial Sequence
  Lymphokine-activated killer T-cell-originated protein kinase (81-90)
agacugauggacgaggccaagauccucaaa

SEQ ID NO: 64347 - RNA, 27 nt, Artificial Sequence
  GCN1 general control of amino-acid synthesis 1-like 1 (961-969)
agacugauggagaucuaccaggaaaag

SEQ ID NO: 64348 - RNA, 27 nt, Artificial Sequence
  RILP-like protein 1 (200-208)
agacugaugaagaucaaccacgaccuc

SEQ ID NO: 64349 - RNA, 27 nt, Artificial Sequence
  Sperm-specific antigen 2 (294-302)
agacugaugaagacccucagcaaacuu

SEQ ID NO: 64350 - RNA, 27 nt, Artificial Sequence
  Glyoxylate reductase/hydroxypyruvate reductase (5-13)
agacugaugaagguguucgucaccagg

SEQ ID NO: 64351 - RNA, 27 nt, Artificial Sequence
  Bombesin receptor-activated protein C6orf89 (119-127)
agacugaugagccuccccaucgccaag

SEQ ID NO: 64352 - RNA, 30 nt, Artificial Sequence
  Fibronectin type-III domain-containing protein 3A (948-957)
agacugaacgagagcaccuccuacaaguuc

SEQ ID NO: 64353 - RNA, 27 nt, Artificial Sequence
  DNA damage-binding protein 1 (1057-1065)
agacugaacaaggugaucaaaagcguc

SEQ ID NO: 64354 - RNA, 30 nt, Artificial Sequence
  Serine/threonine-protein phosphatase 2A 56 kDa regulatory subunit delta isoform (408-417)
agacugaacccccaguacccuauguucagg

SEQ ID NO: 64355 - RNA, 27 nt, Artificial Sequence
  Tuberin (712-720)
agacugcccgagagccucagguacaag

SEQ ID NO: 64356 - RNA, 27 nt, Artificial Sequence
  Poly (ADP-ribose) polymerase 10 (221-229)
agacugcccggcccucucgggaccgug

SEQ ID NO: 64357 - RNA, 30 nt, Artificial Sequence
  Lipase maturation factor 1 (191-200)
agacugccccagcacaccccuacaagcagg

SEQ ID NO: 64358 - RNA, 27 nt, Artificial Sequence
  ER membrane protein complex subunit 7 (133-141)
agacugcccuacccucuccagaugaag

SEQ ID NO: 64359 - RNA, 30 nt, Artificial Sequence
  Guanine nucleotide-binding protein G(s) subunit alpha isoforms short (255-264)
agacugcaggaggcccucaaccuuuucaag

SEQ ID NO: 64360 - RNA, 27 nt, Artificial Sequence
  Syntaxin-18 (265-273)
agacugcaggagaucuucaccgaaaag

SEQ ID NO: 64361 - RNA, 27 nt, Artificial Sequence
  Pyridoxal-dependent decarboxylase domain-containing protein 1 (365-373)
agacugcaggagagccucaagaaagug

SEQ ID NO: 64362 - RNA, 30 nt, Artificial Sequence
  Serine/threonine-protein kinase SIK2 (468-477)
agacugcagaagcccagccuccuuuccaaa

SEQ ID NO: 64363 - RNA, 27 nt, Artificial Sequence
  ELAV-like protein 1 (85-93)
agacugcagagcaagaccaucaaagug

SEQ ID NO: 64364 - RNA, 27 nt, Artificial Sequence
  E3 ubiquitin-protein ligase UBR5 (21-29)
agacugagggaggugagcgaaaagcuc

SEQ ID NO: 64365 - RNA, 27 nt, Artificial Sequence
  Pituitary tumor-transforming gene 1 protein-interacting protein (14-22)
agacugaggcucggcggggccgcucuu

SEQ ID NO: 64366 - RNA, 27 nt, Artificial Sequence
  Serine/arginine-rich splicing factor 6 (8-16)
agacugagcuacaacgugagggagaag

SEQ ID NO: 64367 - RNA, 30 nt, Artificial Sequence
  DNA mismatch repair protein Mlh1 (265-274)
agacugguggagagcaccucccucaggaag

SEQ ID NO: 64368 - RNA, 30 nt, Artificial Sequence
  E3 SUMO-protein ligase RanBP2 (170-179)
agacugguggaggucuacaggagcaccaag

SEQ ID NO: 64369 - RNA, 27 nt, Artificial Sequence
  V-type proton ATPase subunit E 2 (44-52)
agacuggugcagacccaaaggcucaag

SEQ ID NO: 64370 - RNA, 27 nt, Artificial Sequence
  Sterol regulatory element-binding protein 2 (632-640)
agacuggugagguggcuccuuaagaaa

SEQ ID NO: 64371 - RNA, 27 nt, Artificial Sequence
  Protein disulfide-isomerase A3 (115-123)
agacuguggcacauccagagcaagaaa

SEQ ID NO: 64372 - RNA, 27 nt, Artificial Sequence
  Transducin beta-like protein 3 (102-110)
agacuguggaaggccauccacaccgcu

SEQ ID NO: 64373 - RNA, 30 nt, Artificial Sequence
  GRAM domain-containing protein 1B (198-207)
agacuguggcagaacgcccuccuugagaag

SEQ ID NO: 64374 - RNA, 30 nt, Artificial Sequence
  Inositol 1,4,5-trisphosphate receptor type 3 (801-810)
agacuguggaccgagauccccacagccauu

SEQ ID NO: 64375 - RNA, 27 nt, Artificial Sequence
  Annexin A5 (89-97)
agacuguacgacgccuaugagcucaag

SEQ ID NO: 64376 - RNA, 30 nt, Artificial Sequence
  DNA damage-binding protein 1 (134-143)
agacuguacgacggccucuucaaggugauc

SEQ ID NO: 64377 - RNA, 27 nt, Artificial Sequence
  Nesprin-1 (318-326)
agacuguacgaccuccccgccaagagg

SEQ ID NO: 64378 - RNA, 27 nt, Artificial Sequence
  Annexin A2 (273-281)
agacuguacgacagcaugaagggcaaa

SEQ ID NO: 64379 - RNA, 27 nt, Artificial Sequence
  DNA topoisomerase 3-alpha (407-415)
agacuguacgaguucaucgugaggcac

SEQ ID NO: 64380 - RNA, 27 nt, Artificial Sequence
  Glutamine-tRNA ligase (679-687)
agacuguacgagaggcucuuccagcac

SEQ ID NO: 64381 - RNA, 36 nt, Artificial Sequence
  Eukaryotic translation initiation factor 3 subunit A (172-183)
agacuguaccacgacaucgcccagcaagcuuucaag

SEQ ID NO: 64382 - RNA, 27 nt, Artificial Sequence
  GPI transamidase component PIG-T (503-511)
agacuguacaccgagccccuccuugug

SEQ ID NO: 64383 - RNA, 27 nt, Artificial Sequence
  2-hydroxyacyl-CoA lyase 1 (135-143)
agacuguacaccaaguucagcgccagg

SEQ ID NO: 64384 - RNA, 24 nt, Artificial Sequence
  Uncharacterized protein (677-684)
agacuguacgugggcagggagaag

SEQ ID NO: 64385 - RNA, 27 nt, Artificial Sequence
  Protein sel-1 homolog 3 (282-290)
agaauggacuaccccguguucaccguc

SEQ ID NO: 64386 - RNA, 33 nt, Artificial Sequence
  Vimentin (13-23)
agaauguucggcgggcccggaaccgccagcagg

SEQ ID NO: 64387 - RNA, 27 nt, Artificial Sequence
  Dynamin-1 (271-279)
agaaugggcacccccuaccugcagaag

SEQ ID NO: 64388 - RNA, 27 nt, Artificial Sequence
  Eukaryotic translation initiation factor 3 subunit C-like protein (709-717)
agaaugaucagcaagcaguuccaccau

SEQ ID NO: 64389 - RNA, 30 nt, Artificial Sequence
  Protein FAM208B (229-238)
agaaugaaggaccccaccuuccugggcaaa

SEQ ID NO: 64390 - RNA, 30 nt, Artificial Sequence
  UPF0585 protein C16orf13 (168-177)
agaaugguggacaugcccgccaacaauaag

SEQ ID NO: 64391 - RNA, 27 nt, Artificial Sequence
  60S ribosomal protein L13a (117-125)
agaauggugguccccgccgcucugaag

SEQ ID NO: 64392 - RNA, 27 nt, Artificial Sequence
  Cytoplasmic FMR1-interacting protein 1 (286-294)
agaauguaccugacccccagcgagaag

SEQ ID NO: 64393 - RNA, 30 nt, Artificial Sequence
  Phosphatidate cytidylyltransferase 2 (307-316)
agaauguaccccuuccagauccacagcauu

SEQ ID NO: 64394 - RNA, 27 nt, Artificial Sequence
  RNA cytidine acetyltransferase (629-637)
agacccgccgagaggcuggacuaccuc

SEQ ID NO: 64395 - RNA, 27 nt, Artificial Sequence
  Cell division cycle protein 23 homolog (423-431)
agacccaacgacagcaggaugcuggug

SEQ ID NO: 64396 - RNA, 27 nt, Artificial Sequence
  Transgelin-2 (44-52)
agaccccagccuggcagggagaacuuc

SEQ ID NO: 64397 - RNA, 30 nt, Artificial Sequence
  Myosin regulatory light polypeptide 9 (14-23)
agaccccagagggccaccagcaacguguuc

SEQ ID NO: 64398 - RNA, 27 nt, Artificial Sequence
  Pre-mRNA-splicing factor SYF1 (370-378)
agacccagggagaucauuaacaccuac

SEQ ID NO: 64399 - RNA, 30 nt, Artificial Sequence
  Trafficking protein particle complex subunit 4 (100-109)
agacccaggcugaccagcaacgagaagcuc

SEQ ID NO: 64400 - RNA, 30 nt, Artificial Sequence
  Cytochrome c oxidase assembly factor 3 homolog, mitochondrial (39-48)
agacaggccgagcuggcucaauggcagaag

SEQ ID NO: 64401 - RNA, 27 nt, Artificial Sequence
  Focal adhesion kinase 1 (476-484)
agacaguucgaccacccccauaucgug

SEQ ID NO: 64402 - RNA, 33 nt, Artificial Sequence
  Acidic fibroblast growth factor intracellular-binding protein (136-146)
agacaguucgacaacuuuaagaggguguucaaa

SEQ ID NO: 64403 - RNA, 33 nt, Artificial Sequence
  MICOS complex subunit MIC19 (130-140)
agacagcuggaggaaaaggacagggugcucaaa

SEQ ID NO: 64404 - RNA, 33 nt, Artificial Sequence
  40S ribosomal protein S29 (44-54)
agacaguacgccaaggacaucggcuucauuaaa

SEQ ID NO: 64405 - RNA, 30 nt, Artificial Sequence
  F-box only protein 33 (21-30)
agacaguacgacaaguuccugacccacuuu

SEQ ID NO: 64406 - RNA, 27 nt, Artificial Sequence
  SH2B adapter protein 1 (560-568)
agaaggggcgaguacgugcugaccuuc

SEQ ID NO: 64407 - RNA, 27 nt, Artificial Sequence
  Multivesicular body subunit 12A (198-206)
agaaggaacgacagcaucuacgaggcc

SEQ ID NO: 64408 - RNA, 27 nt, Artificial Sequence
  Chloride intracellular channel protein 1 (50-58)
agaaggaccgagacagugcagaagcug

SEQ ID NO: 64409 - RNA, 27 nt, Artificial Sequence
  Eukaryotic translation initiation factor 3 subunit L (327-335)
agaagguaccaggacgccauccgggug

SEQ ID NO: 64410 - RNA, 27 nt, Artificial Sequence
  Breast cancer metastasis-suppressor 1-like protein (255-263)
agaagcgaggaaggcaggcuguacuau

SEQ ID NO: 64411 - RNA, 33 nt, Artificial Sequence
  Putative protein N-methyltransferase FAM86B1 (27-37)
agaagcuuccccuggcagucccuggaggccaag

SEQ ID NO: 64412 - RNA, 33 nt, Artificial Sequence
  Dual specificity protein kinase CLK1 (60-70)
agaagcaucaacgagaaggacuaccacuccagg

SEQ ID NO: 64413 - RNA, 33 nt, Artificial Sequence
  Transmembrane protein 209 (277-287)
agaagcaugggcgacuacgcccagacccugaag

SEQ ID NO: 64414 - RNA, 27 nt, Artificial Sequence
  Annexin A11 (302-310)
agaagcaacgagcacaucagggaacug

SEQ ID NO: 64415 - RNA, 27 nt, Artificial Sequence
  Cullin-associated NEDD8-dissociated protein 1 (758-766)
agaagcaccgacuccaucaggcugcuc

SEQ ID NO: 64416 - RNA, 27 nt, Artificial Sequence
  Non-structural maintenance of chromosomes element 4 homolog A (203-211)
agaaccgccgagaacacauucaauaag

SEQ ID NO: 64417 - RNA, 33 nt, Artificial Sequence
  Nephrocystin-1 (181-191)
agaaccgacccccacuggagcgccgugcagaag

SEQ ID NO: 64418 - RNA, 30 nt, Artificial Sequence
  Arginine-glutamic acid dipeptide repeats protein (74-83)
agaaccgacacaggcgagaucacuagcuac

SEQ ID NO: 64419 - RNA, 33 nt, Artificial Sequence
  Ectonucleoside triphosphate diphosphohydrolase 6 (319-329)
agaaccgaggaagugaagcacgucgacuucuac

SEQ ID NO: 64420 - RNA, 36 nt, Artificial Sequence
  Protein LSM12 homolog (95-106)
agaaccgagaaggaagagaaacugagccaggccuac

SEQ ID NO: 64421 - RNA, 30 nt, Artificial Sequence
  Tubulin-tyrosine ligase-like protein 12 (394-403)
agaaccgagcugccccaguucgugagcuac

SEQ ID NO: 64422 - RNA, 27 nt, Artificial Sequence
  A-kinase anchor protein 13 (994-1002)
agaaccuucagcuacaucaagaacaaa

SEQ ID NO: 64423 - RNA, 36 nt, Artificial Sequence
  Biogenesis of lysosome-related organelles complex 1 subunit 1 (106-117)
agaaccaucgccacagcucuggaguacguguauaag

SEQ ID NO: 64424 - RNA, 27 nt, Artificial Sequence
  WASH complex subunit 7 (330-338)
agaaccaucgacaagaaauucuacaag

SEQ ID NO: 64425 - RNA, 27 nt, Artificial Sequence
  Leucine-rich repeat-containing protein 57 (41-49)
agaaccaucgaccugagcaacaauaag

SEQ ID NO: 64426 - RNA, 36 nt, Artificial Sequence
  DNA damage-binding protein 2 (181-192)
agaaccaucgacguguucgauggcaacagcgggaag

SEQ ID NO: 64427 - RNA, 33 nt, Artificial Sequence
  F-box only protein 25 (19-29)
agaaccauccuggagaugacacagauucucaag

SEQ ID NO: 64428 - RNA, 33 nt, Artificial Sequence
  DDB1- and CUL4-associated factor 4 (390-400)
agaaccauccccagcccuuacccagccuccaag

SEQ ID NO: 64429 - RNA, 27 nt, Artificial Sequence
  Protein CEBPZOS (3-11)
agaacccuggagccccucgccaagaaa

SEQ ID NO: 64430 - RNA, 36 nt, Artificial Sequence
  Solute carrier family 22 member 18 (377-388)
agaacccugggccccacaguggggggacuccuuuac

SEQ ID NO: 64431 - RNA, 27 nt, Artificial Sequence
  Coatomer subunit gamma-2 (309-317)
agaacccugaacaagguggccaugaaa

SEQ ID NO: 64432 - RNA, 36 nt, Artificial Sequence
  Nuclear factor 1 C-type (82-93)
agaacccugcccagcacauccucuucaggcaguaag

SEQ ID NO: 64433 - RNA, 27 nt, Artificial Sequence
  Pinin (6-14)
agaacccugcaggagcaacucgaaaag

SEQ ID NO: 64434 - RNA, 33 nt, Artificial Sequence
  Ornithine decarboxylase antizyme 1 (32-42)
agaaccaugccccugcucagccuucacuccagg

SEQ ID NO: 64435 - RNA, 27 nt, Artificial Sequence
  2,4-dienoyl-CoA reductase, mitochondrial (33-41)
agaaccaacuucuuuagcaauuggaag

SEQ ID NO: 64436 - RNA, 27 nt, Artificial Sequence
  Endoplasmic reticulum-Golgi intermediate compartment protein 3 (297-305)
agaaccaaccaguucagcgugacaagg

SEQ ID NO: 64437 - RNA, 27 nt, Artificial Sequence
  RNA-binding protein 26 (515-523)
agaaccaacagccccggcuuccagaag

SEQ ID NO: 64438 - RNA, 30 nt, Artificial Sequence
  Breast cancer type 2 susceptibility protein (2034-2043)
agaacccccgagcaccugaucagccagaag

SEQ ID NO: 64439 - RNA, 27 nt, Artificial Sequence
  Short transient receptor potential channel 4-associated protein (364-372)
agaacccagcugccccaaagcaugaag

SEQ ID NO: 64440 - RNA, 33 nt, Artificial Sequence
  Signal recognition particle 14 kDa protein (21-31)
agaaccagcggcuccguguacaucacacugaag

SEQ ID NO: 64441 - RNA, 27 nt, Artificial Sequence
  Histone-lysine N-methyltransferase 2A (1655-1663)
agaaccacaagccaccugcucagguac

SEQ ID NO: 64442 - RNA, 30 nt, Artificial Sequence
  Diphosphoinositol polyphosphate phosphohydrolase 3-alpha (9-18)
agaaccuacgaccccgagggcuucaagaaa

SEQ ID NO: 64443 - RNA, 33 nt, Artificial Sequence
  Transcription factor p65 (287-297)
agaaccuacgagacauucaagagcaucaugaaa

SEQ ID NO: 64444 - RNA, 30 nt, Artificial Sequence
  Ras and Rab interactor 1 (442-451)
agaaccuacagccccuccgcccaggugaag

SEQ ID NO: 64445 - RNA, 33 nt, Artificial Sequence
  Ras and Rab interactor 1 (442-452)
agaaccuacagccccuccgcccaggugaagagg

SEQ ID NO: 64446 - RNA, 33 nt, Artificial Sequence
  Acyl-CoA dehydrogenase family member 10 (557-567)
agaguggccgcuauccugcagggcgucuacaag

SEQ ID NO: 64447 - RNA, 33 nt, Artificial Sequence
  Cytochrome c oxidase subunit 7A-related protein, mitochondrial (26-36)
agaguggcccccggccagcuggggcacgagaag

SEQ ID NO: 64448 - RNA, 27 nt, Artificial Sequence
  E3 ubiquitin-protein ligase TRIP12 (1581-1589)
agaguggcccccaggcuggaccggaag

SEQ ID NO: 64449 - RNA, 33 nt, Artificial Sequence
  Coiled-coil domain-containing protein 115 (34-44)
agaguggaggaaggcuggcugagccucgccaag

SEQ ID NO: 64450 - RNA, 27 nt, Artificial Sequence
  Serine/threonine-protein kinase B-raf (158-166)
agaguguuccugcccaacaagcagagg

SEQ ID NO: 64451 - RNA, 33 nt, Artificial Sequence
  Coatomer subunit gamma-1 (32-42)
agaguguucaacgagacccccaucaauccuagg

SEQ ID NO: 64452 - RNA, 27 nt, Artificial Sequence
  Arf-GAP with GTPase, ANK repeat and PH domain-containing protein 3 (240-248)
agaguguuccaggacgucgcccaaaag

SEQ ID NO: 64453 - RNA, 30 nt, Artificial Sequence
  28S ribosomal protein S15, mitochondrial (238-247)
agaguguuccaggagacccaaaagcugaaa

SEQ ID NO: 64454 - RNA, 33 nt, Artificial Sequence
  28S ribosomal protein S15, mitochondrial (238-248)
agaguguuccaggagacccaaaagcugaaaaag

SEQ ID NO: 64455 - RNA, 27 nt, Artificial Sequence
  EH domain-containing protein 2 (305-313)
agagugcacgccuacaucauuagcuau

SEQ ID NO: 64456 - RNA, 30 nt, Artificial Sequence
  L-lactate dehydrogenase A chain (269-278)
agagugcaccccgucagcaccaugaucaag

SEQ ID NO: 64457 - RNA, 30 nt, Artificial Sequence
  E3 ubiquitin-protein ligase NEDD4 (24-33)
agagugaucgccggcauugggcuggcuaag

SEQ ID NO: 64458 - RNA, 27 nt, Artificial Sequence
  60S ribosomal protein L3 (156-164)
agagugaucgcccacacccagaugagg

SEQ ID NO: 64459 - RNA, 27 nt, Artificial Sequence
  Lon protease homolog 2, peroxisomal (241-249)
agagugaucgccauuaggcccauacgg

SEQ ID NO: 64460 - RNA, 27 nt, Artificial Sequence
  Ran GTPase-activating protein 1 (67-75)
agagugaucgccaaggcucuggagaaa

SEQ ID NO: 64461 - RNA, 30 nt, Artificial Sequence
  SAFB-like transcription modulator (26-35)
agagugaucgaccugaagagcgagcucaaa

SEQ ID NO: 64462 - RNA, 33 nt, Artificial Sequence
  Histone-binding protein RBBP7 (58-68)
agagugaucaacgaggaauacaagauuuggaaa

SEQ ID NO: 64463 - RNA, 27 nt, Artificial Sequence
  Pumilio homolog 2 (311-319)
agagugauccagaggauucuggagcac

SEQ ID NO: 64464 - RNA, 33 nt, Artificial Sequence
  60S ribosomal protein L13 (167-177)
agagugaucaccgaggaagagaagaacuucaaa

SEQ ID NO: 64465 - RNA, 36 nt, Artificial Sequence
  Cullin-4A (273-284)
agagugaucaccuaccuggaccacagcacacagaag

SEQ ID NO: 64466 - RNA, 30 nt, Artificial Sequence
  COX assembly mitochondrial protein 2 homolog (63-72)
agagugaucgucacccacggcagccugaag

SEQ ID NO: 64467 - RNA, 36 nt, Artificial Sequence
  Guanine nucleotide-binding protein G(I)/G(S)/G(O) subunit gamma-5 (25-36)
agagugaaggucagccaggccgcugcagaccugaaa

SEQ ID NO: 64468 - RNA, 33 nt, Artificial Sequence
  Monofunctional C1-tetrahydrofolate synthase, mitochondrial (497-507)
agagugcuggacaccaacgauagguuccuccgg

SEQ ID NO: 64469 - RNA, 27 nt, Artificial Sequence
  3-hydroxybutyrate dehydrogenase type 2 (55-63)
agagugcuggacgucaccaagaaaaag

SEQ ID NO: 64470 - RNA, 30 nt, Artificial Sequence
  Cysteine-rich with EGF-like domain protein 1 (411-420)
agagugcuggagggcuucaucaaggggagg

SEQ ID NO: 64471 - RNA, 36 nt, Artificial Sequence
  Serine hydroxymethyltransferase, mitochondrial (374-385)
agagugcuggagcucgucagcaucaccgccaacaag

SEQ ID NO: 64472 - RNA, 36 nt, Artificial Sequence
  Lon protease homolog 2, peroxisomal (308-319)
agagugcuggaguaccucgccgucaggcagcuuaag

SEQ ID NO: 64473 - RNA, 27 nt, Artificial Sequence
  Focadhesin (1784-1792)
agagugcugcccgaguucaagaaaaag

SEQ ID NO: 64474 - RNA, 33 nt, Artificial Sequence
  Zinc finger MYM-type protein 1 (867-877)
agagugcugagcgucaccggcauccucuccaag

SEQ ID NO: 64475 - RNA, 27 nt, Artificial Sequence
  Exostosin-like 2 (12-20)
agagugaugggcaucaggguccugcgg

SEQ ID NO: 64476 - RNA, 33 nt, Artificial Sequence
  Inner centromere protein (907-917)
agagugcccagcucccuggccuacucucucaag

SEQ ID NO: 64477 - RNA, 30 nt, Artificial Sequence
  DNA topoisomerase I, mitochondrial (376-385)
agagugcccgucgagaagccuguuuacaaa

SEQ ID NO: 64478 - RNA, 27 nt, Artificial Sequence
  6-phosphofructo-2-kinase/fructose-2,6-bisphosphatase 3 (43-51)
agagugcaggaccacauccaaagcagg

SEQ ID NO: 64479 - RNA, 30 nt, Artificial Sequence
  Melanoma inhibitory activity protein 3 (1184-1193)
agagugcaggaggaaaacgccaggcugaag

SEQ ID NO: 64480 - RNA, 27 nt, Artificial Sequence
  DNA replication licensing factor MCM3 (234-242)
agagugcaggucguuggcaccuacagg

SEQ ID NO: 64481 - RNA, 42 nt, Artificial Sequence
  LysM and putative peptidoglycan-binding domain-containing protein 2 (74-87)
agagugagggccggcgacacccugcaggggaucgcucucaag

SEQ ID NO: 64482 - RNA, 33 nt, Artificial Sequence
  Galectin-1 (11-21)
agagugaggggcgaggucgcccccgacgcuaag

SEQ ID NO: 64483 - RNA, 27 nt, Artificial Sequence
  Protein phosphatase methylesterase 1 (228-236)
agagugagcauggucggccagguuaag

SEQ ID NO: 64484 - RNA, 30 nt, Artificial Sequence
  SLAIN motif-containing protein 2 (375-384)
agagugagcccccagccuaugaucuccagg

SEQ ID NO: 64485 - RNA, 27 nt, Artificial Sequence
  RNA-binding protein Raly (133-141)
agagugaccgucccccugguuaggcgg

SEQ ID NO: 64486 - RNA, 27 nt, Artificial Sequence
  5'-AMP-activated protein kinase subunit gamma-1 (236-244)
agaguggucgacaucuacagcaaguuc

SEQ ID NO: 64487 - RNA, 27 nt, Artificial Sequence
  Clathrin heavy chain 1 (903-911)
agaguggucggcaaguacugcgagaaa

SEQ ID NO: 64488 - RNA, 30 nt, Artificial Sequence
  Coatomer subunit alpha (160-169)
agagugugggacaucagcggccugaggaag

SEQ ID NO: 64489 - RNA, 27 nt, Artificial Sequence
  SWI/SNF complex subunit SMARCC1 (56-64)
agaguguggcugggcaagcacuacaaa

SEQ ID NO: 64490 - RNA, 33 nt, Artificial Sequence
  Charged multivesicular body protein 1a (46-56)
agaguguacgccgagaacgcuaucaggaagaaa

SEQ ID NO: 64491 - RNA, 30 nt, Artificial Sequence
  WD repeat-containing protein 74 (208-217)
agaguguacgaccccgccagcccucagagg

SEQ ID NO: 64492 - RNA, 30 nt, Artificial Sequence
  Protein Churchill (86-95)
agaguguaccacgccgucagcguuaugagg

SEQ ID NO: 64493 - RNA, 27 nt, Artificial Sequence
  Cytochrome c oxidase assembly protein COX14 (33-41)
agaguguaccacuauuuccaguggagg

SEQ ID NO: 64494 - RNA, 33 nt, Artificial Sequence
  Uncharacterized protein KIAA1522 (239-249)
agaguguacagggacgauaccuucgucggccgg

SEQ ID NO: 64495 - RNA, 27 nt, Artificial Sequence
  Poly(U)-binding-splicing factor PUF60 (112-120)
agaguguacgucggcagcaucuauuac

SEQ ID NO: 64496 - RNA, 27 nt, Artificial Sequence
  Adipocyte plasma membrane-associated protein (296-304)
agaguguacgucagcggccugaugaag

SEQ ID NO: 64497 - RNA, 33 nt, Artificial Sequence
  Histone-lysine N-methyltransferase 2A (2053-2063)
agaguguacuggagcaccacagacgccaggaag

SEQ ID NO: 64498 - RNA, 33 nt, Artificial Sequence
  60S ribosome subunit biogenesis protein NIP7 homolog (43-53)
agaguguacuaugucagcgagaagaucaugaaa

SEQ ID NO: 64499 - RNA, 27 nt, Artificial Sequence
  Kinesin-like protein KIF2C (467-475)
agauacgccgacagggugaaggagcug

SEQ ID NO: 64500 - RNA, 30 nt, Artificial Sequence
  Protein-cysteine N-palmitoyltransferase HHAT (337-346)
agauacuucgacgugggccugcacaacuuu

SEQ ID NO: 64501 - RNA, 27 nt, Artificial Sequence
  von Willebrand factor A domain-containing protein 8 (1836-1844)
agauacggcauccaccccgccaaguuc

SEQ ID NO: 64502 - RNA, 27 nt, Artificial Sequence
  Serine/threonine-protein kinase PLK2 (271-279)
agauacaucgacacccacaacagggug

SEQ ID NO: 64503 - RNA, 27 nt, Artificial Sequence
  Deoxyguanosine kinase, mitochondrial (148-156)
agauacaucuucgccaagaaccuguuu

SEQ ID NO: 64504 - RNA, 27 nt, Artificial Sequence
  Rho GTPase-activating protein 35 (208-216)
agauacaucagggacgcccacaccuuc

SEQ ID NO: 64505 - RNA, 27 nt, Artificial Sequence
  Structural maintenance of chromosomes protein 5 (245-253)
agauacaagcaggacguggagagguuc

SEQ ID NO: 64506 - RNA, 33 nt, Artificial Sequence
  Tumor suppressor candidate 3 (18-28)
agauaccugcccaccggcagcuucccuuuucuc

SEQ ID NO: 64507 - RNA, 27 nt, Artificial Sequence
  Potassium voltage-gated channel subfamily G member 1 (168-176)
agauaccugcagaagaucgaggaauuc

SEQ ID NO: 64508 - RNA, 27 nt, Artificial Sequence
  Cell division cycle protein 16 homolog (320-328)
agauaccugagcaaggccaccacacuc

SEQ ID NO: 64509 - RNA, 27 nt, Artificial Sequence
  Histone-binding protein RBBP7 (130-138)
agauacaugccccagaacccucacauc

SEQ ID NO: 64510 - RNA, 27 nt, Artificial Sequence
  Kelch-like protein 24 (592-600)
agauacaacgagaagugcuucaaacug

SEQ ID NO: 64511 - RNA, 27 nt, Artificial Sequence
  Kelch-like protein 20 (478-486)
agauacaaccccaggaccaaucagugg

SEQ ID NO: 64512 - RNA, 27 nt, Artificial Sequence
  Thyroid transcription factor 1-associated protein 26 (88-96)
agauaccccgacaaccugaagcaccuc

SEQ ID NO: 64513 - RNA, 30 nt, Artificial Sequence
  Thyroid transcription factor 1-associated protein 26 (88-97)
agauaccccgacaaccugaagcaccucuau

SEQ ID NO: 64514 - RNA, 27 nt, Artificial Sequence
  Serine/threonine-protein phosphatase 4 catalytic subunit (103-111)
agauaccccgacaggaucacccugauu

SEQ ID NO: 64515 - RNA, 27 nt, Artificial Sequence
  Lysophosphatidylcholine acyltransferase 1 (98-106)
agauaccccaacaagcuggacaccauc

SEQ ID NO: 64516 - RNA, 30 nt, Artificial Sequence
  CCR4-NOT transcription complex subunit 1 (438-447)
agauaccccaacagccacacccauuauuuc

SEQ ID NO: 64517 - RNA, 27 nt, Artificial Sequence
  Uncharacterized protein C1orf43 (178-186)
agauaccaggaggcccugagcgaacuc

SEQ ID NO: 64518 - RNA, 27 nt, Artificial Sequence
  YTH domain-containing protein 1 (550-558)
agauaccaggagguggacaggcgguuc

SEQ ID NO: 64519 - RNA, 27 nt, Artificial Sequence
  High affinity cationic amino acid transporter 1 (419-427)
agauaccagcccgagcaaccuaaccug

SEQ ID NO: 64520 - RNA, 27 nt, Artificial Sequence
  Centrosomal protein of 89 kDa (331-339)
agauaccagaccaaguucaggcaccug

SEQ ID NO: 64521 - RNA, 27 nt, Artificial Sequence
  Leucine zipper putative tumor suppressor 1 (36-44)
agauacagcgacggccugcucagguuc

SEQ ID NO: 64522 - RNA, 27 nt, Artificial Sequence
  Myotubularin related protein 6 (594-602)
agauacagcgaguaugccgaagaguuc

SEQ ID NO: 64523 - RNA, 27 nt, Artificial Sequence
  Rap guanine nucleotide exchange factor 6 (57-65)
agauacagcggcaaccaggugcuguuc

SEQ ID NO: 64524 - RNA, 27 nt, Artificial Sequence
  Cation-independent mannose-6-phosphate receptor (1582-1590)
agauacguggaccagguccugcaacuc

SEQ ID NO: 64525 - RNA, 27 nt, Artificial Sequence
  Calpain-5 (466-474)
agauacgugaucauucccaccacauuc

SEQ ID NO: 64526 - RNA, 27 nt, Artificial Sequence
  Histone-lysine N-methyltransferase EHMT2 (935-943)
agauacuauggcaacaucagcagguuc

SEQ ID NO: 64527 - RNA, 30 nt, Artificial Sequence
  Myosin-9 (104-113)
agauacuauagcggccugaucuacaccuau

SEQ ID NO: 64528 - RNA, 27 nt, Artificial Sequence
  Fanconi anemia group C protein (413-421)
agcgccgcugagcccccuaccgcacug

SEQ ID NO: 64529 - RNA, 27 nt, Artificial Sequence
  V-type proton ATPase 16 kDa proteolipid subunit (20-28)
agcgccgcuaugguguucuccgcacug

SEQ ID NO: 64530 - RNA, 27 nt, Artificial Sequence
  Factor VIII intron 22 protein (251-259)
agcgccgcucccuccccugcagcccug

SEQ ID NO: 64531 - RNA, 27 nt, Artificial Sequence
  Phosphoacetylglucosamine mutase (515-523)
agcgccgaccaccuggcucaugaggug

SEQ ID NO: 64532 - RNA, 27 nt, Artificial Sequence
  Melanoma-associated antigen 1 (62-70)
agcgccuuccccaccacaaucaacuuu

SEQ ID NO: 64533 - RNA, 27 nt, Artificial Sequence
  Multiple epidermal growth factor-like domains protein 8 (745-753)
agcgccggccccgggcacuccgagcug

SEQ ID NO: 64534 - RNA, 27 nt, Artificial Sequence
  AT-rich interactive domain-containing protein 2 (319-327)
agcgcccacucccauuucaucucucug

SEQ ID NO: 64535 - RNA, 27 nt, Artificial Sequence
  ADP-ribosylation factor GTPase-activating protein 3 (167-175)
agcgccaucgcugagcccuccucucug

SEQ ID NO: 64536 - RNA, 27 nt, Artificial Sequence
  Catenin alpha-1 (366-374)
agcgccaucgacaagaugaccaaaaag

SEQ ID NO: 64537 - RNA, 27 nt, Artificial Sequence
  COBW domain-containing protein 5 (82-90)
agcgcccuggagaagucccucgcugug

SEQ ID NO: 64538 - RNA, 36 nt, Artificial Sequence
  Vimentin (42-53)
agcgcccugagacccuccaccucuaggucacucuac

SEQ ID NO: 64539 - RNA, 30 nt, Artificial Sequence; identical to SEQ ID NO: 40312
  Putative annexin A2-like protein (89-98)

SEQ ID NO: 64540 - RNA, 27 nt, Artificial Sequence
  Ran GTPase-activating protein 1 (174-182)
agcgcccagggcaagccccuggcucuc

SEQ ID NO: 64541 - RNA, 27 nt, Artificial Sequence
  Protein virilizer homolog (804-812)
agcgccgugggccacgucuucucccug

SEQ ID NO: 64542 - RNA, 27 nt, Artificial Sequence
  MICAL-like protein 2 (424-432)
agcgccgugcccccuggcaccucccug

SEQ ID NO: 64543 - RNA, 30 nt, Artificial Sequence
  Eukaryotic peptide chain release factor GTP-binding subunit ERF3A (27-36)
agcgaggccgaacccggcgggggaucccug

SEQ ID NO: 64544 - RNA, 27 nt, Artificial Sequence
  Neuron navigator 2 (1899-1907)
agcgaggccgaaaccgugaugcagcug

SEQ ID NO: 64545 - RNA, 27 nt, Artificial Sequence
  Transportin-1 (59-67)
agcgaggacgaacccaccagaucccug

SEQ ID NO: 64546 - RNA, 27 nt, Artificial Sequence
  Zinc finger protein 217 (77-85)
agcgaggaccugaacaagcacgugcuc

SEQ ID NO: 64547 - RNA, 27 nt, Artificial Sequence
  Vacuolar protein sorting-associated protein 35 (500-508)
agcgaggaccccgaucagcaauaccug

SEQ ID NO: 64548 - RNA, 30 nt, Artificial Sequence
  Protein CASC3 (106-115)
agcgaggaagagaacuccaagguggaacug

SEQ ID NO: 64549 - RNA, 27 nt, Artificial Sequence
  Ribosome biogenesis protein BOP1 (459-467)
agcgaggaagagagacaggugggccug

SEQ ID NO: 64550 - RNA, 27 nt, Artificial Sequence
  GPI-anchor transamidase (176-184)
agcgaggaaaucaccaacauugagcug

SEQ ID NO: 64551 - RNA, 30 nt, Artificial Sequence
  Tyrosine-protein kinase JAK1 (600-609)
agcgaggaaaagaaaaucaaggugauucug

SEQ ID NO: 64552 - RNA, 27 nt, Artificial Sequence
  DNA mismatch repair protein Msh2 (900-908)
agcgaggaaaacaucaccauuaagcug

SEQ ID NO: 64553 - RNA, 27 nt, Artificial Sequence
  Selenocysteine insertion sequence-binding protein 2 (597-605)
agcgaggaacccccuggcaccgagcug

SEQ ID NO: 64554 - RNA, 33 nt, Artificial Sequence
  Rac GTPase-activating protein 1 (44-54)
agcgaggaacagaaguccgcccuggcuuuccuc

SEQ ID NO: 64555 - RNA, 30 nt, Artificial Sequence
  X-ray repair cross-complementing protein 5 (546-555)
agcgaggaacagagauucaacaauuuucug

SEQ ID NO: 64556 - RNA, 27 nt, Artificial Sequence
  Caspase-8 (168-176)
agcgaggaaguguccagaucugagcug

SEQ ID NO: 64557 - RNA, 27 nt, Artificial Sequence
  E3 ubiquitin-protein ligase UBR5 (2161-2169)
agcgagggccccccucugaccuccuuc

SEQ ID NO: 64558 - RNA, 36 nt, Artificial Sequence
  Basigin (49-60)
agcgagcacaucaacgaaggcgagaccgccaugcug

SEQ ID NO: 64559 - RNA, 33 nt, Artificial Sequence
  Kinesin-like protein KIF20A (608-618)
agcgagcaccuggacacccagaaggaacuccuu

SEQ ID NO: 64560 - RNA, 33 nt, Artificial Sequence
  La-related protein 4 (384-394)
agcgagcacuccaccgaaggcucugugucacug

SEQ ID NO: 64561 - RNA, 39 nt, Artificial Sequence
  AP-1 complex subunit beta-1 (185-197)
agcgagaucgccgaaucccaccccucuucaaaccugcuc

SEQ ID NO: 64562 - RNA, 30 nt, Artificial Sequence
  Endothelial PAS domain-containing protein 1 (345-354)
agcgagaucgaaaagaacgacguggucuuc

SEQ ID NO: 64563 - RNA, 33 nt, Artificial Sequence
  Centrosomal protein of 170 kDa (569-579)
agcgagaucggcgaaaagcaggacaccgagcug

SEQ ID NO: 64564 - RNA, 30 nt, Artificial Sequence
  Protein OS-9 (136-145)
agcgagaucaagggcgaagugcuguaccuc

SEQ ID NO: 64565 - RNA, 33 nt, Artificial Sequence
  BCL-6 corepressor (765-775)
agcgagauccuggaaaccuccucuacaaagcuc

SEQ ID NO: 64566 - RNA, 39 nt, Artificial Sequence
  AP-2 complex subunit beta (185-197)
agcgagaucuccgaaucucaccccaacucaaaucugcuc

SEQ ID NO: 64567 - RNA, 30 nt, Artificial Sequence
  E3 ubiquitin-protein ligase UBR4 (365-374)
agcgagaucaccgaccccgaauccuuccug

SEQ ID NO: 64568 - RNA, 30 nt, Artificial Sequence
  Centrin-1 (98-107)
agcgagaaggacaccaaagaagagauccug

SEQ ID NO: 64569 - RNA, 30 nt, Artificial Sequence
  Ubiquitin carboxyl-terminal hydrolase 43 (210-219)
agcgagaagcugcccccugaagccaccaaa

SEQ ID NO: 64570 - RNA, 27 nt, Artificial Sequence
  Spatacsin (742-750)
agcgagcugcucaagaacaugggcuuc

SEQ ID NO: 64571 - RNA, 27 nt, Artificial Sequence
  Nuclear pore complex protein Nup155 (1180-1188)
agcgagcugauggacaucaccaagcuc

SEQ ID NO: 64572 - RNA, 30 nt, Artificial Sequence
  WD repeat-containing protein 43 (123-132)
agcgagaacaaggaagagcccgugaaacug

SEQ ID NO: 64573 - RNA, 30 nt, Artificial Sequence
  Caspase recruitment domain-containing protein 19 (24-33)
agcgagcagcaaguggacagaaucauucug

SEQ ID NO: 64574 - RNA, 30 nt, Artificial Sequence
  Protein deglycase DJ-1 (83-92)
agcgaguccgccgcugugaaggaaauccug

SEQ ID NO: 64575 - RNA, 33 nt, Artificial Sequence
  Coatomer subunit gamma-1 (429-439)
agcgaguccaaggaaaccggccugucucaccuc

SEQ ID NO: 64576 - RNA, 27 nt, Artificial Sequence
  Probable ubiquitin carboxyl-terminal hydrolase FAF-X (1855-1863)
agcgagaccgccggcuccacaaaguac

SEQ ID NO: 64577 - RNA, 30 nt, Artificial Sequence
  Homocysteine-responsive endoplasmic reticulum-resident ubiquitin-like domain member 1 protein (3-12)
agcgagaccgaacccgagccugugacacug

SEQ ID NO: 64578 - RNA, 27 nt, Artificial Sequence
  DNA-dependent protein kinase catalytic subunit (1564-1572)
agcgagaccaucaacacagaacugcuc

SEQ ID NO: 64579 - RNA, 30 nt, Artificial Sequence
  Adipocyte plasma membrane-associated protein (402-411)
agcgaggugcacgaacaugacggccaccug

SEQ ID NO: 64580 - RNA, 27 nt, Artificial Sequence
  Ubiquitin-like modifier-activating enzyme 1 (251-259)
agcgaggugcagggcauggucgaacug

SEQ ID NO: 64581 - RNA, 33 nt, Artificial Sequence
  Zinc finger and BTB domain-containing protein 2 (491-501)
agcgaggugaccgaacccgaccacccuguccug

SEQ ID NO: 64582 - RNA, 30 nt, Artificial Sequence
  60S ribosomal protein L28 (37-46)
agcuucagauacaacggccugauccacagg

SEQ ID NO: 64583 - RNA, 27 nt, Artificial Sequence
  Prelamin-A/C (424-432)
agcggcgaccccgccgaguacaaccug

SEQ ID NO: 64584 - RNA, 27 nt, Artificial Sequence
  Replication protein A 70 kDa DNA-binding subunit (149-157)
agcggcaugggguccaccgugucuaag

SEQ ID NO: 64585 - RNA, 27 nt, Artificial Sequence
  Exocyst complex component 4 (448-456)
agccacgccaucuccaugucugcuuac

SEQ ID NO: 64586 - RNA, 27 nt, Artificial Sequence
  Unconventional myosin-Ib (546-554)
agccacgcccugaucaagucccucuuc

SEQ ID NO: 64587 - RNA, 27 nt, Artificial Sequence
  Transcription factor 4 (246-254)
agccacaucccccaguccucuucauac

SEQ ID NO: 64588 - RNA, 27 nt, Artificial Sequence
  Dual specificity mitogen-activated protein kinase kinase 1 (86-94)
agccacaagcccuccggccuggugaug

SEQ ID NO: 64589 - RNA, 27 nt, Artificial Sequence
  Rho-related GTP-binding protein RhoE (218-226)
agccacaugcccuccagaccugagcug

SEQ ID NO: 64590 - RNA, 27 nt, Artificial Sequence
  Reticulon-3 (10-18)
agccacuccaucucuucaaguagcuuc

SEQ ID NO: 64591 - RNA, 27 nt, Artificial Sequence
  Aminoacylase-1 (79-87)
agccacaccgacgugguccccguuuuc

SEQ ID NO: 64592 - RNA, 27 nt, Artificial Sequence
  Sialin (259-267)
agccacuacgagaaggaauauauccug

SEQ ID NO: 64593 - RNA, 27 nt, Artificial Sequence
  Solute carrier family 35 member C2 (273-281)
agcaucgccggcauuuucaaggaggug

SEQ ID NO: 64594 - RNA, 27 nt, Artificial Sequence
  40S ribosomal protein S4, X isoform (72-80)
agcaucgacaagaccggcgagaacuuc

SEQ ID NO: 64595 - RNA, 33 nt, Artificial Sequence
  YTH domain-containing family protein 1 (434-444)
agcaucuucgacgauuuugcccacuacgagaag

SEQ ID NO: 64596 - RNA, 33 nt, Artificial Sequence
  YTH domain-containing family protein 2 (707-717)
agcaucuucgacgauuuuucccacuacgagaag

SEQ ID NO: 64597 - RNA, 27 nt, Artificial Sequence
  Transmembrane emp24 domain-containing protein 7 (192-200)
agcaucggccagguguuccugcucaag

SEQ ID NO: 64598 - RNA, 27 nt, Artificial Sequence
  Kit ligand (99-107)
agcaucauugacaagcuggugaacaua

SEQ ID NO: 64599 - RNA, 27 nt, Artificial Sequence
  Heat shock protein HSP 90-alpha (763-771)
agcaucauugagacccugagacagaag

SEQ ID NO: 64600 - RNA, 36 nt, Artificial Sequence
  Poly(rC)-binding protein 2 (27-38)
agcaucauuggcaagaaaggggaguccgugaagaaa

SEQ ID NO: 64601 - RNA, 27 nt, Artificial Sequence
  NADH dehydrogenase (ubiquinone) 1 alpha subcomplex subunit 13 (40-48)
agcaucaugaaguggaacagagagagg

SEQ ID NO: 64602 - RNA, 27 nt, Artificial Sequence
  Sterol regulatory element-binding protein 1 (338-346)
agcaucaacgacaagauuauagagcug

SEQ ID NO: 64603 - RNA, 30 nt, Artificial Sequence
  Ubiquitin-associated protein 2-like (325-334)
agcaucccccagaagccucaaaccaacaaa

SEQ ID NO: 64604 - RNA, 33 nt, Artificial Sequence; identical to SEQ ID NO: 40377
  Alkyldihydroxyacetonephosphate synthase, peroxisomal (630-640)

SEQ ID NO: 64605 - RNA, 27 nt, Artificial Sequence
  Progressive ankylosis protein homolog (165-173)
agcaucuccgacgugauugcccagguc

SEQ ID NO: 64606 - RNA, 36 nt, Artificial Sequence
  Insulin-like growth factor 2 mRNA-binding protein 2 (181-192)
agcaucuacaaccccgagagaaccauuacagugaag

SEQ ID NO: 64607 - RNA, 33 nt, Artificial Sequence
  Fibronectin type III domain-containing protein 3B (555-565)
agcaucuacagaggccccucccacaccuauaag

SEQ ID NO: 64608 - RNA, 30 nt, Artificial Sequence
  Nuclear receptor coactivator 3 (336-345)
agccuggccgacggcaccaucgugacagcu

SEQ ID NO: 64609 - RNA, 27 nt, Artificial Sequence
  Calmodulin-regulated spectrin-associated protein 2 (271-279)
agccuggccgacucccucuacaaccuu

SEQ ID NO: 64610 - RNA, 30 nt, Artificial Sequence
  ATPase family AAA domain-containing protein 2 (410-419)
agccuggccgacguggaucccaugcagcuc

SEQ ID NO: 64611 - RNA, 27 nt, Artificial Sequence
  Wiskott-Aldrich syndrome protein family member 2 (67-75)
agccuggccgagagaguggacaggcuc

SEQ ID NO: 64612 - RNA, 27 nt, Artificial Sequence
  Histone H1x (66-74)
agccuggccaagaucuacaccgaggcu

SEQ ID NO: 64613 - RNA, 27 nt, Artificial Sequence
  Discoidin, CUB and LCCL domain-containing protein 2 (222-230)
agccuggccaacaaugugaccuccguc

SEQ ID NO: 64614 - RNA, 36 nt, Artificial Sequence
  Prohibitin (227-238)
agccuggccaccgcuggcgacgggcucaucgagcuu

SEQ ID NO: 64615 - RNA, 27 nt, Artificial Sequence
  Arf-GAP with Rho-GAP domain, ANK repeat and PH domain-containing protein 3 (220-228)
agccuggaccagcccuuccucuccaag

SEQ ID NO: 64616 - RNA, 27 nt, Artificial Sequence
  Transcription intermediary factor 1-beta (265-273)
agccuggaccagcccggcgggacccuc

SEQ ID NO: 64617 - RNA, 27 nt, Artificial Sequence
  Dolichyl-diphosphooligosaccharide-proteinosyltransferase subunit 2 (40-48)
agccuggacagacccuucaccaaccuc

SEQ ID NO: 64618 - RNA, 30 nt, Artificial Sequence; identical to SEQ ID NO: 40391
  Spatacsin (1958-1967)

SEQ ID NO: 64619 - RNA, 27 nt, Artificial Sequence
  Mothers against decapentaplegic homolog 6 (187-195)
agccuggacacccuccuugaggccgug

SEQ ID NO: 64620 - RNA, 30 nt, Artificial Sequence
  Activating transcription factor 7-interacting protein 2 (272-281)
agccuggacaccaacaauaacucccacuac

SEQ ID NO: 64621 - RNA, 27 nt, Artificial Sequence
  Transcription factor E2-alpha (165-173)
agccuggacacccagcccaagaaagug

SEQ ID NO: 64622 - RNA, 30 nt, Artificial Sequence; identical to SEQ ID NO: 40395
  Transformation/transcription domain-associated protein (976-985)

SEQ ID NO: 64623 - RNA, 30 nt, Artificial Sequence; identical to SEQ ID NO: 40396
  Probable E3 ubiquitin-protein ligase HERC6 (177-186)

SEQ ID NO: 64624 - RNA, 27 nt, Artificial Sequence
  Uncharacterized protein C17orf112 (97-105)
agccuggagcucgaccccccuucccuu

SEQ ID NO: 64625 - RNA, 27 nt, Artificial Sequence
  Transmembrane emp24 domain-containing protein 9 (130-138)
agccuguucgccggcgggaugcucaga

SEQ ID NO: 64626 - RNA, 30 nt, Artificial Sequence
  Splicing factor 3A subunit 3 (299-308)
agccuguucgccaagaaccccaaauccaag

SEQ ID NO: 64627 - RNA, 27 nt, Artificial Sequence
  Probable E3 ubiquitin-protein ligase HECTD4 (550-558)
agccuguucggcgggaccuccggacuc

SEQ ID NO: 64628 - RNA, 27 nt, Artificial Sequence
  ADP-ribosylation factor 4 (7-15)
agccuguucuccagacucuuuggcaag

SEQ ID NO: 64629 - RNA, 30 nt, Artificial Sequence
  Leukocyte tyrosine kinase receptor (149-158)
agccugggccucggggagucccuuuacauc

SEQ ID NO: 64630 - RNA, 30 nt, Artificial Sequence
  PRELI domain containing protein 3A (115-124)
agccugggcuccuaccucgagucucuuaug

SEQ ID NO: 64631 - RNA, 33 nt, Artificial Sequence
  Epidermal growth factor receptor kinase substrate 8 (115-125)
agccugaucgaccucgaguccaagaacgaacuu

SEQ ID NO: 64632 - RNA, 30 nt, Artificial Sequence
  Sugar phosphate exchanger 3 (370-379)
agccugaucggcuacucccucuucucugug

SEQ ID NO: 64633 - RNA, 27 nt, Artificial Sequence
  Type I inositol 3,4-bisphosphate 4-phosphatase (107-115)
agccugaucaaccagaugacccaagug

SEQ ID NO: 64634 - RNA, 27 nt, Artificial Sequence
  Kinectin (369-377)
agccugaaggcccacgugcaggagguc

SEQ ID NO: 64635 - RNA, 27 nt, Artificial Sequence
  Dolichyl-diphosphooligosaccharide-proteinosyltransferase 48 kDa subunit (66-74)
agccugaaggacagaggcuucgagcuc

SEQ ID NO: 64636 - RNA, 27 nt, Artificial Sequence
  Gamma-interferon-inducible protein 16 (248-256)
agccugaaggagaaauucaacggcaag

SEQ ID NO: 64637 - RNA, 27 nt, Artificial Sequence
  KN motif and ankyrin repeat domain-containing protein 1 (464-472)
agccugaaggagaaaaucuacagacuc

SEQ ID NO: 64638 - RNA, 30 nt, Artificial Sequence
  Histone-lysine N-methyltransferase NSD2 (177-186)
agccugcucgagcagggccuuguggaagcc

SEQ ID NO: 64639 - RNA, 36 nt, Artificial Sequence
  TSC22 domain family protein 1 (28-39)
agccugcucggcaccgagaacgccuccgugagacuu

SEQ ID NO: 64640 - RNA, 36 nt, Artificial Sequence
  Homocysteine-responsive endoplasmic reticulum-resident ubiquitin-like domain member 1 protein (221-232)
agccugcuccccgagggcccuccagccaucgcuaac

SEQ ID NO: 64641 - RNA, 27 nt, Artificial Sequence
  Ankyrin repeat and KH domain-containing protein 1 (2544-2552)
agccugcuccccuccgugccugcccuu

SEQ ID NO: 64642 - RNA, 27 nt, Artificial Sequence
  E3 ubiquitin-protein ligase TRIM38 (21-29)
agccugaugaccaaccccguguccauc

SEQ ID NO: 64643 - RNA, 27 nt, Artificial Sequence
  Coiled-coil domain-containing protein 93 (321-329)
agccugaacaagcagaucgcccaaaaa

SEQ ID NO: 64644 - RNA, 27 nt, Artificial Sequence
  Deubiquitinating protein VCIP135 (181-189)
agccugaacuccaauguguacgacguc

SEQ ID NO: 64645 - RNA, 27 nt, Artificial Sequence
  Disintegrin and metalloproteinase domain-containing protein 10 (100-108)
agccugaacaccggcaucauuacagug

SEQ ID NO: 64646 - RNA, 27 nt, Artificial Sequence
  E3 ubiquitin-protein ligase BRE1B (149-157)
agccugcagaaccacaaucaucaacuc

SEQ ID NO: 64647 - RNA, 27 nt, Artificial Sequence
  DNA primase small subunit (265-273)
agccugcagagaugggagcaccucaag

SEQ ID NO: 64648 - RNA, 27 nt, Artificial Sequence
  Integrin alpha-3 (452-460)
agccuguccgaccacaucgugcuccuu

SEQ ID NO: 64649 - RNA, 27 nt, Artificial Sequence
  Pleckstrin homology-like domain family B member 2 (117-125)
agccuguccggcuacccccucgggaga

SEQ ID NO: 64650 - RNA, 27 nt, Artificial Sequence
  GDH/6PGL endoplasmic bifunctional protein (741-749)
agccugucccucccccuuaucaacaga

SEQ ID NO: 64651 - RNA, 36 nt, Artificial Sequence
  26S proteasome non-ATPase regulatory subunit 3 (262-273)
agccuguacgaccaggccgagaagcucguguccaaa

SEQ ID NO: 64652 - RNA, 27 nt, Artificial Sequence
  Delta(24)-sterol reductase (399-407)
agccuguaccacaagcucagagagaaa

SEQ ID NO: 64653 - RNA, 39 nt, Artificial Sequence
  D-beta-hydroxybutyrate dehydrogenase, mitochondrial (246-258)
agccuguacucccccgagucuauccaggccauugcuaag

SEQ ID NO: 64654 - RNA, 27 nt, Artificial Sequence
  TATA box-binding protein-associated factor RNA polymerase I subunit B (255-263)
agccuguacuggcucuccacccagaag

SEQ ID NO: 64655 - RNA, 27 nt, Artificial Sequence
  Bifunctional 3'-phosphoadenosine 5'-phosphosulfate synthase 2 (537-545)
agcauggcccccggccugaccuccgug

SEQ ID NO: 64656 - RNA, 27 nt, Artificial Sequence
  Protein SON (1023-1031)
agcaugaugucccccauggccgagaga

SEQ ID NO: 64657 - RNA, 27 nt, Artificial Sequence
  Small nuclear ribonucleoprotein Sm D1 (35-43)
agcaugaacacccaccugaaggccgug

SEQ ID NO: 64658 - RNA, 27 nt, Artificial Sequence
  Ubiquitin carboxyl-terminal hydrolase isozyme L5 (131-139)
agcaacuccgacgugaucagacagguc

SEQ ID NO: 64659 - RNA, 27 nt, Artificial Sequence
  Chloride channel CLIC-like protein 1 (324-332)
agccccgccgcugagaaggcacagcug

SEQ ID NO: 64660 - RNA, 27 nt, Artificial Sequence
  Eukaryotic translation initiation factor 2A (347-355)
agcccccacggccauauccuggugcuc

SEQ ID NO: 64661 - RNA, 33 nt, Artificial Sequence
  Zinc finger SWIM domain-containing protein 7 (59-69)
agccccuccggcagaaggguguaccagguccug

SEQ ID NO: 64662 - RNA, 27 nt, Artificial Sequence
  Spermatogenesis-associated protein 20 (30-38)
agccccaccuccagacugaacucucuc

SEQ ID NO: 64663 - RNA, 27 nt, Artificial Sequence
  mRNA-decapping enzyme 1A (62-70)
agccccuaccacggcuucaccaucgug

SEQ ID NO: 64664 - RNA, 27 nt, Artificial Sequence
  Complex I assembly factor TIMMDC1, mitochondrial (108-116)
agccaggccgagaucuaccacaacaga

SEQ ID NO: 64665 - RNA, 33 nt, Artificial Sequence
  Centromere protein J (1081-1091)
agccagaucuccucuggcacccaaguggagaag

SEQ ID NO: 64666 - RNA, 27 nt, Artificial Sequence
  G protein pathway suppressor 2 (319-327)
agccagaaccccagauucuaccacaag

SEQ ID NO: 64667 - RNA, 27 nt, Artificial Sequence
  T-complex protein 1 subunit eta (157-165)
agccagcaaaaggccuucuuugcuaaa

SEQ ID NO: 64668 - RNA, 30 nt, Artificial Sequence
  3-hydroxy-3-methylglutaryl-coenzyme A reductase (226-235)
agcagagagggcaggcccaucuggcagcug

SEQ ID NO: 64669 - RNA, 27 nt, Artificial Sequence
  Protein CYR61 (3-11)
agcagaaucgccagggcucuggcacuc

SEQ ID NO: 64670 - RNA, 27 nt, Artificial Sequence
  Polyadenylate-binding protein 4 (289-297)
agcagauaccagggcgugaaccuguau

SEQ ID NO: 64671 - RNA, 30 nt, Artificial Sequence
  NUMB protein (52-61)
agcuccgccaccacaucucccuucuuuaag

SEQ ID NO: 64672 - RNA, 27 nt, Artificial Sequence
  Nucleoporin GLE1 (16-24)
agcuccgacaagggcagacugugcuac

SEQ ID NO: 64673 - RNA, 30 nt, Artificial Sequence
  Rho guanine nucleotide exchange factor 35 (173-182)
agcuccgacaacucuggccagaccagauac

SEQ ID NO: 64674 - RNA, 27 nt, Artificial Sequence
  Integrin alpha-7 (233-241)
agcuccgaccccgaucagcugguguac

SEQ ID NO: 64675 - RNA, 33 nt, Artificial Sequence
  Transcriptional coactivator YAP1 (331-341)
agcuccgaccccuuccugaacucuggcaccuac

SEQ ID NO: 64676 - RNA, 27 nt, Artificial Sequence
  Plastin-3 (113-121)
agcuccgagggcacccagcacucuuac

SEQ ID NO: 64677 - RNA, 30 nt, Artificial Sequence
  Spermatogenesis-associated serine-rich protein 2 (123-132)
agcuccgagaagggcgggaugaacggauac

SEQ ID NO: 64678 - RNA, 33 nt, Artificial Sequence
  Myotubularin-related protein 14 (229-239)
agcuccgagaagguggacaaagcccagagauac

SEQ ID NO: 64679 - RNA, 27 nt, Artificial Sequence
  Liprin-beta-1 (506-514)
agcuccuucggcagaggguuuuucaag

SEQ ID NO: 64680 - RNA, 27 nt, Artificial Sequence
  Breast cancer type 2 susceptibility protein (661-669)
agcuccuucggcaccauccugagaaag

SEQ ID NO: 64681 - RNA, 27 nt, Artificial Sequence
  60S ribosomal protein L28 (14-22)
agcuccuuccugaucaagagaaacaaa

SEQ ID NO: 64682 - RNA, 27 nt, Artificial Sequence
  AP-3 complex subunit mu-2 (10-18)
agcuccggcgacaucuuccuggagaag

SEQ ID NO: 64683 - RNA, 27 nt, Artificial Sequence
  Deoxynucleotidyltransferase terminal-interacting protein 2 (562-570)
agcuccaucgaccccggccugucuauu

SEQ ID NO: 64684 - RNA, 27 nt, Artificial Sequence
  60S ribosomal protein L28 (91-99)
agcuccaucagacacaugauuaggaag

SEQ ID NO: 64685 - RNA, 36 nt, Artificial Sequence
  Dermcidin (63-74)
agcucccugcucgagaagggccuugacggggccaaa

SEQ ID NO: 64686 - RNA, 27 nt, Artificial Sequence
  Integrator complex subunit 3 (459-467)
agcucccugaaccacaucguggagaag

SEQ ID NO: 64687 - RNA, 27 nt, Artificial Sequence
  Retinoblastoma-like protein 2 (834-842)
agcucccugucucucuucuuuagaaag

SEQ ID NO: 64688 - RNA, 30 nt, Artificial Sequence
  GATS-like protein 2 (89-98)
agcuccucucagcccaucggcgugaccaag

SEQ ID NO: 64689 - RNA, 33 nt, Artificial Sequence
  Synaptotagmin-like protein 2 (280-290)
agcuccucuaccgacucagagacacugagauac

SEQ ID NO: 64690 - RNA, 33 nt, Artificial Sequence
  WD repeat-containing protein 62 (49-59)
agcaccgccuccgaggaaacagugcagaacaga

SEQ ID NO: 64691 - RNA, 27 nt, Artificial Sequence
  Cyclic AMP-responsive element-binding protein 3-like protein 2 (116-124)
agcaccgacuuccccuccacaucuauc

SEQ ID NO: 64692 - RNA, 36 nt, Artificial Sequence
  ETS-related transcription factor Elf-1 (430-441)
agcaccgaccccuccgccggcacagggucucagaag

SEQ ID NO: 64693 - RNA, 30 nt, Artificial Sequence
  Epidermal growth factor receptor kinase substrate 8 (476-485)
agcaccgagcacuccucugugucagaauac

SEQ ID NO: 64694 - RNA, 27 nt, Artificial Sequence
  Nuclear receptor subfamily 2 group C member 2 (226-234)
agcaccgagaagaucuacauuagaaaa

SEQ ID NO: 64695 - RNA, 30 nt, Artificial Sequence
  V-type proton ATPase subunit H (296-305)
agcaccgagagagaaacaaggcaggaguac

SEQ ID NO: 64696 - RNA, 30 nt, Artificial Sequence
  Nucleolar protein 56 (354-363)
agcaccuucaucggcagagccgcugcaaag

SEQ ID NO: 64697 - RNA, 33 nt, Artificial Sequence
  Ankyrin repeat and KH domain-containing protein 1 (1842-1852)
agcaccuuccagcccgccaacaagcugaauaaa

SEQ ID NO: 64698 - RNA, 33 nt, Artificial Sequence
  5-aminolevulinate synthase, nonspecific, mitochondrial (212-222)
agcaccuuccaguacgacagauuuuucgagaag

SEQ ID NO: 64699 - RNA, 27 nt, Artificial Sequence
  Nuclear autoantigen Sp-100 (389-397)
agcaccuucagagaguccuuuaagaaa

SEQ ID NO: 64700 - RNA, 30 nt, Artificial Sequence
  Zinc finger protein SNAI2 (138-147)
agcaccuucuccggccuggccaagcacaaa

SEQ ID NO: 64701 - RNA, 36 nt, Artificial Sequence
  Oxidative stress-responsive serine-rich protein 1 (96-107)
agcaccaucgccuccucuucaaguagccagcugaag

SEQ ID NO: 64702 - RNA, 27 nt, Artificial Sequence
  Clathrin interactor 1 (210-218)
agcaccaucgacgauacaauuuccaag

SEQ ID NO: 64703 - RNA, 33 nt, Artificial Sequence
  Ligand-dependent nuclear receptor-interacting factor 1 (338-348)
agcaccaucgaccccuccggcacaagaucuaag

SEQ ID NO: 64704 - RNA, 30 nt, Artificial Sequence
  Regulation of nuclear pre-mRNA domain-containing protein 2 (942-951)
agcaccaucgaguucaagaacaugcugaaa

SEQ ID NO: 64705 - RNA, 27 nt, Artificial Sequence
  Probable RNA-binding protein 23 (53-61)
agcaccaucggcgagacauccaacaga

SEQ ID NO: 64706 - RNA, 36 nt, Artificial Sequence
  Hexokinase-2 (408-419)
agcaccaucggcguggacggguccgucuacaagaaa

SEQ ID NO: 64707 - RNA, 33 nt, Artificial Sequence
  Transcription intermediary factor 1-alpha (597-607)
agcaccaucaugcuggacaacauugugagaaag

SEQ ID NO: 64708 - RNA, 27 nt, Artificial Sequence
  Tigger transposable element-derived protein 2 (379-387)
agcaccaucacaaaggccuggaaaaag

SEQ ID NO: 64709 - RNA, 33 nt, Artificial Sequence
  Mediator of RNA polymerase II transcription subunit 20 (51-61)
agcacccugggcucccaggggcaaacaggaaag

SEQ ID NO: 64710 - RNA, 27 nt, Artificial Sequence
  KN motif and ankyrin repeat domain-containing protein 1 (972-980)
agcacccugaaguccaucaugaaaaag

SEQ ID NO: 64711 - RNA, 33 nt, Artificial Sequence
  Alanine-tRNA ligase, cytoplasmic (3-13)
agcacccugacagccuccgagaucagacagagg

SEQ ID NO: 64712 - RNA, 27 nt, Artificial Sequence
  Guanine nucleotide-binding protein G(I)/G(S)/G(O) subunit gamma-12 (7-15)
agcaccaacaauaucgcccaggcuaga

SEQ ID NO: 64713 - RNA, 27 nt, Artificial Sequence
  AP-3 complex subunit delta-1 (232-240)
agcaccaacaauugggugcugaucaag

SEQ ID NO: 64714 - RNA, 27 nt, Artificial Sequence
  Guanine nucleotide-binding protein G(I)/G(S)/G(O) subunit gamma-5 (55-63)
agcaccaaccccuucagaccucagaag

SEQ ID NO: 64715 - RNA, 33 nt, Artificial Sequence
  ATP synthase F(0) complex subunit B1, mitochondrial (228-238)
agcacccagcaagagaaggaaacaaucgccaaa

SEQ ID NO: 64716 - RNA, 30 nt, Artificial Sequence
  Band 4.1-like protein 2 (78-87)
agcaccacaacuacgacccacaucacaaag

SEQ ID NO: 64717 - RNA, 27 nt, Artificial Sequence
  Mediator of RNA polymerase II transcription subunit 25 (129-137)
agcaccguggcccccggcuccgggcug

SEQ ID NO: 64718 - RNA, 27 nt, Artificial Sequence
  SEC14-like protein 1 (142-150)
agcaccguggagaagaucgccaugaaa

SEQ ID NO: 64719 - RNA, 33 nt, Artificial Sequence
  Signal recognition particle 14 kDa protein (68-78)
agcaccguggucuccucuaaggagguuaacaaa

SEQ ID NO: 64720 - RNA, 30 nt, Artificial Sequence
  Cleavage and polyadenylation specificity factor subunit 3 (66-75)
agcaccuacggcacacacauccaugagaag

SEQ ID NO: 64721 - RNA, 30 nt, Artificial Sequence
  DmX-like protein 2 (1766-1775)
agcaccuacaucuccauucugaaccagaag

SEQ ID NO: 64722 - RNA, 33 nt, Artificial Sequence
  Lysosomal protective protein (339-349)
agcaccuaccugaacaaucccuaugugagaaag

SEQ ID NO: 64723 - RNA, 30 nt, Artificial Sequence
  E3 ubiquitin-protein ligase HECTD1 (546-555)
agcaccuacaaccugcagauccucacaaga

SEQ ID NO: 64724 - RNA, 33 nt, Artificial Sequence
  Protein FAM84B (105-115)
agcaccuacacacccgagaaccugcucaauaag

SEQ ID NO: 64725 - RNA, 30 nt, Artificial Sequence
  Lysine-specific demethylase 5B (847-856)
agcguggcccagcaacugcucaacggcaag

SEQ ID NO: 64726 - RNA, 27 nt, Artificial Sequence
  Perilipin-2 (129-137)
agcguggccuccaccaucacaggcguc

SEQ ID NO: 64727 - RNA, 33 nt, Artificial Sequence
  Oral-facial-digital syndrome 1 protein (92-102)
agcguguucuuucccgaguccggccuggccaag

SEQ ID NO: 64728 - RNA, 33 nt, Artificial Sequence
  Short coiled-coil protein (42-52)
agcguguuccagaccacagacacuaaguccaaa

SEQ ID NO: 64729 - RNA, 27 nt, Artificial Sequence
  Centromere protein F (215-223)
agcguguucuccuggcagcaagagaag

SEQ ID NO: 64730 - RNA, 33 nt, Artificial Sequence
  Probable 18S rRNA (guanine-N(7))-methyltransferase (228-238)
agcguguucaccaacgagagauuuccccugagg

SEQ ID NO: 64731 - RNA, 36 nt, Artificial Sequence
  Protein FAN (644-655)
agcguguucaccacaucccaggacucuacucugaag

SEQ ID NO: 64732 - RNA, 27 nt, Artificial Sequence
  Acyl-CoA desaturase (245-253)
agcguguucgucgccaccuuucugaga

SEQ ID NO: 64733 - RNA, 27 nt, Artificial Sequence
  Nitric oxide synthase-interacting protein (147-155)
agcgugggccccccuuccaaggacaaa

SEQ ID NO: 64734 - RNA, 30 nt, Artificial Sequence
  V-type proton ATPase subunit d 1 (68-77)
agcgugaucgacgauagacugaaggagaaa

SEQ ID NO: 64735 - RNA, 33 nt, Artificial Sequence
  Striatin (234-244)
agcgugaucgacaccuccacaauugucagaaag

SEQ ID NO: 64736 - RNA, 33 nt, Artificial Sequence
  Phosducin-like protein (220-230)
agcgugaucggcgccuccucucaguucaccaga

SEQ ID NO: 64737 - RNA, 27 nt, Artificial Sequence
  Protein fuzzy homolog (41-49)
agcgugaucggcucccugaacgggguc

SEQ ID NO: 64738 - RNA, 27 nt, Artificial Sequence
  MAP kinase-activating death domain protein (1140-1148)
agcgugaucggcgucucccccgccguu

SEQ ID NO: 64739 - RNA, 27 nt, Artificial Sequence
  Tubby-related protein 3 (322-330)
agcgugaucauucccggcaugacccug

SEQ ID NO: 64740 - RNA, 27 nt, Artificial Sequence
  ETS-related transcription factor Elf-1 (531-539)
agcgugaucaagacccaggagacaaaa

SEQ ID NO: 64741 - RNA, 27 nt, Artificial Sequence
  SEC14 domain and spectrin repeat-containing protein 1 (4-12)
agcgugauccugcccauucucaagaaa

SEQ ID NO: 64742 - RNA, 27 nt, Artificial Sequence
  Serine/threonine-protein kinase RIO1 (130-138)
agcgugaucaacaaggucaccgagaaa

SEQ ID NO: 64743 - RNA, 27 nt, Artificial Sequence
  NHS-like protein 1 (635-643)
agcgugaucaacgucuucguuggcaga

SEQ ID NO: 64744 - RNA, 33 nt, Artificial Sequence
  E3 ubiquitin-protein ligase Topors (307-317)
agcgugcugggcaaggacgagcagaucaacaaa

SEQ ID NO: 64745 - RNA, 27 nt, Artificial Sequence
  Nuclear pore complex protein Nup50 (280-288)
agcgugcugggcucccucucuucaguc

SEQ ID NO: 64746 - RNA, 27 nt, Artificial Sequence
  Superkiller viralicidic activity 2-like 2 (759-767)
agcgugcugaaguccauccaggagguc

SEQ ID NO: 64747 - RNA, 27 nt, Artificial Sequence
  Nuclear pore membraneoprotein 210 (659-667)
agcgugcugaacuucgccaccaauaga

SEQ ID NO: 64748 - RNA, 36 nt, Artificial Sequence
  Little elongation complex subunit 1 (852-863)
agcgugcugcccaaccaggucuccguuaucaccaag

SEQ ID NO: 64749 - RNA, 33 nt, Artificial Sequence
  Lysine-specific demethylase 3A (512-522)
agcgugcugaccgaccccgccaagcucaaaaag

SEQ ID NO: 64750 - RNA, 27 nt, Artificial Sequence
  Enhancer of mRNA-decapping protein 4 (927-935)
agcgugauggcccaggucagacaaaag

SEQ ID NO: 64751 - RNA, 30 nt, Artificial Sequence
  Poly(U)-binding-splicing factor PUF60 (174-183)
agcgugaugcugggcgggagaaacaucaag

SEQ ID NO: 64752 - RNA, 27 nt, Artificial Sequence
  TGF-beta-activated kinase 1 and MAP3K7-binding protein 2 (354-362)
agcgugaacucccagacccugaauaga

SEQ ID NO: 64753 - RNA, 30 nt, Artificial Sequence
  Rho GDP-dissociation inhibitor 1 (24-33)
agcgugaacuacaagcccccugcccagaaa

SEQ ID NO: 64754 - RNA, 30 nt, Artificial Sequence
  LON peptidase N-terminal domain and RING finger protein 1 (418-427)
agcgugcaggagaagggcguccugcucaaa

SEQ ID NO: 64755 - RNA, 27 nt, Artificial Sequence
  Kinesin-like protein KIF11 (750-758)
agcgugcaggagaacauccaacagaag

SEQ ID NO: 64756 - RNA, 27 nt, Artificial Sequence
  DNA topoisomerase 2-binding protein 1 (587-595)
agcgugcaggaguacuucgucagaaag

SEQ ID NO: 64757 - RNA, 27 nt, Artificial Sequence
  Zinc-binding alcohol dehydrogenase domain-containing protein 2 (299-307)
agcgugcagggcuucuuucugaaccac

SEQ ID NO: 64758 - RNA, 33 nt, Artificial Sequence
  E3 ubiquitin-protein ligase MARCH7 (13-23)
agcgugcagcccuccucuucacugagugccaga

SEQ ID NO: 64759 - RNA, 33 nt, Artificial Sequence
  MAP7 domain-containing protein 3 (532-542)
agcgugcaguccgccucuucaaccgucaagaaa

SEQ ID NO: 64760 - RNA, 30 nt, Artificial Sequence
  BRCA1-associated RING domain protein 1 (162-171)
agcgugcagacccaacccgccaucaagaaa

SEQ ID NO: 64761 - RNA, 27 nt, Artificial Sequence
  DNA-directed RNA polymerase, mitochondrial (77-85)
agcguguccgaggucguugugaacaga

SEQ ID NO: 64762 - RNA, 30 nt, Artificial Sequence
  GAS2-like protein 3 (568-577)
agcgugucccccgucaaggccacccagaaa

SEQ ID NO: 64763 - RNA, 27 nt, Artificial Sequence
  Lipoma-preferred partner (35-43)
agcguguccacccagcaacccccuaag

SEQ ID NO: 64764 - RNA, 27 nt, Artificial Sequence
  Probable 8-oxo-dGTP diphosphatase NUDT15 (78-86)
agcguggucaacuccuucaucgagaag

SEQ ID NO: 64765 - RNA, 27 nt, Artificial Sequence
  Transmembrane and TPR repeat-containing protein 2 (627-635)
agcguguacaaggaggccauccagaaa

SEQ ID NO: 64766 - RNA, 27 nt, Artificial Sequence
  Cytoplasmic dynein 1 heavy chain 1 (2957-2965)
agcguguaccagaucaagguccacaga

SEQ ID NO: 64767 - RNA, 27 nt, Artificial Sequence
  Tetratricopeptide repeat protein 28 (60-68)
agcuaccacaacuaugugcuggagcuc

SEQ ID NO: 64768 - RNA, 27 nt, Artificial Sequence
  Long-chain-fatty-acid-CoA ligase 3 (616-624)
agcuaccacuccuaugugaucggcuuc

SEQ ID NO: 64769 - RNA, 27 nt, Artificial Sequence
  14-3-3 protein beta/alpha (212-220)
agcuacaaggacuccacccugaucaug

SEQ ID NO: 64770 - RNA, 27 nt, Artificial Sequence
  Serine/threonine-protein kinase 24 (88-96)
agcuaccugaaggacaccaaacucugg

SEQ ID NO: 64771 - RNA, 27 nt, Artificial Sequence
  Selenoprotein N (310-318)
agcuaccugcccuucaccgaggccuuu

SEQ ID NO: 64772 - RNA, 27 nt, Artificial Sequence
  Zinc finger protein 383 (239-247)
agcuaccugucccagcaccaaagaauc

SEQ ID NO: 64773 - RNA, 27 nt, Artificial Sequence
  Tumor necrosis factor receptor superfamily member 3 (87-95)
agcuacaacgagcacuggaauuaucug

SEQ ID NO: 64774 - RNA, 27 nt, Artificial Sequence
  Transmembrane protein 39A (477-485)
agcuacccccugaacuccuaugagcuc

SEQ ID NO: 64775 - RNA, 27 nt, Artificial Sequence
  Tetraspanin-10 (217-225)
agcuaccaggacuggcaacagaaccug

SEQ ID NO: 64776 - RNA, 27 nt, Artificial Sequence
  Calcyclin-binding protein (124-132)
agcuacuccaugaucgugaacaaucug

SEQ ID NO: 64777 - RNA, 27 nt, Artificial Sequence
  Transmembrane protein 39A (363-371)
agcuacuccaacgccccccagcacauc

SEQ ID NO: 64778 - RNA, 27 nt, Artificial Sequence
  Serine/threonine-protein kinase LATS2 (554-562)
agcuacucccccuaugccuucaaguuu

SEQ ID NO: 64779 - RNA, 27 nt, Artificial Sequence
  AF4/FMR2 family member 4 (1095-1103)
agcuacgugcaggucaccuccaacuuc

SEQ ID NO: 64780 - RNA, 33 nt, Artificial Sequence
  Basement membrane-specific heparan sulfate proteoglycan core protein (176-186)
agcuacgugaccuccccccagggcuuccaauuu

SEQ ID NO: 64781 - RNA, 27 nt, Artificial Sequence
  Transcription factor BTF3 (82-90)
accgccgacgauaagaaacugcaguuc

SEQ ID NO: 64782 - RNA, 27 nt, Artificial Sequence
  Dolichyl-diphosphooligosaccharide-proteinosyltransferase 48 kDa subunit (78-86)
accgccgacgaucccagccugucccuc

SEQ ID NO: 64783 - RNA, 30 nt, Artificial Sequence
  Transducin beta-like protein 3 (197-206)
accgccgaccacaaccugcuccuuuacgag

SEQ ID NO: 64784 - RNA, 27 nt, Artificial Sequence
  Lymphocyte cytosolic protein 2 (227-235)
accgccaagcugcccgcuccuagcauc

SEQ ID NO: 64785 - RNA, 27 nt, Artificial Sequence
  Pyridine nucleotide-disulfide oxidoreductase domain-containing protein 1 (42-50)
accgccagccccgugaucaaggcuguc

SEQ ID NO: 64786 - RNA, 27 nt, Artificial Sequence
  Programmed cell death 6-interacting protein (658-666)
accgccuacgacaacuucguggagcug

SEQ ID NO: 64787 - RNA, 42 nt, Artificial Sequence
  Cullin-4B (24-37)
accgacggcaacacaagcacuacgcccccuaccuccgccaag

SEQ ID NO: 64788 - RNA, 27 nt, Artificial Sequence
  Putative sodium-coupled neutral amino acid transporter 10 (253-261)
accgaggccacagcuggcaacgugcug

SEQ ID NO: 64789 - RNA, 33 nt, Artificial Sequence
  Optineurin (373-383)
accgaggacgaaaagagcaaacugacagugcuc

SEQ ID NO: 64790 - RNA, 36 nt, Artificial Sequence
  Nuclear factor erythroid 2-related factor 2 (160-171)
accgaggaccccaaccagcugacagugaauagccuc

SEQ ID NO: 64791 - RNA, 33 nt, Artificial Sequence
  Actin-related protein 2/3 complex subunit 1A (312-322)
accgaggacagaaacacagcccuggaaacucuc

SEQ ID NO: 64792 - RNA, 27 nt, Artificial Sequence
  Dynactin subunit 2 (131-139)
accgaggaaaagcugacacccgugcuc

SEQ ID NO: 64793 - RNA, 30 nt, Artificial Sequence
  Dynactin subunit 2 (131-140)
accgaggaaaagcugacacccgugcuccuu

SEQ ID NO: 64794 - RNA, 30 nt, Artificial Sequence
  Protein fuzzy homolog (371-380)
accgaggaacccggcacaggggugagacug

SEQ ID NO: 64795 - RNA, 33 nt, Artificial Sequence
  BRF1 protein (61-71)
accgaguucgaagacacacccacuagccagcug

SEQ ID NO: 64796 - RNA, 30 nt, Artificial Sequence
  Dystonin (2514-2523)
accgagaucgacagcaaguggcaggaacug

SEQ ID NO: 64797 - RNA, 27 nt, Artificial Sequence
  Protein TBRG4 (216-224)
accgagaucgaagacagccacacacug

SEQ ID NO: 64798 - RNA, 27 nt, Artificial Sequence
  RuvB-like 1 (44-52)
accgagaucaagaaaacagaagugcug

SEQ ID NO: 64799 - RNA, 27 nt, Artificial Sequence
  MIF2 suppressor (12-20)
accgagaacaaugaccacaucaaccug

SEQ ID NO: 64800 - RNA, 27 nt, Artificial Sequence
  Sodium/potassium-transporting ATPase subunit alpha-1 (206-214)
accgagaaccagagcggcguguccuuc

SEQ ID NO: 64801 - RNA, 27 nt, Artificial Sequence
  Eukaryotic translation initiation factor 3 subunit L (482-490)
accgagcaggaauucagaauccaacug

SEQ ID NO: 64802 - RNA, 30 nt, Artificial Sequence
  Golgi-associated PDZ and coiled-coil motif-containing protein (106-115)
accgagacacaggccgaaaaggugguccug

SEQ ID NO: 64803 - RNA, 30 nt, Artificial Sequence
  Dolichyl-diphosphooligosaccharide-proteinosyltransferase subunit 2 (371-380)
accgaggugggcaucacaaacgucgaccug

SEQ ID NO: 64804 - RNA, 30 nt, Artificial Sequence
  Apoptosis-inducing factor 2 (163-172)
accgaguaccccgaaaaggaggugacacug

SEQ ID NO: 64805 - RNA, 27 nt, Artificial Sequence
  Fibronectin type III domain-containing protein 3B (635-643)
acccaccugaagcccggcacacucuac

SEQ ID NO: 64806 - RNA, 27 nt, Artificial Sequence
  Transcription factor 12 (468-476)
acccacagagaggacagcgugucccug

SEQ ID NO: 64807 - RNA, 27 nt, Artificial Sequence
  N-alpha-acetyltransferase 25, NatB auxiliary subunit (500-508)
acccacagccccuccaacgcccaguuc

SEQ ID NO: 64808 - RNA, 27 nt, Artificial Sequence
  Minor histocompatibility antigen H13 (287-295)
acccacacauacuucuauacuagcuuu

SEQ ID NO: 64809 - RNA, 27 nt, Artificial Sequence
  GLTSCR1-like protein (169-177)
acccacgugcccgucggcgccagcuuc

SEQ ID NO: 64810 - RNA, 27 nt, Artificial Sequence
  Asparagine synthetase (glutamine-hydrolyzing) (553-561)
acccacuacaagagcgccgugaaagcu

SEQ ID NO: 64811 - RNA, 33 nt, Artificial Sequence
  Sorting nexin-18 (279-289)
accaucgacgaucccacaaagcagacuaaauuc

SEQ ID NO: 64812 - RNA, 27 nt, Artificial Sequence
  Clathrin interactor 1 (211-219)
accaucgacgauacaauuagcaaguuc

SEQ ID NO: 64813 - RNA, 27 nt, Artificial Sequence
  Nucleolar GTP-binding protein 1 (163-171)
accaucgaccccaacacaagaacucug

SEQ ID NO: 64814 - RNA, 39 nt, Artificial Sequence
  Signal transducer and activator of transcription 5B (372-384)
accaucauuagcgagcagcaagccaagucccugcucaaa

SEQ ID NO: 64815 - RNA, 27 nt, Artificial Sequence
  Sorting nexin-14 (74-82)
accaucaaguacaaacccaagcagcug

SEQ ID NO: 64816 - RNA, 33 nt, Artificial Sequence
  Heterogeneous nuclear ribonucleoproteins A2/B1 (164-174)
accaucaacggccacaaugccgaggugagaaag

SEQ ID NO: 64817 - RNA, 30 nt, Artificial Sequence
  Similar to calcium-independent phospholipase A2 (165-174)
accaucgugaacagaggcauuacacccaag

SEQ ID NO: 64818 - RNA, 33 nt, Artificial Sequence
  Cytoplasmic dynein 1 heavy chain 1 (1281-1291)
accaucuacgagggcaaguucgggagacugaaa

SEQ ID NO: 64819 - RNA, 27 nt, Artificial Sequence
  Melanoma-associated antigen D1 (153-161)
accaaggugggccccaacgccacauac

SEQ ID NO: 64820 - RNA, 27 nt, Artificial Sequence
  Calmodulin-binding transcription activator 1 (1179-1187)
acccuggccgagcacaucauugaagcu

SEQ ID NO: 64821 - RNA, 36 nt, Artificial Sequence
  Syndecan-3 (348-359)
acccuggaggaacccaagcaggccagcgugacauac

SEQ ID NO: 64822 - RNA, 36 nt, Artificial Sequence
  Septin-7 (426-437)
acccuggagaagaacaaaaagaaaggcaagaucuuc

SEQ ID NO: 64823 - RNA, 33 nt, Artificial Sequence
  Histone-lysine N-methyltransferase ASH1L (2959-2969)
acccuguucauccccgagaacagcuuuagaaag

SEQ ID NO: 64824 - RNA, 33 nt, Artificial Sequence
  Uncharacterized protein C1orf198 (300-310)
acccuguucagcgagcccaaguuugcccaggug

SEQ ID NO: 64825 - RNA, 33 nt, Artificial Sequence
  Signal recognition particle receptor subunit beta (114-124)
acccugaucgaccuccccggccacgagagccuu

SEQ ID NO: 64826 - RNA, 27 nt, Artificial Sequence
  Conserved oligomeric Golgi complex subunit 5 (271-279)
acccugaaggacacaaucacuagcgug

SEQ ID NO: 64827 - RNA, 27 nt, Artificial Sequence
  Transcription intermediary factor 1-beta (187-195)
acccugcagaagagcacaaaagaggug

SEQ ID NO: 64828 - RNA, 27 nt, Artificial Sequence
  Cell division cycle protein 20 homolog (304-312)
acccugagcggccacucccaggaggug

SEQ ID NO: 64829 - RNA, 27 nt, Artificial Sequence
  Zinc finger BED domain-containing protein 4 (953-961)
acccugagccaggugauccccaugguc

SEQ ID NO: 64830 - RNA, 27 nt, Artificial Sequence
  Ubiquitin-60S ribosomal protein L40 (12-20)
acccugacaggcaagacuaucacgcuc

SEQ ID NO: 64831 - RNA, 27 nt, Artificial Sequence
  Sodium/potassium-transporting ATPase subunit alpha-3 (782-790)
acccugacaagcaacauccccgagauu

SEQ ID NO: 64832 - RNA, 33 nt, Artificial Sequence
  Putative heat shock protein HSP 90-beta 2 (85-95)
acccugguggacacaggcaucgggaugacuaag

SEQ ID NO: 64833 - RNA, 33 nt, Artificial Sequence
  Lathosterol oxidase (245-255)
acccugugggacagaaucggcgggagcuucaag

SEQ ID NO: 64834 - RNA, 27 nt, Artificial Sequence
  Nicotinamide phosphoribosyltransferase (435-443)
acccccgccggcaacuucgugacacug

SEQ ID NO: 64835 - RNA, 27 nt, Artificial Sequence
  SH3 domain-containing protein 19 (137-145)
acccccgccccuagaccacugcuccuu

SEQ ID NO: 64836 - RNA, 27 nt, Artificial Sequence
  Ephrin-A5 (207-215)
acccccagaaucccuagcaggcugcuc

SEQ ID NO: 64837 - RNA, 27 nt, Artificial Sequence
  40S ribosomal protein S2 (285-293)
acccaggcccccgcuguggcaacaacu

SEQ ID NO: 64838 - RNA, 27 nt, Artificial Sequence
  RNA-binding protein EWS (33-41)
acccaggccuacggccaacagagcuau

SEQ ID NO: 64839 - RNA, 27 nt, Artificial Sequence
  28S ribosomal protein S12, mitochondrial (115-123)
acccaggaccugcccggcgugaagcuc

SEQ ID NO: 64840 - RNA, 33 nt, Artificial Sequence
  Synphilin-1 (60-70)
acccagaagcccacaggcaucgccgacguguac

SEQ ID NO: 64841 - RNA, 27 nt, Artificial Sequence
  U5 small nuclear ribonucleoprotein 200 kDa helicase (1765-1773)
acccagaaccccaauuacuauaaccug

SEQ ID NO: 64842 - RNA, 27 nt, Artificial Sequence
  SWI/SNF-related matrix-associated actin-dependent regulator of chromatin subfamily D member 1 (436-444)
acccagagagaguucaugcugagcuuu

SEQ ID NO: 64843 - RNA, 27 nt, Artificial Sequence
  Protein FAM204A (125-133)
acccaguggaaggagcugacacaauac

SEQ ID NO: 64844 - RNA, 27 nt, Artificial Sequence
  Cytoskeleton-associated protein 2 (274-282)
accagcgccaacgugacaaucagaaag

SEQ ID NO: 64845 - RNA, 27 nt, Artificial Sequence
  Uncharacterized protein KIAA2013 (598-606)
accagcgcccccacaggccacacuuuc

SEQ ID NO: 64846 - RNA, 27 nt, Artificial Sequence
  Long-chain-fatty-acid-CoA ligase 4 (10-18)
accagcgacaagcccggcuccccuuac

SEQ ID NO: 64847 - RNA, 27 nt, Artificial Sequence
  Zinc finger MYM-type protein 1 (293-301)
accagcgaccugggcaagacagagcuc

SEQ ID NO: 64848 - RNA, 27 nt, Artificial Sequence
  Importin subunit alpha-4 (81-89)
accagcgacaaccccgugguccagcug

SEQ ID NO: 64849 - RNA, 27 nt, Artificial Sequence
  Dual specificity mitogen-activated protein kinase kinase 3 (150-158)
accagccuggacaaguucuacagaaaa

SEQ ID NO: 64850 - RNA, 33 nt, Artificial Sequence
  Prothymosin alpha (8-18)
accagcuccgagaucacaacuaaggaccugaaa

SEQ ID NO: 64851 - RNA, 27 nt, Artificial Sequence
  Histone-lysine N-methyltransferase SETD2 (1436-1444)
accagcgugcccccuggcuccgcccug

SEQ ID NO: 64852 - RNA, 27 nt, Artificial Sequence
  Metastasis-associated protein MTA2 (312-320)
accacagacagauacauccagcaaaag

SEQ ID NO: 64853 - RNA, 27 nt, Artificial Sequence
  Cyclin-dependent kinase 1 (25-33)
accacaggccagguggucgccaugaag

SEQ ID NO: 64854 - RNA, 33 nt, Artificial Sequence
  ATP-dependent RNA helicase DHX8 (1166-1176)
accacaaucgaccccagauggcugguggaguuc

SEQ ID NO: 64855 - RNA, 27 nt, Artificial Sequence
  Splicing factor 3A subunit 1 (123-131)
accacacagcaacagcugccccagaag

SEQ ID NO: 64856 - RNA, 27 nt, Artificial Sequence
  Germinal-center associated nuclear protein (203-211)
accacaagcaacuucacuuuuuccaag

SEQ ID NO: 64857 - RNA, 27 nt, Artificial Sequence
  Vacuolar protein sorting-associated protein 35 (375-383)
accacaguggagaucuucaacaagcug

SEQ ID NO: 64858 - RNA, 30 nt, Artificial Sequence
  Eukaryotic translation initiation factor 3 subunit L (353-362)
accacauacaaguaugagaugaucaacaaa

SEQ ID NO: 64859 - RNA, 27 nt, Artificial Sequence
  Cofilin-1 (12-20)
accguggacgaucccuacgccacauuc

SEQ ID NO: 64860 - RNA, 27 nt, Artificial Sequence
  CCAAT/enhancer-binding protein beta (266-274)
accguggacaagcacagcgaugaguac

SEQ ID NO: 64861 - RNA, 33 nt, Artificial Sequence
  WD repeat-containing protein 48 (379-389)
accguggacaagaacaugcccaaauucaauaag

SEQ ID NO: 64862 - RNA, 27 nt, Artificial Sequence
  TRAF2 and NCK-interacting protein kinase (352-360)
accguggaggaaggccagagacugaag

SEQ ID NO: 64863 - RNA, 30 nt, Artificial Sequence
  Nicotinamide phosphoribosyltransferase (460-469)
accguguucaagaacggcaaagucacaaag

SEQ ID NO: 64864 - RNA, 27 nt, Artificial Sequence
  E3 ubiquitin-protein ligase RNF213 (4830-4838)
accguguuccugagcacauggaacaag

SEQ ID NO: 64865 - RNA, 27 nt, Artificial Sequence
  Chromatin assembly factor 1 subunit B (444-452)
accgugaucagagaccccccuagcauu

SEQ ID NO: 64866 - RNA, 27 nt, Artificial Sequence
  Glycine-tRNA ligase (350-358)
accgugcugggcuacuucaucgggaga

SEQ ID NO: 64867 - RNA, 33 nt, Artificial Sequence
  Beta-lactamase-like protein 2 (237-247)
accgugauggagcuggucaagaucauuuacaaa

SEQ ID NO: 64868 - RNA, 27 nt, Artificial Sequence
  Probable U3 small nucleolar RNA-associated protein 11 (238-246)
accgugaacagccccgccaucuacaag

SEQ ID NO: 64869 - RNA, 30 nt, Artificial Sequence
  Complex I assembly factor TIMMDC1, mitochondrial (151-160)
accgugaacacaagccugaaugucuacaga

SEQ ID NO: 64870 - RNA, 27 nt, Artificial Sequence
  Coiled-coil domain-containing protein 66 (124-132)
accgugaacacaagccuggucggcaag

SEQ ID NO: 64871 - RNA, 27 nt, Artificial Sequence
  Exportin-1 (648-656)
accgugcaggagcaccugaucgaaaag

SEQ ID NO: 64872 - RNA, 27 nt, Artificial Sequence
  SWI/SNF-related matrix-associated actin-dependent regulator of chromatin subfamily A containing DEAD/H box 1 (109-117)
accgugcaggagaagacauucaacaaa

SEQ ID NO: 64873 - RNA, 27 nt, Artificial Sequence
  Collagen alpha-3(VI) chain (2723-2731)
accgugagacccccugucgccguuaag

SEQ ID NO: 64874 - RNA, 27 nt, Artificial Sequence
  Cleavage and polyadenylation specificity factor subunit 3 (440-448)
accgugacaacugucauccuggagguu

SEQ ID NO: 64875 - RNA, 33 nt, Artificial Sequence
  Transformation/transcription domain-associated protein (10-20)
accguggucgaccagacaacucugaugaagaaa

SEQ ID NO: 64876 - RNA, 36 nt, Artificial Sequence
  Endoplasmic reticulum-Golgi intermediate compartment protein 1 (103-114)
accguguacgaggacaagagcggcaaacagagauau

SEQ ID NO: 64877 - RNA, 36 nt, Artificial Sequence
  HIG1 domain family member 2A, mitochondrial (27-38)
accguguacagaaaccccgagagcuucaaggaaaaa

SEQ ID NO: 64878 - RNA, 27 nt, Artificial Sequence
  Neuroblastoma-amplified sequence (1950-1958)
accuacgccgacacacugaaccaccuc

SEQ ID NO: 64879 - RNA, 27 nt, Artificial Sequence
  Dystonin (672-680)
accuacgccgagaagcugcacagacuc

SEQ ID NO: 64880 - RNA, 27 nt, Artificial Sequence
  Unconventional myosin-Va (386-394)
accuacaucaagcccauuagcaaacug

SEQ ID NO: 64881 - RNA, 27 nt, Artificial Sequence
  Protein transport protein Sec24B (640-648)
accuacaucaaccccuucgugagcuuu

SEQ ID NO: 64882 - RNA, 33 nt, Artificial Sequence; identical to SEQ ID NO: 40655
  MORN repeat-containing protein 1 (177-187)

SEQ ID NO: 64883 - RNA, 27 nt, Artificial Sequence
  Nesprin-2 (2589-2597)
accuaccuggacaagaucaaaaaguuc

SEQ ID NO: 64884 - RNA, 27 nt, Artificial Sequence
  Interferon-induced protein with tetratricopeptide repeats 1 (116-124)
accuaccuggacaagguggagaacauc

SEQ ID NO: 64885 - RNA, 27 nt, Artificial Sequence
  Putative UDP-GlcNAc:betaGal beta-1,3-N-acetylglucosaminyltransferase LOC100288842 (347-355)
accuaccuggacagcuucaagagauuu

SEQ ID NO: 64886 - RNA, 33 nt, Artificial Sequence
  Tenascin (710-720)
accuaccugcccgccccugagggccucaaguuc

SEQ ID NO: 64887 - RNA, 27 nt, Artificial Sequence
  Mid1-interacting protein 1 (6-14)
accuacaaccagaagcacagccuguuc

SEQ ID NO: 64888 - RNA, 27 nt, Artificial Sequence
  Glycogenin-2 (121-129)
accuacagccccgccuucaagcaguuu

SEQ ID NO: 64889 - RNA, 27 nt, Artificial Sequence
  60S ribosomal protein L28 (24-32)
accuacagcacagagcccaacaaucug

SEQ ID NO: 64890 - RNA, 33 nt, Artificial Sequence
  Vacuolar protein sorting-associated protein 13B (523-533)
accuacacagagaucgccggcaugcagagauuc

SEQ ID NO: 64891 - RNA, 27 nt, Artificial Sequence
  5'-3' exoribonuclease 1 (313-321)
accuacgugacaauccugcccgagcuc

SEQ ID NO: 64892 - RNA, 27 nt, Artificial Sequence
  EF-hand calcium-binding domain-containing protein 11 (105-113)
accuacuauagaggcuuccugacacuc

SEQ ID NO: 64893 - RNA, 27 nt, Artificial Sequence
  Exocyst complex component 4 (15-23)
guggccgcugcacacagcgucguucug

SEQ ID NO: 64894 - RNA, 27 nt, Artificial Sequence
  Pre-mRNA-splicing factor RBM22 (282-290)
guggccgcugagaagagcuucaacaaa

SEQ ID NO: 64895 - RNA, 27 nt, Artificial Sequence
  Protein disulfide-isomerase A4 (76-84)
guggccgacaaggauaccguccugcuc

SEQ ID NO: 64896 - RNA, 30 nt, Artificial Sequence
  Dolichyl-diphosphooligosaccharide-proteinosyltransferase 48 kDa subunit (203-212)
guggccgaccccgauaacccucugguccuc

SEQ ID NO: 64897 - RNA, 33 nt, Artificial Sequence
  KN motif and ankyrin repeat domain-containing protein 2 (489-499)
guggccgaccccaccgcucacagaaggagccug

SEQ ID NO: 64898 - RNA, 27 nt, Artificial Sequence
  40S ribosomal protein S5 (11-19)
guggccgagacccccgacaucaagcug

SEQ ID NO: 64899 - RNA, 27 nt, Artificial Sequence
  ATP-dependent 6-phosphofructokinase, liver type (717-725)
guggccuucagccccgucaccgagcug

SEQ ID NO: 64900 - RNA, 27 nt, Artificial Sequence
  Inosine-5'-monophosphate dehydrogenase 2 (219-227)
guggccaucauugcuagaaccgaccug

SEQ ID NO: 64901 - RNA, 27 nt, Artificial Sequence
  Transmembrane protein 41B (243-251)
guggccaucaaggcuggcaccacacug

SEQ ID NO: 64902 - RNA, 33 nt, Artificial Sequence
  Importin-9 (102-112)
guggccaugagccccgagcugauccagcaauuc

SEQ ID NO: 64903 - RNA, 27 nt, Artificial Sequence
  Cytochrome c oxidase subunit 7A2, mitochondrial (75-83)
guggccagcuuccccaagaaacaggag

SEQ ID NO: 64904 - RNA, 27 nt, Artificial Sequence
  Transketolase (365-373)
guggccaccgagaaggcugucgaacug

SEQ ID NO: 64905 - RNA, 27 nt, Artificial Sequence
  Hydroxyacylglutathione hydrolase-like protein (26-34)
guggccgucgacguugcugugcccaag

SEQ ID NO: 64906 - RNA, 42 nt, Artificial Sequence
  Myosin-9 (1950-1963)
guggacggcaaggccgauggggcugaggcaaaacccgccgaa

SEQ ID NO: 64907 - RNA, 27 nt, Artificial Sequence
  StAR-related lipid transfer protein 13 (841-849)
guggaggcccccccuagcgucguucug

SEQ ID NO: 64908 - RNA, 30 nt, Artificial Sequence; identical to SEQ ID NO: 40681
  Cytoplasmic dynein 1 heavy chain 1 (236-245)

SEQ ID NO: 64909 - RNA, 30 nt, Artificial Sequence
  Protein strawberry notch homolog 1 (1087-1096)
guggaggacagaagcggcauccugacccuc

SEQ ID NO: 64910 - RNA, 33 nt, Artificial Sequence
  Condensin complex subunit 3 (683-693)
guggaggaaaccgccacagcuaagaacguccug

SEQ ID NO: 64911 - RNA, 30 nt, Artificial Sequence
  Serine/threonine-protein phosphatase 2A 55 kDa regulatory subunit B alpha isoform (34-43)
guggaguucaaccacagcggcgaacugcuc

SEQ ID NO: 64912 - RNA, 33 nt, Artificial Sequence
  Dynactin subunit 3 (113-123)
guggagaucaccgaagagagcaaggcccugcuc

SEQ ID NO: 64913 - RNA, 33 nt, Artificial Sequence
  Coatomer subunit delta (229-239)
guggagaacgaagacaagaaaggcguccagcug

SEQ ID NO: 64914 - RNA, 36 nt, Artificial Sequence
  Transmembrane emp24 domain-containing protein 4 (79-90)
guggaggucaaggaccccgauggcaaaguugugcug

SEQ ID NO: 64915 - RNA, 30 nt, Artificial Sequence; identical to SEQ ID NO: 40688
  Neuroblast differentiation-associated protein AHNAK (866-875)

SEQ ID NO: 64916 - RNA, 27 nt, Artificial Sequence
  Coatomer subunit alpha (256-264)
guguuccaccccagacaggagcugauc

SEQ ID NO: 64917 - RNA, 27 nt, Artificial Sequence
  Alpha-internexin (107-115)
guguucaucgagaagguccaccagcug

SEQ ID NO: 64918 - RNA, 27 nt, Artificial Sequence
  Protein unc-119 homolog B (162-170)
gugggcgacaagcccgucagcaacuuc

SEQ ID NO: 64919 - RNA, 27 nt, Artificial Sequence
  Dehydrogenase/reductase SDR family member on chromosome X (20-28)
gugauccuggcccagcuccuuagaagg

SEQ ID NO: 64920 - RNA, 30 nt, Artificial Sequence
  Transcription initiation factor IIA subunit 1 (21-30)
gugaucaacgacgucagagauauuuuccug

SEQ ID NO: 64921 - RNA, 27 nt, Artificial Sequence
  Protein FAM208B (1046-1054)
gugaucaaccccgagccuauuacccug

SEQ ID NO: 64922 - RNA, 27 nt, Artificial Sequence
  Copine-2 (523-531)
gugcuggccgagcucccccagcaaguc

SEQ ID NO: 64923 - RNA, 33 nt, Artificial Sequence
  High affinity cationic amino acid transporter 1 (147-157)
gugcuggccgagaaccccgacaucuucgcuguc

SEQ ID NO: 64924 - RNA, 39 nt, Artificial Sequence
  Neudesin (19-31)
gugcuggcccucgcucccggccuuccuaccgcaagagcc

SEQ ID NO: 64925 - RNA, 39 nt, Artificial Sequence
  Activating signal cointegrator 1 complex subunit 2 (166-178)
gugcuguucggcaaggggaacagcccccuccuucagaaa

SEQ ID NO: 64926 - RNA, 33 nt, Artificial Sequence
  Acyl-CoA:lysophosphatidylglycerol acyltransferase 1 (180-190)
gugcuguuccccgagggcggguuucucagaaag

SEQ ID NO: 64927 - RNA, 27 nt, Artificial Sequence
  Importin-7 (169-177)
gugcugauccagaagcaaauuuucaaa

SEQ ID NO: 64928 - RNA, 27 nt, Artificial Sequence
  Tight junction protein ZO-1 (1634-1642)
gugcugagcuccaucgagaccggcguc

SEQ ID NO: 64929 - RNA, 27 nt, Artificial Sequence
  Interleukin-4 receptor subunit alpha (335-343)
gugcuguggcccgagagcaucuccguc

SEQ ID NO: 64930 - RNA, 36 nt, Artificial Sequence
  Dolichyl-diphosphooligosaccharide-proteinosyltransferase subunit 4 (23-34)
gugcuguaccacuaugucgccguuaacaaucccaag

SEQ ID NO: 64931 - RNA, 33 nt, Artificial Sequence
  Clathrin heavy chain 1 (788-798)
gugcuguaccucuauagaaacaaucuucagaag

SEQ ID NO: 64932 - RNA, 27 nt, Artificial Sequence
  ADNP homeobox protein 2 (968-976)
gugaugcacgacagcuccuucucuguc

SEQ ID NO: 64933 - RNA, 30 nt, Artificial Sequence
  Myosin-10 (1967-1976)
gugaacgagacccagcccccucaaagcgaa

SEQ ID NO: 64934 - RNA, 27 nt, Artificial Sequence
  Fas-activated serine/threonine kinase (383-391)
gugcccaucuucccucagccacugauu

SEQ ID NO: 64935 - RNA, 33 nt, Artificial Sequence
  DNA-(apurinic or apyrimidinic site) lyase (172-182)
gugcccaacgccggcagagggcuggucaggcuc

SEQ ID NO: 64936 - RNA, 27 nt, Artificial Sequence
  Eukaryotic translation initiation factor 3 subunit A (428-436)
gugccccagcugcaaaacaauaccauc

SEQ ID NO: 64937 - RNA, 27 nt, Artificial Sequence
  Zinc finger CCCH domain-containing protein 7A (237-245)
gugcccgucaugccucugaccagcauc

SEQ ID NO: 64938 - RNA, 24 nt, Artificial Sequence
  Cellular tumor antigen p53 (218-225)
gugcccuacgagccuccagaaguc

SEQ ID NO: 64939 - RNA, 27 nt, Artificial Sequence
  40S ribosomal protein S11 (120-128)
gugcagaucggcgacauugucaccguu

SEQ ID NO: 64940 - RNA, 27 nt, Artificial Sequence
  Golgin-45 (153-161)
gugcagaccgaggucaacagagaacug

SEQ ID NO: 64941 - RNA, 27 nt, Artificial Sequence
  Centrosomal protein of 192 kDa (314-322)
gugagaaaccccaggaucaccagccug

SEQ ID NO: 64942 - RNA, 27 nt, Artificial Sequence
  Oxidoreductase HTATIP2 (105-113)
gugagagucgacagggauuacguucug

SEQ ID NO: 64943 - RNA, 27 nt, Artificial Sequence
  Serine/threonine-protein phosphatase 4 catalytic subunit (102-110)
gugagauaccccgacaggaucacccug

SEQ ID NO: 64944 - RNA, 27 nt, Artificial Sequence
  Phosphorylated CTD-interacting factor 1 (411-419)
gugagcgcccccccuaugccauccguc

SEQ ID NO: 64945 - RNA, 27 nt, Artificial Sequence
  Protein prenyltransferase alpha subunit repeat-containing protein 1 (214-222)
gugagcgaccacuccggcuuccauuac

SEQ ID NO: 64946 - RNA, 36 nt, Artificial Sequence
  Nuclear protein localization protein 4 homolog (316-327)
gugagcgaggacaccagaaagggcacagucagguac

SEQ ID NO: 64947 - RNA, 27 nt, Artificial Sequence
  Neuronal regeneration-related protein (79-87)
gugagccaggagcccuucccuaacaag

SEQ ID NO: 64948 - RNA, 27 nt, Artificial Sequence
  Mannosyl-oligosaccharide glucosidase (210-218)
gugaccgacggcaaggagguccugcuc

SEQ ID NO: 64949 - RNA, 27 nt, Artificial Sequence
  Attractin (8-16)
gugaccgacggccccgggaacuacaag

SEQ ID NO: 64950 - RNA, 27 nt, Artificial Sequence
  U3 small nucleolar ribonucleoprotein protein IMP3 (23-31)
gugaccgaccacaaccugcaugagcuc

SEQ ID NO: 64951 - RNA, 27 nt, Artificial Sequence
  Protocadherin Fat 1 (1217-1225)
gugaccgacaacggcagccccccuaag

SEQ ID NO: 64952 - RNA, 30 nt, Artificial Sequence
  Death-inducer obliterator 1 (716-725)
gugaccgacaacagauacaagagcaaauau

SEQ ID NO: 64953 - RNA, 33 nt, Artificial Sequence
  Fructose-bisphosphate aldolase A (87-97)
gugaccgagaagguccuggccgcuguuuacaaa

SEQ ID NO: 64954 - RNA, 33 nt, Artificial Sequence
  Prefoldin subunit 4 (11-21)
gugaccuucgaggaccagcaaaagaucaacaaa

SEQ ID NO: 64955 - RNA, 33 nt, Artificial Sequence
  Phosphoserine aminotransferase (349-359)
gugaccaucgaggacguccagaagcuggccgcu

SEQ ID NO: 64956 - RNA, 39 nt, Artificial Sequence
  Phosphate carrier protein, mitochondrial (107-119)
gugacccugaaggaggacggcgucagagggcucgccaaa

SEQ ID NO: 64957 - RNA, 30 nt, Artificial Sequence
  Apoptosis inhibitor 5 (368-377)
gugacccugagcuggaagcccguccagaaa

SEQ ID NO: 64958 - RNA, 30 nt, Artificial Sequence
  Small subunit processome component 20 homolog (830-839)
gugaccaaccccgacaucgccgcuaagaaa

SEQ ID NO: 64959 - RNA, 27 nt, Artificial Sequence
  Putative PIP5K1A and PSMD4-like protein (656-664)
gugaccguccccccuggcccaagccug

SEQ ID NO: 64960 - RNA, 30 nt, Artificial Sequence
  Something about silencing protein 10 (302-311)
gugaccuacagaaaccugaucaauaagcuc

SEQ ID NO: 64961 - RNA, 27 nt, Artificial Sequence
  116 kDa U5 small nuclear ribonucleoprotein component (795-803)
guggucgcccaggagccccugcacaga

SEQ ID NO: 64962 - RNA, 27 nt, Artificial Sequence
  E3 ubiquitin-protein ligase TRIM23 (309-317)
guggucgacgcccacguuagagagaag

SEQ ID NO: 64963 - RNA, 27 nt, Artificial Sequence
  X-ray repair cross-complementing protein 5 (174-182)
guggucgacgccaagacccugaaaaag

SEQ ID NO: 64964 - RNA, 36 nt, Artificial Sequence
  DNA damage-binding protein 1 (364-375)
guggucgaccuggagagacagggccaagggcagcuc

SEQ ID NO: 64965 - RNA, 33 nt, Artificial Sequence
  Vacuolar protein sorting-associated protein 45 (3-13)
guggucuucgccguuaagcaguacaucagcaaa

SEQ ID NO: 64966 - RNA, 33 nt, Artificial Sequence
  60S ribosomal protein L8 (15-25)
guggucuucagagaccccuacagguuuaagaaa

SEQ ID NO: 64967 - RNA, 30 nt, Artificial Sequence
  Rho-related BTB domain-containing protein 3 (256-265)
guggucuucuacaaccccaaucugaagaaa

SEQ ID NO: 64968 - RNA, 33 nt, Artificial Sequence
  Protein FAM171B (18-28)
gugguccugcucaaggccagacuuguucccgcu

SEQ ID NO: 64969 - RNA, 33 nt, Artificial Sequence
  Clathrin interactor 1 (17-27)
guggucaugaacuacagcgagaucgaauccaag

SEQ ID NO: 64970 - RNA, 33 nt, Artificial Sequence
  Protein disulfide-isomerase A4 (356-366)
guggucaugcagcccgagaaguuccaaagcaaa

SEQ ID NO: 64971 - RNA, 30 nt, Artificial Sequence
  Sulfate anion transporter 1 (417-426)
guggucagcgccaccguugugcugcucgua

SEQ ID NO: 64972 - RNA, 27 nt, Artificial Sequence
  26S proteasome non-ATPase regulatory subunit 14 (143-151)
guggucguugaccccauccagagcgug

SEQ ID NO: 64973 - RNA, 27 nt, Artificial Sequence
  Sodium/potassium-transporting ATPase subunit alpha-1 (185-193)
guggucguuggcgaccugguggaggua

SEQ ID NO: 64974 - RNA, 27 nt, Artificial Sequence
  Receptor tyrosine-protein kinase erbB-3 (147-155)
guguacaucgagaagaacgacaaacug

SEQ ID NO: 64975 - RNA, 27 nt, Artificial Sequence
  Uncharacterized protein C5orf42 (702-710)
guguacauccugcagcccgaggucauu

SEQ ID NO: 64976 - RNA, 30 nt, Artificial Sequence
  Small nuclear ribonucleoprotein Sm D3 (61-70)
guguacaucagaggcagcaagauuagguuc

SEQ ID NO: 64977 - RNA, 27 nt, Artificial Sequence
  Selenoprotein K (56-64)
guguacaucagcaacggccagguccug

SEQ ID NO: 64978 - RNA, 27 nt, Artificial Sequence
  Fibronectin type III domain-containing protein 3B (651-659)
guguacaagggcgaggaagccaccuuc

SEQ ID NO: 64979 - RNA, 24 nt, Artificial Sequence
  Transmembrane protein 41B (71-78)
guguacaagaacuucccccagcug

SEQ ID NO: 64980 - RNA, 27 nt, Artificial Sequence
  Surfeit locus protein 4 (220-228)
guguacaagcccaugcacgacuuccug

SEQ ID NO: 64981 - RNA, 30 nt, Artificial Sequence
  Mitogen-activated protein kinase-binding protein 1 (356-365)
guguacaacgaccacagcaucuaugucugg

SEQ ID NO: 64982 - RNA, 27 nt, Artificial Sequence
  CMP-N-acetylneuraminate-beta-galactosamide-alpha-2,3-sialyltransf erase 1 (190-198)
guguaccccgagagcuucagagaacug

SEQ ID NO: 64983 - RNA, 27 nt, Artificial Sequence
  Inactive tyrosine-protein kinase 7 (603-611)
guguaccagggccacaccgcccugcuc

SEQ ID NO: 64984 - RNA, 27 nt, Artificial Sequence
  Bcl-2 homologous antagonist/killer (142-150)
guguaccagcacggccugaccggguuc

SEQ ID NO: 64985 - RNA, 27 nt, Artificial Sequence
  Rho GTPase-activating protein 5 (413-421)
guguaccagaaccacguccaacaucug

SEQ ID NO: 64986 - RNA, 27 nt, Artificial Sequence
  Mitochondrial peptide methionine sulfoxide reductase (82-90)
guguaccagcccgagcacaugagcuuc

SEQ ID NO: 64987 - RNA, 33 nt, Artificial Sequence
  Complex I assembly factor TIMMDC1, mitochondrial (158-168)
guguacagaaacaaggacgcccugagccacuuc

SEQ ID NO: 64988 - RNA, 30 nt, Artificial Sequence; identical to SEQ ID NO: 40761
  Unconventional myosin-XVIIIa (453-462)

SEQ ID NO: 64989 - RNA, 30 nt, Artificial Sequence
  Latent-transforming growth factor beta-binding protein 3 (448-457)
guguacagcuccgccgaguuccacucucug

SEQ ID NO: 64990 - RNA, 27 nt, Artificial Sequence
  Uncharacterized protein C11orf80 (292-300)
guguacacccugcucacaacucaccuu

SEQ ID NO: 64991 - RNA, 27 nt, Artificial Sequence
  Integrin alpha-11 (440-448)
guguacgucgccggcgcucccagauuc

SEQ ID NO: 64992 - RNA, 27 nt, Artificial Sequence
  Angiomotin (598-606)
guguacgucgacaagguugagaaaaug

SEQ ID NO: 64993 - RNA, 27 nt, Artificial Sequence
  Early endosome antigen 1 (285-293)
guguacguccaggagcugcaaaagcuc

SEQ ID NO: 64994 - RNA, 27 nt, Artificial Sequence
  Transformation/transcription domain-associated protein (1973-1981)
guguacuaucccgucagacaccaucug

SEQ ID NO: 64995 - RNA, 27 nt, Artificial Sequence
  Actin-binding protein anillin (212-220)
ugggaggacgaugugaaccacagcuuc

SEQ ID NO: 64996 - RNA, 27 nt, Artificial Sequence
  AP-5 complex subunit zeta-1 (1307-1315)
uacgccgcuggcgugcacagcguccug

SEQ ID NO: 64997 - RNA, 30 nt, Artificial Sequence
  Proline-rich protein 12 (50-59)
uacgccgcuccccacccucugcagagcuau

SEQ ID NO: 64998 - RNA, 27 nt, Artificial Sequence
  A-kinase anchor protein 12 (1228-1236)
uacgccgacgagaagaccaaagaugug

SEQ ID NO: 64999 - RNA, 27 nt, Artificial Sequence
  Maturin (34-42)
uacgccgaccccggcgugagcuucuau

SEQ ID NO: 65000 - RNA, 27 nt, Artificial Sequence
  Integrin alpha-V (110-118)
uacgccaaggacgauccccuggaguuc

SEQ ID NO: 65001 - RNA, 27 nt, Artificial Sequence
  Ras-related protein Rab-1B (43-51)
uacgccagcgagaacgugaauaagcug

SEQ ID NO: 65002 - RNA, 27 nt, Artificial Sequence
  Acetyl-CoA carboxylase 2 (1068-1076)
uacgccagcaacaucaccuccgugcug

SEQ ID NO: 65003 - RNA, 30 nt, Artificial Sequence
  Translocon-associated protein subunit beta (33-42)
uacgccguggagggcagagaccugacccuc

SEQ ID NO: 65004 - RNA, 24 nt, Artificial Sequence
  Melanoma-associated antigen B2 (233-240)
uacgacggcgaggaacacagcgug

SEQ ID NO: 65005 - RNA, 33 nt, Artificial Sequence
  Protein phosphatase 1A (59-69)
uacgacggccacgccgggagccagguggcuaag

SEQ ID NO: 65006 - RNA, 27 nt, Artificial Sequence
  NAD(P)H dehydrogenase (quinone) 1 (130-138)
uacgacaagggccccuucagaagcaaa

SEQ ID NO: 65007 - RNA, 30 nt, Artificial Sequence
  Proteasome subunit beta type-4 (177-186)
uacgaggcccccagccuggcuaccggcuau

SEQ ID NO: 65008 - RNA, 27 nt, Artificial Sequence
  RNA-binding motif protein, X-linked 2 (84-92)
uacgaggaccagagaagcaccauccug

SEQ ID NO: 65009 - RNA, 27 nt, Artificial Sequence
  SAP30-binding protein (41-49)
uacggcgaggacgauuucagcagacug

SEQ ID NO: 65010 - RNA, 27 nt, Artificial Sequence
  Tubulin-specific chaperone C (219-227)
uacggcaaccccaauacccugagacuc

SEQ ID NO: 65011 - RNA, 27 nt, Artificial Sequence
  Regulator of microtubule dynamics protein 1 (188-196)
uacaucauuaaggagcacuucgaaaaa

SEQ ID NO: 65012 - RNA, 27 nt, Artificial Sequence
  Tensin-3 (11-19)
uacaucaccgagagaauuauagccgug

SEQ ID NO: 65013 - RNA, 27 nt, Artificial Sequence
  Uncharacterized protein CXorf57 (109-117)
uaccuggaccccagccucaacucccuu

SEQ ID NO: 65014 - RNA, 27 nt, Artificial Sequence
  Ragulator complex protein LAMTOR2 (114-122)
uaccuggaggaaccccucacccaggug

SEQ ID NO: 65015 - RNA, 27 nt, Artificial Sequence
  HLA class I histocompatibility antigen, B-15 alpha chain (195-203)
uaccuggagaacggcaaggaaacccuc

SEQ ID NO: 65016 - RNA, 27 nt, Artificial Sequence
  Proteasome activator complex subunit 4 (1375-1383)
uaccuggagcccaagcucacccaggug

SEQ ID NO: 65017 - RNA, 27 nt, Artificial Sequence
  Inhibitor of nuclear factor kappa-B kinase subunit alpha (354-362)
uaccuguucgacaagagcaaaaccgug

SEQ ID NO: 65018 - RNA, 27 nt, Artificial Sequence
  Unconventional myosin-X (243-251)
uaccugcucgagaagaacagagugguc

SEQ ID NO: 65019 - RNA, 33 nt, Artificial Sequence
  Protein-lysine N-methyltransferase EEF2KMT (112-122)
uaccugcuccccagcggcggguccgugacccuu

SEQ ID NO: 65020 - RNA, 27 nt, Artificial Sequence
  ER lumen protein-retaining receptor 3 (196-204)
uaccuguaugugaccaagguccucaaa

SEQ ID NO: 65021 - RNA, 30 nt, Artificial Sequence
  Zinc-binding alcohol dehydrogenase domain-containing protein 2 (355-364)
uacauguauaugggcaagaacaccgggaaa

SEQ ID NO: 65022 - RNA, 27 nt, Artificial Sequence
  Ubiquitin-60S ribosomal protein L40 (64-72)
uacaacauccagaaggagagcacccug

SEQ ID NO: 65023 - RNA, 30 nt, Artificial Sequence
  Disabled homolog 2-interacting protein (418-427)
uaccccgacgauagaaccgccaggacacug

SEQ ID NO: 65024 - RNA, 33 nt, Artificial Sequence
  7-methylguanosine phosphate-specific 5'-nucleotidase (85-95)
uaccccaucgagauugacccucacagaaccgug

SEQ ID NO: 65025 - RNA, 27 nt, Artificial Sequence
  RNA polymerase II-associated protein 3 (96-104)
uaccccaaggaggccgacaucgugauu

SEQ ID NO: 65026 - RNA, 27 nt, Artificial Sequence
  Rabankyrin-5 (262-270)
uacccccugcacaaggccaucaaagug

SEQ ID NO: 65027 - RNA, 27 nt, Artificial Sequence
  AP-1 complex subunit beta-1 (421-429)
uaccccaacaaguaugagagcgugauc

SEQ ID NO: 65028 - RNA, 27 nt, Artificial Sequence
  Ataxin-2 (759-767)
uaccccgugccugucagcccaggcguu

SEQ ID NO: 65029 - RNA, 27 nt, Artificial Sequence
  Ataxin-2-like protein (752-760)
uaccccuauccugugagcaacuccguc

SEQ ID NO: 65030 - RNA, 27 nt, Artificial Sequence
  Long-chain-fatty-acid-CoA ligase 3 (709-717)
uaccaggccgacaucgagagaauguau

SEQ ID NO: 65031 - RNA, 27 nt, Artificial Sequence
  RNA-binding motif protein 22 (253-261)
uaccaguucggcgagaucagaaccauu

SEQ ID NO: 65032 - RNA, 27 nt, Artificial Sequence
  Copine-1 (66-74)
uacagauucgagaccgugcagaagcug

SEQ ID NO: 65033 - RNA, 24 nt, Artificial Sequence
  Fibronectin type III domain-containing protein 3B (557-564)
uacagaggccccagccacaccuau

SEQ ID NO: 65034 - RNA, 27 nt, Artificial Sequence
  Myosin-9 (40-48)
uacagaaucggccagagcaagguguuc

SEQ ID NO: 65035 - RNA, 27 nt, Artificial Sequence
  Fatty acid desaturase 2 (166-174)
uacagaaagcccaaauggaaccaccug

SEQ ID NO: 65036 - RNA, 27 nt, Artificial Sequence
  Breast cancer anti-estrogen resistance protein 3 (757-765)
uacagaaugaacgccgagaggauccug

SEQ ID NO: 65037 - RNA, 27 nt, Artificial Sequence
  Unconventional myosin-Ib (72-80)
uacagaaacaggaauuucuaugagcug

SEQ ID NO: 65038 - RNA, 27 nt, Artificial Sequence
  Constitutive coactivator of PPAR-gamma-like protein 1 (602-610)
uacagacccgugaggcaguaugucuac

SEQ ID NO: 65039 - RNA, 27 nt, Artificial Sequence
  E3 ubiquitin-protein ligase MARCH6 (469-477)
uacagcgacgcccccguguccgagcug

SEQ ID NO: 65040 - RNA, 33 nt, Artificial Sequence
  Discoidin, CUB and LCCL domain-containing protein 2 (339-349)
uacagcgacgauggccagaaguggaccguguau

SEQ ID NO: 65041 - RNA, 27 nt, Artificial Sequence
  TM2 domain-containing protein 2 (68-76)
uacagcgacguggagcacaccuccguc

SEQ ID NO: 65042 - RNA, 27 nt, Artificial Sequence
  Caveolin-2 (19-27)
uacagccaccauuccggccuggaguau

SEQ ID NO: 65043 - RNA, 33 nt, Artificial Sequence
  Calcium-responsive transactivator (198-208)
uacagcuccgcccagggcgggucucaacacuau

SEQ ID NO: 65044 - RNA, 30 nt, Artificial Sequence
  Paxillin (31-40)
uacagcuaucccaccggcaaccacacauac

SEQ ID NO: 65045 - RNA, 27 nt, Artificial Sequence
  Uridine phosphorylase 1 (20-28)
uacaccgagaaggacaaacaggccuau

SEQ ID NO: 65046 - RNA, 33 nt, Artificial Sequence
  Nucleolin (463-473)
uacaccggcgagaaggggcagaaccaagacuau

SEQ ID NO: 65047 - RNA, 27 nt, Artificial Sequence
  Melanophilin (121-129)
uacuaugagcacgugaaggccagauuc

SEQ ID NO: 65048 - RNA, 27 nt, Artificial Sequence
  26S proteasome non-ATPase regulatory subunit 3 (212-220)
uacuaucacgccagaguguacgaguuc

SEQ ID NO: 65049 - RNA, 27 nt, Artificial Sequence
  Neuroepithelial cell-transforming gene 1 protein (222-230)
uacuauaucgacaagcuggaguaccuc

SEQ ID NO: 65050 - RNA, 27 nt, Artificial Sequence
  Disheveled-associated activator of morphogenesis 2 (101-109)
uacuauaucgacagaauuaacagcaug

SEQ ID NO: 65051 - RNA, 30 nt, Artificial Sequence
  DNA-dependent protein kinase catalytic subunit (3101-3110)
uacuauauccagaacggcauucaaagcuuc

SEQ ID NO: 65052 - RNA, 27 nt, Artificial Sequence
  Coiled-coil domain-containing protein 130 (79-87)
uacuauaccacacccaucuacagauuc

SEQ ID NO: 65053 - RNA, 27 nt, Artificial Sequence
  RING finger protein 145 (469-477)
uacuaugugaacggcaccuacagacug

SEQ ID NO: 65054 - RNA, 27 nt, Artificial Sequence
  EH domain-containing protein 4 (505-513)
gcccuggcuaagcaccucaucaaaauu

SEQ ID NO: 65055 - RNA, 24 nt, Artificial Sequence
  Ubiquitin carboxyl-terminal hydrolase 10 (606-613)
uucggcgggcacaucagaagcgug

SEQ ID NO: 65056 - RNA, 21 nt, Artificial Sequence
  Guanine nucleotide-binding protein subunit beta-5 (322-328)
uucggccacgagaacagagug

SEQ ID NO: 65057 - RNA, 30 nt, Artificial Sequence
  Alpha-actinin-3 (113-122)
uucaucgccagcaagggcgugaaacugguc

SEQ ID NO: 65058 - RNA, 27 nt, Artificial Sequence
  Transcriptional regulator Kaiso (564-572)
uucaugagcucccacaucaagucugug

SEQ ID NO: 65059 - RNA, 33 nt, Artificial Sequence
  DNA fragmentation factor subunit alpha (139-149)
auccugcucagcgaggaagaccuucagaugcug

SEQ ID NO: 65060 - RNA, 27 nt, Artificial Sequence
  Serine/threonine-protein kinase ULK3 (108-116)
auccugcccgagaagguggccagaguc

SEQ ID NO: 65061 - RNA, 27 nt, Artificial Sequence
  Protein-lysine N-methyltransferase EEF2KMT (154-162)
aagcuggacagccccagagugaccguc

SEQ ID NO: 65062 - RNA, 27 nt, Artificial Sequence
  WASH complex subunit 7 (85-93)
aaggugcugaacaaagucaucaccguu

SEQ ID NO: 65063 - RNA, 24 nt, Artificial Sequence
  Myelin expression factor 2 (298-305)
cuguucgacagacccaugcacgug

SEQ ID NO: 65064 - RNA, 27 nt, Artificial Sequence
  cAMP-specific 3',5'-cyclic phosphodiesterase 4B (450-458)
cugcucgccgaccuuaagaccauggug

SEQ ID NO: 65065 - RNA, 27 nt, Artificial Sequence
  Multifunctional methyltransferase subunit TRM112-like protein (8-16)
cugcucagcucccacgugagaggcguc

SEQ ID NO: 65066 - RNA, 21 nt, Artificial Sequence
  60S ribosomal protein L19 (120-126)
auggagcacauccauaagcug

SEQ ID NO: 65067 - RNA, 27 nt, Artificial Sequence
  Melanoma antigen preferentially expressed in tumors (394-402)
cagcugcucgcccuucugcccagcuug

SEQ ID NO: 65068 - RNA, 27 nt, Artificial Sequence
  Proteasome activator complex subunit 4 (564-572)
cagcugcucagcgagaucaccagagug

SEQ ID NO: 65069 - RNA, 27 nt, Artificial Sequence
  Eukaryotic translation initiation factor 3 subunit C (478-486)
caggugugcgccaucauugagagaguc

SEQ ID NO: 65070 - RNA, 27 nt, Artificial Sequence
  Methylsterol monooxygenase 1 (33-41)
agaaucuacaaguauauucacaaagug

SEQ ID NO: 65071 - RNA, 27 nt, Artificial Sequence
  Spectrin beta chain, erythrocytic (86-94)
agaaugcugaucaagcuccuugaggug

SEQ ID NO: 65072 - RNA, 33 nt, Artificial Sequence
  NHP2-like protein 1 (118-128)
agcauccagcaauccauugagagacugcucgug

SEQ ID NO: 65073 - RNA, 27 nt, Artificial Sequence
  Erlin-2 (41-49)
agccuguucuccgccgugcacaagauc

SEQ ID NO: 65074 - RNA, 27 nt, Artificial Sequence
  Protein FAM214A (403-411)
agccugcacuccaagcucuucagagug

SEQ ID NO: 65075 - RNA, 27 nt, Artificial Sequence
  Vacuole membrane protein 1 (82-90)
agccugugguccaucauuucuaaggug

SEQ ID NO: 65076 - RNA, 27 nt, Artificial Sequence
  Potassium voltage-gated channel subfamily KQT member 5 (530-538)
agcaugcugggcagaguggucaagguu

SEQ ID NO: 65077 - RNA, 27 nt, Artificial Sequence
  Sialate O-acetylesterase (32-40)
accaucaugaagaaagugacaagcguc

SEQ ID NO: 65078 - RNA, 33 nt, Artificial Sequence
  Protein ELFN1 (17-27)
acccugcuccacgccggcgggcuugcuagagca

SEQ ID NO: 65079 - RNA, 27 nt, Artificial Sequence
  Reticulocalbin-1 (21-29)
gugcuggcccccagaguccucagggcu

SEQ ID NO: 65080 - RNA, 27 nt, Artificial Sequence
  Eukaryotic translation initiation factor 3 subunit A (379-387)
gugcugcaguacgucguucccgaggug

SEQ ID NO: 65081 - RNA, 27 nt, Artificial Sequence
  Intraflagellar transport protein 81 homolog (117-125)
uaccuggccagauuccucaucaagcuu

SEQ ID NO: 65082 - RNA, 27 nt, Artificial Sequence
  Small subunit processome component 20 homolog (154-162)
uaccuguauaaguaccucuggagacuu

SEQ ID NO: 65083 - RNA, 45 nt, Artificial Sequence
  Serum albumin (438-452)
aaggugccccaggucagcaccccuacacugguugagguguccaga

SEQ ID NO: 65084 - RNA, 27 nt, Artificial Sequence
  Beta-secretase 2 (5-13)
gccagagcucugcuccuuccccuguug

SEQ ID NO: 65085 - RNA, 27 nt, Artificial Sequence
  Proteasome subunit beta type-4 (79-87)
gccagauucaggaacaucagccggauu

SEQ ID NO: 65086 - RNA, 30 nt, Artificial Sequence
  Protein sel-1 homolog 1 (629-638)
gccagaaucaagcugggcgacuaccacuuc

SEQ ID NO: 65087 - RNA, 30 nt, Artificial Sequence
  Lon protease homolog 2, peroxisomal (291-300)
gccagaauccugcucgacaacgaucacuac

SEQ ID NO: 65088 - RNA, 33 nt, Artificial Sequence
  NAD(P)H dehydrogenase (quinone) 1 (128-138)
gccagaauccagauucuggagggcuggaagaaa

SEQ ID NO: 65089 - RNA, 27 nt, Artificial Sequence
  Zinc finger protein 721 (73-81)
gccagagugaaggucuucagcaaauuu

SEQ ID NO: 65090 - RNA, 27 nt, Artificial Sequence
  TATA-box-binding protein (218-226)
gccagagugguccagaagcugggcuuc

SEQ ID NO: 65091 - RNA, 66 nt, Artificial Sequence
  Plectin (3368-3389)
gccaccacagcugcacugcuccuugaggcccaggcggcuacuggcuuccugguggaccccgucaga

SEQ ID NO: 65092 - RNA, 27 nt, Artificial Sequence
  Coatomer subunit alpha (338-346)
gacagauuccugaggcagcucgauuuu

SEQ ID NO: 65093 - RNA, 27 nt, Artificial Sequence
  Mannosyl-oligosaccharide glucosidase (370-378)
gagagauucgaaaagaccuuucagcug

SEQ ID NO: 65094 - RNA, 27 nt, Artificial Sequence
  General transcription factor II-I (386-394)
gagagaaucagguucgugauuaagaaa

SEQ ID NO: 65095 - RNA, 27 nt, Artificial Sequence
  NADH dehydrogenase (ubiquinone) 1 beta subcomplex subunit 4 (35-43)
gagagacuggccaucagggcucagcuc

SEQ ID NO: 65096 - RNA, 27 nt, Artificial Sequence
  Cytoplasmic dynein 1 heavy chain 1 (2441-2449)
uuccagcuggagcacaucauggaccuc

SEQ ID NO: 65097 - RNA, 27 nt, Artificial Sequence
  AP-2 complex subunit sigma (52-60)
uucagaaacuuuaagaucauuuacagg

SEQ ID NO: 65098 - RNA, 30 nt, Artificial Sequence
  Protein scribble homolog (1146-1155)
ggcagagacgggaggcugcgggugggacuc

SEQ ID NO: 65099 - RNA, 30 nt, Artificial Sequence
  Disintegrin and metalloproteinase domain-containing protein 10 (14-23)
ggcagauucgagggguuuauccagaccagg

SEQ ID NO: 65100 - RNA, 33 nt, Artificial Sequence
  Mitogen-activated protein kinase kinase kinase 12 (175-185)
ggcagauuccacggggaggaaguggccgucaag

SEQ ID NO: 65101 - RNA, 30 nt, Artificial Sequence
  Rho guanine nucleotide exchange factor 2 (459-468)
ggcagauucaaggacgugcugguccuccuu

SEQ ID NO: 65102 - RNA, 27 nt, Artificial Sequence
  Dolichyl-diphosphooligosaccharide-proteinosyltransferase subunit STT3A (230-238)
ggcagauucagccacaggaucuacgug

SEQ ID NO: 65103 - RNA, 27 nt, Artificial Sequence
  Small nuclear ribonucleoprotein-associated proteins B and B' (17-25)
ggcagaaucuucauugggaccuuuaag

SEQ ID NO: 65104 - RNA, 27 nt, Artificial Sequence
  Sorbitol dehydrogenase (55-63)
ggcagaaucgggaacuucauugugaag

SEQ ID NO: 65105 - RNA, 30 nt, Artificial Sequence
  Sorbitol dehydrogenase (55-64)
ggcagaaucgggaacuucauugugaagaaa

SEQ ID NO: 65106 - RNA, 27 nt, Artificial Sequence
  Dystonin (345-353)
ggcagaaucaagcugcuccagggguac

SEQ ID NO: 65107 - RNA, 27 nt, Artificial Sequence
  26S protease regulatory subunit 6B (325-333)
ggcagacuggacaggaagaucgaguuc

SEQ ID NO: 65108 - RNA, 27 nt, Artificial Sequence
  Serine/threonine-protein phosphatase 6 regulatory subunit 3 (311-319)
ggcagacuggggagcuuccacgagcuc

SEQ ID NO: 65109 - RNA, 30 nt, Artificial Sequence
  H(+)/Cl(-) exchange transporter 3 (772-781)
ggcagacugcucgggaucauuaccaagaaa

SEQ ID NO: 65110 - RNA, 27 nt, Artificial Sequence
  Thioredoxin reductase 1, cytoplasmic (45-53)
ggcagacugcagaagcuccuuaaaaug

SEQ ID NO: 65111 - RNA, 27 nt, Artificial Sequence
  Aurora kinase A-interacting protein (40-48)
ggcagacugaccagccagcuccuuagg

SEQ ID NO: 65112 - RNA, 30 nt, Artificial Sequence
  Lon protease homolog 2, peroxisomal (714-723)
ggcagacuggugaggagcgacgucgccaug

SEQ ID NO: 65113 - RNA, 30 nt, Artificial Sequence
  Up-regulated during skeletal muscle growth protein 5 (26-35)
ggcagaaugaacugcgugcuggccaccuac

SEQ ID NO: 65114 - RNA, 27 nt, Artificial Sequence
  Tetratricopeptide repeat protein 12 (373-381)
ggcagaagccugaucauuaaccaccuc

SEQ ID NO: 65115 - RNA, 30 nt, Artificial Sequence
  Plectin (2680-2689)
ggcagaagcuccaucgccgggcugcuccuu

SEQ ID NO: 65116 - RNA, 27 nt, Artificial Sequence
  Nucleolar protein 11 (40-48)
ggcagaaccgugauccuguacaagguc

SEQ ID NO: 65117 - RNA, 48 nt, Artificial Sequence
  HLA class I histocompatibility antigen, A-1 alpha chain (25-40)
ggcagccacuccaugagauacuucuuuaccucugugucaaggcccggg

SEQ ID NO: 65118 - RNA, 27 nt, Artificial Sequence
  Transcription factor E2F4 (157-165)
aucagagcccccagcggcaccucccug

SEQ ID NO: 65119 - RNA, 27 nt, Artificial Sequence
  CAP-Gly domain-containing linker protein 4 (454-462)
aucagauucuuuggcaccacaaacuuc

SEQ ID NO: 65120 - RNA, 33 nt, Artificial Sequence
  Glutamine synthetase (323-333)
aucagaauucccaggaccgugggccaggagaag

SEQ ID NO: 65121 - RNA, 33 nt, Artificial Sequence
  NADH dehydrogenase (ubiquinone) iron-sulfur protein 5 (8-18)
aagagauucggccugaacaucgacagguggcuc

SEQ ID NO: 65122 - RNA, 30 nt, Artificial Sequence
  Cytoplasmic dynein 2 heavy chain 1 (804-813)
aagagauucaucggcauucccaaccaguuu

SEQ ID NO: 65123 - RNA, 27 nt, Artificial Sequence
  DNA-dependent protein kinase catalytic subunit (1074-1082)
aagagacugggcgccagccucgcuuuc

SEQ ID NO: 65124 - RNA, 27 nt, Artificial Sequence
  Fatty acyl-CoA reductase 1 (327-335)
aagagaaacccccuggagcaggccuuc

SEQ ID NO: 65125 - RNA, 27 nt, Artificial Sequence
  ATP-dependent RNA helicase DDX18 (403-411)
aagagaaccacaacuuucuuucaguuc

SEQ ID NO: 65126 - RNA, 30 nt, Artificial Sequence
  Talin-1 (357-366)
aagagaugggccgcuagccccaaauccuuc

SEQ ID NO: 65127 - RNA, 27 nt, Artificial Sequence
  ATP-dependent RNA helicase DHX8 (289-297)
aagagaugggagggccuggugcacauc

SEQ ID NO: 65128 - RNA, 27 nt, Artificial Sequence
  Eukaryotic translation initiation factor 4 gamma 1 (570-578)
aagagauacgacagggaguuccugcuc

SEQ ID NO: 65129 - RNA, 27 nt, Artificial Sequence
  E3 ubiquitin-protein ligase RNF213 (1227-1235)
cugagagacagccacaucuuccagcuc

SEQ ID NO: 65130 - RNA, 27 nt, Artificial Sequence
  Eukaryotic initiation factor 4A-II (229-237)
augagagaccccaucaggauucuggug

SEQ ID NO: 65131 - RNA, 27 nt, Artificial Sequence
  Abhydrolase domain-containing protein 2 (327-335)
augagauaccugcacaggaucuaugug

SEQ ID NO: 65132 - RNA, 27 nt, Artificial Sequence
  Uncharacterized protein C15orf41 (140-148)
aacagauucggccccgggcuggugauc

SEQ ID NO: 65133 - RNA, 27 nt, Artificial Sequence
  Heat shock protein HSP 90-alpha (808-816)
aacagaaucuacaggaugauuaagcug

SEQ ID NO: 65134 - RNA, 27 nt, Artificial Sequence
  Guanine nucleotide-binding protein G(s) subunit alpha isoforms short (265-273)
aacagauggcugaggaccaucagcgug

SEQ ID NO: 65135 - RNA, 42 nt, Artificial Sequence
  Zinc finger protein 608 (42-55)
cccgccagcccuggcgcugggaacccaccgggaacccccaag

SEQ ID NO: 65136 - RNA, 27 nt, Artificial Sequence
  Eukaryotic translation initiation factor 3 subunit L (152-160)
cagagauucgagagcuacuauaacuac

SEQ ID NO: 65137 - RNA, 27 nt, Artificial Sequence
  Eukaryotic translation initiation factor 3 subunit A (316-324)
cagagaaugagcaccagggugcugcuc

SEQ ID NO: 65138 - RNA, 27 nt, Artificial Sequence
  Transmembrane protein 141 (54-62)
agaaaguuccccuacccucugcagugg

SEQ ID NO: 65139 - RNA, 33 nt, Artificial Sequence
  Nuclear envelope integral membrane protein 1 (157-167)
agaagguucgaccccaagcuguuucucguguuc

SEQ ID NO: 65140 - RNA, 33 nt, Artificial Sequence
  Unconventional myosin-Id (770-780)
agaagguucgaggaagcccugcagaccaucuuu

SEQ ID NO: 65141 - RNA, 39 nt, Artificial Sequence
  Pre-mRNA-processing-splicing factor 8 (820-832)
agaagguucagccccaucccuuuuccaccgcuguccuac

SEQ ID NO: 65142 - RNA, 27 nt, Artificial Sequence
  Exportin-1 (596-604)
agaaggcacuucgugcagguccaaguu

SEQ ID NO: 65143 - RNA, 30 nt, Artificial Sequence
  Negative elongation factor C/D (83-92)
agaaggaucgcccaggaggugcaacgguuc

SEQ ID NO: 65144 - RNA, 30 nt, Artificial Sequence
  cAMP-dependent protein kinase type I-beta regulatory subunit (232-241)
agaaggauccugaugggcagcacccuccgg

SEQ ID NO: 65145 - RNA, 30 nt, Artificial Sequence
  Cytoplasmic FMR1-interacting protein 2 (148-157)
agaaggaaggacuucgugagcgaggccuac

SEQ ID NO: 65146 - RNA, 27 nt, Artificial Sequence
  Nuclear pore complex protein Nup98-Nup96 (778-786)
agaaggaaggagguggucguuuaccug

SEQ ID NO: 65147 - RNA, 30 nt, Artificial Sequence
  NADH dehydrogenase (ubiquinone) 1 alpha subcomplex subunit 13 (49-58)
agaaggcugcagaucgaggacuucgaagcc

SEQ ID NO: 65148 - RNA, 30 nt, Artificial Sequence
  Signal peptide peptidase-like 2A (5-14)
agaaggcugagccccgccggcgcugcacuc

SEQ ID NO: 65149 - RNA, 39 nt, Artificial Sequence
  Splicing factor, proline- and glutamine-rich (547-559)
agaaggauggaggaacugcacaaccaggagaugcaaaag

SEQ ID NO: 65150 - RNA, 27 nt, Artificial Sequence
  Probable ATP-dependent RNA helicase DDX10 (353-361)
agaaggauggagguguacaacgaauuc

SEQ ID NO: 65151 - RNA, 36 nt, Artificial Sequence
  40S ribosomal protein S21 (60-71)
agaaggaugggcgagagcgacgauuccauccugcgg

SEQ ID NO: 65152 - RNA, 27 nt, Artificial Sequence
  HLA class II histocompatibility antigen, DQ beta 1 chain (88-96)
agaaggguggagcccaccgucacaauc

SEQ ID NO: 65153 - RNA, 36 nt, Artificial Sequence
  HLA class I histocompatibility antigen, B-15 alpha chain (193-204)
agaagguaccuggagaacggcaaggaaacccuccag

SEQ ID NO: 65154 - RNA, 27 nt, Artificial Sequence
  Glucoside xylosyltransferase 1 (2-10)
agaagguaccugcggguggucguucuc

SEQ ID NO: 65155 - RNA, 33 nt, Artificial Sequence
  Eukaryotic initiation factor 4A-I (168-178)
agaagguaccugagccccaaguauaucaaaaug

SEQ ID NO: 65156 - RNA, 45 nt, Artificial Sequence
  HLA class II histocompatibility antigen, DR alpha chain (48-62)
agcuucgaggcccagggcgcucuggcaaacaucgccguggacaag

SEQ ID NO: 65157 - RNA, 30 nt, Artificial Sequence
  EH domain-containing protein 4 (129-138)
agcagauucggcaacgccuuucugaauagg

SEQ ID NO: 65158 - RNA, 30 nt, Artificial Sequence
  Cohesin subunit SA-2 (369-378)
agcagauucaaggacaggaucguguccaug

SEQ ID NO: 65159 - RNA, 27 nt, Artificial Sequence
  Nucleolar pre-ribosomal-associated protein 1 (628-636)
agcagauucaacagguacuauucccug

SEQ ID NO: 65160 - RNA, 27 nt, Artificial Sequence
  26S proteasome non-ATPase regulatory subunit 13 (153-161)
agcagauucuacgaccuguccucuaag

SEQ ID NO: 65161 - RNA, 27 nt, Artificial Sequence
  Lysine-specific demethylase 3A (1085-1093)
agcagacugcccaacuacuucgugagg

SEQ ID NO: 65162 - RNA, 27 nt, Artificial Sequence
  RRP12-like protein (519-527)
accagacugggcuucuuuacaacuuac

SEQ ID NO: 65163 - RNA, 27 nt, Artificial Sequence
  Voltage-dependent anion-selective channel protein 2 (165-173)
accagaaacaauuucgccgugggcuac

SEQ ID NO: 65164 - RNA, 33 nt, Artificial Sequence
  Dolichyl-diphosphooligosaccharide-proteinosyltransferase 48 kDa subunit (358-368)
gugagaaucgaccccuucgucaggaccuuucug

SEQ ID NO: 65165 - RNA, 27 nt, Artificial Sequence
  Phosphatidylinositol 4-phosphate 5-kinase type-1 alpha (54-62)
uacagauucgugaagaaacuggagcac

SEQ ID NO: 65166 - RNA, 27 nt, Artificial Sequence
  PERQ amino acid-rich with GYF domain-containing protein 2 (41-49)
uacagauauggcagggaggaaaugcug

SEQ ID NO: 65167 - RNA, 27 nt, Artificial Sequence
  Alpha-actinin-1 (567-575)
gccauccugggcauucacaacgaggug

SEQ ID NO: 65168 - RNA, 27 nt, Artificial Sequence
  CCR4-NOT transcription complex subunit 1 (2294-2302)
gccauccaggagcaaauuaccagagug

SEQ ID NO: 65169 - RNA, 30 nt, Artificial Sequence
  GEM-interacting protein (553-562)
gcccuggacgugcagggcaucuacagaguc

SEQ ID NO: 65170 - RNA, 30 nt, Artificial Sequence
  Glycogen phosphorylase, brain form (417-426)
gcccuguuccccggcgacguggauagacuc

SEQ ID NO: 65171 - RNA, 39 nt, Artificial Sequence
  T-complex protein 1 subunit gamma (186-198)
gaggaaaacggcagaaaggagaucgacauuaaaaaguac

SEQ ID NO: 65172 - RNA, 27 nt, Artificial Sequence
  Glycerol-3-phosphate dehydrogenase, mitochondrial (467-475)
gagaccgccagaaaguuccuguacuau

SEQ ID NO: 65173 - RNA, 27 nt, Artificial Sequence
  Hexokinase-2 (850-858)
ggccuggacgcccucaaggugaccguc

SEQ ID NO: 65174 - RNA, 27 nt, Artificial Sequence
  NF-kappa-B-repressing factor (193-201)
ggcagcgacaagaucaacuacaccuau

SEQ ID NO: 65175 - RNA, 27 nt, Artificial Sequence
  Galectin-3 (217-225)
caccugcuccaguacaaccauagagug

SEQ ID NO: 65176 - RNA, 27 nt, Artificial Sequence
  Serine-protein kinase ATM (2898-2906)
aagauccugcccaccccugagacagug

SEQ ID NO: 65177 - RNA, 27 nt, Artificial Sequence
  F-box only protein 7 (226-234)
aagaucaacaaugagauuagaagcgug

SEQ ID NO: 65178 - RNA, 27 nt, Artificial Sequence
  DNA topoisomerase 2-beta (151-159)
aagcuggacgagaccggcguggcccuc

SEQ ID NO: 65179 - RNA, 30 nt, Artificial Sequence; identical to SEQ ID NO: 40952
  Coatomer subunit gamma-1 (75-84)

SEQ ID NO: 65180 - RNA, 30 nt, Artificial Sequence
  Protein S100-A6 (47-56)
aagcugcaggacgccgagaucgcuagacuc

SEQ ID NO: 65181 - RNA, 27 nt, Artificial Sequence
  Nucleoprotein TPR (699-707)
aagcugcaggagcaagugaccgaccuc

SEQ ID NO: 65182 - RNA, 27 nt, Artificial Sequence
  Unconventional myosin-Ic (409-417)
aagcugcagcaacucuucaucgagcuu

SEQ ID NO: 65183 - RNA, 27 nt, Artificial Sequence
  26S proteasome non-ATPase regulatory subunit 11 (159-167)
aagauggacgauaaagcccugcucgug

SEQ ID NO: 65184 - RNA, 27 nt, Artificial Sequence
  Serine/threonine-protein kinase/endoribonuclease IRE1 (690-698)
aagccccacaacauccugauuagcaug

SEQ ID NO: 65185 - RNA, 27 nt, Artificial Sequence
  Zinc finger protein 277 (158-166)
aagagcgagcugggccucaacuucuac

SEQ ID NO: 65186 - RNA, 27 nt, Artificial Sequence
  Profilin-1 (105-113)
aagaccgacaaaacacuggugcuccuu

SEQ ID NO: 65187 - RNA, 27 nt, Artificial Sequence
  RHO/RAC effector protein (462-470)
aagaccgagagaagcgaccuggaauac

SEQ ID NO: 65188 - RNA, 27 nt, Artificial Sequence
  Replication protein A 70 kDa DNA-binding subunit (489-497)
aaggugaucgaccagcaaaacggccug

SEQ ID NO: 65189 - RNA, 27 nt, Artificial Sequence
  Plectin (2572-2580)
cugcucgccgaggaaaaccagagacuu

SEQ ID NO: 65190 - RNA, 27 nt, Artificial Sequence
  Clathrin heavy chain 1 (333-341)
aacaucauucccuacauaaccaaugug

SEQ ID NO: 65191 - RNA, 27 nt, Artificial Sequence
  Cell division cycle protein 27 homolog (216-224)
aaccuggagagcuccaauucuaaguac

SEQ ID NO: 65192 - RNA, 30 nt, Artificial Sequence
  Band 4.1-like protein 2 (252-261)
aaccugcucgagaaggacuacuucggccuu

SEQ ID NO: 65193 - RNA, 27 nt, Artificial Sequence
  Keratin, type I cytoskeletal 18 (100-108)
agacuggccgcugacgauuucagggug

SEQ ID NO: 65194 - RNA, 30 nt, Artificial Sequence
  Vacuolar protein sorting-associated protein 35 (226-235)
agacugagccagcucgagggcgugaacguc

SEQ ID NO: 65195 - RNA, 27 nt, Artificial Sequence
  DNA topoisomerase 2-alpha (230-238)
agccuggacaaggauaucguggcccuc

SEQ ID NO: 65196 - RNA, 27 nt, Artificial Sequence
  Ubiquitin carboxyl-terminal hydrolase 14 (241-249)
agccugaucgaccaguucuuuggcgug

SEQ ID NO: 65197 - RNA, 27 nt, Artificial Sequence
  Calcium-binding mitochondrial carrier protein Aralar1 (25-33)
agcaccgagguggacggcgaaagauac

SEQ ID NO: 65198 - RNA, 27 nt, Artificial Sequence
  Thymosin beta-10 (26-34)
accgagacacaggaaaagaacacucug

SEQ ID NO: 65199 - RNA, 27 nt, Artificial Sequence
  L-lactate dehydrogenase B chain (323-331)
acccugugggacauccagaaggaucuc

SEQ ID NO: 65200 - RNA, 27 nt, Artificial Sequence
  SAM and SH3 domain-containing protein 1 (299-307)
gugcuggacgagagaagcgcccucuac

SEQ ID NO: 65201 - RNA, 27 nt, Artificial Sequence
  Centromere protein F (684-692)
gugcuggacagcaaguccgucgagguu

SEQ ID NO: 65202 - RNA, 30 nt, Artificial Sequence
  N(G),N(G)-dimethylarginine dimethylaminohydrolase 1 (92-101)
gugcuguucaccggcagagaguuuuucguc

SEQ ID NO: 65203 - RNA, 60 nt, Artificial Sequence
  Cytochrome c oxidase subunit 7C, mitochondrial (44-63)
uacuucggcagcgccuuugcuacccccuuccugguggucagacaccagcuccuuaagaca

SEQ ID NO: 65204 - RNA, 27 nt, Artificial Sequence
  GTP-binding protein Rit1 (134-142)
uacaucgacgauguguuccacgcccug

SEQ ID NO: 65205 - RNA, 27 nt, Artificial Sequence
  WASH complex subunit 7 (733-741)
uaccuggacaagaccuucuauaaccuc

SEQ ID NO: 65206 - RNA, 30 nt, Artificial Sequence
  Coatomer subunit alpha (707-716)
uaccugaucaccggcaaccucgagaagcuu

SEQ ID NO: 65207 - RNA, 27 nt, Artificial Sequence
  cAMP-dependent protein kinase type I-alpha regulatory subunit (126-134)
gccgcucuggcaaaggccaucgagaaa

SEQ ID NO: 65208 - RNA, 24 nt, Artificial Sequence
  Fatty acid synthase (1645-1652)
gccgcuagcgugcccgucguuuac

SEQ ID NO: 65209 - RNA, 27 nt, Artificial Sequence
  Matrix Gla protein (90-98)
gccgcuuacaacagauauuucaggaag

SEQ ID NO: 65210 - RNA, 24 nt, Artificial Sequence
  60S ribosomal protein L10 (29-36)
gccaagaucagaauuuucgaccug

SEQ ID NO: 65211 - RNA, 27 nt, Artificial Sequence
  Sushi repeat-containing protein SRPX isoform 4 (328-336)
gcccugcucgaccaguucuacgagaag

SEQ ID NO: 65212 - RNA, 30 nt, Artificial Sequence
  Zinc finger MYM-type protein 4 (757-766)
gccagcgcuggccccccuucccugagaaag

SEQ ID NO: 65213 - RNA, 30 nt, Artificial Sequence
  Thymosin beta-10 (16-25)
gccagcuucgacaaggcuaaacugaagaaa

SEQ ID NO: 65214 - RNA, 27 nt, Artificial Sequence
  Glycogen phosphorylase, muscle form (303-311)
gccacccugcaggacaucauuagaagg

SEQ ID NO: 65215 - RNA, 27 nt, Artificial Sequence
  Cell surfaceoprotein MUC18 (577-585)
gccgugcuguacuuccucuauaagaaa

SEQ ID NO: 65216 - RNA, 24 nt, Artificial Sequence
  Torsin-1A-interacting protein 1 (433-440)
gccuacagcuccuucagaucugug

SEQ ID NO: 65217 - RNA, 24 nt, Artificial Sequence
  Nucleolin (415-422)
gacgccgcugagaucagacuggug

SEQ ID NO: 65218 - RNA, 24 nt, Artificial Sequence
  Prohibitin (233-240)
gacggccugaucgagcucagaaag

SEQ ID NO: 65219 - RNA, 21 nt, Artificial Sequence
  Lysine-specific demethylase 5B (46-52)
uucgccuuuauccacaagauu

SEQ ID NO: 65220 - RNA, 27 nt, Artificial Sequence
  Polypeptide N-acetylgalactosaminyltransferase 5 (282-290)
uuccccaaggugagaauccugaggcuc

SEQ ID NO: 65221 - RNA, 30 nt, Artificial Sequence
  Dual specificity protein phosphatase 6 (130-139)
uucuaccuggagggcggguuuagcaaguuc

SEQ ID NO: 65222 - RNA, 27 nt, Artificial Sequence
  Multiple PDZ domain protein (777-785)
ggcaccgugagaaucggggucgccaag

SEQ ID NO: 65223 - RNA, 30 nt, Artificial Sequence
  Calcyphosin (120-129)
ggcguguacagcgggagagcccaccccaag

SEQ ID NO: 65224 - RNA, 30 nt, Artificial Sequence
  PEST proteolytic signal-containing nuclear protein (144-153)
caccugggcaacgugcaugaccaggauaau

SEQ ID NO: 65225 - RNA, 30 nt, Artificial Sequence
  DAZ-associated protein 1 (397-406)
cacaacgugcagggcuuccaucccuacaga

SEQ ID NO: 65226 - RNA, 45 nt, Artificial Sequence
  Ribonucleoprotein PTB-binding 1 (737-751)
cacagccagggccuggggggacauuacgccgacuccuaucucaag

SEQ ID NO: 65227 - RNA, 27 nt, Artificial Sequence
  Melanocyte protein PMEL (189-197)
cacaccauggaggugacagucuaccau

SEQ ID NO: 65228 - RNA, 33 nt, Artificial Sequence
  Neurosecretory protein VGF (2-12)
aaggcccugagacucagcgcuuccgcacuuuuc

SEQ ID NO: 65229 - RNA, 27 nt, Artificial Sequence
  Serine/threonine-protein kinase Nek7 (81-89)
aaggagaucgaccugcucaaacagcuu

SEQ ID NO: 65230 - RNA, 27 nt, Artificial Sequence
  Calpain-3 (10-18)
aaggugcugaacaccgucguuaauaaa

SEQ ID NO: 65231 - RNA, 27 nt, Artificial Sequence
  (Pyruvate dehydrogenase (acetyl-transferring))-phosphatase 1, mitochondrial (542-550)
cugcccgaggaacucgccagaauguac

SEQ ID NO: 65232 - RNA, 21 nt, Artificial Sequence
  Vimentin (116-122)
aacuacaucgacaaggugaga

SEQ ID NO: 65233 - RNA, 24 nt, Artificial Sequence
  Vimentin (116-123)
aacuacaucgacaaggugagauuc

SEQ ID NO: 65234 - RNA, 24 nt, Artificial Sequence
  Lysine-specific demethylase 5B (45-52)
cccuucgccuuuauccacaagauu

SEQ ID NO: 65235 - RNA, 24 nt, Artificial Sequence
  Isoleucine-tRNA ligase, cytoplasmic (611-618)
cccgugagcaucauucagaaguac

SEQ ID NO: 65236 - RNA, 27 nt, Artificial Sequence
  Ankyrin-2 (1316-1324)
cccuacauggccaaguucguggucuuu

SEQ ID NO: 65237 - RNA, 21 nt, Artificial Sequence
  Plectin (3425-3431)
cccuacagcggcuccaccauc

SEQ ID NO: 65238 - RNA, 27 nt, Artificial Sequence
  Crooked neck-like protein 1 (372-380)
agauucgaggaaaagcacgccuacuuu

SEQ ID NO: 65239 - RNA, 27 nt, Artificial Sequence
  Vimentin (122-130)
agauuccuggagcagcaaaacaagauc

SEQ ID NO: 65240 - RNA, 27 nt, Artificial Sequence
  Membrane-associated transporter protein (209-217)
agacugcucggcaccgaguuccaggug

SEQ ID NO: 65241 - RNA, 24 nt, Artificial Sequence
  V-type proton ATPase subunit B, kidney isoform (40-47)
agaagcggccaggugcuggagguc

SEQ ID NO: 65242 - RNA, 27 nt, Artificial Sequence
  Sialidase-4 (192-200)
agaaccagcccccacuccuucgccuuu

SEQ ID NO: 65243 - RNA, 27 nt, Artificial Sequence
  Tubulin beta-6 chain (244-252)
agauaccugaccguggccacagucuuc

SEQ ID NO: 65244 - RNA, 27 nt, Artificial Sequence
  Transcription elongation factor SPT5 (361-369)
agauacagcaggaagggcuuccuguuu

SEQ ID NO: 65245 - RNA, 27 nt, Artificial Sequence
  Zinc finger MYM-type protein 4 (758-766)
agcgccggccccccuucccugagaaag

SEQ ID NO: 65246 - RNA, 27 nt, Artificial Sequence
  Melanoma-associated antigen 1 (230-238)
agcgccuacggcgagcccagaaagcug

SEQ ID NO: 65247 - RNA, 39 nt, Artificial Sequence
  Heterogeneous nuclear ribonucleoproteins A2/B1 (289-301)
agcggcggguccggagguuacggcgggagaucuagguau

SEQ ID NO: 65248 - RNA, 39 nt, Artificial Sequence
  Elongation factor 1-alpha 1 (18-30)
agcggcaaguccaccacaacugggcaccugaucuacaaa

SEQ ID NO: 65249 - RNA, 27 nt, Artificial Sequence
  G protein pathway suppressor 2 (319-327)
agccagaaccccagauucuaccacaag

SEQ ID NO: 65250 - RNA, 27 nt, Artificial Sequence
  Nuclear pore complex protein Nup205 (214-222)
agcucccuguacaucauucucaagaaa

SEQ ID NO: 65251 - RNA, 27 nt, Artificial Sequence
  RNA binding motif protein, X-linked-like-1 (142-150)
agcuccagaggcccccugccugugaag

SEQ ID NO: 65252 - RNA, 30 nt, Artificial Sequence
  Mitochondrial fission factor (79-88)
agcacccccuucaagccucuggcccucaaa

SEQ ID NO: 65253 - RNA, 51 nt, Artificial Sequence
  Prelamin-A/C (479-495)
agcgugggcggguccggagguggcucuuucggggacaaccuggucaccaga

SEQ ID NO: 65254 - RNA, 27 nt, Artificial Sequence
  Zinc finger MIZ domain-containing protein 1 (594-602)
agcgugcugcagggccuccuuaagaaa

SEQ ID NO: 65255 - RNA, 27 nt, Artificial Sequence
  Anaphase-promoting complex subunit 5 (50-58)
agcguggucggccuguuccucagacac

SEQ ID NO: 65256 - RNA, 33 nt, Artificial Sequence
  Prohibitin (230-240)
accgccggcgacgggcugaucgagcucagaaag

SEQ ID NO: 65257 - RNA, 45 nt, Artificial Sequence
  RNA polymerase II-associated factor 1 homolog (4-18)
accauccagacacaagcccagagagaggacggccacaggcccaac

SEQ ID NO: 65258 - RNA, 45 nt, Artificial Sequence
  Thymosin beta-10 (33-47)
acccugcccacaaaggagacuaucgaacaggagaaaagaagcgaa

SEQ ID NO: 65259 - RNA, 51 nt, Artificial Sequence
  Thymosin beta-10 (33-49)
acccugcccacaaaggagacuaucgaacaggagaaaagaagcgaaauuucc

SEQ ID NO: 65260 - RNA, 42 nt, Artificial Sequence
  Golgi-specific brefeldin A-resistance guanine nucleotide exchange factor 1 (535-548)
acccccagaccuacagacccaaucccgacuagcgaggugaac

SEQ ID NO: 65261 - RNA, 33 nt, Artificial Sequence
  KH domain-containing, RNA-binding, signal transduction-associated protein 1 (33-43)
acccccagcagacagccuccacugccgcacagg

SEQ ID NO: 65262 - RNA, 45 nt, Artificial Sequence
  Probable ATP-dependent RNA helicase DDX5 (556-570)
accagcuucagaacaggcaaccccacugggacguaccagaaugga

SEQ ID NO: 65263 - RNA, 24 nt, Artificial Sequence
  Elongation factor 1-alpha 1 (23-30)
accacaggccaccugaucuacaag

SEQ ID NO: 65264 - RNA, 45 nt, Artificial Sequence
  Vimentin (446-460)
accguggagacaagagacggccaggucaucaacgaaacuagccaa

SEQ ID NO: 65265 - RNA, 42 nt, Artificial Sequence
  Serum albumin (439-452)
gugccccaggucagcaccccuacacugguugagguguccaga

SEQ ID NO: 65266 - RNA, 27 nt, Artificial Sequence
  Melanoma-associated antigen F1 (199-207)
gugcagcccagcaaguaccacuuccug

SEQ ID NO: 65267 - RNA, 24 nt, Artificial Sequence
  Vimentin (117-124)
uacaucgacaaggugagauuccug

SEQ ID NO: 65268 - RNA, 27 nt, Artificial Sequence
  Fatty acid synthase (2288-2296)
uacuauaucgacugcauuagacaggug

SEQ ID NO: 65269 - RNA, 27 nt, Artificial Sequence
  Zinc finger protein 552 (2-10)
gccgcugcagcccugagauuccccgug

SEQ ID NO: 65270 - RNA, 30 nt, Artificial Sequence
  Colipase-like protein 2 (3-12)
gccgcucuggcacucguggccggcguccuu

SEQ ID NO: 65271 - RNA, 27 nt, Artificial Sequence
  ATP-binding cassette sub-family G member 1 (538-546)
gccgcucugggcaccaugacaagccuc

SEQ ID NO: 65272 - RNA, 27 nt, Artificial Sequence
  Integrin beta-7 (351-359)
gccgcucugcccguguaccaggagcuc

SEQ ID NO: 65273 - RNA, 27 nt, Artificial Sequence
  Translocon-associated protein subunit delta (2-10)
gccgcuauggcaagccugggcgcccuc

SEQ ID NO: 65274 - RNA, 27 nt, Artificial Sequence
  Fumarate hydratase, mitochondrial (264-272)
gccgcuaugcccagaaucuacgagcug

SEQ ID NO: 65275 - RNA, 24 nt, Artificial Sequence
  Interferon-induced GTP-binding protein Mx1 (15-22)
gccgcuagccacccccugcuccuu

SEQ ID NO: 65276 - RNA, 27 nt, Artificial Sequence
  Basement membrane-specific heparan sulfate proteoglycan core protein (1503-1511)
gccgcuagcaucuccgcagugucucug

SEQ ID NO: 65277 - RNA, 27 nt, Artificial Sequence
  Zinc finger and BTB domain-containing protein 7B (478-486)
gccgcuagccccgcaggccuggaccuc

SEQ ID NO: 65278 - RNA, 27 nt, Artificial Sequence
  Poly(rC)-binding protein 2 (92-100)
gccgcuagcagacccccugugacccug

SEQ ID NO: 65279 - RNA, 33 nt, Artificial Sequence
  Protein phosphatase inhibitor 2 (2-12)
gccgcuagcaccgcaucccacagacccaucaag

SEQ ID NO: 65280 - RNA, 27 nt, Artificial Sequence
  Transcription factor jun-B (200-208)
gccgcugugggcaccgggagcuccuac

SEQ ID NO: 65281 - RNA, 27 nt, Artificial Sequence
  Carnitine O-palmitoyltransferase 1, liver isoform (476-484)
gccgacgcucccaucguggcacaccug

SEQ ID NO: 65282 - RNA, 30 nt, Artificial Sequence
  Protein CDV3 homolog (2-11)
gccgagaccgaagagagaagccuggacaac

SEQ ID NO: 65283 - RNA, 27 nt, Artificial Sequence
  Cirhin (640-648)
gccuucaagaucagcaaaauuuacaag

SEQ ID NO: 65284 - RNA, 27 nt, Artificial Sequence
  Tyrosine-protein kinase HCK (301-309)
gccuuccuggcugaggcaaacgugaug

SEQ ID NO: 65285 - RNA, 27 nt, Artificial Sequence
  2-oxoglutarate dehydrogenase, mitochondrial (85-93)
gccggcgcucccccugggaccgcauac

SEQ ID NO: 65286 - RNA, 24 nt, Artificial Sequence
  Fc receptor-like A (58-65)
gccggcuuccaggugaaggcuuac

SEQ ID NO: 65287 - RNA, 27 nt, Artificial Sequence
  Piezo-type mechanosensitive ion channel component 1 (211-219)
gccggcaucgcucaccccagcgcacug

SEQ ID NO: 65288 - RNA, 30 nt, Artificial Sequence
  Uncharacterized protein ENSP00000382042 (147-156)
gccggcaccgggggaagccccgcucugcuc

SEQ ID NO: 65289 - RNA, 27 nt, Artificial Sequence
  Glycogen debranching enzyme (1193-1201)
gccggcacccuggaccagccccucuuc

SEQ ID NO: 65290 - RNA, 30 nt, Artificial Sequence
  Abelson tyrosine-protein kinase 2 (1157-1166)
gccggcgugcccgggaccaacccuguccug

SEQ ID NO: 65291 - RNA, 27 nt, Artificial Sequence
  Heterogeneous nuclear ribonucleoprotein F (403-411)
gccggcuacagcgggcagaacuccaug

SEQ ID NO: 65292 - RNA, 27 nt, Artificial Sequence
  Spectrin alpha chain, non-erythrocytic 1 (2132-2140)
gcccacgacgcuuucagaagcucccug

SEQ ID NO: 65293 - RNA, 27 nt, Artificial Sequence
  ER degradation-enhancing alpha-mannosidase-like protein 1 (264-272)
gcccacgaccuggcugugagacuccuu

SEQ ID NO: 65294 - RNA, 27 nt, Artificial Sequence
  DmX-like protein 2 (2940-2948)
gcccacgacagcgcuaucaaggcacug

SEQ ID NO: 65295 - RNA, 27 nt, Artificial Sequence
  Testicular acid phosphatase (287-295)
gcccacgacagcacccugcucgcucuu

SEQ ID NO: 65296 - RNA, 27 nt, Artificial Sequence
  Lysosomal acid phosphatase (285-293)
gcccacgacaccacacugguggcucuc

SEQ ID NO: 65297 - RNA, 33 nt, Artificial Sequence
  U4/U6 small nuclear ribonucleoprotein Prp3 (510-520)
gcccacgaggaagcuaacgcagccagaaagcug

SEQ ID NO: 65298 - RNA, 27 nt, Artificial Sequence
  Protein FAM195A (93-101)
gcccacgaggaaaacgugagauucguc

SEQ ID NO: 65299 - RNA, 27 nt, Artificial Sequence
  Synemin (147-155)
gcccacgagagagacgugagggaacug

SEQ ID NO: 65300 - RNA, 27 nt, Artificial Sequence
  NADH dehydrogenase (ubiquinone) 1 alpha subcomplex subunit 1 (39-47)
gcccacuucggcuaccauuggagccug

SEQ ID NO: 65301 - RNA, 27 nt, Artificial Sequence
  GDP-mannose 4,6 dehydratase (74-82)
gcccacaucgagggcaacaugaagcug

SEQ ID NO: 65302 - RNA, 27 nt, Artificial Sequence
  Striatin-3 (531-539)
gcccacaucggccccgugcugagccuc

SEQ ID NO: 65303 - RNA, 27 nt, Artificial Sequence
  Nuclear factor erythroid 2-related factor 2 (106-114)
gcccacauccccaagagcgacgcucug

SEQ ID NO: 65304 - RNA, 27 nt, Artificial Sequence
  Nucleolar RNA helicase 2 (616-624)
gcccacaucagcggcgcuaccuccgug

SEQ ID NO: 65305 - RNA, 27 nt, Artificial Sequence
  Coatomer subunit beta' (555-563)
gcccaccuggacagaaccauguaccuc

SEQ ID NO: 65306 - RNA, 27 nt, Artificial Sequence
  Nuclear inhibitor of protein phosphatase 1 (172-180)
gcccacaacaagagaaucagcacccug

SEQ ID NO: 65307 - RNA, 24 nt, Artificial Sequence
  Suppressor of SWI4 1 homolog (136-143)
gcccaccccccucugcucgugcuu

SEQ ID NO: 65308 - RNA, 27 nt, Artificial Sequence
  Exosome complex component CSL4 (156-164)
gcccacagcgaguccggcauccagaug

SEQ ID NO: 65309 - RNA, 30 nt, Artificial Sequence
  DNA mismatch repair protein Msh6 (457-466)
gcccacagcggcuuccccgagaucgcuuuu

SEQ ID NO: 65310 - RNA, 27 nt, Artificial Sequence
  60S ribosomal protein L18a (121-129)
gcccacagcauccagauuaugaaggug

SEQ ID NO: 65311 - RNA, 27 nt, Artificial Sequence
  Sodium-coupled neutral amino acid transporter 5 (74-82)
gcccacaccggcgugaucuucuuucug

SEQ ID NO: 65312 - RNA, 27 nt, Artificial Sequence
  AP-2 complex subunit mu (194-202)
gcccacgugagcggcagagucguuaug

SEQ ID NO: 65313 - RNA, 27 nt, Artificial Sequence
  Trafficking protein particle complex subunit 5 (162-170)
gcccacuggcauaagggcaccacacug

SEQ ID NO: 65314 - RNA, 27 nt, Artificial Sequence
  LIM and SH3 domain protein 1 (55-63)
gcccacuaccccaagcagagcuucacc

SEQ ID NO: 65315 - RNA, 27 nt, Artificial Sequence
  Endoplasmic reticulum-Golgi intermediate compartment protein 3 (313-321)
gccaucauuggcgggauguucaccgug

SEQ ID NO: 65316 - RNA, 27 nt, Artificial Sequence
  Parafibromin (184-192)
gccaucaaggcuaaaauuauggcaaag

SEQ ID NO: 65317 - RNA, 27 nt, Artificial Sequence
  Exportin-4 (825-833)
gccauccuguucaacuuucucauggac

SEQ ID NO: 65318 - RNA, 27 nt, Artificial Sequence
  Protein arginine N-methyltransferase 5 (168-176)
gccauccugcccaccagcauuuuccuc

SEQ ID NO: 65319 - RNA, 30 nt, Artificial Sequence
  Bifunctional glutamate/proline-tRNA ligase (215-224)
gccaaggcugcacugcucaaccagcacuac

SEQ ID NO: 65320 - RNA, 30 nt, Artificial Sequence
  Exportin-5 (744-753)
gccaaggcuggcggguucguggucggauac

SEQ ID NO: 65321 - RNA, 27 nt, Artificial Sequence
  DNA replication licensing factor MCM7 (470-478)
gccaaggcuggcauccugaccacacuc

SEQ ID NO: 65322 - RNA, 27 nt, Artificial Sequence
  DNA replication licensing factor MCM5 (470-478)
gccaaggcuggcaucaccacaacucug

SEQ ID NO: 65323 - RNA, 27 nt, Artificial Sequence
  Peptidase M20 domain-containing protein 2 (398-406)
gccaaggcucuggcaaugaccgcccuc

SEQ ID NO: 65324 - RNA, 30 nt, Artificial Sequence
  Proteasome subunit beta type-2 (125-134)
gccaaggcucccuucgcagcccacggcuac

SEQ ID NO: 65325 - RNA, 27 nt, Artificial Sequence
  Drebrin (614-622)
gccaaggcucccccuccaguguucuac

SEQ ID NO: 65326 - RNA, 27 nt, Artificial Sequence
  CCAAT/enhancer-binding protein beta (241-249)
gccaaggcucccccuaccgcaugcuac

SEQ ID NO: 65327 - RNA, 27 nt, Artificial Sequence
  Ragulator complex protein LAMTOR2 (106-114)
gccaaggcucaggcacuggugcaauac

SEQ ID NO: 65328 - RNA, 27 nt, Artificial Sequence
  Protein PRRC2C (2502-2510)
gccaaggcucagagcggccuggcauuc

SEQ ID NO: 65329 - RNA, 27 nt, Artificial Sequence
  ATP-dependent RNA helicase A (181-189)
gccaaggcuagacugaaccaguacuuc

SEQ ID NO: 65330 - RNA, 33 nt, Artificial Sequence
  Heterogeneous nuclear ribonucleoprotein L (247-257)
gccaaggcuagccugaacggcgcagacaucuac

SEQ ID NO: 65331 - RNA, 27 nt, Artificial Sequence
  NAD(P)H-hydrate epimerase (96-104)
gccaaggcuuaccccccuaccagcaug

SEQ ID NO: 65332 - RNA, 27 nt, Artificial Sequence
  1-phosphatidylinositol 4,5-bisphosphate phosphodiesterase beta-1 (127-135)
gccaaggaguggaccaacgaaguguuc

SEQ ID NO: 65333 - RNA, 30 nt, Artificial Sequence
  Cell division cycle-associated 7-like protein (291-300)
gccaaguucgcugaggaauuuuacagcuuc

SEQ ID NO: 65334 - RNA, 27 nt, Artificial Sequence
  Cathepsin D (193-201)
gccaaguucgacggcauccuggggaug

SEQ ID NO: 65335 - RNA, 30 nt, Artificial Sequence
  Crooked neck-like protein 1 (420-429)
gccaaguucgaggaaaaccagaaagaguuu

SEQ ID NO: 65336 - RNA, 27 nt, Artificial Sequence
  Staphylococcal nuclease domain-containing protein 1 (248-256)
gccaaguucuuuaccgagagcagacug

SEQ ID NO: 65337 - RNA, 27 nt, Artificial Sequence
  Pre-mRNA-processing factor 19 (487-495)
gccaaguucaucgcuagcaccggcaug

SEQ ID NO: 65338 - RNA, 27 nt, Artificial Sequence
  Squalene monooxygenase (243-251)
gccaaguucaucgagggcgugguccug

SEQ ID NO: 65339 - RNA, 27 nt, Artificial Sequence
  DCN1-like protein 2 (152-160)
gccaaguucaaagacuuuuaccaguuc

SEQ ID NO: 65340 - RNA, 30 nt, Artificial Sequence
  DnaJ homolog subfamily B member 9 (65-74)
gccaaguucagagagaucgcugaagcauac

SEQ ID NO: 65341 - RNA, 27 nt, Artificial Sequence
  Nitrogen permease regulator 3-like protein (366-374)
gccaaguucagccugcccgugucccuc

SEQ ID NO: 65342 - RNA, 33 nt, Artificial Sequence
  DNA-directed RNA polymerases I and III subunit RPAC1 (223-233)
gccaaguucagccccguggcuaccgcauccuac

SEQ ID NO: 65343 - RNA, 27 nt, Artificial Sequence
  Ubiquitin-like modifier-activating enzyme 1 (321-329)
gccaaguucagcagacccgcucagcug

SEQ ID NO: 65344 - RNA, 27 nt, Artificial Sequence
  Staphylococcal nuclease domain-containing protein 1 (738-746)
gccaaguucguggacggcgagugguac

SEQ ID NO: 65345 - RNA, 27 nt, Artificial Sequence
  60S ribosomal protein L31 (74-82)
gccaagggcaucagaaacgugcccuac

SEQ ID NO: 65346 - RNA, 27 nt, Artificial Sequence
  Cullin-1 (220-228)
gccaagggccccacccugacaguguac

SEQ ID NO: 65347 - RNA, 27 nt, Artificial Sequence
  NACHT, LRR and PYD domains-containing protein 7 (625-633)
gccaagggcguguuccuggagaacuac

SEQ ID NO: 65348 - RNA, 27 nt, Artificial Sequence
  Cystatin-B (90-98)
gccaagcacgacgagcugaccuacuuc

SEQ ID NO: 65349 - RNA, 36 nt, Artificial Sequence
  T-complex protein 1 subunit theta (19-30)
gccaagcacuucagcggccuggaggaagcuguguac

SEQ ID NO: 65350 - RNA, 27 nt, Artificial Sequence
  Unconventional myosin-Va (1821-1829)
gccaagcacaucuuccccgugaccuuu

SEQ ID NO: 65351 - RNA, 27 nt, Artificial Sequence
  Fatty aldehyde dehydrogenase (198-206)
gccaagcaccugacccccgugacacuc

SEQ ID NO: 65352 - RNA, 27 nt, Artificial Sequence
  AP-2 complex subunit sigma (44-52)
gccaagcacaccaacuucguggaguuu

SEQ ID NO: 65353 - RNA, 27 nt, Artificial Sequence
  F-box DNA helicase 1 (835-843)
gccaagaucgcuguggucgagaaauac

SEQ ID NO: 65354 - RNA, 33 nt, Artificial Sequence
  Carnitine O-palmitoyltransferase 1, liver isoform (75-85)
gccaagaucgaccccagccugggcauuauagcu

SEQ ID NO: 65355 - RNA, 27 nt, Artificial Sequence
  D(2) dopamine receptor (338-346)
gccaagaucuucgagauucagaccaug

SEQ ID NO: 65356 - RNA, 27 nt, Artificial Sequence
  Poly(rC)-binding protein 2 (308-316)
gccaagaucaacgagauuagacagaug

SEQ ID NO: 65357 - RNA, 27 nt, Artificial Sequence
  Reticulon-2 (522-530)
gccaagauccccggcaccggggcucug

SEQ ID NO: 65358 - RNA, 33 nt, Artificial Sequence
  Protein SET (89-99)
gccaagauccccaacuucugggugaccacauuu

SEQ ID NO: 65359 - RNA, 33 nt, Artificial Sequence
  COBW domain-containing protein 6 (40-50)
gccaagauccccgugaccauuauaacaggcuac

SEQ ID NO: 65360 - RNA, 33 nt, Artificial Sequence
  Dolichyl-diphosphooligosaccharide-proteinosyltransferase subunit 1 (125-135)
gccaagaucagcgugauugucgagaccguuuac

SEQ ID NO: 65361 - RNA, 27 nt, Artificial Sequence
  Nuclear fragile X mental retardation-interacting protein 2 (350-358)
gccaagaucgugcccaaaauuagcuac

SEQ ID NO: 65362 - RNA, 27 nt, Artificial Sequence
  Poly (ADP-ribose) polymerase 3 (121-129)
gccaagaaagacuucgagaagaaauuu

SEQ ID NO: 65363 - RNA, 27 nt, Artificial Sequence
  DnaJ homolog subfamily C member 7 (40-48)
gccaagaaagacuacaacgaggcuuau

SEQ ID NO: 65364 - RNA, 27 nt, Artificial Sequence
  Double-stranded RNA-binding protein Staufen homolog 1 (297-305)
gccaagaaagagaaggaacccgaguac

SEQ ID NO: 65365 - RNA, 27 nt, Artificial Sequence
  Translocation protein SEC62 (64-72)
gccaagaaaggcgaggaagcucuguuc

SEQ ID NO: 65366 - RNA, 27 nt, Artificial Sequence
  SWI/SNF complex subunit SMARCC2 (316-324)
gccaagaaaggccccagcaccccuuac

SEQ ID NO: 65367 - RNA, 27 nt, Artificial Sequence
  Myosin light chain 1/3, skeletal muscle isoform (105-113)
gccaagaaaaucgaguucgaacaguuu

SEQ ID NO: 65368 - RNA, 27 nt, Artificial Sequence
  Probable ATP-dependent RNA helicase DDX6 (351-359)
gccaagaaaaucagccagcugggcuac

SEQ ID NO: 65369 - RNA, 27 nt, Artificial Sequence
  Poly (ADP-ribose) polymerase 8 (686-694)
gccaagaaacuguucggcagcaccuuu

SEQ ID NO: 65370 - RNA, 27 nt, Artificial Sequence
  Serine/threonine-protein phosphatase 2A 56 kDa regulatory subunit delta isoform (231-239)
gccaagaaauacaucgaccagaaguuc

SEQ ID NO: 65371 - RNA, 27 nt, Artificial Sequence
  Nucleolar RNA helicase 2 (386-394)
gccaagaaauacaugaagagcaccuau

SEQ ID NO: 65372 - RNA, 33 nt, Artificial Sequence
  Interferon-induced, double-stranded RNA-activated protein kinase (313-323)
gccaagcuggaccacgugaacaucguccauuac

SEQ ID NO: 65373 - RNA, 27 nt, Artificial Sequence
  Golgin subfamily A member 4 (798-806)
gccaagcuggacguguuccagagcuac

SEQ ID NO: 65374 - RNA, 27 nt, Artificial Sequence
  Zinc finger Ran-binding domain-containing protein 2 (94-102)
gccaagcuggaggaaagaaccggcuac

SEQ ID NO: 65375 - RNA, 27 nt, Artificial Sequence
  Pre-mRNA-splicing factor ATP-dependent RNA helicase PRP16 (1082-1090)
gccaagcugaaaggcaucggggaguac

SEQ ID NO: 65376 - RNA, 27 nt, Artificial Sequence
  DNA replication licensing factor MCM5 (557-565)
gccaagcugaaaaaguucaucgcuuac

SEQ ID NO: 65377 - RNA, 30 nt, Artificial Sequence
  Transmembrane and coiled-coil domain-containing protein 1 (115-124)
gccaagcugcccuucaccccucucagcuac

SEQ ID NO: 65378 - RNA, 27 nt, Artificial Sequence
  ATP-dependent RNA helicase A (856-864)
gccaagcugcccaucgagccuagauuc

SEQ ID NO: 65379 - RNA, 27 nt, Artificial Sequence
  Peptidyl-prolyl cis-trans isomerase FKBP1A (73-81)
gccaagcugaccaucagccccgacuac

SEQ ID NO: 65380 - RNA, 33 nt, Artificial Sequence
  Heterogeneous nuclear ribonucleoprotein U (422-432)
gccaagaacggccaggaccuggggguggcuuuc

SEQ ID NO: 65381 - RNA, 27 nt, Artificial Sequence
  Pre-mRNA-processing-splicing factor 8 (1011-1019)
gccaagaacaauguggucaucaacuac

SEQ ID NO: 65382 - RNA, 27 nt, Artificial Sequence
  Immunoglobulin superfamily member 10 (2607-2615)
gccaagaacccccugggcagcgacuac

SEQ ID NO: 65383 - RNA, 33 nt, Artificial Sequence
  ADP-ribosylation factor GTPase-activating protein 3 (30-40)
gccaagaaccccagcugggcuuccaucaccuac

SEQ ID NO: 65384 - RNA, 30 nt, Artificial Sequence
  Transmembrane protein 214 (356-365)
gccaagcccgacagcacccugcacacauac

SEQ ID NO: 65385 - RNA, 30 nt, Artificial Sequence
  Nucleolar GTP-binding protein 2 (401-410)
gccaagcccgaguacaucagcaaaaccuau

SEQ ID NO: 65386 - RNA, 27 nt, Artificial Sequence
  Vacuolar protein sorting-associated protein 41 homolog (804-812)
gccaagcccuucagcguggucguuuuu

SEQ ID NO: 65387 - RNA, 27 nt, Artificial Sequence
  116 kDa U5 small nuclear ribonucleoprotein component (445-453)
gccaagcccaaaaucgagcacaccuac

SEQ ID NO: 65388 - RNA, 27 nt, Artificial Sequence
  Olfactomedin-like protein 2B (2-10)
gccaagcccagacugcucgugcuuuac

SEQ ID NO: 65389 - RNA, 30 nt, Artificial Sequence
  RNA-binding protein 38 (113-122)
gccaagcccagaagccugcagaccggcuuc

SEQ ID NO: 65390 - RNA, 27 nt, Artificial Sequence
  116 kDa U5 small nuclear ribonucleoprotein component (962-970)
gccaagcaggacgugguccugaacuac

SEQ ID NO: 65391 - RNA, 27 nt, Artificial Sequence
  Nuclear pore complex protein Nup153 (293-301)
gccaagcagcugagcgcucaauccuac

SEQ ID NO: 65392 - RNA, 27 nt, Artificial Sequence
  Proteasome activator complex subunit 1 (189-197)
gccaagcagccccacgugggcgacuac

SEQ ID NO: 65393 - RNA, 27 nt, Artificial Sequence
  Mitochondrial import receptor subunit TOM7 homolog (8-16)
gccaagcagagacugcaacagcucuuc

SEQ ID NO: 65394 - RNA, 27 nt, Artificial Sequence
  Protein disulfide-isomerase A4 (244-252)
gccaagagauucgacgugagcggcuac

SEQ ID NO: 65395 - RNA, 27 nt, Artificial Sequence
  Serine/threonine-protein phosphatase PP1-beta catalytic subunit (258-266)
gccaagagacagcuggugacccucuuc

SEQ ID NO: 65396 - RNA, 24 nt, Artificial Sequence
  Putative uncharacterized protein C10orf113 (2-9)
gccaagagcgagagaaggaucuac

SEQ ID NO: 65397 - RNA, 27 nt, Artificial Sequence
  Serine/threonine-protein kinase/endoribonuclease IRE1 (276-284)
gccaagagcaaacugacccccacacuc

SEQ ID NO: 65398 - RNA, 30 nt, Artificial Sequence
  Gamma-taxilin (369-378)
gccaagagcaacgagcuguucaccacauuu

SEQ ID NO: 65399 - RNA, 27 nt, Artificial Sequence
  Cullin-1 (38-46)
gccaagagcagauacauggagcuguau

SEQ ID NO: 65400 - RNA, 27 nt, Artificial Sequence
  Protein disulfide-isomerase TMX3 (363-371)
gccaagagcaccaucguguccauuuuc

SEQ ID NO: 65401 - RNA, 27 nt, Artificial Sequence
  Coiled-coil domain-containing protein 115 (51-59)
gccaagagcgugggcccccugcaguac

SEQ ID NO: 65402 - RNA, 27 nt, Artificial Sequence
  Cyclin-dependent kinase 14 (280-288)
gccaagagcgugcccucccacaccuac

SEQ ID NO: 65403 - RNA, 27 nt, Artificial Sequence
  Nuclear nucleic acid-binding protein C1D (53-61)
gccaagguggaccuggucagcgcuuac

SEQ ID NO: 65404 - RNA, 30 nt, Artificial Sequence
  Plastin-2 (19-28)
gccaagguggacaccgauggcaacggguac

SEQ ID NO: 65405 - RNA, 27 nt, Artificial Sequence
  Transmembrane protein 14D (103-111)
gccaaggugggcgucagaaugcugaug

SEQ ID NO: 65406 - RNA, 27 nt, Artificial Sequence
  60S ribosomal protein L27 (114-122)
gccaaggugaaauucgaggaaagauac

SEQ ID NO: 65407 - RNA, 24 nt, Artificial Sequence
  Neuroblast differentiation-associated protein AHNAK (5180-5187)
gccaaggugaaaacccccagcuuc

SEQ ID NO: 65408 - RNA, 27 nt, Artificial Sequence
  Nck-associated protein 1-like (512-520)
gccaaggugaugaaccugaucgucuuc

SEQ ID NO: 65409 - RNA, 27 nt, Artificial Sequence
  Dolichyl-diphosphooligosaccharide-proteinosyltransferase subunit STT3A (520-528)
gccaaggugaugagcuggugggacuac

SEQ ID NO: 65410 - RNA, 27 nt, Artificial Sequence
  Eukaryotic translation initiation factor 3 subunit L (142-150)
gccaaggugagcggcgggcccucccug

SEQ ID NO: 65411 - RNA, 27 nt, Artificial Sequence
  Condensin-2 complex subunit D3 (362-370)
gccaagguggucgacaaaagcgaguac

SEQ ID NO: 65412 - RNA, 27 nt, Artificial Sequence
  Cytoskeleton-associated protein 5 (1205-1213)
gccaaguggcugcaggacgagauguuc

SEQ ID NO: 65413 - RNA, 33 nt, Artificial Sequence
  DNA-directed RNA polymerase II subunit RPB3 (174-184)
gccaaguggaaccccaccgcuggcguggcauuc

SEQ ID NO: 65414 - RNA, 27 nt, Artificial Sequence
  Enhancer of mRNA-decapping protein 4 (124-132)
gccaaguacgacugggagcagaaauau

SEQ ID NO: 65415 - RNA, 27 nt, Artificial Sequence
  Myotubularin-related protein 6 (102-110)
gccaaguacgaggaccuguaugcuuuc

SEQ ID NO: 65416 - RNA, 27 nt, Artificial Sequence
  CXXC-type zinc finger protein 1 (507-515)
gccaaguacgagagccagaccuccuuc

SEQ ID NO: 65417 - RNA, 27 nt, Artificial Sequence
  Guanine nucleotide-binding protein G(s) subunit alpha isoforms XLas (980-988)
gccaaguacuucaucagagacgaguuu

SEQ ID NO: 65418 - RNA, 27 nt, Artificial Sequence
  Integrator complex subunit 10 (304-312)
gccaaguacaaaaaccagguggucuau

SEQ ID NO: 65419 - RNA, 33 nt, Artificial Sequence
  40S ribosomal protein S5 (46-56)
gccaaguaccugccccacagcgcuggcagauau

SEQ ID NO: 65420 - RNA, 33 nt, Artificial Sequence
  Nucleolar protein 56 (319-329)
gccaaguaccccgcuagcaccgugcagauccug

SEQ ID NO: 65421 - RNA, 27 nt, Artificial Sequence
  Proteasome activator complex subunit 3 (194-202)
gccaaguacccccacguggaggacuau

SEQ ID NO: 65422 - RNA, 27 nt, Artificial Sequence
  V-type proton ATPase subunit C 1 (110-118)
gccaaguaccccaucaaacagagccug

SEQ ID NO: 65423 - RNA, 27 nt, Artificial Sequence
  Probable ATP-dependent RNA helicase DDX10 (280-288)
gccaaguacagcacccccgcuacacug

SEQ ID NO: 65424 - RNA, 27 nt, Artificial Sequence
  26S proteasome non-ATPase regulatory subunit 12 (367-375)
gccaaguacuauaccagaaucacaaug

SEQ ID NO: 65425 - RNA, 30 nt, Artificial Sequence
  Serine/arginine repetitive matrix protein 2 (2360-2369)
gcccuggcucccgcaagccucaccuccgcc

SEQ ID NO: 65426 - RNA, 27 nt, Artificial Sequence
  Protein FAM217A (258-266)
gcccuggaccuccacaaccuugcucug

SEQ ID NO: 65427 - RNA, 27 nt, Artificial Sequence
  HAUS augmin-like complex subunit 8 (77-85)
gcccuggacaccacaagacacgagcuc

SEQ ID NO: 65428 - RNA, 30 nt, Artificial Sequence
  Mesoderm development candidate 1 (248-257)
gcccuguucagcggcccccucgugcaggcu

SEQ ID NO: 65429 - RNA, 27 nt, Artificial Sequence
  Zinc finger protein 827 (563-571)
gcccuguucagccaggacaucuccgug

SEQ ID NO: 65430 - RNA, 27 nt, Artificial Sequence
  DNA-directed RNA polymerase I subunit RPA49 (297-305)
gcccugggccccggggugccucacauc

SEQ ID NO: 65431 - RNA, 30 nt, Artificial Sequence
  Fatty acid desaturase 2 (422-431)
gcccugcucgacaucauuagaagccuuaag

SEQ ID NO: 65432 - RNA, 27 nt, Artificial Sequence
  Symplekin (780-788)
gcccugcucccccagaaccacaagcuu

SEQ ID NO: 65433 - RNA, 27 nt, Artificial Sequence
  Transmembrane protein 147 (135-143)
gcccugagcacccucgcucuuuacgug

SEQ ID NO: 65434 - RNA, 30 nt, Artificial Sequence
  Protein HIRA (789-798)
gcccugaccgcugcagccacacucagcgug

SEQ ID NO: 65435 - RNA, 27 nt, Artificial Sequence
  ATP-binding cassette sub-family B member 8, mitochondrial (142-150)
gcccuggugaacguccagaucccccuc

SEQ ID NO: 65436 - RNA, 27 nt, Artificial Sequence
  Serine/threonine-protein phosphatase 6 regulatory ankyrin repeat subunit A (155-163)
gcccuggugccccuccuuagcaacguc

SEQ ID NO: 65437 - RNA, 27 nt, Artificial Sequence
  Protein transport protein Sec61 subunit alpha isoform 2 (274-282)
gcccuggugagcaaccucuacgucauc

SEQ ID NO: 65438 - RNA, 27 nt, Artificial Sequence
  E3 ubiquitin-protein ligase UBR4 (709-717)
gcccuguaccacuucaaccauagccuc

SEQ ID NO: 65439 - RNA, 27 nt, Artificial Sequence
  Tetratricopeptide repeat protein 13 (724-732)
gcccuguacaaggaccucaccgcuaaa

SEQ ID NO: 65440 - RNA, 27 nt, Artificial Sequence
  E3 ubiquitin-protein ligase UBR5 (376-384)
gcccuguacagcgagcuccuugcugug

SEQ ID NO: 65441 - RNA, 27 nt, Artificial Sequence
  Protein spinster homolog 3 (269-277)
gccauggcuuucgugaccggcgcacug

SEQ ID NO: 65442 - RNA, 27 nt, Artificial Sequence
  28S ribosomal protein S9, mitochondrial (347-355)
gccauggcuaaggcacugugcagcuuc

SEQ ID NO: 65443 - RNA, 33 nt, Artificial Sequence
  Probable ribosome biogenesis protein RLP24 (92-102)
gccaugaagagaguggaggaaaucaaacagaag

SEQ ID NO: 65444 - RNA, 27 nt, Artificial Sequence
  Melanocyte-stimulating hormone receptor (198-206)
gccaugcuggugcucauggcuguccuu

SEQ ID NO: 65445 - RNA, 27 nt, Artificial Sequence
  Enteropeptidase (878-886)
gccaugaugcaccuggaguucaaggug

SEQ ID NO: 65446 - RNA, 27 nt, Artificial Sequence
  60S ribosomal protein L11 (162-170)
gccaugagaugguuccagcaaaaguac

SEQ ID NO: 65447 - RNA, 27 nt, Artificial Sequence
  Multivesicular body subunit 12A (38-46)
gcccccgcuagcuucggcaaguccuuu

SEQ ID NO: 65448 - RNA, 27 nt, Artificial Sequence
  Hypoxia-inducible factor 1-alpha (828-836)
gcccccauccagggcagcagaaaccug

SEQ ID NO: 65449 - RNA, 27 nt, Artificial Sequence
  Transcriptional activator Myb (224-232)
gcccaggcucccccuaccgcacaacug

SEQ ID NO: 65450 - RNA, 27 nt, Artificial Sequence
  Serine/threonine-protein phosphatase 2B catalytic subunit beta isoform (292-300)
gcccaggacgcuggcuacagaauguau

SEQ ID NO: 65451 - RNA, 24 nt, Artificial Sequence
  Transcription intermediary factor 1-beta (762-769)
gcccaggacgugggcagaauguuc

SEQ ID NO: 65452 - RNA, 27 nt, Artificial Sequence
  Poly(A) polymerase gamma (579-587)
gcccagggccugagcauccccgugauu

SEQ ID NO: 65453 - RNA, 27 nt, Artificial Sequence
  Ribosomal RNA processing protein 1 homolog A (91-99)
gcccagcaccuguuccuccaagcuuuu

SEQ ID NO: 65454 - RNA, 27 nt, Artificial Sequence
  Very-long-chain enoyl-CoA reductase (83-91)
gcccagaucagcugggugaccgucuuc

SEQ ID NO: 65455 - RNA, 27 nt, Artificial Sequence
  Disintegrin and metalloproteinase domain-containing protein 15 (301-309)
gcccagcuggugaccggcacaagcuuc

SEQ ID NO: 65456 - RNA, 30 nt, Artificial Sequence
  Protein YIF1B (52-61)
gcccagagagcucccggcgggcugagcuac

SEQ ID NO: 65457 - RNA, 27 nt, Artificial Sequence
  Activator of basal transcription 1 (212-220)
gcccagagacccaccgagcaagaacug

SEQ ID NO: 65458 - RNA, 24 nt, Artificial Sequence
  UBX domain-containing protein 4 (350-357)
gcccagaccgugggcaacacauac

SEQ ID NO: 65459 - RNA, 27 nt, Artificial Sequence
  Uncharacterized protein C11orf24 (193-201)
gcccaggugcccaagagcuccgcucug

SEQ ID NO: 65460 - RNA, 30 nt, Artificial Sequence
  Asparagine synthetase (glutamine-hydrolyzing) (277-286)
gcccaggugcaauacccccugcagaccuuc

SEQ ID NO: 65461 - RNA, 27 nt, Artificial Sequence
  Elongation factor 1-gamma (93-101)
gcccaggugguccaauggguuagcuuc

SEQ ID NO: 65462 - RNA, 27 nt, Artificial Sequence
  Transmembrane protein 147 (151-159)
gcccagguguggaugaucaccagauac

SEQ ID NO: 65463 - RNA, 27 nt, Artificial Sequence
  Replication initiator 1 (187-195)
gcccagugggaccaacugguggcucac

SEQ ID NO: 65464 - RNA, 27 nt, Artificial Sequence
  Probable helicase with zinc finger domain (470-478)
gcccaguacaaggagaucagcaaauuc

SEQ ID NO: 65465 - RNA, 27 nt, Artificial Sequence
  Ribonuclease K6 (120-128)
gcccaguacaaguucuuuaucguggcu

SEQ ID NO: 65466 - RNA, 27 nt, Artificial Sequence
  Centromere protein N (267-275)
gcccaguacaagcuggagaccaaauuc

SEQ ID NO: 65467 - RNA, 30 nt, Artificial Sequence
  Periodic tryptophan protein 1 homolog (372-381)
gccagaagcgacaagcccaucuucacccug

SEQ ID NO: 65468 - RNA, 27 nt, Artificial Sequence
  Olfactory receptor 5K3 (240-248)
gccagccacuuccuguccgugucuauc

SEQ ID NO: 65469 - RNA, 27 nt, Artificial Sequence
  N-acetyllactosaminide beta-1,6-N-acetylglucosaminyl-transferase, isoform A (153-161)
gccagcaagaaagaguccguggucuac

SEQ ID NO: 65470 - RNA, 27 nt, Artificial Sequence
  Cytoplasmic FMR1-interacting protein 1 (658-666)
gccagcaugauggaguacgugcuguau

SEQ ID NO: 65471 - RNA, 30 nt, Artificial Sequence
  Utrophin (3369-3378)
gccagcccccagcacuccgcucugucuuac

SEQ ID NO: 65472 - RNA, 27 nt, Artificial Sequence
  RNA-binding protein NOB1 (403-411)
gccagcagaaagaaauucgugaagaaa

SEQ ID NO: 65473 - RNA, 27 nt, Artificial Sequence
  Nodal modulator 2 (823-831)
gccagcuccccccugaucaccguguuc

SEQ ID NO: 65474 - RNA, 27 nt, Artificial Sequence
  Asparagine synthetase (glutamine-hydrolyzing) (544-552)
gccaccgaccccagcgcuagaacacug

SEQ ID NO: 65475 - RNA, 27 nt, Artificial Sequence
  Ribosomal RNA processing protein 1 homolog B (664-672)
gccacccaccccccuggcccagcugug

SEQ ID NO: 65476 - RNA, 27 nt, Artificial Sequence
  Polyadenylate-binding protein 1 (359-367)
gccaccaagccccuguacguggcucuc

SEQ ID NO: 65477 - RNA, 27 nt, Artificial Sequence
  ATP-dependent 6-phosphofructokinase, muscle type (150-158)
gccaccaagagcuccuaccugaacauc

SEQ ID NO: 65478 - RNA, 27 nt, Artificial Sequence
  Transmembrane protein 9B (2-10)
gccacccuguggggcgggcuccuuaga

SEQ ID NO: 65479 - RNA, 27 nt, Artificial Sequence
  Serine/threonine-protein phosphatase 6 regulatory subunit 1 (821-829)
gccaccagagaccccagcacauccgug

SEQ ID NO: 65480 - RNA, 27 nt, Artificial Sequence
  Leukocyte-associated immunoglobulin-like receptor 1 (224-232)
gccaccgugaacggccugcccgagaag

SEQ ID NO: 65481 - RNA, 27 nt, Artificial Sequence
  40S ribosomal protein S5 (40-48)
gccgugaaggagaaauacgcuaaguau

SEQ ID NO: 65482 - RNA, 27 nt, Artificial Sequence
  Oligoribonuclease, mitochondrial (109-117)
gccgugaaggagagcaccaucacacug

SEQ ID NO: 65483 - RNA, 27 nt, Artificial Sequence
  39S ribosomal protein L44, mitochondrial (114-122)
gccgugcugcucaaccuuaagagcaau

SEQ ID NO: 65484 - RNA, 30 nt, Artificial Sequence
  Ig lambda-2 chain C regions (41-50)
gccuggaaggcugacagcucccccgugaaa

SEQ ID NO: 65485 - RNA, 27 nt, Artificial Sequence
  Nucleolar transcription factor 1 (644-652)
gccuacaaggaguauaucagcaacaaa

SEQ ID NO: 65486 - RNA, 30 nt, Artificial Sequence
  Translocon-associated protein subunit gamma (76-85)
gccuacaagaacgugaaauucguccugaag

SEQ ID NO: 65487 - RNA, 27 nt, Artificial Sequence
  Serine-protein kinase ATM (740-748)
gccuacaagagcgagcuguuccagaaa

SEQ ID NO: 65488 - RNA, 27 nt, Artificial Sequence
  Poly (ADP-ribose) polymerase (365-373)
gccuaccccgaguaucugaucaccuuc

SEQ ID NO: 65489 - RNA, 36 nt, Artificial Sequence
  Sialoadhesin (1671-1682)
ugcaagcagagcaugggcgagaacuccguggaaaug

SEQ ID NO: 65490 - RNA, 27 nt, Artificial Sequence
  Transmembrane inner ear expressed protein (21-29)
ugccuggccggcguggcugggcagcuc

SEQ ID NO: 65491 - RNA, 27 nt, Artificial Sequence
  Tetraspanin-18 (82-90)
ugccugcuccuuuucuuuuuccuguuu

SEQ ID NO: 65492 - RNA, 27 nt, Artificial Sequence
  Asparagine-tRNA ligase, cytoplasmic (537-545)
ugccuguaccccagauucgugcagagg

SEQ ID NO: 65493 - RNA, 33 nt, Artificial Sequence
  Protein-glutamine gamma-glutamyltransferase 4 (213-223)
ugcagagccaugugugcuaugaugagcuucgag

SEQ ID NO: 65494 - RNA, 30 nt, Artificial Sequence
  Pentatricopeptide repeat domain-containing protein 3, mitochondrial (34-43)
ugcagauucuacagcggcuccgccacccug

SEQ ID NO: 65495 - RNA, 27 nt, Artificial Sequence
  Endothelin-1 receptor (88-96)
ugcaccaucuucauugugggcaugguc

SEQ ID NO: 65496 - RNA, 27 nt, Artificial Sequence
  cAMP-dependent protein kinase type I-alpha regulatory subunit (109-117)
gacgccgcuagcuacgugagaaagguc

SEQ ID NO: 65497 - RNA, 27 nt, Artificial Sequence
  DnaJ homolog subfamily B member 9 (12-20)
gacgccgaggcuaaguucagagaaauc

SEQ ID NO: 65498 - RNA, 27 nt, Artificial Sequence
  Catenin beta-1 (145-153)
gacgccgagcuggcuaccagagcaauc

SEQ ID NO: 65499 - RNA, 27 nt, Artificial Sequence
  Protein disulfide-isomerase A5 (441-449)
gacgccuucaaggaugacagaaaaauc

SEQ ID NO: 65500 - RNA, 24 nt, Artificial Sequence
  Asparagine synthetase (glutamine-hydrolyzing) (9-16)
gacgccuucagauuugagaacgug

SEQ ID NO: 65501 - RNA, 27 nt, Artificial Sequence
  Protein FAM127A (61-69)
gacgcccugaaggugaccuuccucauc

SEQ ID NO: 65502 - RNA, 27 nt, Artificial Sequence
  Importin subunit beta-1 (627-635)
gacgcccugauggcugugagcacccuc

SEQ ID NO: 65503 - RNA, 24 nt, Artificial Sequence
  Eukaryotic translation initiation factor 3 subunit A (504-511)
gacgcccccaucggcccucaccug

SEQ ID NO: 65504 - RNA, 33 nt, Artificial Sequence
  Dermcidin (86-96)
gacgccguggaggaucuggaaagcgucggcaag

SEQ ID NO: 65505 - RNA, 24 nt, Artificial Sequence
  DNA polymerase delta catalytic subunit (515-522)
gacgccuaccugccccucagacuu

SEQ ID NO: 65506 - RNA, 27 nt, Artificial Sequence
  Oral-facial-digital syndrome 1 protein (185-193)
gacgccuacccccagagaaucaaguuc

SEQ ID NO: 65507 - RNA, 27 nt, Artificial Sequence
  Splicing factor, arginine/serine-rich 15 (540-548)
gacgccuacagagcucugcagaagcuc

SEQ ID NO: 65508 - RNA, 24 nt, Artificial Sequence
  Period circadian protein homolog 1 (771-778)
gacgccuacagacccgugggccug

SEQ ID NO: 65509 - RNA, 27 nt, Artificial Sequence
  Torsin-1A-interacting protein 2 (317-325)
gacgccuacaccagcucccagaaggug

SEQ ID NO: 65510 - RNA, 36 nt, Artificial Sequence
  Autism susceptibility gene 2 protein (283-294)
gacugcuguaaggagcccaucuucgaaccugugguc

SEQ ID NO: 65511 - RNA, 30 nt, Artificial Sequence
  Voltage-dependent T-type calcium channel subunit alpha-1G (1640-1649)
gacgaggcccugaagaucugcaacuacauu

SEQ ID NO: 65512 - RNA, 27 nt, Artificial Sequence
  Signal peptidase complex subunit 2 (82-90)
gacggcagacugaccaucugcacaauu

SEQ ID NO: 65513 - RNA, 30 nt, Artificial Sequence
  Alanine-tRNA ligase, cytoplasmic (300-309)
gaccacgccagaaccaucacaguggcucug

SEQ ID NO: 65514 - RNA, 27 nt, Artificial Sequence
  SRSF protein kinase 2 (597-605)
gaccacaucgcccauauuauagagcug

SEQ ID NO: 65515 - RNA, 24 nt, Artificial Sequence
  Laminin subunit beta-3 (1159-1166)
gaccacaucaacggcagagugcug

SEQ ID NO: 65516 - RNA, 27 nt, Artificial Sequence
  Coatomer subunit gamma-1 (762-770)
gaccacauccagaaggugaugaaacug

SEQ ID NO: 65517 - RNA, 27 nt, Artificial Sequence
  Protein Hook homolog 2 (130-138)
gaccacauccagagaauuaugacccug

SEQ ID NO: 65518 - RNA, 27 nt, Artificial Sequence
  V-type proton ATPase subunit S1 (458-466)
gaccacaagggccccaccaucagccug

SEQ ID NO: 65519 - RNA, 27 nt, Artificial Sequence
  Cyclin-Y-like protein 2 (84-92)
gaccaccccaaggccagcaccaucuuc

SEQ ID NO: 65520 - RNA, 27 nt, Artificial Sequence
  Calponin-2 (202-210)
gaccacagcaccaucucccugcagaug

SEQ ID NO: 65521 - RNA, 24 nt, Artificial Sequence
  Integrin beta-7 (722-729)
gaccacacccaggccaucgugcug

SEQ ID NO: 65522 - RNA, 24 nt, Artificial Sequence
  Lipopolysaccharide-responsive and beige-like anchor protein (1946-1953)
gaccacgugaccgccacacagcug

SEQ ID NO: 65523 - RNA, 27 nt, Artificial Sequence
  BPI fold-containing family A member 2 (98-106)
gacaucuucggccugaagauuagcaac

SEQ ID NO: 65524 - RNA, 33 nt, Artificial Sequence
  BPI fold-containing family A member 2 (98-108)
gacaucuucggccugaagauuagcaacucccuc

SEQ ID NO: 65525 - RNA, 30 nt, Artificial Sequence
  60S ribosomal protein L4 (35-44)
gacaucgugaacuucguccacaccaaucug

SEQ ID NO: 65526 - RNA, 27 nt, Artificial Sequence
  Solute carrier family 2, facilitated glucose transporter member 2 (4-12)
gacaaggugaccggcacacuggucuuc

SEQ ID NO: 65527 - RNA, 27 nt, Artificial Sequence
  1,2-dihydroxy-3-keto-5-methylthiopentene dioxygenase (44-52)
gacaaguacgagaacgaucccgaacug

SEQ ID NO: 65528 - RNA, 27 nt, Artificial Sequence
  Peroxidasin-like protein (813-821)
gaccuggaucacaccgugcccgcccuc

SEQ ID NO: 65529 - RNA, 27 nt, Artificial Sequence
  Mitochondrial import receptor subunit TOM6 homolog (66-74)
gaccugauggccccccagccuggcgug

SEQ ID NO: 65530 - RNA, 27 nt, Artificial Sequence
  Phosphorylase b kinase gamma catalytic chain, skeletal muscle/heart isoform (105-113)
gaccugaugaagagaggcgagcucuuc

SEQ ID NO: 65531 - RNA, 27 nt, Artificial Sequence
  Inosine-5'-monophosphate dehydrogenase 1 (77-85)
gacauggccaucgcuauggcacugaug

SEQ ID NO: 65532 - RNA, 36 nt, Artificial Sequence
  Type II inositol 1,4,5-trisphosphate 5-phosphatase (2-13)
gaccagagcguggccauccaagagacccuggcugaa

SEQ ID NO: 65533 - RNA, 27 nt, Artificial Sequence
  Proline and serine-rich protein 3 (2-10)
gacagaagccugcccguguucuccauc

SEQ ID NO: 65534 - RNA, 27 nt, Artificial Sequence
  Nucleotide exchange factor SIL1 (410-418)
gacagauacaggcaggauccccaacug

SEQ ID NO: 65535 - RNA, 27 nt, Artificial Sequence
  Cyclin-Y-like protein 2 (130-138)
gacagcaucgccucccagccccaccug

SEQ ID NO: 65536 - RNA, 24 nt, Artificial Sequence
  Hexokinase-2 (815-822)
gacagcaucauugugaaggagguc

SEQ ID NO: 65537 - RNA, 24 nt, Artificial Sequence
  60S ribosomal protein L6 (255-262)
gacagccagauccugcccaagauu

SEQ ID NO: 65538 - RNA, 27 nt, Artificial Sequence
  Small ubiquitin-related modifier 1 (30-38)
gacagcuccgagauccacuucaaggug

SEQ ID NO: 65539 - RNA, 27 nt, Artificial Sequence
  Integrin beta-7 (374-382)
gacagcuccaacgugguccagcugauc

SEQ ID NO: 65540 - RNA, 27 nt, Artificial Sequence
  Ig lambda-2 chain C regions (45-53)
gacagcucccccgugaaggccggcguc

SEQ ID NO: 65541 - RNA, 27 nt, Artificial Sequence
  Sterol O-acyltransferase 1 (310-318)
gacagcuaccccagaaacccuaccgug

SEQ ID NO: 65542 - RNA, 24 nt, Artificial Sequence
  Store-operated calcium entry-associated regulatory factor (74-81)
gacagcuacacccccaaggugauc

SEQ ID NO: 65543 - RNA, 27 nt, Artificial Sequence
  Disintegrin and metalloproteinase domain-containing protein 15 (247-255)
gacaccuucuuuagaccccugaacgug

SEQ ID NO: 65544 - RNA, 24 nt, Artificial Sequence
  Sialidase-1 (75-82)
gacaccuucagaaucccccugauu

SEQ ID NO: 65545 - RNA, 27 nt, Artificial Sequence
  WD repeat-containing protein 54 (273-281)
gacaccuucgugcacaucuggaagcug

SEQ ID NO: 65546 - RNA, 27 nt, Artificial Sequence
  Protein FAM117A (93-101)
gacaccauccugagcuccuaccuccuu

SEQ ID NO: 65547 - RNA, 30 nt, Artificial Sequence
  Ankyrin repeat and SOCS box protein 3 (420-429)
gacacccugaucuucacacucgaguuuacu

SEQ ID NO: 65548 - RNA, 27 nt, Artificial Sequence
  WD repeat-containing protein 26 (376-384)
gacaccacagugaucauuuggcagguc

SEQ ID NO: 65549 - RNA, 27 nt, Artificial Sequence
  Signal recognition particle receptor subunit beta (154-162)
gacguggccgaguuccuguaccagguc

SEQ ID NO: 65550 - RNA, 27 nt, Artificial Sequence
  60S ribosomal protein L23a (120-128)
gacguggccaaggucaacacccugauc

SEQ ID NO: 65551 - RNA, 27 nt, Artificial Sequence
  G2/M phase-specific E3 ubiquitin-protein ligase (493-501)
gacguggcccagaucauuauaagaauc

SEQ ID NO: 65552 - RNA, 27 nt, Artificial Sequence
  Inorganic pyrophosphatase (42-50)
gacguguuccacauggucguugaggug

SEQ ID NO: 65553 - RNA, 27 nt, Artificial Sequence
  Carboxylesterase 3 (415-423)
gacguguucaucaacguccccaccguu

SEQ ID NO: 65554 - RNA, 27 nt, Artificial Sequence
  Bardet-Biedl syndrome 7 protein (53-61)
gaggccgcugcaguguucaagacccug

SEQ ID NO: 65555 - RNA, 27 nt, Artificial Sequence
  Exocyst complex component 5 (158-166)
gaggccgcugacaucauucagaagcug

SEQ ID NO: 65556 - RNA, 27 nt, Artificial Sequence
  Lysine-specific histone demethylase 1A (710-718)
gaggccgcuggcaucauggaaaacauu

SEQ ID NO: 65557 - RNA, 33 nt, Artificial Sequence
  Probable phospholipid-transporting ATPase VA (700-710)
gaggccgcucugguguacgcagccagagcguau

SEQ ID NO: 65558 - RNA, 27 nt, Artificial Sequence
  Kelch-like protein 6 (450-458)
gaggccgcuccccugcucgugcacguc

SEQ ID NO: 65559 - RNA, 27 nt, Artificial Sequence
  Coatomer subunit gamma-1 (269-277)
gaggccgcuagcgcaaucgugaaccug

SEQ ID NO: 65560 - RNA, 27 nt, Artificial Sequence
  Nesprin-3 (176-184)
gaggccgcuagccuguucaacagaauc

SEQ ID NO: 65561 - RNA, 30 nt, Artificial Sequence
  snRNA-activating protein complex subunit 4 (237-246)
gaggccgaaaaggagauccaggacauuaac

SEQ ID NO: 65562 - RNA, 27 nt, Artificial Sequence
  L-xylulose reductase (98-106)
gaggccuucgacagaagcuuugaagug

SEQ ID NO: 65563 - RNA, 30 nt, Artificial Sequence
  Protein flightless-1 homolog (516-525)
gaggccuuccacggcaaguuuuacgaagcu

SEQ ID NO: 65564 - RNA, 27 nt, Artificial Sequence
  Mortality factor 4-like protein 2 (113-121)
gaggccuucaagaacagaauggaagug

SEQ ID NO: 65565 - RNA, 27 nt, Artificial Sequence
  Pre-B-cell leukemia transcription factor-interacting protein 1 (166-174)
gaggccggccccccucagccaauggug

SEQ ID NO: 65566 - RNA, 27 nt, Artificial Sequence
  E3 ubiquitin-protein ligase UBR2 (256-264)
gaggccaucggcuucgcuaccacagug

SEQ ID NO: 65567 - RNA, 24 nt, Artificial Sequence
  60S ribosomal protein L10 (63-70)
gaggcccuggaagcugcaagaauc

SEQ ID NO: 65568 - RNA, 24 nt, Artificial Sequence
  Steroid hormone receptor ERR1 (353-360)
gaggcccugcacgaagcucuccuu

SEQ ID NO: 65569 - RNA, 27 nt, Artificial Sequence
  Very-long-chain (3R)-3-hydroxyacyl-CoA dehydratase 3 (293-301)
gaggccgugagcgucauccaguccauu

SEQ ID NO: 65570 - RNA, 27 nt, Artificial Sequence
  Paired amphipathic helix protein Sin3a (1166-1174)
gagugcagauucaagcugaacagcuac

SEQ ID NO: 65571 - RNA, 36 nt, Artificial Sequence
  RNA polymerase I-specific transcription initiation factor RRN3 (604-615)
gaggacgaugacuuccugaagggcgaagugccccag

SEQ ID NO: 65572 - RNA, 27 nt, Artificial Sequence
  MICAL C-terminal-like protein (368-376)
gaggacgugcccacccugcucgaaaag

SEQ ID NO: 65573 - RNA, 27 nt, Artificial Sequence
  Protein transport protein Sec24C (408-416)
gaggaagccagccccuacguggucgac

SEQ ID NO: 65574 - RNA, 33 nt, Artificial Sequence
  PHD finger protein 10 (446-456)
gaggaaaugauguucugcgacaugugugauaga

SEQ ID NO: 65575 - RNA, 27 nt, Artificial Sequence
  FERM domain-containing protein 6 (338-346)
gaggaaaacgaggaaaagaaacaguac

SEQ ID NO: 65576 - RNA, 27 nt, Artificial Sequence
  Epiplakin (2700-2708)
gaggaaagacugagcaagguguccuuc

SEQ ID NO: 65577 - RNA, 36 nt, Artificial Sequence
  Salivary acidic proline-rich phosphoprotein 1/2 (44-55)
gaggaaagacagggccccccucuggggggacaacag

SEQ ID NO: 65578 - RNA, 27 nt, Artificial Sequence
  Inactive ubiquitin carboxyl-terminal hydrolase 17-like protein 4 (449-457)
gaguucaacgugagaaaggucgaaggc

SEQ ID NO: 65579 - RNA, 27 nt, Artificial Sequence
  Kinesin heavy chain isoform 5A (583-591)
gaguucaccguggccagacuguacauc

SEQ ID NO: 65580 - RNA, 27 nt, Artificial Sequence
  Hyaluronan and proteoglycan link protein 2 (201-209)
gagggcagcgugagauaccccguccug

SEQ ID NO: 65581 - RNA, 24 nt, Artificial Sequence
  Gem-associated protein 5 (589-596)
gagcacggcagccagcccgaacug

SEQ ID NO: 65582 - RNA, 27 nt, Artificial Sequence
  Filamin-B (2269-2277)
gagcacauccccgaaagcccuuaccug

SEQ ID NO: 65583 - RNA, 27 nt, Artificial Sequence
  Protein Hook homolog 1 (136-144)
gagcacauccagaacauuaugacccug

SEQ ID NO: 65584 - RNA, 27 nt, Artificial Sequence
  26S proteasome non-ATPase regulatory subunit 11 (348-356)
gagcacaucagcucccugauuaagcuc

SEQ ID NO: 65585 - RNA, 27 nt, Artificial Sequence
  Intraflagellar transport protein 46 homolog (70-78)
gagcaccugcccgugagcgccgaaauc

SEQ ID NO: 65586 - RNA, 27 nt, Artificial Sequence
  Kinesin-like protein KIF21B (1412-1420)
gagcaccagaucaaccaaauugcccug

SEQ ID NO: 65587 - RNA, 27 nt, Artificial Sequence
  Zinc finger and BTB domain-containing protein 38 (220-228)
gagcacagcuacgccguguccucuguc

SEQ ID NO: 65588 - RNA, 27 nt, Artificial Sequence
  Fructose-bisphosphate aldolase A (156-164)
gagcacacccccagcgcccuggcuauc

SEQ ID NO: 65589 - RNA, 27 nt, Artificial Sequence
  Ribosome-binding protein 1 (768-776)
gagcacgugaaggaaguccagcaacug

SEQ ID NO: 65590 - RNA, 27 nt, Artificial Sequence
  OTU domain-containing protein 6B (276-284)
gagcacuacaacagcgugaccagacug

SEQ ID NO: 65591 - RNA, 27 nt, Artificial Sequence
  E3 ubiquitin-protein ligase UBR4 (401-409)
gagcacuaccagaacuuccaacugcuc

SEQ ID NO: 65592 - RNA, 27 nt, Artificial Sequence
  26S protease regulatory subunit 4 (130-138)
gagcacuacgugagcauccuguccuuc

SEQ ID NO: 65593 - RNA, 27 nt, Artificial Sequence
  Epsin-2 (42-50)
gagaucgccgaccugaccuacaacgug

SEQ ID NO: 65594 - RNA, 27 nt, Artificial Sequence
  Telomere-associated protein RIF1 (220-228)
gagaucgccagcauuaccgaacagcug

SEQ ID NO: 65595 - RNA, 30 nt, Artificial Sequence
  General transcription factor II-I (577-586)
gagaucuucaaccugaaguuugcccaggcu

SEQ ID NO: 65596 - RNA, 30 nt, Artificial Sequence
  Atlastin-3 (199-208)
gagaucuuccagaagcccuuucaaacccug

SEQ ID NO: 65597 - RNA, 27 nt, Artificial Sequence
  DNA-directed RNA polymerase III subunit RPC5 (655-663)
gagaucuucagcaagaacuacagagug

SEQ ID NO: 65598 - RNA, 30 nt, Artificial Sequence
  C-X-C motif chemokine 9 (62-71)
gagaucauugccacccugaagaacggcgug

SEQ ID NO: 65599 - RNA, 27 nt, Artificial Sequence
  Uncharacterized protein CXorf23 (474-482)
gagaucauuaccauaauccaccaggug

SEQ ID NO: 65600 - RNA, 27 nt, Artificial Sequence
  Serine/threonine-protein kinase TBK1 (497-505)
gagaucagcgacauucacaccaagcug

SEQ ID NO: 65601 - RNA, 27 nt, Artificial Sequence
  Constitutive coactivator of peroxisome proliferator-activated receptor gamma (111-119)
gagaucagcagaauuuuccacuacaua

SEQ ID NO: 65602 - RNA, 27 nt, Artificial Sequence
  Centrosomal protein of 170 kDa protein B (1491-1499)
gagaucagcuccauucugaaggaacuc

SEQ ID NO: 65603 - RNA, 27 nt, Artificial Sequence
  Testis-specific Y-encoded-like protein 2 (468-476)
gagaucaccgacauuaacgaaaauaua

SEQ ID NO: 65604 - RNA, 27 nt, Artificial Sequence
  Oxysterols receptor LXR-beta (280-288)
gagaucguggacuucgccaagcagguc

SEQ ID NO: 65605 - RNA, 30 nt, Artificial Sequence
  Tubulin beta-4B chain (3-12)
gagaucgugcaccugcaggccggccaaugc

SEQ ID NO: 65606 - RNA, 27 nt, Artificial Sequence
  Activating transcription factor 7-interacting protein 2 (101-109)
gagaucgugcacagcgaaaccaagcug

SEQ ID NO: 65607 - RNA, 27 nt, Artificial Sequence
  Ras GTPase-activating-like protein IQGAP2 (753-761)
gagaucgugaagauucagagccugcuc

SEQ ID NO: 65608 - RNA, 27 nt, Artificial Sequence
  Williams-Beuren syndrome chromosomal region 16 protein (214-222)
gagaucuacagcgaaucccacagagug

SEQ ID NO: 65609 - RNA, 30 nt, Artificial Sequence
  Protein S100-A8 (6-15)
gagaaggcccugaacagcaucauugacgug

SEQ ID NO: 65610 - RNA, 30 nt, Artificial Sequence
  Zinc finger protein 559 (97-106)
gagaaggcccugagcgaacacuccugccuc

SEQ ID NO: 65611 - RNA, 27 nt, Artificial Sequence
  Replication protein A 32 kDa subunit (84-92)
gagaaggcccccaccaacaucguguac

SEQ ID NO: 65612 - RNA, 27 nt, Artificial Sequence
  Pre-mRNA-processing factor 40 homolog A (475-483)
gagaagaugaccagcacaacuagauac

SEQ ID NO: 65613 - RNA, 30 nt, Artificial Sequence
  Transcriptional repressor p66-beta (434-443)
gagaagaacggcaaaauccugugcgaacag

SEQ ID NO: 65614 - RNA, 30 nt, Artificial Sequence
  Valine-tRNA ligase (271-280)
gagaagagagaccccggcgugaucaccuac

SEQ ID NO: 65615 - RNA, 27 nt, Artificial Sequence
  Transcriptional regulator Kaiso (528-536)
gagaagguguucccccuggccgaauac

SEQ ID NO: 65616 - RNA, 27 nt, Artificial Sequence
  Tyrosine-tRNA ligase, cytoplasmic (281-289)
gagaaguggggcgggaacaaaaccuac

SEQ ID NO: 65617 - RNA, 27 nt, Artificial Sequence
  E3 ubiquitin-protein ligase synoviolin (216-224)
gagcuguucaccggcuuuaucaaggug

SEQ ID NO: 65618 - RNA, 30 nt, Artificial Sequence
  Cohesin subunit SA-2 (1209-1218)
gagcugaagcccgacuucuuugauccugcc

SEQ ID NO: 65619 - RNA, 27 nt, Artificial Sequence
  Cytospin-A (413-421)
gagcugcaggccacccuccaagaacuu

SEQ ID NO: 65620 - RNA, 27 nt, Artificial Sequence
  E3 ubiquitin-protein ligase UBR4 (3813-3821)
gagcugagcaagaucauucagaaagug

SEQ ID NO: 65621 - RNA, 27 nt, Artificial Sequence
  60S ribosomal protein L36 (89-97)
gagcugagcaacgugcucgccgcuaug

SEQ ID NO: 65622 - RNA, 30 nt, Artificial Sequence
  Glutamate-rich protein 3 (1485-1494)
gagcugagccccgaaucccuccaggccaug

SEQ ID NO: 65623 - RNA, 27 nt, Artificial Sequence
  Mini-chromosome maintenance complex-binding protein (343-351)
gagcugagccccgugagagccgaacuc

SEQ ID NO: 65624 - RNA, 36 nt, Artificial Sequence
  Dynamin-binding protein (804-815)
gagaugugcaucgaaagaauuauggugcccaugcag

SEQ ID NO: 65625 - RNA, 30 nt, Artificial Sequence
  GLIPR1-like protein 2 (312-321)
gagauggaaauggagaucauggaaauggag

SEQ ID NO: 65626 - RNA, 36 nt, Artificial Sequence
  Pleckstrin homology domain-containing family G member 3 (582-593)
gagaugggcggggccgcucaggaacccgagagccug

SEQ ID NO: 65627 - RNA, 27 nt, Artificial Sequence
  Contactin-1 (416-424)
gagaugaaccccaugaagaaaaagauc

SEQ ID NO: 65628 - RNA, 24 nt, Artificial Sequence
  Putative vomeronasal receptor-like protein 4 (2-9)
gagaugaccaagcuguucagcuac

SEQ ID NO: 65629 - RNA, 30 nt, Artificial Sequence; identical to SEQ ID NO: 41402
  Putative vomeronasal receptor-like protein 4 (2-11)

SEQ ID NO: 65630 - RNA, 27 nt, Artificial Sequence
  Cyclin-H (240-248)
gagaacagaaccugccugagccagcuc

SEQ ID NO: 65631 - RNA, 27 nt, Artificial Sequence
  3-phosphoinositide-dependent protein kinase 1 (57-65)
gagcccagaccuggcgccgggagccug

SEQ ID NO: 65632 - RNA, 27 nt, Artificial Sequence
  Gamma-glutamyltransferase 6 (2-10)
gagagagccgaagagcccguggucuac

SEQ ID NO: 65633 - RNA, 27 nt, Artificial Sequence
  Integrin beta-7 (243-251)
gagagagaagugggcaggcagagcguc

SEQ ID NO: 65634 - RNA, 27 nt, Artificial Sequence
  Serine/threonine-protein kinase pim-3 (34-42)
gagagcuucgaaaaggccuaccaggug

SEQ ID NO: 65635 - RNA, 27 nt, Artificial Sequence
  Endoplasmin (550-558)
gagagcucccccuucguggaaagacug

SEQ ID NO: 65636 - RNA, 27 nt, Artificial Sequence
  Lamina-associated polypeptide 2, isoforms beta/gamma (277-285)
gagagcacccccaucgccgaaacaauu

SEQ ID NO: 65637 - RNA, 36 nt, Artificial Sequence
  Dermcidin (92-103)
gagagcgugggcaagggggccguccacgacguuaaa

SEQ ID NO: 65638 - RNA, 27 nt, Artificial Sequence
  Elongation factor 2 (311-319)
gagaccgccaagcugaucgaaaaacuc

SEQ ID NO: 65639 - RNA, 30 nt, Artificial Sequence
  Dolichyl-diphosphooligosaccharide-proteinosyltransferase 48 kDa subunit (318-327)
gagaccgcccccccuaacgcuuacacagug

SEQ ID NO: 65640 - RNA, 27 nt, Artificial Sequence
  Heat shock protein HSP 90-beta (13-21)
gagaccuucgccuuucaggcugaaauc

SEQ ID NO: 65641 - RNA, 27 nt, Artificial Sequence
  Cyclin-dependent kinase 6 (69-77)
gagaccuucgaacaccccaacgugguc

SEQ ID NO: 65642 - RNA, 27 nt, Artificial Sequence
  Serine/threonine-protein phosphatase 2A catalytic subunit beta isoform (226-234)
gagaccuucaaccacgccaauggccug

SEQ ID NO: 65643 - RNA, 36 nt, Artificial Sequence
  Protein diaphanous homolog 1 (1255-1266)
gagaccuuccccacaauccuggaagaggccaaggaa

SEQ ID NO: 65644 - RNA, 27 nt, Artificial Sequence
  Serine/threonine-protein kinase 17B (257-265)
gagaccuucagcuccgugucucagcug

SEQ ID NO: 65645 - RNA, 27 nt, Artificial Sequence
  Transcription elongation factor SPT6 (1159-1167)
gagaccuucuacaucggcaagcugauu

SEQ ID NO: 65646 - RNA, 27 nt, Artificial Sequence
  SWI/SNF-related matrix-associated actin-dependent regulator of chromatin subfamily D member 2 (442-450)
gagaccaucgaaagcauuaaccagcug

SEQ ID NO: 65647 - RNA, 30 nt, Artificial Sequence
  Ribonuclease H2 subunit C (135-144)
gagaccauccccggcccugacgccaaggug

SEQ ID NO: 65648 - RNA, 30 nt, Artificial Sequence; identical to SEQ ID NO: 41421
  MOB kinase activator 1A (129-138)

SEQ ID NO: 65649 - RNA, 27 nt, Artificial Sequence
  Cystatin-B (15-23)
gagacccagcacaucgccgaccaagug

SEQ ID NO: 65650 - RNA, 27 nt, Artificial Sequence
  Heat shock protein HSP 90-beta (478-486)
gagacccagaagagcaucuacuauauu

SEQ ID NO: 65651 - RNA, 30 nt, Artificial Sequence
  Wiskott-Aldrich syndrome protein (285-294)
gagaccagcaagcugaucuacgacuucauu

SEQ ID NO: 65652 - RNA, 27 nt, Artificial Sequence
  Elongation factor 1-alpha 1 (81-89)
gagaccagcaaguacuaugugacaauc

SEQ ID NO: 65653 - RNA, 27 nt, Artificial Sequence
  Protein virilizer homolog (61-69)
gagaccagcccccacacauuccagcug

SEQ ID NO: 65654 - RNA, 27 nt, Artificial Sequence
  Splicing factor 3B subunit 1 (1221-1229)
gagaccagcccccacgugauccaggcc

SEQ ID NO: 65655 - RNA, 30 nt, Artificial Sequence
  G1/S-specific cyclin-D2 (114-123)
gagaccagcccccugacagccgaaaagcuc

SEQ ID NO: 65656 - RNA, 27 nt, Artificial Sequence
  Neurexin-3 (1375-1383)
gagaccacaaaggacagccuguccaug

SEQ ID NO: 65657 - RNA, 27 nt, Artificial Sequence
  Mucin-16 (2346-2354)
gagaccacagugaagacuagcgacauc

SEQ ID NO: 65658 - RNA, 27 nt, Artificial Sequence
  Non-structural maintenance of chromosomes element 1 homolog (182-190)
gagaccuaccccgacgccgugaagauc

SEQ ID NO: 65659 - RNA, 27 nt, Artificial Sequence
  Alanine-tRNA ligase, cytoplasmic (688-696)
gagaccuaccccgacccugugagaguc

SEQ ID NO: 65660 - RNA, 30 nt, Artificial Sequence
  Actin-related protein 2 (129-138)
gagaccuaccaguucagcggcguguauguc

SEQ ID NO: 65661 - RNA, 27 nt, Artificial Sequence
  Pre-mRNA-processing-splicing factor 8 (1844-1852)
gagguggccgcucugaucagaagccuc

SEQ ID NO: 65662 - RNA, 27 nt, Artificial Sequence
  Ankyrin repeat and KH domain-containing protein 1 (519-527)
gagguggccgacuuccugaucaaggcu

SEQ ID NO: 65663 - RNA, 27 nt, Artificial Sequence
  PRKCA-binding protein (85-93)
gagguggccaagaugauccaggaaguc

SEQ ID NO: 65664 - RNA, 27 nt, Artificial Sequence
  A-kinase anchor protein 9 (1455-1463)
gagguggccaaggucaucguuagcaug

SEQ ID NO: 65665 - RNA, 27 nt, Artificial Sequence
  Histone acetyltransferase KAT8 (250-258)
gagguggacggcaaggaucacaaaauc

SEQ ID NO: 65666 - RNA, 33 nt, Artificial Sequence
  Nucleolin (411-421)
gagguguucgaagacgccgcugagaucagacug

SEQ ID NO: 65667 - RNA, 27 nt, Artificial Sequence
  Nucleolin (504-512)
gagguguucgaaaaggccaccuuuauc

SEQ ID NO: 65668 - RNA, 27 nt, Artificial Sequence
  Desmoplakin (745-753)
gagguguucggccuguuucagaagcuc

SEQ ID NO: 65669 - RNA, 27 nt, Artificial Sequence
  Splicing factor 3B subunit 3 (57-65)
gagguguucggcgucaucagaagccug

SEQ ID NO: 65670 - RNA, 27 nt, Artificial Sequence
  E2F-associated phosphoprotein (273-281)
gagguguuccacuuuuucaacguccug

SEQ ID NO: 65671 - RNA, 27 nt, Artificial Sequence
  Vacuolar protein sorting-associated protein 8 homolog (935-943)
gagguguucaacuacauccacaauauu

SEQ ID NO: 65672 - RNA, 27 nt, Artificial Sequence
  Actin-binding LIM protein 1 (747-755)
gagguguucagagaaaucuuuggcaug

SEQ ID NO: 65673 - RNA, 30 nt, Artificial Sequence
  Replication protein A 32 kDa subunit (62-71)
gagguguucagaaucggcaacgucgaaauu

SEQ ID NO: 65674 - RNA, 27 nt, Artificial Sequence
  Phenylalanine-tRNA ligase alpha subunit (418-426)
gagguguucagcuaccaccagggccug

SEQ ID NO: 65675 - RNA, 27 nt, Artificial Sequence
  Non-canonical poly(A) RNA polymerase PAPD7 (185-193)
gagguguucaccggcgggaucagcucc

SEQ ID NO: 65676 - RNA, 27 nt, Artificial Sequence
  Cytochrome b-245 heavy chain (203-211)
gagguguucugguacacccaccaucug

SEQ ID NO: 65677 - RNA, 30 nt, Artificial Sequence
  Sigma non-opioid intracellular receptor 1 (144-153)
gagguguucuaccccggcgaaaccgucguu

SEQ ID NO: 65678 - RNA, 27 nt, Artificial Sequence
  Phosphomannomutase 1 (68-76)
gaggugaucgaaaaguucgacuacguc

SEQ ID NO: 65679 - RNA, 27 nt, Artificial Sequence
  Centromere/kinetochore protein zw10 homolog (663-671)
gaggugaucggcaagauuaccgcccug

SEQ ID NO: 65680 - RNA, 27 nt, Artificial Sequence
  Protein phosphatase 1G (109-117)
gaggugaucaaggaacuggcccagauu

SEQ ID NO: 65681 - RNA, 27 nt, Artificial Sequence
  Importin-9 (267-275)
gaggugcugaaggccgucaccgcucuc

SEQ ID NO: 65682 - RNA, 27 nt, Artificial Sequence
  Nuclear receptor-binding factor 2 (2-10)
gaggugauggaaggcccccugaaccuc

SEQ ID NO: 65683 - RNA, 27 nt, Artificial Sequence
  Uncharacterized protein KIAA1143 (71-79)
gaggugaugaagaucaaagccgaaauu

SEQ ID NO: 65684 - RNA, 27 nt, Artificial Sequence
  C-1-tetrahydrofolate synthase, cytoplasmic (80-88)
gaggugaugaaguacaucaccagccug

SEQ ID NO: 65685 - RNA, 27 nt, Artificial Sequence
  Probable ubiquitin carboxyl-terminal hydrolase FAF-X (357-365)
gaggugaacaaggucaucagcuccguu

SEQ ID NO: 65686 - RNA, 27 nt, Artificial Sequence
  Programmed cell death protein 4 (355-363)
gaggugccccacuuccaucacgaacug

SEQ ID NO: 65687 - RNA, 27 nt, Artificial Sequence
  InaD-like protein (626-634)
gaggugcccccuccauucacccugguc

SEQ ID NO: 65688 - RNA, 27 nt, Artificial Sequence
  Gypsy retrotransposon integrase-like protein 1 (184-192)
gaggugagcaaggccaucauuaacaua

SEQ ID NO: 65689 - RNA, 27 nt, Artificial Sequence
  DNA-directed RNA polymerase III subunit RPC3 (143-151)
gaggugagcaacaccuucgucagacug

SEQ ID NO: 65690 - RNA, 27 nt, Artificial Sequence
  CAP-Gly domain-containing linker protein 1 (841-849)
gaggugagccaggucaaggaaacccug

SEQ ID NO: 65691 - RNA, 30 nt, Artificial Sequence
  Double-stranded RNA-specific adenosine deaminase (806-815)
gaggugacccccgucacaggcgccagccug

SEQ ID NO: 65692 - RNA, 27 nt, Artificial Sequence
  Multiple C2 and transmembrane domain-containing protein 1 (410-418)
gagguggucggcagcuacuucuccguu

SEQ ID NO: 65693 - RNA, 30 nt, Artificial Sequence
  Monocarboxylate transporter 4 (456-465)
gaggugguccacacccccgaaacaagcguu

SEQ ID NO: 65694 - RNA, 27 nt, Artificial Sequence
  E3 ubiquitin-protein ligase RNF114 (34-42)
gagguguacgaaaagcccguccagguu

SEQ ID NO: 65695 - RNA, 33 nt, Artificial Sequence
  Sorting nexin-17 (460-470)
uucgccuuugagggcaucggggacgaagaucug

SEQ ID NO: 65696 - RNA, 30 nt, Artificial Sequence
  Coiled-coil domain-containing protein 60 (70-79)
uucgccauccugagagaggaaaccgcuaag

SEQ ID NO: 65697 - RNA, 27 nt, Artificial Sequence
  Serpin B6 (11-19)
uucgcccugaaccuccuuaagacccug

SEQ ID NO: 65698 - RNA, 27 nt, Artificial Sequence
  Inactive phospholipase D5 (72-80)
uucgcccuggugugcuguuuugcuauc

SEQ ID NO: 65699 - RNA, 27 nt, Artificial Sequence
  Actin-like protein 6A (118-126)
uucgccaacggcagaagcaccgggcug

SEQ ID NO: 65700 - RNA, 27 nt, Artificial Sequence
  Fatty acid synthase (1720-1728)
uucgccaacagcagagacaccuccuuu

SEQ ID NO: 65701 - RNA, 27 nt, Artificial Sequence
  DNA polymerase delta subunit 2 (24-32)
uucgccagagugcccgucgcuaccuac

SEQ ID NO: 65702 - RNA, 30 nt, Artificial Sequence; identical to SEQ ID NO: 41475
  Microtubule cross-linking factor 1 (1586-1595)

SEQ ID NO: 65703 - RNA, 27 nt, Artificial Sequence
  ATP synthase subunit delta, mitochondrial (42-50)
uucgccagccccacccagguguuuuuc

SEQ ID NO: 65704 - RNA, 27 nt, Artificial Sequence
  Alanine-tRNA ligase, cytoplasmic (346-354)
uucgccacccugguggacgucguugug

SEQ ID NO: 65705 - RNA, 33 nt, Artificial Sequence
  G patch domain-containing protein 2 (148-158)
uucgccguggacaacgucggcaauagaacccug

SEQ ID NO: 65706 - RNA, 27 nt, Artificial Sequence
  Protein disulfide-isomerase A2 (456-464)
uucgccgugcacggcuuucccacccug

SEQ ID NO: 65707 - RNA, 27 nt, Artificial Sequence
  Translocon-associated protein subunit gamma (75-83)
uucgccuacaagaacgugaaauuuguc

SEQ ID NO: 65708 - RNA, 27 nt, Artificial Sequence
  Transmembrane protein 214 (326-334)
uucgccuacaugcccaacaauagccug

SEQ ID NO: 65709 - RNA, 27 nt, Artificial Sequence
  28S ribosomal protein S29, mitochondrial (117-125)
uucgccuaccccgcuaucagauaucug

SEQ ID NO: 65710 - RNA, 27 nt, Artificial Sequence
  Protein furry homolog-like (828-836)
uucgccuacaccagacugcagcuccuu

SEQ ID NO: 65711 - RNA, 24 nt, Artificial Sequence
  Transmembrane and coiled-coil domain-containing protein 1 (109-116)
uucgacggcagaguggucgccaag

SEQ ID NO: 65712 - RNA, 27 nt, Artificial Sequence
  ATP-binding cassette sub-family A member 9 (420-428)
uucgacaagauccugcccgccgaguac

SEQ ID NO: 65713 - RNA, 24 nt, Artificial Sequence
  Peroxidasin-like protein (1168-1175)
uucgaggaccugcagaacgaaauc

SEQ ID NO: 65714 - RNA, 30 nt, Artificial Sequence
  Unconventional myosin-Ih (75-84)
uucgagcugcccccucacguguacgccauc

SEQ ID NO: 65715 - RNA, 27 nt, Artificial Sequence
  Band 4.1-like protein 1 (692-700)
uucgagcccgugaagaccgaaacaaug

SEQ ID NO: 65716 - RNA, 36 nt, Artificial Sequence
  Gigaxonin (459-470)
uucggcgccguggcuugcggggucgcaauggagcug

SEQ ID NO: 65717 - RNA, 30 nt, Artificial Sequence
  Cysteine andine-rich protein 1 (180-189)
uucggcuuugggcagggagccggugcucug

SEQ ID NO: 65718 - RNA, 27 nt, Artificial Sequence
  Protein FAM60A (2-10)
uucggcuuucacaagcccaaaauguac

SEQ ID NO: 65719 - RNA, 27 nt, Artificial Sequence
  Acyl-CoA-binding domain-containing protein 6 (141-149)
uucggcgggcccgugaucagcucccug

SEQ ID NO: 65720 - RNA, 27 nt, Artificial Sequence
  Hydroxyacyl-coenzyme A dehydrogenase, mitochondrial (302-310)
uucggcaagaaaaccggggagggauuu

SEQ ID NO: 65721 - RNA, 27 nt, Artificial Sequence
  EH domain-containing protein 1 (42-50)
uuccacgaguuucauagccccgcccug

SEQ ID NO: 65722 - RNA, 27 nt, Artificial Sequence
  Forkhead box protein N2 (278-286)
uuccaccaucccagcgccgugagacug

SEQ ID NO: 65723 - RNA, 27 nt, Artificial Sequence
  B-lymphocyte antigen CD20 (62-70)
uuccacaucgcccugggcgggcuccuu

SEQ ID NO: 65724 - RNA, 27 nt, Artificial Sequence
  Endoplasmic reticulum-Golgi intermediate compartment protein 2 (185-193)
uuccacaucaccgugggcaaggccauu

SEQ ID NO: 65725 - RNA, 27 nt, Artificial Sequence
  Complement receptor type 2 (1016-1024)
uuccaccuggaggccagagaaguguac

SEQ ID NO: 65726 - RNA, 27 nt, Artificial Sequence
  Eukaryotic elongation factor 2 kinase (553-561)
uuccaccuggagcaugccgcuaaccuc

SEQ ID NO: 65727 - RNA, 27 nt, Artificial Sequence
  Dolichyl-diphosphooligosaccharide-proteinosyltransferase subunit 2 (579-587)
uuccaccugggccaugccgcuaugcuc

SEQ ID NO: 65728 - RNA, 27 nt, Artificial Sequence
  Brain-specific angiogenesis inhibitor 1-associated protein 2 (97-105)
uuccacaacgagcugcucacccagcuu

SEQ ID NO: 65729 - RNA, 27 nt, Artificial Sequence
  Large subunit GTPase 1 homolog (597-605)
uuccaccaggagaacgugagagcccug

SEQ ID NO: 65730 - RNA, 27 nt, Artificial Sequence
  tRNA (uracil(54)-C(5))-methyltransferase homolog (396-404)
uuccacaccggccaggccgagaagauc

SEQ ID NO: 65731 - RNA, 30 nt, Artificial Sequence
  E3 ubiquitin-protein ligase UHRF1 (36-45)
uuccacguggagcccggccugcagagacuc

SEQ ID NO: 65732 - RNA, 27 nt, Artificial Sequence
  Minor histocompatibility protein HA-1 (190-198)
uuccacuacgagagcaacaaugaccug

SEQ ID NO: 65733 - RNA, 27 nt, Artificial Sequence
  Gamma-adducin (307-315)
uuccacuacaucuuuaacgugcagcug

SEQ ID NO: 65734 - RNA, 27 nt, Artificial Sequence
  Protein RER1 (79-87)
uucaucgccuuucugagccccaaggug

SEQ ID NO: 65735 - RNA, 27 nt, Artificial Sequence
  Mitochondrial import receptor subunit TOM5 homolog (43-51)
uucauccugaagaaacucgacagcauu

SEQ ID NO: 65736 - RNA, 27 nt, Artificial Sequence
  Neutral amino acid transporter B(0) (175-183)
uucauccugcccauuggcgccaccgug

SEQ ID NO: 65737 - RNA, 27 nt, Artificial Sequence
  Nectin-1 (509-517)
uucaucagcaagaaagagugguacgug

SEQ ID NO: 65738 - RNA, 27 nt, Artificial Sequence
  Desmoplakin (2300-2308)
uucaucguggaccccgucagcaaccug

SEQ ID NO: 65739 - RNA, 27 nt, Artificial Sequence
  Zinc finger protein 460 (554-562)
uucaucguggaggaaacccugccccuc

SEQ ID NO: 65740 - RNA, 27 nt, Artificial Sequence
  Elongation factor 1-gamma (16-24)
uucaaggcccugaucgcugcacaguac

SEQ ID NO: 65741 - RNA, 27 nt, Artificial Sequence
  Ubiquilin-1 (61-69)
uucaaggaggaaaucagcaaaagauuu

SEQ ID NO: 65742 - RNA, 27 nt, Artificial Sequence
  Nuclear pore complex protein Nup153 (924-932)
uucaaguuuggcgaccaggggggauuc

SEQ ID NO: 65743 - RNA, 27 nt, Artificial Sequence
  Thioredoxin-interacting protein (370-378)
uucaaguuuaugcccccuccaaccuac

SEQ ID NO: 65744 - RNA, 27 nt, Artificial Sequence
  Protein SCAF11 (1115-1123)
uucaaguuuguggagcagcaaagcuac

SEQ ID NO: 65745 - RNA, 30 nt, Artificial Sequence; identical to SEQ ID NO: 41518
  Casein kinase II subunit alpha (197-206)

SEQ ID NO: 65746 - RNA, 30 nt, Artificial Sequence
  Ras association domain-containing protein 2 (212-221)
uucaagaucgagaacagcgccgaagaguuu

SEQ ID NO: 65747 - RNA, 27 nt, Artificial Sequence
  Septin-6 (197-205)
uucaagaucaaaauuaccagcgagcug

SEQ ID NO: 65748 - RNA, 27 nt, Artificial Sequence
  Ubiquitin carboxyl-terminal hydrolase 33 (150-158)
uucaagauccccagcaacaccacacug

SEQ ID NO: 65749 - RNA, 30 nt, Artificial Sequence
  SLIT-ROBO Rho GTPase-activating protein 3 (765-774)
uucaagaaaggcgccagccugcuccuuuac

SEQ ID NO: 65750 - RNA, 30 nt, Artificial Sequence
  ETS domain-containing protein Elk-4 (163-172)
uucaagcugaucaaaaccgagaaccccgcc

SEQ ID NO: 65751 - RNA, 27 nt, Artificial Sequence
  Nucleoporin-like protein 2 (303-311)
uucaagagccccgccgcuuccucuuuu

SEQ ID NO: 65752 - RNA, 30 nt, Artificial Sequence; identical to SEQ ID NO: 41525
  Mini-chromosome maintenance complex-binding protein (250-259)

SEQ ID NO: 65753 - RNA, 27 nt, Artificial Sequence
  U2 small nuclear ribonucleoprotein auxiliary factor 35 kDa subunit-related protein 2 (256-264)
uucaaggugagcugcaaccuggagccc

SEQ ID NO: 65754 - RNA, 27 nt, Artificial Sequence
  Ubiquitin-conjugating enzyme E2 T (132-140)
uucaaguacaacaaacccgccuuucug

SEQ ID NO: 65755 - RNA, 27 nt, Artificial Sequence
  Bestrophin-3 (595-603)
uuccugggcagcucccacaccucucuc

SEQ ID NO: 65756 - RNA, 30 nt, Artificial Sequence; identical to SEQ ID NO: 41529
  Heparan-alpha-glucosaminide N-acetyltransferase (512-521)

SEQ ID NO: 65757 - RNA, 27 nt, Artificial Sequence
  Acetyl-CoA carboxylase 1 (2174-2182)
uuccugauccccauuuaccaccaggug

SEQ ID NO: 65758 - RNA, 27 nt, Artificial Sequence
  Rho-associated protein kinase 1 (316-324)
uuccugaccgacagagaggugaggcuc

SEQ ID NO: 65759 - RNA, 27 nt, Artificial Sequence
  AP-2 complex subunit alpha-1 (812-820)
uuccugacccccccucuccuuagcgug

SEQ ID NO: 65760 - RNA, 30 nt, Artificial Sequence
  Bardet-Biedl syndrome 1 protein (409-418)
uuccuguacaacgaggcccucuauagccuu

SEQ ID NO: 65761 - RNA, 27 nt, Artificial Sequence
  Adiponectin receptor protein 1 (163-171)
uucauggccccccugcaggagaaggug

SEQ ID NO: 65762 - RNA, 27 nt, Artificial Sequence
  Protein SGT1 homolog (332-340)
uucauggagagcggcgggaccgugcug

SEQ ID NO: 65763 - RNA, 27 nt, Artificial Sequence
  Cyclin-dependent kinase 13 (131-139)
uuccccaucaccgccauuagagagaua

SEQ ID NO: 65764 - RNA, 27 nt, Artificial Sequence
  Actin-like protein 6A (99-107)
uuccaggccauccuggaccacaccuac

SEQ ID NO: 65765 - RNA, 30 nt, Artificial Sequence
  Nuclear pore complex protein Nup153 (1395-1404)
uuccaguuuggcagcuccaccacaaacuuc

SEQ ID NO: 65766 - RNA, 27 nt, Artificial Sequence
  Choline-phosphate cytidylyltransferase B (242-250)
uuccagaaccaaguggacaagaugaaa

SEQ ID NO: 65767 - RNA, 27 nt, Artificial Sequence
  Fibrillin-3 (594-602)
uucagaugccagugucugggcgggcuc

SEQ ID NO: 65768 - RNA, 27 nt, Artificial Sequence
  Polycystin-1 (3465-3473)
uucagcgccuccgacgaggaucugauc

SEQ ID NO: 65769 - RNA, 27 nt, Artificial Sequence
  Chromodomain-helicase-DNA-binding protein 4 (167-175)
uucagcgaggaagacuacagaacccug

SEQ ID NO: 65770 - RNA, 27 nt, Artificial Sequence
  Integrin beta-7 (227-235)
uucagcuuucaccaugugcugucccuc

SEQ ID NO: 65771 - RNA, 30 nt, Artificial Sequence
  GPALPP motifs-containing protein 1 (331-340)
uucagccacggcaaggggaacauguuucug

SEQ ID NO: 65772 - RNA, 27 nt, Artificial Sequence
  Transcription intermediary factor 1-beta (125-133)
uucagcaaggacaucguggagaacuac

SEQ ID NO: 65773 - RNA, 27 nt, Artificial Sequence
  Meiosis arrest female protein 1 (1734-1742)
uucagccuggcccccaucaccaagcuc

SEQ ID NO: 65774 - RNA, 24 nt, Artificial Sequence
  Chromosome transmission fidelity protein 8 homolog isoform 2 (371-378)
uucagccaguccucuggcacccug

SEQ ID NO: 65775 - RNA, 27 nt, Artificial Sequence
  Protein PRRC2A (165-173)
uucagcagagaggaauuucccacccug

SEQ ID NO: 65776 - RNA, 27 nt, Artificial Sequence
  V-type proton ATPase subunit D (79-87)
uucagcaccacagugauccagaacguc

SEQ ID NO: 65777 - RNA, 24 nt, Artificial Sequence
  Nodal modulator 2 (329-336)
uucagcgugaccggcagaguccug

SEQ ID NO: 65778 - RNA, 27 nt, Artificial Sequence
  ETS domain-containing protein Elk-3 (331-339)
uucaccgcccagacacccaacggccug

SEQ ID NO: 65779 - RNA, 30 nt, Artificial Sequence
  ATP synthase subunit delta, mitochondrial (40-49)
uucaccuuugccagccccacacagguguuc

SEQ ID NO: 65780 - RNA, 33 nt, Artificial Sequence
  E3 SUMO-protein ligase RanBP2 (1132-1142)
uucaccuuucacggccccgggaagagcguguuc

SEQ ID NO: 65781 - RNA, 27 nt, Artificial Sequence
  Embigin (129-137)
uucaccaucauuaacagcaagcagaug

SEQ ID NO: 65782 - RNA, 27 nt, Artificial Sequence
  Protein transport protein Sec23B (392-400)
uucaccaaggacuuuaacggcgauuuc

SEQ ID NO: 65783 - RNA, 27 nt, Artificial Sequence
  Protein TFG (363-371)
uucaccagccugcccggcuccacaaug

SEQ ID NO: 65784 - RNA, 27 nt, Artificial Sequence
  Nuclear factor of activated T-cells, cytoplasmic 2 (454-462)
uucaccuaccaccccgugccugccauc

SEQ ID NO: 65785 - RNA, 27 nt, Artificial Sequence
  Phosphomannomutase 2 (157-165)
uucguggccgaccugagaaaggaguuu

SEQ ID NO: 65786 - RNA, 27 nt, Artificial Sequence
  V-type proton ATPase subunit G 1 (102-110)
uucgugugcgacaucagacccgagauu

SEQ ID NO: 65787 - RNA, 27 nt, Artificial Sequence
  T-box transcription factor TBX20 (45-53)
uucguggagaagagcuccugcgcccag

SEQ ID NO: 65788 - RNA, 27 nt, Artificial Sequence
  Dual specificity protein phosphatase 4 (364-372)
uucguguuuagcuuccccgucuccguu

SEQ ID NO: 65789 - RNA, 27 nt, Artificial Sequence
  RNA-binding protein PNO1 (136-144)
uucgugaaggccuuuauccugggcuuc

SEQ ID NO: 65790 - RNA, 27 nt, Artificial Sequence
  Serine/threonine-protein kinase mTOR (725-733)
uucgugaugcccuuucugagaaagaug

SEQ ID NO: 65791 - RNA, 27 nt, Artificial Sequence
  60S ribosomal protein L36 (39-47)
uucgugagagacaugaucagggagguc

SEQ ID NO: 65792 - RNA, 27 nt, Artificial Sequence
  Melanoma-associated antigen C2 (265-273)
uucguguacggcgagcccagagaacug

SEQ ID NO: 65793 - RNA, 27 nt, Artificial Sequence
  Beta-1,3-galactosyltransferase 5 (36-44)
uucguguacaagaaagacggcaacuuu

SEQ ID NO: 65794 - RNA, 27 nt, Artificial Sequence
  Olfactory receptor 12D2 (250-258)
uucuacgcccccgugcuguuuaccuau

SEQ ID NO: 65795 - RNA, 27 nt, Artificial Sequence
  Laminin subunit alpha-5 (1849-1857)
uucuacagagacgugaagggccuguuu

SEQ ID NO: 65796 - RNA, 27 nt, Artificial Sequence
  Erythrocyte band 7 integral membrane protein (75-83)
ggcgccaaggggcccggacuguucuuu

SEQ ID NO: 65797 - RNA, 27 nt, Artificial Sequence
  Forkhead box protein O3 (542-550)
ggcgcccuggggggaagcagagcucuc

SEQ ID NO: 65798 - RNA, 27 nt, Artificial Sequence
  Tumor necrosis factor receptor superfamily member 18 (5-13)
ggcgccaugggggcuuucagagcacug

SEQ ID NO: 65799 - RNA, 27 nt, Artificial Sequence
  Leukocyte elastase inhibitor (309-317)
ggcgccagagacaucuucauuagcaag

SEQ ID NO: 65800 - RNA, 27 nt, Artificial Sequence
  Solute carrier family 22 member 9 (444-452)
ggcgccagcgcucuggcaaacacccuc

SEQ ID NO: 65801 - RNA, 27 nt, Artificial Sequence
  Alpha-enolase (122-130)
ggcgccguggagaagggggucccccug

SEQ ID NO: 65802 - RNA, 27 nt, Artificial Sequence
  Importin subunit alpha-5 (169-177)
ggcgccgugcccaucuucauugagcug

SEQ ID NO: 65803 - RNA, 27 nt, Artificial Sequence
  60S ribosomal protein L15 (2-10)
ggcgccuacaaguauauccaggagcug

SEQ ID NO: 65804 - RNA, 30 nt, Artificial Sequence
  Nuclease EXOG, mitochondrial (105-114)
ggcgacgccgauagaaagcacugcaaauuc

SEQ ID NO: 65805 - RNA, 27 nt, Artificial Sequence
  Lariat debranching enzyme (502-510)
ggcgaggaccugaccaaggugccccuc

SEQ ID NO: 65806 - RNA, 24 nt, Artificial Sequence
  Leucine-rich repeat LGI family member 4 (2-9)
ggcggggccggaauccugcuccuu

SEQ ID NO: 65807 - RNA, 27 nt, Artificial Sequence
  Anosmin-1 (412-420)
ggcgggauccagacccaacugcccuuc

SEQ ID NO: 65808 - RNA, 27 nt, Artificial Sequence
  Cold-inducible RNA-binding protein (133-141)
ggcggguacggagguagcagagacuau

SEQ ID NO: 65809 - RNA, 27 nt, Artificial Sequence
  Acetyl-CoA carboxylase 2 (352-360)
ggccacgccagcgagaaccccaagcug

SEQ ID NO: 65810 - RNA, 27 nt, Artificial Sequence
  Guanine nucleotide-binding protein subunit beta-5 (365-373)
ggccacgagaacagagugagcacccug

SEQ ID NO: 65811 - RNA, 33 nt, Artificial Sequence; identical to SEQ ID NO: 41584
  Rho guanine nucleotide exchange factor 2 (157-167)

SEQ ID NO: 65812 - RNA, 27 nt, Artificial Sequence
  DNA polymerase delta catalytic subunit (784-792)
ggccacuuccccagcccuaucagacug

SEQ ID NO: 65813 - RNA, 27 nt, Artificial Sequence
  Factor VIII intron 22 protein (163-171)
ggccacuuccagagagccgcucaacug

SEQ ID NO: 65814 - RNA, 27 nt, Artificial Sequence
  Centrosomal protein of 152 kDa (1140-1148)
ggccaccaugcccagccccuggcucuc

SEQ ID NO: 65815 - RNA, 27 nt, Artificial Sequence
  Inosine-5'-monophosphate dehydrogenase 2 (371-379)
ggccacaucgccaaggcucuggcacuc

SEQ ID NO: 65816 - RNA, 30 nt, Artificial Sequence; identical to SEQ ID NO: 41589
  Selenocysteine-specific elongation factor (14-23)

SEQ ID NO: 65817 - RNA, 27 nt, Artificial Sequence
  Hairy/enhancer-of-split related with YRPW motif protein 1 (176-184)
ggccacauccccugggggaccguguuc

SEQ ID NO: 65818 - RNA, 36 nt, Artificial Sequence
  Transcription factor AP-1 (86-97)
ggccacaucaccacaacucccacgccuacccaguuc

SEQ ID NO: 65819 - RNA, 27 nt, Artificial Sequence
  U5 small nuclear ribonucleoprotein 40 kDa protein (107-115)
ggccacagcggggccgugauggagcug

SEQ ID NO: 65820 - RNA, 27 nt, Artificial Sequence
  Scaffold attachment factor B1 (858-866)
ggccacagcgggcccggacauaugaug

SEQ ID NO: 65821 - RNA, 27 nt, Artificial Sequence
  Proteasome subunit beta type-4 (125-133)
ggccacagcuacucccccagagccauc

SEQ ID NO: 65822 - RNA, 33 nt, Artificial Sequence
  Inactive tyrosine-protein kinase transmembrane receptor ROR1 (927-937)
ggccacaccgagagcaugaucuccgccgaacug

SEQ ID NO: 65823 - RNA, 27 nt, Artificial Sequence
  Cytochrome b-c1 complex subunit 2, mitochondrial (445-453)
ggccacacccccuucguggacgagcug

SEQ ID NO: 65824 - RNA, 27 nt, Artificial Sequence
  Tetratricopeptide repeat protein 8 (471-479)
ggccacguggagcaggccagagcucug

SEQ ID NO: 65825 - RNA, 27 nt, Artificial Sequence
  Centromere protein M (155-163)
ggccacgugcccggggucagcgcccug

SEQ ID NO: 65826 - RNA, 27 nt, Artificial Sequence
  Inosine-5'-monophosphate dehydrogenase 1 (371-379)
ggccacguggucaaggcccuggcucuc

SEQ ID NO: 65827 - RNA, 27 nt, Artificial Sequence
  Ubiquitin carboxyl-terminal hydrolase 1 (592-600)
ggccacuacaccgccagcgugaagguc

SEQ ID NO: 65828 - RNA, 27 nt, Artificial Sequence
  Tubulin beta-4B chain (104-112)
ggccacuacaccgagggggccgaacug

SEQ ID NO: 65829 - RNA, 27 nt, Artificial Sequence
  Ubiquitin-like-conjugating enzyme ATG3 (118-126)
ggcaucaccgaggccgugaaggaaauu

SEQ ID NO: 65830 - RNA, 27 nt, Artificial Sequence
  Phospholipid phosphatase 5 (2-10)
ggcaaggccgcugcagccguggcguuc

SEQ ID NO: 65831 - RNA, 30 nt, Artificial Sequence
  Sterol regulatory element-binding protein 2 (933-942)
ggcaaggccgacgggcagcaaagcuccuuc

SEQ ID NO: 65832 - RNA, 27 nt, Artificial Sequence
  Zinc finger protein 623 (381-389)
ggcaaggccuucuuucugagcuccuac

SEQ ID NO: 65833 - RNA, 27 nt, Artificial Sequence
  Zinc finger protein 791 (278-286)
ggcaaggccuucaucuuucccagcuuc

SEQ ID NO: 65834 - RNA, 27 nt, Artificial Sequence
  Zinc finger protein with KRAB and SCAN domains 1 (495-503)
ggcaaggccuucaacagaaauagcuac

SEQ ID NO: 65835 - RNA, 27 nt, Artificial Sequence
  Zinc finger protein 397 (375-383)
ggcaaggccuucagccaguccucuuac

SEQ ID NO: 65836 - RNA, 27 nt, Artificial Sequence
  Zinc finger protein 791 (362-370)
ggcaaggccuucagcagaaucuccuac

SEQ ID NO: 65837 - RNA, 30 nt, Artificial Sequence
  Zinc finger protein 460 (370-379)
ggcaaggccuucacccacuacagcacauau

SEQ ID NO: 65838 - RNA, 27 nt, Artificial Sequence
  Coatomer subunit delta (13-21)
ggcaaggccaucgugagcagacaguuc

SEQ ID NO: 65839 - RNA, 27 nt, Artificial Sequence
  O-acetyl-ADP-ribose deacetylase MACROD1 (208-216)
ggcaaggccaaaaucaccgggggauac

SEQ ID NO: 65840 - RNA, 27 nt, Artificial Sequence
  2',3'-cyclic-nucleotide 3'-phosphodiesterase (260-268)
ggcaaggcccccggggcugaggaauac

SEQ ID NO: 65841 - RNA, 27 nt, Artificial Sequence
  Ig lambda chain V-II region BOH (43-51)
ggcaaggcccccaaacugaucauuuac

SEQ ID NO: 65842 - RNA, 27 nt, Artificial Sequence
  Ig kappa chain V-I region Walker (63-71)
ggcaaggcccccaaacugcucaucuac

SEQ ID NO: 65843 - RNA, 27 nt, Artificial Sequence
  Filamin-B (876-884)
ggcaaggccccccugaacgugcaguuc

SEQ ID NO: 65844 - RNA, 27 nt, Artificial Sequence
  SH2 domain-containing protein 3C (476-484)
ggcaaggccagccccuccccuucucug

SEQ ID NO: 65845 - RNA, 27 nt, Artificial Sequence
  Parafibromin (46-54)
ggcaaggaggggcagcccagagaauac

SEQ ID NO: 65846 - RNA, 27 nt, Artificial Sequence
  40S ribosomal protein S11 (29-37)
ggcaaggagaaacugcccagauacuau

SEQ ID NO: 65847 - RNA, 30 nt, Artificial Sequence
  Transmembrane emp24 domain-containing protein 10 (93-102)
ggcaaguucgccuuuaccacagaggacuac

SEQ ID NO: 65848 - RNA, 27 nt, Artificial Sequence
  ER membrane protein complex subunit 1 (28-36)
ggcaaguucgacuggagacagcaauac

SEQ ID NO: 65849 - RNA, 27 nt, Artificial Sequence
  Nucleolar protein 56 (40-48)
ggcaaguuccacagcaucgugagacug

SEQ ID NO: 65850 - RNA, 30 nt, Artificial Sequence
  Putative ATP-dependent RNA helicase DHX30 (1039-1048)
ggcaaguucaaacccaacagcgugaccuac

SEQ ID NO: 65851 - RNA, 30 nt, Artificial Sequence
  Kinesin light chain 1 (395-404)
ggcaaguucaaacaggccgagacccuguac

SEQ ID NO: 65852 - RNA, 30 nt, Artificial Sequence
  Transcription activator BRG1 (851-860)
ggcaaguucaacgugcugcucaccacauac

SEQ ID NO: 65853 - RNA, 27 nt, Artificial Sequence
  60S ribosomal protein L10a (132-140)
ggcaaguuccccagccugcucacccac

SEQ ID NO: 65854 - RNA, 27 nt, Artificial Sequence
  Microtubule-associated protein RP/EB family member 1 (99-107)
ggcaaguuccaggacaacuuugaguuc

SEQ ID NO: 65855 - RNA, 36 nt, Artificial Sequence
  Glycogen phosphorylase, brain form (810-821)
ggcaaguucagcuccgacagaaccaucacagaguac

SEQ ID NO: 65856 - RNA, 27 nt, Artificial Sequence
  60S ribosome subunit biogenesis protein NIP7 homolog (71-79)
ggcaaguucaccaaaacacacaaguuu

SEQ ID NO: 65857 - RNA, 33 nt, Artificial Sequence
  ATP-dependent RNA helicase DDX19B (186-196)
ggcaaguucuaccccgagcugaaacucgccuau

SEQ ID NO: 65858 - RNA, 27 nt, Artificial Sequence
  Serine/threonine-protein kinase pim-2 (39-47)
ggcaaggggggauucgguaccguguuu

SEQ ID NO: 65859 - RNA, 27 nt, Artificial Sequence
  Tyrosine-protein kinase Fer (570-578)
ggcaaggggaacuucggagagguguac

SEQ ID NO: 65860 - RNA, 27 nt, Artificial Sequence
  YTH domain-containing family protein 2 (451-459)
ggcaaggggcccguguaccugcucuuc

SEQ ID NO: 65861 - RNA, 30 nt, Artificial Sequence; identical to SEQ ID NO: 41634
  MYCBP-associated protein (359-368)

SEQ ID NO: 65862 - RNA, 33 nt, Artificial Sequence
  60S ribosomal protein L36a (16-26)
ggcaagcaccagccccauaaagugacccaauac

SEQ ID NO: 65863 - RNA, 27 nt, Artificial Sequence
  SWI/SNF complex subunit SMARCC1 (93-101)
ggcaagcacgugaccaaccccgccuuc

SEQ ID NO: 65864 - RNA, 27 nt, Artificial Sequence
  DNA damage-binding protein 1 (59-67)
ggcaagaucgccgugauggagcuguuc

SEQ ID NO: 65865 - RNA, 30 nt, Artificial Sequence
  Acidic leucine-rich nuclear phosphoprotein 32 family member B (32-41)
ggcaagaucgaggggcugaccgccgaauuc

SEQ ID NO: 65866 - RNA, 27 nt, Artificial Sequence
  Endothelial differentiation-related factor 1 (122-130)
ggcaagaucgagagagccauugggcug

SEQ ID NO: 65867 - RNA, 27 nt, Artificial Sequence
  Heterogeneous nuclear ribonucleoprotein A3 (150-158)
ggcaagaucgagaccauugaagugaug

SEQ ID NO: 65868 - RNA, 27 nt, Artificial Sequence
  Peptidyl-prolyl cis-trans isomerase B (203-211)
ggcaagaucgagguggaaaaacccuuc

SEQ ID NO: 65869 - RNA, 33 nt, Artificial Sequence
  Macrophage migration inhibitory factor (66-76)
ggcaagaucgggggagcccagaacagaagcuac

SEQ ID NO: 65870 - RNA, 27 nt, Artificial Sequence
  Phospholipase ABHD3 (231-239)
ggcaagaucgggagcaaaaccccccug

SEQ ID NO: 65871 - RNA, 27 nt, Artificial Sequence
  D-dopachrome decarboxylase (109-117)
ggcaagaucgggaccgugaugacauuc

SEQ ID NO: 65872 - RNA, 27 nt, Artificial Sequence
  Protein YIF1B (244-252)
ggcaagaucggguacuaucuggugcuc

SEQ ID NO: 65873 - RNA, 27 nt, Artificial Sequence
  Nucleolar GTP-binding protein 2 (54-62)
ggcaagaucauuaaaccccugcaguac

SEQ ID NO: 65874 - RNA, 30 nt, Artificial Sequence
  Nucleolar protein 58 (195-204)
ggcaagaucauuagcgacaaccugaccuac

SEQ ID NO: 65875 - RNA, 27 nt, Artificial Sequence
  Nucleolar GTP-binding protein 2 (534-542)
ggcaagaucaacguggucccccaguuc

SEQ ID NO: 65876 - RNA, 27 nt, Artificial Sequence
  Protein YIPF5 (145-153)
ggcaagauccaguucggguacguguau

SEQ ID NO: 65877 - RNA, 30 nt, Artificial Sequence
  TBC1 domain family member 9 (117-126)
ggcaagauccaggggauuauagccgaguac

SEQ ID NO: 65878 - RNA, 27 nt, Artificial Sequence
  Nucleolysin TIAR (121-129)
ggcaagaucagcgacgccagagugguc

SEQ ID NO: 65879 - RNA, 27 nt, Artificial Sequence
  Ras GTPase-activating protein 1 (354-362)
ggcaagaucagcaaacaggaggccuac

SEQ ID NO: 65880 - RNA, 24 nt, Artificial Sequence
  Solute carrier family 35 member E2B (319-326)
ggcaagaucagccccgugaccuuc

SEQ ID NO: 65881 - RNA, 27 nt, Artificial Sequence
  40S ribosomal protein S4, X isoform (167-175)
ggcaagaucaccgacuucauuaaauuu

SEQ ID NO: 65882 - RNA, 27 nt, Artificial Sequence
  Calcium channel flower homolog (141-149)
ggcaagaaaggggacgccaucagcuac

SEQ ID NO: 65883 - RNA, 27 nt, Artificial Sequence
  Signal recognition particle receptor subunit beta (226-234)
ggcaagaaagggaaggaguucgaauuu

SEQ ID NO: 65884 - RNA, 27 nt, Artificial Sequence
  Sodium-coupled neutral amino acid transporter 2 (58-66)
ggcaagaaaaaguacgagaccgaauuc

SEQ ID NO: 65885 - RNA, 27 nt, Artificial Sequence
  Barrier-to-autointegration factor (31-39)
ggcaagaaacuggaggaaagaggguuc

SEQ ID NO: 65886 - RNA, 27 nt, Artificial Sequence
  Amyloid protein-binding protein 2 (502-510)
ggcaagaaacuguucggggagggauac

SEQ ID NO: 65887 - RNA, 27 nt, Artificial Sequence
  C-1-tetrahydrofolate synthase, cytoplasmic (332-340)
ggcaagcuggccagagagaucgggcuc

SEQ ID NO: 65888 - RNA, 27 nt, Artificial Sequence
  Sterol regulatory element-binding protein 2 (730-738)
ggcaagcugggguuccucgccagcuac

SEQ ID NO: 65889 - RNA, 30 nt, Artificial Sequence; identical to SEQ ID NO: 41662
  T-cell-specific surfaceoprotein CD28 (88-97)

SEQ ID NO: 65890 - RNA, 33 nt, Artificial Sequence; identical to SEQ ID NO: 41663
  T-cell-specific surfaceoprotein CD28 (88-98)

SEQ ID NO: 65891 - RNA, 27 nt, Artificial Sequence
  Guanine nucleotide-binding protein G(I)/G(S)/G(T) subunit beta-1 (77-85)
ggcaagcugaucauuugggacagcuac

SEQ ID NO: 65892 - RNA, 24 nt, Artificial Sequence
  Sterile alpha motif domain-containing protein 9-like (1531-1538)
ggcaagcugaucagcguggaguac

SEQ ID NO: 65893 - RNA, 27 nt, Artificial Sequence
  RNA-binding protein FUS (331-339)
ggcaagcugaaaggggaggccaccgug

SEQ ID NO: 65894 - RNA, 27 nt, Artificial Sequence
  Hydroxysteroid dehydrogenase-like protein 2 (382-390)
ggcaagcugaaacccaccauggccuuc

SEQ ID NO: 65895 - RNA, 27 nt, Artificial Sequence
  Endoplasmic reticulum-Golgi intermediate compartment protein 3 (5-13)
ggcaagcugaaacaguucgacgccuac

SEQ ID NO: 65896 - RNA, 27 nt, Artificial Sequence
  Tripartite motif-containing protein 26 (302-310)
ggcaagcugcucagagaccuugaguac

SEQ ID NO: 65897 - RNA, 30 nt, Artificial Sequence
  Protein PRRC2A (1913-1922)
ggcaagcugcccgccgggggagugcucuac

SEQ ID NO: 65898 - RNA, 27 nt, Artificial Sequence
  RRP12-like protein (5-13)
ggcaagcugcccagcgggguguccgcc

SEQ ID NO: 65899 - RNA, 24 nt, Artificial Sequence
  Proteasome subunit alpha type-2 (17-24)
ggcaagcuggugcagaucgaguac

SEQ ID NO: 65900 - RNA, 27 nt, Artificial Sequence
  Pre-mRNA-processing-splicing factor 8 (1462-1470)
ggcaagcuguggaaccucaauaacuac

SEQ ID NO: 65901 - RNA, 27 nt, Artificial Sequence
  Non-specific lipid-transfer protein (510-518)
ggcaagaugaacccccagagcgccuuc

SEQ ID NO: 65902 - RNA, 27 nt, Artificial Sequence
  Vitamin D 25-hydroxylase (287-295)
ggcaagaacgaccccagcuccaccuuc

SEQ ID NO: 65903 - RNA, 27 nt, Artificial Sequence
  FACT complex subunit SSRP1 (142-150)
ggcaagaacgaggugacccuggaauuc

SEQ ID NO: 65904 - RNA, 27 nt, Artificial Sequence
  Protein disulfide-isomerase A2 (395-403)
ggcaagaacuucgagcagguggccuuu

SEQ ID NO: 65905 - RNA, 27 nt, Artificial Sequence
  Embigin (163-171)
ggcaagaacaaaccccugaucagcuac

SEQ ID NO: 65906 - RNA, 27 nt, Artificial Sequence
  Pre-mRNA-splicing factor SLU7 (301-309)
ggcaagaaccccgacgaggugagcuac

SEQ ID NO: 65907 - RNA, 30 nt, Artificial Sequence; identical to SEQ ID NO: 41680
  Cell cycle control protein 50A (320-329)

SEQ ID NO: 65908 - RNA, 27 nt, Artificial Sequence
  WD repeat-containing protein 75 (353-361)
ggcaagcccgggcaccugcaguucuac

SEQ ID NO: 65909 - RNA, 30 nt, Artificial Sequence
  Aurora kinase A (325-334)
ggcaagcccccuuucgaggccaacaccuac

SEQ ID NO: 65910 - RNA, 27 nt, Artificial Sequence
  Filamin-B (863-871)
ggcaagcccacccacuucacaguguac

SEQ ID NO: 65911 - RNA, 27 nt, Artificial Sequence
  Dual specificity protein phosphatase 5 (162-170)
ggcaagcccguggucaacguuagcuac

SEQ ID NO: 65912 - RNA, 27 nt, Artificial Sequence
  Actin-like protein 6A (61-69)
ggcaagcaggggggacccaccuacuau

SEQ ID NO: 65913 - RNA, 30 nt, Artificial Sequence
  F-box only protein 21 (396-405)
ggcaagagagaggggaucgaccagagcuac

SEQ ID NO: 65914 - RNA, 27 nt, Artificial Sequence
  Probable ATP-dependent RNA helicase DDX5 (500-508)
ggcaagagagggggauucaacaccuuu

SEQ ID NO: 65915 - RNA, 27 nt, Artificial Sequence
  Hydroxymethylglutaryl-CoA synthase, cytoplasmic (367-375)
ggcaagagaaucgggguguucagcuac

SEQ ID NO: 65916 - RNA, 27 nt, Artificial Sequence
  Protein S100-A4 (47-55)
ggcaagagaaccgacgaggccgcuuuc

SEQ ID NO: 65917 - RNA, 27 nt, Artificial Sequence
  Cell cycle progression protein 1 (410-418)
ggcaagagcgacucccccaacguguac

SEQ ID NO: 65918 - RNA, 27 nt, Artificial Sequence
  C-myc promoter-binding protein (1422-1430)
ggcaagagcgaggugaccuccucuuuc

SEQ ID NO: 65919 - RNA, 27 nt, Artificial Sequence
  Zinc finger protein 213 (379-387)
ggcaagagcuucuccagaucugccuac

SEQ ID NO: 65920 - RNA, 27 nt, Artificial Sequence
  Zinc finger protein 557 (403-411)
ggcaagagcuucaccuccaacucuuac

SEQ ID NO: 65921 - RNA, 27 nt, Artificial Sequence
  Nuclear receptor corepressor 1 (1214-1222)
ggcaagagcgggcacauccuguccuac

SEQ ID NO: 65922 - RNA, 33 nt, Artificial Sequence
  Polyadenylate-binding protein 1 (228-238)
ggcaagagcaaaggguucggauuuguguccuuc

SEQ ID NO: 65923 - RNA, 27 nt, Artificial Sequence
  Constitutive coactivator of PPAR-gamma-like protein 1 (209-217)
ggcaagagccugaccacaucccaguac

SEQ ID NO: 65924 - RNA, 30 nt, Artificial Sequence
  Heterogeneous nuclear ribonucleoprotein U (185-194)
ggcaagagcuccgggcccaccucucuguuc

SEQ ID NO: 65925 - RNA, 33 nt, Artificial Sequence
  Elongation factor 1-alpha 1 (19-29)
ggcaagagcaccacaacugggcaccugaucuac

SEQ ID NO: 65926 - RNA, 27 nt, Artificial Sequence
  Zinc finger protein 845 (333-341)
ggcaagaccuucagccagacauccuac

SEQ ID NO: 65927 - RNA, 30 nt, Artificial Sequence
  Sodium-coupled neutral amino acid transporter 5 (46-55)
ggcaagaccagcuucgggauguccguguuu

SEQ ID NO: 65928 - RNA, 27 nt, Artificial Sequence
  Ras-related protein Rab-6A (25-33)
ggcaagaccagccugaucacaagauuc

SEQ ID NO: 65929 - RNA, 27 nt, Artificial Sequence
  ATP-dependent RNA helicase DHX8 (593-601)
ggcaagaccacacagaucacucaauac

SEQ ID NO: 65930 - RNA, 27 nt, Artificial Sequence
  Pre-mRNA-splicing factor ATP-dependent RNA helicase PRP16 (560-568)
ggcaagaccacacagcugacucaauac

SEQ ID NO: 65931 - RNA, 27 nt, Artificial Sequence
  ATP-dependent RNA helicase DHX36 (235-243)
ggcaagaccacacaggugacucaauuc

SEQ ID NO: 65932 - RNA, 27 nt, Artificial Sequence
  Adenosylhomocysteinase (213-221)
ggcaagguggccgucguugcuggguac

SEQ ID NO: 65933 - RNA, 27 nt, Artificial Sequence
  Major facilitator superfamily domain-containing protein 1 (287-295)
ggcaagguguucuuuaccgagaaauuc

SEQ ID NO: 65934 - RNA, 27 nt, Artificial Sequence
  Zinc finger protein 264 (349-357)
ggcaagguguucaaacacagaagcuac

SEQ ID NO: 65935 - RNA, 27 nt, Artificial Sequence
  DNA polymerase delta catalytic subunit (997-1005)
ggcaagguggggggacugcucgccuuc

SEQ ID NO: 65936 - RNA, 33 nt, Artificial Sequence
  Estradiol 17-beta-dehydrogenase 8 (159-169)
ggcaagguggggaacgucggacagaccaauuac

SEQ ID NO: 65937 - RNA, 30 nt, Artificial Sequence
  WD repeat domain phosphoinositide-interacting protein 4 (281-290)
ggcaagguggggcccaugaucggacaguac

SEQ ID NO: 65938 - RNA, 27 nt, Artificial Sequence
  Dual specificity protein phosphatase 16 (647-655)
ggcaagguggggagccaguccucuuuc

SEQ ID NO: 65939 - RNA, 27 nt, Artificial Sequence
  Protein lin-7 homolog C (165-173)
ggcaaggugaaacuggucguuagauac

SEQ ID NO: 65940 - RNA, 27 nt, Artificial Sequence
  Apoptosis-associated speck-like protein containing a CARD (138-146)
ggcaaggugcugaccgacgagcaguac

SEQ ID NO: 65941 - RNA, 27 nt, Artificial Sequence
  E3 ubiquitin-protein ligase synoviolin (58-66)
ggcaaggugauggggaaagucuucuuu

SEQ ID NO: 65942 - RNA, 27 nt, Artificial Sequence
  Poly (ADP-ribose) polymerase 1 (46-54)
ggcaaggugccccacugguaccauuuc

SEQ ID NO: 65943 - RNA, 27 nt, Artificial Sequence
  DNA-directed RNA polymerase II subunit RPB1 (572-580)
ggcaaggugccccagccugccauccug

SEQ ID NO: 65944 - RNA, 27 nt, Artificial Sequence
  Nucleolar complex protein 2 homolog (575-583)
ggcaaggugcaggagaacagcgccuac

SEQ ID NO: 65945 - RNA, 33 nt, Artificial Sequence
  Major vault protein (396-406)
ggcaaggugagagccgucaucgggagcaccuac

SEQ ID NO: 65946 - RNA, 27 nt, Artificial Sequence
  40S ribosomal protein S4, X isoform (74-82)
ggcaaggugagaaccgacaucacauac

SEQ ID NO: 65947 - RNA, 27 nt, Artificial Sequence
  40S ribosomal protein S4, Y isoform 1 (74-82)
ggcaaggugagagucgacguuaccuac

SEQ ID NO: 65948 - RNA, 27 nt, Artificial Sequence
  ATP-dependent RNA helicase DHX8 (270-278)
ggcaaggugaccagcaucaugcaguuc

SEQ ID NO: 65949 - RNA, 27 nt, Artificial Sequence
  G2/mitotic-specific cyclin-B2 (323-331)
ggcaaguggaaccugaaacagcaauac

SEQ ID NO: 65950 - RNA, 27 nt, Artificial Sequence
  Transcription initiation factor IIE subunit beta (135-143)
ggcaaguacgccuucaaacccaaguau

SEQ ID NO: 65951 - RNA, 27 nt, Artificial Sequence
  Interferon-induced protein 44 (72-80)
ggcaaguacgccagcaucauucuguuc

SEQ ID NO: 65952 - RNA, 27 nt, Artificial Sequence
  WD repeat-containing protein 44 (704-712)
ggcaaguacgccgugaucgggaccuau

SEQ ID NO: 65953 - RNA, 27 nt, Artificial Sequence
  Kinesin light chain 1 (353-361)
ggcaaguacgaggaaguggaguauuac

SEQ ID NO: 65954 - RNA, 27 nt, Artificial Sequence
  Transketolase (139-147)
ggcaaguacuucgacaaagccagcuau

SEQ ID NO: 65955 - RNA, 27 nt, Artificial Sequence
  Golgi pH regulator A (283-291)
ggcaaguacuucaacuuucugggguau

SEQ ID NO: 65956 - RNA, 33 nt, Artificial Sequence
  Ethanolamine kinase 1 (257-267)
ggcaaguacuucagccugauccccaccggguuu

SEQ ID NO: 65957 - RNA, 36 nt, Artificial Sequence
  Solute carrier family 35 member B1 (38-49)
ggcaaguacggggagggagccaaacaggaaaccuuc

SEQ ID NO: 65958 - RNA, 33 nt, Artificial Sequence
  Phosphatidylinositol 3-kinase regulatory subunit alpha (388-398)
ggcaaguacggguucagcgacccccugaccuuu

SEQ ID NO: 65959 - RNA, 27 nt, Artificial Sequence
  DNA-directed RNA polymerase II subunit RPB7 (40-48)
ggcaaguacggguucgugaucgccguc

SEQ ID NO: 65960 - RNA, 27 nt, Artificial Sequence
  Neutral amino acid transporter A (295-303)
ggcaaguacaucuucgccagcauucug

SEQ ID NO: 65961 - RNA, 27 nt, Artificial Sequence
  ER membrane protein complex subunit 3 (65-73)
ggcaaguacauccccaaacagagcuuc

SEQ ID NO: 65962 - RNA, 30 nt, Artificial Sequence
  Protein phosphatase 1K, mitochondrial (350-359)
ggcaaguacaaaaacagcgagaucaauuuc

SEQ ID NO: 65963 - RNA, 30 nt, Artificial Sequence
  Peptidyl-prolyl cis-trans isomerase FKBP4 (284-293)
ggcaaguacaaacaggcccugcuccaauau

SEQ ID NO: 65964 - RNA, 27 nt, Artificial Sequence
  Protein transport protein Sec31A (487-495)
ggcaaguaccuggagcuccuuggguau

SEQ ID NO: 65965 - RNA, 27 nt, Artificial Sequence
  Catalase (272-280)
ggcaaguaccccagcuggaccuucuau

SEQ ID NO: 65966 - RNA, 27 nt, Artificial Sequence
  Transmembrane protein 222 (176-184)
ggcaaguacgugagcgucggggccuuc

SEQ ID NO: 65967 - RNA, 27 nt, Artificial Sequence
  5'-nucleotidase domain-containing protein 1 (122-130)
ggcaaguacuauuucuacgacaacuau

SEQ ID NO: 65968 - RNA, 24 nt, Artificial Sequence
  Plasmalemma vesicle-associated protein (2-9)
ggccuggccauggagcacggggga

SEQ ID NO: 65969 - RNA, 27 nt, Artificial Sequence
  DC-STAMP domain-containing protein 2 (243-251)
ggccuggccagccucgugcaggucuuc

SEQ ID NO: 65970 - RNA, 24 nt, Artificial Sequence
  Protein sel-1 homolog 3 (550-557)
ggccugcaccagaucagcuccauu

SEQ ID NO: 65971 - RNA, 27 nt, Artificial Sequence
  40S ribosomal protein S3a (61-69)
ggccugaaggggagaguguucgagguc

SEQ ID NO: 65972 - RNA, 27 nt, Artificial Sequence
  Integrin beta-7 (317-325)
ggccuguacagcagauccaccgaguuc

SEQ ID NO: 65973 - RNA, 33 nt, Artificial Sequence
  Solute carrier family 25 member 46 (162-172)
ggcauggggagcaccuucaucgugcagggaguc

SEQ ID NO: 65974 - RNA, 27 nt, Artificial Sequence
  DNA damage-binding protein 1 (56-64)
ggcauguacgggaagaucgccgugaug

SEQ ID NO: 65975 - RNA, 27 nt, Artificial Sequence
  60S ribosomal protein L8 (131-139)
ggcaacuacgccaccgugaucagccac

SEQ ID NO: 65976 - RNA, 27 nt, Artificial Sequence
  Huntingtin (77-85)
ggccccgccguggcugaggaaccucug

SEQ ID NO: 65977 - RNA, 27 nt, Artificial Sequence
  Salivary acidic proline-rich phosphoprotein 1/2 (83-91)
ggccccccuccaccgcaggggaagccc

SEQ ID NO: 65978 - RNA, 33 nt, Artificial Sequence
  Basic salivary proline-rich protein 2 (59-69)
ggccccccuccacaggggggaaaccaaccgcag

SEQ ID NO: 65979 - RNA, 33 nt, Artificial Sequence
  Basic salivary proline-rich protein 4 (248-258)
ggccccccucagcaagaggggaacaagccacag

SEQ ID NO: 65980 - RNA, 33 nt, Artificial Sequence
  Basic salivary proline-rich protein 2 (368-378)
ggccccccucagcaagaggggaacaauccacag

SEQ ID NO: 65981 - RNA, 27 nt, Artificial Sequence
  Ig kappa chain V-I region WAT (41-49)
ggccaggcccccaaggugcugaucuac

SEQ ID NO: 65982 - RNA, 30 nt, Artificial Sequence
  Thioredoxin domain-containing protein 5 (57-66)
ggccaggacccccacagcaagcaucuguac

SEQ ID NO: 65983 - RNA, 27 nt, Artificial Sequence
  Protein FAM179B (288-296)
ggccaggacagauuccaaagcuacauc

SEQ ID NO: 65984 - RNA, 27 nt, Artificial Sequence
  Nucleosome-remodeling factor subunit BPTF (843-851)
ggccaggaggggaaguacagaguguau

SEQ ID NO: 65985 - RNA, 27 nt, Artificial Sequence
  Rho GTPase-activating protein 1 (183-191)
ggccagaagaucuucuacgugaacuau

SEQ ID NO: 65986 - RNA, 27 nt, Artificial Sequence
  Endoplasmic reticulum lectin 1 (141-149)
ggccagaagaucaacauucacgaguac

SEQ ID NO: 65987 - RNA, 27 nt, Artificial Sequence
  Chromodomain-helicase-DNA-binding protein 2 (905-913)
ggccagaagaaacaagugaacaucuac

SEQ ID NO: 65988 - RNA, 27 nt, Artificial Sequence
  Immunoglobulin superfamily member 10 (2429-2437)
ggccagaagcccgugauccugaccuac

SEQ ID NO: 65989 - RNA, 27 nt, Artificial Sequence
  Fibronectin (679-687)
ggccagcugaucagcauucaacaguac

SEQ ID NO: 65990 - RNA, 27 nt, Artificial Sequence
  Lysine-specific demethylase 4B (78-86)
ggccagagcgggcuguucacccaauac

SEQ ID NO: 65991 - RNA, 27 nt, Artificial Sequence
  FERM domain-containing protein 3 (200-208)
ggccagagccccccuguggccgaguuc

SEQ ID NO: 65992 - RNA, 27 nt, Artificial Sequence
  RNA-binding protein EWS (62-70)
ggccagaccgccuacgcuacaagcuau

SEQ ID NO: 65993 - RNA, 24 nt, Artificial Sequence
  Guanine nucleotide-binding protein subunit beta-2-like 1 (295-302)
ggccagacccuguucgccggguac

SEQ ID NO: 65994 - RNA, 27 nt, Artificial Sequence
  Protein ELYS (807-815)
ggccaggugaagcugauccaaggguuc

SEQ ID NO: 65995 - RNA, 27 nt, Artificial Sequence
  Zinc finger protein 507 (577-585)
ggccaggugaagaccgggaucagcaug

SEQ ID NO: 65996 - RNA, 30 nt, Artificial Sequence
  Probable ATP-dependent RNA helicase DDX17 (631-640)
ggccaguacaccuaugggcaaggaacauac

SEQ ID NO: 65997 - RNA, 27 nt, Artificial Sequence
  LanC-like protein 1 (154-162)
ggcagaaucggguacauuuaugcccug

SEQ ID NO: 65998 - RNA, 27 nt, Artificial Sequence
  Gamma-interferon-inducible protein 16 (464-472)
ggcagccacuuccccgggccuuuuaug

SEQ ID NO: 65999 - RNA, 27 nt, Artificial Sequence
  NADH dehydrogenase (ubiquinone) 1 alpha subcomplex subunit 8 (164-172)
ggcagcagauucuacuuuuggaccaag

SEQ ID NO: 66000 - RNA, 27 nt, Artificial Sequence
  Proteasome subunit beta type-4 (73-81)
ggcagcuacgggucccuggccagauuc

SEQ ID NO: 66001 - RNA, 30 nt, Artificial Sequence
  Egl nine homolog 2 (272-281)
ggcagcuacgugaucaacgggagaaccaag

SEQ ID NO: 66002 - RNA, 27 nt, Artificial Sequence
  Olfactory receptor 8I2 (193-201)
ggcaccgagauggugagcuucguccug

SEQ ID NO: 66003 - RNA, 27 nt, Artificial Sequence
  Dual adapter for phosphotyrosine and 3-phosphotyrosine and 3-phosphoinositide (165-173)
ggcaccaaggagggguaccugacaaaa

SEQ ID NO: 66004 - RNA, 27 nt, Artificial Sequence
  Large proline-rich protein BAG6 (391-399)
ggcaccagacccccuccaacaccgaac

SEQ ID NO: 66005 - RNA, 27 nt, Artificial Sequence
  Splicing factor 3A subunit 2 (300-308)
ggcgugcaccccccugccccagggguc

SEQ ID NO: 66006 - RNA, 27 nt, Artificial Sequence
  Centrosomal protein of 76 kDa (224-232)
ggcgugaccagccugacagucgagcuc

SEQ ID NO: 66007 - RNA, 27 nt, Artificial Sequence
  Programmed cell death 6-interacting protein (279-287)
cacgccgcugagcugaucaagaccgug

SEQ ID NO: 66008 - RNA, 27 nt, Artificial Sequence
  UDP-glucose:glycoprotein glucosyltransferase 1 (566-574)
cacgccuuccagacccugacacauauc

SEQ ID NO: 66009 - RNA, 27 nt, Artificial Sequence
  Methionine synthase (601-609)
cacgccaucaagagcggcauggacaug

SEQ ID NO: 66010 - RNA, 27 nt, Artificial Sequence
  KH domain-containing, RNA-binding, signal transduction-associated protein 1 (246-254)
cacgccauggaggaagugaagaaauuc

SEQ ID NO: 66011 - RNA, 27 nt, Artificial Sequence
  Dynein heavy chain 6, axonemal (1387-1395)
cacgccagagacaucgugaccgagcug

SEQ ID NO: 66012 - RNA, 24 nt, Artificial Sequence
  Putative sodium-coupled neutral amino acid transporter 10 (698-705)
cacgccgugcugcuccaggucauc

SEQ ID NO: 66013 - RNA, 33 nt, Artificial Sequence
  HLA class I histocompatibility antigen, A-30 alpha chain (140-150)
cacgccuacgacggcaaggauuauaucgcucug

SEQ ID NO: 66014 - RNA, 24 nt, Artificial Sequence
  Tryptophan 2,3-dioxygenase (67-74)
cacgacgagcaucuguucaucauu

SEQ ID NO: 66015 - RNA, 24 nt, Artificial Sequence
  G1/S-specific cyclin-D2 (157-164)
cacgacuucaucgagcauauucug

SEQ ID NO: 66016 - RNA, 27 nt, Artificial Sequence
  Splicing factor, proline- and glutamine-rich (29-37)
cacgacuucagaagccccccuccaggc

SEQ ID NO: 66017 - RNA, 27 nt, Artificial Sequence
  MKL/myocardin-like protein 1 (831-839)
cacgacggccccgagccucugagccuc

SEQ ID NO: 66018 - RNA, 27 nt, Artificial Sequence
  Rho guanine nucleotide exchange factor 5 (1170-1178)
cacgaggaccagaagcugcaagaagug

SEQ ID NO: 66019 - RNA, 33 nt, Artificial Sequence
  Dedicator of cytokinesis protein 9 (933-943)
cacgaggaacugaccaagagcaugacaacuauc

SEQ ID NO: 66020 - RNA, 27 nt, Artificial Sequence
  Protein phosphatase 2C-like domain-containing protein 1 (71-79)
cacgagaucgaccugaccggcauuuuc

SEQ ID NO: 66021 - RNA, 30 nt, Artificial Sequence
  Histatin-3 (34-43)
cacgagaagcaucacagccauagaggcuac

SEQ ID NO: 66022 - RNA, 27 nt, Artificial Sequence
  Protocadherin-9 (1071-1079)
cacgagcccgugggcagcgggacccug

SEQ ID NO: 66023 - RNA, 27 nt, Artificial Sequence
  60S ribosomal protein L36a-like (90-98)
cacuucgagcugggcggggacaagaaa

SEQ ID NO: 66024 - RNA, 33 nt, Artificial Sequence
  Cancer/testis antigen 47A (120-130)
cacuucgugcugcucgacaugguccauagccuu

SEQ ID NO: 66025 - RNA, 30 nt, Artificial Sequence
  Neuroblast differentiation-associated protein AHNAK (5535-5544)
cacggcgccgcucccgacaucagcgugaag

SEQ ID NO: 66026 - RNA, 24 nt, Artificial Sequence
  Centrosomal protein of 97 kDa (154-161)
cacggcaacaucauuaccagccug

SEQ ID NO: 66027 - RNA, 27 nt, Artificial Sequence
  Ubiquitin carboxyl-terminal hydrolase 19 (562-570)
caccaugccuuccagcccagcaagcug

SEQ ID NO: 66028 - RNA, 24 nt, Artificial Sequence
  E3 SUMO-protein ligase CBX4 (399-406)
caccaugccgugggccugaaccuc

SEQ ID NO: 66029 - RNA, 30 nt, Artificial Sequence
  Thyroid hormone receptor-associated protein 3 (641-650)
caccauuucggcagcuccgggaugacccug

SEQ ID NO: 66030 - RNA, 27 nt, Artificial Sequence
  Beta-galactoside alpha-2,6-sialyltransferase 2 (354-362)
caccauuucaucgacagcucccuguac

SEQ ID NO: 66031 - RNA, 27 nt, Artificial Sequence
  Protein virilizer homolog (679-687)
caccauuuccuggagcucgugacccuu

SEQ ID NO: 66032 - RNA, 24 nt, Artificial Sequence
  L-aminoadipate-semialdehyde dehydrogenase-phosphopantetheinyl transferase (238-245)
caccauuucguggccgucgcucug

SEQ ID NO: 66033 - RNA, 27 nt, Artificial Sequence
  PCNA-interacting partner (385-393)
caccauggcaccagcauccugacacuc

SEQ ID NO: 66034 - RNA, 27 nt, Artificial Sequence
  E3 SUMO-protein ligase CBX4 (398-406)
caccaucacgccgugggccugaaccuc

SEQ ID NO: 66035 - RNA, 27 nt, Artificial Sequence
  Transcriptional repressor protein YY1 (76-84)
caccaucaccaucaccccccuaugauc

SEQ ID NO: 66036 - RNA, 30 nt, Artificial Sequence
  Histone deacetylase complex subunit SAP130 (202-211)
caccauaucaugaccacaaacgugcagaug

SEQ ID NO: 66037 - RNA, 30 nt, Artificial Sequence
  Vacuolar protein sorting-associated protein 11 homolog (554-563)
caccauauccccgagcagaccacacaacug

SEQ ID NO: 66038 - RNA, 24 nt, Artificial Sequence
  Drebrin-like protein (362-369)
caccauauccagggccaagggcug

SEQ ID NO: 66039 - RNA, 27 nt, Artificial Sequence
  Protein PRRC2B (1834-1842)
caccauauccagagagccauuggccug

SEQ ID NO: 66040 - RNA, 27 nt, Artificial Sequence
  Fructose-bisphosphate aldolase A (220-228)
caccauaucuaccuggagggcacccuc

SEQ ID NO: 66041 - RNA, 27 nt, Artificial Sequence
  Queuine tRNA-ribosyltransferase subunit QTRTD1 (365-373)
caccaucugcucgugaccaacgagcuu

SEQ ID NO: 66042 - RNA, 27 nt, Artificial Sequence
  MMS19 nucleotide excision repair protein homolog (102-110)
caccaucuggugauccccagcguccuc

SEQ ID NO: 66043 - RNA, 27 nt, Artificial Sequence
  Transcription factor ETV6 (170-178)
caccauaaccccccuaccaucgagcug

SEQ ID NO: 66044 - RNA, 27 nt, Artificial Sequence
  Eukaryotic translation initiation factor 2-alpha kinase 1 (119-127)
caccauaacagagccaucacccaccug

SEQ ID NO: 66045 - RNA, 27 nt, Artificial Sequence
  Fas apoptotic inhibitory molecule 3 (176-184)
caccauagcucccccaccacacagauc

SEQ ID NO: 66046 - RNA, 27 nt, Artificial Sequence
  Gamma-glutamyltranspeptidase 1 (532-540)
caccauacccagaucgccagcacauuc

SEQ ID NO: 66047 - RNA, 27 nt, Artificial Sequence
  Zinc transporter 6 (356-364)
caccaugugauccccaugccucugcuc

SEQ ID NO: 66048 - RNA, 33 nt, Artificial Sequence
  GLTSCR1-like protein (415-425)
caccaugugcagaccaucaacggccaacugcuc

SEQ ID NO: 66049 - RNA, 27 nt, Artificial Sequence
  Nucleolar RNA helicase 2 (218-226)
caccauguguacagcggcaaggaccug

SEQ ID NO: 66050 - RNA, 27 nt, Artificial Sequence
  GMP synthase (glutamine-hydrolyzing) (22-30)
caccauuacgagggcgccguggucauc

SEQ ID NO: 66051 - RNA, 30 nt, Artificial Sequence
  GMP synthase (glutamine-hydrolyzing) (22-31)
caccauuacgagggcgccguggucauccug

SEQ ID NO: 66052 - RNA, 27 nt, Artificial Sequence
  Membralin (447-455)
caccauuacgagcugcccgccauccuc

SEQ ID NO: 66053 - RNA, 30 nt, Artificial Sequence
  G/T mismatch-specific thymine DNAosylase (150-159)
caccauuaccccggcccugggaaccacuuc

SEQ ID NO: 66054 - RNA, 27 nt, Artificial Sequence
  Suppression of tumorigenicity 18 protein (571-579)
cacaucgccgcugcagccgcgauucug

SEQ ID NO: 66055 - RNA, 27 nt, Artificial Sequence
  Cytochrome b-c1 complex subunit 9 (55-63)
cacaucaagcauaaauacgagaacaag

SEQ ID NO: 66056 - RNA, 27 nt, Artificial Sequence
  Phosphofurin acidic cluster sorting protein 1 (734-742)
cacaaguuccccgacgaggauagcuac

SEQ ID NO: 66057 - RNA, 27 nt, Artificial Sequence
  Heterogeneous nuclear ribonucleoproteins C1/C2 (49-57)
cacaagggcuucgccuuugugcaguac

SEQ ID NO: 66058 - RNA, 27 nt, Artificial Sequence
  60S ribosomal protein L31 (30-38)
cacaagagaauccauggcgugggguuc

SEQ ID NO: 66059 - RNA, 27 nt, Artificial Sequence
  Mitotic checkpoint serine/threonine-protein kinase BUB1 (430-438)
cacaagguggccaacaccagcuccuuc

SEQ ID NO: 66060 - RNA, 30 nt, Artificial Sequence; identical to SEQ ID NO: 41833
  JmjC domain-containing protein 8 (176-185)

SEQ ID NO: 66061 - RNA, 30 nt, Artificial Sequence; identical to SEQ ID NO: 41834
  40S ribosomal protein S7 (168-177)

SEQ ID NO: 66062 - RNA, 30 nt, Artificial Sequence
  Histone-lysine N-methyltransferase SETD2 (1284-1293)
cacaaguaccagcaaaacgccgagcaguau

SEQ ID NO: 66063 - RNA, 33 nt, Artificial Sequence
  Protein S100-A4 (17-27)
cacaaguacagcggcaaagagggggacaaguuc

SEQ ID NO: 66064 - RNA, 27 nt, Artificial Sequence
  Calpain-12 (697-705)
caccuggacggcggggagggagugauc

SEQ ID NO: 66065 - RNA, 36 nt, Artificial Sequence
  Tyrosine-protein kinase BAZ1B (365-376)
caccuggaggaaaugaugaagaugaugagccccaac

SEQ ID NO: 66066 - RNA, 33 nt, Artificial Sequence
  Catalase (466-476)
caccugaaggacgcccagaucuucauucaaaaa

SEQ ID NO: 66067 - RNA, 27 nt, Artificial Sequence
  Neuropeptide FF receptor 1 (270-278)
cacaugcuggugauggucgcccucuuc

SEQ ID NO: 66068 - RNA, 30 nt, Artificial Sequence
  AP-1 complex subunit gamma-like 2 (576-585)
cacaugagagccgcuauccuggagaagaug

SEQ ID NO: 66069 - RNA, 27 nt, Artificial Sequence
  Uncharacterized protein C2orf16 (1260-1268)
cacaaccugcccgagagcgacuccgaa

SEQ ID NO: 66070 - RNA, 27 nt, Artificial Sequence
  E3 ubiquitin-protein ligase CBL (213-221)
caccccaucagcuccggccuggaggcc

SEQ ID NO: 66071 - RNA, 27 nt, Artificial Sequence
  Ubiquitin-conjugating enzyme E2 variant 3 (119-127)
caccccaagagcgugaucgucggccug

SEQ ID NO: 66072 - RNA, 30 nt, Artificial Sequence
  Microtubule-associated protein 4 (1128-1137)
caccccacccugagcggcgggggagaccag

SEQ ID NO: 66073 - RNA, 27 nt, Artificial Sequence
  Ataxin-2-like protein (896-904)
caccaggccggccaagcuccccaucug

SEQ ID NO: 66074 - RNA, 27 nt, Artificial Sequence
  Programmed cell death protein 10 (162-170)
caccagaagaaagaguucgugaaguac

SEQ ID NO: 66075 - RNA, 30 nt, Artificial Sequence
  Transcription activator BRG1 (178-187)
caccagcugagagcccaaaucauggcuuac

SEQ ID NO: 66076 - RNA, 27 nt, Artificial Sequence
  RNA polymerase-associated protein CTR9 homolog (714-722)
caccagaacaccgaggugguccuguac

SEQ ID NO: 66077 - RNA, 30 nt, Artificial Sequence
  Ubiquitin-conjugating enzyme E2 J1 (238-247)
caccagcccacccaaccuguggccaagaac

SEQ ID NO: 66078 - RNA, 33 nt, Artificial Sequence
  40S ribosomal protein S29 (3-13)
caccagcaacuguacuggagccaucccagaaag

SEQ ID NO: 66079 - RNA, 36 nt, Artificial Sequence
  MORC family CW-type zinc finger protein 3 (528-539)
caccaggugcccccucaaagcgagccagaauccaac

SEQ ID NO: 66080 - RNA, 27 nt, Artificial Sequence
  TBC1 domain family member 2B (111-119)
cacagcgccggcgcugugaccguccug

SEQ ID NO: 66081 - RNA, 27 nt, Artificial Sequence
  Serine palmitoyltransferase 2 (403-411)
cacagcgccguguacgcuaccucccug

SEQ ID NO: 66082 - RNA, 27 nt, Artificial Sequence
  Protein virilizer homolog (1566-1574)
cacagcgagcuggaaagauccuuccuc

SEQ ID NO: 66083 - RNA, 24 nt, Artificial Sequence
  Hematopoietic SH2 domain-containing protein (62-69)
cacagccaugugggcuacacccug

SEQ ID NO: 66084 - RNA, 27 nt, Artificial Sequence
  Thrombospondin type-1 domain-containing protein 7B (289-297)
cacagcaaguccugggccaucgagauu

SEQ ID NO: 66085 - RNA, 27 nt, Artificial Sequence
  Paired box protein Pax-9 (196-204)
cacagcgugaccgacauccugggcauu

SEQ ID NO: 66086 - RNA, 27 nt, Artificial Sequence
  Proteasome subunit beta type-4 (134-142)
cacagcuggcugaccagagccauguac

SEQ ID NO: 66087 - RNA, 27 nt, Artificial Sequence
  E3 SUMO-protein ligase RanBP2 (3152-3160)
cacaccggccccgggcugcucagcaug

SEQ ID NO: 66088 - RNA, 27 nt, Artificial Sequence
  Cytochrome b-245 heavy chain (115-123)
cacaccaucgcccaucuguucaacgug

SEQ ID NO: 66089 - RNA, 30 nt, Artificial Sequence
  Heterogeneous nuclear ribonucleoproteins A2/B1 (163-172)
cacaccaucaacggccauaaugccgaggug

SEQ ID NO: 66090 - RNA, 30 nt, Artificial Sequence
  Heterogeneous nuclear ribonucleoprotein A3 (189-198)
cacaccaucaacggccauaauugcgaggug

SEQ ID NO: 66091 - RNA, 27 nt, Artificial Sequence
  Mucin-3A (1830-1838)
cacacccugacacccagcacugcccuc

SEQ ID NO: 66092 - RNA, 27 nt, Artificial Sequence
  Eukaryotic translation initiation factor 4 gamma 1 (354-362)
cacaccguggagauccaugaacccaac

SEQ ID NO: 66093 - RNA, 27 nt, Artificial Sequence
  Nucleoporin NUP188 homolog (1451-1459)
cacaccgugggcuucauccugcagcuc

SEQ ID NO: 66094 - RNA, 27 nt, Artificial Sequence
  5-phosphohydroxy-L-lysine phospho-lyase (166-174)
cacguggccccccugccugacaccuac

SEQ ID NO: 66095 - RNA, 30 nt, Artificial Sequence
  Extracellular matrix protein FRAS1 (3372-3381)
cacgugugcagcaaccuggucaccacauac

SEQ ID NO: 66096 - RNA, 30 nt, Artificial Sequence
  Cystatin-B (58-67)
cacgugggcgacgaggauuucguccaucug

SEQ ID NO: 66097 - RNA, 36 nt, Artificial Sequence
  Microtubule-associated protein 4 (1016-1027)
cacgugcccggcgggggaaacguccagauccaaaau

SEQ ID NO: 66098 - RNA, 27 nt, Artificial Sequence
  Transmembrane protein 201 (96-104)
cacguggucagcuccgcccccucucug

SEQ ID NO: 66099 - RNA, 33 nt, Artificial Sequence
  Cholinesterase (154-164)
cacguguacgacggcaaguuccuggccagaguc

SEQ ID NO: 66100 - RNA, 27 nt, Artificial Sequence
  60S ribosomal protein L26 (61-69)
cacuacaagggccagcaaaucgggaaa

SEQ ID NO: 66101 - RNA, 27 nt, Artificial Sequence
  HEAT repeat-containing protein 1 (578-586)
aucgccgcugacauucugauaaaggag

SEQ ID NO: 66102 - RNA, 30 nt, Artificial Sequence
  Protein PRRC2C (2676-2685)
aucgccggcagaagcaccacacccacuucc

SEQ ID NO: 66103 - RNA, 27 nt, Artificial Sequence
  Endoplasmic reticulum lectin 1 (311-319)
aucgccauuggcagccagcccgugcug

SEQ ID NO: 66104 - RNA, 27 nt, Artificial Sequence
  Monoacylglycerol lipase ABHD12 (84-92)
aucgccauucccuuccugauaaagcuc

SEQ ID NO: 66105 - RNA, 27 nt, Artificial Sequence
  Endoplasmin (166-174)
aucgccaagagcggcaccuccgaguuc

SEQ ID NO: 66106 - RNA, 27 nt, Artificial Sequence
  Msx2-interacting protein (613-621)
aucgcccccaagauuaccagcgugaua

SEQ ID NO: 66107 - RNA, 27 nt, Artificial Sequence
  Mitotic checkpoint serine/threonine-protein kinase BUB1 (382-390)
aucgcccccccugugccacugaaggcu

SEQ ID NO: 66108 - RNA, 27 nt, Artificial Sequence
  Large proline-rich protein BAG6 (504-512)
aucgccagacccaccccuccacaggcu

SEQ ID NO: 66109 - RNA, 27 nt, Artificial Sequence
  Low-density lipoprotein receptor-related protein 1B (2001-2009)
aucgccgugcaccccgagaagggccug

SEQ ID NO: 66110 - RNA, 30 nt, Artificial Sequence
  Signal transducing adapter molecule 2 (292-301)
aucgacgaggauaagauggacagagcccug

SEQ ID NO: 66111 - RNA, 27 nt, Artificial Sequence
  Omega-amidase NIT2 (246-254)
aucgaccugaagaaacucgccgagauu

SEQ ID NO: 66112 - RNA, 27 nt, Artificial Sequence
  DENN domain-containing protein 1A (78-86)
aucgacagcaagcagagauucggcuuu

SEQ ID NO: 66113 - RNA, 27 nt, Artificial Sequence
  Histone-lysine N-methyltransferase EHMT1 (1232-1240)
aucgaggccggcgaacagcugggguuc

SEQ ID NO: 66114 - RNA, 24 nt, Artificial Sequence
  Basic helix-loop-helix domain-containing protein KIAA2018 (1140-1147)
aucuucgaccaggagaaccuggaa

SEQ ID NO: 66115 - RNA, 27 nt, Artificial Sequence
  Neutral cholesterol ester hydrolase 1 (382-390)
aucuucaccagcuggcccacaaacuuu

SEQ ID NO: 66116 - RNA, 27 nt, Artificial Sequence
  Olfactory receptor 5H15 (106-114)
aucggcgugaccacagagugcuuccug

SEQ ID NO: 66117 - RNA, 27 nt, Artificial Sequence
  Heterogeneous nuclear ribonucleoprotein U (749-757)
aucggcuaccccuauccuagagcccca

SEQ ID NO: 66118 - RNA, 27 nt, Artificial Sequence
  BolA-like protein 2 (67-75)
auccacgccuucgagcagaagacccug

SEQ ID NO: 66119 - RNA, 27 nt, Artificial Sequence
  Histone H3.1 (113-121)
auccacgccaagagagugaccauuaug

SEQ ID NO: 66120 - RNA, 27 nt, Artificial Sequence
  Two pore calcium channel protein 1 (44-52)
auccacgacagccaggcccccucccug

SEQ ID NO: 66121 - RNA, 27 nt, Artificial Sequence
  Probable ATP-dependent RNA helicase DDX41 (201-209)
auccaccaucccaccccuauucagaua

SEQ ID NO: 66122 - RNA, 27 nt, Artificial Sequence
  T-complex protein 1 subunit eta (281-289)
auccaccauagcggcgccaaggugguc

SEQ ID NO: 66123 - RNA, 30 nt, Artificial Sequence
  T-complex protein 1 subunit eta (281-290)
auccaccauagcggcgccaaggugguccug

SEQ ID NO: 66124 - RNA, 27 nt, Artificial Sequence
  Leucine-rich repeat-containing protein 16A (481-489)
auccacaacauuaccagccuggacaua

SEQ ID NO: 66125 - RNA, 27 nt, Artificial Sequence
  UDP-N-acetylglucosamine-peptide N-acetylglucosaminyltransferase 110 kDa subunit (628-636)
auccaccaggacggcauucauauacug

SEQ ID NO: 66126 - RNA, 27 nt, Artificial Sequence
  Calcium/calmodulin-dependent protein kinase type 1 (286-294)
auccaccagagcguguccgagcaaauu

SEQ ID NO: 66127 - RNA, 30 nt, Artificial Sequence
  G-protein coupled receptor 98 (3507-3516)
auccacagcuucacccccgccuccggcauu

SEQ ID NO: 66128 - RNA, 27 nt, Artificial Sequence
  Wee1-like protein kinase (417-425)
auccacagcaugucccuggugcauaug

SEQ ID NO: 66129 - RNA, 27 nt, Artificial Sequence
  Toll-like receptor 9 (587-595)
auccacagccaggugucccaacagcug

SEQ ID NO: 66130 - RNA, 27 nt, Artificial Sequence
  Tumor suppressor candidate 2 (99-107)
auccacguggacuuccccgucauucug

SEQ ID NO: 66131 - RNA, 27 nt, Artificial Sequence
  DNA replication licensing factor MCM5 (694-702)
aucauuaaggacuucaccaaacagaag

SEQ ID NO: 66132 - RNA, 30 nt, Artificial Sequence
  Kelch-like protein 6 (114-123)
aucauuaagggcguggacgccgagaccaug

SEQ ID NO: 66133 - RNA, 30 nt, Artificial Sequence
  Transcription factor Sp2 (277-286)
aucauucaggccggcaacaaucugcucaua

SEQ ID NO: 66134 - RNA, 27 nt, Artificial Sequence
  Stress-associated endoplasmic reticulum protein 1 (58-66)
aucauucagagcauaagaaugggcaug

SEQ ID NO: 66135 - RNA, 27 nt, Artificial Sequence
  HEAT repeat-containing protein 5B (1006-1014)
aucauuaccacagugggccccgagcug

SEQ ID NO: 66136 - RNA, 27 nt, Artificial Sequence
  Annexin A7 (223-231)
aucaaggccgcuuucaaaaccagcuac

SEQ ID NO: 66137 - RNA, 30 nt, Artificial Sequence
  Tetraspanin-8 (198-207)
aucaaggacuuccuggccaaaaaccucauu

SEQ ID NO: 66138 - RNA, 27 nt, Artificial Sequence
  Copine-3 (135-143)
aucaaggacaacagagugguccuguuc

SEQ ID NO: 66139 - RNA, 27 nt, Artificial Sequence
  AP-3 complex subunit mu-1 (102-110)
aucaaggacaacguggucauuguuuac

SEQ ID NO: 66140 - RNA, 27 nt, Artificial Sequence
  Geminin (90-98)
aucaaggagaaccccagcucccaguac

SEQ ID NO: 66141 - RNA, 27 nt, Artificial Sequence
  X-ray repair cross-complementing protein 5 (647-655)
aucaaguucagcgaggaacagagauuu

SEQ ID NO: 66142 - RNA, 27 nt, Artificial Sequence
  Serine/threonine-protein kinase TAO1 (83-91)
aucaagcaccccaacagcauugaguac

SEQ ID NO: 66143 - RNA, 27 nt, Artificial Sequence
  60S ribosomal protein L12 (98-106)
aucaagcacagcggcaacauuaccuuc

SEQ ID NO: 66144 - RNA, 27 nt, Artificial Sequence
  Alkyldihydroxyacetonephosphate synthase, peroxisomal (379-387)
aucaagauuagacccgugccugaguac

SEQ ID NO: 66145 - RNA, 27 nt, Artificial Sequence
  Probable ATP-dependent RNA helicase DDX52 (255-263)
aucaagauuagcgagggcaccggguuc

SEQ ID NO: 66146 - RNA, 27 nt, Artificial Sequence
  Nucleolar and spindle-associated protein 1 (108-116)
aucaagauuagcaaccccaccgaguuc

SEQ ID NO: 66147 - RNA, 27 nt, Artificial Sequence
  Serine/threonine-protein kinase 17A (79-87)
aucaagaaagacagcggcaaggaguuc

SEQ ID NO: 66148 - RNA, 27 nt, Artificial Sequence
  Dynein light chain 1, cytoplasmic (42-50)
aucaagaaagaguucgacaagaaauac

SEQ ID NO: 66149 - RNA, 27 nt, Artificial Sequence
  Endoplasmin (472-480)
aucaagaaaauugccgacgauaaguac

SEQ ID NO: 66150 - RNA, 30 nt, Artificial Sequence
  Elongation factor 2 (570-579)
aucaagaaaagcgaccccguggucuccuac

SEQ ID NO: 66151 - RNA, 27 nt, Artificial Sequence
  DNA ligase 1 (608-616)
aucaagcugcccagcgugaccuccuuc

SEQ ID NO: 66152 - RNA, 27 nt, Artificial Sequence
  Acetyl-coenzyme A transporter 1 (305-313)
aucaagaugcccgccgugcugaccuuc

SEQ ID NO: 66153 - RNA, 27 nt, Artificial Sequence
  Ribulose-phosphate 3-epimerase (119-127)
aucaagcccggcaccagcguggaguac

SEQ ID NO: 66154 - RNA, 24 nt, Artificial Sequence
  Serine/threonine-protein kinase tousled-like 1 (482-489)
aucaagcccccuauuauacacuac

SEQ ID NO: 66155 - RNA, 30 nt, Artificial Sequence
  Eukaryotic translation initiation factor 5B (366-375)
aucaagagacuggaggaacucgaggccaaa

SEQ ID NO: 66156 - RNA, 27 nt, Artificial Sequence
  F-box only protein 11 (714-722)
aucaagaccgacagcaaccccacacug

SEQ ID NO: 66157 - RNA, 30 nt, Artificial Sequence
  60S ribosomal protein L11 (117-126)
aucaaguacgaccccagcauuggcauauau

SEQ ID NO: 66158 - RNA, 27 nt, Artificial Sequence
  Ubiquitin carboxyl-terminal hydrolase 40 (723-731)
auccugauucaggacagccacgaugac

SEQ ID NO: 66159 - RNA, 27 nt, Artificial Sequence
  E3 ubiquitin-protein ligase UBR4 (654-662)
auccugaacuucauuaccagcuccaug

SEQ ID NO: 66160 - RNA, 27 nt, Artificial Sequence
  ATP-dependent RNA helicase DDX18 (529-537)
auccugagacccgaggaacucggcuuc

SEQ ID NO: 66161 - RNA, 33 nt, Artificial Sequence
  Trace amine-associated receptor 6 (212-222)
aucaugauuauacuguacggcaacaucuuccuc

SEQ ID NO: 66162 - RNA, 27 nt, Artificial Sequence
  DNA polymerase delta subunit 2 (258-266)
aucaacaaggccaaauaccugaccaag

SEQ ID NO: 66163 - RNA, 27 nt, Artificial Sequence
  40S ribosomal protein S18 (5-13)
auccccgagaaguuccagcacauucug

SEQ ID NO: 66164 - RNA, 27 nt, Artificial Sequence
  Nuclear factor of activated T-cells, cytoplasmic 2 (331-339)
auccccgagagcuccggcagaauugug

SEQ ID NO: 66165 - RNA, 24 nt, Artificial Sequence
  Nuclear factor erythroid 2-related factor 2 (443-450)
auccccuucccuguggagaagauu

SEQ ID NO: 66166 - RNA, 27 nt, Artificial Sequence
  Tetra-peptide repeat homeobox protein 1 (109-117)
auccccggcccucugccagggagcauu

SEQ ID NO: 66167 - RNA, 27 nt, Artificial Sequence
  DNA replication licensing factor MCM6 (79-87)
auccaggaggaauucuacagaguguau

SEQ ID NO: 66168 - RNA, 33 nt, Artificial Sequence
  Poly (ADP-ribose) polymerase 8 (10-20)
auccagaaggacauugauguggucauacaaaaa

SEQ ID NO: 66169 - RNA, 27 nt, Artificial Sequence
  DNA-directed RNA polymerase II subunit RPB4 (134-142)
auccagaccaagagaagcuuccaauac

SEQ ID NO: 66170 - RNA, 27 nt, Artificial Sequence
  Serine/threonine-protein phosphatase 4 regulatory subunit 2 (40-48)
auccaguggagccaauucaagggcuac

SEQ ID NO: 66171 - RNA, 27 nt, Artificial Sequence
  Maestro heat-like repeat-containing protein family member 1 (525-533)
auccaguacgacgcccacgcuagccug

SEQ ID NO: 66172 - RNA, 27 nt, Artificial Sequence
  Protein capicua homolog (862-870)
aucagauucacccugcccccuggcaca

SEQ ID NO: 66173 - RNA, 30 nt, Artificial Sequence
  Inactive serine/threonine-protein kinase VRK3 (422-431)
aucagacccagcgagacccugcagaaguac

SEQ ID NO: 66174 - RNA, 27 nt, Artificial Sequence
  Sphingomyelin phosphodiesterase 3 (179-187)
aucagcgccgcuuccuucucuucacug

SEQ ID NO: 66175 - RNA, 27 nt, Artificial Sequence
  Sodium channel protein type 5 subunit alpha (1758-1766)
aucagcuuccugauuguggucaacaug

SEQ ID NO: 66176 - RNA, 27 nt, Artificial Sequence
  Calsyntenin-1 (783-791)
aucagcaacgaguucaagguggaaguc

SEQ ID NO: 66177 - RNA, 30 nt, Artificial Sequence; identical to SEQ ID NO: 41950
  Calcineurin subunit B type 2 (107-116)

SEQ ID NO: 66178 - RNA, 27 nt, Artificial Sequence
  AT-rich interactive domain-containing protein 2 (1322-1330)
aucagcaacggccccucccuggagcuc

SEQ ID NO: 66179 - RNA, 27 nt, Artificial Sequence
  THUMP domain-containing protein 3 (77-85)
aucagcguggagucccuggcccagguc

SEQ ID NO: 66180 - RNA, 27 nt, Artificial Sequence
  Methylcrotonoyl-CoA carboxylase subunit alpha, mitochondrial (547-555)
aucagcuacaccagaaacaugacacug

SEQ ID NO: 66181 - RNA, 27 nt, Artificial Sequence
  Kelch repeat and BTB domain-containing protein 12 (77-85)
aucaccgccgagagcguguccguccug

SEQ ID NO: 66182 - RNA, 27 nt, Artificial Sequence
  Titin (15022-15030)
aucaccaagaacacagccgaccugaaa

SEQ ID NO: 66183 - RNA, 33 nt, Artificial Sequence
  Elongation factor 1-alpha 1 (170-180)
aucgugaaggaggucagcaccuacauuaaaaag

SEQ ID NO: 66184 - RNA, 27 nt, Artificial Sequence
  Nucleolar protein 58 (41-49)
aucgugaagcugaaacacuucgagaag

SEQ ID NO: 66185 - RNA, 27 nt, Artificial Sequence
  NADH dehydrogenase (ubiquinone) 1 beta subcomplex subunit 1 (7-15)
aucgugagagaccacuggguccauguu

SEQ ID NO: 66186 - RNA, 27 nt, Artificial Sequence
  Serine/threonine-protein kinase RIO1 (209-217)
aucuacaagaccagcauucugguguuc

SEQ ID NO: 66187 - RNA, 27 nt, Artificial Sequence
  60S ribosomal protein L4 (269-277)
aaggccgcuagccugaaauccaacuac

SEQ ID NO: 66188 - RNA, 27 nt, Artificial Sequence
  Pre-mRNA-splicing factor SYF2 (221-229)
aaggccgagagauucuacggcaaauau

SEQ ID NO: 66189 - RNA, 27 nt, Artificial Sequence
  Zinc finger protein 215 (386-394)
aaggccuucugcagaagcuccucucug

SEQ ID NO: 66190 - RNA, 27 nt, Artificial Sequence
  Integrin alpha-4 (236-244)
aaggccuuccuggacaaacagaaccaa

SEQ ID NO: 66191 - RNA, 27 nt, Artificial Sequence
  Spermatid perinuclear RNA-binding protein (384-392)
aaggccaucgaccugaugaacgcucuc

SEQ ID NO: 66192 - RNA, 27 nt, Artificial Sequence
  Collagen alpha-6(VI) chain (501-509)
aaggccaucgagaacauuagacagaug

SEQ ID NO: 66193 - RNA, 27 nt, Artificial Sequence
  T-complex protein 1 subunit gamma (163-171)
aaggccaucagcagaugguccucucug

SEQ ID NO: 66194 - RNA, 27 nt, Artificial Sequence
  60S ribosomal protein L7 (53-61)
aaggccaaacacuaccauaaggaguau

SEQ ID NO: 66195 - RNA, 27 nt, Artificial Sequence
  N(G),N(G)-dimethylarginine dimethylaminohydrolase 1 (196-204)
aaggcccugaaaaucaugcagcaaaug

SEQ ID NO: 66196 - RNA, 27 nt, Artificial Sequence
  Zinc finger protein 491 (250-258)
aaggcccugagcagacucaucuccuuc

SEQ ID NO: 66197 - RNA, 27 nt, Artificial Sequence
  Inositol 1,4,5-trisphosphate receptor type 3 (2312-2320)
aaggccauggugauggacauggaguuc

SEQ ID NO: 66198 - RNA, 30 nt, Artificial Sequence
  Mid1-interacting protein 1 (164-173)
aaggccaacauccugaccaauagauacaaa

SEQ ID NO: 66199 - RNA, 27 nt, Artificial Sequence
  Phosphoenolpyruvate carboxykinase, cytosolic (GTP) (547-555)
aaggccagcaccaaacugacacccauc

SEQ ID NO: 66200 - RNA, 27 nt, Artificial Sequence
  Zinc finger protein 726 (174-182)
aagugcaaaaacugugugaagagcuuc

SEQ ID NO: 66201 - RNA, 27 nt, Artificial Sequence
  PDZ domain-containing protein 8 (559-567)
aaggacggcaacaaacccccuccacug

SEQ ID NO: 66202 - RNA, 27 nt, Artificial Sequence
  Zinc finger protein 470 (79-87)
aaggaccccugggugaucaaaggcggg

SEQ ID NO: 66203 - RNA, 27 nt, Artificial Sequence
  HIV Tat-specific factor 1 (234-242)
aaggacuacaaaaagaaacugagcaug

SEQ ID NO: 66204 - RNA, 27 nt, Artificial Sequence
  Glucose-6-phosphate translocase (212-220)
aaggaggaaagcacccugcaggagcuc

SEQ ID NO: 66205 - RNA, 27 nt, Artificial Sequence
  Protein bassoon (2970-2978)
aaggagaucgacgccaaacugaaguac

SEQ ID NO: 66206 - RNA, 27 nt, Artificial Sequence
  Nuclear fragile X mental retardation-interacting protein 2 (667-675)
aaggagauggaaagcaucuggaaccug

SEQ ID NO: 66207 - RNA, 27 nt, Artificial Sequence
  Desmoplakin (423-431)
aaggagagagaaaaaauccuggaguac

SEQ ID NO: 66208 - RNA, 27 nt, Artificial Sequence
  Protein FAM91A1 (752-760)
aaggagagccugcagaaccuccuucac

SEQ ID NO: 66209 - RNA, 27 nt, Artificial Sequence
  Complement C4-A (189-197)
aaggagguguacaugcccagcuccauc

SEQ ID NO: 66210 - RNA, 30 nt, Artificial Sequence
  Heterogeneous nuclear ribonucleoprotein U (565-574)
aaguucaucgagauugccgcuagaaaaaag

SEQ ID NO: 66211 - RNA, 27 nt, Artificial Sequence
  Ciliogenesis-associated TTC17-interacting protein (302-310)
aaguuccuggacagaaaagaggaacuc

SEQ ID NO: 66212 - RNA, 30 nt, Artificial Sequence
  Heparan-sulfate 6-O-sulfotransferase 2 (519-528)
aaguuccugaaaggcagacuccuucagacc

SEQ ID NO: 66213 - RNA, 30 nt, Artificial Sequence
  78 kDa glucose-regulated protein (113-122)
aaguuccugcccuuuaaaguggucgagaag

SEQ ID NO: 66214 - RNA, 27 nt, Artificial Sequence
  Protein SON (16-24)
aaguucagagagauccagcaagaacug

SEQ ID NO: 66215 - RNA, 30 nt, Artificial Sequence
  Mothers against decapentaplegic homolog 9 (159-168)
aaguucagaagcgccucccugcacucugag

SEQ ID NO: 66216 - RNA, 33 nt, Artificial Sequence; identical to SEQ ID NO: 41989
  Stabilin-2 (1755-1765)

SEQ ID NO: 66217 - RNA, 27 nt, Artificial Sequence
  Desmoglein-2 (639-647)
aagggcgccaaaggguucacccccauc

SEQ ID NO: 66218 - RNA, 27 nt, Artificial Sequence
  Tumor necrosis factor ligand superfamily member 11 (257-265)
aagggcgggagcaccaaauacuggucc

SEQ ID NO: 66219 - RNA, 33 nt, Artificial Sequence
  Arginase-1 (153-163)
aagggcaaaauccccgacgugccuggguucagc

SEQ ID NO: 66220 - RNA, 30 nt, Artificial Sequence
  Casein kinase I isoform delta (242-251)
aagggcuaccccagcgaguucgccaccuau

SEQ ID NO: 66221 - RNA, 33 nt, Artificial Sequence
  40S ribosomal protein S17 (49-59)
aagaucgccggcuacgugacccaccugaugaaa

SEQ ID NO: 66222 - RNA, 27 nt, Artificial Sequence
  Repetin (489-497)
aagaucgacagacaggaucaaagcuac

SEQ ID NO: 66223 - RNA, 27 nt, Artificial Sequence
  T-complex protein 1 subunit eta (135-143)
aagaucaaagagauugccgugaccguc

SEQ ID NO: 66224 - RNA, 27 nt, Artificial Sequence
  V-type proton ATPase catalytic subunit A (596-604)
aagaucaaaagcgacuacgcccagcug

SEQ ID NO: 66225 - RNA, 27 nt, Artificial Sequence
  Potassium-transporting ATPase alpha chain 1 (737-745)
aagaaagccgacaucggcguggcuaug

SEQ ID NO: 66226 - RNA, 27 nt, Artificial Sequence
  Histone H1.4 (63-71)
aagaaagcccuggcugcagccggcuac

SEQ ID NO: 66227 - RNA, 27 nt, Artificial Sequence
  Ezrin (262-270)
aagaaagcccccgacuucguguuuuac

SEQ ID NO: 66228 - RNA, 27 nt, Artificial Sequence
  C1GALT1-specific chaperone 1 (160-168)
aagaaagaccccagccagccuuucuac

SEQ ID NO: 66229 - RNA, 27 nt, Artificial Sequence
  Cofilin-1 (95-103)
aagaaagaggaccugguguucaucuuu

SEQ ID NO: 66230 - RNA, 30 nt, Artificial Sequence
  116 kDa U5 small nuclear ribonucleoprotein component (421-430)
aagaaauucuuuggcgaguucaccggguuu

SEQ ID NO: 66231 - RNA, 27 nt, Artificial Sequence
  Squalene monooxygenase (15-23)
aagaaauucggcgacuuuaucacccug

SEQ ID NO: 66232 - RNA, 27 nt, Artificial Sequence
  UPF0729 protein C18orf32 (17-25)
aagaaauuccuggagcccuacaucuau

SEQ ID NO: 66233 - RNA, 27 nt, Artificial Sequence
  Cholesterol 24-hydroxylase (94-102)
aagaaauuccugaugagcaccaaguac

SEQ ID NO: 66234 - RNA, 33 nt, Artificial Sequence
  Spermidine synthase (134-144)
aagaaauuccugcccggcauggccaucggguac

SEQ ID NO: 66235 - RNA, 30 nt, Artificial Sequence
  Probable global transcription activator SNF2L2 (1110-1119)
aagaaauucaacgagcccggcagccaguac

SEQ ID NO: 66236 - RNA, 30 nt, Artificial Sequence
  TRAF-interacting protein with FHA domain-containing protein A (76-85)
aagaaauucaacagcuccgugcugucuuuu

SEQ ID NO: 66237 - RNA, 36 nt, Artificial Sequence
  Nicotinamide phosphoribosyltransferase (330-341)
aagaaauuccccgugaccgagaacagcaagggcuac

SEQ ID NO: 66238 - RNA, 33 nt, Artificial Sequence
  Cell cycle progression protein 1 (523-533)
aagaaauucagcgacuccgugaagucuaccuuu

SEQ ID NO: 66239 - RNA, 30 nt, Artificial Sequence
  40S ribosomal protein S7 (85-94)
aagaaauucagcggcaagcacguggucuuu

SEQ ID NO: 66240 - RNA, 33 nt, Artificial Sequence
  Lupus La protein (165-175)
aagaaauucguggagacccccggccagaaguac

SEQ ID NO: 66241 - RNA, 27 nt, Artificial Sequence
  Zinc finger protein 451 (219-227)
aagaaauucgugacccagcaacaguac

SEQ ID NO: 66242 - RNA, 27 nt, Artificial Sequence
  Melanoma inhibitory activity protein 3 (67-75)
aagaaaggcgaccccguguacgucuau

SEQ ID NO: 66243 - RNA, 27 nt, Artificial Sequence
  Protein FAM173B (108-116)
aagaaaggcuucaccgccgugggguac

SEQ ID NO: 66244 - RNA, 27 nt, Artificial Sequence
  SEC14-like protein 1 (157-165)
aagaaaggcaaggagaucauugaauac

SEQ ID NO: 66245 - RNA, 27 nt, Artificial Sequence
  Na(+)/H(+) exchange regulatory cofactor NHE-RF1 (158-166)
aagaaaggccccagcggguacggauuc

SEQ ID NO: 66246 - RNA, 27 nt, Artificial Sequence
  Serine/threonine-protein kinase RIO3 (353-361)
aagaaacacauccuggugaugagcuuc

SEQ ID NO: 66247 - RNA, 27 nt, Artificial Sequence
  Heat shock protein HSP 90-beta (203-211)
aagaaacacagccaguucaucggcuac

SEQ ID NO: 66248 - RNA, 27 nt, Artificial Sequence
  Dynactin subunit 3 (59-67)
aagaaaaucgaggaccugauuaaguac

SEQ ID NO: 66249 - RNA, 27 nt, Artificial Sequence
  60S ribosomal protein L23a (88-96)
aagaaaaucgaggacaacaauacccug

SEQ ID NO: 66250 - RNA, 30 nt, Artificial Sequence
  Nardilysin (992-1001)
aagaaaaucgaggaauuccugagcuccuuu

SEQ ID NO: 66251 - RNA, 27 nt, Artificial Sequence
  Leydig cell tumor 10 kDa protein homolog (59-67)
aagaaaaucgagcacgacguggucaug

SEQ ID NO: 66252 - RNA, 27 nt, Artificial Sequence
  Brain-specific angiogenesis inhibitor 1-associated protein 2-like protein 1 (106-114)
aagaaaaucgagcuggacgugaaguac

SEQ ID NO: 66253 - RNA, 30 nt, Artificial Sequence
  General transcription factor 3C polypeptide 4 (563-572)
aagaaaaucgagagcuccggcgugaccuac

SEQ ID NO: 66254 - RNA, 30 nt, Artificial Sequence
  T-complex protein 1 subunit gamma (353-362)
aagaaaaucggcgacgaguacuucaccuuu

SEQ ID NO: 66255 - RNA, 27 nt, Artificial Sequence
  Gamma-interferon-inducible protein 16 (256-264)
aagaaaaucauuauaaucagcgacuac

SEQ ID NO: 66256 - RNA, 27 nt, Artificial Sequence
  Synaptojanin-2 (121-129)
aagaaaauccugagcuccggcguguuc

SEQ ID NO: 66257 - RNA, 27 nt, Artificial Sequence
  Golgin-45 (320-328)
aagaaaauccccagcaccguggaguuc

SEQ ID NO: 66258 - RNA, 27 nt, Artificial Sequence
  RNA exonuclease 4 (342-350)
aagaaaaucagagacacccagaaguac

SEQ ID NO: 66259 - RNA, 27 nt, Artificial Sequence
  60S ribosomal protein L23a (38-46)
aagaaaaucagaaccagccccacauuc

SEQ ID NO: 66260 - RNA, 27 nt, Artificial Sequence
  Stress-induced-phosphoprotein 1 (237-245)
aagaaaaaggacuucgauaccgcccug

SEQ ID NO: 66261 - RNA, 30 nt, Artificial Sequence
  Protein DEK (143-152)
aagaaaaaggaggaaaugcugaaaaaguuc

SEQ ID NO: 66262 - RNA, 27 nt, Artificial Sequence
  Protein KIAA2022 (1378-1386)
aagaaaaagaucaacagcggcucccag

SEQ ID NO: 66263 - RNA, 27 nt, Artificial Sequence
  Regulatory factor X-associated protein (175-183)
aagaaaaagaaaagcgaccaggcccug

SEQ ID NO: 66264 - RNA, 27 nt, Artificial Sequence
  UBX domain-containing protein 4 (377-385)
aagaaaaagcugcucgaccuugagcug

SEQ ID NO: 66265 - RNA, 30 nt, Artificial Sequence
  Prefoldin subunit 3 (51-60)
aagaaacuggacgagcaguaccaaaaguau

SEQ ID NO: 66266 - RNA, 30 nt, Artificial Sequence
  Non-specific lipid-transfer protein (442-451)
aagaaacuggaggaagagggcgaacaguuc

SEQ ID NO: 66267 - RNA, 30 nt, Artificial Sequence
  Alpha-taxilin (423-432)
aagaaacuggagaaggaaaccacaauguac

SEQ ID NO: 66268 - RNA, 27 nt, Artificial Sequence
  Mitogen-activated protein kinase kinase kinase 1 (792-800)
aagaaacugcucagccuucugaccuuc

SEQ ID NO: 66269 - RNA, 30 nt, Artificial Sequence
  Cold shock domain-containing protein E1 (411-420)
aagaaacugcccaagggcaccgugagcuuc

SEQ ID NO: 66270 - RNA, 27 nt, Artificial Sequence
  Hexokinase-2 (146-154)
aagaaacugccccucggcuucaccuuu

SEQ ID NO: 66271 - RNA, 27 nt, Artificial Sequence
  14-3-3 protein theta (74-82)
aagaaacugcagcucaucaaggacuac

SEQ ID NO: 66272 - RNA, 27 nt, Artificial Sequence
  Nibrin (236-244)
aagaaacugagcuccgccguggucuuc

SEQ ID NO: 66273 - RNA, 30 nt, Artificial Sequence
  Clustered mitochondria protein homolog (294-303)
aagaaaaacuucgccgugcugcagaagaaa

SEQ ID NO: 66274 - RNA, 27 nt, Artificial Sequence
  General transcription factor II-I (644-652)
aagaaacccgagcuggugaucagcuac

SEQ ID NO: 66275 - RNA, 30 nt, Artificial Sequence
  SUMO-activating enzyme subunit 1 (117-126)
aagaaacccgagagcuucuuuacccaguuc

SEQ ID NO: 66276 - RNA, 27 nt, Artificial Sequence
  Poly(ADP-ribose)ohydrolase (689-697)
aagaaacccaccggccuggugacauuc

SEQ ID NO: 66277 - RNA, 27 nt, Artificial Sequence
  DnaJ homolog subfamily C member 3 (406-414)
aagaaacaggagaucauuaaggccuac

SEQ ID NO: 66278 - RNA, 30 nt, Artificial Sequence
  Ankyrin repeat domain-containing protein 17 (1650-1659)
aagaaacagcccagcgugcuggucaccuuc

SEQ ID NO: 66279 - RNA, 27 nt, Artificial Sequence
  Transmembrane emp24 domain-containing protein 3 (82-90)
aagaaacaguacgacagcuucaccuau

SEQ ID NO: 66280 - RNA, 30 nt, Artificial Sequence
  Heterogeneous nuclear ribonucleoproteins A2/B1 (151-160)
aagaaaagaggcuucggguuugugaccuuc

SEQ ID NO: 66281 - RNA, 27 nt, Artificial Sequence
  Heterogeneous nuclear ribonucleoproteins C1/C2 (29-37)
aagaaaagcgacguggaggccaucuuc

SEQ ID NO: 66282 - RNA, 27 nt, Artificial Sequence
  RNA-binding protein Raly (34-42)
aagaaaagcgacguggagaccaucuuc

SEQ ID NO: 66283 - RNA, 27 nt, Artificial Sequence
  Endoplasmin (404-412)
aagaaaagcgacuacaucaagcuguau

SEQ ID NO: 66284 - RNA, 27 nt, Artificial Sequence
  Exocyst complex component 2 (196-204)
aagaaaagcgagggcucccuggccuac

SEQ ID NO: 66285 - RNA, 24 nt, Artificial Sequence
  ATPase family AAA domain-containing protein 5 (1559-1566)
aagaaaagccagaagaaaaagcaa

SEQ ID NO: 66286 - RNA, 27 nt, Artificial Sequence
  60S ribosomal protein L18a (55-63)
aagaaaagcuccggcgagaucguguac

SEQ ID NO: 66287 - RNA, 27 nt, Artificial Sequence
  Copper transport protein ATOX1 (56-64)
aagaaaaccggcaagacagugagcuac

SEQ ID NO: 66288 - RNA, 27 nt, Artificial Sequence
  Melanoma-associated antigen 1 (104-112)
aagaaaguggccgaccuggucggcuuc

SEQ ID NO: 66289 - RNA, 27 nt, Artificial Sequence
  ATP-dependent RNA helicase DDX18 (647-655)
aagaaaguggagaagagcaaaaucuuc

SEQ ID NO: 66290 - RNA, 27 nt, Artificial Sequence
  Polyadenylate-binding protein 1 (268-276)
aagaaaguggagagacagaccgaacug

SEQ ID NO: 66291 - RNA, 30 nt, Artificial Sequence
  Asparagine synthetase (glutamine-hydrolyzing) (131-140)
aagaaaguguuccugggcagagacaccuac

SEQ ID NO: 66292 - RNA, 27 nt, Artificial Sequence
  60S ribosomal protein L37a (6-14)
aagaaagugggcaucgucgggaaguac

SEQ ID NO: 66293 - RNA, 27 nt, Artificial Sequence
  60S ribosomal protein L23 (74-82)
aagaaagugcaccccgccgucguuauc

SEQ ID NO: 66294 - RNA, 27 nt, Artificial Sequence
  Acyl-CoA desaturase (337-345)
aagaaagugagcaaggccgcuauccug

SEQ ID NO: 66295 - RNA, 27 nt, Artificial Sequence
  Condensin-2 complex subunit G2 (421-429)
aagaaagugaccggcgagcuggccuuc

SEQ ID NO: 66296 - RNA, 27 nt, Artificial Sequence
  Sorting nexin-29 (261-269)
aagaaagugaccaacaucauuagcuuc

SEQ ID NO: 66297 - RNA, 30 nt, Artificial Sequence
  3-hydroxyisobutyryl-CoA hydrolase, mitochondrial (73-82)
aagaaaugggagcaggaccccgaaaccuuc

SEQ ID NO: 66298 - RNA, 30 nt, Artificial Sequence
  Rho-related GTP-binding protein RhoE (115-124)
aagaaauggaagggcgagauccaggaauuc

SEQ ID NO: 66299 - RNA, 27 nt, Artificial Sequence
  Conserved oligomeric Golgi complex subunit 2 (378-386)
aagaaauggaaccugcccguguacuuc

SEQ ID NO: 66300 - RNA, 27 nt, Artificial Sequence
  Oxysterol-binding protein 1 (288-296)
aagaaauggcagaagagccugcaauac

SEQ ID NO: 66301 - RNA, 30 nt, Artificial Sequence
  Cytosolic phospholipase A2 (379-388)
aagaaauacgaggaaaacccccugcacuuc

SEQ ID NO: 66302 - RNA, 27 nt, Artificial Sequence
  F-BAR and double SH3 domains protein 2 (153-161)
aagaaauacuucgagaccgaacagaug

SEQ ID NO: 66303 - RNA, 30 nt, Artificial Sequence
  Cysteine andine-rich protein 1 (64-73)
aagaaauacggccccaagggguauggauac

SEQ ID NO: 66304 - RNA, 30 nt, Artificial Sequence
  WD repeat-containing protein 82 (62-71)
aagaaauacggcguggaccugaucagauau

SEQ ID NO: 66305 - RNA, 27 nt, Artificial Sequence
  Gamma-interferon-inducible protein 16 (3-11)
aagaaauacaagaacaucgugcugcuc

SEQ ID NO: 66306 - RNA, 30 nt, Artificial Sequence
  AT-rich interactive domain-containing protein 4B (387-396)
aagaaauaccuguauggcuucgaggaauac

SEQ ID NO: 66307 - RNA, 33 nt, Artificial Sequence
  116 kDa U5 small nuclear ribonucleoprotein component (63-73)
aagaaauacuaucccaccgccgaggaaguguac

SEQ ID NO: 66308 - RNA, 27 nt, Artificial Sequence
  Astrocytic phosphoprotein PEA-15 (122-130)
aagcuggcccccccuccaaaaaaggcu

SEQ ID NO: 66309 - RNA, 27 nt, Artificial Sequence
  Remodeling and spacing factor 1 (587-595)
aagcuggagaaaagcaagaaaaccuuc

SEQ ID NO: 66310 - RNA, 36 nt, Artificial Sequence
  Zymogen granule protein 16 homolog B (100-111)
aagcugggcgcccucgggggaaacacccaggaggug

SEQ ID NO: 66311 - RNA, 24 nt, Artificial Sequence
  Ubiquitin carboxyl-terminal hydrolase 3 (107-114)
aagcugggccucgugcagaaaguc

SEQ ID NO: 66312 - RNA, 27 nt, Artificial Sequence
  Sister chromatid cohesion protein PDS5 homolog A (112-120)
aagcugaaagacaucuuccucuuuauu

SEQ ID NO: 66313 - RNA, 27 nt, Artificial Sequence
  DDB1- and CUL4-associated factor 13 (376-384)
aagcugaaagagaaguuccagcacuac

SEQ ID NO: 66314 - RNA, 33 nt, Artificial Sequence
  Heterogeneous nuclear ribonucleoproteins C1/C2 (187-197)
aagcugaaaggcgacgaucuccaggccaucaag

SEQ ID NO: 66315 - RNA, 27 nt, Artificial Sequence
  Rap guanine nucleotide exchange factor 2 (828-836)
aagcugcccaacaaauacgagaagcuc

SEQ ID NO: 66316 - RNA, 27 nt, Artificial Sequence
  Dynein heavy chain 1, axonemal (2025-2033)
aagcugcccccucuccuuaaaccauac

SEQ ID NO: 66317 - RNA, 30 nt, Artificial Sequence
  Signal peptidase complex subunit 2 (173-182)
aagcugaccuucaucagcggcagaacaaaa

SEQ ID NO: 66318 - RNA, 30 nt, Artificial Sequence
  Heterogeneous nuclear ribonucleoprotein U-like protein 2 (521-530)
aagcuggugcagaucgccagcagaaccaaa

SEQ ID NO: 66319 - RNA, 30 nt, Artificial Sequence
  Dedicator of cytokinesis protein 3 (182-191)
aagaugcaccugagcuccagacagucugug

SEQ ID NO: 66320 - RNA, 27 nt, Artificial Sequence
  Neuroblast differentiation-associated protein AHNAK (5087-5095)
aagauguacuuccccgacguggaguuu

SEQ ID NO: 66321 - RNA, 27 nt, Artificial Sequence
  A-kinase anchor protein 9 (1420-1428)
aagaacaucgacggcaccauugaguuc

SEQ ID NO: 66322 - RNA, 24 nt, Artificial Sequence
  Nucleoporin p58/p45 (71-78)
aagcccgccaccggcuucacacug

SEQ ID NO: 66323 - RNA, 24 nt, Artificial Sequence
  MARCKS-related protein (96-103)
aagcccuucaaacugagcggccuc

SEQ ID NO: 66324 - RNA, 27 nt, Artificial Sequence
  Zinc finger and BTB domain-containing protein 38 (175-183)
aagcaguuccaaagccccuccacccug

SEQ ID NO: 66325 - RNA, 30 nt, Artificial Sequence
  ADP-sugar pyrophosphatase (81-90)
aagcaguucagacccccuaugggcggguac

SEQ ID NO: 66326 - RNA, 27 nt, Artificial Sequence
  26S protease regulatory subunit 8 (30-38)
aagcagaucaaagagauuaaggaagug

SEQ ID NO: 66327 - RNA, 27 nt, Artificial Sequence
  Ubiquitin-40S ribosomal protein S27a (48-56)
aagcagcuggaggacggcagaacccuc

SEQ ID NO: 66328 - RNA, 27 nt, Artificial Sequence
  tRNA selenocysteine 1-associated protein 1 (88-96)
aagcagcccgacaacagcccugaguac

SEQ ID NO: 66329 - RNA, 27 nt, Artificial Sequence
  MARVEL domain-containing protein 2 (540-548)
aagcagagaauccaagaguacgacaaa

SEQ ID NO: 66330 - RNA, 27 nt, Artificial Sequence
  Heat shock 70 kDa protein 1B (423-431)
aagcagacccaaaucuucacaacuuac

SEQ ID NO: 66331 - RNA, 27 nt, Artificial Sequence
  Mortality factor 4-like protein 1 (38-46)
aagcaggugaaauacuucauccacuau

SEQ ID NO: 66332 - RNA, 30 nt, Artificial Sequence
  ADP-ribosylation factor-binding protein GGA2 (311-320)
aagcaggugauggagggcagagucaccuuc

SEQ ID NO: 66333 - RNA, 36 nt, Artificial Sequence
  60S ribosomal protein L17 (74-85)
aagcaguggggcuggacccaagggagauggcccaaa

SEQ ID NO: 66334 - RNA, 27 nt, Artificial Sequence
  ATP-dependent RNA helicase DDX3X (264-272)
aagcaguaccccaucagccuggugcuc

SEQ ID NO: 66335 - RNA, 27 nt, Artificial Sequence
  Cancer-related nucleoside-triphosphatase (73-81)
aagagagagugcagggugggccaguac

SEQ ID NO: 66336 - RNA, 30 nt, Artificial Sequence
  Unconventional myosin-VIIb (624-633)
aagagacccagcacccugggcucccaguuc

SEQ ID NO: 66337 - RNA, 33 nt, Artificial Sequence
  Vigilin (550-560)
aagagcgacaucgugcagcugagaggccccaaa

SEQ ID NO: 66338 - RNA, 30 nt, Artificial Sequence; identical to SEQ ID NO: 42111
  Cyclin-dependent kinase-like 5 (680-689)

SEQ ID NO: 66339 - RNA, 27 nt, Artificial Sequence
  Clathrin heavy chain 1 (706-714)
aagagcuucgagggccuguuuuacuuc

SEQ ID NO: 66340 - RNA, 27 nt, Artificial Sequence
  General transcription factor 3C polypeptide 2 (146-154)
aagagcaaagccgagcugcuccuucug

SEQ ID NO: 66341 - RNA, 33 nt, Artificial Sequence
  Calcyclin-binding protein (33-43)
aagagcaaaaucgagaccgaaauuaagaacaaa

SEQ ID NO: 66342 - RNA, 27 nt, Artificial Sequence
  Dol-P-Glc:Glc(2)Man(9)GlcNAc(2)-PP-Dol alpha-1,2-glucosyltransferase (389-397)
aagagcaaauccaucuucuggaaccug

SEQ ID NO: 66343 - RNA, 27 nt, Artificial Sequence
  Leucine-rich repeat-containing protein 40 (210-218)
aagagccugcccgccgagaucaacaga

SEQ ID NO: 66344 - RNA, 27 nt, Artificial Sequence
  Solute carrier family 7 member 13 (416-424)
aagagccccaacgugcacuacgucuau

SEQ ID NO: 66345 - RNA, 27 nt, Artificial Sequence
  Aromatase (99-107)
aagagcuccucuauguuccacaucaug

SEQ ID NO: 66346 - RNA, 27 nt, Artificial Sequence
  Thromboxane-A synthase (118-126)
aagagcguggccgacuccguccuguuc

SEQ ID NO: 66347 - RNA, 33 nt, Artificial Sequence
  Hypoxia up-regulated protein 1 (249-259)
aagaccaaagaggccggcaugcagccccaacug

SEQ ID NO: 66348 - RNA, 30 nt, Artificial Sequence
  Translin (76-85)
aagaccaaauuccccgccgagcaguacuau

SEQ ID NO: 66349 - RNA, 27 nt, Artificial Sequence
  RNA-binding protein PNO1 (189-197)
aagaccaaauucacaaucgagaacgug

SEQ ID NO: 66350 - RNA, 27 nt, Artificial Sequence
  DNA damage-binding protein 1 (915-923)
aagaccaaaggcgacuucauccuggug

SEQ ID NO: 66351 - RNA, 27 nt, Artificial Sequence
  N-acetylgalactosamine kinase (102-110)
aagaccaaaccccuguggcacaacuac

SEQ ID NO: 66352 - RNA, 27 nt, Artificial Sequence
  Splicing factor 3B subunit 3 (294-302)
aagaccaaaagcauguucuuuuuccug

SEQ ID NO: 66353 - RNA, 36 nt, Artificial Sequence
  Heterogeneous nuclear ribonucleoproteins A2/B1 (3-14)
aagacccuggagacagugccccucgaaagaaaaaag

SEQ ID NO: 66354 - RNA, 27 nt, Artificial Sequence
  ADP-ribosylation factor-like protein 11 (25-33)
aagaccacacugcucuacaaacuuaag

SEQ ID NO: 66355 - RNA, 27 nt, Artificial Sequence
  Catenin alpha-2 (794-802)
aaggugaaagccgagguccagaaccug

SEQ ID NO: 66356 - RNA, 27 nt, Artificial Sequence
  Serine/threonine-protein phosphatase 2A 65 kDa regulatory subunit A alpha isoform (305-313)
aaggugaaagaguucugcgaaaaccug

SEQ ID NO: 66357 - RNA, 27 nt, Artificial Sequence
  Septin-7 (364-372)
aaggugaaagagaagguccagaaacug

SEQ ID NO: 66358 - RNA, 27 nt, Artificial Sequence
  Kelch-like protein 24 (128-136)
aaggugaaaaucaccacagagaacguc

SEQ ID NO: 66359 - RNA, 33 nt, Artificial Sequence
  Ubiquitin-40S ribosomal protein S27a (97-107)
aaggugaaacuggccguccucaaguacuauaaa

SEQ ID NO: 66360 - RNA, 30 nt, Artificial Sequence
  Thioredoxin-like protein 4A (51-60)
aaggugaaaaacuucgccgucaucuaccug

SEQ ID NO: 66361 - RNA, 27 nt, Artificial Sequence
  FACT complex subunit SPT16 (424-432)
aaggugaaaaacgucggcaucuuccug

SEQ ID NO: 66362 - RNA, 30 nt, Artificial Sequence
  Peptidylprolyl isomerase domain and WD repeat-containing protein 1 (65-74)
aaggugcuggaguucgaaagagucuaccuc

SEQ ID NO: 66363 - RNA, 30 nt, Artificial Sequence
  Exocyst complex component 4 (568-577)
aaggugcugggcguccagagaccccuccuu

SEQ ID NO: 66364 - RNA, 30 nt, Artificial Sequence
  60S ribosomal protein L15 (5-14)
aaguacauccaggagcuguggagaaaaaag

SEQ ID NO: 66365 - RNA, 27 nt, Artificial Sequence
  Proto-oncogene vav (272-280)
aaguacaaagagagauuccugguguau

SEQ ID NO: 66366 - RNA, 30 nt, Artificial Sequence
  60S ribosomal protein L35 (77-86)
aaguacaaaccccuggaccucagaccuaag

SEQ ID NO: 66367 - RNA, 36 nt, Artificial Sequence
  Protein mab-21-like 3 (2-13)
aaguaccugaccgugggcgaccucgaggauugccuu

SEQ ID NO: 66368 - RNA, 27 nt, Artificial Sequence
  Protein archease (35-43)
aaguaccccccugugaacagaaaauau

SEQ ID NO: 66369 - RNA, 27 nt, Artificial Sequence
  RNA-binding protein 42 (445-453)
aaguacgugggcagcagacccaucaaa

SEQ ID NO: 66370 - RNA, 27 nt, Artificial Sequence
  Suppressor of tumorigenicity 7 protein-like (66-74)
cuggccgcugugaccgucuuccucaac

SEQ ID NO: 66371 - RNA, 27 nt, Artificial Sequence
  Cytochrome c oxidase assembly protein COX14 (7-15)
cuggccgacaucggcuacaagaccuuc

SEQ ID NO: 66372 - RNA, 30 nt, Artificial Sequence
  Serine/arginine repetitive matrix protein 2 (2256-2265)
cuggccgacagcagaacccccgcugcagcc

SEQ ID NO: 66373 - RNA, 27 nt, Artificial Sequence
  Neutral amino acid transporter A (75-83)
cuggccuuccccggcgagaugcuccuu

SEQ ID NO: 66374 - RNA, 27 nt, Artificial Sequence
  Apolipoprotein B receptor (1069-1077)
cuggcccaccccggcaugaugcaggag

SEQ ID NO: 66375 - RNA, 30 nt, Artificial Sequence; identical to SEQ ID NO: 42148
  Dystrophin-related protein 2 (299-308)

SEQ ID NO: 66376 - RNA, 27 nt, Artificial Sequence
  Microtubule-associated protein 4 (558-566)
cuggccaaggacggcgugcucacccuu

SEQ ID NO: 66377 - RNA, 27 nt, Artificial Sequence
  Renin receptor (203-211)
cuggccaaggaccacagccccgaucuc

SEQ ID NO: 66378 - RNA, 27 nt, Artificial Sequence
  Minor histocompatibility antigen H13 (335-343)
cuggccaagggcgaggugaccgaaaug

SEQ ID NO: 66379 - RNA, 27 nt, Artificial Sequence
  Nectin-1 (16-24)
cuggcccucggccuuaccgcuuucuuu

SEQ ID NO: 66380 - RNA, 33 nt, Artificial Sequence
  Heterogeneous nuclear ribonucleoprotein M (609-619)
cuggccaugggcgggggagguggcgcuagcuuc

SEQ ID NO: 66381 - RNA, 30 nt, Artificial Sequence; identical to SEQ ID NO: 42154
  Golgin subfamily A member 3 (204-213)

SEQ ID NO: 66382 - RNA, 27 nt, Artificial Sequence
  Thioredoxin-interacting protein (222-230)
cuggccaacggccagaccaaggugcuc

SEQ ID NO: 66383 - RNA, 33 nt, Artificial Sequence
  Orexin receptor type 1 (225-235)
cuggccccccucggccuuauggcuauggcauac

SEQ ID NO: 66384 - RNA, 27 nt, Artificial Sequence
  Dynein heavy chain 6, axonemal (1621-1629)
cuggccagaaagaugacccagauguac

SEQ ID NO: 66385 - RNA, 27 nt, Artificial Sequence
  Nucleolar protein 16 (58-66)
cuggccguggaccccaacagagcuguc

SEQ ID NO: 66386 - RNA, 27 nt, Artificial Sequence
  Ectonucleoside triphosphate diphosphohydrolase 1 (33-41)
cuggccgugggccucacccagaacaag

SEQ ID NO: 66387 - RNA, 27 nt, Artificial Sequence
  60S ribosomal protein L29 (96-104)
cuggccuacaucgcucaccccaagcuc

SEQ ID NO: 66388 - RNA, 27 nt, Artificial Sequence
  Potassium-transporting ATPase alpha chain 2 (598-606)
cugugcuucgugggccuccuuagcaug

SEQ ID NO: 66389 - RNA, 30 nt, Artificial Sequence
  Eukaryotic translation initiation factor 3 subunit C-like protein (635-644)
cuggacauccagagcuccggcagagccaag

SEQ ID NO: 66390 - RNA, 27 nt, Artificial Sequence
  Cullin-7 (163-171)
cuggaccuccuuaugcacaugcugagc

SEQ ID NO: 66391 - RNA, 27 nt, Artificial Sequence
  Sodium-driven chloride bicarbonate exchanger (854-862)
cuggaccuccuuaugguggccgucaug

SEQ ID NO: 66392 - RNA, 27 nt, Artificial Sequence
  Fibrillin-3 (2702-2710)
cuggacagcgaggcccuccuuacccug

SEQ ID NO: 66393 - RNA, 27 nt, Artificial Sequence
  Uncharacterized protein C9orf171 (285-293)
cuggacaccuuccccacagaggccgau

SEQ ID NO: 66394 - RNA, 30 nt, Artificial Sequence
  Ankyrin repeat and LEM domain-containing protein 1 (184-193)
cuggaggccgaccccggcccuccaagccuc

SEQ ID NO: 66395 - RNA, 24 nt, Artificial Sequence
  Core histone macro-H2A.1 (61-68)
cuggagcucgccggcaacgcugca

SEQ ID NO: 66396 - RNA, 27 nt, Artificial Sequence
  Alpha-mannosidase 2x (1106-1114)
cuguuccacggccucgacguggucuuu

SEQ ID NO: 66397 - RNA, 27 nt, Artificial Sequence
  Vasohibin-2 (48-56)
cuguuccacgugaacaagagcggcuuu

SEQ ID NO: 66398 - RNA, 27 nt, Artificial Sequence
  Pre-mRNA-processing factor 17 (418-426)
cugggcgccgugaacaccaucgucuuc

SEQ ID NO: 66399 - RNA, 27 nt, Artificial Sequence
  Pumilio homolog 1 (673-681)
cugggcuucgggagcuccucuucacuc

SEQ ID NO: 66400 - RNA, 27 nt, Artificial Sequence
  Putative nuclease HARBI1 (77-85)
cugggcuucuacaccagcggguccuuu

SEQ ID NO: 66401 - RNA, 30 nt, Artificial Sequence
  Hyaluronidase-4 (205-214)
cugggcaucaagagcagacccaaagggcuc

SEQ ID NO: 66402 - RNA, 30 nt, Artificial Sequence
  NF-kappa-B-repressing factor (591-600)
cugggccucgacguggagagagucaacaag

SEQ ID NO: 66403 - RNA, 27 nt, Artificial Sequence
  G-protein coupled receptor family C group 6 member A (447-455)
cugggcgugcucaagaacgucaccuuc

SEQ ID NO: 66404 - RNA, 27 nt, Artificial Sequence
  L-xylulose reductase (27-35)
cugcacgccaccggcgcuagagugguc

SEQ ID NO: 66405 - RNA, 27 nt, Artificial Sequence
  Sterol regulatory element-binding protein 1 (1037-1045)
cugcacgaggccaccgcuagacucaug

SEQ ID NO: 66406 - RNA, 27 nt, Artificial Sequence
  U3 small nucleolar ribonucleoprotein protein MPP10 (405-413)
cugcacuucgaccaugccgugagaaug

SEQ ID NO: 66407 - RNA, 27 nt, Artificial Sequence
  Nucleoporin Nup43 (101-109)
cugcaccaucccaacaaucagacccuc

SEQ ID NO: 66408 - RNA, 27 nt, Artificial Sequence
  Delta(14)-sterol reductase (279-287)
cugcaccauccccagccucucggccuu

SEQ ID NO: 66409 - RNA, 27 nt, Artificial Sequence
  Phospholipid-transporting ATPase ID (589-597)
cugcaccauagcacccaggagcuccuu

SEQ ID NO: 66410 - RNA, 30 nt, Artificial Sequence
  Neuron navigator 3 (2128-2137)
cugcaccaugugggcagccucuccgacauc

SEQ ID NO: 66411 - RNA, 27 nt, Artificial Sequence
  GTP-binding protein 1 (551-559)
cugcacaucgaccagagacucguguuc

SEQ ID NO: 66412 - RNA, 27 nt, Artificial Sequence
  Cyclin-I (151-159)
cugcacaucuuccaugccauugcugug

SEQ ID NO: 66413 - RNA, 27 nt, Artificial Sequence
  Thioredoxin domain-containing protein 9 (138-146)
cugcacaucaaggugauucccacccuc

SEQ ID NO: 66414 - RNA, 27 nt, Artificial Sequence
  Myb-binding protein 1A (438-446)
cugcacaugcccgagagagccguguuc

SEQ ID NO: 66415 - RNA, 27 nt, Artificial Sequence
  Probable ATP-dependent RNA helicase DDX56 (212-220)
cugcacaaccccgugacccucaagcuu

SEQ ID NO: 66416 - RNA, 27 nt, Artificial Sequence
  Gem-associated protein 5 (107-115)
cugcaccagcauaccaucagcacacuc

SEQ ID NO: 66417 - RNA, 27 nt, Artificial Sequence
  G patch domain-containing protein 8 (828-836)
cugcaccagaagagccccucccaauac

SEQ ID NO: 66418 - RNA, 27 nt, Artificial Sequence
  Actin-binding LIM protein 1 (664-672)
cugcacagacccgugagcaccgacuuc

SEQ ID NO: 66419 - RNA, 27 nt, Artificial Sequence
  Cytochrome c oxidase subunit 2 (160-168)
cugcacagcugggccgugcccacccuc

SEQ ID NO: 66420 - RNA, 27 nt, Artificial Sequence
  IQ motif and SEC7 domain-containing protein 1 (263-271)
cugcacaccgaggaagcccccgcucuc

SEQ ID NO: 66421 - RNA, 27 nt, Artificial Sequence
  Selenoprotein S (22-30)
cugcacaccacagugggcagccuccuu

SEQ ID NO: 66422 - RNA, 27 nt, Artificial Sequence
  Plectin (1023-1031)
cugcacguggacaugaagagccuccuu

SEQ ID NO: 66423 - RNA, 27 nt, Artificial Sequence
  Unconventional myosin-Ih (186-194)
cugaucgagaagagcagaguggucuac

SEQ ID NO: 66424 - RNA, 33 nt, Artificial Sequence
  Heat shock 70 kDa protein 1-like (198-208)
cugaucuucgaccucggcgggggaaccuuugau

SEQ ID NO: 66425 - RNA, 27 nt, Artificial Sequence
  DnaJ homolog subfamily C member 13 (1046-1054)
cugauccucaacaugcuuauuaccaug

SEQ ID NO: 66426 - RNA, 27 nt, Artificial Sequence
  Probable ATP-dependent RNA helicase DDX59 (275-283)
cugauccucacccccacaagagagcuu

SEQ ID NO: 66427 - RNA, 27 nt, Artificial Sequence
  Integrin beta-7 (381-389)
cugaucauggacgccuacaacagccuc

SEQ ID NO: 66428 - RNA, 27 nt, Artificial Sequence
  Leucine-rich repeat and fibronectin type-III domain-containing protein 4 (447-455)
cugaucuacagaauugugcccgccagc

SEQ ID NO: 66429 - RNA, 27 nt, Artificial Sequence
  Protein disulfide-isomerase A2 (328-336)
cugaaggccgaggcugcacccacccuc

SEQ ID NO: 66430 - RNA, 27 nt, Artificial Sequence
  Mini-chromosome maintenance complex-binding protein (430-438)
cugaaguucaucccccacaaagacuac

SEQ ID NO: 66431 - RNA, 27 nt, Artificial Sequence
  RNA-binding protein 8A (113-121)
cugaagggcuacacccucguggaguau

SEQ ID NO: 66432 - RNA, 27 nt, Artificial Sequence
  Mannosyl-oligosaccharide glucosidase (326-334)
cugaagauccccauuagcauagaguuc

SEQ ID NO: 66433 - RNA, 27 nt, Artificial Sequence
  ER membrane protein complex subunit 1 (411-419)
cugaagaaagacgauagcgugggcuac

SEQ ID NO: 66434 - RNA, 33 nt, Artificial Sequence
  DENN domain-containing protein 4C (704-714)
cugaagcucuucgacagaccccaggagcuuaaa

SEQ ID NO: 66435 - RNA, 27 nt, Artificial Sequence
  Eukaryotic translation initiation factor 3 subunit D (447-455)
cugaagcucggcuacgugagcagauau

SEQ ID NO: 66436 - RNA, 27 nt, Artificial Sequence
  Serine/threonine-protein kinase PAK 2 (301-309)
cugaagaaccccaauaucgugaacuuc

SEQ ID NO: 66437 - RNA, 27 nt, Artificial Sequence
  Elongation factor 1-alpha 1 (272-280)
cugaagcccggcaugguggucaccuuc

SEQ ID NO: 66438 - RNA, 27 nt, Artificial Sequence
  X-ray repair cross-complementing protein 6 (281-289)
cugaagcccccuccaaucaaacucuac

SEQ ID NO: 66439 - RNA, 27 nt, Artificial Sequence
  Choline/ethanolaminephosphotransferase 1 (48-56)
cugaagagacucgaggaacacagguac

SEQ ID NO: 66440 - RNA, 27 nt, Artificial Sequence
  Renin receptor (22-30)
cugaagagccccggcuccguggucuuc

SEQ ID NO: 66441 - RNA, 27 nt, Artificial Sequence
  Nucleolin (323-331)
cugaagaccggcaucagcgacguguuc

SEQ ID NO: 66442 - RNA, 27 nt, Artificial Sequence
  26S protease regulatory subunit 7 (33-41)
cugaagaccuacggccagagcacauau

SEQ ID NO: 66443 - RNA, 24 nt, Artificial Sequence
  60S ribosomal protein L19 (125-132)
cugaaggugaaaggcaacgucuuc

SEQ ID NO: 66444 - RNA, 27 nt, Artificial Sequence
  Forkhead box protein O3 (93-101)
cugcucgaggacagcgccagagugcuu

SEQ ID NO: 66445 - RNA, 27 nt, Artificial Sequence
  Dynein heavy chain 9, axonemal (368-376)
cugcucauccagcaagccagcaacuac

SEQ ID NO: 66446 - RNA, 33 nt, Artificial Sequence
  Dynein heavy chain 10, axonemal (1334-1344)
cugcuccuugaccugaagaacgaggccuugaga

SEQ ID NO: 66447 - RNA, 27 nt, Artificial Sequence
  ER membrane protein complex subunit 3 (6-14)
cugcuccuugacagcaacaucagacug

SEQ ID NO: 66448 - RNA, 27 nt, Artificial Sequence
  Echinoderm microtubule-associated protein-like 4 (278-286)
cugcuccccaccggcaagaucguguac

SEQ ID NO: 66449 - RNA, 27 nt, Artificial Sequence
  Chromodomain-helicase-DNA-binding protein 2 (628-636)
cugcucuacaagacccuuaucgacuuc

SEQ ID NO: 66450 - RNA, 27 nt, Artificial Sequence
  Integrator complex subunit 10 (519-527)
cugaugugcuacauggugcuccccauc

SEQ ID NO: 66451 - RNA, 33 nt, Artificial Sequence
  Melatonin receptor type 1A (106-116)
cugaugggccucagcgugaucggguccauuuuc

SEQ ID NO: 66452 - RNA, 27 nt, Artificial Sequence
  DNA-dependent protein kinase catalytic subunit (2219-2227)
cugaugaagcacguguuccaucccaaa

SEQ ID NO: 66453 - RNA, 33 nt, Artificial Sequence
  Eukaryotic translation initiation factor 3 subunit H (211-221)
cugaugugggagcucgaaaagaaaagcgccgug

SEQ ID NO: 66454 - RNA, 27 nt, Artificial Sequence
  CTP synthase 2 (334-342)
cugauguacaucgacagcauugaucuc

SEQ ID NO: 66455 - RNA, 27 nt, Artificial Sequence
  Ubiquitin-like modifier-activating enzyme ATG7 (128-136)
cugaacaaguuccuccuucugaccuuu

SEQ ID NO: 66456 - RNA, 30 nt, Artificial Sequence
  Carboxy-terminal domain RNA polymerase II polypeptide A small phosphatase 1 (54-63)
cugcccgcccacagcggcgcuccucuccuu

SEQ ID NO: 66457 - RNA, 27 nt, Artificial Sequence
  Neutrophil cytosol factor 4 (89-97)
cugcccgccaagguguacgucggcguu

SEQ ID NO: 66458 - RNA, 27 nt, Artificial Sequence
  GPI transamidase component PIG-T (430-438)
cugcccgccaacagcgugaccaagguc

SEQ ID NO: 66459 - RNA, 27 nt, Artificial Sequence
  Tyrosine-protein phosphatase non-receptor type 12 (677-685)
cugcccgagagaaccccugaaagcuuc

SEQ ID NO: 66460 - RNA, 27 nt, Artificial Sequence
  Collagen alpha-2(IV) chain (385-393)
cugcccggcccuccagggcucagcauc

SEQ ID NO: 66461 - RNA, 27 nt, Artificial Sequence
  DDB1- and CUL4-associated factor 13 (548-556)
cugcccaagagcaucuacucccagauu

SEQ ID NO: 66462 - RNA, 27 nt, Artificial Sequence
  Interferon regulatory factor 2-binding protein-like (271-279)
cugcccccuccaccgccccacgcccuc

SEQ ID NO: 66463 - RNA, 27 nt, Artificial Sequence
  Neutral amino acid transporter A (142-150)
cugcccacccacgaccucccucuuauc

SEQ ID NO: 66464 - RNA, 24 nt, Artificial Sequence
  General transcription factor 3C polypeptide 2 (665-672)
cugcccuacaacggcgugaccguc

SEQ ID NO: 66465 - RNA, 27 nt, Artificial Sequence
  Signal peptidase complex catalytic subunit SEC11C (158-166)
cugcccuacgugggcauggucaccauc

SEQ ID NO: 66466 - RNA, 27 nt, Artificial Sequence
  WD repeat-containing protein 34 (423-431)
cugcaggcccccccucucaccagccuu

SEQ ID NO: 66467 - RNA, 27 nt, Artificial Sequence
  Protein unc-13 homolog C (117-125)
cugcaggagcucagcuccaucgaaucu

SEQ ID NO: 66468 - RNA, 27 nt, Artificial Sequence
  TBC1 domain family member 4 (1186-1194)
cugcaggagagcuccuacucuugcgaa

SEQ ID NO: 66469 - RNA, 30 nt, Artificial Sequence
  WD repeat-containing protein 82 (288-297)
cugcaguucaaccccaaguuuaugaccuuc

SEQ ID NO: 66470 - RNA, 33 nt, Artificial Sequence
  Serine/threonine-protein kinase RIO2 (521-531)
cugcagaagggcgaggccaacaucuucaccaaa

SEQ ID NO: 66471 - RNA, 30 nt, Artificial Sequence; identical to SEQ ID NO: 42244
  WAS protein family homolog 1 (40-49)

SEQ ID NO: 66472 - RNA, 27 nt, Artificial Sequence
  Tubulin beta chain (42-50)
cugcagcucgacagaaucagcguguac

SEQ ID NO: 66473 - RNA, 27 nt, Artificial Sequence
  Tubulin beta-4B chain (42-50)
cugcagcucgagagaaucaacguguac

SEQ ID NO: 66474 - RNA, 27 nt, Artificial Sequence
  Acyl-coenzyme A synthetase ACSM5, mitochondrial (112-120)
cugcagcccggcgacagaaugaugcuc

SEQ ID NO: 66475 - RNA, 27 nt, Artificial Sequence
  GPI transamidase component PIG-T (58-66)
cugcagagagagggcgugagccacuac

SEQ ID NO: 66476 - RNA, 27 nt, Artificial Sequence
  Splicing factor 1 (254-262)
cugagagaggacgauaacaggauccuc

SEQ ID NO: 66477 - RNA, 27 nt, Artificial Sequence
  FH1/FH2 domain-containing protein 1 (1156-1164)
cugagcaagggccccgggcucgaggug

SEQ ID NO: 66478 - RNA, 30 nt, Artificial Sequence
  Phosphatidylethanolamine-binding protein 1 (5-14)
cugagcaagugguccggcccccucucucuu

SEQ ID NO: 66479 - RNA, 24 nt, Artificial Sequence
  FYVE, RhoGEF and PH domain-containing protein 5 (524-531)
cugagccucgagggcaagccccuu

SEQ ID NO: 66480 - RNA, 27 nt, Artificial Sequence
  Cilia- and flagella-associated protein 54 (689-697)
cugagcaugcucaaguccaugcuucug

SEQ ID NO: 66481 - RNA, 27 nt, Artificial Sequence
  Alpha-ketoglutarate-dependent dioxygenase alkB homolog 7, mitochondrial (104-112)
cugagcuccgugcacguccucgaccuu

SEQ ID NO: 66482 - RNA, 27 nt, Artificial Sequence
  WD repeat-containing protein 7 (683-691)
cugaccgaccccgauauccacgugcuc

SEQ ID NO: 66483 - RNA, 27 nt, Artificial Sequence
  Transcription factor SOX-30 (235-243)
cuggugcacggcagcgccgaggucauc

SEQ ID NO: 66484 - RNA, 27 nt, Artificial Sequence
  60S ribosomal protein L32 (7-15)
cuggugaagcccaaaaucgucaagaaa

SEQ ID NO: 66485 - RNA, 27 nt, Artificial Sequence
  Probable ATP-dependent RNA helicase DDX41 (390-398)
cuggugaagcccgucaccaucaacguu

SEQ ID NO: 66486 - RNA, 27 nt, Artificial Sequence
  Cationic amino acid transporter 3 (165-173)
cuggugcucaucgucggcuucaccuuu

SEQ ID NO: 66487 - RNA, 27 nt, Artificial Sequence
  Mitogen-activated protein kinase kinase kinase 10 (901-909)
cuggugagcuucggcagaacccucaca

SEQ ID NO: 66488 - RNA, 27 nt, Artificial Sequence
  Glypican-4 (385-393)
cuggugaccgacgucaaggagaaacuc

SEQ ID NO: 66489 - RNA, 27 nt, Artificial Sequence
  Transmembrane protein with metallophosphoesterase domain (414-422)
cuguaccagguggcccaagcuaccuuc

SEQ ID NO: 66490 - RNA, 27 nt, Artificial Sequence
  Transcription factor SOX-6 (312-320)
auggccgcugcagccgcgagcggccug

SEQ ID NO: 66491 - RNA, 27 nt, Artificial Sequence
  28S ribosomal protein S14, mitochondrial (1-9)
auggccgcuuucaugcugggcagccuc

SEQ ID NO: 66492 - RNA, 27 nt, Artificial Sequence
  Steroid 21-hydroxylase (283-291)
auggccgcuguggaccugcucaucggc

SEQ ID NO: 66493 - RNA, 27 nt, Artificial Sequence
  XK-related protein 5 (595-603)
auggccgacaucagccccauucugggc

SEQ ID NO: 66494 - RNA, 24 nt, Artificial Sequence
  Histone-binding protein RBBP4 (1-8)
auggccgacaaggaggcugcauuc

SEQ ID NO: 66495 - RNA, 27 nt, Artificial Sequence
  N-acetylated-alpha-linked acidic dipeptidase 2 (1-9)
auggccgagagcagaggcaggcuguac

SEQ ID NO: 66496 - RNA, 27 nt, Artificial Sequence
  Mucin-17 (161-169)
auggccuucgugagcaccgcuccccug

SEQ ID NO: 66497 - RNA, 27 nt, Artificial Sequence
  Butyrophilin-like protein 8 (1-9)
auggcccugaugcucagccuugugcug

SEQ ID NO: 66498 - RNA, 30 nt, Artificial Sequence
  Zinc finger protein 28 (1-10)
auggcccugccccagggccuccuuaccuuc

SEQ ID NO: 66499 - RNA, 30 nt, Artificial Sequence
  Major facilitator superfamily domain-containing protein 9 (295-304)
auggccauggcugugaugcuguacuauagc

SEQ ID NO: 66500 - RNA, 27 nt, Artificial Sequence
  Splicing factor 3A subunit 1 (775-783)
auggccaacggcgcugugauccaccug

SEQ ID NO: 66501 - RNA, 27 nt, Artificial Sequence
  Small nuclear ribonucleoprotein-associated protein N (189-197)
auggcccccccuccaggcaugagaccg

SEQ ID NO: 66502 - RNA, 24 nt, Artificial Sequence
  HLA class I histocompatibility antigen, Cw-7 alpha chain (4-11)
auggcccccagagcucugcuccuu

SEQ ID NO: 66503 - RNA, 27 nt, Artificial Sequence
  Coiled-coil domain-containing protein 42A (261-269)
auggccacccugaaccucuuccagauc

SEQ ID NO: 66504 - RNA, 27 nt, Artificial Sequence
  Frizzled-4 (474-482)
auggccguggagaugcugaagaucuuc

SEQ ID NO: 66505 - RNA, 27 nt, Artificial Sequence
  Interferon alpha-inducible protein 6 (45-53)
auggccgugggcgggggacuggcuguc

SEQ ID NO: 66506 - RNA, 33 nt, Artificial Sequence
  Thyroid adenoma-associated protein (70-80)
augugcgaccccaccauccagagcugucuggau

SEQ ID NO: 66507 - RNA, 27 nt, Artificial Sequence
  Putative tripartite motif-containing protein 49B (236-244)
augugccacaagcccgacguggagcug

SEQ ID NO: 66508 - RNA, 27 nt, Artificial Sequence
  C-C chemokine receptor type 9 (118-126)
augugcaagguggucaacagcauguac

SEQ ID NO: 66509 - RNA, 27 nt, Artificial Sequence
  Centrosomal protein of 72 kDa (190-198)
auggacgccgaugacgaggcugugcug

SEQ ID NO: 66510 - RNA, 30 nt, Artificial Sequence; identical to SEQ ID NO: 42283
  Rho guanine nucleotide exchange factor 12 (1356-1365)

SEQ ID NO: 66511 - RNA, 27 nt, Artificial Sequence
  Adenosine receptor A2b (219-227)
auggaccacagcagaaccacacugcag

SEQ ID NO: 66512 - RNA, 27 nt, Artificial Sequence
  Protein CREG1 (164-172)
auggacaucgccaagcacagccuguuc

SEQ ID NO: 66513 - RNA, 27 nt, Artificial Sequence
  P2X purinoceptor 7 (140-148)
auggacccccagagcaagggcauccaa

SEQ ID NO: 66514 - RNA, 30 nt, Artificial Sequence
  40S ribosomal protein S28 (1-10)
auggacaccagcagagugcagcccaucaag

SEQ ID NO: 66515 - RNA, 27 nt, Artificial Sequence
  F-box only protein 44 (151-159)
auggacaccacaagacccgauaucgag

SEQ ID NO: 66516 - RNA, 36 nt, Artificial Sequence
  BEN domain-containing protein 7 (1-12)
auggaguucagcgaaagaaagaggucccggaaaucu

SEQ ID NO: 66517 - RNA, 30 nt, Artificial Sequence
  Rho guanine nucleotide exchange factor 11 (1442-1451)
auggagcuggcccacagagaacuccuuaag

SEQ ID NO: 66518 - RNA, 36 nt, Artificial Sequence
  Nitric oxide synthase, endothelial (1137-1148)
auggagcuggacgaagccggcgaugugaucgggguc

SEQ ID NO: 66519 - RNA, 24 nt, Artificial Sequence
  Pseudouridylate synthase 7 homolog (1-8)
auggagaugaccgaaaugacaggc

SEQ ID NO: 66520 - RNA, 27 nt, Artificial Sequence
  Lethal(3)malignant brain tumor-like protein 3 (52-60)
auggagaacgugaagaaagccaccgcu

SEQ ID NO: 66521 - RNA, 36 nt, Artificial Sequence
  Heme oxygenase 1 (1-12)
auggagagaccccagccugacagcaugccacaagau

SEQ ID NO: 66522 - RNA, 27 nt, Artificial Sequence
  Metalloreductase STEAP2 (1-9)
auggagagcaucuccaugaugggcucu

SEQ ID NO: 66523 - RNA, 27 nt, Artificial Sequence
  CD97 antigen (1-9)
augggcgggagaguguuccuggccuuu

SEQ ID NO: 66524 - RNA, 30 nt, Artificial Sequence
  Putative uncharacterized protein ENSP00000381562 (1-10)
augggcagcauccccuccaagccuugcaac

SEQ ID NO: 66525 - RNA, 27 nt, Artificial Sequence
  Ubiquitin carboxyl-terminal hydrolase isozyme L3 (111-119)
augcacuucgagagcggcuccacccug

SEQ ID NO: 66526 - RNA, 27 nt, Artificial Sequence
  Complex I assembly factor TMEM126B, mitochondrial (35-43)
augcacggccagcccagcccuucccug

SEQ ID NO: 66527 - RNA, 27 nt, Artificial Sequence
  Transmembrane protein 114 (102-110)
augcacggcaccuucgugauccugcuc

SEQ ID NO: 66528 - RNA, 30 nt, Artificial Sequence; identical to SEQ ID NO: 42301
  Leucine-twenty homeobox (1-10)

SEQ ID NO: 66529 - RNA, 27 nt, Artificial Sequence
  Protein Tob1 (226-234)
augcacagccuguacggccucgggcuu

SEQ ID NO: 66530 - RNA, 27 nt, Artificial Sequence
  Deoxyribonuclease-1-like 1 (1-9)
augcacuaccccaccgcccugcucuuc

SEQ ID NO: 66531 - RNA, 27 nt, Artificial Sequence
  Neuronal acetylcholine receptor subunit alpha-4 (314-322)
augaucuucgugacccugagcauuguc

SEQ ID NO: 66532 - RNA, 27 nt, Artificial Sequence
  Eukaryotic translation initiation factor 3 subunit L (359-367)
augaucaacaagcagaaugagcaaaug

SEQ ID NO: 66533 - RNA, 30 nt, Artificial Sequence
  Lysosomal protective protein (1-10)
augaucagagccgcucccccuccacuguuc

SEQ ID NO: 66534 - RNA, 30 nt, Artificial Sequence
  60S ribosomal protein L18a (1-10)
augaaggccagcggcacccugagagaguac

SEQ ID NO: 66535 - RNA, 27 nt, Artificial Sequence
  Lymphocyte antigen 86 (1-9)
augaagggcuucaccgccacacuguuu

SEQ ID NO: 66536 - RNA, 27 nt, Artificial Sequence
  Sodium-coupled neutral amino acid transporter 5 (188-196)
augaagcaccugggcuaccucggguau

SEQ ID NO: 66537 - RNA, 27 nt, Artificial Sequence
  Neurexin-3 (694-702)
augaagaucauuaugcccauggugaug

SEQ ID NO: 66538 - RNA, 27 nt, Artificial Sequence
  Dentin matrix acidic phosphoprotein 1 (1-9)
augaagaucagcauucugcucauguuc

SEQ ID NO: 66539 - RNA, 27 nt, Artificial Sequence
  Sarcoplasmic/endoplasmic reticulum calcium ATPase 2 (479-487)
augaagaaagaguucacccuggaauuu

SEQ ID NO: 66540 - RNA, 30 nt, Artificial Sequence
  60S ribosomal protein L18a (54-63)
augaagaaaagcuccggcgagaucguguac

SEQ ID NO: 66541 - RNA, 27 nt, Artificial Sequence
  Lysine-tRNA ligase (406-414)
augaagcugcccgagaccaaccucuuc

SEQ ID NO: 66542 - RNA, 30 nt, Artificial Sequence; identical to SEQ ID NO: 42315
  Glucose-fructose oxidoreductase domain-containing protein 2 (1-10)

SEQ ID NO: 66543 - RNA, 27 nt, Artificial Sequence
  Striatin-interacting protein 1 (733-741)
augaagaccaugagcgccaucuaccag

SEQ ID NO: 66544 - RNA, 27 nt, Artificial Sequence
  Zinc finger protein 425 (38-46)
augaagaccaacuacgagacacuggac

SEQ ID NO: 66545 - RNA, 27 nt, Artificial Sequence
  Peptidyl-prolyl cis-trans isomerase B (9-17)
augaaggugcugcucgccgcugcacuu

SEQ ID NO: 66546 - RNA, 27 nt, Artificial Sequence
  Protein tyrosine phosphatase type IVA 1 (124-132)
augaaguacgaggacgccgugcaguuc

SEQ ID NO: 66547 - RNA, 33 nt, Artificial Sequence
  Transmembrane protein 50A (102-112)
augcuggccuucggcagccucaucgcuuccaug

SEQ ID NO: 66548 - RNA, 33 nt, Artificial Sequence
  Inactive phospholipase C-like protein 1 (259-269)
augcuggaggacaccagcguggaacucaucaag

SEQ ID NO: 66549 - RNA, 30 nt, Artificial Sequence
  Tyrosine-protein phosphatase non-receptor type 2 (134-143)
augcuguucaaggagaccggcuuuagcgug

SEQ ID NO: 66550 - RNA, 36 nt, Artificial Sequence
  SPARC-related modular calcium-binding protein 1 (1-12)
augcugcccgccagaugcgcuaggcuccuuaccccu

SEQ ID NO: 66551 - RNA, 27 nt, Artificial Sequence
  E3 ubiquitin-protein ligase TRIM22 (248-256)
augcugcaggacgugaucgaugucaug

SEQ ID NO: 66552 - RNA, 27 nt, Artificial Sequence
  Condensin complex subunit 1 (56-64)
augcugcagcacuucgacaccaucuac

SEQ ID NO: 66553 - RNA, 27 nt, Artificial Sequence
  Fibronectin (1-9)
augcugagaggccccgggccuggacuc

SEQ ID NO: 66554 - RNA, 27 nt, Artificial Sequence
  Protein S100-A8 (1-9)
augcugaccgagcucgaaaaggcccuu

SEQ ID NO: 66555 - RNA, 30 nt, Artificial Sequence; identical to SEQ ID NO: 42328
  NACHT, LRR and PYD domains-containing protein 4 (169-178)

SEQ ID NO: 66556 - RNA, 27 nt, Artificial Sequence
  Eukaryotic translation initiation factor 4 gamma 1 (88-96)
augaugauccccagccagauuuccuac

SEQ ID NO: 66557 - RNA, 27 nt, Artificial Sequence
  Olfactory receptor 4K1 (112-120)
augaugcugcucguggccauggcuuac

SEQ ID NO: 66558 - RNA, 30 nt, Artificial Sequence
  BUB3-interacting and GLEBS motif-containing protein ZNF207 (185-194)
augaugcccaugggcgggaugaugccucca

SEQ ID NO: 66559 - RNA, 24 nt, Artificial Sequence
  C-myc promoter-binding protein (618-625)
augaugaccaagacacagauguuc

SEQ ID NO: 66560 - RNA, 24 nt, Artificial Sequence
  Protein SSX4 (1-8)
augaacggcgacgaugccuucgcu

SEQ ID NO: 66561 - RNA, 24 nt, Artificial Sequence
  Putative uncharacterized protein ENSP00000383407 (1-8)
augaaccuguucugcaucagccuc

SEQ ID NO: 66562 - RNA, 33 nt, Artificial Sequence
  Coiled-coil domain-containing protein 127 (1-11)
augaacaaucugaacgaccccccuaauuggaac

SEQ ID NO: 66563 - RNA, 27 nt, Artificial Sequence
  General transcription factor IIF subunit 1 (417-425)
augcccgccgcuaagagacugaggcuc

SEQ ID NO: 66564 - RNA, 27 nt, Artificial Sequence
  Actin-related protein 2/3 complex subunit 3 (1-9)
augcccgccuaccacagcucccugaug

SEQ ID NO: 66565 - RNA, 27 nt, Artificial Sequence
  Kelch domain-containing protein 10 (360-368)
augcccgagccuguguacuuccacugc

SEQ ID NO: 66566 - RNA, 30 nt, Artificial Sequence
  von Willebrand factor A domain-containing protein 5B2 (1-10)
augcccggccuguacugcccuagcuccugg

SEQ ID NO: 66567 - RNA, 27 nt, Artificial Sequence
  Acid ceramidase (1-9)
augcccggcagaagcugcguggcccug

SEQ ID NO: 66568 - RNA, 24 nt, Artificial Sequence
  Eukaryotic translation initiation factor 2 subunit 1 (223-230)
augcccaucaagauuaaccugaua

SEQ ID NO: 66569 - RNA, 36 nt, Artificial Sequence
  Cytochrome c oxidase subunit 8C, mitochondrial (1-12)
augccccugcucagaggcaggugcccugcccggcgc

SEQ ID NO: 66570 - RNA, 36 nt, Artificial Sequence
  Retrotransposon gag domain-containing protein 1 (964-975)
augccccugaugagcgccauggcuuccggcgagaug

SEQ ID NO: 66571 - RNA, 36 nt, Artificial Sequence
  BUB3-interacting and GLEBS motif-containing protein ZNF207 (181-192)
augcccccuggcaugaugccaauggggggaaugaug

SEQ ID NO: 66572 - RNA, 27 nt, Artificial Sequence
  Pre-mRNA-processing-splicing factor 8 (108-116)
augcccugggagcagaucagagacgug

SEQ ID NO: 66573 - RNA, 27 nt, Artificial Sequence
  Protein diaphanous homolog 2 (733-741)
augcccuacgaggacaucagaaacgug

SEQ ID NO: 66574 - RNA, 27 nt, Artificial Sequence
  Nuclear receptor coactivator 2 (1151-1159)
augcaggaccccaacuuccacaccaug

SEQ ID NO: 66575 - RNA, 27 nt, Artificial Sequence
  Heterogeneous nuclear ribonucleoprotein H (352-360)
augcagcacagauacguggagcuguuc

SEQ ID NO: 66576 - RNA, 27 nt, Artificial Sequence
  Myosin-7 (77-85)
augcagcaaaaccccccuaaguucgac

SEQ ID NO: 66577 - RNA, 27 nt, Artificial Sequence
  Laminin subunit alpha-2 (1349-1357)
augagacagagcaggaucuccgagauu

SEQ ID NO: 66578 - RNA, 30 nt, Artificial Sequence
  Toll-like receptor 3 (1-10)
augagacagacccugcccugcaucuacuuc

SEQ ID NO: 66579 - RNA, 24 nt, Artificial Sequence
  Transmembrane channel-like protein 2 (170-177)
augagaagcaagcccuggccuaug

SEQ ID NO: 66580 - RNA, 27 nt, Artificial Sequence
  Clathrin coat assembly protein AP180 (156-164)
augagaaccauggcccccgagaagcug

SEQ ID NO: 66581 - RNA, 27 nt, Artificial Sequence
  Glucose-6-phosphate translocase (266-274)
augagcgcccuggaggugggcgggcuc

SEQ ID NO: 66582 - RNA, 24 nt, Artificial Sequence
  RING finger protein 148 (1-8)
augagcuuccugagaaucaccccc

SEQ ID NO: 66583 - RNA, 27 nt, Artificial Sequence
  Nesprin-1 (4697-4705)
augagcaaggugcccaccgaccuggcc

SEQ ID NO: 66584 - RNA, 24 nt, Artificial Sequence
  Zinc finger protein ZFPM2 (1-8)
augagcagaaggaagcaguccaaa

SEQ ID NO: 66585 - RNA, 27 nt, Artificial Sequence
  Cerebral dopamine neurotrophic factor (103-111)
augagcgugcacaugcccgccaugaag

SEQ ID NO: 66586 - RNA, 27 nt, Artificial Sequence
  Heat shock protein 105 kDa (1-9)
augagcguggucggccuggacguuggg

SEQ ID NO: 66587 - RNA, 27 nt, Artificial Sequence
  Solute carrier family 35 member E2B (144-152)
augaccaugcuguucgugggccucaug

SEQ ID NO: 66588 - RNA, 27 nt, Artificial Sequence
  Integrin beta-7 (1-9)
augguggcccugcccaugguccucguu

SEQ ID NO: 66589 - RNA, 30 nt, Artificial Sequence
  Testis- and ovary-specific PAZ domain-containing protein 1 (583-592)
auggugaucaaggagcccauuauaaaagac

SEQ ID NO: 66590 - RNA, 24 nt, Artificial Sequence
  Transmembrane and coiled-coil domain-containing protein 1 (85-92)
auggugagaaugaagagcauguuc

SEQ ID NO: 66591 - RNA, 24 nt, Artificial Sequence
  Vomeronasal type-1 receptor 3 (279-286)
auggugagccccuucguccugaug

SEQ ID NO: 66592 - RNA, 27 nt, Artificial Sequence
  Receptor expression-enhancing protein 2 (1-9)
auggugagcuggaucauuuccagacug

SEQ ID NO: 66593 - RNA, 27 nt, Artificial Sequence
  Secretogranin-1 (32-40)
auggugaccagaugcaucauugagguc

SEQ ID NO: 66594 - RNA, 30 nt, Artificial Sequence
  Protocadherin-19 (125-134)
aacgcccccagcuucccugcugcacagauc

SEQ ID NO: 66595 - RNA, 27 nt, Artificial Sequence
  Exportin-6 (750-758)
aaccacgccagccugaucuccgcucuc

SEQ ID NO: 66596 - RNA, 27 nt, Artificial Sequence
  Olfactomedin-like protein 2B (387-395)
aaccacgccagcgugggccccacccug

SEQ ID NO: 66597 - RNA, 27 nt, Artificial Sequence
  Serine-protein kinase ATM (1801-1809)
aaccacgacaucuggauuaagacccug

SEQ ID NO: 66598 - RNA, 36 nt, Artificial Sequence
  Histone-binding protein RBBP4 (122-133)
aaccacgagggcgaagugaauagagccagguacaug

SEQ ID NO: 66599 - RNA, 27 nt, Artificial Sequence
  WD repeat-containing protein 6 (772-780)
aaccacaucagcuccgugagagccguc

SEQ ID NO: 66600 - RNA, 27 nt, Artificial Sequence
  Integrator complex subunit 3 (462-470)
aaccacaucguggagaagagaguccug

SEQ ID NO: 66601 - RNA, 27 nt, Artificial Sequence
  Protein RMD5 homolog A (226-234)
aaccaccagaaggacauccaagugcug

SEQ ID NO: 66602 - RNA, 27 nt, Artificial Sequence
  Protein dopey-2 (223-231)
aaccaccagcugaccgugaagagccuc

SEQ ID NO: 66603 - RNA, 27 nt, Artificial Sequence
  Protein FAM193A (991-999)
aaccacagcgagcccagaccuggccug

SEQ ID NO: 66604 - RNA, 27 nt, Artificial Sequence
  Myb-binding protein 1A (554-562)
aaccacagccauaaugugaccacaguc

SEQ ID NO: 66605 - RNA, 27 nt, Artificial Sequence
  E3 ubiquitin-protein ligase RNF19A (822-830)
aaccacagccaucagaccauggagcug

SEQ ID NO: 66606 - RNA, 33 nt, Artificial Sequence
  Vesicle transport protein SFT2B (73-83)
aacaucgccagcauuggcuccaccauauuccug

SEQ ID NO: 66607 - RNA, 27 nt, Artificial Sequence
  Bardet-Biedl syndrome 4 protein (82-90)
aacauccaggagagccuggaacucuuc

SEQ ID NO: 66608 - RNA, 27 nt, Artificial Sequence
  V-type proton ATPase 116 kDa subunit a isoform 3 (810-818)
aacaaguucuacagcggcaccggguau

SEQ ID NO: 66609 - RNA, 27 nt, Artificial Sequence
  WD repeat-containing protein 82 (83-91)
aacaagaucgacgauaccauuagauac

SEQ ID NO: 66610 - RNA, 27 nt, Artificial Sequence
  C-X-C chemokine receptor type 4 (37-45)
aacaagaucuuccugcccaccauuuac

SEQ ID NO: 66611 - RNA, 36 nt, Artificial Sequence
  Sialic acid-binding Ig-like lectin 9 (225-236)
aacaagaccgugcaccugaaugucagcuaccccccu

SEQ ID NO: 66612 - RNA, 27 nt, Artificial Sequence
  Zinc finger and BTB domain-containing protein 38 (494-502)
aacaagguguucgcccuggcugaguac

SEQ ID NO: 66613 - RNA, 27 nt, Artificial Sequence
  Probable ubiquitin carboxyl-terminal hydrolase FAF-X (359-367)
aacaaggugaucagcuccgucucuuac

SEQ ID NO: 66614 - RNA, 27 nt, Artificial Sequence
  Monocarboxylate transporter 1 (81-89)
aacaaguacggcagcagaaucgugaug

SEQ ID NO: 66615 - RNA, 27 nt, Artificial Sequence
  Bifunctional glutamate/proline-tRNA ligase (369-377)
aacaaguacaauguguaucccaccuac

SEQ ID NO: 66616 - RNA, 33 nt, Artificial Sequence
  60S ribosomal protein L7 (146-156)
aaccugaagagcgugaaugagcucaucuacaaa

SEQ ID NO: 66617 - RNA, 27 nt, Artificial Sequence
  Protein MMS22-like (862-870)
aaccugagcgaggugaaguccaucuuc

SEQ ID NO: 66618 - RNA, 30 nt, Artificial Sequence
  Leucine-rich repeat and calponin homology domain-containing protein 2 (140-149)
aaccuguaccacaauugcaucaagaccauu

SEQ ID NO: 66619 - RNA, 27 nt, Artificial Sequence
  Lysine-specific histone demethylase 1A (492-500)
aaccuguacaaggcccccauccuccuu

SEQ ID NO: 66620 - RNA, 24 nt, Artificial Sequence
  Dynein regulatory complex protein 1 (2-9)
aaccccccuggcagccuggaggcc

SEQ ID NO: 66621 - RNA, 27 nt, Artificial Sequence
  F-box only protein 8 (11-19)
aaccagcaacugcagcaggagggcuac

SEQ ID NO: 66622 - RNA, 27 nt, Artificial Sequence
  Serine/arginine repetitive matrix protein 2 (1399-1407)
aaccagagcaucuccucucccgugcug

SEQ ID NO: 66623 - RNA, 27 nt, Artificial Sequence
  COP9 signalosome complex subunit 2 (34-42)
aaccaguacuauaauagcaaggcccug

SEQ ID NO: 66624 - RNA, 30 nt, Artificial Sequence
  Gamma-aminobutyric acid receptor subunit delta (246-255)
aacagaggcguguacaucauucagagcuau

SEQ ID NO: 66625 - RNA, 33 nt, Artificial Sequence
  Anaphase-promoting complex subunit CDC26 (75-85)
aacagaagcucccaguucggcucucuggaguuu

SEQ ID NO: 66626 - RNA, 27 nt, Artificial Sequence
  Ubiquitin-like modifier-activating enzyme 1 (449-457)
aacagauacgacggccagguggccguc

SEQ ID NO: 66627 - RNA, 27 nt, Artificial Sequence
  Small G protein signaling modulator 3 (329-337)
aacagcgccuccaucuucaauacccug

SEQ ID NO: 66628 - RNA, 24 nt, Artificial Sequence
  Nuclear transcription factor Y subunit alpha (232-239)
aacagcggcgggauggugaugaug

SEQ ID NO: 66629 - RNA, 27 nt, Artificial Sequence
  Unconventional myosin-XV (3472-3480)
aacagcuccuaccccuauguggagauc

SEQ ID NO: 66630 - RNA, 27 nt, Artificial Sequence
  Junction plakoglobin (584-592)
aacaccaucccccuguucgugcagcuc

SEQ ID NO: 66631 - RNA, 27 nt, Artificial Sequence
  Olfactory receptor 5D18 (7-15)
aacaccagcggcacaacuuucacgcug

SEQ ID NO: 66632 - RNA, 27 nt, Artificial Sequence
  Kinetochore protein Nuf2 (10-18)
aacguggccgagaucgucauucacaua

SEQ ID NO: 66633 - RNA, 30 nt, Artificial Sequence
  Sodium- and chloride-dependentine transporter 2 (288-297)
aacgugaucauuugcuacacccuguucuau

SEQ ID NO: 66634 - RNA, 36 nt, Artificial Sequence
  Alpha-enolase (118-129)
aacgugaucaauggcgggagccacgccggaaacaag

SEQ ID NO: 66635 - RNA, 27 nt, Artificial Sequence
  Clustered mitochondria protein homolog (96-104)
aacgugcuggaccacuucagcgagcuc

SEQ ID NO: 66636 - RNA, 30 nt, Artificial Sequence
  Myosin regulatory light chain 12B (155-164)
aacuacaucgaguucaccagaauucugaag

SEQ ID NO: 66637 - RNA, 24 nt, Artificial Sequence
  Protein LYRIC (498-505)
cccgccgaggugcuggucaagaac

SEQ ID NO: 66638 - RNA, 30 nt, Artificial Sequence
  Peroxiredoxin-4 (260-269)
cccgccggcaagcugaaauacuucgacaag

SEQ ID NO: 66639 - RNA, 27 nt, Artificial Sequence
  Leucine-rich repeat-containing protein 26 (63-71)
cccgccgugccuccaggccugagccuc

SEQ ID NO: 66640 - RNA, 27 nt, Artificial Sequence
  StAR-related lipid transfer protein 13 (243-251)
cccuuccacccuaagaacgagaaacca

SEQ ID NO: 66641 - RNA, 30 nt, Artificial Sequence
  Dystrophia myotonica WD repeat-containing protein (517-526)
cccuucagcaucggcagauuugccacccug

SEQ ID NO: 66642 - RNA, 30 nt, Artificial Sequence
  B-lymphocyte antigen CD19 (99-108)
cccggcccuccaagcgagaaggccuggcag

SEQ ID NO: 66643 - RNA, 27 nt, Artificial Sequence
  Zinc finger protein 853 (438-446)
cccggcuacguggucguucaggagcug

SEQ ID NO: 66644 - RNA, 36 nt, Artificial Sequence
  DNA replication licensing factor MCM6 (505-516)
cccaucagcggccacuacgacagauccaagucucug

SEQ ID NO: 66645 - RNA, 30 nt, Artificial Sequence
  UPF0428 protein CXorf56 (2-11)
cccaagguggucagcagauccguugugugc

SEQ ID NO: 66646 - RNA, 27 nt, Artificial Sequence
  Integrin beta-6 (709-717)
cccaugaucaugcugggcgugagccuc

SEQ ID NO: 66647 - RNA, 30 nt, Artificial Sequence
  AF4/FMR2 family member 2 (271-280)
cccccuggccuguacugcaagaccagcaug

SEQ ID NO: 66648 - RNA, 27 nt, Artificial Sequence
  Basic salivary proline-rich protein 4 (50-58)
cccccuccaccgcccggcaagccucag

SEQ ID NO: 66649 - RNA, 27 nt, Artificial Sequence
  RAS guanyl-releasing protein 2 (400-408)
cccccuccaagaccgcccgugcuggag

SEQ ID NO: 66650 - RNA, 27 nt, Artificial Sequence
  Coiled-coil domain-containing protein 8 (89-97)
cccccuagacugguggucggcaccuac

SEQ ID NO: 66651 - RNA, 36 nt, Artificial Sequence
  RNA-binding protein FUS (344-355)
cccccuagcgccaaggcugcaaucgacugguucgau

SEQ ID NO: 66652 - RNA, 24 nt, Artificial Sequence
  Cornulin (2-9)
ccccagcugcuccaaaacaucaau

SEQ ID NO: 66653 - RNA, 27 nt, Artificial Sequence
  Sialate O-acetylesterase (378-386)
cccagagacaagcagaccguggccuac

SEQ ID NO: 66654 - RNA, 27 nt, Artificial Sequence
  Metastasis-associated in colon cancer protein 1 (382-390)
cccagcuucaccgugguccugacaguu

SEQ ID NO: 66655 - RNA, 33 nt, Artificial Sequence
  ATP synthase F(0) complex subunit B1, mitochondrial (43-53)
cccgugccuccacugccggaguacggcgggaag

SEQ ID NO: 66656 - RNA, 27 nt, Artificial Sequence
  MAP7 domain-containing protein 3 (645-653)
caggccgaggaccaccugaagcucaaa

SEQ ID NO: 66657 - RNA, 27 nt, Artificial Sequence
  26S proteasome non-ATPase regulatory subunit 12 (265-273)
caggcccugaagagcgugguccucuac

SEQ ID NO: 66658 - RNA, 27 nt, Artificial Sequence
  Bromodomain-containing protein 8 (465-473)
caggagagagacaagcccgugccucug

SEQ ID NO: 66659 - RNA, 30 nt, Artificial Sequence
  Prolyl endopeptidase (268-277)
caggagagcuccggcaucgccgggauucug

SEQ ID NO: 66660 - RNA, 27 nt, Artificial Sequence
  Mitochondrial import inner membrane translocase subunit Tim17-B (140-148)
caguucagaaacgcccccccuuuucug

SEQ ID NO: 66661 - RNA, 27 nt, Artificial Sequence
  60S acidic ribosomal protein P2 (57-65)
cagggcaucgggaagcuggccagcgug

SEQ ID NO: 66662 - RNA, 33 nt, Artificial Sequence
  Salivary acidic proline-rich phosphoprotein 1/2 (82-92)
cagggccccccuccaccgcaagggaagccccag

SEQ ID NO: 66663 - RNA, 27 nt, Artificial Sequence
  Protocadherin Fat 4 (557-565)
cagggcgugcaccccaaggucagcuac

SEQ ID NO: 66664 - RNA, 27 nt, Artificial Sequence
  Transmembrane protein 205 (75-83)
cagcacgccugggcucaacugaccuuc

SEQ ID NO: 66665 - RNA, 27 nt, Artificial Sequence
  MICOS complex subunit MIC10 (59-67)
cagcacgacuuccaagcccccuaccug

SEQ ID NO: 66666 - RNA, 24 nt, Artificial Sequence
  CX3C chemokine receptor 1 (144-151)
cagcacggcgugaccaucagccug

SEQ ID NO: 66667 - RNA, 27 nt, Artificial Sequence
  60S ribosomal protein L8 (217-225)
cagcacaucggcaagcccagcaccauu

SEQ ID NO: 66668 - RNA, 27 nt, Artificial Sequence
  Inositol polyphosphate 5-phosphatase K (105-113)
cagcaccugcccuacauccaaauucuc

SEQ ID NO: 66669 - RNA, 27 nt, Artificial Sequence
  Torsin-3A (137-145)
cagcaccuggugcaacagcucguccuu

SEQ ID NO: 66670 - RNA, 33 nt, Artificial Sequence
  Forkhead box protein J3 (593-603)
cagcacaugaugcccagccaagccuuccagaug

SEQ ID NO: 66671 - RNA, 27 nt, Artificial Sequence
  PAX-interacting protein 1 (506-514)
cagcaccaacugcagcagcagcaacuc

SEQ ID NO: 66672 - RNA, 27 nt, Artificial Sequence
  Dual specificity tyrosine-phosphorylation-regulated kinase 1A (475-483)
cagcacagcuucuuuaagaaaaccgcc

SEQ ID NO: 66673 - RNA, 27 nt, Artificial Sequence
  G protein-regulated inducer of neurite outgrowth 3 (749-757)
cagcacagcguguuccaauccaugcug

SEQ ID NO: 66674 - RNA, 27 nt, Artificial Sequence
  Histone-lysine N-methyltransferase 2E (207-215)
cagcacacccccacaagcaucacucug

SEQ ID NO: 66675 - RNA, 27 nt, Artificial Sequence
  Class A basic helix-loop-helix protein 15 (151-159)
cagcacuaccaacagcagcagcaagug

SEQ ID NO: 66676 - RNA, 27 nt, Artificial Sequence
  Glutathione peroxidase 7 (62-70)
cagcacuacagagcccugcaacagcuc

SEQ ID NO: 66677 - RNA, 27 nt, Artificial Sequence
  N-terminal EF-hand calcium-binding protein 2 (176-184)
cagauccaaagccugcucuccucugug

SEQ ID NO: 66678 - RNA, 30 nt, Artificial Sequence
  Ig heavy chain V-II region MCE (1-10)
cagaucacccugaaggagagcggccccaca

SEQ ID NO: 66679 - RNA, 27 nt, Artificial Sequence
  CDGSH iron-sulfur domain-containing protein 3, mitochondrial (119-127)
cagaaggccgaggugggcagcccccug

SEQ ID NO: 66680 - RNA, 27 nt, Artificial Sequence
  Splicing factor 3B subunit 3 (1087-1095)
cagaaggccgaggugaucaugaacuac

SEQ ID NO: 66681 - RNA, 27 nt, Artificial Sequence
  Apolipoprotein L6 (219-227)
cagaaggccuucgcuggcaccacacug

SEQ ID NO: 66682 - RNA, 30 nt, Artificial Sequence
  Synapsin-2 (317-326)
cagaagaucggcaacaauuacaaagccuau

SEQ ID NO: 66683 - RNA, 27 nt, Artificial Sequence
  E3 ubiquitin-protein ligase DTX3L (683-691)
cagaagcugaucuucaccgugggcuac

SEQ ID NO: 66684 - RNA, 36 nt, Artificial Sequence
  Very-long-chain enoyl-CoA reductase (66-77)
cagaagcugcccgugggcaccacagccacucucuac

SEQ ID NO: 66685 - RNA, 27 nt, Artificial Sequence
  ATP-dependent DNA helicase Q1 (438-446)
cagaagcuguacgagauggugagcuau

SEQ ID NO: 66686 - RNA, 30 nt, Artificial Sequence
  Melanoma inhibitory activity protein 3 (1518-1527)
cagaagguggagauccugaacgaacucuac

SEQ ID NO: 66687 - RNA, 27 nt, Artificial Sequence
  Clathrin interactor 1 (130-138)
cagaaggugaaagagcuggucgaauuc

SEQ ID NO: 66688 - RNA, 27 nt, Artificial Sequence
  Cell growth-regulating nucleolar protein (56-64)
cagaaguacggcgggaaaggauaugag

SEQ ID NO: 66689 - RNA, 33 nt, Artificial Sequence
  Pre-mRNA-processing-splicing factor 8 (573-583)
cagcuggccgacggccuccaauacaucuucgcu

SEQ ID NO: 66690 - RNA, 27 nt, Artificial Sequence
  Chloride transport protein 6 (651-659)
cagcugaucagcaacaauauuaaguuc

SEQ ID NO: 66691 - RNA, 27 nt, Artificial Sequence
  Probable helicase senataxin (307-315)
cagcugauggaccccaucguggccuuc

SEQ ID NO: 66692 - RNA, 27 nt, Artificial Sequence
  BRCA1-associated protein (505-513)
cagaacaagcugaaagaggaagagaga

SEQ ID NO: 66693 - RNA, 27 nt, Artificial Sequence
  dCTP pyrophosphatase 1 (52-60)
cagcccagaaaccugcuccuugcccug

SEQ ID NO: 66694 - RNA, 27 nt, Artificial Sequence
  E3 ubiquitin-protein ligase TRIM37 (638-646)
cagcccagaccuccagccagccugcuc

SEQ ID NO: 66695 - RNA, 36 nt, Artificial Sequence
  Salivary acidic proline-rich phosphoprotein 1/2 (81-92)
cagcaaggccccccuccaccgcaggggaagccccag

SEQ ID NO: 66696 - RNA, 27 nt, Artificial Sequence
  GTP-binding protein 1 (587-595)
cagcaaaucaagaugcagagcaccaaa

SEQ ID NO: 66697 - RNA, 27 nt, Artificial Sequence
  Titin (1700-1708)
cagcaaaagcccuucuuuaaaaagaaa

SEQ ID NO: 66698 - RNA, 27 nt, Artificial Sequence
  Histamine H1 receptor (130-138)
cagcaaccccugagauaccucaaguau

SEQ ID NO: 66699 - RNA, 27 nt, Artificial Sequence
  5-oxoprolinase (164-172)
cagcaacccguggaccugggcgcccuc

SEQ ID NO: 66700 - RNA, 27 nt, Artificial Sequence
  Protein sel-1 homolog 3 (692-700)
cagcaaagacuggcccagaugcucuuc

SEQ ID NO: 66701 - RNA, 27 nt, Artificial Sequence
  60S ribosomal protein L3 (203-211)
cagcaagugcccgucaaccagguuuuc

SEQ ID NO: 66702 - RNA, 27 nt, Artificial Sequence
  Pyruvate dehydrogenase protein X component, mitochondrial (463-471)
cagagacaacugaucaccgugacaaug

SEQ ID NO: 66703 - RNA, 27 nt, Artificial Sequence
  E3 ubiquitin-protein ligase RBBP6 (887-895)
cagagccacagauccaggaacaucggc

SEQ ID NO: 66704 - RNA, 27 nt, Artificial Sequence
  Mismatch repair endonuclease PMS2 (237-245)
cagagccugauccccuucgugcaacuc

SEQ ID NO: 66705 - RNA, 27 nt, Artificial Sequence
  Myosin-7 (419-427)
caggugaucuacgccaccggcgcucug

SEQ ID NO: 66706 - RNA, 30 nt, Artificial Sequence
  CD160 antigen (101-110)
caggugaccccccugcacagcggcacauac

SEQ ID NO: 66707 - RNA, 27 nt, Artificial Sequence
  tRNA (adenine(58)-N(1))-methyltransferase non-catalytic subunit TRM6 (198-206)
agagccggcaacaagaugaucgugaug

SEQ ID NO: 66708 - RNA, 27 nt, Artificial Sequence
  Nucleolar GTP-binding protein 2 (400-408)
agagccaagcccgaguacaucagcaaa

SEQ ID NO: 66709 - RNA, 30 nt, Artificial Sequence
  Solute carrier family 15 member 3 (102-111)
agagccguggcucugagccuccuucuguac

SEQ ID NO: 66710 - RNA, 27 nt, Artificial Sequence
  tRNA dimethylallyltransferase, mitochondrial (8-16)
agagccgugcccgucggcagcgggcug

SEQ ID NO: 66711 - RNA, 30 nt, Artificial Sequence
  Translocating chain-associated membrane protein 1 (154-163)
agagccuacccccacaaccugaugaccuuc

SEQ ID NO: 66712 - RNA, 33 nt, Artificial Sequence
  Phosphoribosyl pyrophosphate synthase-associated protein 1 (68-78)
agagacgugaacaccgccgucauggagcugcuc

SEQ ID NO: 66713 - RNA, 27 nt, Artificial Sequence
  Voltage-dependent L-type calcium channel subunit alpha-1D (1825-1833)
agagaggaccccgaaauccacggcuac

SEQ ID NO: 66714 - RNA, 30 nt, Artificial Sequence
  Inner nuclear membrane protein Man1 (459-468)
agagaggaagugagccccaccggcuccuuc

SEQ ID NO: 66715 - RNA, 27 nt, Artificial Sequence
  Gamma-glutamyltranspeptidase 1 (107-115)
agagagguggcccccaggcuggcuuuc

SEQ ID NO: 66716 - RNA, 27 nt, Artificial Sequence
  Ras-related protein Rab-30 (70-78)
agauucaggagcaucacccaguccuac

SEQ ID NO: 66717 - RNA, 27 nt, Artificial Sequence
  UHRF1-binding protein 1-like (15-23)
agauucaccaagaaccugagccccgac

SEQ ID NO: 66718 - RNA, 27 nt, Artificial Sequence
  DNA-directed RNA polymerase I subunit RPA2 (766-774)
agaggcuucgcccacgggagcguguac

SEQ ID NO: 66719 - RNA, 33 nt, Artificial Sequence
  Endothelial differentiation-related factor 1 (133-143)
agaggcaaggacaucgggaaacccauugagaag

SEQ ID NO: 66720 - RNA, 27 nt, Artificial Sequence
  NADH dehydrogenase (ubiquinone) iron-sulfur protein 2, mitochondrial (118-126)
agaggcaccgagaagcugaucgaauac

SEQ ID NO: 66721 - RNA, 27 nt, Artificial Sequence
  Membrane-associated tyrosine- and threonine-specific cdc2-inhibitory kinase (33-41)
agacacgccgagcccggcuucagccug

SEQ ID NO: 66722 - RNA, 27 nt, Artificial Sequence
  Colorectal mutant cancer protein (800-808)
agacacgagacccaggugaggaugcug

SEQ ID NO: 66723 - RNA, 30 nt, Artificial Sequence
  Beta-1,4-galactosyltransferase 6 (247-256)
agacacuucgccgcuaagcuggacaaauac

SEQ ID NO: 66724 - RNA, 27 nt, Artificial Sequence
  Exophilin-5 (1818-1826)
agacacuucagcgaguccaccucuauc

SEQ ID NO: 66725 - RNA, 27 nt, Artificial Sequence
  PDZ domain-containing protein GIPC1 (190-198)
agacacuacgagguggccaggcugcuc

SEQ ID NO: 66726 - RNA, 30 nt, Artificial Sequence
  26S proteasome non-ATPase regulatory subunit 14 (198-207)
agacacuacuauagcaucaccauuaacuac

SEQ ID NO: 66727 - RNA, 27 nt, Artificial Sequence
  Ubiquitin carboxyl-terminal hydrolase 40 (780-788)
agaaucaaggccauuaaagagcugaag

SEQ ID NO: 66728 - RNA, 30 nt, Artificial Sequence
  ADP-ribosylation factor-like protein 2-binding protein (84-93)
agaauccccgaguucaacauggccgcuuuu

SEQ ID NO: 66729 - RNA, 27 nt, Artificial Sequence
  U5 small nuclear ribonucleoprotein 200 kDa helicase (234-242)
agaauccagagcaagcuguacagggcc

SEQ ID NO: 66730 - RNA, 30 nt, Artificial Sequence
  60S ribosomal protein L4 (268-277)
agaaaggccgcuagccugaaauccaacuac

SEQ ID NO: 66731 - RNA, 27 nt, Artificial Sequence
  Selenoprotein H (8-16)
agaaaggccgaggcugcaguggucgcc

SEQ ID NO: 66732 - RNA, 27 nt, Artificial Sequence
  Polyadenylate-binding protein 4 (374-382)
agaaaggcccaccugaccaaccaguac

SEQ ID NO: 66733 - RNA, 27 nt, Artificial Sequence
  Sterol regulatory element-binding protein 2 (371-379)
agaaaggccaucgacuacauuaaauau

SEQ ID NO: 66734 - RNA, 27 nt, Artificial Sequence
  DNA-directed RNA polymerase II subunit RPB1 (1375-1383)
agaaaggcccuggagagggaacucuac

SEQ ID NO: 66735 - RNA, 30 nt, Artificial Sequence
  Mid1-interacting protein 1 (163-172)
agaaaggccaacauccugaccaauagguac

SEQ ID NO: 66736 - RNA, 33 nt, Artificial Sequence
  26S proteasome non-ATPase regulatory subunit 3 (314-324)
agaaaggccccccagcacaccgcugugggcuuc

SEQ ID NO: 66737 - RNA, 27 nt, Artificial Sequence
  60S ribosomal protein L23 (90-98)
agaaaggacggcguguuccuguacuuu

SEQ ID NO: 66738 - RNA, 27 nt, Artificial Sequence
  Eukaryotic translation initiation factor 5B (376-384)
agaaaggaggaagagaggcuggaacag

SEQ ID NO: 66739 - RNA, 27 nt, Artificial Sequence
  Uridine-cytidine kinase 2 (119-127)
agaaaggaggaaaccgugacagucuac

SEQ ID NO: 66740 - RNA, 30 nt, Artificial Sequence
  Histone H2B type 1-K (34-43)
agaaaggagagcuacuccguguaugucuac

SEQ ID NO: 66741 - RNA, 30 nt, Artificial Sequence
  MOB kinase activator 3A (20-29)
agaaaguucgagcccggcacccagagguuu

SEQ ID NO: 66742 - RNA, 27 nt, Artificial Sequence
  Group XV phospholipase A2 (296-304)
agaaaguucuuucaggacaucggcuuc

SEQ ID NO: 66743 - RNA, 33 nt, Artificial Sequence
  General transcription factor II-I (878-888)
agaaaguucggcgaggccaucgggaugggauuu

SEQ ID NO: 66744 - RNA, 27 nt, Artificial Sequence
  Ribosome biogenesis protein TSR3 homolog (186-194)
agaaaguucaaauggggcaagggguuu

SEQ ID NO: 66745 - RNA, 33 nt, Artificial Sequence
  Elongation factor 1-gamma (51-61)
agaaaguuccccgccggcaaagugccugcuuuu

SEQ ID NO: 66746 - RNA, 27 nt, Artificial Sequence
  Actin filament-associated protein 1-like 2 (481-489)
agaaaguucagcgagcccaacaccuac

SEQ ID NO: 66747 - RNA, 27 nt, Artificial Sequence
  Casein kinase I isoform delta (98-106)
agaaaguucagccugaaaaccgugcuc

SEQ ID NO: 66748 - RNA, 27 nt, Artificial Sequence
  60S ribosomal protein L35 (70-78)
agaaaguucuacaaaggcaagaaauau

SEQ ID NO: 66749 - RNA, 27 nt, Artificial Sequence
  Eukaryotic peptide chain release factor GTP-binding subunit ERF3B (315-323)
agaaagggcgaguucgaaaccggguuu

SEQ ID NO: 66750 - RNA, 30 nt, Artificial Sequence
  Cytochrome c oxidase subunit 5A, mitochondrial (71-80)
agaaagggcaucaacacccuggugacauac

SEQ ID NO: 66751 - RNA, 27 nt, Artificial Sequence
  Heat shock protein HSP 90-alpha (512-520)
agaaagcacggccuggaggugaucuac

SEQ ID NO: 66752 - RNA, 30 nt, Artificial Sequence
  Nardilysin (545-554)
agaaagaucgaggacaacgaauuccacuac

SEQ ID NO: 66753 - RNA, 30 nt, Artificial Sequence
  Lamin-B1 (473-482)
agaaagaucggcgacaccagcguguccuac

SEQ ID NO: 66754 - RNA, 27 nt, Artificial Sequence
  Mediator of RNA polymerase II transcription subunit 23 (123-131)
agaaagaucauuggcgggguggacuac

SEQ ID NO: 66755 - RNA, 27 nt, Artificial Sequence
  Immunoglobulin superfamily member 10 (1201-1209)
agaaagauccccuggcagcaaaacuuc

SEQ ID NO: 66756 - RNA, 27 nt, Artificial Sequence
  Ubiquitin carboxyl-terminal hydrolase 22 (420-428)
agaaagaucaccacauacgugagcuuc

SEQ ID NO: 66757 - RNA, 27 nt, Artificial Sequence
  60S ribosomal protein L10 (38-46)
agaaagaaagccaagguggacgaguuc

SEQ ID NO: 66758 - RNA, 27 nt, Artificial Sequence
  Cytochrome c oxidase subunit 6C (45-53)
agaaagaaagccuacgcugacuucuau

SEQ ID NO: 66759 - RNA, 27 nt, Artificial Sequence
  Protein ENL (20-28)
agaaagaaacccaccacagagggcuuc

SEQ ID NO: 66760 - RNA, 30 nt, Artificial Sequence
  60S ribosomal protein L15 (12-21)
agaaagaaacagagcgacgugaugagguuc

SEQ ID NO: 66761 - RNA, 27 nt, Artificial Sequence
  Cytochrome c1, heme protein, mitochondrial (317-325)
agaaagcuggccuacaggcccccuaaa

SEQ ID NO: 66762 - RNA, 33 nt, Artificial Sequence
  CD2 antigen cytoplasmic tail-binding protein 2 (320-330)
agaaagcuggaccccccuggcgggcaguucuac

SEQ ID NO: 66763 - RNA, 27 nt, Artificial Sequence
  Protein O-GlcNAcase (156-164)
agaaagcuggaccaggugagccaauuc

SEQ ID NO: 66764 - RNA, 27 nt, Artificial Sequence
  Neurabin-2 (179-187)
agaaagcuggacguggucguuagguuc

SEQ ID NO: 66765 - RNA, 33 nt, Artificial Sequence
  Prohibitin (239-249)
agaaagcuggaggccgcugaagacaucgcauac

SEQ ID NO: 66766 - RNA, 27 nt, Artificial Sequence
  Thyroid transcription factor 1-associated protein 26 (59-67)
agaaagcugaaaauccagcaaagcuac

SEQ ID NO: 66767 - RNA, 27 nt, Artificial Sequence
  Pre-mRNA-processing factor 19 (422-430)
agaaagcugaaaaacuucaagacccuc

SEQ ID NO: 66768 - RNA, 27 nt, Artificial Sequence
  Toll-like receptor 9 (337-345)
agaaagcugaaccucagcuucaauuac

SEQ ID NO: 66769 - RNA, 30 nt, Artificial Sequence
  von Willebrand factor A domain-containing protein 9 (424-433)
agaaagcugcccgagaaaacccagacauuc

SEQ ID NO: 66770 - RNA, 27 nt, Artificial Sequence
  UAP56-interacting factor (165-173)
agaaagaacaauauccccgccaacuuc

SEQ ID NO: 66771 - RNA, 30 nt, Artificial Sequence
  Activating signal cointegrator 1 complex subunit 1 (17-26)
agaaagaaccccgugcaggagcaaaccuac

SEQ ID NO: 66772 - RNA, 27 nt, Artificial Sequence
  5'-AMP-activated protein kinase catalytic subunit alpha-1 (447-455)
agaaagaaccccgugaccagcacauac

SEQ ID NO: 66773 - RNA, 30 nt, Artificial Sequence
  Nuclear pore complex protein Nup98-Nup96 (1206-1215)
agaaagcccgacgaggauaugaaacuguac

SEQ ID NO: 66774 - RNA, 30 nt, Artificial Sequence
  Ubiquitin carboxyl-terminal hydrolase 47 (700-709)
agaaagcccgaccagguguuccaaagcuac

SEQ ID NO: 66775 - RNA, 27 nt, Artificial Sequence
  Transcriptional regulator ATRX (81-89)
agaaagcccagcaucgugaccaaauac

SEQ ID NO: 66776 - RNA, 27 nt, Artificial Sequence
  Bifunctional polynucleotide phosphatase/kinase (483-491)
agaaagcaguucgaggcccccacccug

SEQ ID NO: 66777 - RNA, 27 nt, Artificial Sequence
  DNA-dependent protein kinase catalytic subunit (70-78)
agaaagagccugaacuccaucgaguuc

SEQ ID NO: 66778 - RNA, 27 nt, Artificial Sequence
  Serine/threonine-protein phosphatase 6 regulatory subunit 1 (134-142)
agaaagaccgaccagcuggugagcuuc

SEQ ID NO: 66779 - RNA, 33 nt, Artificial Sequence
  Histone H4 (79-89)
agaaagaccgugacagccauggacgucguuuac

SEQ ID NO: 66780 - RNA, 27 nt, Artificial Sequence
  Flap endonuclease 1 (29-37)
agaaagguggccaucgacgcuagcaug

SEQ ID NO: 66781 - RNA, 33 nt, Artificial Sequence
  60S ribosome subunit biogenesis protein NIP7 homolog (154-164)
agaaagguggaccccauggccaucgucguuuuc

SEQ ID NO: 66782 - RNA, 30 nt, Artificial Sequence
  E3 ubiquitin/ISG15 ligase TRIM25 (236-245)
agaaagguggagcagcugcaacaggaauac

SEQ ID NO: 66783 - RNA, 27 nt, Artificial Sequence
  Mitochondrial carrier homolog 2 (287-295)
agaaaggugcccuucggcaaaaccuac

SEQ ID NO: 66784 - RNA, 27 nt, Artificial Sequence
  Fatty acid desaturase 1 (40-48)
agaaagguguacaacaucagcgaguuc

SEQ ID NO: 66785 - RNA, 27 nt, Artificial Sequence
  Glucose-6-phosphate translocase (126-134)
agaaagugguucgagcccagccaguuu

SEQ ID NO: 66786 - RNA, 36 nt, Artificial Sequence
  Heterogeneous nuclear ribonucleoprotein R (145-156)
agaaaguacggcgggcccccuccagacagcguguau

SEQ ID NO: 66787 - RNA, 27 nt, Artificial Sequence
  Serine/threonine-protein phosphatase 4 catalytic subunit (132-140)
agaaaguacggcagcgugaccgucugg

SEQ ID NO: 66788 - RNA, 27 nt, Artificial Sequence
  Vigilin (87-95)
agaaaguacaaagacaugaaccaguuc

SEQ ID NO: 66789 - RNA, 27 nt, Artificial Sequence
  Lysine-specific demethylase 5A (773-781)
agaaaguaccccgagaacgaccuguuc

SEQ ID NO: 66790 - RNA, 27 nt, Artificial Sequence
  Pre-mRNA-processing-splicing factor 8 (217-225)
agaaaguacgugaacggcagcaccuau

SEQ ID NO: 66791 - RNA, 27 nt, Artificial Sequence
  Max-binding protein MNT (295-303)
agacuggccgagcucaagcacgaacuu

SEQ ID NO: 66792 - RNA, 27 nt, Artificial Sequence
  Protein unc-93 homolog B1 (374-382)
agacuggccuaccuccuuguggcuuau

SEQ ID NO: 66793 - RNA, 27 nt, Artificial Sequence
  Nuclear pore complex protein Nup85 (162-170)
agacuggacgaggccaggcagaugcuc

SEQ ID NO: 66794 - RNA, 27 nt, Artificial Sequence
  Acetyl-CoA carboxylase 2 (765-773)
agacugggcgggauccccgugggaguc

SEQ ID NO: 66795 - RNA, 27 nt, Artificial Sequence
  X-ray repair cross-complementing protein 6 (517-525)
agacugggcagccucguggacgaguuc

SEQ ID NO: 66796 - RNA, 27 nt, Artificial Sequence
  N-alpha-acetyltransferase 35, NatC auxiliary subunit (331-339)
agacugaucgacaggauuaagaccgug

SEQ ID NO: 66797 - RNA, 30 nt, Artificial Sequence
  Cyclic GMP-AMP synthase (353-362)
agacugaagcccuucuaccucgugccuaaa

SEQ ID NO: 66798 - RNA, 27 nt, Artificial Sequence
  Myosin light chain kinase 2, skeletal/cardiac muscle (553-561)
agacugaagagccagauccuccuuaaa

SEQ ID NO: 66799 - RNA, 27 nt, Artificial Sequence
  tRNA wybutosine-synthesizing protein 4 (311-319)
agacugagccccguguccccugcccuc

SEQ ID NO: 66800 - RNA, 27 nt, Artificial Sequence
  DnaJ homolog subfamily C member 8 (45-53)
agacugaccaggcccggcagcuccuac

SEQ ID NO: 66801 - RNA, 27 nt, Artificial Sequence
  C-type lectin domain family 4 member F (36-44)
agacuggugcaggccacccccgcuuuc

SEQ ID NO: 66802 - RNA, 27 nt, Artificial Sequence
  Proteasome assembly chaperone 4 (20-28)
agacugugggagcagcucgugcacuuc

SEQ ID NO: 66803 - RNA, 30 nt, Artificial Sequence
  Laminin subunit beta-3 (1125-1134)
agaaugaaggacauggagcuggaacuccuu

SEQ ID NO: 66804 - RNA, 27 nt, Artificial Sequence
  Cytochrome c oxidase assembly protein COX15 homolog (153-161)
agaauguggggcaggcugguggggcuc

SEQ ID NO: 66805 - RNA, 27 nt, Artificial Sequence
  Histone deacetylase complex subunit SAP18 (117-125)
agacccggcuacagggugaaggagauc

SEQ ID NO: 66806 - RNA, 30 nt, Artificial Sequence
  R3H domain-containing protein 2 (2-11)
agacccccugugaccaaggccagcuccuuc

SEQ ID NO: 66807 - RNA, 27 nt, Artificial Sequence
  Short transient receptor potential channel 4-associated protein (31-39)
agacccaggccuggcaacauccugcuc

SEQ ID NO: 66808 - RNA, 27 nt, Artificial Sequence
  Glycogen synthase kinase-3 beta (306-314)
agacccaggaccccuccagaggccauc

SEQ ID NO: 66809 - RNA, 27 nt, Artificial Sequence
  Transcription initiation factor IIB (169-177)
agacaggagggcgugcccaggaccuuc

SEQ ID NO: 66810 - RNA, 30 nt, Artificial Sequence
  Protein FAM46A (224-233)
agacaguucgaguuuagcguggacuccuuc

SEQ ID NO: 66811 - RNA, 27 nt, Artificial Sequence
  Pre-rRNA-processing protein TSR1 homolog (574-582)
agacagggcaccccccugaucgccuuc

SEQ ID NO: 66812 - RNA, 27 nt, Artificial Sequence
  NADH dehydrogenase (ubiquinone) 1 subunit C2 (59-67)
agacagcugcucuacaucaccgccuuc

SEQ ID NO: 66813 - RNA, 27 nt, Artificial Sequence
  Cytochrome b-245 heavy chain (147-155)
agacagaacgagagcuaccugaauuuc

SEQ ID NO: 66814 - RNA, 27 nt, Artificial Sequence
  Rho GTPase-activating protein 4 (492-500)
agacagcccaggccuagcucccaauac

SEQ ID NO: 66815 - RNA, 30 nt, Artificial Sequence
  Protein strawberry notch homolog 1 (79-88)
agacagcaacccccuagcaccacaacuuuc

SEQ ID NO: 66816 - RNA, 27 nt, Artificial Sequence
  Large proline-rich protein BAG6 (780-788)
agaagcuucuuucaccagcauuaccug

SEQ ID NO: 66817 - RNA, 27 nt, Artificial Sequence
  DnaJ homolog subfamily C member 10 (220-228)
agaagcaaggagucccuggugucuuuc

SEQ ID NO: 66818 - RNA, 27 nt, Artificial Sequence
  DNA-dependent protein kinase catalytic subunit (3046-3054)
agaagcaagcugaaacuccuucugcag

SEQ ID NO: 66819 - RNA, 30 nt, Artificial Sequence
  Protein SON (1072-1081)
agaagcaugaugucccccauggccgacagg

SEQ ID NO: 66820 - RNA, 27 nt, Artificial Sequence
  Small nuclear ribonucleoprotein E (28-36)
agaagccagauccaaguguggcuguac

SEQ ID NO: 66821 - RNA, 30 nt, Artificial Sequence
  PHD finger protein 3 (815-824)
agaaccaaguacaucgacgauacagugaaa

SEQ ID NO: 66822 - RNA, 27 nt, Artificial Sequence
  60S ribosomal protein L34 (24-32)
agaacccccggcaacaggaucguguac

SEQ ID NO: 66823 - RNA, 27 nt, Artificial Sequence
  Androglobin (1138-1146)
agaaccagcaagcccgacgccuucauc

SEQ ID NO: 66824 - RNA, 27 nt, Artificial Sequence
  Eukaryotic translation initiation factor 2 subunit 2 (182-190)
agaguguucaacaucaugagggagaag

SEQ ID NO: 66825 - RNA, 27 nt, Artificial Sequence
  Ankyrin repeat domain-containing protein 13C (353-361)
agagugggcaacuuccuggccgacuuu

SEQ ID NO: 66826 - RNA, 27 nt, Artificial Sequence
  Eyes absent homolog 1 (440-448)
agagugaaggagaucuacaacaccuau

SEQ ID NO: 66827 - RNA, 27 nt, Artificial Sequence
  NADH dehydrogenase (ubiquinone) 1 beta subcomplex subunit 5, mitochondrial (150-158)
agagugaaggagcuggaagucaggaaa

SEQ ID NO: 66828 - RNA, 27 nt, Artificial Sequence
  Histone-lysine N-methyltransferase EZH2 (18-26)
agagugaagagcgaguacaugaggcug

SEQ ID NO: 66829 - RNA, 27 nt, Artificial Sequence
  Bystin (257-265)
agagugagggacgaugucgccgaguac

SEQ ID NO: 66830 - RNA, 27 nt, Artificial Sequence
  Ribonucleoside-diphosphate reductase subunit M2 (288-296)
agagugagggagaucauuauaaacgcc

SEQ ID NO: 66831 - RNA, 27 nt, Artificial Sequence
  Leydig cell tumor 10 kDa protein homolog (42-50)
agagugguccagcaacagaagcugaaa

SEQ ID NO: 66832 - RNA, 30 nt, Artificial Sequence
  Thioredoxin-related transmembrane protein 2 (198-207)
agauacaccgacgugagcacaagguauaag

SEQ ID NO: 66833 - RNA, 27 nt, Artificial Sequence
  Dipeptidyl peptidase 3 (692-700)
agcgccgcuggccugaucagauccuuc

SEQ ID NO: 66834 - RNA, 27 nt, Artificial Sequence
  Cyclin-dependent kinase 11B (785-793)
agcgccgcuggccccggguucucccug

SEQ ID NO: 66835 - RNA, 27 nt, Artificial Sequence
  Fanconi anemia group M protein (1313-1321)
agcgccgcuaagaacgaggaacugcuc

SEQ ID NO: 66836 - RNA, 27 nt, Artificial Sequence
  Integrin beta-7 (338-346)
agcgccgcuaacauccagcccauuuuc

SEQ ID NO: 66837 - RNA, 27 nt, Artificial Sequence
  Deleted in malignant brain tumors 1 protein (202-210)
agcgccgcucagccccaauccacccug

SEQ ID NO: 66838 - RNA, 27 nt, Artificial Sequence
  Cell division cycle and apoptosis regulator protein 1 (253-261)
agcgccgcuuccaucaccccccugcuc

SEQ ID NO: 66839 - RNA, 27 nt, Artificial Sequence
  Magnesium transporter protein 1 (108-116)
agcgccuucaccaacagaaucuuuuuc

SEQ ID NO: 66840 - RNA, 27 nt, Artificial Sequence
  Rho guanine nucleotide exchange factor 2 (122-130)
agcgccaucuaccccuccgacucuuuc

SEQ ID NO: 66841 - RNA, 27 nt, Artificial Sequence
  Pleckstrin homology domain-containing family B member 1 (11-19)
agcgcccuggagucccccuucgaagag

SEQ ID NO: 66842 - RNA, 27 nt, Artificial Sequence
  14-3-3 protein eta (25-33)
agcgccaugaaggcugugaccgagcug

SEQ ID NO: 66843 - RNA, 33 nt, Artificial Sequence
  Nuclease-sensitive element-binding protein 1 (314-324)
agcgcccccgaggcugaacagggcggggcagag

SEQ ID NO: 66844 - RNA, 27 nt, Artificial Sequence
  Peroxisomal multifunctional enzyme type 2 (151-159)
agcgccuccggcaucuacgggaacuuc

SEQ ID NO: 66845 - RNA, 27 nt, Artificial Sequence
  Multidrug resistance-associated protein 4 (326-334)
agcgccuccaagaucauuguguucguc

SEQ ID NO: 66846 - RNA, 27 nt, Artificial Sequence
  CapZ-interacting protein (15-23)
agcgccucccccucuguggcucagcug

SEQ ID NO: 66847 - RNA, 27 nt, Artificial Sequence
  Mucin-20 (558-566)
agcgccgugggcaagaccacauccuuc

SEQ ID NO: 66848 - RNA, 27 nt, Artificial Sequence
  ADP-dependent glucokinase (7-15)
agcgccuacgcuggcuuccuggcacuc

SEQ ID NO: 66849 - RNA, 27 nt, Artificial Sequence
  AFG3-like protein 2 (656-664)
agcgccuacgcucagaucgugcaauuc

SEQ ID NO: 66850 - RNA, 33 nt, Artificial Sequence
  HLA class I histocompatibility antigen, Cw-7 alpha chain (115-125)
agcgccuacgacggcaaggauuauaucgcucug

SEQ ID NO: 66851 - RNA, 27 nt, Artificial Sequence
  Heterogeneous nuclear ribonucleoprotein D-like (363-371)
agcgccuacggcggggaccagaacuau

SEQ ID NO: 66852 - RNA, 27 nt, Artificial Sequence
  Cyclic AMP-responsive element-binding protein 1 (143-151)
agcgacgcccccggcgugccuagaauc

SEQ ID NO: 66853 - RNA, 27 nt, Artificial Sequence
  Obscurin (2339-2347)
agcgacggccuguacagaaagcucauc

SEQ ID NO: 66854 - RNA, 30 nt, Artificial Sequence
  Transgelin-2 (163-172)
agcgacaaccagcugcaagagggcaagaau

SEQ ID NO: 66855 - RNA, 33 nt, Artificial Sequence
  Histone H2B type 1-K (113-123)
agcgagggcaccaaggccgugacaaaauacacu

SEQ ID NO: 66856 - RNA, 30 nt, Artificial Sequence
  Tumor protein D54 (166-175)
agcuucgaggacagagugggcaccaucaag

SEQ ID NO: 66857 - RNA, 36 nt, Artificial Sequence
  Ubiquitin-conjugating enzyme E2 J1 (236-247)
agcuuccaccagcccacccaaccuguggccaagaac

SEQ ID NO: 66858 - RNA, 27 nt, Artificial Sequence
  Lipase member J (205-213)
agcuucaagaaauuuaucggcuccaag

SEQ ID NO: 66859 - RNA, 30 nt, Artificial Sequence
  DNA damage-binding protein 1 (1096-1105)
agcuuccuggacaucuccagacccaagaug

SEQ ID NO: 66860 - RNA, 30 nt, Artificial Sequence
  Dynein heavy chain 14, axonemal (3238-3247)
agcuuccugaacaugagagugcccacccuc

SEQ ID NO: 66861 - RNA, 27 nt, Artificial Sequence
  Actin-related protein 3 (170-178)
agcggcgacggggugacccacgucauc

SEQ ID NO: 66862 - RNA, 27 nt, Artificial Sequence
  Protein phosphatase 1 regulatory subunit 14B (21-29)
agcggcgggcccggaccuagaguguac

SEQ ID NO: 66863 - RNA, 30 nt, Artificial Sequence
  Dolichyl-diphosphooligosaccharide-proteinosyltransferase subunit 1 (272-281)
agcggcaucuccucuauuagaucauucaag

SEQ ID NO: 66864 - RNA, 27 nt, Artificial Sequence
  Kinesin-like protein KIFC2 (600-608)
agccacgcccuggugacccucacacuu

SEQ ID NO: 66865 - RNA, 27 nt, Artificial Sequence
  Sorting nexin-19 (151-159)
agccacgccguggcucaguccguccug

SEQ ID NO: 66866 - RNA, 27 nt, Artificial Sequence
  Probable E3 ubiquitin-protein ligase HERC4 (280-288)
agccacgagaucaaccccagaaaggug

SEQ ID NO: 66867 - RNA, 36 nt, Artificial Sequence
  Mucin-7 (41-52)
agccacuucgagcugccccauuacccuggccuccuu

SEQ ID NO: 66868 - RNA, 27 nt, Artificial Sequence
  Histone-lysine N-methyltransferase 2D (2564-2572)
agccacuucggccccgggccuacccug

SEQ ID NO: 66869 - RNA, 24 nt, Artificial Sequence
  Putative uncharacterized protein FLJ37218 (158-165)
agccacuucaccgaccaggagcug

SEQ ID NO: 66870 - RNA, 27 nt, Artificial Sequence
  Tapasin (318-326)
agccacuucuaccccuccggcgggcug

SEQ ID NO: 66871 - RNA, 27 nt, Artificial Sequence
  Translational activator GCN1 (674-682)
agccaccaucccucccugguggccguc

SEQ ID NO: 66872 - RNA, 27 nt, Artificial Sequence
  Transcriptional repressor p66-beta (322-330)
agccacauccagcccggcaccgugaac

SEQ ID NO: 66873 - RNA, 27 nt, Artificial Sequence
  Disintegrin and metalloproteinase domain-containing protein 10 (377-385)
agccacaucaccuucgcccaugaggug

SEQ ID NO: 66874 - RNA, 27 nt, Artificial Sequence
  Niemann-Pick C1 protein (1169-1177)
agccacaucaccagagccuucacagug

SEQ ID NO: 66875 - RNA, 27 nt, Artificial Sequence
  Endothelial PAS domain-containing protein 1 (49-57)
agccaccuggacaaggccuccaucaug

SEQ ID NO: 66876 - RNA, 27 nt, Artificial Sequence
  Retrotransposon-derived protein PEG10 (219-227)
agccaccuggagguggccaagucccuc

SEQ ID NO: 66877 - RNA, 27 nt, Artificial Sequence
  Dolichyl-diphosphooligosaccharide-proteinosyltransferase subunit 2 (169-177)
agccaccugucccagcaagccgaccuc

SEQ ID NO: 66878 - RNA, 27 nt, Artificial Sequence
  Protein FAM78A (95-103)
agccacauggaguucuacaaccaguau

SEQ ID NO: 66879 - RNA, 27 nt, Artificial Sequence
  THO complex subunit 5 homolog (470-478)
agccacauggagaccacaaugaagcug

SEQ ID NO: 66880 - RNA, 27 nt, Artificial Sequence
  Nicastrin (219-227)
agccacaugcaugccgugaucuccacc

SEQ ID NO: 66881 - RNA, 27 nt, Artificial Sequence
  Regulation of nuclear pre-mRNA domain-containing protein 2 (503-511)
agccacaacccccuggccaauauccuc

SEQ ID NO: 66882 - RNA, 27 nt, Artificial Sequence
  Myotubularin-related protein 6 (41-49)
agccaccagaaggagaccuggauccug

SEQ ID NO: 66883 - RNA, 36 nt, Artificial Sequence
  Cytochrome c oxidase subunit 7B, mitochondrial (25-36)
agccaccagaagagaacccccgacuuccaugauaaa

SEQ ID NO: 66884 - RNA, 27 nt, Artificial Sequence
  Transmembrane protein 201 (295-303)
agccaccagaccggcguggucgcccug

SEQ ID NO: 66885 - RNA, 27 nt, Artificial Sequence
  Squalene monooxygenase (461-469)
agccacuccuucguggucaacauccug

SEQ ID NO: 66886 - RNA, 27 nt, Artificial Sequence
  Zinc transporter ZIP6 (388-396)
agccacucccaugaggaacccgccaug

SEQ ID NO: 66887 - RNA, 27 nt, Artificial Sequence
  Transmembrane protein 214 (503-511)
agccacuccucuuuccaggccucacug

SEQ ID NO: 66888 - RNA, 27 nt, Artificial Sequence
  39S ribosomal protein L17, mitochondrial (167-175)
agccacaccgcccagacacccggcauc

SEQ ID NO: 66889 - RNA, 27 nt, Artificial Sequence
  CLOCK-interacting pacemaker (249-257)
agccacguggccaaggcucccucccug

SEQ ID NO: 66890 - RNA, 27 nt, Artificial Sequence
  Pre-mRNA-processing-splicing factor 8 (2254-2262)
agccacuacgagagagugcagaugcug

SEQ ID NO: 66891 - RNA, 27 nt, Artificial Sequence
  DNA-binding protein RFX7 (154-162)
agccacuacaucggcaccaaguccaug

SEQ ID NO: 66892 - RNA, 27 nt, Artificial Sequence
  Dual specificity protein kinase CLK1 (54-62)
agccacuaccuggaguccagaucuauc

SEQ ID NO: 66893 - RNA, 27 nt, Artificial Sequence
  Protein EVI2B (202-210)
agcaucgccgcuauucugauaggcgug

SEQ ID NO: 66894 - RNA, 27 nt, Artificial Sequence
  DNA-directed RNA polymerase II subunit RPB2 (468-476)
agcaucgcccccagaaugauguccgug

SEQ ID NO: 66895 - RNA, 27 nt, Artificial Sequence
  E3 ubiquitin-protein ligase RNF19A (93-101)
agcaucgaguccauucacucugaaaug

SEQ ID NO: 66896 - RNA, 27 nt, Artificial Sequence
  Translocon-associated protein subunit delta (126-134)
agcaucauucccccucuguucaccgug

SEQ ID NO: 66897 - RNA, 36 nt, Artificial Sequence
  Alpha-enolase (2-13)
agcauccugaagauucacgccagagagauauucgac

SEQ ID NO: 66898 - RNA, 27 nt, Artificial Sequence
  Copper-transporting ATPase 2 (876-884)
agcaucaacgcccacggcuccgugcug

SEQ ID NO: 66899 - RNA, 27 nt, Artificial Sequence
  Protein Smaug homolog 2 (352-360)
agcauccagaagcugagagagaggcaa

SEQ ID NO: 66900 - RNA, 27 nt, Artificial Sequence
  CCR4-NOT transcription complex subunit 1 (312-320)
agcaucuccgcccccggcucugggauu

SEQ ID NO: 66901 - RNA, 27 nt, Artificial Sequence
  AP-5 complex subunit mu-1 (477-485)
agcaaggcccccgcuccugugaccuac

SEQ ID NO: 66902 - RNA, 27 nt, Artificial Sequence
  Ubiquitin carboxyl-terminal hydrolase 19 (576-584)
agcaaggccucccaguucaccggcuac

SEQ ID NO: 66903 - RNA, 27 nt, Artificial Sequence
  Putative tRNA (cytidine(32)/guanosine(34)-2'-O)-methyltransferase (5-13)
agcaaggacaaaagagauguguacuau

SEQ ID NO: 66904 - RNA, 27 nt, Artificial Sequence
  40S ribosomal protein S6 (148-156)
agcaaggaggacgaugugagacaguac

SEQ ID NO: 66905 - RNA, 27 nt, Artificial Sequence
  60S ribosomal protein L11 (158-166)
agcaaggaggaagccaugagaugguuc

SEQ ID NO: 66906 - RNA, 27 nt, Artificial Sequence
  Gamma-glutamyltranspeptidase 1 (30-38)
agcaaggagcccgacaaccacguguac

SEQ ID NO: 66907 - RNA, 27 nt, Artificial Sequence
  NADH dehydrogenase (ubiquinone) 1 beta subcomplex subunit 8, mitochondrial (175-183)
agcaaggagcccgaaagagugguccac

SEQ ID NO: 66908 - RNA, 27 nt, Artificial Sequence
  Neuroblast differentiation-associated protein AHNAK (5611-5619)
agcaaguucgccggcgggcugcacuuu

SEQ ID NO: 66909 - RNA, 27 nt, Artificial Sequence
  Core-binding factor subunit beta (10-18)
agcaaguucgagaacgaagaguuuuuc

SEQ ID NO: 66910 - RNA, 30 nt, Artificial Sequence
  Proteasomal ATPase-associated factor 1 (78-87)
agcaaguuccuggcccccuacaccacauuu

SEQ ID NO: 66911 - RNA, 33 nt, Artificial Sequence
  CWF19-like protein 2 (623-633)
agcaaguucaugggcaaaaccgacggggauuac

SEQ ID NO: 66912 - RNA, 27 nt, Artificial Sequence
  Transcription intermediary factor 1-alpha (457-465)
agcaaguuccccacccagaucucccug

SEQ ID NO: 66913 - RNA, 27 nt, Artificial Sequence
  40S ribosomal protein S25 (101-109)
agcaagcacagagcccaggugaucuac

SEQ ID NO: 66914 - RNA, 33 nt, Artificial Sequence
  Proteasome subunit beta type-7 (75-85)
agcaagauccacuucauuucccccaacauauac

SEQ ID NO: 66915 - RNA, 27 nt, Artificial Sequence
  60S ribosomal protein L18a (148-156)
agcaagaucaaauucccccugccucac

SEQ ID NO: 66916 - RNA, 27 nt, Artificial Sequence
  Serine/threonine-protein phosphatase 4 regulatory subunit 3B (54-62)
agcaagaucaaccccaauaccgccuac

SEQ ID NO: 66917 - RNA, 27 nt, Artificial Sequence
  Signal recognition particle receptor subunit alpha (128-136)
agcaagaucagagcccccaccacaaug

SEQ ID NO: 66918 - RNA, 27 nt, Artificial Sequence
  NUAK family SNF1-like kinase 2 (123-131)
agcaagaucgugauugucauggaguac

SEQ ID NO: 66919 - RNA, 30 nt, Artificial Sequence
  E3 ubiquitin-protein ligase RING1 (108-117)
agcaagaucuaccccuccagagaggaauau

SEQ ID NO: 66920 - RNA, 27 nt, Artificial Sequence
  60S ribosomal protein L19 (112-120)
agcaagaaaaucgacagacacauguac

SEQ ID NO: 66921 - RNA, 27 nt, Artificial Sequence
  HAUS augmin-like complex subunit 8 (124-132)
agcaagaaacccgaguccaccucuuuc

SEQ ID NO: 66922 - RNA, 27 nt, Artificial Sequence
  60S ribosomal protein L10 (168-176)
agcaagaaauggggcuucaccaaguuu

SEQ ID NO: 66923 - RNA, 30 nt, Artificial Sequence
  Golgi-associated PDZ and coiled-coil motif-containing protein (448-457)
agcaagcuggacgaucuccacacccuuuac

SEQ ID NO: 66924 - RNA, 27 nt, Artificial Sequence
  Protein yippee-like 5 (78-86)
agcaagcugggcuggaucuacgaguuc

SEQ ID NO: 66925 - RNA, 33 nt, Artificial Sequence
  Eukaryotic translation initiation factor 2A (459-469)
agcaagcugcacgaggaagagcccccucagaac

SEQ ID NO: 66926 - RNA, 36 nt, Artificial Sequence; identical to SEQ ID NO: 42699
  T-complex protein 1 subunit eta (291-302)

SEQ ID NO: 66927 - RNA, 27 nt, Artificial Sequence
  Ubiquitin-protein ligase E3C (217-225)
agcaagcugcccuccucuaucgaguac

SEQ ID NO: 66928 - RNA, 27 nt, Artificial Sequence
  Laminin subunit alpha-5 (3479-3487)
agcaagcugcccgugaccgucggcuuc

SEQ ID NO: 66929 - RNA, 27 nt, Artificial Sequence
  Anaphase-promoting complex subunit 5 (144-152)
agcaagcuguccuucucucagguguuu

SEQ ID NO: 66930 - RNA, 27 nt, Artificial Sequence
  Protein Red (280-288)
agcaagcugacccagauccucuccuac

SEQ ID NO: 66931 - RNA, 27 nt, Artificial Sequence
  GPN-loop GTPase 2 (178-186)
agcaagauggaccugaucgagcacuac

SEQ ID NO: 66932 - RNA, 30 nt, Artificial Sequence
  Hsp90 co-chaperone Cdc37 (322-331)
agcaagauggaccccaccgaugccaaauac

SEQ ID NO: 66933 - RNA, 27 nt, Artificial Sequence
  Ubiquitin-conjugating enzyme E2 A (74-82)
agcaagauguuccaccccaacguguac

SEQ ID NO: 66934 - RNA, 27 nt, Artificial Sequence
  Deoxyribonuclease-2-alpha (168-176)
agcaagaugggcaaacagcugaccuac

SEQ ID NO: 66935 - RNA, 27 nt, Artificial Sequence
  Small nuclear ribonucleoprotein-associated protein N (7-15)
agcaagaugcugcagcacaucgacuac

SEQ ID NO: 66936 - RNA, 27 nt, Artificial Sequence
  A-kinase anchor protein 9 (893-901)
agcaagaacaaacaggagcuggaauac

SEQ ID NO: 66937 - RNA, 27 nt, Artificial Sequence
  Intraflagellar transport protein 80 homolog (558-566)
agcaagaacccccacaucguguccuuc

SEQ ID NO: 66938 - RNA, 27 nt, Artificial Sequence
  E3 SUMO-protein ligase RanBP2 (1103-1111)
agcaagaacguguccggcaucucuuuc

SEQ ID NO: 66939 - RNA, 27 nt, Artificial Sequence
  Protein yippee-like 3 (5-13)
agcaagcccaaaaccuuccaggccuac

SEQ ID NO: 66940 - RNA, 27 nt, Artificial Sequence
  Coatomer subunit alpha (279-287)
agcaagagaaccggcgugcagacauuc

SEQ ID NO: 66941 - RNA, 27 nt, Artificial Sequence
  Calcium-dependent secretion activator 1 (390-398)
agcaaguccgacgugguccugucuuuc

SEQ ID NO: 66942 - RNA, 27 nt, Artificial Sequence
  S-adenosylmethionine synthase isoform type-2 (180-188)
agcaagacccaggugacaguccaauac

SEQ ID NO: 66943 - RNA, 27 nt, Artificial Sequence
  Protein YIPF1 (188-196)
agcaaggugaugaacaucgucuccuac

SEQ ID NO: 66944 - RNA, 27 nt, Artificial Sequence
  Nucleolar complex protein 4 homolog (137-145)
agcaagugggagggcaacuaccuguuc

SEQ ID NO: 66945 - RNA, 27 nt, Artificial Sequence
  EBNA1-binding protein 2 (257-265)
agcaaguggaacaccagagaguccuac

SEQ ID NO: 66946 - RNA, 30 nt, Artificial Sequence
  Nuclease-sensitive element-binding protein 1 (136-145)
agcaaguacgccgcugacagaaaccacuau

SEQ ID NO: 66947 - RNA, 27 nt, Artificial Sequence
  Transcription factor MafG (109-117)
agcaaguacgaggcccugcagaccuuc

SEQ ID NO: 66948 - RNA, 30 nt, Artificial Sequence
  7-dehydrocholesterol reductase (453-462)
agcaaguacggcagagacugggagagguau

SEQ ID NO: 66949 - RNA, 27 nt, Artificial Sequence
  Gamma-tubulin complex component 6 (1622-1630)
agcaaguacuccggcguguucucuuuu

SEQ ID NO: 66950 - RNA, 33 nt, Artificial Sequence
  V-type proton ATPase catalytic subunit A (264-274)
agcaaguacuccaacucugacgugaucauuuau

SEQ ID NO: 66951 - RNA, 27 nt, Artificial Sequence
  DNA polymerase delta catalytic subunit (737-745)
agcaaguacaccguggagaacggcuau

SEQ ID NO: 66952 - RNA, 33 nt, Artificial Sequence
  Fatty acid synthase (1747-1757)
agccuggccgaggaaaagcuccaggcuuccgug

SEQ ID NO: 66953 - RNA, 36 nt, Artificial Sequence
  Intraflagellar transport protein 140 homolog (561-572)
agccuggccgagcucgugcccggcgucgggggaauc

SEQ ID NO: 66954 - RNA, 27 nt, Artificial Sequence
  DNA topoisomerase 3-beta-1 (12-20)
agccuggcccaguccaucgcuaagauu

SEQ ID NO: 66955 - RNA, 27 nt, Artificial Sequence
  PMS1 protein homolog 1 (605-613)
agccuguucaacggcucccacuaccuc

SEQ ID NO: 66956 - RNA, 27 nt, Artificial Sequence
  Nuclear pore membraneoprotein 210-like (625-633)
agccugggccacacccucgugacaguc

SEQ ID NO: 66957 - RNA, 27 nt, Artificial Sequence
  Bifunctional glutamate/proline-tRNA ligase (786-794)
agccugaaggccgaguacaaagaaaag

SEQ ID NO: 66958 - RNA, 27 nt, Artificial Sequence
  Bifunctional glutamate/proline-tRNA ligase (859-867)
agccugaaggcccaguacaaagagaag

SEQ ID NO: 66959 - RNA, 27 nt, Artificial Sequence
  Heterogeneous nuclear ribonucleoprotein M (86-94)
agccugaaggaccucgugaaagagaag

SEQ ID NO: 66960 - RNA, 24 nt, Artificial Sequence
  Serine/threonine-protein phosphatase 2A 65 kDa regulatory subunit A alpha isoform (403-410)
agccugcuccccgccaucguggag

SEQ ID NO: 66961 - RNA, 30 nt, Artificial Sequence
  Protein transport protein Sec23B (156-165)
agccugcuccccccugacgcccuugugggc

SEQ ID NO: 66962 - RNA, 27 nt, Artificial Sequence
  Nesprin-1 (5397-5405)
agccugcagcucgccgagguggcucuu

SEQ ID NO: 66963 - RNA, 27 nt, Artificial Sequence
  Tetratricopeptide repeat protein 28 (1301-1309)
agccuguggcccgugccugucgccgcu

SEQ ID NO: 66964 - RNA, 27 nt, Artificial Sequence
  Probable E3 ubiquitin-protein ligase HECTD4 (1660-1668)
agcauggccgcugaggugaucgcacug

SEQ ID NO: 66965 - RNA, 27 nt, Artificial Sequence
  Ribonuclease 3 (661-669)
agcaugcaccagauccugcucuaccuu

SEQ ID NO: 66966 - RNA, 36 nt, Artificial Sequence
  B-cell CLL/lymphoma 9-like protein (1201-1212)
agcaugaugauggcccccggcgggccugacucccug

SEQ ID NO: 66967 - RNA, 30 nt, Artificial Sequence; identical to SEQ ID NO: 42740
  Titin (34201-34210)

SEQ ID NO: 66968 - RNA, 36 nt, Artificial Sequence
  Protein S100-A7 (2-13)
agcaacacccaggccgagagauccaucauuggcaug

SEQ ID NO: 66969 - RNA, 36 nt, Artificial Sequence
  Basic salivary proline-rich protein 4 (241-252)
agccccccuggcaagccacaggggccgccccaacag

SEQ ID NO: 66970 - RNA, 24 nt, Artificial Sequence
  Protein kinase C-binding protein 1 (698-705)
agccccaccgugcaccugggccuc

SEQ ID NO: 66971 - RNA, 27 nt, Artificial Sequence
  Protein AF-17 (915-923)
agccaggccggcggggcucccacccug

SEQ ID NO: 66972 - RNA, 27 nt, Artificial Sequence
  4F2 cell-surface antigen heavy chain (436-444)
agccaggccagacugcucaccuccuuc

SEQ ID NO: 66973 - RNA, 27 nt, Artificial Sequence
  Dolichyl-diphosphooligosaccharide-proteinosyltransferase subunit 1 (210-218)
agccaggacaccuucaaggugcacuac

SEQ ID NO: 66974 - RNA, 27 nt, Artificial Sequence
  Arf-GAP with SH3 domain, ANK repeat and PH domain-containing protein 2 (285-293)
agccagaucagacaauccaccgccuac

SEQ ID NO: 66975 - RNA, 27 nt, Artificial Sequence
  DNA mismatch repair protein Msh2 (717-725)
agccagcugaagggcguguccaccuuc

SEQ ID NO: 66976 - RNA, 30 nt, Artificial Sequence
  Fanconi anemia group E protein (322-331)
agccagauggaccugcucugcgcccaacuu

SEQ ID NO: 66977 - RNA, 27 nt, Artificial Sequence
  Multidrug resistance-associated protein 4 (661-669)
agccagcaauccucuagacccucacug

SEQ ID NO: 66978 - RNA, 27 nt, Artificial Sequence
  Heat shock protein 105 kDa (552-560)
agccagucccccccuucuccagagcug

SEQ ID NO: 66979 - RNA, 27 nt, Artificial Sequence
  Cystatin-B (45-53)
agccagguggucgccggcaccaacuac

SEQ ID NO: 66980 - RNA, 30 nt, Artificial Sequence
  NEDD8-activating enzyme E1 catalytic subunit (290-299)
agccaguacaacaucagaggcgugaccuau

SEQ ID NO: 66981 - RNA, 27 nt, Artificial Sequence
  WD repeat-containing protein 97 (311-319)
agcagagacuccaccgugaaggucugg

SEQ ID NO: 66982 - RNA, 36 nt, Artificial Sequence
  Nuclease-sensitive element-binding protein 1 (309-320)
agcuccgcccccgaggcugaacagggcggggcagag

SEQ ID NO: 66983 - RNA, 30 nt, Artificial Sequence
  Hematological and neurological expressed 1 protein (91-100)
agcuccggcgacuuccuggaucucaagggg

SEQ ID NO: 66984 - RNA, 30 nt, Artificial Sequence
  Synaptotagmin-like protein 2 (602-611)
agcuccggcaugaccucucugucaagugug

SEQ ID NO: 66985 - RNA, 27 nt, Artificial Sequence
  HLA class I histocompatibility antigen, alpha chain G (301-309)
agcucccugcccaccaucccuauuaug

SEQ ID NO: 66986 - RNA, 27 nt, Artificial Sequence
  Mucin-1 (130-138)
agcaccgcccccccugcucacggcgug

SEQ ID NO: 66987 - RNA, 27 nt, Artificial Sequence
  Sperm-associated antigen 5 (305-313)
agcaccugccugacacccaaccucgug

SEQ ID NO: 66988 - RNA, 27 nt, Artificial Sequence
  V-type proton ATPase catalytic subunit A (16-24)
agcaccuucggcuacgugcacgggguc

SEQ ID NO: 66989 - RNA, 27 nt, Artificial Sequence
  Uncharacterized protein C20orf195 (2-10)
agcacccacguggccggccuggggcuc

SEQ ID NO: 66990 - RNA, 30 nt, Artificial Sequence
  Ubiquitin carboxyl-terminal hydrolase 3 (394-403)
agcaccaagaaauucuggauccagaagcug

SEQ ID NO: 66991 - RNA, 27 nt, Artificial Sequence
  Heat shock cognate 71 kDa protein (340-348)
agcaccagaauccccaagauucagaaa

SEQ ID NO: 66992 - RNA, 27 nt, Artificial Sequence
  Putativeosylation-dependent cell adhesion molecule 1 (14-22)
agcaccucccuggccauccucgacgug

SEQ ID NO: 66993 - RNA, 30 nt, Artificial Sequence
  Microtubule-actin cross-linking factor 1, isoforms 1/2/3/5 (844-853)
agcguggccucccuggucggcagaucuaag

SEQ ID NO: 66994 - RNA, 30 nt, Artificial Sequence
  Zinc finger protein 638 (1228-1237)
agcguguucgccgaggaaagaaaccugaag

SEQ ID NO: 66995 - RNA, 27 nt, Artificial Sequence
  Heat shock protein HSP 90-alpha (658-666)
agcgugaaggaccuggucauccuccuu

SEQ ID NO: 66996 - RNA, 27 nt, Artificial Sequence
  Eukaryotic translation initiation factor 3 subunit E (27-35)
agcgugaaggagaucuacaacgaaaaa

SEQ ID NO: 66997 - RNA, 36 nt, Artificial Sequence
  Cytoskeleton-associated protein 2 (388-399)
agcguggucacccagcacgagcccgccggccaaaac

SEQ ID NO: 66998 - RNA, 30 nt, Artificial Sequence
  Echinoderm microtubule-associated protein-like 4 (184-193)
agcugggagaacuccgacgauucuagaaau

SEQ ID NO: 66999 - RNA, 30 nt, Artificial Sequence
  Cold-inducible RNA-binding protein (163-172)
agcuacgacuccuaugccacccacaacgag

SEQ ID NO: 67000 - RNA, 33 nt, Artificial Sequence; identical to SEQ ID NO: 42773
  14-3-3 protein theta (210-220)

SEQ ID NO: 67001 - RNA, 27 nt, Artificial Sequence
  Nucleolar and coiled-body phosphoprotein 1 (681-689)
agcuacagaggcggguccaucucugug

SEQ ID NO: 67002 - RNA, 24 nt, Artificial Sequence
  Asparagine synthetase (glutamine-hydrolyzing) (409-416)
accgccgcucacggccuggagcuc

SEQ ID NO: 67003 - RNA, 30 nt, Artificial Sequence
  Ribosome biogenesis protein BOP1 (10-19)
accgccgcucccagcgugagaccugagaag

SEQ ID NO: 67004 - RNA, 30 nt, Artificial Sequence
  Poly(rC)-binding protein 2 (91-100)
accgccgcuagcagacccccugugacacug

SEQ ID NO: 67005 - RNA, 27 nt, Artificial Sequence
  Elongation factor 2 (73-81)
accgccaucagccuguucuacgagcuc

SEQ ID NO: 67006 - RNA, 30 nt, Artificial Sequence
  Ubiquitin-associated protein 2-like (322-331)
accgccaucagccagcccgcuuccggcaac

SEQ ID NO: 67007 - RNA, 36 nt, Artificial Sequence
  Intraflagellar transport protein 88 homolog (62-73)
accgccaagaucagcuccacagcugugacuagaccc

SEQ ID NO: 67008 - RNA, 24 nt, Artificial Sequence
  Max-like protein X (152-159)
accgcccugaagaucaugaaagug

SEQ ID NO: 67009 - RNA, 27 nt, Artificial Sequence
  Nuclear pore membraneoprotein 210 (1573-1581)
accgccagcaaggugaucgucgcuguu

SEQ ID NO: 67010 - RNA, 36 nt, Artificial Sequence
  Syndecan-1 (220-231)
accgccguggucgcuguugagcccgacagaaggaac

SEQ ID NO: 67011 - RNA, 27 nt, Artificial Sequence
  Probable C-mannosyltransferase DPY19L3 (463-471)
accgccuacaaccugauccacacaauu

SEQ ID NO: 67012 - RNA, 27 nt, Artificial Sequence
  XK-related protein 9 (255-263)
accugcaucagcauggaguuccuguac

SEQ ID NO: 67013 - RNA, 33 nt, Artificial Sequence
  Uncharacterized protein C9orf78 (274-284)
accgacgauuaccacuaugagaaguucaaaaag

SEQ ID NO: 67014 - RNA, 24 nt, Artificial Sequence
  Bcl-2-associated transcription factor 1 (341-348)
accgacgaggaaagcagaguguuc

SEQ ID NO: 67015 - RNA, 30 nt, Artificial Sequence
  Bcl-2-associated transcription factor 1 (341-350)
accgacgaggaaagcagaguguuccugcuc

SEQ ID NO: 67016 - RNA, 36 nt, Artificial Sequence
  Pleiotropic regulator 1 (74-85)
accgacagcuacgugcacaagcaguaucccgccaac

SEQ ID NO: 67017 - RNA, 27 nt, Artificial Sequence
  PRA1 family protein 3 (180-188)
accgacuacaucagcaaggugaaagag

SEQ ID NO: 67018 - RNA, 27 nt, Artificial Sequence
  Testis-expressed sequence 10 protein (733-741)
accgaggccguguuccacagccugcuc

SEQ ID NO: 67019 - RNA, 33 nt, Artificial Sequence
  Pre-mRNA cleavage complex 2 protein Pcf11 (561-571)
accgaggaagagagaccccaggaaacaacuaac

SEQ ID NO: 67020 - RNA, 30 nt, Artificial Sequence
  cTAGE family member 5 (795-804)
accgagcaccccgaaccucagcaagagaca

SEQ ID NO: 67021 - RNA, 36 nt, Artificial Sequence
  Tumor protein D52 (213-224)
accgagccccugccugaaaagacacaggagagccuc

SEQ ID NO: 67022 - RNA, 36 nt, Artificial Sequence
  BAG family molecular chaperone regulator 4 (167-178)
accgaggugcccagcacauacagauccucuggcaac

SEQ ID NO: 67023 - RNA, 33 nt, Artificial Sequence
  Non-POU domain-containing octamer-binding protein (6-16)
accuucaaccuggagaagcagaaucacacaccc

SEQ ID NO: 67024 - RNA, 36 nt, Artificial Sequence
  Non-POU domain-containing octamer-binding protein (6-17)
accuucaaccuggagaagcagaaucacacacccaga

SEQ ID NO: 67025 - RNA, 30 nt, Artificial Sequence
  U2 snRNP-associated SURP motif-containing protein (134-143)
accuucgugagaggcggggucguuaacgcc

SEQ ID NO: 67026 - RNA, 36 nt, Artificial Sequence
  Ubiquitin-associated protein 2-like (225-236)
accggccacuucgagcccgacgaugggacaagcgcc

SEQ ID NO: 67027 - RNA, 36 nt, Artificial Sequence
  E3 ubiquitin-protein ligase HUWE1 (2557-2568)
accggccacacaauccaugugcacuaccccgggaac

SEQ ID NO: 67028 - RNA, 30 nt, Artificial Sequence
  Transcriptional repressor p66-beta (558-567)
accggcaucgggggacacaagggucccagc

SEQ ID NO: 67029 - RNA, 36 nt, Artificial Sequence
  Peptidyl-prolyl cis-trans isomerase FKBP1A (28-39)
accggcaugcuggaggacgggaagaaauucgauagc

SEQ ID NO: 67030 - RNA, 33 nt, Artificial Sequence
  Probable ATP-dependent RNA helicase DDX5 (560-570)
accggcaaccccacagggacuuaccagaaugga

SEQ ID NO: 67031 - RNA, 24 nt, Artificial Sequence
  60S ribosomal protein L13 (151-158)
accggccccgugaugccugucaga

SEQ ID NO: 67032 - RNA, 36 nt, Artificial Sequence
  AT-rich interactive domain-containing protein 1A (1514-1525)
accggcagcgccccccaggggccugcuuaccacgga

SEQ ID NO: 67033 - RNA, 36 nt, Artificial Sequence
  Nuclear pore complex protein Nup153 (406-417)
accggcuacgagaagaacaugacacccgggcagaau

SEQ ID NO: 67034 - RNA, 27 nt, Artificial Sequence
  Pumilio homolog 3 (361-369)
acccacgacggcgccagaguggcuaug

SEQ ID NO: 67035 - RNA, 27 nt, Artificial Sequence
  Glutaryl-CoA dehydrogenase, mitochondrial (416-424)
acccacgacauccaugcccugauucuc

SEQ ID NO: 67036 - RNA, 27 nt, Artificial Sequence
  Nuclear pore complex protein Nup88 (408-416)
acccacgaggccggcgugcauagcguc

SEQ ID NO: 67037 - RNA, 27 nt, Artificial Sequence
  Endonuclease G, mitochondrial (227-235)
acccacuucuuuaaggugcugauccuc

SEQ ID NO: 67038 - RNA, 27 nt, Artificial Sequence
  Bax inhibitor 1 (51-59)
acccacuucauccaggccggccugcuc

SEQ ID NO: 67039 - RNA, 27 nt, Artificial Sequence
  BMP/retinoic acid-inducible neural-specific protein 2 (144-152)
acccacuuccugcucagcgccacacuu

SEQ ID NO: 67040 - RNA, 27 nt, Artificial Sequence
  HEAT repeat-containing protein 1 (721-729)
acccacuuccccuuugccaucagagug

SEQ ID NO: 67041 - RNA, 27 nt, Artificial Sequence
  Transitional endoplasmic reticulum ATPase (403-411)
acccacggccaugugggggccgaccug

SEQ ID NO: 67042 - RNA, 27 nt, Artificial Sequence
  Zinc finger protein 638 (449-457)
acccacaucgagagcugcagacagcug

SEQ ID NO: 67043 - RNA, 24 nt, Artificial Sequence
  Leucine-rich PPR motif-containing protein, mitochondrial (1095-1102)
acccacaucaagggcuucacacug

SEQ ID NO: 67044 - RNA, 27 nt, Artificial Sequence
  Probable C-mannosyltransferase DPY19L1 (228-236)
acccacauccugagagccacaaagcuc

SEQ ID NO: 67045 - RNA, 30 nt, Artificial Sequence
  Guanine nucleotide-binding protein-like 3-like protein (251-260)
acccacaucagagugggcgucguugggcug

SEQ ID NO: 67046 - RNA, 36 nt, Artificial Sequence; identical to SEQ ID NO: 42819
  Neuroblast differentiation-associated protein AHNAK (1576-1587)

SEQ ID NO: 67047 - RNA, 27 nt, Artificial Sequence
  Homeodomain-interacting protein kinase 3 (1110-1118)
acccaccugggcgggcagcccacacuc

SEQ ID NO: 67048 - RNA, 27 nt, Artificial Sequence
  Nck-associated protein 1-like (1054-1062)
acccaccugaaggaguuccucgugguc

SEQ ID NO: 67049 - RNA, 24 nt, Artificial Sequence
  Bone marrow stromal antigen 2 (67-74)
acccaccugcuccagcaagagcuu

SEQ ID NO: 67050 - RNA, 27 nt, Artificial Sequence
  Dol-P-Man:Man(5)GlcNAc(2)-PP-Dol alpha-1,3-mannosyltransferase (381-389)
acccaccugcucagacuucugguguug

SEQ ID NO: 67051 - RNA, 27 nt, Artificial Sequence
  Myocyte-specific enhancer factor 2C (372-380)
acccaccugagccaguccucuaaccuc

SEQ ID NO: 67052 - RNA, 27 nt, Artificial Sequence
  Dolichyl-diphosphooligosaccharide-proteinosyltransferase 48 kDa subunit (400-408)
acccaccuguacagcuccacacaggug

SEQ ID NO: 67053 - RNA, 27 nt, Artificial Sequence
  Bifunctional glutamate/proline-tRNA ligase (1422-1430)
acccacaugguggucgccaacacaaug

SEQ ID NO: 67054 - RNA, 27 nt, Artificial Sequence
  C-myc promoter-binding protein (1300-1308)
acccacagcucccccucuuucaaccug

SEQ ID NO: 67055 - RNA, 27 nt, Artificial Sequence
  Heterogeneous nuclear ribonucleoprotein R (25-33)
acccacacagagcauuacaagacucug

SEQ ID NO: 67056 - RNA, 27 nt, Artificial Sequence
  Stromal cell-derived factor 2 (95-103)
acccacgugaacacaggcagaaaucug

SEQ ID NO: 67057 - RNA, 27 nt, Artificial Sequence
  Dolichyl-diphosphooligosaccharide-proteinosyltransferase subunit 2 (26-34)
acccacuaccugacaaagcaugacgug

SEQ ID NO: 67058 - RNA, 33 nt, Artificial Sequence
  Lymphoid-restricted membrane protein (375-385)
accaucgccagccugcccagaaacauuggcaau

SEQ ID NO: 67059 - RNA, 36 nt, Artificial Sequence
  Myosin-binding protein H-like (137-148)
accaucgacauucuggugauagagagacccggcccu

SEQ ID NO: 67060 - RNA, 27 nt, Artificial Sequence
  Glycerol-3-phosphate dehydrogenase 1-like protein (285-293)
accaucgaggaacuggagaaggaaaug

SEQ ID NO: 67061 - RNA, 36 nt, Artificial Sequence
  BPI fold-containing family A member 2 (157-168)
accaucgagacagacccccagacucaccaaccugug

SEQ ID NO: 67062 - RNA, 27 nt, Artificial Sequence
  MOB kinase activator 1A (192-200)
accauccugaagagacucuucagggug

SEQ ID NO: 67063 - RNA, 27 nt, Artificial Sequence
  Protein sel-1 homolog 1 (219-227)
accaaggcccuggagagagugagcuac

SEQ ID NO: 67064 - RNA, 27 nt, Artificial Sequence
  WD repeat-containing protein 5 (45-53)
accaaggccgugagcuccgucaaauuc

SEQ ID NO: 67065 - RNA, 27 nt, Artificial Sequence
  Transforming protein RhoA (163-171)
accaaggacggcgugagagaggucuuc

SEQ ID NO: 67066 - RNA, 27 nt, Artificial Sequence
  Disintegrin and metalloproteinase domain-containing protein 17 (159-167)
accaaggacaaaagaaugcugguguac

SEQ ID NO: 67067 - RNA, 27 nt, Artificial Sequence
  Ras GTPase-activating-like protein IQGAP2 (912-920)
accaaguucauggacacagugaucuuu

SEQ ID NO: 67068 - RNA, 27 nt, Artificial Sequence
  Vigilin (613-621)
accaagaucgaccugcccgccgagaac

SEQ ID NO: 67069 - RNA, 33 nt, Artificial Sequence
  Vigilin (613-623)
accaagaucgaccugcccgccgagaacagcaau

SEQ ID NO: 67070 - RNA, 27 nt, Artificial Sequence
  Vesicular integral-membrane protein VIP36 (290-298)
accaagaucgagcccagcgugaacuuc

SEQ ID NO: 67071 - RNA, 27 nt, Artificial Sequence
  Ubiquitin carboxyl-terminal hydrolase 33 (627-635)
accaagaucagcacacacguguccuuc

SEQ ID NO: 67072 - RNA, 27 nt, Artificial Sequence
  Nucleoprotein TPR (712-720)
accaagaucagcacacagcuggacuuc

SEQ ID NO: 67073 - RNA, 36 nt, Artificial Sequence
  Eukaryotic translation initiation factor 4 gamma 1 (1070-1081)
accaagaucacaaaacccggcagcauugacuccaac

SEQ ID NO: 67074 - RNA, 27 nt, Artificial Sequence
  Pre-mRNA-processing factor 19 (264-272)
accaagaaagugacaagcgucguuuuc

SEQ ID NO: 67075 - RNA, 27 nt, Artificial Sequence
  Serine/threonine-protein kinase 24 (105-113)
accaagcuguggaucauuauggaguac

SEQ ID NO: 67076 - RNA, 27 nt, Artificial Sequence
  Parafibromin (282-290)
accaagcagcccaucccugccgcuuac

SEQ ID NO: 67077 - RNA, 27 nt, Artificial Sequence
  Cerebral cavernous malformations 2 protein (253-261)
accaagguggacaucaaagagacauac

SEQ ID NO: 67078 - RNA, 27 nt, Artificial Sequence
  S-adenosylmethionine synthase isoform type-2 (288-296)
accaagguggacagaagcgccgcuuac

SEQ ID NO: 67079 - RNA, 27 nt, Artificial Sequence
  ER membrane protein complex subunit 3 (138-146)
accaaggugcccuucccucugacacuc

SEQ ID NO: 67080 - RNA, 30 nt, Artificial Sequence; identical to SEQ ID NO: 42853
  ATP-binding cassette sub-family F member 2 (592-601)

SEQ ID NO: 67081 - RNA, 27 nt, Artificial Sequence
  60S ribosomal protein L17 (45-53)
accaaguaccugaaagacgugacacuc

SEQ ID NO: 67082 - RNA, 24 nt, Artificial Sequence
  DNA dC-dU-editing enzyme APOBEC-3C (84-91)
accaaguaccaggugacaugguau

SEQ ID NO: 67083 - RNA, 30 nt, Artificial Sequence; identical to SEQ ID NO: 42856
  Tetratricopeptide repeat protein 27 (205-214)

SEQ ID NO: 67084 - RNA, 27 nt, Artificial Sequence
  Proliferation-associated protein 2G4 (386-394)
acccuggaggaaaacgaggccggcgac

SEQ ID NO: 67085 - RNA, 27 nt, Artificial Sequence
  Protein FAM185A (259-267)
acccugggcagcgugcacgggaacauc

SEQ ID NO: 67086 - RNA, 36 nt, Artificial Sequence
  60S ribosomal protein L23a (126-137)
acccugaucagacccgacggcgagaagaaagccuac

SEQ ID NO: 67087 - RNA, 27 nt, Artificial Sequence
  Transcription elongation factor SPT6 (835-843)
acccugaagaaauuccuccuuaacaag

SEQ ID NO: 67088 - RNA, 27 nt, Artificial Sequence
  AP-5 complex subunit mu-1 (115-123)
acccugagccccagaccuccacucauc

SEQ ID NO: 67089 - RNA, 27 nt, Artificial Sequence
  40S ribosomal protein S7 (121-129)
acccugacagccgugcacgacgcuauc

SEQ ID NO: 67090 - RNA, 33 nt, Artificial Sequence
  40S ribosomal protein S7 (121-131)
acccugacagccgugcacgacgcuauccucgag

SEQ ID NO: 67091 - RNA, 36 nt, Artificial Sequence
  Translocating chain-associated membrane protein 1 (357-368)
acccugacaagcaacguggccgacucccccagaaau

SEQ ID NO: 67092 - RNA, 36 nt, Artificial Sequence
  Peptidyl-prolyl cis-trans isomerase FKBP1A (97-108)
acccugguguucgacgucgagcuccuuaagcuggaa

SEQ ID NO: 67093 - RNA, 27 nt, Artificial Sequence
  Serine/threonine-protein kinase RIO2 (243-251)
accaugaucgacuucccccagauggug

SEQ ID NO: 67094 - RNA, 30 nt, Artificial Sequence; identical to SEQ ID NO: 42867
  CDC42 small effector protein 1 (26-35)

SEQ ID NO: 67095 - RNA, 36 nt, Artificial Sequence
  Far upstream element-binding protein 2 (277-288)
accaacguggacaagccccugagaaucauuggcgau

SEQ ID NO: 67096 - RNA, 36 nt, Artificial Sequence
  Cell division cycle 5-like protein (373-384)
accaacguggacacaccccugaagggcgggcucaau

SEQ ID NO: 67097 - RNA, 30 nt, Artificial Sequence
  Vacuolar protein sorting-associated protein VTA1 homolog (224-233)
acccccgccgaggugccucacagcacaggc

SEQ ID NO: 67098 - RNA, 36 nt, Artificial Sequence
  Vacuolar protein sorting-associated protein VTA1 homolog (224-235)
acccccgccgaggugccucacagcacaggcgucgcu

SEQ ID NO: 67099 - RNA, 30 nt, Artificial Sequence
  Polyadenylate-binding protein 1 (502-511)
acccccgccgugagaacagucccucaguac

SEQ ID NO: 67100 - RNA, 24 nt, Artificial Sequence
  Ubiquitin-associated protein 2-like (952-959)
acccccuuccagcaaccuagcggc

SEQ ID NO: 67101 - RNA, 27 nt, Artificial Sequence
  IST1 homolog (241-249)
acccccuucagcuacccucugccaaag

SEQ ID NO: 67102 - RNA, 33 nt, Artificial Sequence
  IST1 homolog (241-251)
acccccuucagcuacccucugccaaagggcccg

SEQ ID NO: 67103 - RNA, 36 nt, Artificial Sequence
  TBC1 domain family member 30 (869-880)
acccccaucuucagcccuuuuccauccgugaagccg

SEQ ID NO: 67104 - RNA, 24 nt, Artificial Sequence
  Eukaryotic translation initiation factor 4 gamma 1 (647-654)
accccccugagaccucucgaccca

SEQ ID NO: 67105 - RNA, 27 nt, Artificial Sequence
  Eukaryotic translation initiation factor 4 gamma 1 (647-655)
accccccugagaccucucgacccaaca

SEQ ID NO: 67106 - RNA, 30 nt, Artificial Sequence
  Eukaryotic translation initiation factor 4 gamma 1 (647-656)
accccccugagaccucucgacccaacaagg

SEQ ID NO: 67107 - RNA, 33 nt, Artificial Sequence
  Eukaryotic translation initiation factor 4 gamma 1 (647-657)
accccccugagaccucucgacccaacaaggcuu

SEQ ID NO: 67108 - RNA, 36 nt, Artificial Sequence
  Intercellular adhesion molecule 1 (521-532)
acccccaugaagccuaacacacaggccacuccaccg

SEQ ID NO: 67109 - RNA, 36 nt, Artificial Sequence
  Vesicular, overexpressed in cancer, prosurvival protein 1 (160-171)
acccccccuccaccguacgagcagguggucaaggcc

SEQ ID NO: 67110 - RNA, 36 nt, Artificial Sequence
  GTPase-activating protein and VPS9 domain-containing protein 1 (462-473)
accccccagcugagcccugccacaacuccagcuaac

SEQ ID NO: 67111 - RNA, 27 nt, Artificial Sequence
  Translocating chain-associated membrane protein 2 (334-342)
acccccagacugccugccaggcucauc

SEQ ID NO: 67112 - RNA, 27 nt, Artificial Sequence
  Target of Nesh-SH3 (160-168)
acccccagaccuacaggcacuccacug

SEQ ID NO: 67113 - RNA, 36 nt, Artificial Sequence
  Acidic leucine-rich nuclear phosphoprotein 32 family member A (15-26)
acccccagcgacgugaaggagcugguccucgauaac

SEQ ID NO: 67114 - RNA, 33 nt, Artificial Sequence
  ATP-dependent RNA helicase A (18-28)
acccccagcuacgagaucagagccgugggcaac

SEQ ID NO: 67115 - RNA, 27 nt, Artificial Sequence
  Protein DENND6A (343-351)
acccaggcccccccuagcgugauccug

SEQ ID NO: 67116 - RNA, 27 nt, Artificial Sequence
  Gamma-glutamyltranspeptidase 1 (475-483)
acccagaucacaacugccacggcucug

SEQ ID NO: 67117 - RNA, 27 nt, Artificial Sequence
  Disks large homolog 5 (356-364)
acccagcaaagagacacagccauccag

SEQ ID NO: 67118 - RNA, 27 nt, Artificial Sequence
  U3 small nucleolar RNA-associated protein 14 homolog A (567-575)
acccagagccccuccgugaagucucug

SEQ ID NO: 67119 - RNA, 27 nt, Artificial Sequence
  Splicing factor 1 (362-370)
acccagagcagacccccuuggaugaac

SEQ ID NO: 67120 - RNA, 33 nt, Artificial Sequence
  Serine/threonine-protein kinase VRK1 (378-388)
acccagacagaggaagccauccaaacuagaagc

SEQ ID NO: 67121 - RNA, 24 nt, Artificial Sequence
  Elongation factor 1-gamma (409-416)
acccagacacuggugagagaguac

SEQ ID NO: 67122 - RNA, 27 nt, Artificial Sequence
  Nucleolar protein 58 (259-267)
acccaggugaucgagauuagcgaauac

SEQ ID NO: 67123 - RNA, 27 nt, Artificial Sequence
  Lon protease homolog 2, peroxisomal (556-564)
accagagaggccggcgugaggagccug

SEQ ID NO: 67124 - RNA, 33 nt, Artificial Sequence
  Fibronectin type III domain-containing protein 3B (182-192)
accagagaggaccaguacagcaagcccccucac

SEQ ID NO: 67125 - RNA, 27 nt, Artificial Sequence
  Myotubularin-related protein 10 (495-503)
accagaaucagccuguucggcacauuu

SEQ ID NO: 67126 - RNA, 27 nt, Artificial Sequence
  Uncharacterized protein DKFZp434B061 (517-525)
accagaagccccccuacagccucccug

SEQ ID NO: 67127 - RNA, 27 nt, Artificial Sequence
  Putative coiled-coil-helix-coiled-coil-helix domain-containing protein CHCHD2P9, mitochondrial (9-17)
accagcagaauggcccccccugcuucc

SEQ ID NO: 67128 - RNA, 30 nt, Artificial Sequence
  Splicing factor 1 (361-370)
accacacagagcagacccccuuggaugaac

SEQ ID NO: 67129 - RNA, 27 nt, Artificial Sequence
  Ubiquitin carboxyl-terminal hydrolase 22 (424-432)
accuacgugagcuucccccuggagcuc

SEQ ID NO: 67130 - RNA, 27 nt, Artificial Sequence
  Ataxin-7 (448-456)
guggagaagcaccugaacgcccagcuc

SEQ ID NO: 67131 - RNA, 27 nt, Artificial Sequence
  X-ray repair cross-complementing protein 6 (231-239)
gugcacuucgaggaaagcuccaagcug

SEQ ID NO: 67132 - RNA, 27 nt, Artificial Sequence
  Sorting nexin-19 (246-254)
gugauccugccccucauuagcagacuu

SEQ ID NO: 67133 - RNA, 27 nt, Artificial Sequence
  Eukaryotic translation initiation factor 3 subunit G (59-67)
gugaucaacggcaauauuaagaccguc

SEQ ID NO: 67134 - RNA, 27 nt, Artificial Sequence
  Inositol-tetrakisphosphate 1-kinase (261-269)
gugaucagagagcugagcagggcccuc

SEQ ID NO: 67135 - RNA, 27 nt, Artificial Sequence
  Serine/threonine-protein phosphatase 2A 65 kDa regulatory subunit A beta isoform (174-182)
gugaaggccgagaucagacagcaauuc

SEQ ID NO: 67136 - RNA, 27 nt, Artificial Sequence
  T-complex protein 1 subunit theta (234-242)
gugaaggacgccaaaaucgcugucuac

SEQ ID NO: 67137 - RNA, 27 nt, Artificial Sequence
  Nodal modulator 2 (43-51)
gugaagagcgacgucgagaucaacuac

SEQ ID NO: 67138 - RNA, 27 nt, Artificial Sequence
  Elongation factor 2 (480-488)
gugaagaccggcacaaucacuacguuc

SEQ ID NO: 67139 - RNA, 27 nt, Artificial Sequence
  Alpha/beta hydrolase domain-containing protein 14B (150-158)
gugaagacccccgcccugaucgucuac

SEQ ID NO: 67140 - RNA, 27 nt, Artificial Sequence
  Eukaryotic translation initiation factor 3 subunit E (278-286)
gugaaggucauccagcaagagagcuac

SEQ ID NO: 67141 - RNA, 27 nt, Artificial Sequence
  Exocyst complex component 3 (40-48)
gugcugcagagaagccucgucaccguu

SEQ ID NO: 67142 - RNA, 27 nt, Artificial Sequence
  HLA class II histocompatibility antigen, DRB1-11 beta chain (21-29)
gugcugagcuccccccucgcccuugcu

SEQ ID NO: 67143 - RNA, 27 nt, Artificial Sequence
  Cytoplasmic dynein 1 heavy chain 1 (1684-1692)
gugauguucaagacccccgucagcauc

SEQ ID NO: 67144 - RNA, 27 nt, Artificial Sequence
  HEAT repeat-containing protein 1 (171-179)
gugccccuggccaagggcacccucauc

SEQ ID NO: 67145 - RNA, 27 nt, Artificial Sequence
  DNA-(apurinic or apyrimidinic site) lyase (172-180)
gugcccaacgccggcagagggcugguc

SEQ ID NO: 67146 - RNA, 27 nt, Artificial Sequence
  DDB1- and CUL4-associated factor 13 (189-197)
gugcccagagaguacaucagggcccug

SEQ ID NO: 67147 - RNA, 30 nt, Artificial Sequence
  Transketolase (505-514)
gugcccagaagcggcaagccugccgagcug

SEQ ID NO: 67148 - RNA, 27 nt, Artificial Sequence
  Calcineurin-binding protein cabin-1 (1016-1024)
gugcccagaaccgagaggccugcccug

SEQ ID NO: 67149 - RNA, 27 nt, Artificial Sequence
  ATP-dependent RNA helicase DDX24 (664-672)
gugcccagaaccagcgagaucuacguc

SEQ ID NO: 67150 - RNA, 27 nt, Artificial Sequence
  Transient receptor potential cation channel subfamily V member 2 (284-292)
gugcagcuggaggacaucagaaaccuc

SEQ ID NO: 67151 - RNA, 27 nt, Artificial Sequence
  Putative eukaryotic translation initiation factor 2 subunit 3-like protein (234-242)
guggucugcgaguacaucguuaagaaa

SEQ ID NO: 67152 - RNA, 27 nt, Artificial Sequence
  ATP-citrate synthase (56-64)
guggucaagcccgaccagcugaucaaa

SEQ ID NO: 67153 - RNA, 27 nt, Artificial Sequence
  U4/U6 small nuclear ribonucleoprotein Prp31 (433-441)
guggucuacggcgggaagagcaccauc

SEQ ID NO: 67154 - RNA, 27 nt, Artificial Sequence
  Integrin beta-7 (770-778)
uggaagcaggacagcaacccccuguac

SEQ ID NO: 67155 - RNA, 24 nt, Artificial Sequence
  Heterogeneous nuclear ribonucleoprotein U (421-428)
uacgccaagaacggccaggaccug

SEQ ID NO: 67156 - RNA, 27 nt, Artificial Sequence
  Eukaryotic translation initiation factor 2 subunit 3 (83-91)
uacgccaacgcuaagaucuauaaacug

SEQ ID NO: 67157 - RNA, 27 nt, Artificial Sequence
  Pyruvate kinase PKM (83-91)
uaccacgccgagaccaucaagaacgug

SEQ ID NO: 67158 - RNA, 27 nt, Artificial Sequence
  Interferon-induced GTP-binding protein Mx1 (584-592)
uaccaccaggaggccagcaagagaauc

SEQ ID NO: 67159 - RNA, 30 nt, Artificial Sequence
  60S ribosomal protein L15 (53-62)
uacaaggccaaacagggcuaugugaucuac

SEQ ID NO: 67160 - RNA, 27 nt, Artificial Sequence
  Bifunctional glutamate/proline-tRNA ligase (791-799)
uacaaggagaaaaccggccaggaauau

SEQ ID NO: 67161 - RNA, 30 nt, Artificial Sequence
  Eukaryotic translation initiation factor 3 subunit G (70-79)
uacaagaucgacgaggauggcaaaaaguuc

SEQ ID NO: 67162 - RNA, 27 nt, Artificial Sequence
  Elongation factor 1-alpha 1 (254-262)
uacaagaucggcgggauuggaaccgug

SEQ ID NO: 67163 - RNA, 24 nt, Artificial Sequence
  Coatomer subunit alpha (73-80)
uacaagaucaaaguguggaacuau

SEQ ID NO: 67164 - RNA, 24 nt, Artificial Sequence
  60S ribosomal protein L5 (219-226)
uacaagaaacaguucagccaauau

SEQ ID NO: 67165 - RNA, 27 nt, Artificial Sequence
  Eukaryotic translation initiation factor 3 subunit B (253-261)
uacaagcuggacaaacagcacaccuuc

SEQ ID NO: 67166 - RNA, 27 nt, Artificial Sequence
  Cathepsin B (219-227)
uacaagcaggacaaacacuauggcuac

SEQ ID NO: 67167 - RNA, 36 nt, Artificial Sequence
  Peroxisomal carnitine O-octanoyltransferase (254-265)
uaccugaucggccucgaccccgagaaccuugcccug

SEQ ID NO: 67168 - RNA, 27 nt, Artificial Sequence
  Putative ATP-dependent RNA helicase DDX11-like protein 8 (448-456)
uaccugcucgagaaguucguggccguc

SEQ ID NO: 67169 - RNA, 30 nt, Artificial Sequence
  G1/S-specific cyclin-E1 (243-252)
uaccugaacgaccuccacgaggugcuucug

SEQ ID NO: 67170 - RNA, 27 nt, Artificial Sequence
  DNA replication complex GINS protein PSF1 (79-87)
uaccuguaugacagacuccuuaggauc

SEQ ID NO: 67171 - RNA, 27 nt, Artificial Sequence
  Adenomatous polyposis coli protein (899-907)
uaccccgccgaccuggcucacaagauc

SEQ ID NO: 67172 - RNA, 27 nt, Artificial Sequence
  Cathepsin D (203-211)
uaccccagaaucagcgugaacaauguc

SEQ ID NO: 67173 - RNA, 27 nt, Artificial Sequence
  Dolichyl-diphosphooligosaccharide-proteinosyltransferase subunit 2 (53-61)
uacagcaucgugggccuguccucucuc

SEQ ID NO: 67174 - RNA, 27 nt, Artificial Sequence
  Staphylococcal nuclease domain-containing protein 1 (178-186)
uacaccaucgagaaccccagacacuuc

SEQ ID NO: 67175 - RNA, 27 nt, Artificial Sequence
  Glycogen synthase kinase-3 beta (134-142)
uacgugcccgagaccgucuauagaguu

SEQ ID NO: 67176 - RNA, 27 nt, Artificial Sequence
  Titin (24337-24345)
gagagcgaccccaucguggcccaguac

SEQ ID NO: 67177 - RNA, 24 nt, Artificial Sequence
  Thymidylate synthase (255-262)
gcccacaucuaccugaaccauauu

SEQ ID NO: 67178 - RNA, 24 nt, Artificial Sequence
  Store-operated calcium entry-associated regulatory factor (104-111)
gccuacaaguucggcaaaaccgug

SEQ ID NO: 67179 - RNA, 27 nt, Artificial Sequence
  Junction plakoglobin (136-144)
gacgccgagcuggcuaccagagcacuc

SEQ ID NO: 67180 - RNA, 24 nt, Artificial Sequence
  U1 small nuclear ribonucleoprotein 70 kDa (100-107)
gacgccuucaagacccuguuugug

SEQ ID NO: 67181 - RNA, 24 nt, Artificial Sequence
  Interferon-induced helicase C domain-containing protein 1 (514-521)
gacgccuucaccaucaagacagug

SEQ ID NO: 67182 - RNA, 24 nt, Artificial Sequence
  Gamma-interferon-inducible protein 16 (59-66)
gacgccggccuggggaagcucauc

SEQ ID NO: 67183 - RNA, 27 nt, Artificial Sequence
  Ubiquitin carboxyl-terminal hydrolase 30 (44-52)
gacgcccacgagcuguuccaugugauc

SEQ ID NO: 67184 - RNA, 27 nt, Artificial Sequence
  Ubiquitin carboxyl-terminal hydrolase 51 (682-690)
gacgccaucauuaccaaggcuacaaua

SEQ ID NO: 67185 - RNA, 27 nt, Artificial Sequence
  ATP-dependent RNA helicase DDX50 (215-223)
gacgccaucagaagccuggcuuccgug

SEQ ID NO: 67186 - RNA, 27 nt, Artificial Sequence
  WD repeat-containing protein 11 (348-356)
gacgccaucagagugaccaagacaguc

SEQ ID NO: 67187 - RNA, 27 nt, Artificial Sequence
  Protein disulfide-isomerase TMX3 (362-370)
gacgccaagagcaccaucguguccauu

SEQ ID NO: 67188 - RNA, 27 nt, Artificial Sequence
  Cell division cycle protein 16 homolog (426-434)
gacgcccuggagaagaucaaagcuauu

SEQ ID NO: 67189 - RNA, 24 nt, Artificial Sequence
  Protein FAM127A (61-68)
gacgcccugaaggugaccuuccuc

SEQ ID NO: 67190 - RNA, 27 nt, Artificial Sequence
  Glucosamine-6-phosphate isomerase 2 (125-133)
gacgccagagaggugaugauccugauu

SEQ ID NO: 67191 - RNA, 27 nt, Artificial Sequence
  Little elongation complex subunit 2 (170-178)
gacgccagacuguucaccgagaagauc

SEQ ID NO: 67192 - RNA, 30 nt, Artificial Sequence
  Myotubularin (299-308)
gacgccuaccacaacgcugagcuguucuuu

SEQ ID NO: 67193 - RNA, 27 nt, Artificial Sequence
  C-Jun-amino-terminal kinase-interacting protein 4 (932-940)
gacgccuacaaggaucagaucagcgug

SEQ ID NO: 67194 - RNA, 27 nt, Artificial Sequence
  Interleukin-1 receptor accessory protein-like 1 (406-414)
gacgccuaccugagcuauaccaaggug

SEQ ID NO: 67195 - RNA, 24 nt, Artificial Sequence
  T-complex protein 1 subunit eta (49-56)
gacggcgccaccauccugaagcuc

SEQ ID NO: 67196 - RNA, 24 nt, Artificial Sequence
  Non-specific lipid-transfer protein (348-355)
gacggcuucaaggccaaccuggug

SEQ ID NO: 67197 - RNA, 24 nt, Artificial Sequence
  Ankyrin-1 (176-183)
gacggcuucaccccccuggccgug

SEQ ID NO: 67198 - RNA, 24 nt, Artificial Sequence
  Transmembrane protein 106C (116-123)
gacggcaucaagguggucaaaguu

SEQ ID NO: 67199 - RNA, 24 nt, Artificial Sequence
  Retrotransposon-derived protein PEG10 (644-651)
gacggccugaucacccccacaauu

SEQ ID NO: 67200 - RNA, 27 nt, Artificial Sequence
  Phosphatidate phosphatase LPIN1 (456-464)
gacggccugagagaucuccccagcauc

SEQ ID NO: 67201 - RNA, 24 nt, Artificial Sequence
  Phosphatidylinositol transfer protein alpha isoform (159-166)
gaccccgccaaguucaaaagcauc

SEQ ID NO: 67202 - RNA, 27 nt, Artificial Sequence
  Structural maintenance of chromosomes protein 3 (21-29)
gaccccuucagcuccaagcacaacgug

SEQ ID NO: 67203 - RNA, 24 nt, Artificial Sequence
  Interferon regulatory factor 4 (120-127)
gaccccuacaagguguauagaauc

SEQ ID NO: 67204 - RNA, 27 nt, Artificial Sequence
  Interferon regulatory factor 4 (120-128)
gaccccuacaagguguauagaaucguc

SEQ ID NO: 67205 - RNA, 24 nt, Artificial Sequence
  Plectin (4002-4009)
gaccccuacagcggcaagcugauc

SEQ ID NO: 67206 - RNA, 27 nt, Artificial Sequence
  All-trans-retinol 13,14-reductase (23-31)
aucgccuuccacaccauucccgugaua

SEQ ID NO: 67207 - RNA, 27 nt, Artificial Sequence
  Putative pre-mRNA-splicing factor ATP-dependent RNA helicase DHX16 (412-420)
aucgccaaccaccaggugcugauuaua

SEQ ID NO: 67208 - RNA, 27 nt, Artificial Sequence
  RNA-binding protein 12 (28-36)
auccccgacggcggggugcacauuguc

SEQ ID NO: 67209 - RNA, 27 nt, Artificial Sequence
  Integrator complex subunit 4 (508-516)
auccccuucagcaagccugugaaaguc

SEQ ID NO: 67210 - RNA, 33 nt, Artificial Sequence
  14-3-3 protein zeta/delta (126-136)
auccccaacgccagccaggcugaguccaaggug

SEQ ID NO: 67211 - RNA, 24 nt, Artificial Sequence
  U5 small nuclear ribonucleoprotein 200 kDa helicase (821-828)
cugcccgcccacaccgugaucauu

SEQ ID NO: 67212 - RNA, 24 nt, Artificial Sequence
  Transportin-2 (392-399)
cugccccaccuccuuccucuguug

SEQ ID NO: 67213 - RNA, 27 nt, Artificial Sequence
  Histone-lysine N-methyltransferase SETD1A (1210-1218)
cugccccucgaccacgccagccuugug

SEQ ID NO: 67214 - RNA, 27 nt, Artificial Sequence
  Polyhomeotic-like protein 3 (456-464)
cugccccucccugccagcccagugguc

SEQ ID NO: 67215 - RNA, 24 nt, Artificial Sequence
  Microphthalmia-associated transcription factor (107-114)
cugcccccuccaggccucaccauc

SEQ ID NO: 67216 - RNA, 24 nt, Artificial Sequence
  Flotillin-2 (345-352)
cugccccagaucgccgcuaagauu

SEQ ID NO: 67217 - RNA, 27 nt, Artificial Sequence
  G1/S-specific cyclin-D3 (98-106)
cugcccagagacaggcaggcccucgug

SEQ ID NO: 67218 - RNA, 27 nt, Artificial Sequence
  Cyclic AMP-dependent transcription factor ATF-6 beta (296-304)
cugcccagaccugagaggaagagcauc

SEQ ID NO: 67219 - RNA, 33 nt, Artificial Sequence
  Charged multivesicular body protein 2b (147-157)
cugcccagcgccuccaccucuaaggcuacaauc

SEQ ID NO: 67220 - RNA, 24 nt, Artificial Sequence
  Msx2-interacting protein (1295-1302)
cugcccuacagcaacaucaccgug

SEQ ID NO: 67221 - RNA, 24 nt, Artificial Sequence
  LIM domain kinase 2 (146-153)
cugcccuacagcgugacccucauc

SEQ ID NO: 67222 - RNA, 27 nt, Artificial Sequence
  Isoleucine-tRNA ligase, cytoplasmic (986-994)
auggccagagaggugaucaacaggauu

SEQ ID NO: 67223 - RNA, 24 nt, Artificial Sequence
  Probable ATP-dependent RNA helicase DHX37 (780-787)
aacgccuacaagaccccccugcuc

SEQ ID NO: 67224 - RNA, 27 nt, Artificial Sequence
  Ubiquitin D (25-33)
aaccccuacgacagcgugaagaaaauc

SEQ ID NO: 67225 - RNA, 30 nt, Artificial Sequence
  Host cell factor 1 (1378-1387)
cccgacgccaccagcucccacagaacagug

SEQ ID NO: 67226 - RNA, 24 nt, Artificial Sequence
  Queuine tRNA-ribosyltransferase subunit QTRTD1 (121-128)
cccgaggacaagccuagacugauc

SEQ ID NO: 67227 - RNA, 27 nt, Artificial Sequence
  Zinc finger and BTB domain-containing protein 7B (219-227)
ccccugccuccaccgcccccuccaccc

SEQ ID NO: 67228 - RNA, 24 nt, Artificial Sequence
  E3 ubiquitin-protein ligase UBR5 (666-673)
cccgugggcaagguccugaaaguu

SEQ ID NO: 67229 - RNA, 27 nt, Artificial Sequence
  Probable ATP-dependent RNA helicase DDX5 (308-316)
agcgccaaccacaauauccugcagauu

SEQ ID NO: 67230 - RNA, 24 nt, Artificial Sequence
  Lys-63-specific deubiquitinase BRCC36 (236-243)
agcgccguggagcugcccaagauc

SEQ ID NO: 67231 - RNA, 27 nt, Artificial Sequence
  A-kinase anchor protein 9 (740-748)
agcgacgccuaccagaccagagagauc

SEQ ID NO: 67232 - RNA, 27 nt, Artificial Sequence
  WD repeat-containing protein 35 (500-508)
accgccagcgacaagauccugauugug

SEQ ID NO: 67233 - RNA, 24 nt, Artificial Sequence
  Ubiquitin carboxyl-terminal hydrolase 36 (521-528)
acccccacacacaugccuacuauc

SEQ ID NO: 67234 - RNA, 27 nt, Artificial Sequence
  DNA damage-binding protein 1 (463-471)
guggcccaccagcaacugauccagauu

SEQ ID NO: 67235 - RNA, 27 nt, Artificial Sequence
  Something about silencing protein 10 (290-298)
gugcccgcccacggccauccugucauc

SEQ ID NO: 67236 - RNA, 27 nt, Artificial Sequence
  RING finger protein unkempt homolog (549-557)
gugccccacccuggcagcaucaccauu

SEQ ID NO: 67237 - RNA, 27 nt, Artificial Sequence
  Ecto-NOX disulfide-thiol exchanger 1 (100-108)
gugcccccuccaccgcccaccgagguc

SEQ ID NO: 67238 - RNA, 27 nt, Artificial Sequence
  Epidermal growth factor receptor kinase substrate 8 (711-719)
gugcccagacagaacgucccuguuauc

SEQ ID NO: 67239 - RNA, 24 nt, Artificial Sequence
  NEDD8-conjugating enzyme Ubc12 (86-93)
uacccccacgacccuccaaaggug

SEQ ID NO: 67240 - RNA, 24 nt, Artificial Sequence
  Protein SMG7 (359-366)
uacccccugccugccgugaagguc

SEQ ID NO: 67241 - RNA, 24 nt, Artificial Sequence
  Nicotinamide phosphoribosyltransferase (26-33)
uaccccccuaacaccagcaaggug

SEQ ID NO: 67242 - RNA, 27 nt, Artificial Sequence
  E3 ubiquitin-protein ligase RNF144A (27-35)
uaccccguggagcagaugaccacaauc

SEQ ID NO: 67243 - RNA, 24 nt, Artificial Sequence
  Elongation of very long chain fatty acids protein 1 (202-209)
uaccccgugaucauucaccugaua

SEQ ID NO: 67244 - RNA, 27 nt, Artificial Sequence
  Mediator of RNA polymerase II transcription subunit 15 (438-446)
gccagaaccccccagaacuucagcgug

SEQ ID NO: 67245 - RNA, 30 nt, Artificial Sequence
  Tubulin beta chain (335-344)
gccguguucagaggcaggaugagcaugaag

SEQ ID NO: 67246 - RNA, 48 nt, Artificial Sequence
  Myosin regulatory light chain 12A (110-125)
gacgaggaagccaccggcacaauccaggaggauuaccugagagaacuc

SEQ ID NO: 67247 - RNA, 48 nt, Artificial Sequence
  MARCKS-related protein (153-168)
gagccccaggccaagggcgcugaagcaagcgccgcguccgaggaagag

SEQ ID NO: 67248 - RNA, 27 nt, Artificial Sequence
  Cytochrome c oxidase subunit 7C, mitochondrial (49-57)
uucgccacccccuuucugguggucaga

SEQ ID NO: 67249 - RNA, 57 nt, Artificial Sequence
  Cytochrome c oxidase subunit 8A, mitochondrial (26-44)
uuccugcuccccgccggcuggauccuuagccaccuggagaccuacagaaggccugaa

SEQ ID NO: 67250 - RNA, 45 nt, Artificial Sequence
  Disintegrin and metalloproteinase domain-containing protein 10 (292-306)
uuccccaacaucggcguggagaaguuucuggaacucaauagcgag

SEQ ID NO: 67251 - RNA, 27 nt, Artificial Sequence
  Hermansky-Pudlak syndrome 5 protein (380-388)
uuccagaacagcgugaucgccuccaga

SEQ ID NO: 67252 - RNA, 30 nt, Artificial Sequence
  NADH dehydrogenase (ubiquinone) flavoprotein 3, mitochondrial (107-116)
uucaccgacgagggcgugcccaaguuucug

SEQ ID NO: 67253 - RNA, 48 nt, Artificial Sequence
  Myristoylated alanine-rich C-kinase substrate (191-206)
ggcgggaaggacgaggccgcuggaggugcagccgcggcugccgcagaa

SEQ ID NO: 67254 - RNA, 39 nt, Artificial Sequence; identical to SEQ ID NO: 43027
  Heat shock cognate 71 kDa protein (484-496)

SEQ ID NO: 67255 - RNA, 48 nt, Artificial Sequence
  Heat shock cognate 71 kDa protein (484-499)
ggcauccugaacgugagcgccgucgacaaguccaccgggaaagagaau

SEQ ID NO: 67256 - RNA, 45 nt, Artificial Sequence
  Myristoylated alanine-rich C-kinase substrate (192-206)
ggcaaggacgaggccgcugggggagcagccgcggcugccgcagaa

SEQ ID NO: 67257 - RNA, 48 nt, Artificial Sequence
  Gamma-secretase C-terminal fragment 59 (185-200)
ggcagcgaggacaagguggucgaaguugccgaggaagaggaaguggcu

SEQ ID NO: 67258 - RNA, 24 nt, Artificial Sequence
  26S proteasome non-ATPase regulatory subunit 12 (115-122)
aucaccgaccugcccauuaagcuc

SEQ ID NO: 67259 - RNA, 42 nt, Artificial Sequence
  Myristoylated alanine-rich C-kinase substrate (193-206)
aaggacgaggccgcuggcggggcagccgcggcugccgcagaa

SEQ ID NO: 67260 - RNA, 51 nt, Artificial Sequence
  NEDD4 family-interacting protein 1 (63-79)
aagcccccuagcuacaacguggccaccacacugccauccuaugacgaggcu

SEQ ID NO: 67261 - RNA, 42 nt, Artificial Sequence
  HLA class I histocompatibility antigen, A-24 alpha chain (143-156)
aagagaaaaugggaggccgcucacguggcagaacagcaaagg

SEQ ID NO: 67262 - RNA, 39 nt, Artificial Sequence
  Glyceraldehyde-3-phosphate dehydrogenase (27-39)
aagguggacaucgucgccauuaacgaucccuucauagac

SEQ ID NO: 67263 - RNA, 54 nt, Artificial Sequence
  Cytochrome c oxidase subunit 8A, mitochondrial (27-44)
cugcuccccgccggcuggauccuuagccaccuggagaccuacagaaggccugaa

SEQ ID NO: 67264 - RNA, 42 nt, Artificial Sequence
  HLA class I histocompatibility antigen, Cw-7 alpha chain (154-167)
cugagaagcuggaccgccgcugacacagcagcccagaucacu

SEQ ID NO: 67265 - RNA, 48 nt, Artificial Sequence
  HLA class I histocompatibility antigen, B-15 alpha chain (239-254)
cugaccuggcagagagacggcgaggaucaaacacaggacacugaacuc

SEQ ID NO: 67266 - RNA, 54 nt, Artificial Sequence
  HLA class I histocompatibility antigen, B-15 alpha chain (239-256)
cugaccuggcagagagacggcgaggaucaaacacaggacacugaacucguggag

SEQ ID NO: 67267 - RNA, 69 nt, Artificial Sequence
  NADH dehydrogenase (ubiquinone) 1 alpha subcomplex subunit 8 (150-172)
cccagcccugagaucgaaggcgaccugcagccagccacccacggguccagauucuacuuuuggacaaag

SEQ ID NO: 67268 - RNA, 27 nt, Artificial Sequence
  Probable ATP-dependent RNA helicase DDX47 (371-379)
cagagaaucgagcaccugauuggcaag

SEQ ID NO: 67269 - RNA, 30 nt, Artificial Sequence
  Ras GTPase-activating-like protein IQGAP3 (482-491)
cagagauacuucgacgcccugcucaagcuu

SEQ ID NO: 67270 - RNA, 27 nt, Artificial Sequence
  Prelamin-A/C (213-221)
cagagcagaaucaggauugacucccug

SEQ ID NO: 67271 - RNA, 27 nt, Artificial Sequence
  Proteasome subunit beta type-2 (170-178)
agauucauccugaaccuccccaccuuu

SEQ ID NO: 67272 - RNA, 30 nt, Artificial Sequence
  Unconventional myosin-IXa (1043-1052)
agacaggccagcgugaucauucaaagguuc

SEQ ID NO: 67273 - RNA, 36 nt, Artificial Sequence
  DNA polymerase delta subunit 3 (416-427)
agacaggugagcaucaccggcuucuuucaaaggaag

SEQ ID NO: 67274 - RNA, 30 nt, Artificial Sequence
  Calcipressin-1 (161-170)
agaaggcccgaguacaccccuauccaccug

SEQ ID NO: 67275 - RNA, 45 nt, Artificial Sequence
  Glyceraldehyde-3-phosphate dehydrogenase (25-39)
agcggcaagguggacaucgucgccauuaacgaucccuucauagac

SEQ ID NO: 67276 - RNA, 27 nt, Artificial Sequence
  Mitotic checkpoint serine/threonine-protein kinase BUB1 beta (486-494)
agccagaagauccccggcaugacccug

SEQ ID NO: 67277 - RNA, 45 nt, Artificial Sequence
  HLA class I histocompatibility antigen, B-15 alpha chain (155-169)
agcuccuggaccgccgcugacacagcagcccagaucacucaaaga

SEQ ID NO: 67278 - RNA, 33 nt, Artificial Sequence
  L-lactate dehydrogenase A chain (255-265)
agcguggccgaccuggcugaguccaucaugaag

SEQ ID NO: 67279 - RNA, 45 nt, Artificial Sequence
  IST1 homolog (278-292)
acccccccuagcuacgaguccguggacgauaucaacgccgacaag

SEQ ID NO: 67280 - RNA, 48 nt, Artificial Sequence
  IST1 homolog (278-293)
acccccccuagcuacgaguccguggacgauaucaacgccgacaagaau

SEQ ID NO: 67281 - RNA, 27 nt, Artificial Sequence
  Palladin (534-542)
guggccgacggcuaccccgucagacug

SEQ ID NO: 67282 - RNA, 30 nt, Artificial Sequence
  Interferon-induced transmembrane protein 2 (89-98)
gugggcgacgucaccggggcccaggcuuac

SEQ ID NO: 67283 - RNA, 60 nt, Artificial Sequence
  78 kDa glucose-regulated protein (425-444)
gugcccaccaagaaaagccagaucuucuccacagccucugacaaccaaccuacugucacg

SEQ ID NO: 67284 - RNA, 63 nt, Artificial Sequence
  Cytochrome c oxidase subunit 8A, mitochondrial (24-44)
gugaccuuccugcuccccgccggcuggauccuuagccaccuggagacauacagaaggccugaa

SEQ ID NO: 67285 - RNA, 42 nt, Artificial Sequence
  Alpha-enolase (70-83)
guggucaucggcauggacguugccgcuagcgaguucuuuaga

SEQ ID NO: 67286 - RNA, 48 nt, Artificial Sequence
  HLA class I histocompatibility antigen, B-15 alpha chain (241-256)
uggcagagagacggcgaggaucaaacccaggacacagaacugguggag

SEQ ID NO: 67287 - RNA, 42 nt, Artificial Sequence
  Vesicle-fusing ATPase (118-131)
gccgcugaguucauccagcaauuuaacaaucaggcauucagc

SEQ ID NO: 67288 - RNA, 45 nt, Artificial Sequence
  Moesin (14-28)
gccgagcuggaauucgcuauccagcccaacaccacaggcaagcaa

SEQ ID NO: 67289 - RNA, 48 nt, Artificial Sequence
  Moesin (13-28)
gacgccgagcuggaauucgcuauccagcccaacaccacaggcaagcaa

SEQ ID NO: 67290 - RNA, 45 nt, Artificial Sequence
  Dihydropyrimidinase-related protein 2 (340-354)
gacgagaaccaguucguggccgucaccagcacaaaugcugcaaag

SEQ ID NO: 67291 - RNA, 48 nt, Artificial Sequence
  Dihydropyrimidinase-related protein 2 (340-355)
gacgagaaccaguucguggccgucaccagcacaaaugcugcaaagguu

SEQ ID NO: 67292 - RNA, 33 nt, Artificial Sequence
  Putative ATP-dependent RNA helicase DHX33 (87-97)
gaggccaucagcgacucccugcucagaaaguac

SEQ ID NO: 67293 - RNA, 27 nt, Artificial Sequence
  Ubiquitin-associated protein 2-like (88-96)
gagggcaaccccgacacccacagcugg

SEQ ID NO: 67294 - RNA, 42 nt, Artificial Sequence
  Moesin (15-28)
gagcuggaauucgccauccagcccaacaccacaggcaagcaa

SEQ ID NO: 67295 - RNA, 48 nt, Artificial Sequence
  Acylamino-acid-releasing enzyme (440-455)
ggccaggacagcauccugucccuccccgggaacgugggacaccaagau

SEQ ID NO: 67296 - RNA, 45 nt, Artificial Sequence
  Serine/threonine-protein phosphatase 2A 65 kDa regulatory subunit A alpha isoform (202-216)
aagagcgagaucauucccauguucuccaaccuggccucugacgaa

SEQ ID NO: 67297 - RNA, 27 nt, Artificial Sequence
  60 kDa heat shock protein, mitochondrial (397-405)
cugagcgacggcguggccguccucaag

SEQ ID NO: 67298 - RNA, 42 nt, Artificial Sequence
  Disintegrin and metalloproteinase domain-containing protein 10 (83-96)
agcgacgaguucaagguggaaaccuccaacaaaguccuggau

SEQ ID NO: 67299 - RNA, 45 nt, Artificial Sequence
  Peptidyl-prolyl cis-trans isomerase A (77-91)
agcaucuacggcgagaaguucgaagacgagaacuuuauucugaaa

SEQ ID NO: 67300 - RNA, 48 nt, Artificial Sequence
  Serine/threonine-protein phosphatase 2A 65 kDa regulatory subunit A alpha isoform (201-216)
gugaagagcgagaucauucccauguucuccaaccuggccucugacgaa

SEQ ID NO: 67301 - RNA, 51 nt, Artificial Sequence
  Serine/threonine-protein phosphatase 2A 65 kDa regulatory subunit A alpha isoform (201-217)
gugaagagcgagaucauucccauguucuccaaccuggccucugacgaacag

SEQ ID NO: 67302 - RNA, 42 nt, Artificial Sequence
  Solute carrier family 2, facilitated glucose transporter member 1 (140-153)
gugcccauguacgucggcgagguuagcccuaccgcccugaga

SEQ ID NO: 67303 - RNA, 45 nt, Artificial Sequence
  Glyceraldehyde-3-phosphate dehydrogenase (116-130)
gccaagagagugaucauuagcgcucccuccgcagacgccccuaug

SEQ ID NO: 67304 - RNA, 45 nt, Artificial Sequence
  Glyceraldehyde-3-phosphate dehydrogenase (202-216)
gcccugcagaacaucauucccgcuagcaccggcgcagccaaggcg

SEQ ID NO: 67305 - RNA, 45 nt, Artificial Sequence
  60 kDa heat shock protein, mitochondrial (35-49)
gacgccagagcucugaugcuccagggcguggaucuucuggcagac

SEQ ID NO: 67306 - RNA, 45 nt, Artificial Sequence
  Tubulin beta-4B chain (22-36)
gaggugaucagcgacgaacacggcauugaucccaccgggacauac

SEQ ID NO: 67307 - RNA, 45 nt, Artificial Sequence
  Glyceraldehyde-3-phosphate dehydrogenase (269-283)
aucagcugguacgacaacgaguucggcuauuccaauagagugguc

SEQ ID NO: 67308 - RNA, 24 nt, Artificial Sequence
  RNA cytidine acetyltransferase (478-485)
gacgcccccgcucaccaucuguuc

SEQ ID NO: 67309 - RNA, 87 nt, Artificial Sequence
  Alpha-synuclein (103-131)
aacgaggaaggcgccccccaggaggggauccuggaagacaugccuguggauccagacaaugaggcuuacgaaaugccgagcgaggag

SEQ ID NO: 67310 - RNA, 15 nt, Artificial Sequence
  Carbonic anhydrase 2 (85-89)
gacggcaccuacaga

SEQ ID NO: 67311 - RNA, 15 nt, Artificial Sequence
  Carbonic anhydrase 2 (155-159)
ggccugcagaaggug

SEQ ID NO: 67312 - RNA, 15 nt, Artificial Sequence
  Carbonic anhydrase 2 (22-26)
aucgccaagggcgag

SEQ ID NO: 67313 - RNA, 15 nt, Artificial Sequence
  Carbonic anhydrase 2 (253-257)
agacagaucaaggcc

SEQ ID NO: 67314 - RNA, 15 nt, Artificial Sequence
  Carbonic anhydrase 2 (218-222)
agcuccgagcaggug

SEQ ID NO: 67315 - RNA, 45 nt, Artificial Sequence
  Complement factor H (1110-1124)
ggccccccuccaccgaucgacaacggggauauuaccagcuucccc

SEQ ID NO: 67316 - RNA, 33 nt, Artificial Sequence
  Complement factor H (1112-1122)
cccccuccaaucgacaacggcgauauuaccagc

SEQ ID NO: 67317 - RNA, 30 nt, Artificial Sequence
  Glutathione peroxidase 1 (7-16)
gccgcugcagccgcggcucagagcguguac

SEQ ID NO: 67318 - RNA, 36 nt, Artificial Sequence
  RalBP1-associated Eps domain-containing protein 2 (13-24)
gccgcugcagccgcgggcgggggaugcgguagcggc

SEQ ID NO: 67319 - RNA, 75 nt, Artificial Sequence
  Pre-mRNA-processing factor 40 homolog A (251-275)
gccgcugcagccguggucgcggcugccgcagccgcugcagccgcugccgcggcagccaacgcuaaugccagcacc

SEQ ID NO: 67320 - RNA, 33 nt, Artificial Sequence
  Cytochrome b-c1 complex subunit 9 (2-12)
gccgcugcaacccugacaagcaagcucuacucc

SEQ ID NO: 67321 - RNA, 186 nt, Artificial Sequence
  Cytochrome b-c1 complex subunit 9 (2-63)
gccgcugcaacccugacaagcaagcucuacucccuucuguucagaaggacuucuacguuugccuugaccaucauugugggcgucauguucuuugagcgggcguucgaccagggggcugaugccauauaugaccacaucaacgaaggaaaauuauggaagcauauuaaacacaaguacgagaauaaa

SEQ ID NO: 67322 - RNA, 27 nt, Artificial Sequence
  Semaphorin-3A (191-199)
gccgcugacuucaugggcagagauuuu

SEQ ID NO: 67323 - RNA, 27 nt, Artificial Sequence
  60S ribosomal protein L28 (54-62)
gccgcugacggcaaggggguggucguu

SEQ ID NO: 67324 - RNA, 27 nt, Artificial Sequence
  Glia-derived nexin (209-217)
gccgcugacggcaagagcuaccaggug

SEQ ID NO: 67325 - RNA, 27 nt, Artificial Sequence
  AF4/FMR2 family member 4 (993-1001)
gccgcugacaagagacugaccgugcuc

SEQ ID NO: 67326 - RNA, 27 nt, Artificial Sequence
  Enhancer of mRNA-decapping protein 4 (854-862)
gccgcugaccugaaccucgugcuuuac

SEQ ID NO: 67327 - RNA, 42 nt, Artificial Sequence
  Core histone macro-H2A.2 (57-70)
gccgcugagauccuggaacucgcaggcaacgccgcgagagac

SEQ ID NO: 67328 - RNA, 45 nt, Artificial Sequence
  Melanotransferrin (591-605)
gccgcugagcugagaagcgaagacuacgagcuccuuugccccaac

SEQ ID NO: 67329 - RNA, 30 nt, Artificial Sequence
  Cholinesterase (211-220)
gccgcuuucggcgggaaccccaagagcgug

SEQ ID NO: 67330 - RNA, 27 nt, Artificial Sequence
  Phospholipid transfer protein (155-163)
gccgcuuucggcgggaccuuuaagaaa

SEQ ID NO: 67331 - RNA, 27 nt, Artificial Sequence
  Bax inhibitor 1 (88-96)
gccgcuggcgcauacgugcacaugguc

SEQ ID NO: 67332 - RNA, 39 nt, Artificial Sequence
  Ran-binding protein 9 (182-194)
gccgcuggccccgggccugcaggaggugccccaaccccg

SEQ ID NO: 67333 - RNA, 45 nt, Artificial Sequence
  SKI family transcriptional corepressor 2 (519-533)
gccgcuggcagcgcagaggccgcgcccccuccagggcagccgccc

SEQ ID NO: 67334 - RNA, 42 nt, Artificial Sequence
  Fatty acid synthase (859-872)
gccgcuaucuacaacauugacaccagcuccgagucucccgau

SEQ ID NO: 67335 - RNA, 45 nt, Artificial Sequence
  Fatty acid synthase (859-873)
gccgcuaucuacaacauugacaccagcuccgagucucccgaucac

SEQ ID NO: 67336 - RNA, 48 nt, Artificial Sequence
  Fatty acid synthase (859-874)
gccgcuaucuacaacauugacaccagcuccgagucucccgaucacuau

SEQ ID NO: 67337 - RNA, 24 nt, Artificial Sequence
  Spectrin beta chain, non-erythrocytic 4 (2141-2148)
gccgcuaaggcagccccccugcuc

SEQ ID NO: 67338 - RNA, 45 nt, Artificial Sequence
  Talin-1 (859-873)
gccgcuaagauccuggcagacgccaccgcgaaaaugguggaggcu

SEQ ID NO: 67339 - RNA, 36 nt, Artificial Sequence
  Prohibitin (2-13)
gccgcuaagguguucgagagcaucggcaaauuuggg

SEQ ID NO: 67340 - RNA, 42 nt, Artificial Sequence
  Prohibitin (2-15)
gccgcuaagguguucgagagcaucggcaaauuugggcuggca

SEQ ID NO: 67341 - RNA, 45 nt, Artificial Sequence
  Beta-secretase 2 (74-88)
gccgcuaacuuccuggcaaugguggacaaucuccagggcgauagc

SEQ ID NO: 67342 - RNA, 27 nt, Artificial Sequence
  Rho guanine nucleotide exchange factor 2 (516-524)
gccgcucccccugagauguacgaagug

SEQ ID NO: 67343 - RNA, 27 nt, Artificial Sequence
  Collagen alpha-1(VI) chain (3-11)
gccgcuagagcacugcucccccuucug

SEQ ID NO: 67344 - RNA, 27 nt, Artificial Sequence
  U2 small nuclear ribonucleoprotein B'' (202-210)
gccgcuagagacgcacugcagggcuuc

SEQ ID NO: 67345 - RNA, 39 nt, Artificial Sequence
  Transport and Golgi organization protein 6 homolog (2-14)
gccgcuagacaggcagugggcagcggggcccaagagacc

SEQ ID NO: 67346 - RNA, 24 nt, Artificial Sequence
  Protein AATF (31-38)
gccgcuagagugaucgacagguuc

SEQ ID NO: 67347 - RNA, 48 nt, Artificial Sequence
  Dachshund homolog 1 (110-125)
gccgcuagcaacggcuccgggggagguggcgggggaaucucugcaggc

SEQ ID NO: 67348 - RNA, 57 nt, Artificial Sequence
  HLA class I histocompatibility antigen, A-23 alpha chain (347-365)
gccgcuagcuccgacucugcacagggcucagaugugagucugaccgccugcaagguc

SEQ ID NO: 67349 - RNA, 27 nt, Artificial Sequence
  Talin-1 (2432-2440)
gccgcuagcaccgcacagcugcucgug

SEQ ID NO: 67350 - RNA, 27 nt, Artificial Sequence
  Amyloid-like protein 2 (10-18)
gccgcuaccggcagacugcuccuucug

SEQ ID NO: 67351 - RNA, 27 nt, Artificial Sequence
  Protein BTG1 (17-25)
gccgcugugagcuucaucuccaaguuu

SEQ ID NO: 67352 - RNA, 27 nt, Artificial Sequence
  Basement membrane-specific heparan sulfate proteoglycan core protein (1409-1417)
gccgcuuacggcgggaagcugagauau

SEQ ID NO: 67353 - RNA, 27 nt, Artificial Sequence
  Glycogen phosphorylase, muscle form (154-162)
gccgcuuacggcuaugggaucagauac

SEQ ID NO: 67354 - RNA, 30 nt, Artificial Sequence
  Tyrosine-tRNA ligase, cytoplasmic (339-348)
gccgcuuaccccgacccuagcaagcagaaa

SEQ ID NO: 67355 - RNA, 30 nt, Artificial Sequence
  SPRY domain-containing SOCS box protein 1 (218-227)
gccgacgcuccccugcacagcgugggcuac

SEQ ID NO: 67356 - RNA, 27 nt, Artificial Sequence
  Ataxin-10 (381-389)
gccgacgcuagccugcucaagaaagug

SEQ ID NO: 67357 - RNA, 39 nt, Artificial Sequence
  Histidine triad nucleotide-binding protein 1 (2-14)
gccgacgagaucgcuaaggcacagguggccagacccggc

SEQ ID NO: 67358 - RNA, 27 nt, Artificial Sequence
  Eukaryotic initiation factor 4A-II (185-193)
gccgacgagaugcugagcagaggcuuc

SEQ ID NO: 67359 - RNA, 27 nt, Artificial Sequence
  Cyclin-dependent kinase 4 (83-91)
gccgacuucggccuggcuagaaucuac

SEQ ID NO: 67360 - RNA, 27 nt, Artificial Sequence
  Cyclin-dependent kinase 13 (240-248)
gccgacuucggccuggcuagacucuac

SEQ ID NO: 67361 - RNA, 21 nt, Artificial Sequence
  Coatomer subunit gamma-1 (761-767)
gccgaccacauccagaaggug

SEQ ID NO: 67362 - RNA, 21 nt, Artificial Sequence
  Eukaryotic translation initiation factor 3 subunit H (222-228)
gccgacaagcacgagcugcuc

SEQ ID NO: 67363 - RNA, 21 nt, Artificial Sequence
  Dual specificity protein phosphatase 14 (94-100)
gccgacaagauccacagcgug

SEQ ID NO: 67364 - RNA, 21 nt, Artificial Sequence
  Transformation/transcription domain-associated protein (380-386)
gccgaccuggugcaccauguc

SEQ ID NO: 67365 - RNA, 27 nt, Artificial Sequence
  Threonine-tRNA ligase, cytoplasmic (147-155)
gccgacaacaccgugaucgcuaagguc

SEQ ID NO: 67366 - RNA, 51 nt, Artificial Sequence
  H(+)/Cl(-) exchange transporter 7 (526-542)
gccgaccccggcaaguacgcucugaugggggcagccgcgcagcucggaggu

SEQ ID NO: 67367 - RNA, 27 nt, Artificial Sequence
  Cyclin-dependent kinase 18 (414-422)
gccgaggcugcacugagccacuccuac

SEQ ID NO: 67368 - RNA, 27 nt, Artificial Sequence
  Actin-binding protein anillin (758-766)
gccgaggcugaaagacugcuccuuauc

SEQ ID NO: 67369 - RNA, 36 nt, Artificial Sequence
  T-box transcription factor TBX2 (61-72)
gccgaggcuggccugcacgugagcgcacucgggccc

SEQ ID NO: 67370 - RNA, 30 nt, Artificial Sequence
  Synemin (1056-1065)
gccgaggcucccgcagccggcaucagauuc

SEQ ID NO: 67371 - RNA, 30 nt, Artificial Sequence
  IgGFc-binding protein (407-416)
gccgaggcuaccacaaaccugggccuccuu

SEQ ID NO: 67372 - RNA, 36 nt, Artificial Sequence
  Probable methyltransferase TARBP1 (184-195)
gccgaggacgcugcagcccugguggcgggcagacuc

SEQ ID NO: 67373 - RNA, 27 nt, Artificial Sequence
  Filamin-B (9-17)
gccgaggacgcucccuggaagaaaauc

SEQ ID NO: 67374 - RNA, 30 nt, Artificial Sequence
  Cytochrome c oxidase subunit 6B1 (2-11)
gccgaggacauggaaaccaagaucaaaaac

SEQ ID NO: 67375 - RNA, 30 nt, Artificial Sequence; identical to SEQ ID NO: 43148
  Voltage-dependent L-type calcium channel subunit alpha-1C (919-928)

SEQ ID NO: 67376 - RNA, 30 nt, Artificial Sequence
  F-box/WD repeat-containing protein 8 (326-335)
gccgaggacagcgcuagaacccugcucuac

SEQ ID NO: 67377 - RNA, 33 nt, Artificial Sequence
  ATP-binding cassette sub-family B member 8, mitochondrial (351-361)
gccgaggaacugggcagagggaucgcucucuuc

SEQ ID NO: 67378 - RNA, 27 nt, Artificial Sequence
  Vimentin (287-295)
gccgaggaaugguacaagagcaaauuc

SEQ ID NO: 67379 - RNA, 63 nt, Artificial Sequence
  Proliferation-associated protein 2G4 (162-182)
gccgaguucgaagugcacgaggucuacgcuguugacgugcugguaagcuccggcgaagggaag

SEQ ID NO: 67380 - RNA, 36 nt, Artificial Sequence
  Gamma-secretase C-terminal fragment 59 (563-574)
gccgaguucagacacgacagcggcuacgaagugcau

SEQ ID NO: 67381 - RNA, 39 nt, Artificial Sequence
  Gamma-secretase C-terminal fragment 59 (563-575)
gccgaguucagacacgacagcggcuacgaagugcaucac

SEQ ID NO: 67382 - RNA, 42 nt, Artificial Sequence
  Gamma-secretase C-terminal fragment 59 (563-576)
gccgaguucagacacgacagcggcuacgaagugcaucaccag

SEQ ID NO: 67383 - RNA, 45 nt, Artificial Sequence
  Gamma-secretase C-terminal fragment 59 (563-577)
gccgaguucagacacgacagcggcuacgaagugcaucaccagaag

SEQ ID NO: 67384 - RNA, 36 nt, Artificial Sequence
  Ataxin-10 (295-306)
gccgagggcgacaucagcaacguggcuaauggguuc

SEQ ID NO: 67385 - RNA, 21 nt, Artificial Sequence
  Baculoviral IAP repeat-containing protein 6 (1093-1099)
gccgagggcauccacaacuuc

SEQ ID NO: 67386 - RNA, 30 nt, Artificial Sequence; identical to SEQ ID NO: 43159
  Zinc finger protein 516 (373-382)

SEQ ID NO: 67387 - RNA, 33 nt, Artificial Sequence
  Synemin (327-337)
gccgagcacguggaaaacaugcccagcgaguuc

SEQ ID NO: 67388 - RNA, 27 nt, Artificial Sequence
  Intraflagellar transport protein 81 homolog (43-51)
gccgagaucgaccccaagcagcuggug

SEQ ID NO: 67389 - RNA, 33 nt, Artificial Sequence
  Nucleolar pre-ribosomal-associated protein 1 (403-413)
gccgagaucauuggcggggaaagaagcguguuc

SEQ ID NO: 67390 - RNA, 21 nt, Artificial Sequence
  Poly (ADP-ribose) polymerase 1 (811-817)
gccgagaucauuagaaaguac

SEQ ID NO: 67391 - RNA, 36 nt, Artificial Sequence
  Sorting nexin-18 (397-408)
gccgagaaggacgaaauggugggcgcuaacuucuuu

SEQ ID NO: 67392 - RNA, 36 nt, Artificial Sequence
  Actin-binding protein anillin (451-462)
gccgagaagggcgggaacagcaaauccaagcagcug

SEQ ID NO: 67393 - RNA, 27 nt, Artificial Sequence
  A-kinase anchor protein 9 (834-842)
gccgagaagaacuucgaagugaauuac

SEQ ID NO: 67394 - RNA, 27 nt, Artificial Sequence
  Ribosomal protein S6 kinase alpha-5 (41-49)
gccgagaaggugggcaucgaaaacuuc

SEQ ID NO: 67395 - RNA, 24 nt, Artificial Sequence
  Guanine nucleotide-binding protein G(olf) subunit alpha (78-85)
gccgagaaggugcuggcuggcaaa

SEQ ID NO: 67396 - RNA, 36 nt, Artificial Sequence
  Myosin-10 (1603-1614)
gccgagcuggaagacgagagaaagcagagggcucuc

SEQ ID NO: 67397 - RNA, 30 nt, Artificial Sequence
  Synemin (111-120)
gccgagcugggcgcucagcaaagagaacuc

SEQ ID NO: 67398 - RNA, 27 nt, Artificial Sequence
  YTH domain-containing family protein 3 (480-488)
gccgagaugaagagcguggucgacuac

SEQ ID NO: 67399 - RNA, 36 nt, Artificial Sequence
  YTH domain-containing family protein 3 (480-491)
gccgagaugaagagcguggucgacuacaacgcuuau

SEQ ID NO: 67400 - RNA, 33 nt, Artificial Sequence
  Melanoma-associated antigen 4 (134-144)
gccgagaugcuggaaagagugaucaagaacuac

SEQ ID NO: 67401 - RNA, 33 nt, Artificial Sequence
  Melanoma-associated antigen 9 (132-142)
gccgagaugcuggaaagcgugaucaagaacuac

SEQ ID NO: 67402 - RNA, 21 nt, Artificial Sequence
  Probable ATP-dependent RNA helicase DHX37 (108-114)
gccgagaugagacuguucuac

SEQ ID NO: 67403 - RNA, 33 nt, Artificial Sequence
  Synemin (1391-1401)
gccgagaugaccagcggcguguccagaucuuuc

SEQ ID NO: 67404 - RNA, 27 nt, Artificial Sequence
  Obscurin (5874-5882)
gccgagaacaagcugcacgugagccuc

SEQ ID NO: 67405 - RNA, 27 nt, Artificial Sequence
  Plexin-B2 (399-407)
gccgagaacaaucacaccguggcuuuc

SEQ ID NO: 67406 - RNA, 30 nt, Artificial Sequence
  Heterogeneous nuclear ribonucleoprotein U (399-408)
gccgagaaccccggcaaguacaauauccug

SEQ ID NO: 67407 - RNA, 27 nt, Artificial Sequence
  Protocadherin gamma-B2 (110-118)
gccgagaacccccugaauaucuucuac

SEQ ID NO: 67408 - RNA, 27 nt, Artificial Sequence
  Dolichyl-diphosphooligosaccharide-proteinosyltransferase subunit 2 (312-320)
gccgagcccgacaacaagaauguguac

SEQ ID NO: 67409 - RNA, 30 nt, Artificial Sequence
  RING finger protein 112 (134-143)
gccgagccccugcuccuugugagaaucaac

SEQ ID NO: 67410 - RNA, 33 nt, Artificial Sequence
  Plectin (1676-1686)
gccgagcaggaacuggagaagcaaagacagcuc

SEQ ID NO: 67411 - RNA, 30 nt, Artificial Sequence
  Intraflagellar transport protein 81 homolog (40-49)
gccgagcaggaaaaccugggcaagaaacuc

SEQ ID NO: 67412 - RNA, 39 nt, Artificial Sequence
  Transcription factor SOX-10 (195-207)
gccgagcagggcgggaccgcugcaauccaagcccacuac

SEQ ID NO: 67413 - RNA, 30 nt, Artificial Sequence
  Vacuolar protein sorting-associated protein 13D (998-1007)
gccgagcagggcgggacccccaucagauac

SEQ ID NO: 67414 - RNA, 27 nt, Artificial Sequence
  Tetratricopeptide repeat protein 19, mitochondrial (155-163)
gccgagcagcuguucaaggcuaccaug

SEQ ID NO: 67415 - RNA, 30 nt, Artificial Sequence
  Vacuolar protein sorting-associated protein 18 homolog (210-219)
gccgagagaggccccgacgggaggagcuuc

SEQ ID NO: 67416 - RNA, 27 nt, Artificial Sequence
  COP9 signalosome complex subunit 7a (56-64)
gccgagagcgacuucgcuuccaccuuu

SEQ ID NO: 67417 - RNA, 27 nt, Artificial Sequence
  Tumor suppressor candidate 3 (279-287)
gccgagagccacaucauucuggugcuc

SEQ ID NO: 67418 - RNA, 27 nt, Artificial Sequence
  Melanoma-associated antigen 4 (102-110)
gccgagagccuguucagagaagcucuc

SEQ ID NO: 67419 - RNA, 30 nt, Artificial Sequence; identical to SEQ ID NO: 43192
  Peroxisome assembly protein 12 (45-54)

SEQ ID NO: 67420 - RNA, 30 nt, Artificial Sequence
  Collagen alpha-1(XI) chain (281-290)
gccgagagcgugaccgaaggccccacaguc

SEQ ID NO: 67421 - RNA, 27 nt, Artificial Sequence
  Procollagen-lysine,2-oxoglutarate 5-dioxygenase 3 (47-55)
gccgagaccgaaggcuaccugagauuc

SEQ ID NO: 67422 - RNA, 30 nt, Artificial Sequence
  Procollagen-lysine,2-oxoglutarate 5-dioxygenase 3 (47-56)
gccgagaccgaaggcuaccugagauuccuc

SEQ ID NO: 67423 - RNA, 27 nt, Artificial Sequence
  Melanoma-associated antigen 4 (280-288)
gccgagaccagcuacgugaagguccug

SEQ ID NO: 67424 - RNA, 33 nt, Artificial Sequence
  Melanoma-associated antigen 1 (272-282)
gccgagaccagcuacgugaagguccuggaauau

SEQ ID NO: 67425 - RNA, 36 nt, Artificial Sequence
  THO complex subunit 5 homolog (41-52)
gccgagguggaccugagagaucccggcagggacuac

SEQ ID NO: 67426 - RNA, 33 nt, Artificial Sequence
  Peptidase M20 domain-containing protein 2 (78-88)
gccgaggugggcgcugcagccgcgcuggggguc

SEQ ID NO: 67427 - RNA, 21 nt, Artificial Sequence
  Probable cation-transporting ATPase 13A2 (443-449)
gccuuccugccccucgugccu

SEQ ID NO: 67428 - RNA, 93 nt, Artificial Sequence
  Heat shock protein HSP 90-beta (38-68)
gccuucauggaggcucugcaggcaggcgccgacaucagcaugauugggcaauuuggaguggguuucuacuccgcguaucucgucgcugaaaag

SEQ ID NO: 67429 - RNA, 33 nt, Artificial Sequence
  Integrin alpha-7 (107-117)
gccuucagccccgacucccacuaccugcucuuu

SEQ ID NO: 67430 - RNA, 21 nt, Artificial Sequence
  Clustered mitochondria protein homolog (332-338)
gccuucguggagcacagauac

SEQ ID NO: 67431 - RNA, 27 nt, Artificial Sequence
  DnaJ homolog subfamily C member 3 (224-232)
gccuucuacaagaucagcacccuguau

SEQ ID NO: 67432 - RNA, 33 nt, Artificial Sequence
  SKI family transcriptional corepressor 2 (437-447)
gccggcgcugggggagcaggugccgcgcccaag

SEQ ID NO: 67433 - RNA, 27 nt, Artificial Sequence
  Actin, gamma-enteric smooth muscle (23-31)
gccggcgacgaugcucccagagcagug

SEQ ID NO: 67434 - RNA, 48 nt, Artificial Sequence
  Tripartite motif-containing protein 67 (85-100)
gccggcgggcugggagguggcgcugggggaggcggugaccacgcagau

SEQ ID NO: 67435 - RNA, 24 nt, Artificial Sequence
  Cytochrome c oxidase subunit 6C (68-75)
gccggcaucuuccagagcgugaag

SEQ ID NO: 67436 - RNA, 69 nt, Artificial Sequence
  Histone-lysine N-methyltransferase EHMT1 (702-724)
gccggccuggggagacccaccccuggacucagccaggguccaggcaaggagacacuugaauccgcucug

SEQ ID NO: 67437 - RNA, 78 nt, Artificial Sequence
  Trifunctional enzyme subunit beta, mitochondrial (344-369)
gccggccugaccaugaacgacaucgaugcuuucgaguuucacgaagcauucagcgggcagauucucgccaauuuuaag

SEQ ID NO: 67438 - RNA, 36 nt, Artificial Sequence
  Collagen alpha-2(IV) chain (15-26)
gccggccccccugggaucaccggauucccagguuuu

SEQ ID NO: 67439 - RNA, 30 nt, Artificial Sequence; identical to SEQ ID NO: 43212
  HLA class I histocompatibility antigen, B-8 alpha chain (89-98)

SEQ ID NO: 67440 - RNA, 24 nt, Artificial Sequence
  Actin-related protein 2/3 complex subunit 5 (75-82)
gccggcagcaucgugcugaagguc

SEQ ID NO: 67441 - RNA, 27 nt, Artificial Sequence
  Glucosylceramidase (22-30)
gccggcagccugaccgggcuccuucug

SEQ ID NO: 67442 - RNA, 39 nt, Artificial Sequence
  CD44 antigen (31-43)
gccggcguguuccacgucgagaagaacgggagauacagc

SEQ ID NO: 67443 - RNA, 36 nt, Artificial Sequence
  Cytochrome c oxidase subunit 5B, mitochondrial (118-129)
gcccacuacaagcuggugccccagcaacucgcucau

SEQ ID NO: 67444 - RNA, 27 nt, Artificial Sequence
  H(+)/Cl(-) exchange transporter 5 (533-541)
gccaucgcuggcagacugcucggggug

SEQ ID NO: 67445 - RNA, 27 nt, Artificial Sequence
  HEAT repeat-containing protein 2 (474-482)
gccaucgcuaccgagcuggcacaggcc

SEQ ID NO: 67446 - RNA, 27 nt, Artificial Sequence
  Tetratricopeptide repeat protein 28 (1994-2002)
gccaucgacgagaaggugcaggcuguc

SEQ ID NO: 67447 - RNA, 27 nt, Artificial Sequence
  Prolow-density lipoprotein receptor-related protein 1 (1748-1756)
gccaucgacuuccccgagagcaagcug

SEQ ID NO: 67448 - RNA, 24 nt, Artificial Sequence
  L-dopachrome tautomerase (63-70)
gccaucgaccugcccgugagcguc

SEQ ID NO: 67449 - RNA, 24 nt, Artificial Sequence
  CCR4-NOT transcription complex subunit 1 (94-101)
gccaucgacaacccccugcacuac

SEQ ID NO: 67450 - RNA, 27 nt, Artificial Sequence
  Leucine-rich repeat-containing protein 1 (516-524)
gccaucgacagagugaccacaagcguc

SEQ ID NO: 67451 - RNA, 42 nt, Artificial Sequence
  Clathrin heavy chain 1 (1124-1137)
gccaucgacagcuacauuaaggcugaugaccccuccucuuau

SEQ ID NO: 67452 - RNA, 45 nt, Artificial Sequence
  Clathrin heavy chain 1 (1124-1138)
gccaucgacagcuacauuaaggcugaugaccccuccucuuauaug

SEQ ID NO: 67453 - RNA, 24 nt, Artificial Sequence
  Eukaryotic translation initiation factor 4 gamma 1 (748-755)
gccaucgacaccgaggaaagacug

SEQ ID NO: 67454 - RNA, 27 nt, Artificial Sequence
  Probable phospholipid-transporting ATPase VB (1005-1013)
gccaucuuccagggcaagcuggagaaa

SEQ ID NO: 67455 - RNA, 30 nt, Artificial Sequence
  Tubulin beta-2A chain (315-324)
gccaucuucagaggcaggaugagcaugaag

SEQ ID NO: 67456 - RNA, 66 nt, Artificial Sequence
  Aldose reductase (156-177)
gccaucggcauuagcaacuucaaucaccugcagguggagaugauacucaacaagcccgggcuuaaa

SEQ ID NO: 67457 - RNA, 27 nt, Artificial Sequence
  General transcription factor 3C polypeptide 1 (642-650)
gccaucauugcuaccggcugcuucggg

SEQ ID NO: 67458 - RNA, 27 nt, Artificial Sequence
  Receptor-type tyrosine-protein phosphatase zeta (195-203)
gccaucauugacggcguggagagcguc

SEQ ID NO: 67459 - RNA, 27 nt, Artificial Sequence
  Protein TANC1 (414-422)
gccaucauuagcaagcugguggcucuc

SEQ ID NO: 67460 - RNA, 27 nt, Artificial Sequence
  Putative endoplasmin-like protein (265-273)
gccaucaaggacaaaauugagaaggcu

SEQ ID NO: 67461 - RNA, 27 nt, Artificial Sequence
  Kinesin-like protein KIF2A (638-646)
gccauccuggagcagaagauugacaua

SEQ ID NO: 67462 - RNA, 27 nt, Artificial Sequence
  CLIP-associating protein 2 (795-803)
gccauccugaaguacauugagacccuc

SEQ ID NO: 67463 - RNA, 27 nt, Artificial Sequence
  Heat shock 70 kDa protein 4 (381-389)
gccauccugagccccgcuuucaaggug

SEQ ID NO: 67464 - RNA, 27 nt, Artificial Sequence
  Arginyl-tRNA-protein transferase 1 (382-390)
gccaucaugcccuacggcguguauaag

SEQ ID NO: 67465 - RNA, 27 nt, Artificial Sequence
  Probable ATP-dependent RNA helicase DDX17 (464-472)
gccaucaaccccaagcugaugcagcuc

SEQ ID NO: 67466 - RNA, 30 nt, Artificial Sequence
  Polypyrimidine tract-binding protein 1 (346-355)
gccauccccggccuggcuggggcaggaaac

SEQ ID NO: 67467 - RNA, 33 nt, Artificial Sequence
  Moesin (19-29)
gccauccagcccaacaccacaggcaagcaacug

SEQ ID NO: 67468 - RNA, 39 nt, Artificial Sequence
  Moesin (19-31)
gccauccagcccaacaccacaggcaagcaacuguucgac

SEQ ID NO: 67469 - RNA, 27 nt, Artificial Sequence
  EH domain-containing protein 2 (17-25)
gccaucagaaccgugacaagcgcucug

SEQ ID NO: 67470 - RNA, 30 nt, Artificial Sequence
  DNA-dependent protein kinase catalytic subunit (460-469)
gccaucgugaaggucuuccuggcucucgca

SEQ ID NO: 67471 - RNA, 36 nt, Artificial Sequence
  Solute carrier family 23 member 2 (58-69)
gccaucuacaccacagagaacggcauugcugaaaag

SEQ ID NO: 67472 - RNA, 24 nt, Artificial Sequence
  Nuclear factor of activated T-cells 5 (154-161)
gccaaggcuccccacuacgugcug

SEQ ID NO: 67473 - RNA, 96 nt, Artificial Sequence
  ATP synthase subunit epsilon, mitochondrial (20-51)
gccaaggcugugagagacgcacugaaaaccgaguucaaggccaacgcggaaaaaacaagcggcuccaaugucaagaucguuaaagugaagaaggag

SEQ ID NO: 67474 - RNA, 42 nt, Artificial Sequence
  Alpha-protein kinase 2 (1992-2005)
gccaagaucuacgcugcagaggcccagccccuggaaggcuuc

SEQ ID NO: 67475 - RNA, 27 nt, Artificial Sequence
  Choline-phosphate cytidylyltransferase A (99-107)
gccaagaaccuguuccccaauaccuac

SEQ ID NO: 67476 - RNA, 27 nt, Artificial Sequence
  Putative hexokinase HKDC1 (389-397)
gcccuggcugcaauccucaccagacuu

SEQ ID NO: 67477 - RNA, 39 nt, Artificial Sequence
  AT-rich interactive domain-containing protein 1B (2130-2142)
gcccuggcugcaagagccaucgcggugcagaagggcagc

SEQ ID NO: 67478 - RNA, 27 nt, Artificial Sequence
  Lamin-B receptor (330-338)
gcccuggcugcaaccguguucugcguc

SEQ ID NO: 67479 - RNA, 42 nt, Artificial Sequence
  Chondroitin sulfate proteoglycan 4 (1294-1307)
gcccuggcugacgagcccccuagccucgauccagugcagucc

SEQ ID NO: 67480 - RNA, 33 nt, Artificial Sequence
  Metastasis-associated protein MTA1 (57-67)
gcccuggcugacaagcacgcaacccucagcgug

SEQ ID NO: 67481 - RNA, 33 nt, Artificial Sequence
  Probable ATP-dependent RNA helicase DDX27 (69-79)
gcccuggcugacgugaugagccagcucaagaaa

SEQ ID NO: 67482 - RNA, 27 nt, Artificial Sequence
  Seizure 6-like protein 2 (50-58)
gcccuggcugagcuccuucacggcgca

SEQ ID NO: 67483 - RNA, 27 nt, Artificial Sequence
  Helicase SKI2W (784-792)
gcccuggcugagcucaccaagagacuu

SEQ ID NO: 67484 - RNA, 30 nt, Artificial Sequence
  Chloride channel protein 2 (506-515)
gcccuggcuggcgcagugacccacacaguc

SEQ ID NO: 67485 - RNA, 27 nt, Artificial Sequence
  RNA 3'-terminal phosphate cyclase (317-325)
gcccuggcuaacggcgugagcagaauc

SEQ ID NO: 67486 - RNA, 27 nt, Artificial Sequence
  La-related protein 1 (672-680)
gcccuggcuaacaagcucuucggcgca

SEQ ID NO: 67487 - RNA, 27 nt, Artificial Sequence
  Beclin-1 (316-324)
gcccuggcuaacaagaugggccucaaa

SEQ ID NO: 67488 - RNA, 30 nt, Artificial Sequence
  Nicastrin (550-559)
gcccuggcuaaccucaccggcacagugguc

SEQ ID NO: 67489 - RNA, 27 nt, Artificial Sequence
  Poly(rC)-binding protein 4 (256-264)
gcccuggcucaguaccucaucaccgca

SEQ ID NO: 67490 - RNA, 27 nt, Artificial Sequence
  Oxidation resistance protein 1 (776-784)
gcccuggcuagcgagccccucaaggug

SEQ ID NO: 67491 - RNA, 27 nt, Artificial Sequence
  Kinesin light chain 4 (108-116)
gcccuggcuagccaccucuccaccgug

SEQ ID NO: 67492 - RNA, 27 nt, Artificial Sequence
  E3 ubiquitin-protein ligase TRIM33 (830-838)
gcccuggcuagccucgagaaccacgug

SEQ ID NO: 67493 - RNA, 30 nt, Artificial Sequence
  Ataxin-10 (300-309)
gcccuggcuaccaucagacuccuugacgug

SEQ ID NO: 67494 - RNA, 27 nt, Artificial Sequence
  Catenin alpha-1 (336-344)
gcccugugcccccaggugaucaacgcu

SEQ ID NO: 67495 - RNA, 27 nt, Artificial Sequence
  Pre-mRNA-processing factor 40 homolog B (616-624)
gcccuggacgcuggcaacaucaagcuc

SEQ ID NO: 67496 - RNA, 27 nt, Artificial Sequence
  Coiled-coil domain-containing protein 14 (192-200)
gcccuggacgcuaacaucgcaagacuc

SEQ ID NO: 67497 - RNA, 27 nt, Artificial Sequence
  Hyccin (259-267)
gcccuggacgauaucauuuacagagcu

SEQ ID NO: 67498 - RNA, 27 nt, Artificial Sequence
  Protein transport protein Sec16A (815-823)
gcccuggacuucacccucagcagaaca

SEQ ID NO: 67499 - RNA, 27 nt, Artificial Sequence
  Rho GTPase-activating protein 5 (624-632)
gcccuggacggcaagaucuacgagcuc

SEQ ID NO: 67500 - RNA, 24 nt, Artificial Sequence
  Endoplasmin (90-97)
gcccuggacaagaucagacucauu

SEQ ID NO: 67501 - RNA, 21 nt, Artificial Sequence
  Heat shock protein HSP 90-beta (1-7)
gcccuggacaagaucagauac

SEQ ID NO: 67502 - RNA, 30 nt, Artificial Sequence; identical to SEQ ID NO: 43275
  Puromycin-sensitive aminopeptidase-like protein (412-421)

SEQ ID NO: 67503 - RNA, 33 nt, Artificial Sequence
  Ubiquitin-like modifier-activating enzyme 1 (574-584)
gcccuggacaacguggaugcuagaauguacaug

SEQ ID NO: 67504 - RNA, 27 nt, Artificial Sequence
  Receptor-type tyrosine-protein phosphatase gamma (213-221)
gcccuggaccccaucauucacggccuc

SEQ ID NO: 67505 - RNA, 27 nt, Artificial Sequence
  Chromobox protein homolog 8 (299-307)
gcccuggaccccaacggcaccagagug

SEQ ID NO: 67506 - RNA, 27 nt, Artificial Sequence
  Microtubule-associated protein 1A (1498-1506)
gcccuggaccagaaggugagaagcguc

SEQ ID NO: 67507 - RNA, 27 nt, Artificial Sequence
  Cathepsin F (223-231)
gcccuggacagaggcaccgcucaguac

SEQ ID NO: 67508 - RNA, 27 nt, Artificial Sequence
  Probable helicase with zinc finger domain (1495-1503)
gcccuggacagaauccacggcagcgug

SEQ ID NO: 67509 - RNA, 27 nt, Artificial Sequence
  Integrin beta-8 (291-299)
gcccuggacagcaagcucgcuggcauc

SEQ ID NO: 67510 - RNA, 27 nt, Artificial Sequence
  C-type lectin domain family 11 member A (131-139)
gcccuggacaccagaguggucgagcuc

SEQ ID NO: 67511 - RNA, 27 nt, Artificial Sequence
  Keratin, type I cytoskeletal 27 (352-360)
gcccuggaggaacagcuccaccaagug

SEQ ID NO: 67512 - RNA, 27 nt, Artificial Sequence
  Serine-protein kinase ATM (1512-1520)
gcccuggagaaccaccuccaugugauc

SEQ ID NO: 67513 - RNA, 27 nt, Artificial Sequence
  Tetratricopeptide repeat protein 28 (936-944)
gcccuggagcagcacaucgcuagcgug

SEQ ID NO: 67514 - RNA, 27 nt, Artificial Sequence
  DNA-dependent protein kinase catalytic subunit (315-323)
gcccuggagagcuuccucaagcaggug

SEQ ID NO: 67515 - RNA, 27 nt, Artificial Sequence
  Uridine phosphorylase 1 (48-56)
gcccuguucggcgacgugaaguuuguc

SEQ ID NO: 67516 - RNA, 27 nt, Artificial Sequence
  Ankyrin repeat and SAM domain-containing protein 1A (255-263)
gcccuguucggcaagaccgacgugguc

SEQ ID NO: 67517 - RNA, 33 nt, Artificial Sequence; identical to SEQ ID NO: 43290
  Eukaryotic translation initiation factor 2-alpha kinase 4 (1102-1112)

SEQ ID NO: 67518 - RNA, 27 nt, Artificial Sequence
  Protein transport protein Sec61 subunit alpha isoform 2 (88-96)
gcccuguucaacggcgcucagaagcuc

SEQ ID NO: 67519 - RNA, 30 nt, Artificial Sequence
  Transforming growth factor-beta-induced protein ig-h3 (2-11)
gcccuguucgugagacuccuugcucuggca

SEQ ID NO: 67520 - RNA, 24 nt, Artificial Sequence
  Jerky protein homolog (486-493)
gcccugggcgcuguggucaagguu

SEQ ID NO: 67521 - RNA, 30 nt, Artificial Sequence
  GTP-binding protein 2 (438-447)
gcccugggcgacuucgauagagcucuccuu

SEQ ID NO: 67522 - RNA, 24 nt, Artificial Sequence
  Ankyrin repeat domain-containing protein 40 (19-26)
gcccugggcgacaucagagaggug

SEQ ID NO: 67523 - RNA, 27 nt, Artificial Sequence
  Integrin alpha-11 (344-352)
gcccugggcgacagaaucuucagccuc

SEQ ID NO: 67524 - RNA, 78 nt, Artificial Sequence
  Collagen alpha-3(VI) chain (105-130)
gcccugggcuucgcugggggagagcucgcaaacaucggucuugcccuggacuuuguggucgaaaaucacuucaccaga

SEQ ID NO: 67525 - RNA, 24 nt, Artificial Sequence
  Fucose-1-phosphate guanylyltransferase (126-133)
gcccugggcaagaucuucaccgcu

SEQ ID NO: 67526 - RNA, 36 nt, Artificial Sequence
  NAD(P) transhydrogenase, mitochondrial (649-660)
gcccugggcaugaucgggguggcuggaggucucgca

SEQ ID NO: 67527 - RNA, 30 nt, Artificial Sequence
  ATP-binding cassette sub-family A member 13 (1237-1246)
gcccugggcaacgcucucgugagcgucaag

SEQ ID NO: 67528 - RNA, 24 nt, Artificial Sequence
  ATP-binding cassette sub-family B member 8, mitochondrial (320-327)
gcccugggcaacgugagaaccguc

SEQ ID NO: 67529 - RNA, 27 nt, Artificial Sequence
  T-box transcription factor TBX2 (69-77)
gcccugggcccccacccuccagcugca

SEQ ID NO: 67530 - RNA, 27 nt, Artificial Sequence
  Dolichol-phosphate mannosyltransferase subunit 3 (74-82)
gcccugggcaccgugggguacagaguc

SEQ ID NO: 67531 - RNA, 27 nt, Artificial Sequence
  Methionine-tRNA ligase, cytoplasmic (168-176)
gcccugcacagcugguuccagacccuc

SEQ ID NO: 67532 - RNA, 27 nt, Artificial Sequence
  X-ray repair cross-complementing protein 5 (456-464)
gcccugaucgacagcaugucccucgcu

SEQ ID NO: 67533 - RNA, 30 nt, Artificial Sequence
  Gamma-tubulin complex component 2 (186-195)
gcccugaucggcgacuuccucauuggggcu

SEQ ID NO: 67534 - RNA, 30 nt, Artificial Sequence
  Sodium-dependent phosphate transporter 2 (216-225)
gcccugaucagcuucggcguggcucuccuu

SEQ ID NO: 67535 - RNA, 27 nt, Artificial Sequence
  Outer dense fiber protein 2-like (357-365)
gcccugaaggacgagguggucagcguu

SEQ ID NO: 67536 - RNA, 27 nt, Artificial Sequence
  Lysine-specific demethylase 5B (1044-1052)
gcccugaaggacagcgugcagagagcu

SEQ ID NO: 67537 - RNA, 21 nt, Artificial Sequence
  Max-like protein X (153-159)
gcccugaagaucaugaaagug

SEQ ID NO: 67538 - RNA, 27 nt, Artificial Sequence
  Poly (ADP-ribose) polymerase 1 (194-202)
gcccugaagaaacagcuccccggcgug

SEQ ID NO: 67539 - RNA, 27 nt, Artificial Sequence
  Chondroitin sulfate proteoglycan 4 (2314-2322)
gcccugaagaacggccaguacugggug

SEQ ID NO: 67540 - RNA, 78 nt, Artificial Sequence
  ATP synthase subunit epsilon, mitochondrial (26-51)
gcccugaagaccgaguucaaagcuaacgcagaaaagacaagcggcuccaaugugaaaaucgucaagguuaaaaaggag

SEQ ID NO: 67541 - RNA, 27 nt, Artificial Sequence
  Ubiquitin thioesterase OTUB1 (103-111)
gcccugcucgacgauagcaaggagcuu

SEQ ID NO: 67542 - RNA, 33 nt, Artificial Sequence
  Eukaryotic translation initiation factor 3 subunit C-like protein (633-643)
gcccugcucgacauccagagcuccggcagagcu

SEQ ID NO: 67543 - RNA, 27 nt, Artificial Sequence
  Dystonin (5774-5782)
gcccugcucgacagccuuaacgaggug

SEQ ID NO: 67544 - RNA, 30 nt, Artificial Sequence
  G1/S-specific cyclin-D1 (253-262)
gcccugcucgagagcucccuuagacaggcu

SEQ ID NO: 67545 - RNA, 33 nt, Artificial Sequence
  Phosphatidylinositol 3-kinase catalytic subunit type 3 (575-585)
gcccugcucggcgacaacgagaagaugaaucuu

SEQ ID NO: 67546 - RNA, 27 nt, Artificial Sequence
  WD repeat and FYVE domain-containing protein 3 (1152-1160)
gcccugcucggccacaccgacacagug

SEQ ID NO: 67547 - RNA, 36 nt, Artificial Sequence
  ATP-binding cassette sub-family A member 13 (940-951)
gcccugcucggcaccaacggggcuggaaagacaacu

SEQ ID NO: 67548 - RNA, 27 nt, Artificial Sequence
  Immunity-related GTPase family Q protein (318-326)
gcccugcuccuucccgacgcuccucug

SEQ ID NO: 67549 - RNA, 27 nt, Artificial Sequence
  Ubiquitin-like modifier-activating enzyme 6 (782-790)
gcccugcucaacauccuuagcgaggug

SEQ ID NO: 67550 - RNA, 27 nt, Artificial Sequence
  Transmembrane O-methyltransferase (232-240)
gcccugcuccccgcuggcgcaaccgug

SEQ ID NO: 67551 - RNA, 33 nt, Artificial Sequence
  Insulin receptor substrate 2 (417-427)
gcccugcuccccgcuggcggggcacuucagcac

SEQ ID NO: 67552 - RNA, 27 nt, Artificial Sequence
  General vesicular transport factor p115 (852-860)
gcccugcuccaggagaccaaggaacuu

SEQ ID NO: 67553 - RNA, 30 nt, Artificial Sequence
  Sulfate transporter (251-260)
gcccugcucagcggcuucgugaccggggcu

SEQ ID NO: 67554 - RNA, 27 nt, Artificial Sequence
  Protein eva-1 homolog A (15-23)
gcccugcucagcaacauccuugcugca

SEQ ID NO: 67555 - RNA, 27 nt, Artificial Sequence
  Putative tyrosine-protein phosphatase auxilin (822-830)
gcccugcucagcaccaugcacacagug

SEQ ID NO: 67556 - RNA, 30 nt, Artificial Sequence; identical to SEQ ID NO: 43329
  Ankyrin repeat and SOCS box protein 11 (33-42)

SEQ ID NO: 67557 - RNA, 27 nt, Artificial Sequence
  Multiple epidermal growth factor-like domains protein 8 (1267-1275)
gcccugcucaccaacgugagcuccguc

SEQ ID NO: 67558 - RNA, 33 nt, Artificial Sequence
  Protein TANC2 (1001-1011)
gcccugauggacaaggagggccucaccgcucuu

SEQ ID NO: 67559 - RNA, 33 nt, Artificial Sequence
  Calpain-3 (37-47)
gcccugauggacaccgauggcagcgggaagcuc

SEQ ID NO: 67560 - RNA, 39 nt, Artificial Sequence
  Calpain-3 (37-49)
gcccugauggacaccgauggcagcgggaagcucaaccuu

SEQ ID NO: 67561 - RNA, 27 nt, Artificial Sequence
  Protein cordon-bleu (1169-1177)
gcccugauggaggcuauccacagcgca

SEQ ID NO: 67562 - RNA, 33 nt, Artificial Sequence
  Bestrophin-1 (462-472)
gcccugauggagcaccccgaagugagccagguc

SEQ ID NO: 67563 - RNA, 27 nt, Artificial Sequence
  Integrin beta-8 (662-670)
gcccugauggagcagcaacacuacgug

SEQ ID NO: 67564 - RNA, 63 nt, Artificial Sequence
  60 kDa heat shock protein, mitochondrial (38-58)
gcccugaugcuccagggcguggaccuucuggcugaugcagucgccguuaccauggggcccaag

SEQ ID NO: 67565 - RNA, 27 nt, Artificial Sequence
  HLA class II histocompatibility antigen, DQ beta 1 chain (103-111)
gcccugaaccaccauaaucuccuugug

SEQ ID NO: 67566 - RNA, 27 nt, Artificial Sequence
  Putative ribosome-binding factor A, mitochondrial (243-251)
gcccugaacaagcagaucauggaguac

SEQ ID NO: 67567 - RNA, 30 nt, Artificial Sequence
  Protocadherin gamma-A2 (171-180)
gcccugaaccccaaugaccacuucagccuc

SEQ ID NO: 67568 - RNA, 33 nt, Artificial Sequence
  RELT-like protein 1 (5-15)
gcccugcccggcagcgcugugcucgcagccgcg

SEQ ID NO: 67569 - RNA, 27 nt, Artificial Sequence
  Formin-1 (867-875)
gcccugcccccuccaccggcuagcauc

SEQ ID NO: 67570 - RNA, 27 nt, Artificial Sequence
  E3 ubiquitin/ISG15 ligase TRIM25 (398-406)
gcccugcccagcaagcucccuaccuuc

SEQ ID NO: 67571 - RNA, 33 nt, Artificial Sequence
  Epsin-2 (283-293)
gcccugcccagcuccggcccugcugcacagaag

SEQ ID NO: 67572 - RNA, 30 nt, Artificial Sequence
  Transcription factor SOX-10 (341-350)
gcccugcccaccgugagcccuccaggcguc

SEQ ID NO: 67573 - RNA, 27 nt, Artificial Sequence
  Nuclear receptor subfamily 1 group D member 2 (527-535)
gcccugcaggagacccucaucagagcu

SEQ ID NO: 67574 - RNA, 27 nt, Artificial Sequence
  Interleukin-17 receptor D (642-650)
gcccugcagccccuccuucacaccgug

SEQ ID NO: 67575 - RNA, 27 nt, Artificial Sequence
  Golgin subfamily A member 3 (542-550)
gcccugcagagccaacuccagcaggug

SEQ ID NO: 67576 - RNA, 27 nt, Artificial Sequence
  V-type proton ATPase subunit C 1 (264-272)
gcccugagaguguucgucgagagcguu

SEQ ID NO: 67577 - RNA, 27 nt, Artificial Sequence
  Rootletin (252-260)
gcccugagcgaggacaucagaaaggug

SEQ ID NO: 67578 - RNA, 33 nt, Artificial Sequence
  Catenin alpha-1 (773-783)
gcccugagcgaguucaaggcuauggacuccauc

SEQ ID NO: 67579 - RNA, 27 nt, Artificial Sequence
  Staphylococcal nuclease domain-containing protein 1 (626-634)
gcccugagcaaggugcacuucaccgcu

SEQ ID NO: 67580 - RNA, 33 nt, Artificial Sequence
  Ubiquitin carboxyl-terminal hydrolase isozyme L5 (129-139)
gcccugagcaacuccgacgugaucagacagguc

SEQ ID NO: 67581 - RNA, 27 nt, Artificial Sequence
  Serine incorporator 5 (278-286)
gcccugagcuccaagcccgcugaggug

SEQ ID NO: 67582 - RNA, 27 nt, Artificial Sequence
  NudC domain-containing protein 3 (153-161)
gcccugagcuccucuucaaucagagug

SEQ ID NO: 67583 - RNA, 27 nt, Artificial Sequence
  Piezo-type mechanosensitive ion channel component 1 (218-226)
gcccugagcuccguguaccuccuucug

SEQ ID NO: 67584 - RNA, 30 nt, Artificial Sequence
  Glutamate receptor ionotropic, kainate 3 (632-641)
gcccugagcaccagaaucauuggcgggaua

SEQ ID NO: 67585 - RNA, 27 nt, Artificial Sequence
  A-kinase anchor protein 9 (1723-1731)
gcccugaccgacuacaucacaagacuc

SEQ ID NO: 67586 - RNA, 27 nt, Artificial Sequence
  Transmembraneoprotein NMB (477-485)
gcccugaccagcacacucaucuccgug

SEQ ID NO: 67587 - RNA, 27 nt, Artificial Sequence
  Glutamine-tRNA ligase (715-723)
gcccugguggacugcagcgucgcucuc

SEQ ID NO: 67588 - RNA, 27 nt, Artificial Sequence
  (4658-4666)
gcccugguggacuggcucuacaagguc

SEQ ID NO: 67589 - RNA, 33 nt, Artificial Sequence
  Ribosome biogenesis protein BRX1 homolog (228-238)
gcccugguggagaucggccccagauucguccuc

SEQ ID NO: 67590 - RNA, 39 nt, Artificial Sequence
  Kinesin-like protein KIF1A (397-409)
gcccuggugggcaugagccccuccucuucacucagugcu

SEQ ID NO: 67591 - RNA, 30 nt, Artificial Sequence
  Plexin-A2 (475-484)
gcccuggugggcaccacaagcgggcccguc

SEQ ID NO: 67592 - RNA, 30 nt, Artificial Sequence
  E3 ubiquitin-protein ligase TRIP12 (1669-1678)
gcccuggugagccaggagcuccaaagagcu

SEQ ID NO: 67593 - RNA, 27 nt, Artificial Sequence
  Diphthamide biosynthesis protein 1 (172-180)
gcccuggugagcaccauccaguucguc

SEQ ID NO: 67594 - RNA, 30 nt, Artificial Sequence
  ER membrane protein complex subunit 7 (4-13)
gcccuguggggcuucuuucccgugcuccuu

SEQ ID NO: 67595 - RNA, 30 nt, Artificial Sequence
  Transmembrane protein 234 (16-25)
gcccuguggggcgggacccagccccuccuu

SEQ ID NO: 67596 - RNA, 30 nt, Artificial Sequence
  tRNA (uracil-5-)-methyltransferase homolog A (132-141)
gcccuguggaagggcagaccccucagcgug

SEQ ID NO: 67597 - RNA, 30 nt, Artificial Sequence
  WD repeat-containing protein 60 (1057-1066)
gcccuguggcccgagggcaagcuccacaaa

SEQ ID NO: 67598 - RNA, 27 nt, Artificial Sequence
  Beta-hexosaminidase subunit beta (43-51)
gcccuguggccccucccucuuagcgug

SEQ ID NO: 67599 - RNA, 45 nt, Artificial Sequence
  Phosphatidate phosphatase LPIN1 (411-425)
gcccuguacuuccccaagaacggcgacccuagcgggcucgcuaaa

SEQ ID NO: 67600 - RNA, 27 nt, Artificial Sequence
  Caskin-2 (229-237)
gcccuguacggcaagaccgaggugguc

SEQ ID NO: 67601 - RNA, 27 nt, Artificial Sequence
  Ankyrin repeat and SAM domain-containing protein 1A (190-198)
gcccuguacggcagacucgaggugguc

SEQ ID NO: 67602 - RNA, 30 nt, Artificial Sequence
  Hemicentin-1 (1594-1603)
gcccuguacaucgacaagggccaguaucuc

SEQ ID NO: 67603 - RNA, 36 nt, Artificial Sequence
  Cytoplasmic dynein 1 heavy chain 1 (3101-3112)
gcccuguaccaggugggcaaggaguucaccagcaaa

SEQ ID NO: 67604 - RNA, 36 nt, Artificial Sequence
  Type II inositol 3,4-bisphosphate 4-phosphatase (472-483)
gcccuguacaccgcuagacccggcgggauccucaag

SEQ ID NO: 67605 - RNA, 39 nt, Artificial Sequence
  Type II inositol 3,4-bisphosphate 4-phosphatase (472-484)
gcccuguacaccgcuagacccggcgggauccucaagaaa

SEQ ID NO: 67606 - RNA, 27 nt, Artificial Sequence
  Dedicator of cytokinesis protein 7 (712-720)
gccauggcuagcaucauuaacagacug

SEQ ID NO: 67607 - RNA, 27 nt, Artificial Sequence
  Protein transport protein Sec31A (697-705)
gccauggacaccagcacagugggcguc

SEQ ID NO: 67608 - RNA, 24 nt, Artificial Sequence
  Synemin (36-43)
gccauguucgacaagaaagugcag

SEQ ID NO: 67609 - RNA, 33 nt, Artificial Sequence; identical to SEQ ID NO: 43382
  Exportin-4 (248-258)

SEQ ID NO: 67610 - RNA, 33 nt, Artificial Sequence
  NAD(P)H dehydrogenase (quinone) 1 (21-31)
gccaugaaggaggcugcagccgcggcucugaaa

SEQ ID NO: 67611 - RNA, 30 nt, Artificial Sequence
  Tryptophan-tRNA ligase, cytoplasmic (424-433)
gccaugcugaccggcgagcucaagaaagcu

SEQ ID NO: 67612 - RNA, 27 nt, Artificial Sequence
  Nucleoporin p58/p45 (376-384)
gccaugcagaagaucuaccaaaccuuc

SEQ ID NO: 67613 - RNA, 27 nt, Artificial Sequence
  Tenascin (3-11)
gccaugacccagcugcucgcuggcgug

SEQ ID NO: 67614 - RNA, 27 nt, Artificial Sequence
  S-adenosylmethionine synthase isoform type-1 (75-83)
gccaugguggacuaccagagagucguu

SEQ ID NO: 67615 - RNA, 30 nt, Artificial Sequence
  Zinc finger protein 697 (233-242)
gccauggugggcaugaugggggucggaguu

SEQ ID NO: 67616 - RNA, 33 nt, Artificial Sequence
  Leucine zipper putative tumor suppressor 1 (529-539)
gccauguaccagagaaaccaaaggcuggagaag

SEQ ID NO: 67617 - RNA, 24 nt, Artificial Sequence
  Eukaryotic translation initiation factor 2 subunit 3 (84-91)
gccaacgcuaagaucuacaaacug

SEQ ID NO: 67618 - RNA, 42 nt, Artificial Sequence
  Beta-secretase 2 (75-88)
gccaacuuccuggcuaugguggacaaucuccagggcgauagc

SEQ ID NO: 67619 - RNA, 21 nt, Artificial Sequence
  EH domain-containing protein 1 (504-510)
gccaaccaccugaucaaggug

SEQ ID NO: 67620 - RNA, 24 nt, Artificial Sequence
  Galectin-3 (142-149)
gccaacagaaucgcucuggacuuc

SEQ ID NO: 67621 - RNA, 27 nt, Artificial Sequence
  Spectrin alpha chain, non-erythrocytic 1 (94-102)
gccaacagcggcgcuaucgugaagcug

SEQ ID NO: 67622 - RNA, 27 nt, Artificial Sequence
  AT-rich interactive domain-containing protein 2 (940-948)
gcccccgcuauccaccagauugugcug

SEQ ID NO: 67623 - RNA, 33 nt, Artificial Sequence
  E3 ubiquitin-protein ligase MIB2 (408-418)
gcccccgcucugggcagaguggggaaggucguu

SEQ ID NO: 67624 - RNA, 30 nt, Artificial Sequence
  Biogenesis of lysosome-related organelles complex 1 subunit 3 (99-108)
gcccccgcuccugcaccagccagaagccug

SEQ ID NO: 67625 - RNA, 27 nt, Artificial Sequence
  Protein capicua homolog (1681-1689)
gcccccgcuccuccagcagugcaguuc

SEQ ID NO: 67626 - RNA, 30 nt, Artificial Sequence
  Cathepsin F (20-29)
gcccccgcucagccuagagcagccagcuuc

SEQ ID NO: 67627 - RNA, 27 nt, Artificial Sequence
  Serum paraoxonase/arylesterase 2 (78-86)
gcccccgacaagccuggcgggauccug

SEQ ID NO: 67628 - RNA, 54 nt, Artificial Sequence
  Fructose-bisphosphate aldolase A (79-96)
gcccccggcaaggggauccuggcugcagacgagagcaccggauccauugccaaa

SEQ ID NO: 67629 - RNA, 30 nt, Artificial Sequence
  Lysosome-associated membraneoprotein 1 (3-12)
gcccccggcagcgcuagaaggccucugcuc

SEQ ID NO: 67630 - RNA, 36 nt, Artificial Sequence
  Dynein heavy chain domain-containing protein 1 (4690-4701)
gcccccggcaccagcgaccugccugcuccagcagau

SEQ ID NO: 67631 - RNA, 27 nt, Artificial Sequence
  Protein SEC13 homolog (98-106)
gccccccacgacuacggccugauccuc

SEQ ID NO: 67632 - RNA, 27 nt, Artificial Sequence
  Chondroitin sulfate proteoglycan 4 (1875-1883)
gccccccacaacggcuuccugagccuc

SEQ ID NO: 67633 - RNA, 30 nt, Artificial Sequence
  Hypoxia-inducible factor 1-alpha (828-837)
gcccccauccagggcagcagaaaccugcuc

SEQ ID NO: 67634 - RNA, 24 nt, Artificial Sequence
  TRAF2 and NCK-interacting protein kinase (326-333)
gcccccaagccuuaccacaaauuc

SEQ ID NO: 67635 - RNA, 30 nt, Artificial Sequence
  Ankyrin repeat and SOCS box protein 11 (248-257)
gcccccaagagcuccguggagcaggcucug

SEQ ID NO: 67636 - RNA, 27 nt, Artificial Sequence
  Cancer/testis antigen 2 (114-122)
gccccccugccuagaccaggcgcugug

SEQ ID NO: 67637 - RNA, 48 nt, Artificial Sequence
  GTP-binding nuclear protein Ran (203-218)
gcccccccugagguggucauggacccagcucuggcagcccaguacgaa

SEQ ID NO: 67638 - RNA, 51 nt, Artificial Sequence
  GTP-binding nuclear protein Ran (203-219)
gcccccccugagguggucauggacccagcucuggcagcccaguacgaacac

SEQ ID NO: 67639 - RNA, 30 nt, Artificial Sequence
  DNA-binding protein inhibitor ID-4 (131-140)
gcccccccuagaaccccacugacagcucuc

SEQ ID NO: 67640 - RNA, 39 nt, Artificial Sequence
  Heat shock cognate 71 kDa protein (630-642)
gcccccccuagcggcggggcuuccucuggaccaaccauc

SEQ ID NO: 67641 - RNA, 33 nt, Artificial Sequence
  Uncharacterized protein C17orf51 (66-76)
gcccccccuaccagaagggcucaggcagcccug

SEQ ID NO: 67642 - RNA, 36 nt, Artificial Sequence
  UPF0669 protein C6orf120 (3-14)
gcccccagaggcagggcugcaccuuggaccacagcc

SEQ ID NO: 67643 - RNA, 24 nt, Artificial Sequence
  Procollagen-lysine,2-oxoglutarate 5-dioxygenase 1 (691-698)
gcccccagaaagggcuggacccug

SEQ ID NO: 67644 - RNA, 27 nt, Artificial Sequence
  La-related protein 7 (193-201)
gcccccagaaagccuggcaucuuccca

SEQ ID NO: 67645 - RNA, 123 nt, Artificial Sequence
  DNA-binding protein RFX5 (352-392)
gcccccagacugagcuccggcgcucucaagguggcaacccuuccucugucuucaagggccggggcgccaccggcugccguccccaucauuaacaugauauugccuacaguuccagcauuaccc

SEQ ID NO: 67646 - RNA, 30 nt, Artificial Sequence
  RNA-binding protein 33 (702-711)
gcccccagaaacagcaaucugagggagcuc

SEQ ID NO: 67647 - RNA, 27 nt, Artificial Sequence
  Alpha-2-macroglobulin receptor-associated protein (2-10)
gcccccagaagggugcggagcuuccug

SEQ ID NO: 67648 - RNA, 27 nt, Artificial Sequence
  Alpha-1-syntrophin (7-15)
gcccccagaaccggccugcucgagcuu

SEQ ID NO: 67649 - RNA, 36 nt, Artificial Sequence
  Nance-Horan syndrome protein (1306-1317)
gcccccagcgcuggccuggaggaaguggcacagccu

SEQ ID NO: 67650 - RNA, 27 nt, Artificial Sequence
  Eukaryotic translation initiation factor 3 subunit C-like protein (203-211)
gcccccagcggcgaguccagaaaguuc

SEQ ID NO: 67651 - RNA, 27 nt, Artificial Sequence
  Rho GTPase-activating protein 7 (241-249)
gcccccagcaagcugggccucaucauu

SEQ ID NO: 67652 - RNA, 27 nt, Artificial Sequence
  Dickkopf-related protein 3 (30-38)
gcccccgugaagccuggcccagcucug

SEQ ID NO: 67653 - RNA, 27 nt, Artificial Sequence
  Hemicentin-1 (1702-1710)
gcccaggagaucgacagaggccaauac

SEQ ID NO: 67654 - RNA, 33 nt, Artificial Sequence; identical to SEQ ID NO: 43427
  Coatomer subunit alpha (141-151)

SEQ ID NO: 67655 - RNA, 30 nt, Artificial Sequence
  Voltage-dependent T-type calcium channel subunit alpha-1H (1841-1850)
gcccaguucgugcuggucaacguuguggua

SEQ ID NO: 67656 - RNA, 24 nt, Artificial Sequence
  Ran GTPase-activating protein 1 (175-182)
gcccagggcaagccccuggcucuc

SEQ ID NO: 67657 - RNA, 36 nt, Artificial Sequence
  Heat shock 70 kDa protein 1B (623-634)
gcccagggccccaaggggggaagcgguuccggcccu

SEQ ID NO: 67658 - RNA, 39 nt, Artificial Sequence
  HLA class I histocompatibility antigen, A-69 alpha chain (234-246)
gcccagggcagcgacgugucccugaccgcuugcaagguc

SEQ ID NO: 67659 - RNA, 51 nt, Artificial Sequence
  T-complex protein 1 subunit zeta (291-307)
gcccagcugggcgugcaagcuuucgcagacgcccuccuuaucauucccaag

SEQ ID NO: 67660 - RNA, 27 nt, Artificial Sequence
  Retrotransposon-derived protein PEG10 (460-468)
gcccagaacggcaucccccugagaauu

SEQ ID NO: 67661 - RNA, 33 nt, Artificial Sequence
  F-box/LRR-repeat protein 18 (437-447)
gcccagcccgcuaugcacgcagugccuagaggc

SEQ ID NO: 67662 - RNA, 30 nt, Artificial Sequence
  Actin, aortic smooth muscle (60-69)
gcccagagcaagagaggcauccugacccuc

SEQ ID NO: 67663 - RNA, 30 nt, Artificial Sequence
  Histone-lysine N-methyltransferase NSD3 (366-375)
gcccagugggacaucggcauugcucacgca

SEQ ID NO: 67664 - RNA, 27 nt, Artificial Sequence
  Arrestin domain-containing protein 1 (236-244)
gcccaguggcacgagcaaauccuggug

SEQ ID NO: 67665 - RNA, 27 nt, Artificial Sequence
  Glycogen phosphorylase, liver form (247-255)
gccagagcucccaacgacuucaaucug

SEQ ID NO: 67666 - RNA, 27 nt, Artificial Sequence
  Myosin-10 (1639-1647)
gccagagacgaggugaucaagcagcug

SEQ ID NO: 67667 - RNA, 27 nt, Artificial Sequence
  Apoptosis-inducing factor 1, mitochondrial (148-156)
gccagagaccccggcgcuagggugcug

SEQ ID NO: 67668 - RNA, 30 nt, Artificial Sequence
  HLA class II histocompatibility antigen, DQ beta 1 chain (33-42)
gccagauucgacagcgaugugggcgucuac

SEQ ID NO: 67669 - RNA, 33 nt, Artificial Sequence
  HLA class II histocompatibility antigen, DQ beta 1 chain (33-43)
gccagauucgacagcgaugugggcgucuacagg

SEQ ID NO: 67670 - RNA, 30 nt, Artificial Sequence
  H/ACA ribonucleoprotein complex subunit 3 (33-42)
gccagauucagccccgacgauaaguacucc

SEQ ID NO: 67671 - RNA, 24 nt, Artificial Sequence
  ATP-dependent RNA helicase DDX24 (411-418)
gccagauucaccggcaucaagaca

SEQ ID NO: 67672 - RNA, 27 nt, Artificial Sequence
  60S ribosomal protein L7 (75-83)
gccagaaaggcuggcaacuucuacgug

SEQ ID NO: 67673 - RNA, 27 nt, Artificial Sequence
  Phospholipid transfer protein (319-327)
gccagacugagcgcuaagauggcacuc

SEQ ID NO: 67674 - RNA, 27 nt, Artificial Sequence
  V-type proton ATPase subunit S1 (217-225)
gccagacugagccucaccuacgagagg

SEQ ID NO: 67675 - RNA, 27 nt, Artificial Sequence
  Peroxisomal acyl-coenzyme A oxidase 1 (492-500)
gccagacugguggagaucgcugcaaag

SEQ ID NO: 67676 - RNA, 33 nt, Artificial Sequence
  Membrane-associated guanylate kinase, WW and PDZ domain-containing protein 2 (849-859)
gccagaaacggccaggugaaucugaccgucagg

SEQ ID NO: 67677 - RNA, 33 nt, Artificial Sequence
  Melanotransferrin (274-284)
gccagagugcccgcucacgcagucguugugagg

SEQ ID NO: 67678 - RNA, 36 nt, Artificial Sequence
  Syntenin-1 (35-46)
gccagcgcucccaucccucacgacggcaaccuguac

SEQ ID NO: 67679 - RNA, 39 nt, Artificial Sequence
  Receptor-type tyrosine-protein phosphatase mu (849-861)
gccagcgacaccuccucucuggugcagucacacacauac

SEQ ID NO: 67680 - RNA, 27 nt, Artificial Sequence
  Heterogeneous nuclear ribonucleoprotein M (578-586)
gccagcuucgacagagcuaucgagaug

SEQ ID NO: 67681 - RNA, 24 nt, Artificial Sequence
  Cytochrome c oxidase subunit 7A2, mitochondrial (76-83)
gccagcuuccccaagaaacaggag

SEQ ID NO: 67682 - RNA, 87 nt, Artificial Sequence
  Cytochrome c oxidase subunit 5B, mitochondrial (32-60)
gccagcggcgggggagugcccaccgacgaggaacaggcuacaggucuggagagagaaaucaugcucgcagccaagaaaggccuugau

SEQ ID NO: 67683 - RNA, 24 nt, Artificial Sequence
  Chromodomain-helicase-DNA-binding protein 4 (1045-1052)
gccagcggcaagcugcuccuucug

SEQ ID NO: 67684 - RNA, 24 nt, Artificial Sequence
  Thioredoxin domain-containing protein 12 (52-59)
gccagcggccugccccucauggug

SEQ ID NO: 67685 - RNA, 24 nt, Artificial Sequence
  Histone deacetylase 6 (38-45)
gccagcggcuccgugcugagacuc

SEQ ID NO: 67686 - RNA, 27 nt, Artificial Sequence
  DNA damage-binding protein 1 (882-890)
gccagcaucaacuccaccgugagacug

SEQ ID NO: 67687 - RNA, 24 nt, Artificial Sequence
  Alpha-actinin-3 (115-122)
gccagcaagggcgugaaacugguc

SEQ ID NO: 67688 - RNA, 27 nt, Artificial Sequence
  Adhesion G protein-coupled receptor A3 (756-764)
gccagccugcuccaccccguggucuac

SEQ ID NO: 67689 - RNA, 27 nt, Artificial Sequence
  Dynein light chain roadblock-type 1 (43-51)
gccagccugaugcacuccuucauccuc

SEQ ID NO: 67690 - RNA, 27 nt, Artificial Sequence
  Proline synthase co-transcribed bacterial homolog protein (77-85)
gccagcaaccccaagauccugucccuc

SEQ ID NO: 67691 - RNA, 30 nt, Artificial Sequence
  Solute carrier family 52, riboflavin transporter, member 2 (127-136)
gccagcaacgugaccuuccugcccuuucuc

SEQ ID NO: 67692 - RNA, 27 nt, Artificial Sequence
  Alanine-tRNA ligase, cytoplasmic (341-349)
gccagcagaggcuucuuugcuacccug

SEQ ID NO: 67693 - RNA, 21 nt, Artificial Sequence
  Histone H2B type 2-F (78-84)
gccagcagacuggcucacuac

SEQ ID NO: 67694 - RNA, 54 nt, Artificial Sequence
  HLA class I histocompatibility antigen, A-23 alpha chain (348-365)
gccagcuccgacucugcucagggcucagaugugagucugaccgcaugcaagguc

SEQ ID NO: 67695 - RNA, 27 nt, Artificial Sequence
  OTU domain-containing protein 5 (237-245)
gccagcucccccgagcacccugaacug

SEQ ID NO: 67696 - RNA, 27 nt, Artificial Sequence
  40S ribosomal protein S19 (58-66)
gccagcaccgcuagacaccuguaccuc

SEQ ID NO: 67697 - RNA, 30 nt, Artificial Sequence
  Cullin-1 (195-204)
gccagcaccuuccagauggcuauccugcuc

SEQ ID NO: 67698 - RNA, 27 nt, Artificial Sequence
  Dolichyl-diphosphooligosaccharide-proteinosyltransferase subunit DAD1 (100-108)
gccagcaccauccugcaccucgugguc

SEQ ID NO: 67699 - RNA, 30 nt, Artificial Sequence
  Thyroid adenoma-associated protein (153-162)
gccagcgugaacaaucugcucaagaacguc

SEQ ID NO: 67700 - RNA, 24 nt, Artificial Sequence
  Cystic fibrosis transmembrane conductance regulator (9-16)
gccagcguggucuccaagcuguuc

SEQ ID NO: 67701 - RNA, 27 nt, Artificial Sequence
  ATP-citrate synthase (223-231)
gccaccgcugacuacaucugcaaggug

SEQ ID NO: 67702 - RNA, 27 nt, Artificial Sequence
  Leucine-rich repeat-containing protein 47 (393-401)
gccaccgcucccccucacgugacaguc

SEQ ID NO: 67703 - RNA, 30 nt, Artificial Sequence
  Hermansky-Pudlak syndrome 1 protein (7-16)
gccaccgagggcgcugaagugcuguucuac

SEQ ID NO: 67704 - RNA, 27 nt, Artificial Sequence
  Kinesin-like protein KIF3C (506-514)
gccaccgagcugcucgcugcaaaguac

SEQ ID NO: 67705 - RNA, 27 nt, Artificial Sequence
  EF-hand calcium-binding domain-containing protein 4B isoform a (677-685)
gccaccgagaacaaucugaucuucuac

SEQ ID NO: 67706 - RNA, 27 nt, Artificial Sequence
  Bestrophin-1 (573-581)
gccaccuucacaggcauccuggggaag

SEQ ID NO: 67707 - RNA, 27 nt, Artificial Sequence
  Apoptosis inhibitor 5 (19-27)
gccaccggcgagaaccugcccagagug

SEQ ID NO: 67708 - RNA, 24 nt, Artificial Sequence
  (11-18)
gccaccggcagacugcuccuucug

SEQ ID NO: 67709 - RNA, 33 nt, Artificial Sequence
  40S ribosomal protein S15 (135-145)
gccacccacagcuccagauucaucccccugaag

SEQ ID NO: 67710 - RNA, 27 nt, Artificial Sequence
  Poly(rC)-binding protein 4 (135-143)
gccaccauccccuaccacccuagccug

SEQ ID NO: 67711 - RNA, 30 nt, Artificial Sequence
  Phosphatidylinositol 4-kinase alpha (169-178)
gccaccaucagaaacgugcugagggagaag

SEQ ID NO: 67712 - RNA, 27 nt, Artificial Sequence
  Cathepsin D (182-190)
gccaccaagcagcccggcaucacauuc

SEQ ID NO: 67713 - RNA, 36 nt, Artificial Sequence
  Protein FAM171B (413-424)
gccacccugcccagaaagggccagcucguguacggg

SEQ ID NO: 67714 - RNA, 27 nt, Artificial Sequence
  Nuclear fragile X mental retardation-interacting protein 2 (116-124)
gccaccaaccccaucagcagagugcug

SEQ ID NO: 67715 - RNA, 39 nt, Artificial Sequence
  UPF0606 protein KIAA1549L (947-959)
gccaccacacugggcagcuacacugugcagauggucaag

SEQ ID NO: 67716 - RNA, 27 nt, Artificial Sequence
  PH domain leucine-rich repeat-containing protein phosphatase 1 (7-15)
gccaccgugcagagacugcccgagcuc

SEQ ID NO: 67717 - RNA, 27 nt, Artificial Sequence
  Myelin proteolipid protein (206-214)
gccaccuacaacuucgcugugcugaag

SEQ ID NO: 67718 - RNA, 30 nt, Artificial Sequence
  Eyes absent homolog 1 (124-133)
gccaccuacccccagccuggccaaccauau

SEQ ID NO: 67719 - RNA, 27 nt, Artificial Sequence
  Sigma non-opioid intracellular receptor 1 (17-25)
gccguggcugcaguccugacccagguu

SEQ ID NO: 67720 - RNA, 27 nt, Artificial Sequence
  Unconventional myosin-Ic (83-91)
gccguggcugacaccgucuacagagca

SEQ ID NO: 67721 - RNA, 27 nt, Artificial Sequence
  Membrane-associated guanylate kinase, WW and PDZ domain-containing protein 2 (1428-1436)
gccguggcucccggcccuuggaagguc

SEQ ID NO: 67722 - RNA, 27 nt, Artificial Sequence
  Endothelin B receptor (291-299)
gccguggcuagcugguccagaaucaag

SEQ ID NO: 67723 - RNA, 27 nt, Artificial Sequence
  Sideroflexin-3 (161-169)
gccguggcuaccgcacugggccucaag

SEQ ID NO: 67724 - RNA, 27 nt, Artificial Sequence
  Ubiquitin-like modifier-activating enzyme 1 (786-794)
gccguggcuaccuuccugcagagcguc

SEQ ID NO: 67725 - RNA, 51 nt, Artificial Sequence
  Tubulin alpha-3E chain (374-390)
gccgugugcaugcugagcaacaccacagcuaucgcagaggccugggcgaga

SEQ ID NO: 67726 - RNA, 30 nt, Artificial Sequence
  SH3 domain-containing RING finger protein 3 (442-451)
gccguggacgcucugcuccagggcgcaguc

SEQ ID NO: 67727 - RNA, 27 nt, Artificial Sequence
  Ribosome biogenesis protein WDR12 (196-204)
gccguggacggcagcgggaccaaguuc

SEQ ID NO: 67728 - RNA, 27 nt, Artificial Sequence
  Protein fem-1 homolog A (542-550)
gccguggacaaggauaccacaaacguc

SEQ ID NO: 67729 - RNA, 45 nt, Artificial Sequence
  Transmembraneoprotein NMB (550-564)
gccguguucuuucccggcaaccaggagaaggacccucugcucaaa

SEQ ID NO: 67730 - RNA, 30 nt, Artificial Sequence
  GTP-binding protein Di-Ras2 (11-20)
gccguguucggcgcugggggagucgguaag

SEQ ID NO: 67731 - RNA, 30 nt, Artificial Sequence
  Ankyrin-2 (1172-1181)
gccguguuccccgagggcgcucugaccaag

SEQ ID NO: 67732 - RNA, 24 nt, Artificial Sequence
  Mitochondrial coenzyme A transporter SLC25A42 (298-305)
gccgugggcaucagcuucaccaca

SEQ ID NO: 67733 - RNA, 27 nt, Artificial Sequence
  Low-density lipoprotein receptor-related protein 2 (1967-1975)
gccgugcacgacagcuuccuguacuau

SEQ ID NO: 67734 - RNA, 27 nt, Artificial Sequence
  Exosome complex exonuclease RRP44 (286-294)
gccgugcacgaggacaucgucgcuguu

SEQ ID NO: 67735 - RNA, 36 nt, Artificial Sequence
  Structural maintenance of chromosomes flexible hinge domain-containing protein 1 (181-192)
gccgugaucgacaacggcagagggaugaccagcaag

SEQ ID NO: 67736 - RNA, 33 nt, Artificial Sequence
  Pirin (150-160)
gccgugaucagcggcgaggcucuggggauuaag

SEQ ID NO: 67737 - RNA, 33 nt, Artificial Sequence
  Protein disulfide-isomerase (199-209)
gccgugaagguccacagcuuccccacccugaaa

SEQ ID NO: 67738 - RNA, 27 nt, Artificial Sequence
  Influenza virus NS1A-binding protein (306-314)
gccgugcuggacggcaucuucugcguc

SEQ ID NO: 67739 - RNA, 27 nt, Artificial Sequence
  HLA class I histocompatibility antigen, Cw-5 alpha chain (322-330)
gccgugcugggcgcugucauggcaguu

SEQ ID NO: 67740 - RNA, 27 nt, Artificial Sequence
  HLA class I histocompatibility antigen, Cw-3 alpha chain (322-330)
gccgugcugggcgcugucguugcagug

SEQ ID NO: 67741 - RNA, 27 nt, Artificial Sequence
  Kelch-like protein 21 (508-516)
gccgugcugggcgggaagcucuacguc

SEQ ID NO: 67742 - RNA, 27 nt, Artificial Sequence
  Transmembrane protein 147 (17-25)
gccgugcugggccacuuccucagccau

SEQ ID NO: 67743 - RNA, 24 nt, Artificial Sequence
  ER membrane protein complex subunit 1 (144-151)
gccgugcugaagaaaaccacacuc

SEQ ID NO: 67744 - RNA, 27 nt, Artificial Sequence
  Coronin-1B (42-50)
gccgugaaccccaaguuccuggcuguc

SEQ ID NO: 67745 - RNA, 36 nt, Artificial Sequence
  Trinucleotide repeat-containing gene 6C protein (287-298)
gccgugcagaaggagggcagcgggggaaacgcuugg

SEQ ID NO: 67746 - RNA, 27 nt, Artificial Sequence
  Constitutive coactivator of peroxisome proliferator-activated receptor gamma (278-286)
gccgugagcgaccacaucuccaagguc

SEQ ID NO: 67747 - RNA, 51 nt, Artificial Sequence
  Histone H2B type 2-F (111-127)
gccgugagcgagggcaccaaggcugucacaaaauacacuuccucuaagcug

SEQ ID NO: 67748 - RNA, 30 nt, Artificial Sequence
  Unconventional myosin-Ib (273-282)
gccguggucgcugcaguucugaagcucggc

SEQ ID NO: 67749 - RNA, 39 nt, Artificial Sequence
  HLA class I histocompatibility antigen, Cw-7 alpha chain (270-282)
gccguggucguucccagcggccaggagcaaagauacacc

SEQ ID NO: 67750 - RNA, 54 nt, Artificial Sequence
  Transketolase (84-101)
gccgugugggcugaggcaggcuuccuggccgaagcggagcuccuuaaccugaga

SEQ ID NO: 67751 - RNA, 27 nt, Artificial Sequence
  Fanconi anemia group B protein (310-318)
gccguguggaaggagagcuuccagguc

SEQ ID NO: 67752 - RNA, 27 nt, Artificial Sequence
  Glia-derived nexin (198-206)
gccguguacuucaagggccuguggaaa

SEQ ID NO: 67753 - RNA, 30 nt, Artificial Sequence
  Ras GTPase-activating protein-binding protein 1 (54-63)
gccguguacggccagaaggagauccacaga

SEQ ID NO: 67754 - RNA, 27 nt, Artificial Sequence
  Probable helicase with zinc finger domain (533-541)
gccguguaccugcuccccgucccuaag

SEQ ID NO: 67755 - RNA, 27 nt, Artificial Sequence
  Coagulation factor VIII (1262-1270)
gccuacgcucccgugcugcaggacuuc

SEQ ID NO: 67756 - RNA, 30 nt, Artificial Sequence
  E3 ubiquitin-protein ligase TTC3 (578-587)
gccuacugcggcaucgggaagguguaucug

SEQ ID NO: 67757 - RNA, 27 nt, Artificial Sequence
  Serine/threonine-protein kinase SIK3 (371-379)
gccuacgaccacuauagcgcuaucuac

SEQ ID NO: 67758 - RNA, 27 nt, Artificial Sequence
  E3 ubiquitin-protein ligase TRIM13 (217-225)
gccuacgaccccgagaucaacaagcug

SEQ ID NO: 67759 - RNA, 27 nt, Artificial Sequence
  Lysophosphatidic acid receptor 1 (291-299)
gccuacgagaaguucuuucugcuccuu

SEQ ID NO: 67760 - RNA, 24 nt, Artificial Sequence
  Annexin A5 (93-100)
gccuacgagcugaagcacgcucuc

SEQ ID NO: 67761 - RNA, 24 nt, Artificial Sequence
  Collagen alpha-1(VI) chain (997-1004)
gccuacggcgagagccaccuguuc

SEQ ID NO: 67762 - RNA, 24 nt, Artificial Sequence
  Ribosomal protein S6 kinase alpha-4 (27-34)
gccuacggcaagguguuccugguc

SEQ ID NO: 67763 - RNA, 24 nt, Artificial Sequence
  Lipase maturation factor 2 (303-310)
gccuacggcaccgugcacuauuuc

SEQ ID NO: 67764 - RNA, 27 nt, Artificial Sequence
  Transportin-1 (520-528)
gccuacauccuggacacccucguguuc

SEQ ID NO: 67765 - RNA, 27 nt, Artificial Sequence
  Poly(A)-specific ribonuclease PARN (337-345)
gccuacaucaccggccugugcuucauu

SEQ ID NO: 67766 - RNA, 27 nt, Artificial Sequence
  Collagen alpha-1(XXII) chain (141-149)
gccuacaagcagguggcuauccugcuc

SEQ ID NO: 67767 - RNA, 27 nt, Artificial Sequence
  Nuclear receptor subfamily 2 group C member 2 (493-501)
gccuaccugaaggcuaucgugcucuuc

SEQ ID NO: 67768 - RNA, 27 nt, Artificial Sequence
  Low affinity sodium-glucose cotransporter (318-326)
gccuaccugaagcuccuucccauguuc

SEQ ID NO: 67769 - RNA, 27 nt, Artificial Sequence
  Phosphatidylinositide phosphatase SAC2 (390-398)
gccuaccugaagcaggugcuccuuuuc

SEQ ID NO: 67770 - RNA, 30 nt, Artificial Sequence
  TRPM8 channel-associated factor 1 (477-486)
gccuaccugcccgaguggaaggaaaacauc

SEQ ID NO: 67771 - RNA, 27 nt, Artificial Sequence
  Catenin alpha-2 (811-819)
gccuaccugcagagaaucgcucucuau

SEQ ID NO: 67772 - RNA, 27 nt, Artificial Sequence
  Signal recognition particle subunit SRP68 (191-199)
gccuaccugagcggcaugcucagauuc

SEQ ID NO: 67773 - RNA, 27 nt, Artificial Sequence
  Transmembraneoprotein NMB (36-44)
gccuacaugagagagcacaaccagcug

SEQ ID NO: 67774 - RNA, 30 nt, Artificial Sequence
  Serine/threonine-protein kinase mTOR (1308-1317)
gccuacaaccccauggcuagagaccuguuc

SEQ ID NO: 67775 - RNA, 27 nt, Artificial Sequence
  Eukaryotic translation initiation factor 2-alpha kinase 4 (919-927)
gccuacaaccagaagguggaccuguuc

SEQ ID NO: 67776 - RNA, 27 nt, Artificial Sequence
  Regulation of nuclear pre-mRNA domain-containing protein 2 (70-78)
gccuacccccacagacugaaccucuuc

SEQ ID NO: 67777 - RNA, 27 nt, Artificial Sequence
  Alpha-mannosidase 2C1 (924-932)
gccuacagccugaacuucccccuccuu

SEQ ID NO: 67778 - RNA, 27 nt, Artificial Sequence
  Glutamine-fructose-6-phosphate aminotransferase (isomerizing) 1 (477-485)
gccuacaccagccaguucgugucccug

SEQ ID NO: 67779 - RNA, 24 nt, Artificial Sequence
  Bax inhibitor 1 (91-98)
gccuacgugcacauggucacccau

SEQ ID NO: 67780 - RNA, 147 nt, Artificial Sequence
  ATP synthase subunit epsilon, mitochondrial (3-51)
gccuacuggagacaggcuggccugagcuauaucagguacucccaaauuugcgcaaaggccgugcgggacgcgcucaaaaccgaguucaaggcuaacgccgaaaaaacaucugggucaaaugucaagauaguuaaagugaagaaggag

SEQ ID NO: 67781 - RNA, 27 nt, Artificial Sequence
  Serum albumin (500-508)
ugcuguaccgagagccuggugaacaga

SEQ ID NO: 67782 - RNA, 27 nt, Artificial Sequence
  Phosphoglycerate kinase 1 (50-58)
ugccuggacaacggcgccaagagcgug

SEQ ID NO: 67783 - RNA, 27 nt, Artificial Sequence
  Sodium/potassium-transporting ATPase subunit alpha-3 (359-367)
ugccuggugaagaaccucgaggccguc

SEQ ID NO: 67784 - RNA, 24 nt, Artificial Sequence
  Unconventional myosin-Id (243-250)
gacgccgcugaguucagagugguc

SEQ ID NO: 67785 - RNA, 27 nt, Artificial Sequence
  Dual serine/threonine and tyrosine protein kinase (357-365)
gacgccgcuaaggcacugaaccucgug

SEQ ID NO: 67786 - RNA, 27 nt, Artificial Sequence
  Dynactin subunit 1 (411-419)
gacgccgcucugggcgcagaggaaaug

SEQ ID NO: 67787 - RNA, 27 nt, Artificial Sequence
  Cytoplasmic dynein 2 heavy chain 1 (311-319)
gacgccgcucugcagaugaucaccgug

SEQ ID NO: 67788 - RNA, 24 nt, Artificial Sequence
  Unconventional myosin-Ib (247-254)
gacgccgcuaacuucagaaccgug

SEQ ID NO: 67789 - RNA, 24 nt, Artificial Sequence
  HLA class I histocompatibility antigen, alpha chain E (60-67)
gacgccgcuagccccagaauggug

SEQ ID NO: 67790 - RNA, 30 nt, Artificial Sequence
  Density-regulated protein (69-78)
gacgccgauuacccccugagagugcucuau

SEQ ID NO: 67791 - RNA, 42 nt, Artificial Sequence
  Gamma-secretase C-terminal fragment 59 (562-575)
gacgccgaguucagacacgauagcggcuacgaagugcaucac

SEQ ID NO: 67792 - RNA, 27 nt, Artificial Sequence
  Uncharacterized protein C15orf52 (63-71)
gacgccgagcuggauagaaggaucgug

SEQ ID NO: 67793 - RNA, 24 nt, Artificial Sequence
  Zinc finger SWIM domain-containing protein 6 (875-882)
gacgccuucaagaucgcuacccug

SEQ ID NO: 67794 - RNA, 27 nt, Artificial Sequence
  Fructosamine-3-kinase (34-42)
gacgccggccccguguucgucaagguu

SEQ ID NO: 67795 - RNA, 27 nt, Artificial Sequence
  WD repeat-containing protein 81 (428-436)
gacgcccacuuccauuuucaccagauc

SEQ ID NO: 67796 - RNA, 27 nt, Artificial Sequence
  Farnesyl pyrophosphate synthase (33-41)
gacgccaucgcuagacugaaggaggug

SEQ ID NO: 67797 - RNA, 27 nt, Artificial Sequence
  Dolichyl-diphosphooligosaccharide-proteinosyltransferase subunit 2 (67-75)
gacgccaagaaagcuugcaccuacauc

SEQ ID NO: 67798 - RNA, 27 nt, Artificial Sequence
  Heat shock 70 kDa protein 1B (323-331)
gacgccaagcuggauaaagcucagauc

SEQ ID NO: 67799 - RNA, 27 nt, Artificial Sequence
  FERM, RhoGEF and pleckstrin domain-containing protein 2 (711-719)
gacgcccugaaggcuaucaccgaggug

SEQ ID NO: 67800 - RNA, 27 nt, Artificial Sequence
  Protocadherin gamma-A12 (636-644)
gacgcccugaagcagagccucgugguc

SEQ ID NO: 67801 - RNA, 27 nt, Artificial Sequence
  Short-chain dehydrogenase/reductase 3 (138-146)
gacgcccugcucaagagccagcacauc

SEQ ID NO: 67802 - RNA, 27 nt, Artificial Sequence
  Importin subunit alpha-3 (326-334)
gacgcccugagccacuuccccgcucuc

SEQ ID NO: 67803 - RNA, 27 nt, Artificial Sequence
  Rab GDP dissociation inhibitor beta (233-241)
gacgccaacagcugccagaucauuaua

SEQ ID NO: 67804 - RNA, 24 nt, Artificial Sequence
  Cubilin (2289-2296)
gacgcccccauccugagcaaguuc

SEQ ID NO: 67805 - RNA, 24 nt, Artificial Sequence
  Fibronectin isoform 11 (1163-1170)
gacgcccccaucgugaacaagguc

SEQ ID NO: 67806 - RNA, 27 nt, Artificial Sequence
  Fibronectin isoform 11 (1163-1171)
gacgcccccaucgugaacaaggucguu

SEQ ID NO: 67807 - RNA, 24 nt, Artificial Sequence
  Transcription activator BRG1 (696-703)
gacgcccccaaggcuggccagcug

SEQ ID NO: 67808 - RNA, 27 nt, Artificial Sequence
  Protein scribble homolog (439-447)
gacgcccccccuagcagaguguccguc

SEQ ID NO: 67809 - RNA, 27 nt, Artificial Sequence
  Protocadherin gamma-C3 (256-264)
gacgcccccagcggcaccagagugguc

SEQ ID NO: 67810 - RNA, 27 nt, Artificial Sequence
  Fc receptor-like A (54-62)
gacgccagagaggcuggcuuccaggug

SEQ ID NO: 67811 - RNA, 24 nt, Artificial Sequence
  Polymerase delta-interacting protein 3 (116-123)
gacgccagagagaagaucagccug

SEQ ID NO: 67812 - RNA, 24 nt, Artificial Sequence
  Forkhead-associated domain-containing protein 1 (180-187)
gacgccagaaagcccccugugauc

SEQ ID NO: 67813 - RNA, 24 nt, Artificial Sequence
  Polymerase delta-interacting protein 3 (55-62)
gacgccagacagaagaucggccug

SEQ ID NO: 67814 - RNA, 39 nt, Artificial Sequence
  Filamin-A (1614-1626)
gacgccagcaagugcaccgugacaggcgcugggaucgga

SEQ ID NO: 67815 - RNA, 24 nt, Artificial Sequence
  Ataxin-10 (382-389)
gacgccagccugcucaagaaagug

SEQ ID NO: 67816 - RNA, 30 nt, Artificial Sequence
  Rootletin (478-487)
gacgccagcaacggcucccugagagggcuc

SEQ ID NO: 67817 - RNA, 27 nt, Artificial Sequence
  Basement membrane-specific heparan sulfate proteoglycan core protein (2026-2034)
gacgccagccccccuccagugaagauc

SEQ ID NO: 67818 - RNA, 27 nt, Artificial Sequence
  Poly(A)-specific ribonuclease PARN (220-228)
gacgccgugggcuucagcagagucauc

SEQ ID NO: 67819 - RNA, 24 nt, Artificial Sequence
  Uncharacterized protein KIAA1522 (204-211)
gacgccgugagaauccccaccguc

SEQ ID NO: 67820 - RNA, 24 nt, Artificial Sequence
  Peptidylprolyl isomerase domain and WD repeat-containing protein 1 (214-221)
gacgccgugagacugaucaacauu

SEQ ID NO: 67821 - RNA, 24 nt, Artificial Sequence
  GCN1 general control of amino-acid synthesis 1-like 1 (1074-1081)
gacgccgugagacagagcgucguu

SEQ ID NO: 67822 - RNA, 27 nt, Artificial Sequence
  Putative segment polarity protein dishevelled homolog DVL1P1 (316-324)
gacgccgugagaguccugagggagauc

SEQ ID NO: 67823 - RNA, 24 nt, Artificial Sequence
  WD repeat-containing protein 60 (576-583)
gacgccguggucaugcccaagauc

SEQ ID NO: 67824 - RNA, 27 nt, Artificial Sequence
  Acyl-coenzyme A thioesterase 1 isoform X1 (280-288)
gacgccuggaagcagcugcaaaccuuc

SEQ ID NO: 67825 - RNA, 24 nt, Artificial Sequence
  Nuclear factor erythroid 2-related factor 3 (109-116)
gacgccuggcuggugcacagcguc

SEQ ID NO: 67826 - RNA, 27 nt, Artificial Sequence
  Zinc finger protein 148 (493-501)
gacgccuaccugaacagccccucccuc

SEQ ID NO: 67827 - RNA, 24 nt, Artificial Sequence
  Phosphatidylinositide phosphatase SAC2 (555-562)
gacgccuacagacaggcugugauc

SEQ ID NO: 67828 - RNA, 27 nt, Artificial Sequence
  Type II inositol 3,4-bisphosphate 4-phosphatase (589-597)
gacugcaugggcgagguggucaacaga

SEQ ID NO: 67829 - RNA, 54 nt, Artificial Sequence
  Prolow-density lipoprotein receptor-related protein 1 (2270-2287)
gacgauggcagcagaaggaucaccauuguggagaacgucggguccguugaagga

SEQ ID NO: 67830 - RNA, 48 nt, Artificial Sequence
  HLA class I histocompatibility antigen, alpha chain E (50-65)
gacgauacccaguucgugagauuugacaacgaugccgcuagccccagg

SEQ ID NO: 67831 - RNA, 39 nt, Artificial Sequence
  HLA class I histocompatibility antigen, B-15 alpha chain (53-65)
gacgauacccaguucgugagauuugacagcgaugccgcu

SEQ ID NO: 67832 - RNA, 24 nt, Artificial Sequence
  Serum paraoxonase/arylesterase 2 (123-130)
gacgauaccguguaccuguucguc

SEQ ID NO: 67833 - RNA, 30 nt, Artificial Sequence
  Prohibitin (166-175)
gacgaugugagccugacccaccucacauuc

SEQ ID NO: 67834 - RNA, 33 nt, Artificial Sequence
  Eukaryotic initiation factor 4A-II (183-193)
gacgaggccgaugaaaugcugagcagaggcuuc

SEQ ID NO: 67835 - RNA, 30 nt, Artificial Sequence
  Protein Red (199-208)
gacgaggaucccgaaaacaagaucgaguuc

SEQ ID NO: 67836 - RNA, 30 nt, Artificial Sequence
  Nuclear pore complex protein Nup98-Nup96 (633-642)
gacgaggauagccuggugucccacuucuac

SEQ ID NO: 67837 - RNA, 24 nt, Artificial Sequence
  Caseinolytic peptidase B protein homolog (340-347)
gacgaggaacacccccugguguuc

SEQ ID NO: 67838 - RNA, 30 nt, Artificial Sequence
  Splicing factor, proline- and glutamine-rich (311-320)
gacgaguucaagagacuguuugccaaauac

SEQ ID NO: 67839 - RNA, 27 nt, Artificial Sequence
  ER membrane protein complex subunit 1 (527-535)
gacgaguucaaccugcagaagaugaug

SEQ ID NO: 67840 - RNA, 27 nt, Artificial Sequence
  Aggrecan core protein (225-233)
gacgaguuccccggcgugagaaccuac

SEQ ID NO: 67841 - RNA, 27 nt, Artificial Sequence
  Alpha-actinin-3 (248-256)
gacgagaaggccaucaugaccuacgug

SEQ ID NO: 67842 - RNA, 21 nt, Artificial Sequence
  Probable ATP-dependent RNA helicase DDX27 (87-93)
gacgagaagaucgaaaaagug

SEQ ID NO: 67843 - RNA, 27 nt, Artificial Sequence
  Heterogeneous nuclear ribonucleoprotein U (281-289)
gacgagaacgaugugaucaccugcuuc

SEQ ID NO: 67844 - RNA, 30 nt, Artificial Sequence
  SURP and G-patch domain-containing protein 2 (569-578)
gacgagaacagccuggaauacaaguauuac

SEQ ID NO: 67845 - RNA, 27 nt, Artificial Sequence
  Serine/threonine-protein phosphatase 2A 65 kDa regulatory subunit A beta isoform (227-235)
gacgagcaggauagcgugagacugcuc

SEQ ID NO: 67846 - RNA, 39 nt, Artificial Sequence
  Cytochrome c oxidase subunit 6B1 (5-17)
gacgagcagagagccgaaggcaccuuccccgggaagauc

SEQ ID NO: 67847 - RNA, 27 nt, Artificial Sequence
  Glycine-tRNA ligase (545-553)
gacgagcagagaaccuucuuuagcuuc

SEQ ID NO: 67848 - RNA, 48 nt, Artificial Sequence
  Prohibitin-2 (246-261)
gacgagagcuucaccagaggcuccgauucucugaucaaggggaaaaag

SEQ ID NO: 67849 - RNA, 45 nt, Artificial Sequence
  Annexin A2 (52-66)
gacgaggugaccaucgucaacauucugacaaauagaagcaacgcc

SEQ ID NO: 67850 - RNA, 72 nt, Artificial Sequence
  Beta-2-microglobulin (75-98)
gacgaguacgccugcagagugaaccacgucacccugagccagcccaagaucguuaaaugggauagggacaug

SEQ ID NO: 67851 - RNA, 27 nt, Artificial Sequence
  Rho GTPase-activating protein 33 (76-84)
gacuucggccacauccagcugcuccuu

SEQ ID NO: 67852 - RNA, 21 nt, Artificial Sequence
  Exocyst complex component 1 (516-522)
gacuucaucagcaaguuuuuc

SEQ ID NO: 67853 - RNA, 30 nt, Artificial Sequence
  Chromodomain-helicase-DNA-binding protein 4 (1081-1090)
gacuuccuggagcacgaaggcuacaaguau

SEQ ID NO: 67854 - RNA, 21 nt, Artificial Sequence
  Prelamin-A/C (56-62)
gacuuccagaagaacaucuac

SEQ ID NO: 67855 - RNA, 30 nt, Artificial Sequence
  Vacuolar protein sorting-associated protein 51 homolog (75-84)
gacuucagcgccagaaucuccgcuacccug

SEQ ID NO: 67856 - RNA, 54 nt, Artificial Sequence
  Prohibitin-2 (174-191)
gacuucagccugauccucgaugacguggccauuaccgagcuuuccuuuucuaga

SEQ ID NO: 67857 - RNA, 75 nt, Artificial Sequence
  Cytochrome c oxidase subunit 6C (51-75)
gacuucuacagaaacuaugaugugaugaaggacuuugaggaaaugaggaaagccggcaucuuccagagcgucaag

SEQ ID NO: 67858 - RNA, 24 nt, Artificial Sequence
  Histone-lysine N-methyltransferase 2C (1502-1509)
gacggcgccauccuggggaagcuc

SEQ ID NO: 67859 - RNA, 24 nt, Artificial Sequence
  Melanocyte protein PMEL (233-240)
gacggcgggaacaagcacuuccug

SEQ ID NO: 67860 - RNA, 66 nt, Artificial Sequence
  Cytochrome c oxidase subunit 6A1, mitochondrial (65-86)
gacggcaaccacacccuguuccauaauccccacgugaacccucucccaacaggguacgaggaugaa

SEQ ID NO: 67861 - RNA, 27 nt, Artificial Sequence
  E3 ubiquitin-protein ligase UBR4 (503-511)
gacggccccccugccgcucugagcauc

SEQ ID NO: 67862 - RNA, 24 nt, Artificial Sequence
  Signal transducer and activator of transcription 2 (570-577)
gacggcagaaucaugggguucgug

SEQ ID NO: 67863 - RNA, 27 nt, Artificial Sequence
  Protein transport protein Sec31A (325-333)
gacggcagaaucagcguguacuccauu

SEQ ID NO: 67864 - RNA, 48 nt, Artificial Sequence
  Roundabout homolog 1 (1436-1451)
gacggcagacagguggucgauaugaggaccaaccccggggacccucgg

SEQ ID NO: 67865 - RNA, 24 nt, Artificial Sequence
  Ubiquitin-60S ribosomal protein L40 (57-64)
gacggcagaacccugagcgauuac

SEQ ID NO: 67866 - RNA, 27 nt, Artificial Sequence
  Low-density lipoprotein receptor-related protein 2 (857-865)
gacggcagccaccugcuccccgugauc

SEQ ID NO: 67867 - RNA, 45 nt, Artificial Sequence
  Annexin A2 (182-196)
gacggcagcgugaucgauuacgagcugauugaccaggaugccaga

SEQ ID NO: 67868 - RNA, 24 nt, Artificial Sequence
  Neuroblast differentiation-associated protein AHNAK (730-737)
gacggcgugaagguccccgggauc

SEQ ID NO: 67869 - RNA, 60 nt, Artificial Sequence
  Glia-derived nexin (187-206)
gacggcgugcugaccagacucguccuuguuaacgccguguacuucaaggggcuguggaaa

SEQ ID NO: 67870 - RNA, 27 nt, Artificial Sequence
  Myotubularin-related protein 3 (99-107)
gacggcugggauagaaccccccagauc

SEQ ID NO: 67871 - RNA, 27 nt, Artificial Sequence
  Phosphorylase b kinase regulatory subunit alpha, skeletal muscle isoform (591-599)
gacggcuacuucgggggagccagagug

SEQ ID NO: 67872 - RNA, 24 nt, Artificial Sequence
  Molybdenum cofactor sulfurase (53-60)
gaccacgccggcgcuacccuguuc

SEQ ID NO: 67873 - RNA, 36 nt, Artificial Sequence
  Trifunctional enzyme subunit alpha, mitochondrial (752-763)
gaccacgccaacagccccaauaagaaauucuaccag

SEQ ID NO: 67874 - RNA, 21 nt, Artificial Sequence
  tRNA-splicing ligase RtcB homolog (149-155)
gaccacauccccgugggcguc

SEQ ID NO: 67875 - RNA, 24 nt, Artificial Sequence
  T-complex protein 1 subunit beta (336-343)
gaccaccccgagcuggugaagcuc

SEQ ID NO: 67876 - RNA, 21 nt, Artificial Sequence
  Syntenin-1 (292-298)
gaccacaccauccccgaggug

SEQ ID NO: 67877 - RNA, 21 nt, Artificial Sequence
  GPI transamidase component PIG-T (163-169)
gaccacuacuuccugagauau

SEQ ID NO: 67878 - RNA, 21 nt, Artificial Sequence
  Probable helicase with zinc finger domain (343-349)
gaccacuacguguauaagguc

SEQ ID NO: 67879 - RNA, 27 nt, Artificial Sequence
  Probable helicase with zinc finger domain (343-351)
gaccacuacguguauaaggucggcauc

SEQ ID NO: 67880 - RNA, 27 nt, Artificial Sequence
  Putative Polycomb group protein ASXL1 (616-624)
gacaucaaggccagagcucugcaggug

SEQ ID NO: 67881 - RNA, 27 nt, Artificial Sequence
  Protein zyg-11 homolog B (263-271)
gacauccugcccaaccucgugagccuu

SEQ ID NO: 67882 - RNA, 42 nt, Artificial Sequence
  Collagen alpha-1(XI) chain (219-232)
gacauccagcaauuccugauuaccggcgaucccaaggccgcu

SEQ ID NO: 67883 - RNA, 48 nt, Artificial Sequence
  Collagen alpha-1(XI) chain (219-234)
gacauccagcaauuccugauuaccggcgaucccaaggccgcuuacgac

SEQ ID NO: 67884 - RNA, 27 nt, Artificial Sequence
  Eukaryotic translation initiation factor 3 subunit C-like protein (636-644)
gacauccagagcuccggcagagccaag

SEQ ID NO: 67885 - RNA, 42 nt, Artificial Sequence
  Protocadherin Fat 1 (2630-2643)
gacaucaccuacgccauugaggcugauagcgaauccgugaag

SEQ ID NO: 67886 - RNA, 45 nt, Artificial Sequence
  Glia-derived nexin (118-132)
gacaucgugaccgucgccaacgcuguuuucgugaagaaugcaagc

SEQ ID NO: 67887 - RNA, 24 nt, Artificial Sequence
  SWI/SNF complex subunit SMARCC1 (603-610)
gacaucuacagcaagaaaacccug

SEQ ID NO: 67888 - RNA, 36 nt, Artificial Sequence
  Spectrin alpha chain, non-erythrocytic 1 (662-673)
gacaagggcgauagccuggacuccguggaggcccuc

SEQ ID NO: 67889 - RNA, 21 nt, Artificial Sequence
  V-type proton ATPase catalytic subunit A (466-472)
gacaagcacuucaccgaguuu

SEQ ID NO: 67890 - RNA, 21 nt, Artificial Sequence
  Heat shock protein HSP 90-beta (498-504)
gacaagaaaguggagaagguc

SEQ ID NO: 67891 - RNA, 21 nt, Artificial Sequence
  Protein O-GlcNAcase (831-837)
gacaagagaauccuggaguuc

SEQ ID NO: 67892 - RNA, 42 nt, Artificial Sequence
  Beta-enolase (195-208)
gacaagguggucaucggcauggauguugccgcuagcgaguuc

SEQ ID NO: 67893 - RNA, 45 nt, Artificial Sequence
  L-lactate dehydrogenase A chain (43-57)
gaccuggccgaugagcucgcucuuguggacgucaucgaagauaag

SEQ ID NO: 67894 - RNA, 69 nt, Artificial Sequence
  Neutral alpha-glucosidase AB (213-235)
gaccugggcaucuucuggcucaacgccgcugagaccuggguggauauuagcuccaauacagcagggaag

SEQ ID NO: 67895 - RNA, 57 nt, Artificial Sequence
  Biotin-protein ligase (615-633)
gaccugaucaccgaguacaacaagcagcacaaagccgaacucaagccccuuagagcu

SEQ ID NO: 67896 - RNA, 24 nt, Artificial Sequence
  1-phosphatidylinositol 4,5-bisphosphate phosphodiesterase beta-4 (280-287)
gaccugaagaaaaagggccucauc

SEQ ID NO: 67897 - RNA, 27 nt, Artificial Sequence
  Protein AHNAK2 (2044-2052)
gaccugaaggugcagaccggccaaguc

SEQ ID NO: 67898 - RNA, 48 nt, Artificial Sequence
  Inosine triphosphate pyrophosphatase (41-56)
gaccugcccgaguaccagggcgaaccugaugagaucagcauucaaaag

SEQ ID NO: 67899 - RNA, 81 nt, Artificial Sequence
  Heat shock protein HSP 90-alpha (477-503)
gaccuggugauccuccuuuacgagaccgcccuguugagcuccggcuucucuuuagaagauccccagacacacgcuaacaga

SEQ ID NO: 67900 - RNA, 24 nt, Artificial Sequence
  Melanocyte protein PMEL (9-16)
gaccuggugcucaagagaugccuu

SEQ ID NO: 67901 - RNA, 81 nt, Artificial Sequence
  Heat shock protein HSP 90-beta (579-605)
gaccuggugguccuccuuuucgagaccgcccuguugagcuccggcuuuucuuuagaagauccccagacacacucaaacaga

SEQ ID NO: 67902 - RNA, 33 nt, Artificial Sequence
  Fibronectin isoform 6 (1235-1245)
gacaaccugagccccggccucgaguacaaugug

SEQ ID NO: 67903 - RNA, 57 nt, Artificial Sequence
  Serine/threonine-protein phosphatase 2A 65 kDa regulatory subunit A alpha isoform (199-217)
gacaacgugaagagcgagaucauucccauguucuccaaucuggccucugaugaacag

SEQ ID NO: 67904 - RNA, 24 nt, Artificial Sequence
  GPN-loop GTPase 2 (151-158)
gaccccgccaaguucaucagcgug

SEQ ID NO: 67905 - RNA, 48 nt, Artificial Sequence
  Cadherin-2 (380-395)
gaccccgccaacuggcugaagaucgauccugugaauggccagauuacc

SEQ ID NO: 67906 - RNA, 27 nt, Artificial Sequence
  DNA helicase MCM9 (298-306)
gaccccuucgccggcagaaacgugauc

SEQ ID NO: 67907 - RNA, 24 nt, Artificial Sequence
  Putative signal peptidase complex catalytic subunit SEC11B (62-69)
gaccccaucagagugggcgagauu

SEQ ID NO: 67908 - RNA, 30 nt, Artificial Sequence
  Maestro heat-like repeat-containing protein family member 6 (652-661)
gaccccaagccugccguggcugcagccgcg

SEQ ID NO: 67909 - RNA, 27 nt, Artificial Sequence
  Prolyl 4-hydroxylase subunit alpha-2 (368-376)
gaccccaagaccggcgugcugacaguc

SEQ ID NO: 67910 - RNA, 24 nt, Artificial Sequence
  Sulfate transporter (642-649)
gacccccuggagcuccacaccauc

SEQ ID NO: 67911 - RNA, 24 nt, Artificial Sequence
  Signal recognition particle 9 kDa protein (21-28)
gaccccaugaaggccagagugguc

SEQ ID NO: 67912 - RNA, 27 nt, Artificial Sequence
  Titin (17217-17225)
gaccccccuggcaccccagagccgauc

SEQ ID NO: 67913 - RNA, 27 nt, Artificial Sequence
  Titin (16908-16916)
gaccccagaagccuggccgugccuauc

SEQ ID NO: 67914 - RNA, 27 nt, Artificial Sequence
  Dedicator of cytokinesis protein 7 (1087-1095)
gaccccagauacagcgauccucagauc

SEQ ID NO: 67915 - RNA, 30 nt, Artificial Sequence
  Integral membrane protein DGCR2/IDD (52-61)
gaccccagccacuuccaugccgugaacguc

SEQ ID NO: 67916 - RNA, 45 nt, Artificial Sequence
  Cadherin-2 (267-281)
gaccccaccggcagauucgccauccagacagauccuaacagcaau

SEQ ID NO: 67917 - RNA, 48 nt, Artificial Sequence
  Cadherin-2 (267-282)
gaccccaccggcagauucgccauccagacagauccuaacagcaaugac

SEQ ID NO: 67918 - RNA, 51 nt, Artificial Sequence
  Cadherin-2 (267-283)
gaccccaccggcagauucgccauccagacagauccuaacagcaaugacggg

SEQ ID NO: 67919 - RNA, 27 nt, Artificial Sequence
  Zinc finger protein 469 (3286-3294)
gaccccugggccggcggggagccucug

SEQ ID NO: 67920 - RNA, 24 nt, Artificial Sequence
  Poly (ADP-ribose) polymerase 12 (148-155)
gaccccuggcugcucccugagauc

SEQ ID NO: 67921 - RNA, 78 nt, Artificial Sequence
  Protein S100-A6 (65-90)
gaccaggaggugaacuuccaagaauacgucaccuuucugggcgcccucgcucuuaucuauaaugaggcacugaagggg

SEQ ID NO: 67922 - RNA, 72 nt, Artificial Sequence
  CREB-binding protein (539-562)
gaccagcaacccccuaaccugaucagcgaguccgcccucccaaccucucuuggcgcuacaaauccgcugaug

SEQ ID NO: 67923 - RNA, 21 nt, Artificial Sequence
  Paired amphipathic helix protein Sin3a (131-137)
gaccaggugaagcugcaauuc

SEQ ID NO: 67924 - RNA, 21 nt, Artificial Sequence
  Cyclin-I (74-80)
gacagauuccuggccaccgug

SEQ ID NO: 67925 - RNA, 24 nt, Artificial Sequence
  SUN domain-containing protein 2 (41-48)
gacagaaucggccuggccgauuac

SEQ ID NO: 67926 - RNA, 63 nt, Artificial Sequence
  Heterogeneous nuclear ribonucleoprotein U (184-204)
gacagacugagcgccuccucucucaccauggagucauucgcuuuucuuugggcaggcgggagg

SEQ ID NO: 67927 - RNA, 45 nt, Artificial Sequence
  HLA class I histocompatibility antigen, A-23 alpha chain (351-365)
gacagcgcccagggcuccgaugugucucugaccgcuugcaagguc

SEQ ID NO: 67928 - RNA, 33 nt, Artificial Sequence
  HLA class I histocompatibility antigen, alpha chain E (338-348)
gacagcgcccagggcuccgagucucacucacug

SEQ ID NO: 67929 - RNA, 33 nt, Artificial Sequence
  DNA-directed RNA polymerase I subunit RPA1 (1009-1019)
gacagcgauggcuccgugguccaguuccuguac

SEQ ID NO: 67930 - RNA, 33 nt, Artificial Sequence
  ATP-dependent RNA helicase DHX29 (1132-1142)
gacagcgaucaccugaccaucuacaacgccuau

SEQ ID NO: 67931 - RNA, 27 nt, Artificial Sequence
  Sorbin and SH3 domain-containing protein 1 (255-263)
gacagcgaucuguacucccccagauau

SEQ ID NO: 67932 - RNA, 30 nt, Artificial Sequence
  Tyrosinase (454-463)
gacagcgaucccgacuccuuccaggauuac

SEQ ID NO: 67933 - RNA, 21 nt, Artificial Sequence
  Cullin-4B (365-371)
gacagcuucgagcagagauuu

SEQ ID NO: 67934 - RNA, 48 nt, Artificial Sequence
  Alpha-endosulfine (66-81)
gacagcggcgauuacaacauggccaaggcuaaaaugaagaauaaacag

SEQ ID NO: 67935 - RNA, 30 nt, Artificial Sequence
  Ral GTPase-activating protein subunit alpha-1 (921-930)
gacagccacuccgauucuuucucagccuuu

SEQ ID NO: 67936 - RNA, 42 nt, Artificial Sequence
  Acylamino-acid-releasing enzyme (442-455)
gacagcauccugucccuccccggcaacguggggcaccaggau

SEQ ID NO: 67937 - RNA, 39 nt, Artificial Sequence
  Endoplasmin (205-217)
gacagcaacgaguucuccgugaucgccgaucccagaggc

SEQ ID NO: 67938 - RNA, 42 nt, Artificial Sequence
  Endoplasmin (205-218)
gacagcaacgaguucuccgugaucgccgaucccagaggcaau

SEQ ID NO: 67939 - RNA, 45 nt, Artificial Sequence
  Endoplasmin (205-219)
gacagcaacgaguucuccgugaucgccgaucccagaggcaauacc

SEQ ID NO: 67940 - RNA, 48 nt, Artificial Sequence
  Endoplasmin (205-220)
gacagcaacgaguucuccgugaucgccgaucccagaggcaauacccug

SEQ ID NO: 67941 - RNA, 51 nt, Artificial Sequence
  Endoplasmin (205-221)
gacagcaacgaguucuccgugaucgccgaucccagaggcaauacccugggg

SEQ ID NO: 67942 - RNA, 24 nt, Artificial Sequence
  Serine/threonine-protein phosphatase 2A 65 kDa regulatory subunit A beta isoform isoform e (103-110)
gacagcgugagacugcucgccguc

SEQ ID NO: 67943 - RNA, 30 nt, Artificial Sequence
  Calpain-3 (40-49)
gacaccgauggcagcgggaagcugaaccuc

SEQ ID NO: 67944 - RNA, 57 nt, Artificial Sequence
  Beta-secretase 2 (110-128)
gacaccggcagcuccaacuucgccguggcugggacaccccacucuuacaucgauacu

SEQ ID NO: 67945 - RNA, 33 nt, Artificial Sequence
  Fibronectin isoform 6 (1261-1271)
gacaccaucauucccgccgugccuccaccgaca

SEQ ID NO: 67946 - RNA, 36 nt, Artificial Sequence
  IST1 homolog (333-344)
gacacccugcccacagccagcgcuggcgcauccacu

SEQ ID NO: 67947 - RNA, 27 nt, Artificial Sequence
  Pre-mRNA-processing-splicing factor 8 (1782-1790)
gacaccaacguguacagagucacaauc

SEQ ID NO: 67948 - RNA, 48 nt, Artificial Sequence
  Glutamate receptor ionotropic, kainate 2 (79-94)
gacacccagaagaucaaccuguacgauagcuucgaggccuccaaaaag

SEQ ID NO: 67949 - RNA, 21 nt, Artificial Sequence
  Zinc finger MYM-type protein 2 (612-618)
gacaccuggagaacagaguac

SEQ ID NO: 67950 - RNA, 27 nt, Artificial Sequence
  V-type proton ATPase subunit S1 (142-150)
gacguggccgucguugcuggcgggcug

SEQ ID NO: 67951 - RNA, 27 nt, Artificial Sequence
  Coatomer subunit epsilon (49-57)
gacguggagagagaugucuuccuguac

SEQ ID NO: 67952 - RNA, 24 nt, Artificial Sequence
  Endothelial differentiation-related factor 1 (37-44)
gacguggagaccagcaagaaaugg

SEQ ID NO: 67953 - RNA, 30 nt, Artificial Sequence
  Inhibitor of nuclear factor kappa-B kinase subunit alpha (123-132)
gacgugggcgggaagaucauucacaaaaua

SEQ ID NO: 67954 - RNA, 36 nt, Artificial Sequence
  Gamma-secretase C-terminal fragment 59 (584-595)
gacgugggcagcaacaagggggccaucauuggacug

SEQ ID NO: 67955 - RNA, 54 nt, Artificial Sequence
  Gamma-secretase C-terminal fragment 59 (584-601)
gacgugggcagcaacaagggggccaucauuggacugauggucgguggcguugug

SEQ ID NO: 67956 - RNA, 21 nt, Artificial Sequence
  40S ribosomal protein S13 (21-27)
gacgugaaggagcagaucuac

SEQ ID NO: 67957 - RNA, 48 nt, Artificial Sequence
  Laminin subunit alpha-4 (1287-1302)
gacgugaagggcaucaaaguccagagcguugauaagcaauacaacgac

SEQ ID NO: 67958 - RNA, 51 nt, Artificial Sequence
  Laminin subunit alpha-4 (1287-1303)
gacgugaagggcaucaaaguccagagcguugauaagcaauacaacgacggg

SEQ ID NO: 67959 - RNA, 24 nt, Artificial Sequence
  N6-adenosine-methyltransferase 70 kDa subunit (382-389)
gacgugagcauccugggcaaguuc

SEQ ID NO: 67960 - RNA, 27 nt, Artificial Sequence
  HLA class I histocompatibility antigen, A-23 alpha chain (357-365)
gacgugagccugaccgccugcaagguc

SEQ ID NO: 67961 - RNA, 36 nt, Artificial Sequence
  Ubiquitin carboxyl-terminal hydrolase 36 (576-587)
gacgugguccugagcaccucccccaagcuccuugcc

SEQ ID NO: 67962 - RNA, 18 nt, Artificial Sequence
  U5 small nuclear ribonucleoprotein 200 kDa helicase (1392-1397)
gacugguacgagaaguuc

SEQ ID NO: 67963 - RNA, 27 nt, Artificial Sequence
  Growth arrest-specific protein 7 (285-293)
gacuacgccaagaaccuggcuaaacuc

SEQ ID NO: 67964 - RNA, 27 nt, Artificial Sequence
  ER membrane protein complex subunit 1 (634-642)
gacuacgccaaggugcugcuccuuauc

SEQ ID NO: 67965 - RNA, 27 nt, Artificial Sequence
  Multidrug resistance-associated protein 5 (776-784)
gacuacgccaccaucuucaacaaucug

SEQ ID NO: 67966 - RNA, 27 nt, Artificial Sequence
  Protein Niban (485-493)
gacuacgauagcuccaccaucagaaag

SEQ ID NO: 67967 - RNA, 21 nt, Artificial Sequence
  Plastin-3 (34-40)
gacuacgagcugcacgaacuc

SEQ ID NO: 67968 - RNA, 27 nt, Artificial Sequence
  14-3-3 protein epsilon (127-135)
gacuaccacagauaucuggccgaguuc

SEQ ID NO: 67969 - RNA, 27 nt, Artificial Sequence
  Cyclic AMP-dependent transcription factor ATF-4 (36-44)
gacuaccuggagguggccaagcacuuc

SEQ ID NO: 67970 - RNA, 27 nt, Artificial Sequence
  Lysosomal-trafficking regulator (2228-2236)
gacuaccugaagggccucgccagcuuc

SEQ ID NO: 67971 - RNA, 27 nt, Artificial Sequence
  Importin-7 (93-101)
gacuaccccagcagauggaccgccauc

SEQ ID NO: 67972 - RNA, 27 nt, Artificial Sequence
  L-dopachrome tautomerase (155-163)
gacuacgugaucaccacacagcacugg

SEQ ID NO: 67973 - RNA, 27 nt, Artificial Sequence
  Down syndrome critical region protein 3 (203-211)
gaggccgcuaucagaagcguggaacug

SEQ ID NO: 67974 - RNA, 30 nt, Artificial Sequence
  V-set and immunoglobulin domain-containing protein 10-like (447-456)
gaggccgcugugcccgcaggcagcagacug

SEQ ID NO: 67975 - RNA, 24 nt, Artificial Sequence
  Laminin subunit gamma-1 (1193-1200)
gaggccgacgauaucgugagaguc

SEQ ID NO: 67976 - RNA, 24 nt, Artificial Sequence
  Poly (ADP-ribose) polymerase 1 (810-817)
gaggccgaaaucauuagaaaguac

SEQ ID NO: 67977 - RNA, 30 nt, Artificial Sequence
  Poly (ADP-ribose) polymerase 14 (805-814)
gaggccuucgcugaagcagugaagaccguc

SEQ ID NO: 67978 - RNA, 24 nt, Artificial Sequence
  Alpha-mannosidase 2x (749-756)
gaggccuucccccugagagugauc

SEQ ID NO: 67979 - RNA, 36 nt, Artificial Sequence
  Coronin-6 (123-134)
gaggccggcgggggaggugcuuucaucgugcugccc

SEQ ID NO: 67980 - RNA, 24 nt, Artificial Sequence
  Leucine-tRNA ligase, cytoplasmic (462-469)
gaggccaaggaaaaaaucuaccug

SEQ ID NO: 67981 - RNA, 27 nt, Artificial Sequence
  Guanine nucleotide-binding protein G(s) subunit alpha isoforms short (258-266)
gaggcccugaaccucuucaagagcauc

SEQ ID NO: 67982 - RNA, 27 nt, Artificial Sequence
  60 kDa heat shock protein, mitochondrial (165-173)
gaggcccugagcacccucgugcuuaac

SEQ ID NO: 67983 - RNA, 24 nt, Artificial Sequence
  Sulfhydryl oxidase 1 (224-231)
gaggccaacguggucagaaaguuc

SEQ ID NO: 67984 - RNA, 30 nt, Artificial Sequence
  General transcription factor IIF subunit 1 (356-365)
gaggccagcuccgcucuguucauggcaaag

SEQ ID NO: 67985 - RNA, 27 nt, Artificial Sequence
  Spectrin beta chain, non-erythrocytic 2 (1585-1593)
gaggacgcccugagagcucagcaauuc

SEQ ID NO: 67986 - RNA, 24 nt, Artificial Sequence
  Tyrosine-protein kinase BAZ1B (275-282)
gaggacgaacuggugaagaaauac

SEQ ID NO: 67987 - RNA, 27 nt, Artificial Sequence
  ATP-dependent RNA helicase DDX50 (3-11)
gaggacaacccccagacccugcucuuc

SEQ ID NO: 67988 - RNA, 27 nt, Artificial Sequence
  Kinesin-like protein KIF13B (775-783)
gaggacaaccccgugaucagaagcuac

SEQ ID NO: 67989 - RNA, 24 nt, Artificial Sequence
  F-box only protein 32 (101-108)
gaggaccagcaaaacaucagacug

SEQ ID NO: 67990 - RNA, 27 nt, Artificial Sequence
  Peptidyl-prolyl cis-trans isomerase FKBP9 (198-206)
gaggaccaggugcaaauccacaccuac

SEQ ID NO: 67991 - RNA, 24 nt, Artificial Sequence
  Eukaryotic translation initiation factor 3 subunit A (755-762)
gaggacagagaucuguucgugaug

SEQ ID NO: 67992 - RNA, 27 nt, Artificial Sequence
  Cullin-4B (405-413)
gaggaagccgacagacugaucaccuac

SEQ ID NO: 67993 - RNA, 30 nt, Artificial Sequence
  Proteasome activator complex subunit 3 (93-102)
gaggaagccuuccagggcaccaagguguuu

SEQ ID NO: 67994 - RNA, 30 nt, Artificial Sequence
  Heterogeneous nuclear ribonucleoprotein U (540-549)
gaggaagcccagaagcugcucgagcaauac

SEQ ID NO: 67995 - RNA, 30 nt, Artificial Sequence
  Staphylococcal nuclease domain-containing protein 1 (554-563)
gaggaagccacccuguucacaaaggagcuc

SEQ ID NO: 67996 - RNA, 27 nt, Artificial Sequence
  Tribbles homolog 2 (149-157)
gaggaagaggccgcuagacuguucuac

SEQ ID NO: 67997 - RNA, 30 nt, Artificial Sequence
  Cullin-4B (404-413)
gaggaagaggccgacagacugaucaccuac

SEQ ID NO: 67998 - RNA, 27 nt, Artificial Sequence
  Negative elongation factor E (11-19)
gaggaagaggcccugcagaagaaauuc

SEQ ID NO: 67999 - RNA, 30 nt, Artificial Sequence
  Synemin (68-77)
gaggaagaggaaaacgacggccacugguuc

SEQ ID NO: 68000 - RNA, 33 nt, Artificial Sequence
  Nestin (503-513)
gaggaagagggcagcgcccugaagaccuccugg

SEQ ID NO: 68001 - RNA, 30 nt, Artificial Sequence
  Angiomotin-like protein 1 (596-605)
gaggaagagcugagagaaaagcaggccuac

SEQ ID NO: 68002 - RNA, 30 nt, Artificial Sequence
  Nestin (316-325)
gaggaagagaaccugggcaagggggaauac

SEQ ID NO: 68003 - RNA, 27 nt, Artificial Sequence
  SHC-transforming protein 1 (341-349)
gaggaagagcccccugaccaccaguac

SEQ ID NO: 68004 - RNA, 30 nt, Artificial Sequence
  Synemin (856-865)
gaggaagagagcaccaucagauacuccugg

SEQ ID NO: 68005 - RNA, 27 nt, Artificial Sequence
  (1052-1060)
gaggaauucgagacccugaaggaauuu

SEQ ID NO: 68006 - RNA, 39 nt, Artificial Sequence
  HLA class II histocompatibility antigen, DR alpha chain (41-53)
gaggaauucggcagauuugccagcuucgaggcucagggg

SEQ ID NO: 68007 - RNA, 21 nt, Artificial Sequence
  cAMP-dependent protein kinase type I-beta regulatory subunit (247-253)
gaggaauuccugagcaaggug

SEQ ID NO: 68008 - RNA, 27 nt, Artificial Sequence
  Erlin-2 (50-58)
gaggaaggccacaucgggguguacuau

SEQ ID NO: 68009 - RNA, 27 nt, Artificial Sequence
  STAM-binding protein (50-58)
gaggaaggcaacaucgagcacgccuuc

SEQ ID NO: 68010 - RNA, 27 nt, Artificial Sequence
  Rho guanine nucleotide exchange factor 11 (801-809)
gaggaaggccccaucauuaaggagaua

SEQ ID NO: 68011 - RNA, 30 nt, Artificial Sequence
  Nestin (504-513)
gaggaaggcagcgcccugaagaccuccugg

SEQ ID NO: 68012 - RNA, 24 nt, Artificial Sequence
  Cytochrome c oxidase subunit 6A1, mitochondrial (8-15)
gaggaaggcagcgccagaaugugg

SEQ ID NO: 68013 - RNA, 27 nt, Artificial Sequence
  Phosphopantothenate-cysteine ligase (283-291)
gaggaaaucgagaagggcguggaaauu

SEQ ID NO: 68014 - RNA, 30 nt, Artificial Sequence
  A-kinase anchor protein 9 (822-831)
gaggaaaucgagaagcagagaaacaccuuc

SEQ ID NO: 68015 - RNA, 30 nt, Artificial Sequence
  Vimentin (240-249)
gaggaaauccaggagcugcaagcccagauu

SEQ ID NO: 68016 - RNA, 27 nt, Artificial Sequence
  Zinc finger E-box-binding homeobox 2 (457-465)
gaggaaaucagcaagcugaaaggcuac

SEQ ID NO: 68017 - RNA, 27 nt, Artificial Sequence
  Nuclear pore complex protein Nup205 (77-85)
gaggaaaucagcaccgugcugcaguac

SEQ ID NO: 68018 - RNA, 27 nt, Artificial Sequence
  Cadherin-2 (138-146)
gaggaaaucguguuccccagacaguuu

SEQ ID NO: 68019 - RNA, 27 nt, Artificial Sequence
  Leucine zipper putative tumor suppressor 1 (511-519)
gaggaaaaggagaaagugauccaguac

SEQ ID NO: 68020 - RNA, 33 nt, Artificial Sequence
  Intraflagellar transport protein 81 homolog (450-460)
gaggaaaagaaaggcaucagcggguacuccuau

SEQ ID NO: 68021 - RNA, 27 nt, Artificial Sequence
  FERM domain-containing protein 5 (259-267)
gaggaaaagaaaaucauucugaccuac

SEQ ID NO: 68022 - RNA, 27 nt, Artificial Sequence
  Receptor-type tyrosine-protein phosphatase zeta (1495-1503)
gaggaaaagcugaucauucaggacuuc

SEQ ID NO: 68023 - RNA, 33 nt, Artificial Sequence
  Cyclic AMP-responsive element-binding protein 3-like protein 2 (268-278)
gaggaaaagagaacccugaucgccgagggcuac

SEQ ID NO: 68024 - RNA, 33 nt, Artificial Sequence
  Nestin (176-186)
gaggaacuggccagaaggcucggcgaggcuugg

SEQ ID NO: 68025 - RNA, 42 nt, Artificial Sequence
  L-dopachrome tautomerase (49-62)
gaggaacuguuccucaccagcgaccagcuuggcuacuccuau

SEQ ID NO: 68026 - RNA, 36 nt, Artificial Sequence
  Glia-derived nexin (40-51)
gaggaacugggcagcaacaccgggauccagguguuc

SEQ ID NO: 68027 - RNA, 30 nt, Artificial Sequence
  Myotubularin-related protein 6 (290-299)
gaggaacugaagcucaaagagaagaccuac

SEQ ID NO: 68028 - RNA, 27 nt, Artificial Sequence
  HEAT repeat-containing protein 1 (773-781)
gaggaacugaacagcacccagagagug

SEQ ID NO: 68029 - RNA, 24 nt, Artificial Sequence
  E3 ubiquitin-protein ligase RNF213 (1762-1769)
gaggaacugccccucaugcuucug

SEQ ID NO: 68030 - RNA, 30 nt, Artificial Sequence
  Protein KRI1 homolog (27-36)
gaggaacugcagagacucaaggacagguac

SEQ ID NO: 68031 - RNA, 27 nt, Artificial Sequence
  Angiomotin-like protein 1 (597-605)
gaggaacugagagagaagcaggccuac

SEQ ID NO: 68032 - RNA, 30 nt, Artificial Sequence
  Serpin H1 (373-382)
gaggaacugagaagccccaagcucuucuac

SEQ ID NO: 68033 - RNA, 30 nt, Artificial Sequence
  Vimentin (374-383)
gaggaaauggccagacaccugagggaguac

SEQ ID NO: 68034 - RNA, 30 nt, Artificial Sequence
  RANBP2-like and GRIP domain-containing protein 1 (1180-1189)
gaggaaaugaagagcggccugaaagacuuc

SEQ ID NO: 68035 - RNA, 30 nt, Artificial Sequence
  Non-POU domain-containing octamer-binding protein (88-97)
gaggaaaugagaaagcuguucgagaaauac

SEQ ID NO: 68036 - RNA, 27 nt, Artificial Sequence
  NudC domain-containing protein 3 (165-173)
gaggaaaacggcgagagagugcugaug

SEQ ID NO: 68037 - RNA, 30 nt, Artificial Sequence
  cGMP-inhibited 3',5'-cyclic phosphodiesterase B (605-614)
gaggaaaacaucuucagcaaggaguccuuu

SEQ ID NO: 68038 - RNA, 33 nt, Artificial Sequence
  Pituitary tumor-transforming gene 1 protein-interacting protein (169-179)
gaggaaaaccccuacgccagauucgagaauaac

SEQ ID NO: 68039 - RNA, 30 nt, Artificial Sequence
  Nestin (283-292)
gaggaaaaccaggagagccugagaucccuc

SEQ ID NO: 68040 - RNA, 27 nt, Artificial Sequence
  Tropomodulin-2 (273-281)
gaggaaaacagcagaauccugaaguuc

SEQ ID NO: 68041 - RNA, 30 nt, Artificial Sequence
  Syndecan-3 (422-431)
gaggaacccaagcaggccagcgugaccuac

SEQ ID NO: 68042 - RNA, 27 nt, Artificial Sequence
  Lymphoid enhancer-binding factor 1 (247-255)
gaggaacaggccaaguacuaugagcug

SEQ ID NO: 68043 - RNA, 27 nt, Artificial Sequence
  Receptor-type tyrosine-protein phosphatase gamma (1261-1269)
gaggaacagaucauuauacacgacuuc

SEQ ID NO: 68044 - RNA, 27 nt, Artificial Sequence
  Eukaryotic translation initiation factor 4 gamma 2 (197-205)
gaggaacagagagccaucgcuaagauu

SEQ ID NO: 68045 - RNA, 30 nt, Artificial Sequence
  General receptor for phosphoinositides 1-associated scaffold protein (125-134)
gaggaacagagaguggagauggucaccuuc

SEQ ID NO: 68046 - RNA, 30 nt, Artificial Sequence
  14-3-3 protein beta/alpha (41-50)
gaggaaagaaaccugcucagcguggccuac

SEQ ID NO: 68047 - RNA, 27 nt, Artificial Sequence
  Unconventional myosin-Va (255-263)
gaggaaagaaacuaccacaucuucuau

SEQ ID NO: 68048 - RNA, 27 nt, Artificial Sequence
  Protein RTF2 homolog (273-281)
gaggaaagcgaggccuacaagucccug

SEQ ID NO: 68049 - RNA, 30 nt, Artificial Sequence
  Protein RTF2 homolog (273-282)
gaggaaagcgaggccuacaagucccuguuc

SEQ ID NO: 68050 - RNA, 30 nt, Artificial Sequence
  Rho-associated protein kinase 2 (440-449)
gaggaaagccaggagauccaaaagaaacug

SEQ ID NO: 68051 - RNA, 33 nt, Artificial Sequence
  Rho-associated protein kinase 2 (440-450)
gaggaaagccaggagauccaaaagaaacuguac

SEQ ID NO: 68052 - RNA, 27 nt, Artificial Sequence
  Spectrin beta chain, non-erythrocytic 1 (635-643)
gaggaaagcagaaggcuguggaaguuc

SEQ ID NO: 68053 - RNA, 27 nt, Artificial Sequence
  Synemin (857-865)
gaggaaagcaccaucagauacuccugg

SEQ ID NO: 68054 - RNA, 30 nt, Artificial Sequence
  Caldesmon (163-172)
gaggaaaccgagacagugacuaagagcuac

SEQ ID NO: 68055 - RNA, 27 nt, Artificial Sequence
  Putative segment polarity protein dishevelled homolog DVL1P1 (13-21)
gaggaaacccccuaccuggugaagcuc

SEQ ID NO: 68056 - RNA, 27 nt, Artificial Sequence
  Trinucleotide repeat-containing gene 18 protein (2863-2871)
gaggaaaccagccccggcaagcaguuc

SEQ ID NO: 68057 - RNA, 24 nt, Artificial Sequence
  Dedicator of cytokinesis protein 10 (2044-2051)
gaggaaguggacaugaucagacug

SEQ ID NO: 68058 - RNA, 30 nt, Artificial Sequence
  ATR-interacting protein (133-142)
gaggaagugcugaucaagaacggcgagauu

SEQ ID NO: 68059 - RNA, 27 nt, Artificial Sequence
  V-type proton ATPase subunit B, kidney isoform (273-281)
gaggaagugcccggcagaaggggguuc

SEQ ID NO: 68060 - RNA, 24 nt, Artificial Sequence
  Protein ITFG3 (235-242)
gaggaagugagcggccaccuguac

SEQ ID NO: 68061 - RNA, 27 nt, Artificial Sequence
  Tyrosinase (280-288)
gaggaauacaacagccaccagucccug

SEQ ID NO: 68062 - RNA, 30 nt, Artificial Sequence
  Hom s 1 (51-60)
gaggaauacagaggcuucacccaggacuuu

SEQ ID NO: 68063 - RNA, 36 nt, Artificial Sequence
  Moesin (17-28)
gaguucgccauccagcccaacaccacaggcaagcaa

SEQ ID NO: 68064 - RNA, 39 nt, Artificial Sequence
  Moesin (17-29)
gaguucgccauccagcccaacaccacaggcaagcaacug

SEQ ID NO: 68065 - RNA, 30 nt, Artificial Sequence
  Lamin-B receptor (208-217)
gaguucggcggggugcccggagucuuucug

SEQ ID NO: 68066 - RNA, 27 nt, Artificial Sequence
  Nuclear factor erythroid 2-related factor 1 (312-320)
gaguucaacgaacugcucagcaaguac

SEQ ID NO: 68067 - RNA, 30 nt, Artificial Sequence
  Maltase-glucoamylase  (594-603)
gaguucaaccuguuuggcauccccauggug

SEQ ID NO: 68068 - RNA, 27 nt, Artificial Sequence
  Signal peptidase complex subunit 2 (188-196)
gaguucaccaagagcaucgccaaauuu

SEQ ID NO: 68069 - RNA, 24 nt, Artificial Sequence
  Inositol 1,4,5-trisphosphate receptor type 3 (835-842)
gaguucguggaagacuaccugaac

SEQ ID NO: 68070 - RNA, 21 nt, Artificial Sequence
  Melanoma-associated antigen D1 (610-616)
gaguucgugaagcagaaauac

SEQ ID NO: 68071 - RNA, 27 nt, Artificial Sequence
  Vimentin (405-413)
gagggcgaagagagcagaaucucccug

SEQ ID NO: 68072 - RNA, 36 nt, Artificial Sequence
  Disintegrin and metalloproteinase domain-containing protein 10 (17-28)
gagggcuucauccagaccagagggggaacauuuuac

SEQ ID NO: 68073 - RNA, 24 nt, Artificial Sequence
  Coiled-coil-helix-coiled-coil-helix domain-containing protein 2 (135-142)
gagggcuucaacgaagugcugaag

SEQ ID NO: 68074 - RNA, 21 nt, Artificial Sequence
  Dual specificity protein phosphatase 6 (133-139)
gagggcggguucagcaaguuu

SEQ ID NO: 68075 - RNA, 27 nt, Artificial Sequence
  Heat shock protein beta-8 (131-139)
gagggcgggaucgugagcaagaacuuc

SEQ ID NO: 68076 - RNA, 27 nt, Artificial Sequence
  Chondroitin sulfate proteoglycan 4 (257-265)
gagggccaccugagagccguggucgaa

SEQ ID NO: 68077 - RNA, 24 nt, Artificial Sequence
  Zinc finger protein 106 (925-932)
gagggccacagcaagaccauccug

SEQ ID NO: 68078 - RNA, 21 nt, Artificial Sequence
  Activator of 90 kDa heat shock protein ATPase homolog 1 (249-255)
gagggcaucaagcagaccuuc

SEQ ID NO: 68079 - RNA, 21 nt, Artificial Sequence
  Kremen protein 2 (107-113)
gagggcaucuacuggagauau

SEQ ID NO: 68080 - RNA, 27 nt, Artificial Sequence
  Secretory phospholipase A2 receptor (1283-1291)
gagggcagcaaccugcucaccaucaag

SEQ ID NO: 68081 - RNA, 18 nt, Artificial Sequence
  Leucine-tRNA ligase, cytoplasmic (177-182)
gagcacaucuggacccug

SEQ ID NO: 68082 - RNA, 30 nt, Artificial Sequence
  Protein DBF4 homolog A (541-550)
gagcaccugaccgugcaggccaaggcuccc

SEQ ID NO: 68083 - RNA, 24 nt, Artificial Sequence
  Bestrophin-1 (465-472)
gagcaccccgaagugagccagguc

SEQ ID NO: 68084 - RNA, 18 nt, Artificial Sequence
  Glycine-tRNA ligase (536-541)
gagcacaccuuccaugug

SEQ ID NO: 68085 - RNA, 24 nt, Artificial Sequence
  Fibronectin 1 (1541-1548)
gagaucgacaagcccagccagaug

SEQ ID NO: 68086 - RNA, 39 nt, Artificial Sequence
  39S ribosomal protein L37, mitochondrial (51-63)
gagauccccggccuggaaccuauuaccuucgccgggaag

SEQ ID NO: 68087 - RNA, 21 nt, Artificial Sequence
  ATP-dependent RNA helicase DDX24 (574-580)
gagaaggacuucuaccuguau

SEQ ID NO: 68088 - RNA, 24 nt, Artificial Sequence
  Tyrosinase (517-524)
gagaaggaagacuaccacagccug

SEQ ID NO: 68089 - RNA, 33 nt, Artificial Sequence
  Nuclear autoantigenic sperm protein (365-375)
gagaagcccggccaggaagccccugugcugcca

SEQ ID NO: 68090 - RNA, 27 nt, Artificial Sequence
  Exocyst complex component 3 (32-40)
gagcuggccaagcagcucuggauggug

SEQ ID NO: 68091 - RNA, 27 nt, Artificial Sequence
  Eukaryotic initiation factor 4A-II (112-120)
gagcuggcccagcaaauccagaaggug

SEQ ID NO: 68092 - RNA, 27 nt, Artificial Sequence
  Probable ATP-dependent RNA helicase DDX5 (178-186)
gagcuggcccagcaagugcagcagguc

SEQ ID NO: 68093 - RNA, 27 nt, Artificial Sequence
  Splicing factor 3B subunit 3 (1196-1204)
gagcuggacagaacccccccugaagug

SEQ ID NO: 68094 - RNA, 27 nt, Artificial Sequence
  Microtubule cross-linking factor 1 (532-540)
gagcuggaacaggagcuccaaaaguac

SEQ ID NO: 68095 - RNA, 21 nt, Artificial Sequence
  Clathrin heavy chain 1 (362-368)
gagcuguucgccagaaaguuu

SEQ ID NO: 68096 - RNA, 66 nt, Artificial Sequence
  HEAT repeat-containing protein 5B (423-444)
gagcugggcagccucgugcagucccuuaacgccaccgcuucuccccugauccaagaagcaucaauu

SEQ ID NO: 68097 - RNA, 24 nt, Artificial Sequence
  Leucine-rich repeat flightless-interacting protein 2 (198-205)
gagcugaucgaaaagcacggccuc

SEQ ID NO: 68098 - RNA, 27 nt, Artificial Sequence
  Golgin subfamily B member 1 (2901-2909)
gagcugaagaaccuccagcaacaguac

SEQ ID NO: 68099 - RNA, 21 nt, Artificial Sequence
  Eukaryotic translation initiation factor 3 subunit C-like protein (84-90)
gagcugcucggcaaggccuac

SEQ ID NO: 68100 - RNA, 27 nt, Artificial Sequence
  RHO/RAC effector protein (236-244)
gagcugaacaaucagaacuucuaccuc

SEQ ID NO: 68101 - RNA, 24 nt, Artificial Sequence
  Presenilin-1 (3-10)
gagcugcccgccccucucagcuac

SEQ ID NO: 68102 - RNA, 18 nt, Artificial Sequence
  FERM domain-containing protein 4A (927-932)
gagcugagacagugguac

SEQ ID NO: 68103 - RNA, 27 nt, Artificial Sequence
  Proteasome maturation protein (49-57)
gagcugagcgaaaagaacuuccagcuc

SEQ ID NO: 68104 - RNA, 24 nt, Artificial Sequence
  FACT complex subunit SSRP1 (312-319)
gagauggugagcagagucaugaag

SEQ ID NO: 68105 - RNA, 30 nt, Artificial Sequence
  Ras GTPase-activating-like protein IQGAP2 (450-459)
gagaacgacagaguggucgccguuggcuac

SEQ ID NO: 68106 - RNA, 21 nt, Artificial Sequence
  Eukaryotic translation initiation factor 3 subunit L (295-301)
gagaacaucgaacugaauaag

SEQ ID NO: 68107 - RNA, 102 nt, Artificial Sequence
  Glia-derived nexin (343-376)
gagaaccugcacgugagccauauccuccagaaggccaaaauugaagucuccgaggacggcaccaaggcuucugcagccacaacugcgauacuuaucgcuaga

SEQ ID NO: 68108 - RNA, 105 nt, Artificial Sequence
  Proteasome activator complex subunit 4 (1077-1111)
gagaaccugaaucacgacgccaucguggucagaaagauggcuauuagcgcaguugccggcauacucaaacagcuuaagaggacccauaaaaagcugacaaucaac

SEQ ID NO: 68109 - RNA, 33 nt, Artificial Sequence
  FYVE, RhoGEF and PH domain-containing protein 6 (143-153)
gagaacagcaagaucgacgaaacccugacaauu

SEQ ID NO: 68110 - RNA, 27 nt, Artificial Sequence
  Ankyrin repeat domain-containing protein SOWAHB (248-256)
gagcccgccccugugccagcugucgca

SEQ ID NO: 68111 - RNA, 33 nt, Artificial Sequence
  39S ribosomal protein L3, mitochondrial (91-101)
gagcccggcagcuucagaguggggcugaucgcc

SEQ ID NO: 68112 - RNA, 27 nt, Artificial Sequence
  Nurim (116-124)
gagcccaucccuaagggcccagugcug

SEQ ID NO: 68113 - RNA, 30 nt, Artificial Sequence
  Ryanodine receptor 1 (370-379)
gagcccccuaccccagaaggcagcccgauc

SEQ ID NO: 68114 - RNA, 27 nt, Artificial Sequence
  WD repeat-containing protein 18 (350-358)
gagcccagacacggcgggcugacccuc

SEQ ID NO: 68115 - RNA, 33 nt, Artificial Sequence
  Gamma-secretase C-terminal fragment 59 (473-483)
gagcccagaaucagcuacggcaacgacgcccug

SEQ ID NO: 68116 - RNA, 54 nt, Artificial Sequence
  Integral membrane protein GPR137C (19-36)
gagcccagcaccccuggcgggggauccgguggcgggggagccguggcugcagcc

SEQ ID NO: 68117 - RNA, 123 nt, Artificial Sequence
  Ubiquitin-associated protein 2-like (364-404)
gagcaguucaagaccgcccaagcucuggcacagcucgccgcgcagcacagccaguccggcucuacaacuacgucaaguugggacauggggagcaccacacaaucccccucucuugugcaguac

SEQ ID NO: 68118 - RNA, 30 nt, Artificial Sequence
  Keratin, type II cytoskeletal 1b (186-195)
gagcagcaaaaccaggugcugcagaccaag

SEQ ID NO: 68119 - RNA, 30 nt, Artificial Sequence
  Histone-lysine N-methyltransferase 2D (2989-2998)
gagcagcaaagcaagauccagaaacagcug

SEQ ID NO: 68120 - RNA, 24 nt, Artificial Sequence
  Hsp90 co-chaperone Cdc37 (207-214)
gagcagguggcccaccaaaccauc

SEQ ID NO: 68121 - RNA, 24 nt, Artificial Sequence
  Mucin-16 (582-589)
gagcagguguuccuggacaagacc

SEQ ID NO: 68122 - RNA, 21 nt, Artificial Sequence
  Serine/arginine-rich splicing factor 3 (27-33)
gagagagccuucggcuacuau

SEQ ID NO: 68123 - RNA, 27 nt, Artificial Sequence
  Kinectin (367-375)
gagagaagcaacguggucaucaccagg

SEQ ID NO: 68124 - RNA, 21 nt, Artificial Sequence
  RAB6A-GEF complex partner protein 2 (263-269)
gagagagugcagcccgaauac

SEQ ID NO: 68125 - RNA, 18 nt, Artificial Sequence
  Vacuolar protein sorting-associated protein 18 homolog (309-314)
gagagagugugggaauac

SEQ ID NO: 68126 - RNA, 33 nt, Artificial Sequence
  Pre-mRNA-splicing factor ATP-dependent RNA helicase PRP16 (1005-1015)
gagagcgaccaccugaccuaccucaacguguau

SEQ ID NO: 68127 - RNA, 57 nt, Artificial Sequence
  Endoplasmin (203-221)
gagagcgacuccaacgaauucucugugaucgccgaucccagaggcaauacccugggg

SEQ ID NO: 68128 - RNA, 30 nt, Artificial Sequence
  Netrin receptor UNC5A (438-447)
gagagcgaagccggcgugcccgcucugguc

SEQ ID NO: 68129 - RNA, 27 nt, Artificial Sequence
  DNA-directed RNA polymerase I subunit RPA1 (186-194)
gagagcaaguccaaacugaucgcccuc

SEQ ID NO: 68130 - RNA, 24 nt, Artificial Sequence
  Four and a half LIM domains protein 2 (122-129)
gagagccuguucggcaagaaauac

SEQ ID NO: 68131 - RNA, 24 nt, Artificial Sequence
  T-complex protein 1 subunit beta (114-121)
gagagccugaucgccaagaaaauu

SEQ ID NO: 68132 - RNA, 21 nt, Artificial Sequence
  Heterogeneous nuclear ribonucleoproteins A2/B1 (23-29)
gagagccugagaaacuacuau

SEQ ID NO: 68133 - RNA, 51 nt, Artificial Sequence
  AT-rich interactive domain-containing protein 1A (78-94)
gagagcaacggcgggggagguggcgggggagccggcuccggugggggaccc

SEQ ID NO: 68134 - RNA, 21 nt, Artificial Sequence
  DENN domain-containing protein 4B (1394-1400)
gagagcgugcugagacacguc

SEQ ID NO: 68135 - RNA, 27 nt, Artificial Sequence
  Protein kinase C-binding protein 1 (695-703)
gagaccgacagccccacagugcaccug

SEQ ID NO: 68136 - RNA, 27 nt, Artificial Sequence
  HEAT repeat-containing protein 1 (1479-1487)
gagaccauccccaaggccgugagcuuc

SEQ ID NO: 68137 - RNA, 27 nt, Artificial Sequence
  Receptor-type tyrosine-protein phosphatase C (52-60)
gagaccaagcuguucacagccaaacuc

SEQ ID NO: 68138 - RNA, 30 nt, Artificial Sequence
  Uridine-cytidine kinase-like 1 (329-338)
gagaccagcagagacgaauucaucuuuuac

SEQ ID NO: 68139 - RNA, 54 nt, Artificial Sequence
  UPF0606 protein KIAA1549 (278-295)
gagaccacacuguuccucagcuccagaucucuuaugccccagccucugggcgac

SEQ ID NO: 68140 - RNA, 66 nt, Artificial Sequence
  ATP synthase subunit alpha, mitochondrial (339-360)
gagguggccgcuuucgcacaguuuggcagcgaccuggaugccgcgacccaacagcuccuuuccaga

SEQ ID NO: 68141 - RNA, 27 nt, Artificial Sequence
  40S ribosomal protein S21 (38-46)
gagguggacaaggucaccggcagauuc

SEQ ID NO: 68142 - RNA, 27 nt, Artificial Sequence
  Melanoma-associated antigen 4 (169-177)
gagguggaccccgccagcaacaccuac

SEQ ID NO: 68143 - RNA, 30 nt, Artificial Sequence
  Dystrophin (1633-1642)
gaggugggcgaagcccugaagaccguccuc

SEQ ID NO: 68144 - RNA, 48 nt, Artificial Sequence
  Filamin-A (1150-1165)
gaggugggccaguuccaagucgacugcagcuccgccgggucugcugaa

SEQ ID NO: 68145 - RNA, 57 nt, Artificial Sequence
  Titin (5338-5356)
gaggugggcagcuccucuugcgaaaccacauucacuguccuggacagagauaucgcc

SEQ ID NO: 68146 - RNA, 27 nt, Artificial Sequence
  Nucleosome assembly protein 1-like 4 (87-95)
gaggugcacgaccuggaaagaaaguac

SEQ ID NO: 68147 - RNA, 24 nt, Artificial Sequence
  Pseudouridylate synthase 7 homolog-like protein (87-94)
gaggugcacacccugaucaaguac

SEQ ID NO: 68148 - RNA, 30 nt, Artificial Sequence
  Midasin (595-604)
gaggugaucggcagcaagcugaacauuucc

SEQ ID NO: 68149 - RNA, 30 nt, Artificial Sequence
  Protein ZGRF1 (72-81)
gaggugaaggucgccggcgcuaucgggauu

SEQ ID NO: 68150 - RNA, 30 nt, Artificial Sequence
  RNA-binding protein Nova-1 (277-286)
gaggugcugcccaccgccgcugcagccgcg

SEQ ID NO: 68151 - RNA, 30 nt, Artificial Sequence
  Hemicentin-1 (2987-2996)
gaggugagcggcuuccccccuccagaccug

SEQ ID NO: 68152 - RNA, 21 nt, Artificial Sequence
  Basigin (49-55)
gaggugaccggccacagaugg

SEQ ID NO: 68153 - RNA, 39 nt, Artificial Sequence
  Annexin A2 (53-65)
gaggugaccaucgucaacauucugacaaauagaagcaac

SEQ ID NO: 68154 - RNA, 45 nt, Artificial Sequence
  Annexin A2 (53-67)
gaggugaccaucgucaacauucugacaaauagaagcaacgcccag

SEQ ID NO: 68155 - RNA, 27 nt, Artificial Sequence
  Myotubularin (410-418)
gaguggaucagcuucggccacaaguuu

SEQ ID NO: 68156 - RNA, 27 nt, Artificial Sequence
  Zinc finger protein 317 (82-90)
gaguacgcccaccuguucgaaguguuu

SEQ ID NO: 68157 - RNA, 27 nt, Artificial Sequence
  Lysophosphatidylcholine acyltransferase 2 (495-503)
gaguacgccaagaucuucaccacauau

SEQ ID NO: 68158 - RNA, 30 nt, Artificial Sequence
  Meiosis arrest female protein 1 (1363-1372)
gaguacgccaagaccuucggcuauacauuu

SEQ ID NO: 68159 - RNA, 27 nt, Artificial Sequence
  Tyrosine-protein kinase Fer (41-49)
gaguacgccagcacccugcagaaccuc

SEQ ID NO: 68160 - RNA, 27 nt, Artificial Sequence
  Origin recognition complex subunit 3 (309-317)
gaguacgccagcgugcugcagcuccuu

SEQ ID NO: 68161 - RNA, 27 nt, Artificial Sequence
  Gamma-tubulin complex component 2 (312-320)
gaguacggccaggugaaccacgcccug

SEQ ID NO: 68162 - RNA, 27 nt, Artificial Sequence
  Nuclear pore complex protein Nup214 (115-123)
gaguacggcagcaucauugccuucuuu

SEQ ID NO: 68163 - RNA, 27 nt, Artificial Sequence
  GDH/6PGL endoplasmic bifunctional protein (267-275)
gaguacggcgugaucagagacguccug

SEQ ID NO: 68164 - RNA, 27 nt, Artificial Sequence
  Probable ATP-dependent RNA helicase DDX52 (539-547)
gaguacaucaagggcuuccagaaacug

SEQ ID NO: 68165 - RNA, 27 nt, Artificial Sequence
  Myotubularin (566-574)
gaguacaucaagagacuggaagagcuc

SEQ ID NO: 68166 - RNA, 27 nt, Artificial Sequence
  Probable ATP-dependent RNA helicase DDX60-like (1185-1193)
gaguacaucaacuuccuggaaaaucuc

SEQ ID NO: 68167 - RNA, 33 nt, Artificial Sequence
  Aspartate aminotransferase, mitochondrial (95-105)
gaguaccugcccaucggcgggcucgccgaauuc

SEQ ID NO: 68168 - RNA, 27 nt, Artificial Sequence
  Phosphatidylinositol-glycan biosynthesis class W protein (124-132)
gaguacaaccccgccaucagcugcuuc

SEQ ID NO: 68169 - RNA, 27 nt, Artificial Sequence
  Lysosomal protective protein (111-119)
gaguacaaccccuauagcuggaaucug

SEQ ID NO: 68170 - RNA, 27 nt, Artificial Sequence
  Dolichyl-diphosphooligosaccharide-proteinosyltransferase 48 kDa subunit (332-340)
gaguacagcaucgugauucagcaacug

SEQ ID NO: 68171 - RNA, 27 nt, Artificial Sequence
  MAU2 chromatid cohesion factor homolog (89-97)
gaguacaccagagcccuguuccuccuu

SEQ ID NO: 68172 - RNA, 27 nt, Artificial Sequence
  FERM, RhoGEF and pleckstrin domain-containing protein 2 (134-142)
gaguacaccagauaucuguucgcccuc

SEQ ID NO: 68173 - RNA, 27 nt, Artificial Sequence
  Dual specificity protein kinase CLK3 (343-351)
gaguacuauagaggcuucacccuguuu

SEQ ID NO: 68174 - RNA, 24 nt, Artificial Sequence
  Nuclear receptor corepressor 2 (1025-1032)
uucgccgcugaggcacagaagcug

SEQ ID NO: 68175 - RNA, 24 nt, Artificial Sequence
  UDP-N-acetylglucosamine-peptide N-acetylglucosaminyltransferase 110 kDa subunit (428-435)
uucgccgacgcucacagcaaccug

SEQ ID NO: 68176 - RNA, 27 nt, Artificial Sequence
  Catenin alpha-2 (110-118)
uucgccgacgaucccugcagcuccgug

SEQ ID NO: 68177 - RNA, 27 nt, Artificial Sequence
  Zinc finger MYM-type protein 1 (482-490)
uucgccgacgagcugagccaccuccuu

SEQ ID NO: 68178 - RNA, 30 nt, Artificial Sequence
  E3 ubiquitin-protein ligase UBR4 (495-504)
uucgccgacaaggagacccugauccaguuu

SEQ ID NO: 68179 - RNA, 30 nt, Artificial Sequence
  Histone-lysine N-methyltransferase SETDB1 (995-1004)
uucgccgacagcgauucccacucuucauuu

SEQ ID NO: 68180 - RNA, 30 nt, Artificial Sequence
  Staphylococcal nuclease domain-containing protein 1 (819-828)
uucgccgacagcaagggcgauguggggcug

SEQ ID NO: 68181 - RNA, 27 nt, Artificial Sequence
  Frizzled-1 (386-394)
uucgccgaggacggcgcuagaaccgug

SEQ ID NO: 68182 - RNA, 39 nt, Artificial Sequence
  Amyloid beta A4 protein (18-30)
uucgccgaggacgugggcagcaacaagggggcuaucauu

SEQ ID NO: 68183 - RNA, 42 nt, Artificial Sequence
  Amyloid beta A4 protein (20-33)
uucgccgaggacgugggcagcaacaagggggcuaucauugga

SEQ ID NO: 68184 - RNA, 27 nt, Artificial Sequence
  Centromere protein F (1090-1098)
uucgccgaggaaagaaaccagaaucug

SEQ ID NO: 68185 - RNA, 24 nt, Artificial Sequence
  Superkiller viralicidic activity 2-like 2 (1024-1031)
uucgccgagggcaucaccaagauu

SEQ ID NO: 68186 - RNA, 27 nt, Artificial Sequence
  ATP-binding cassette sub-family C member 11 (241-249)
uucgccuuugagaagcugauccaguuc

SEQ ID NO: 68187 - RNA, 27 nt, Artificial Sequence
  Arf-GAP with SH3 domain, ANK repeat and PH domain-containing protein 3 (673-681)
uucgccuuuccccugcacguggacuac

SEQ ID NO: 68188 - RNA, 24 nt, Artificial Sequence
  Filamin-A (333-340)
uucgccggccagcacaucgcuaag

SEQ ID NO: 68189 - RNA, 27 nt, Artificial Sequence
  Elongation factor 1-gamma (198-206)
uucgcccaccugcccaagagcaccuuu

SEQ ID NO: 68190 - RNA, 27 nt, Artificial Sequence
  Nuclear pore complex protein Nup85 (365-373)
uucgcccaccccagccuguggcagcuc

SEQ ID NO: 68191 - RNA, 36 nt, Artificial Sequence
  Moesin (18-29)
uucgccauccagcccaacaccacaggcaagcaacug

SEQ ID NO: 68192 - RNA, 27 nt, Artificial Sequence
  Sodium-dependent phosphate transport protein 2C (387-395)
uucgcccugcagagcuccucuguguuu

SEQ ID NO: 68193 - RNA, 45 nt, Artificial Sequence
  Cytochrome c oxidase subunit 7C, mitochondrial (49-63)
uucgccacccccuuucugguggucagacaccagcuccuuaagaca

SEQ ID NO: 68194 - RNA, 36 nt, Artificial Sequence
  Beta-secretase 2 (116-127)
uucgccguggcuggcaccccccacagcuacaucgac

SEQ ID NO: 68195 - RNA, 27 nt, Artificial Sequence
  Protein FAM179B (1301-1309)
uucgccgugguccaggagguuaagaac

SEQ ID NO: 68196 - RNA, 24 nt, Artificial Sequence
  WD repeat-containing protein 35 (933-940)
uucgacgccgcuaagcugauguuu

SEQ ID NO: 68197 - RNA, 21 nt, Artificial Sequence
  Synemin (38-44)
uucgacaagaaagugcagcug

SEQ ID NO: 68198 - RNA, 24 nt, Artificial Sequence
  Protein SET (138-145)
uucgaggacaucaagagcggcuac

SEQ ID NO: 68199 - RNA, 42 nt, Artificial Sequence
  ATP synthase-coupling factor 6, mitochondrial (95-108)
uucgaggaccccaaguuugaagugaucgagaaaccucaggcc

SEQ ID NO: 68200 - RNA, 42 nt, Artificial Sequence
  Cytochrome c oxidase subunit 6C (62-75)
uucgaggaaaugagaaaggccggcaucuuucagagcgugaaa

SEQ ID NO: 68201 - RNA, 21 nt, Artificial Sequence
  Myotubularin-related protein 13 (1490-1496)
uucgaguuuaaccuguacuau

SEQ ID NO: 68202 - RNA, 33 nt, Artificial Sequence
  FACT complex subunit SSRP1 (391-401)
uucgagaucgaaaccaagcagggcacacaauac

SEQ ID NO: 68203 - RNA, 27 nt, Artificial Sequence
  Myosin-9 (456-464)
uucgagaucuuugaccugaacagcuuc

SEQ ID NO: 68204 - RNA, 24 nt, Artificial Sequence
  F-box/LRR-repeat protein 5 (75-82)
uucgagaagggccugaaaaacgug

SEQ ID NO: 68205 - RNA, 27 nt, Artificial Sequence
  Integrin beta-5 (536-544)
uucgagagcgaauuuggcaagaucuac

SEQ ID NO: 68206 - RNA, 21 nt, Artificial Sequence
  Small subunit processome component 20 homolog (1420-1426)
uucgagagcggccugaaguac

SEQ ID NO: 68207 - RNA, 27 nt, Artificial Sequence
  ATP synthase-coupling factor 6, mitochondrial (100-108)
uucgaggugaucgaaaagccccaggcc

SEQ ID NO: 68208 - RNA, 30 nt, Artificial Sequence
  Nuclear pore membraneoprotein 210 (396-405)
uucuuugaggugcugagcuccucucagaac

SEQ ID NO: 68209 - RNA, 27 nt, Artificial Sequence
  Dynein heavy chain 10, axonemal (148-156)
uucuuuuucaucagcgacgaugagcug

SEQ ID NO: 68210 - RNA, 18 nt, Artificial Sequence
  FACT complex subunit SSRP1 (88-93)
uucuuuaagacccacuac

SEQ ID NO: 68211 - RNA, 27 nt, Artificial Sequence
  Sterol regulatory element-binding protein 2 (769-777)
uucuuuauggagagaagcugguccgug

SEQ ID NO: 68212 - RNA, 27 nt, Artificial Sequence
  L-dopachrome tautomerase (339-347)
uucuuucagaacagcaccuucuccuuu

SEQ ID NO: 68213 - RNA, 21 nt, Artificial Sequence
  Protein MCM10 homolog (335-341)
uucggcgaggugcacaaggcc

SEQ ID NO: 68214 - RNA, 27 nt, Artificial Sequence
  Dynein light chain 4, axonemal (77-85)
uucggcuuugagaucacccacgaagug

SEQ ID NO: 68215 - RNA, 27 nt, Artificial Sequence
  Myelin basic protein (46-54)
uucggcggggacagaggagcccccaag

SEQ ID NO: 68216 - RNA, 87 nt, Artificial Sequence
  Keratin, type I cytoskeletal 9 (90-118)
uucggcgggggaagcagagguuuuggcggggccuccggaggcgguuacucuucaagugggggauucggcggcggguuuggagguggc

SEQ ID NO: 68217 - RNA, 24 nt, Artificial Sequence
  Oxysterol-binding protein-related protein 1 (367-374)
uucggcaaggagcugcacaaagug

SEQ ID NO: 68218 - RNA, 27 nt, Artificial Sequence
  Cyclin-dependent kinase 3 (146-154)
uucggccuggccagagcuuuuggggug

SEQ ID NO: 68219 - RNA, 48 nt, Artificial Sequence
  Pyruvate kinase PKM (157-172)
uucggcguggagcaggacgucgauaugguuuuugccagcuucaucaga

SEQ ID NO: 68220 - RNA, 33 nt, Artificial Sequence
  AP-2 complex subunit beta (776-786)
uucggcgugauccccagcaccccucuggccauu

SEQ ID NO: 68221 - RNA, 30 nt, Artificial Sequence
  Myelin basic protein (152-161)
uucggcuacgggggaagagccagcgacuau

SEQ ID NO: 68222 - RNA, 48 nt, Artificial Sequence
  Cytochrome c oxidase subunit 6A1, mitochondrial (71-86)
uuccacaacccccaugugaauccucugccaaccggcuacgaggacgaa

SEQ ID NO: 68223 - RNA, 18 nt, Artificial Sequence
  Large proline-rich protein BAG6 (789-794)
uuccaccagcauuaccug

SEQ ID NO: 68224 - RNA, 27 nt, Artificial Sequence
  Transformation/transcription domain-associated protein (280-288)
uucaucgccgcucagauuaagacccug

SEQ ID NO: 68225 - RNA, 30 nt, Artificial Sequence
  Vitamin K-dependent gamma-carboxylase (474-483)
uucaucgccgacuuucccggccugcaccuc

SEQ ID NO: 68226 - RNA, 27 nt, Artificial Sequence
  Ubiquitin carboxyl-terminal hydrolase 7 (183-191)
uucaucgacgaugacaaggugaccuuu

SEQ ID NO: 68227 - RNA, 27 nt, Artificial Sequence
  Histone-lysine N-methyltransferase SETDB1 (43-51)
uucaucgacgaggaacuggagaagaug

SEQ ID NO: 68228 - RNA, 27 nt, Artificial Sequence
  Dolichyl-diphosphooligosaccharide-proteinosyltransferase 48 kDa subunit (119-127)
uucaucgacggcgggggaagcgugcug

SEQ ID NO: 68229 - RNA, 30 nt, Artificial Sequence
  Dolichyl-diphosphooligosaccharide-proteinosyltransferase 48 kDa subunit (119-128)
uucaucgacggcgggggaagcgugcugguc

SEQ ID NO: 68230 - RNA, 27 nt, Artificial Sequence
  Nck-associated protein 1 (400-408)
uucaucgacaagcacauugccgagcug

SEQ ID NO: 68231 - RNA, 27 nt, Artificial Sequence
  ATP-dependent RNA helicase DDX19B (230-238)
uucaucgaccccaagaaaauuaaggug

SEQ ID NO: 68232 - RNA, 27 nt, Artificial Sequence
  BTB/POZ domain-containing protein KCTD15 (102-110)
uucaucgacagagauggcgagauuuuu

SEQ ID NO: 68233 - RNA, 78 nt, Artificial Sequence
  Tubulin beta chain (387-412)
uucaucggcaacagcaccgccauucaggagcuguuuaagagaauauccgaacaauucacagcuauguuuaggcggaaa

SEQ ID NO: 68234 - RNA, 27 nt, Artificial Sequence
  Receptor-type protein tyrosine phosphatase beta (1317-1325)
uucauccacgacacccugguggaggcc

SEQ ID NO: 68235 - RNA, 27 nt, Artificial Sequence
  Kelch-like protein 7 (120-128)
uucauccaccagcauuuuaccgaggug

SEQ ID NO: 68236 - RNA, 27 nt, Artificial Sequence
  Kelch-like protein 18 (97-105)
uucauccaccagcauuuuguggagguc

SEQ ID NO: 68237 - RNA, 27 nt, Artificial Sequence
  Myotubularin-related protein 13 (272-280)
uucaucauuggcgugcacagcgucuuu

SEQ ID NO: 68238 - RNA, 27 nt, Artificial Sequence
  LisH domain-containing protein ARMC9 (551-559)
uucaucaaggagggcaacgccgaaaug

SEQ ID NO: 68239 - RNA, 27 nt, Artificial Sequence
  Importin-5 (200-208)
uucauccuggccaacgagcacaaugug

SEQ ID NO: 68240 - RNA, 27 nt, Artificial Sequence
  WD repeat and FYVE domain-containing protein 3 (419-427)
uucauccuggagagccagcacacccuc

SEQ ID NO: 68241 - RNA, 27 nt, Artificial Sequence
  Cyclin-related protein FAM58A (33-41)
uucaucauggaggccggcgugaagcug

SEQ ID NO: 68242 - RNA, 27 nt, Artificial Sequence
  Protein EFR3 homolog A (468-476)
uucaucaugggcaaggugcccgucuuu

SEQ ID NO: 68243 - RNA, 27 nt, Artificial Sequence
  Translocated to HRX in t(11,19) leukemia (81-89)
uucaucaugcccauugaggugcacuuu

SEQ ID NO: 68244 - RNA, 18 nt, Artificial Sequence
  Endoplasmic reticulum metallopeptidase 1 (110-115)
uucaucaacuuuauuuac

SEQ ID NO: 68245 - RNA, 30 nt, Artificial Sequence
  Sacsin (114-123)
uucaucaacggcaauuuucccgggaccuuc

SEQ ID NO: 68246 - RNA, 27 nt, Artificial Sequence
  Tripartite motif-containing protein 2 (185-193)
uucaucagcgagauuauacaccagcug

SEQ ID NO: 68247 - RNA, 27 nt, Artificial Sequence
  Protein TANC1 (603-611)
uucaucaccaagauuauaagcaaauuu

SEQ ID NO: 68248 - RNA, 21 nt, Artificial Sequence
  Gelsolin (365-371)
uucaucaccaagauggacuac

SEQ ID NO: 68249 - RNA, 27 nt, Artificial Sequence
  Calcium/calmodulin-dependent 3',5'-cyclic nucleotide phosphodiesterase 1C (433-441)
uucaucguggagcccaccuuuacaguc

SEQ ID NO: 68250 - RNA, 30 nt, Artificial Sequence
  Dopamine D4 receptor (72-81)
uucaucgugagccuggccgcugcagaccuc

SEQ ID NO: 68251 - RNA, 27 nt, Artificial Sequence
  Regulatory-associated protein of mTOR (277-285)
uucaucugggccaagauucuggcugug

SEQ ID NO: 68252 - RNA, 27 nt, Artificial Sequence
  Unconventional myosin-X (583-591)
uucaucuacgaccuguuugagcacgug

SEQ ID NO: 68253 - RNA, 30 nt, Artificial Sequence
  Cullin-4B (578-587)
uucaucuacggcaaggacguguuugaggcc

SEQ ID NO: 68254 - RNA, 39 nt, Artificial Sequence
  Cytochrome c oxidase subunit 7A2, mitochondrial (24-36)
uucaagaacaaagugcccgagaagcagaaacuguuucaa

SEQ ID NO: 68255 - RNA, 84 nt, Artificial Sequence
  Cytochrome c oxidase subunit 7A2, mitochondrial (24-51)
uucaagaacaaagugcccgagaagcagaaacuguuucaagaagacgaugagaucccucucuaccuuaagggcggggucgccgac

SEQ ID NO: 68256 - RNA, 180 nt, Artificial Sequence
  Cytochrome c oxidase subunit 7A2, mitochondrial (24-83)
uucaagaacaaagugcccgagaagcagaaacuguuucaagaagacgaugagaucccucucuaccuuaagggcggggucgccgacgcucuguuguauagagcaaccaugauuuuaacaguuggagguacugccuacgcgauauaugaacuggcuguggccagcuucccaaaaaagcaggag

SEQ ID NO: 68257 - RNA, 21 nt, Artificial Sequence
  Histone deacetylase 1 (241-247)
uucaagcccgugaugagcaaa

SEQ ID NO: 68258 - RNA, 21 nt, Artificial Sequence
  Protein kinase C-binding protein 1 (213-219)
uuccuggccgacgcuaagugg

SEQ ID NO: 68259 - RNA, 30 nt, Artificial Sequence
  Methionine-tRNA ligase, cytoplasmic (395-404)
uuccuggccgacagauuuguggagggcguc

SEQ ID NO: 68260 - RNA, 30 nt, Artificial Sequence
  Ras GTPase-activating-like protein IQGAP3 (868-877)
uuccuggccgaggcugaacuccuuaagcug

SEQ ID NO: 68261 - RNA, 30 nt, Artificial Sequence
  Protein sel-1 homolog 1 (366-375)
uuccuggccgagaagggcgacgugcaggcu

SEQ ID NO: 68262 - RNA, 27 nt, Artificial Sequence
  H(+)/Cl(-) exchange transporter 3 (206-214)
uuccuggccgugagccucgucaagguu

SEQ ID NO: 68263 - RNA, 27 nt, Artificial Sequence
  Sodium/potassium-transporting ATPase subunit alpha-1 (28-36)
uuccuggccuacagcauccaggcugca

SEQ ID NO: 68264 - RNA, 24 nt, Artificial Sequence
  B-cell receptor-associated protein 29 (63-70)
uuccuggacgccgugagagagguc

SEQ ID NO: 68265 - RNA, 27 nt, Artificial Sequence
  Cytoplasmic dynein 2 heavy chain 1 (42-50)
uuccuggacgauggcaaccagaugcuc

SEQ ID NO: 68266 - RNA, 27 nt, Artificial Sequence
  Guanine nucleotide-binding protein G(I)/G(S)/G(T) subunit beta-2 (151-159)
uuccuggacgauaaccagaucauuacc

SEQ ID NO: 68267 - RNA, 27 nt, Artificial Sequence
  Polycystin-1 (3400-3408)
uuccuggacgauagcaagucccucgug

SEQ ID NO: 68268 - RNA, 27 nt, Artificial Sequence
  Guanine nucleotide-binding protein subunit beta-4 (151-159)
uuccuggacgauagccagaucgugacc

SEQ ID NO: 68269 - RNA, 27 nt, Artificial Sequence
  F-box only protein 32 (25-33)
uuccuggacgagaagagcggcuccuuu

SEQ ID NO: 68270 - RNA, 30 nt, Artificial Sequence
  F-box only protein 32 (25-34)
uuccuggacgagaagagcggcuccuuugug

SEQ ID NO: 68271 - RNA, 24 nt, Artificial Sequence
  Dipeptidyl peptidase 8 (72-79)
uuccuggacgagaacgugcacuuu

SEQ ID NO: 68272 - RNA, 27 nt, Artificial Sequence
  Ubiquitin-like-conjugating enzyme ATG10 (117-125)
uuccuggacggcagaccccucacccuu

SEQ ID NO: 68273 - RNA, 27 nt, Artificial Sequence
  Mediator of RNA polymerase II transcription subunit 18 (51-59)
uuccuggaccacgagaugguguuucuc

SEQ ID NO: 68274 - RNA, 24 nt, Artificial Sequence
  Protein SMG8 (484-491)
uuccuggacaucgauaccaaguuu

SEQ ID NO: 68275 - RNA, 27 nt, Artificial Sequence
  Unconventional myosin-Ic (523-531)
uuccuggacaagaacaaugaucuccuu

SEQ ID NO: 68276 - RNA, 27 nt, Artificial Sequence
  Sterol regulatory element-binding protein cleavage-activating protein (641-649)
uuccuggacaagagaaucguggccgcu

SEQ ID NO: 68277 - RNA, 27 nt, Artificial Sequence
  Major facilitator superfamily domain-containing protein 12 (410-418)
uuccuggacaagguggccaacggccuc

SEQ ID NO: 68278 - RNA, 24 nt, Artificial Sequence
  Putative bifunctional UDP-N-acetylglucosamine transferase and deubiquitinase ALG13 (156-163)
uuccuggacaagguggucggccuc

SEQ ID NO: 68279 - RNA, 24 nt, Artificial Sequence
  Formin-1 (471-478)
uuccuggaccucccccacaaggug

SEQ ID NO: 68280 - RNA, 27 nt, Artificial Sequence
  Group XV phospholipase A2 (126-134)
uuccuggaccccagcaaguccucugug

SEQ ID NO: 68281 - RNA, 24 nt, Artificial Sequence
  Glycogen phosphorylase, muscle form (144-151)
uuccuggacagcauggccacccuc

SEQ ID NO: 68282 - RNA, 27 nt, Artificial Sequence
  Basic leucine zipper and W2 domain-containing protein 2 (51-59)
uuccuggacagcaccggcuccagacuc

SEQ ID NO: 68283 - RNA, 27 nt, Artificial Sequence
  Tuftelin-interacting protein 11 (507-515)
uuccuggacagcugggugcacaucauu

SEQ ID NO: 68284 - RNA, 30 nt, Artificial Sequence
  Sulfate transporter (658-667)
uuccuggacaccgccggcauccacacacuc

SEQ ID NO: 68285 - RNA, 27 nt, Artificial Sequence
  Protein naked cuticle homolog 1 (320-328)
uuccuggacacccccaucgccaaggug

SEQ ID NO: 68286 - RNA, 27 nt, Artificial Sequence
  Protein S100-A1 (45-53)
uuccuggacgugaaggagcucaugcuu

SEQ ID NO: 68287 - RNA, 27 nt, Artificial Sequence
  Electron transfer flavoprotein subunit beta (232-240)
uuccuggacuggccccagggcaccuuu

SEQ ID NO: 68288 - RNA, 27 nt, Artificial Sequence
  A-kinase anchor protein 9 (882-890)
uuccuggaggaaagaagcgugcuccuu

SEQ ID NO: 68289 - RNA, 27 nt, Artificial Sequence
  Paraneoplastic antigen Ma2 (107-115)
uuccuggagaaggaaggccagaccgug

SEQ ID NO: 68290 - RNA, 27 nt, Artificial Sequence
  Nitric oxide synthase-interacting protein (114-122)
uuccuggagaaggaaagcgccaucgug

SEQ ID NO: 68291 - RNA, 30 nt, Artificial Sequence
  Cytochrome c oxidase subunit 2 (127-136)
uuccuggagcccggcgaccucagacuucug

SEQ ID NO: 68292 - RNA, 21 nt, Artificial Sequence
  Calnexin (139-145)
uuccuguuugacaccaagccc

SEQ ID NO: 68293 - RNA, 27 nt, Artificial Sequence
  Transmembrane protein 97 (118-126)
uuccuguuugaggacuucagcaaggcc

SEQ ID NO: 68294 - RNA, 27 nt, Artificial Sequence
  Melanoma-associated antigen 11 (321-329)
uuccuguuuggcgagcccaagagacuc

SEQ ID NO: 68295 - RNA, 27 nt, Artificial Sequence
  Transmembrane protein 106B (155-163)
uuccuguuucccagaagcaucgacgug

SEQ ID NO: 68296 - RNA, 27 nt, Artificial Sequence
  Hephaestin (680-688)
uuccuguuuagcaaccuccccagacuu

SEQ ID NO: 68297 - RNA, 27 nt, Artificial Sequence
  Unconventional myosin-Ib (362-370)
uuccuguuuagcuccgaccaccucauc

SEQ ID NO: 68298 - RNA, 24 nt, Artificial Sequence
  POU domain, class 2, transcription factor 1 (70-77)
uuccugggccaccuccaucaggug

SEQ ID NO: 68299 - RNA, 27 nt, Artificial Sequence
  Glutathione S-transferase Mu 4 (141-149)
uuccugggcaagagacccugguuugug

SEQ ID NO: 68300 - RNA, 27 nt, Artificial Sequence
  Maltase-glucoamylase, intestinal (1217-1225)
uuccugggccccaccccugagcucgug

SEQ ID NO: 68301 - RNA, 27 nt, Artificial Sequence
  Asparagine synthetase (glutamine-hydrolyzing) (51-59)
uuccugggcagagacaccuacggggug

SEQ ID NO: 68302 - RNA, 27 nt, Artificial Sequence
  Ras GTPase-activating protein 1 (583-591)
uuccugcacgagaagcucgaaagccuu

SEQ ID NO: 68303 - RNA, 27 nt, Artificial Sequence
  Kelch domain-containing protein 8B (171-179)
uuccugcacggcaacaagaucuacgug

SEQ ID NO: 68304 - RNA, 30 nt, Artificial Sequence
  VWFA and cache domain-containing protein 1 (212-221)
uuccugaucgacgauaagggcuacacccuc
